United States Patent 9,782,462 (MODIFIED POLYNUCLEOTIDES FOR THE PRODUCTION OF PROTEINS ASSOCIATED WITH HUMAN DISEASE) - sequence listing, part 55

SEQ ID NO: 105631 - DNA, 8370 bp, Artificial Sequence
  Description of Artificial Sequence: Synthetic coding sequence
atgagactgggcggcggccagctggtgagcgaggagctgatgaacctgggcgagagcttcatccagaccaacgaccccagcctgaagctgttccagtgcgccgtgtgcaacaagttcaccaccgacaacctggacatgctgggcctgcacatgaacgtggagagaagcctgagcgaggacgagtggaaggccgtgatgggcgacagctaccagtgcaagctgtgcagatacaacacccagctgaaggccaacttccagctgcactgcaagaccgacaagcacgtgcagaagtaccagctggtggcccacatcaaggagggcggcaaggccaacgagtggagactgaagtgcgtggccatcggcaaccccgtgcacctgaagtgcaacgcctgcgactactacaccaacagcctggagaagctgagactgcacaccgtgaacagcagacacgaggccagcctgaagctgtacaagcacctgcagcagcacgagagcggcgtggagggcgagagctgctactaccactgcgtgctgtgcaactacagcaccaaggccaagctgaacctgatccagcacgtgagaagcatgaagcaccagagaagcgagagcctgagaaagctgcagagactgcagaagggcctgcccgaggaggacgaggacctgggccagatcttcaccatcagaagatgccccagcaccgaccccgaggaggccatcgaggacgtggagggccccagcgagaccgccgccgaccccgaggagctggccaaggaccaggagggcggcgccagcagcagccaggccgagaaggagctgaccgacagccccgccaccagcaagagaatcagcttccccggcagcagcgagagccccctgagcagcaagagacccaagaccgccgaggagatcaagcccgagcagatgtaccagtgcccctactgcaagtacagcaacgccgacgtgaacagactgagagtgcacgccatgacccagcacagcgtgcagcccatgctgagatgccccctgtgccaggacatgctgaacaacaagatccacctgcagctgcacctgacccacctgcacagcgtggcccccgactgcgtggagaagctgatcatgaccgtgaccacccccgagatggtgatgcccagcagcatgttcctgcccgccgccgtgcccgacagagacggcaacagcaacctggaggaggccggcaagcagcccgagaccagcgaggacctgggcaagaacatcctgcccagcgccagcaccgagcagagcggcgacctgaagcccagccccgccgaccccggcagcgtgagagaggacagcggcttcatctgctggaagaagggctgcaaccaggtgttcaagaccagcgccgccctgcagacccacttcaacgaggtgcacgccaagagaccccagctgcccgtgagcgacagacacgtgtacaagtacagatgcaaccagtgcagcctggccttcaagaccatcgagaagctgcagctgcacagccagtaccacgtgatcagagccgccaccatgtgctgcctgtgccagagaagcttcagaaccttccaggccctgaagaagcacctggagaccagccacctggagctgagcgaggccgacatccagcagctgtacggcggcctgctggccaacggcgacctgctggccatgggcgaccccaccctggccgaggaccacaccatcatcgtggaggaggacaaggaggaggagagcgacctggaggacaagcagagccccaccggcagcgacagcggcagcgtgcaggaggacagcggcagcgagcccaagagagccctgcccttcagaaagggccccaacttcaccatggagaagttcctggaccccagcagaccctacaagtgcaccgtgtgcaaggagagcttcacccagaagaacatcctgctggtgcactacaacagcgtgagccacctgcacaagctgaagagagccctgcaggagagcgccaccggccagcccgagcccaccagcagccccgacaacaagcccttcaagtgcaacacctgcaacgtggcctacagccagagcagcaccctggagatccacatgagaagcgtgctgcaccagaccaaggccagagccgccaagctggaggccgccagcggcagcagcaacggcaccggcaacagcagcagcatcagcctgagcagcagcacccccagccccgtgagcaccagcggcagcaacaccttcaccaccagcaaccccagcagcgccggcatcgcccccagcagcaacctgctgagccaggtgcccaccgagagcgtgggcatgccccccctgggcaaccccatcggcgccaacatcgccagccccagcgagcccaaggaggccaacagaaagaagctggccgacatgatcgccagcagacagcagcagcagcagcagcagcagcagcagcagcagcagcagcagcagcagcagcaggcccagaccctggcccaggcccaggcccaggtgcaggcccacctgcagcaggagctgcagcagcaggccgccctgatccagagccagctgttcaaccccaccctgctgccccacttccccatgaccaccgagaccctgctgcagctgcagcagcagcagcacctgctgttccccttctacatccccagcgccgagttccagctgaaccccgaggtgagcctgcccgtgaccagcggcgccctgaccctgaccggcaccggccccggcctgctggaggacctgaaggcccaggtgcaggtgccccagcagagccaccagcagatcctgccccagcagcagcagaaccagctgagcatcgcccagagccacagcgccctgctgcagcccagccagcaccccgagaagaagaacaagctggtgatcaaggagaaggagaaggagagccagagagagagagacagcgccgagggcggcgagggcaacaccggccccaaggagaccctgcccgacgccctgaaggccaaggagaagaaggagctggcccccggcggcggcagcgagcccagcatgctgccccccagaatcgccagcgacgccagaggcaacgccaccaaggccctgctggagaacttcggcttcgagctggtgatccagtacaacgagaacaagcagaaggtgcagaagaagaacggcaagaccgaccagggcgagaacctggagaagctggagtgcgacagctgcggcaagctgttcagcaacatcctgatcctgaagagccaccaggagcacgtgcaccagaactacttccccttcaagcagctggagagattcgccaagcagtacagagaccactacgacaagctgtaccccctgagaccccagacccccgagccccccccccccccccccccccccccccccccccccctgcccgccgcccccccccagcccgccagcacccccgccatccccgccagcgccccccccatcaccagccccaccatcgcccccgcccagcccagcgtgcccctgacccagctgagcatgcccatggagctgcccatcttcagccccctgatgatgcagaccatgcccctgcagaccctgcccgcccagctgcccccccagctgggccccgtggagcccctgcccgccgacctggcccagctgtaccagcaccagctgaaccccaccctgctgcagcagcagaacaagagacccagaaccagaatcaccgacgaccagctgagagtgctgagacagtacttcgacatcaacaacagccccagcgaggagcagatcaaggagatggccgacaagagcggcctgccccagaaggtgatcaagcactggttcagaaacaccctgttcaaggagagacagagaaacaaggacagcccctacaacttcagcaacccccccatcaccagcctggaggagctgaagatcgacagcagaccccccagccccgagccccccaagcaggagtactggggcagcaagagaagcagcagaaccagattcaccgactaccagctgagagtgctgcaggacttcttcgacgccaacgcctaccccaaggacgacgagttcgagcagctgagcaacctgctgaacctgcccaccagagtgatcgtggtgtggttccagaacgccagacagaaggccagaaagaactacgagaaccagggcgagggcaaggacggcgagagaagagagctgaccaacgacagatacatcagaaccagcaacctgaactaccagtgcaagaagtgcagcctggtgttccagagaatcttcgacctgatcaagcaccagaagaagctgtgctacaaggacgaggacgaggagggccaggacgacagccagaacgaggacagcatggacgccatggagatcctgacccccaccagcagcagctgcagcacccccatgcccagccaggcctacagcgcccccgcccccagcgccaacaacaccgccagcagcgccttcctgcagctgaccgccgaggccgaggagctggccaccttcaacagcaagaccgaggccggcgacgagaagcccaagctggccgaggcccccagcgcccagcccaaccagacccaggagaagcagggccagcccaagcccgagctgcagcagcaggagcagcccgagcagaagaccaacaccccccagcagaagctgccccagctggtgagcctgcccagcctgccccagccccccccccaggccccccccccccagtgccccctgccccagagcagccccagccccagccagctgagccacctgcccctgaagcccctgcacaccagcaccccccagcagctggccaacctgcccccccagctgatcccctaccagtgcgaccagtgcaagctggccttccccagcttcgagcactggcaggagcaccagcagctgcacttcctgagcgcccagaaccagttcatccacccccagttcctggacagaagcctggacatgcccttcatgctgttcgaccccagcaaccccctgctggccagccagctgctgagcggcgccatcccccagatccccgccagcagcgccaccagccccagcacccccaccagcaccatgaacaccctgaagagaaagctggaggagaaggccagcgccagccccggcgagaacgacagcggcaccggcggcgaggagccccagagagacaagagactgagaaccaccatcacccccgagcagctggagatcctgtaccagaagtacctgctggacagcaaccccaccagaaagatgctggaccacatcgcccacgaggtgggcctgaagaagagagtggtgcaggtgtggttccagaacaccagagccagagagagaaagggccagttcagagccgtgggccccgcccaggcccacagaagatgccccttctgcagagccctgttcaaggccaagaccgccctggaggcccacatcagaagcagacactggcacgaggccaagagagccggctacaacctgaccctgagcgccatgctgctggactgcgacggcggcctgcagatgaagggcgacatcttcgacggcaccagcttcagccacctgccccccagcagcagcgacggccagggcgtgcccctgagccccgtgagcaagaccatggagctgagccccagaaccctgctgagccccagcagcatcaaggtggagggcatcgaggacttcgagagccccagcatgagcagcgtgaacctgaacttcgaccagaccaagctggacaacgacgactgcagcagcgtgaacaccgccatcaccgacaccaccaccggcgacgagggcaacgccgacaacgacagcgccaccggcatcgccaccgagaccaagagcagcagcgcccccaacgagggcctgaccaaggccgccatgatggccatgagcgagtacgaggacagactgagcagcggcctggtgagccccgcccccagcttctacagcaaggagtacgacaacgagggcaccgtggactacagcgagaccagcagcctggccgacccctgcagccccagccccggcgccagcggcagcgccggcaagagcggcgacagcggcgacagacccggccagaagagattcagaacccagatgaccaacctgcagctgaaggtgctgaagagctgcttcaacgactacagaacccccaccatgctggagtgcgaggtgctgggcaacgacatcggcctgcccaagagagtggtgcaggtgtggttccagaacgccagagccaaggagaagaagagcaagctgagcatggccaagcacttcggcatcaaccagaccagctacgagggccccaagaccgagtgcaccctgtgcggcatcaagtacagcgccagactgagcgtgagagaccacatcttcagccagcagcacatcagcaaggtgaaggacaccatcggcagccagctggacaaggagaaggagtacttcgaccccgccaccgtgagacagctgatggcccagcaggagctggacagaatcaagaaggccaacgaggtgctgggcctggccgcccagcagcagggcatgttcgacaacacccccctgcaggccctgaacctgcccaccgcctaccccgccctgcagggcatcccccccgtgctgctgcccggcctgaacagccccagcctgcccggcttcacccccagcaacaccgccctgaccagccccaagcccaacctgatgggcctgcccagcaccaccgtgcccagccccggcctgcccaccagcggcctgcccaacaagcccagcagcgccagcctgagcagccccacccccgcccaggccaccatggccatgggcccccagcagcccccccagcagcagcagcagcagcagcagccccaggtgcagcagcccccccccccccccgccgcccagcccccccccaccccccagctgcccctgcagcagcagcagcagagaaaggacaaggacagcgagaaggtgaaggagaaggagaaggcccacaagggcaagggcgagcccctgcccgtgcccaagaaggagaagggcgaggcccccaccgccaccgccgccaccatcagcgcccccctgcccaccatggagtacgccgtggaccccgcccagctgcaggccctgcaggccgccctgaccagcgaccccaccgccctgctgaccagccagttcctgccctacttcgtgcccggcttcagcccctactacgccccccagatccccggcgccctgcagagcggctacctgcagcccatgtacggcatggagggcctgttcccctacagccccgccctgagccaggccctgatgggcctgagccccggcagcctgctgcagcagtaccagcagtaccagcagagcctgcaggaggccatccagcagcagcagcagagacagctgcagcagcagcagcagcagaaggtgcagcagcagcagcccaaggccagccagacccccgtgccccccggcgcccccagccccgacaaggaccccgccaaggagagccccaagcccgaggagcagaagaacacccccagagaggtgagccccctgctgcccaagctgcccgaggagcccgaggccgagagcaagagcgccgacagcctgtacgaccccttcatcgtgcccaaggtgcagtacaagctggtgtgcagaaagtgccaggccggcttcagcgacgaggaggccgccagaagccacctgaagagcctgtgcttcttcggccagagcgtggtgaacctgcaggagatggtgctgcacgtgcccaccggcggcggcggcggcggcagcggcggcggcggcggcggcggcggcggcggcggcggcggcggcagctaccactgcctggcctgcgagagcgccctgtgcggcgaggaggccctgagccagcacctggagagcgccctgcacaagcacagaaccatcaccagagccgccagaaacgccaaggagcaccccagcctgctgccccacagcgcctgcttccccgaccccagcaccgccagcaccagccagagcgccgcccacagcaacgacagcccccccccccccagcgccgccgcccccagcagcgccagcccccacgccagcagaaagagctggccccaggtggtgagcagagccagcgccgccaagccccccagcttcccccccctgagcagcagcagcaccgtgaccagcagcagctgcagcaccagcggcgtgcagcccagcatgcccaccgacgactacagcgaggagagcgacaccgacctgagccagaagagcgacggccccgccagccccgtggagggccccaaggaccccagctgccccaaggacagcggcctgaccagcgtgggcaccgacaccttcagactgtag

SEQ ID NO: 105632 - DNA, 10704 bp, Artificial Sequence
  Description of Artificial Sequence: Synthetic coding sequence
atggagacctgcgacagcccccccatcagcagacaggagaacggccagagcaccagcaagctgtgcggcaccacccagctggacaacgaggtgcccgagaaggtggccggcatggagcccgacagagagaacagcagcaccgacgacaacctgaagaccgacgagagaaagagcgaggccctgctgggcttcagcgtggagaacgccgccgccacccaggtgaccagcgccaaggagatcccctgcaacgagtgcgccaccagcttccccagcctgcagaagtacatggagcaccactgccccaacgccagactgcccgtgctgaaggacgacaacgagagcgagatcagcgagctggaggacagcgacgtggagaacctgaccggcgagatcgtgtaccagcccgacggcagcgcctacatcatcgaggacagcaaggagagcggccagaacgcccagaccggcgccaacagcaagctgttcagcaccgccatgttcctggacagcctggccagcgccggcgagaagagcgaccagagcgccagcgcccccatgagcttctacccccagatcatcaacaccttccacatcgccagcagcctgggcaagcccttcaccgccgaccaggccttccccaacaccagcgccctggccggcgtgggccccgtgctgcacagcttcagagtgtacgacctgagacacaagagagagaaggactacctgaccagcgacggcagcgccaagaacagctgcgtgagcaaggacgtgcccaacaacgtggacctgagcaagttcgacggctgcgtgagcgacggcaagagaaagcccgtgctgatgtgcttcctgtgcaagctgagcttcggctacatcagaagcttcgtgacccacgccgtgcacgaccacagaatgaccctgaacgacgaggagcagaagctgctgagcaacaagtgcgtgagcgccatcatccagggcatcggcaaggacaaggagcccctgatcagcttcctggagcccaagaagagcaccagcgtgtacccccacttcagcaccaccaacctgatcggccccgaccccaccttcagaggcctgtggagcgccttccacgtggagaacggcgacagcctgcccgccggcttcgccttcctgaagggcagcgccagcaccagcagcagcgccgagcagcccctgggcatcacccagatgcccaaggccgaggtgaacctgggcggcctgagcagcctggtggtgaacacccccatcaccagcgtgagcctgagccacagcagcagcgagagcagcaagatgagcgagagcaaggaccaggagaacaactgcgagagacccaaggagagcaacgtgctgcaccccaacggcgagtgccccgtgaagagcgagcccaccgagcccggcgacgaggacgaggaggacgcctacagcaacgagctggacgacgaggaggtgctgggcgagctgaccgacagcatcggcaacaaggacttccccctgctgaaccagagcatcagccccctgagcagcagcgtgctgaagttcatcgagaagggcaccagcagcagcagcgccaccgtgagcgacgacaccgagaagaagaagcagaccgccgccgtgagagccagcggcagcgtggccagcaactacggcatcagcggcaaggacttcgccgacgccagcgccagcaaggacagcgccaccgccgcccaccccagcgagatcgccagaggcgacgaggacagcagcgccaccccccaccagcacggcttcacccccagcacccccggcacccccggccccggcggcgacggcagccccggcagcggcatcgagtgccccaagtgcgacaccgtgctgggcagcagcagaagcctgggcggccacatgaccatgatgcacagcagaaacagctgcaagaccctgaagtgccccaagtgcaactggcactacaagtaccagcagaccctggaggcccacatgaaggagaagcaccccgagcccggcggcagctgcgtgtactgcaagaccggccagccccaccccagactggccagaggcgagagctacacctgcggctacaagcccttcagatgcgaggtgtgcaactacagcaccaccaccaagggcaacctgagcatccacatgcagagcgacaagcacctgaacaacgtgcagaacctgcagaacggcaacggcgagcaggtgttcggccacagcgcccccgcccccaacaccagcctgagcggctgcggcacccccagccccagcaagcccaagcagaagcccacctggagatgcgaggtgtgcgactacgagaccaacgtggccagaaacctgagaatccacatgaccagcgagaagcacatgcacaacatgatgctgctgcagcagaacatgaagcagatccagcacaacctgcacctgggcctggcccccgccgaggccgagctgtaccagtactacctggcccagaacatcggcctgaccggcatgaagctggagaaccccgccgacccccagctgatgatcaaccccttccagctggaccccgccaccgccgccgccctggcccccggcctgggcgagctgagcccctacatcagcgaccccgccctgaagctgttccagtgcgccgtgtgcaacaagttcaccagcgacagcctggaggccctgagcgtgcacgtgagcagcgagagaagcctgcccgaggaggagtggagagccgtgatcggcgacatctaccagtgcaagctgtgcaactacaacacccagctgaaggccaacttccagctgcactgcaagaccgacaagcacatgcagaagtaccagctggtggcccacatcaaggagggcggcaagagcaacgagtggagactgaagtgcatcgccatcggcaaccccgtgcacctgaagtgcaacgcctgcgactactacaccaacagcgtggacaagctgagactgcacaccaccaaccacagacacgaggccgccctgaagctgtacaagcacctgcagaagcaggagggcgccgtgaaccccgagagctgctactactactgcgccgtgtgcgactacaccaccaaggtgaagctgaacctggtgcagcacgtgagaagcgtgaagcaccagcagaccgagggcctgagaaagctgcagctgcaccagcagggcctggcccccgaggaggacaacctgagcgagatcttcttcgtgaaggactgcccccccaacgagctggagaccgccagcctgggcgccagaacctgcgacgacgacctgaccgagcagcacgaggaggccgagggcgccatcaagcccaccgccgtggccgaggacgacgagaaggacaccagcgagagagacaacagcgagggcaagaacagcaacaaggacagcgtgagcgtggccggcggcacccagcccctgctgctggccaaggaggaggacgtggccaccaagagaagcaagcccaccgaggacaacaagttctgccacgagcagttctaccagtgcccctactgcaactacaacagcagagaccagagcagaatccagatgcacgtgctgagccagcacagcgtgcagcccgtgatctgctgccccctgtgccaggacgtgctgagcaacaagatgcacctgcagctgcacctgacccacctgcacagcgtgagccccgactgcgtggagaagctgctgatgaccgtgcccgtgcccgacgtgatgatgcccaacagcatgctgctgcccgccgccgccagcgagaagagcgagagagacacccccgccgccgtgaccgccgagggcagcggcaagtacagcggcgagagccccatggacgacaagagcatggccggcctggaggacagcaaggccaacgtggaggtgaagaacgaggagcagaagcccaccaaggagcccctggaggtgagcgagtggaacaagaacagcagcaaggacgtgaagatccccgacaccctgcaggaccagctgaacgagcagcagaagagacagcccctgagcgtgagcgacagacacgtgtacaagtacagatgcaaccactgcagcctggccttcaagaccatgcagaagctgcagatccacagccagtaccacgccatcagagccgccaccatgtgcaacctgtgccagagaagcttcagaaccttccaggccctgaagaagcacctggaggccggccaccccgagctgagcgaggccgagctgcagcagctgtacgccagcctgcccgtgaacggcgagctgtgggccgagagcgagaccatgagccaggacgaccacggcctggagcaggagatggagagagagtacgaggtggaccacgagggcaaggccagccccgtgggcagcgacagcagcagcatccccgacgacatgggcagcgagcccaagagaaccctgcccttcagaaagggccccaacttcaccatggagaagttcctggaccccagcagaccctacaagtgcaccgtgtgcaaggagagcttcacccagaagaacatcctgctggtgcactacaacagcgtgagccacctgcacaagctgaagaaggtgctgcaggaggccagcagccccgtgccccaggagaccaacagcaacaccgacaacaagccctacaagtgcagcatctgcaacgtggcctacagccagagcagcaccctggagatccacatgagaagcgtgctgcaccagaccaaggccagagccgccaagctggagcccagcggccacgtggccggcggccacagcatcgccgccaacgtgaacagccccggccagggcatgctggacagcatgagcctggccgccgtgaacagcaaggacacccacctggacgccaaggagctgaacaagaagcagacccccgacctgatcagcgcccagcccgcccaccaccccccccagagccccgcccagatccagatgcagctgcagcacgagctgcagcagcaggccgccttcttccagccccagttcctgaaccccgccttcctgccccacttccccatgacccccgaggccctgctgcagttccagcagccccagttcctgttccccttctacatccccggcaccgagttcagcctgggccccgacctgggcctgcccggcagcgccaccttcggcatgcccggcatgaccggcatggccggcagcctgctggaggacctgaagcagcagatccagacccagcaccacgtgggccagacccagctgcagatcctgcagcagcaggcccagcagtaccaggccacccagccccagctgcagccccagaagcagcagcagcagcccccccccccccagcagcagcagcagcagcaggccagcaagctgctgaagcaggagcagagcaacatcgtgagcgccgactgccagatcatgaaggacgtgcccagctacaaggaggccgaggacatcagcgagaagcccgagaagcccaagcaggagttcatcagcgagggcgagggcctgaaggagggcaaggacaccaagaagcagaagagcctggagcccagcatccccccccccagaatcgccagcggcgccagaggcaacgccgccaaggccctgctggagaacttcggcttcgagctggtgatccagtacaacgagaacagacagaaggtgcagaagaagggcaagagcggcgagggcgagaacaccgacaagctggagtgcggcacctgcggcaagctgttcagcaacgtgctgatcctgaagagccaccaggagcacgtgcacggccagttcttcccctacgccgccctggagaagttcgccagacagtacagagaggcctacgacaagctgtaccccatcagccccagcagccccgagacccccccccccccccccccccccccccccctgccccccgcccccccccagcccagcagcatgggccccgtgaagatccccaacaccgtgagcacccccctgcaggcccccccccccaccccccccccccccccccccccccccccccccccccccccccccccccccccccccccccccagcgcccccccccaggtgcagctgcccgtgagcctggacctgcccctgttccccagcatcatgatgcagcccgtgcagcaccccgccctgcccccccagctggccctgcagctgccccagatggacgccctgagcgccgacctgacccagctgtgccagcagcagctgggcctggaccccaacttcctgagacacagccagttcaagagacccagaaccagaatcaccgacgaccagctgaagatcctgagagcctacttcgacatcaacaacagccccagcgaggagcagatccaggagatggccgagaagagcggcctgagccagaaggtgatcaagcactggttcagaaacaccctgttcaaggagagacagagaaacaaggacagcccctacaacttcagcaacccccccatcaccgtgctggaggacatcagaatcgacccccagcccaccagcctggagcactacaagagcgacgccagcttcagcaagagaagcagcagaaccagattcaccgactaccagctgagagtgctgcaggacttcttcgacaccaacgcctaccccaaggacgacgagatcgagcagctgagcaccgtgctgaacctgcccaccagagtgatcgtggtgtggttccagaacgccagacagaaggccagaaagagctacgagaaccaggccgagaccaaggacaacgagaagagagagctgaccaacgagagatacatcagaaccagcaacatgcagtaccagtgcaagaagtgcaacgtggtgttccccagaatcttcgacctgatcacccaccagaagaagcagtgctacaaggacgaggacgacgacgcccaggacgagagccagaccgaggacagcatggacgccaccgaccaggtggtgtacaagcactgcaccgtgagcggccagaccgacgccgccaagaacgccgccgcccccgccgccagcagcggcagcggcaccagcacccccctgatccccagccccaagcccgagcccgagaagaccagccccaagcccgagtaccccgccgagaagcccaagcagagcgaccccagcccccccagccagggcaccaagcccgccctgcccctggccagcaccagcagcgaccccccccaggccagcaccgcccagccccagccccagccccagccccccaagcagccccagctgatcggcagaccccccagcgccagccagacccccgtgcccagcagccccctgcagatcagcatgaccagcctgcagaacagcctgcccccccagctgctgcagtaccagtgcgaccagtgcaccgtggccttccccaccctggagctgtggcaggagcaccagcacatgcacttcctggccgcccagaaccagttcctgcacagccccttcctggagagacccatggacatgccctacatgatcttcgaccccaacaaccccctgatgaccggccagctgctgggcagcagcctgacccagatgcccccccaggccagcagcagccacaccaccgcccccaccaccgtggccgccagcctgaagagaaagctggacgacaaggaggacaacaactgcagcgagaaggagggcggcaacagcggcgaggaccagcacagagacaagagactgagaaccaccatcacccccgagcagctggagatcctgtacgagaagtacctgctggacagcaaccccaccagaaagatgctggaccacatcgccagagaggtgggcctgaagaagagagtggtgcaggtgtggttccagaacaccagagccagagagagaaagggccagttcagagccgtgggccccgcccagagccacaagagatgccccttctgcagagccctgttcaaggccaagagcgccctggagagccacatcagaagcagacactggaacgagggcaagcaggccggctacagcctgccccccagccccctgatcagcaccgaggacggcggcgagagcccccagaagtacatctacttcgactaccccagcctgcccctgaccaagatcgacctgagcagcgagaacgagctggccagcaccgtgagcacccccgtgagcaagaccgccgagctgagccccaagaacctgctgagccccagcagcttcaaggccgagtgcagcgaggacgtggagaacctgaacgccccccccgccgaggccggctacgaccagaacaagaccgacttcgacgagaccagcagcatcaacaccgccatcagcgacgccaccaccggcgacgagggcaacaccgagatggagagcaccaccggcagcagcggcgacgtgaagcccgccctgagccccaaggagcccaagaccctggacaccctgcccaagcccgccaccacccccaccaccgaggtgtgcgacgacaagttcctgttcagcctgaccagccccagcatccacttcaacgacaaggacggcgaccacgaccagagcttctacatcaccgacgaccccgacgacaacgccgacagaagcgagaccagcagcatcgccgaccccagcagccccaaccccttcggcagcagcaaccccttcaagagcaagagcaacgacagacccggccacaagagattcagaacccagatgagcaacctgcagctgaaggtgctgaaggcctgcttcagcgactacagaacccccaccatgcaggagtgcgagatgctgggcaacgagatcggcctgcccaagagagtggtgcaggtgtggttccagaacgccagagccaaggagaagaagttcaagatcaacatcggcaagcccttcatgatcaaccagggcggcaccgagggcaccaagcccgagtgcaccctgtgcggcgtgaagtacagcgccagactgagcatcagagaccacatcttcagcaagcagcacatcagcaaggtgagagagaccgtgggcagccagctggacagagagaaggactacctggcccccaccaccgtgagacagctgatggcccagcaggagctggacagaatcaagaaggccagcgacgtgctgggcctgaccgtgcagcagcccggcatgatggacagcagcagcctgcacggcatcagcctgcccaccgcctaccccggcctgcccggcctgccccccgtgctgctgcccggcatgaacggccccagcagcctgcccggcttcccccagaacagcaacatcgccagcggcatgctgggcttccccaccagcgccaccagcagccccgccctgagcctgagcagcgcccccaccaagcccctgctgcagaccccccccccccccccccccccccccccccccccccccagcagcagcctgagcggccagcagaccgagcagcagaacaaggagagcgagaagaagcagaccaagcccaacaaggtgaagaagatcaaggaggaggagctggaggccaccaagcccgagaagcaccccaagaaggaggagaagatcagcagcgccctgagcgtgctgggcaaggtggtgggcgagacccacgtggaccccatccagctgcaggccctgcagaacgccatcgccggcgaccccgccagcttcatcggcggccagttcctgccctacttcatccccggcttcgccagctacttcaccccccagctgcccggcaccgtgcagggcggctacttcccccccgtgtgcggcatggagagcctgttcccctacggccccaccatgccccagaccctggccggcctgagccccggcgccctgctgcagcagtaccagcagtaccagcagaacctgcaggagagcctgcagaagcagcagaagcagcagcaggagcagcagcagaagcccgtgcaggccaagaccagcaaggtggagagcgaccagccccagaacagcaacgacgccagcgagaccaaggaggacaagagcaccgccaccgagagcaccaaggaggagccccagctggagagcaagagcgccgacttcagcgacacctacgtggtgcccttcgtgaagtacgagttcatctgcagaaagtgccagatgatgttcaccgacgaggacgccgccgtgaaccaccagaagagcttctgctacttcggccagcccctgatcgacccccaggagaccgtgctgagagtgcccgtgagcaagtaccagtgcctggcctgcgacgtggccatcagcggcaacgaggccctgagccagcacctgcagagcagcctgcacaaggagaagaccatcaagcaggccatgagaaacgccaaggagcacgtgagactgctgccccacagcgtgtgcagccccaaccccaacaccaccagcaccagccagagcgccgccagcagcaacaacacctacccccacctgagctgcttcagcatgaagagctggcccaacatcctgttccaggccagcgccagaagagccgccagcccccccagcagcccccccagcctgagcctgcccagcaccgtgaccagcagcctgtgcagcaccagcggcgtgcagaccagcctgcccaccgagagctgcagcgacgagagcgacagcgagctgagccagaagctggaggacctggacaacagcctggaggtgaaggccaagcccgccagcggcctggacggcaacttcaacagcatcagaatggacatgttcagcgtgtag

SEQ ID NO: 105633 - DNA, 10803 bp, Artificial Sequence
  Description of Artificial Sequence: Synthetic coding sequence
atggagacctgcgacagcccccccatcagcagacaggagaacggccagagcaccagcaagctgtgcggcaccacccagctggacaacgaggtgcccgagaaggtggccggcatggagcccgacagagagaacagcagcaccgacgacaacctgaagaccgacgagagaaagagcgaggccctgctgggcttcagcgtggagaacgccgccgccacccaggtgaccagcgccaaggagatcccctgcaacgagtgcgccaccagcttccccagcctgcagaagtacatggagcaccactgccccaacgccagactgcccgtgctgaaggacgacaacgagagcgagatcagcgagctggaggacagcgacgtggagaacctgaccggcgagatcgtgtaccagcccgacggcagcgcctacatcatcgaggacagcaaggagagcggccagaacgcccagaccggcgccaacagcaagctgttcagcaccgccatgttcctggacagcctggccagcgccggcgagaagagcgaccagagcgccagcgcccccatgagcttctacccccagatcatcaacaccttccacatcgccagcagcctgggcaagcccttcaccgccgaccaggccttccccaacaccagcgccctggccggcgtgggccccgtgctgcacagcttcagagtgtacgacctgagacacaagagagagaaggactacctgaccagcgacggcagcgccaagaacagctgcgtgagcaaggacgtgcccaacaacgtggacctgagcaagttcgacggctgcgtgagcgacggcaagagaaagcccgtgctgatgtgcttcctgtgcaagctgagcttcggctacatcagaagcttcgtgacccacgccgtgcacgaccacagaatgaccctgaacgacgaggagcagaagctgctgagcaacaagtgcgtgagcgccatcatccagggcatcggcaaggacaaggagcccctgatcagcttcctggagcccaagaagagcaccagcgtgtacccccacttcagcaccaccaacctgatcggccccgaccccaccttcagaggcctgtggagcgccttccacgtggagaacggcgacagcctgcccgccggcttcgccttcctgaagggcagcgccagcaccagcagcagcgccgagcagcccctgggcatcacccagatgcccaaggccgaggtgaacctgggcggcctgagcagcctggtggtgaacacccccatcaccagcgtgagcctgagccacagcagcagcgagagcagcaagatgagcgagagcaaggaccaggagaacaactgcgagagacccaaggagagcaacgtgctgcaccccaacggcgagtgccccgtgaagagcgagcccaccgagcccggcgacgaggacgaggaggacgcctacagcaacgagctggacgacgaggaggtgctgggcgagctgaccgacagcatcggcaacaaggacttccccctgctgaaccagagcatcagccccctgagcagcagcgtgctgaagttcatcgagaagggcaccagcagcagcagcgccaccgtgagcgacgacaccgagaagaagaagcagaccgccgccgtgagagccagcggcagcgtggccagcaactacggcatcagcggcaaggacttcgccgacgccagcgccagcaaggacagcgccaccgccgcccaccccagcgagatcgccagaggcgacgaggacagcagcgccaccccccaccagcacggcttcacccccagcacccccggcacccccggccccggcggcgacggcagccccggcagcggcatcgagtgccccaagtgcgacaccgtgctgggcagcagcagaagcctgggcggccacatgaccatgatgcacagcagaaacagctgcaagaccctgaagtgccccaagtgcaactggcactacaagtaccagcagaccctggaggcccacatgaaggagaagcaccccgagcccggcggcagctgcgtgtactgcaagaccggccagccccaccccagactggccagaggcgagagctacacctgcggctacaagcccttcagatgcgaggtgtgcaactacagcaccaccaccaagggcaacctgagcatccacatgcagagcgacaagcacctgaacaacgtgcagaacctgcagaacggcaacggcgagcaggtgttcggccacagcgcccccgcccccaacaccagcctgagcggctgcggcacccccagccccagcaagcccaagcagaagcccacctggagatgcgaggtgtgcgactacgagaccaacgtggccagaaacctgagaatccacatgaccagcgagaagcacatgcacaacatgatgctgctgcagcagaacatgaagcagatccagcacaacctgcacctgggcctggcccccgccgaggccgagctgtaccagtactacctggcccagaacatcggcctgaccggcatgaagctggagaaccccgccgacccccagctgatgatcaaccccttccagctggaccccgccaccgccgccgccctggcccccggcctggtgaacaacgagctgccccccgagatcagactggccagcggccagctgatgggcgacgacctgagcctgctgaccgccggcgagctgagcccctacatcagcgaccccgccctgaagctgttccagtgcgccgtgtgcaacaagttcaccagcgacagcctggaggccctgagcgtgcacgtgagcagcgagagaagcctgcccgaggaggagtggagagccgtgatcggcgacatctaccagtgcaagctgtgcaactacaacacccagctgaaggccaacttccagctgcactgcaagaccgacaagcacatgcagaagtaccagctggtggcccacatcaaggagggcggcaagagcaacgagtggagactgaagtgcatcgccatcggcaaccccgtgcacctgaagtgcaacgcctgcgactactacaccaacagcgtggacaagctgagactgcacaccaccaaccacagacacgaggccgccctgaagctgtacaagcacctgcagaagcaggagggcgccgtgaaccccgagagctgctactactactgcgccgtgtgcgactacaccaccaaggtgaagctgaacctggtgcagcacgtgagaagcgtgaagcaccagcagaccgagggcctgagaaagctgcagctgcaccagcagggcctggcccccgaggaggacaacctgagcgagatcttcttcgtgaaggactgcccccccaacgagctggagaccgccagcctgggcgccagaacctgcgacgacgacctgaccgagcagcagctgagaagcaccagcgaggagcagagcgaggaggccgagggcgccatcaagcccaccgccgtggccgaggacgacgagaaggacaccagcgagagagacaacagcgagggcaagaacagcaacaaggacagcggcatcatcacccccgagaaggagctgaaggtgagcgtggccggcggcacccagcccctgctgctggccaaggaggaggacgtggccaccaagagaagcaagcccaccgaggacaacaagttctgccacgagcagttctaccagtgcccctactgcaactacaacagcagagaccagagcagaatccagatgcacgtgctgagccagcacagcgtgcagcccgtgatctgctgccccctgtgccaggacgtgctgagcaacaagatgcacctgcagctgcacctgacccacctgcacagcgtgagccccgactgcgtggagaagctgctgatgaccgtgcccgtgcccgacgtgatgatgcccaacagcatgctgctgcccgccgccgccagcgagaagagcgagagagacacccccgccgccgtgaccgccgagggcagcggcaagtacagcggcgagagccccatggacgacaagagcatggccggcctggaggacagcaaggccaacgtggaggtgaagaacgaggagcagaagcccaccaaggagcccctggaggtgagcgagtggaacaagaacagcagcaaggacgtgaagatccccgacaccctgcaggaccagctgaacgagcagcagaagagacagcccctgagcgtgagcgacagacacgtgtacaagtacagatgcaaccactgcagcctggccttcaagaccatgcagaagctgcagatccacagccagtaccacgccatcagagccgccaccatgtgcaacctgtgccagagaagcttcagaaccttccaggccctgaagaagcacctggaggccggccaccccgagctgagcgaggccgagctgcagcagctgtacgccagcctgcccgtgaacggcgagctgtgggccgagagcgagaccatgagccaggacgaccacggcctggagcaggagatggagagagagtacgaggtggaccacgagggcaaggccagccccgtgggcagcgacagcagcagcatccccgacgacatgggcagcgagcccaagagaaccctgcccttcagaaagggccccaacttcaccatggagaagttcctggaccccagcagaccctacaagtgcaccgtgtgcaaggagagcttcacccagaagaacatcctgctggtgcactacaacagcgtgagccacctgcacaagctgaagaaggtgctgcaggaggccagcagccccgtgccccaggagaccaacagcaacaccgacaacaagccctacaagtgcagcatctgcaacgtggcctacagccagagcagcaccctggagatccacatgagaagcgtgctgcaccagaccaaggccagagccgccaagctggagcccagcggccacgtggccggcggccacagcatcgccgccaacgtgaacagccccggccagggcatgctggacagcatgagcctggccgccgtgaacagcaaggacacccacctggacgccaaggagctgaacaagaagcagacccccgacctgatcagcgcccagcccgcccaccaccccccccagagccccgcccagatccagatgcagctgcagcacgagctgcagcagcaggccgccttcttccagccccagttcctgaaccccgccttcctgccccacttccccatgacccccgaggccctgctgcagttccagcagccccagttcctgttccccttctacatccccggcaccgagttcagcctgggccccgacctgggcctgcccggcagcgccaccttcggcatgcccggcatgaccggcatggccggcagcctgctggaggacctgaagcagcagatccagacccagcaccacgtgggccagacccagctgcagatcctgcagcagcaggcccagcagtaccaggccacccagccccagctgcagccccagaagcagcagcagcagcccccccccccccagcagcagcagcagcagcaggccagcaagctgctgaagcaggagcagagcaacatcgtgagcgccgactgccagatcatgaaggacgtgcccagctacaaggaggccgaggacatcagcgagaagcccgagaagcccaagcaggagttcatcagcgagggcgagggcctgaaggagggcaaggacaccaagaagcagaagagcctggagcccagcatccccccccccagaatcgccagcggcgccagaggcaacgccgccaaggccctgctggagaacttcggcttcgagctggtgatccagtacaacgagaacagacagaaggtgcagaagaagggcaagagcggcgagggcgagaacaccgacaagctggagtgcggcacctgcggcaagctgttcagcaacgtgctgatcctgaagagccaccaggagcacgtgcacggccagttcttcccctacgccgccctggagaagttcgccagacagtacagagaggcctacgacaagctgtaccccatcagccccagcagccccgagacccccccccccccccccccccccccccccctgccccccgcccccccccagcccagcagcatgggccccgtgaagatccccaacaccgtgagcacccccctgcaggcccccccccccaccccccccccccccagcgcccccccccaggtgcagctgcccgtgagcctggacctgcccctgttccccagcatcatgatgcagcccgtgcagcaccccgccctgcccccccagctggccctgcagctgccccagatggacgccctgagcgccgacctgacccagctgtgccagcagcagctgggcctggaccccaacttcctgagacacagccagttcaagagacccagaaccagaatcaccgacgaccagctgaagatcctgagagcctacttcgacatcaacaacagccccagcgaggagcagatccaggagatggccgagaagagcggcctgagccagaaggtgatcaagcactggttcagaaacaccctgttcaaggagagacagagaaacaaggacagcccctacaacttcagcaacccccccatcaccgtgctggaggacatcagaatcgacccccagcccaccagcctggagcactacaagagcgacgccagcttcagcaagagaagcagcagaaccagattcaccgactaccagctgagagtgctgcaggacttcttcgacaccaacgcctaccccaaggacgacgagatcgagcagctgagcaccgtgctgaacctgcccaccagagtgatcgtggtgtggttccagaacgccagacagaaggccagaaagagctacgagaaccaggccgagaccaaggacaacgagaagagagagctgaccaacgagagatacatcagaaccagcaacatgcagtaccagtgcaagaagtgcaacgtggtgttccccagaatcttcgacctgatcacccaccagaagaagcagtgctacaaggacgaggacgacgacgcccaggacgagagccagaccgaggacagcatggacgccaccgaccaggtggtgtacaagcactgcaccgtgagcggccagaccgacgccgccaagaacgccgccgcccccgccgccagcagcggcagcggcaccagcacccccctgatccccagccccaagcccgagcccgagaagaccagccccaagcccgagtaccccgccgagaagcccaagcagagcgaccccagcccccccagccagggcaccaagcccgccctgcccctggccagcaccagcagcgaccccccccaggccagcaccgcccagccccagccccagccccagccccccaagcagccccagctgatcggcagaccccccagcgccagccagacccccgtgcccagcagccccctgcagatcagcatgaccagcctgcagaacagcctgcccccccagctgctgcagtaccagtgcgaccagtgcaccgtggccttccccaccctggagctgtggcaggagcaccagcacatgcacttcctggccgcccagaaccagttcctgcacagccccttcctggagagacccatggacatgccctacatgatcttcgaccccaacaaccccctgatgaccggccagctgctgggcagcagcctgacccagatgcccccccaggccagcagcagccacaccaccgcccccaccaccgtggccgccagcctgaagagaaagctggacgacaaggaggacaacaactgcagcgagaaggagggcggcaacagcggcgaggaccagcacagagacaagagactgagaaccaccatcacccccgagcagctggagatcctgtacgagaagtacctgctggacagcaaccccaccagaaagatgctggaccacatcgccagagaggtgggcctgaagaagagagtggtgcaggtgtggttccagaacaccagagccagagagagaaagggccagttcagagccgtgggccccgcccagagccacaagagatgccccttctgcagagccctgttcaaggccaagagcgccctggagagccacatcagaagcagacactggaacgagggcaagcaggccggctacagcctgccccccagccccctgatcagcaccgaggacggcggcgagagcccccagaagtacatctacttcgactaccccagcctgcccctgaccaagatcgacctgagcagcgagaacgagctggccagcaccgtgagcacccccgtgagcaagaccgccgagctgagccccaagaacctgctgagccccagcagcttcaaggccgagtgcagcgaggacgtggagaacctgaacgccccccccgccgaggccggctacgaccagaacaagaccgacttcgacgagaccagcagcatcaacaccgccatcagcgacgccaccaccggcgacgagggcaacaccgagatggagagcaccaccggcagcagcggcgacgtgaagcccgccctgagccccaaggagcccaagaccctggacaccctgcccaagcccgccaccacccccaccaccgaggtgtgcgacgacaagttcctgttcagcctgaccagccccagcatccacttcaacgacaaggacggcgaccacgaccagagcttctacatcaccgacgaccccgacgacaacgccgacagaagcgagaccagcagcatcgccgaccccagcagccccaaccccttcggcagcagcaaccccttcaagagcaagagcaacgacagacccggccacaagagattcagaacccagatgagcaacctgcagctgaaggtgctgaaggcctgcttcagcgactacagaacccccaccatgcaggagtgcgagatgctgggcaacgagatcggcctgcccaagagagtggtgcaggtgtggttccagaacgccagagccaaggagaagaagttcaagatcaacatcggcaagcccttcatgatcaaccagggcggcaccgagggcaccaagcccgagtgcaccctgtgcggcgtgaagtacagcgccagactgagcatcagagaccacatcttcagcaagcagcacatcagcaaggtgagagagaccgtgggcagccagctggacagagagaaggactacctggcccccaccaccgtgagacagctgatggcccagcaggagctggacagaatcaagaaggccagcgacgtgctgggcctgaccgtgcagcagcccggcatgatggacagcagcagcctgcacggcatcagcctgcccaccgcctaccccggcctgcccggcctgccccccgtgctgctgcccggcatgaacggccccagcagcctgcccggcttcccccagaacagcaacaccctgaccccccccggcgccggcatgctgggcttccccaccagcgccaccagcagccccgccctgagcctgagcagcgcccccaccaagcccctgctgcagaccccccccccccccccccccccccccccccccccccccagcagcagcctgagcggccagcagaccgagcagcagaacaaggagagcgagaagaagcagaccaagcccaacaaggtgaagaagatcaaggaggaggagctggaggccaccaagcccgagaagcaccccaagaaggaggagaagatcagcagcgccctgagcgtgctgggcaaggtggtgggcgagacccacgtggaccccatccagctgcaggccctgcagaacgccatcgccggcgaccccgccagcttcatcggcggccagttcctgccctacttcatccccggcttcgccagctacttcaccccccagctgcccggcaccgtgcagggcggctacttcccccccgtgtgcggcatggagagcctgttcccctacggccccaccatgccccagaccctggccggcctgagccccggcgccctgctgcagcagtaccagcagtaccagcagaacctgcaggagagcctgcagaagcagcagaagcagcagcaggagcagcagcagaagcccgtgcaggccaagaccagcaaggtggagagcgaccagccccagaacagcaacgacgccagcgagaccaaggaggacaagagcaccgccaccgagagcaccaaggaggagccccagctggagagcaagagcgccgacttcagcgacacctacgtggtgcccttcgtgaagtacgagttcatctgcagaaagtgccagatgatgttcaccgacgaggacgccgccgtgaaccaccagaagagcttctgctacttcggccagcccctgatcgacccccaggagaccgtgctgagagtgcccgtgagcaagtaccagtgcctggcctgcgacgtggccatcagcggcaacgaggccctgagccagcacctgcagagcagcctgcacaaggagaagaccatcaagcaggccatgagaaacgccaaggagcacgtgagactgctgccccacagcgtgtgcagccccaaccccaacaccaccagcaccagccagagcgccgccagcagcaacaacacctacccccacctgagctgcttcagcatgaagagctggcccaacatcctgttccaggccagcgccagaagagccgccagcccccccagcagcccccccagcctgagcctgcccagcaccgtgaccagcagcctgtgcagcaccagcggcgtgcagaccagcctgcccaccgagagctgcagcgacgagagcgacagcgagctgagccagaagctggaggacctggacaacagcctggaggtgaaggccaagcccgccagcggcctggacggcaacttcaacagcatcagaatggacatgttcagcgtgtag

SEQ ID NO: 105634 - DNA, 10716 bp, Artificial Sequence
  Description of Artificial Sequence: Synthetic coding sequence
atggagacctgcgacagcccccccatcagcagacaggagaacggccagagcaccagcaagctgtgcggcaccacccagctggacaacgaggtgcccgagaaggtggccggcatggagcccgacagagagaacagcagcaccgacgacaacctgaagaccgacgagagaaagagcgaggccctgctgggcttcagcgtggagaacgccgccgccacccaggtgaccagcgccaaggagatcccctgcaacgagtgcgccaccagcttccccagcctgcagaagtacatggagcaccactgccccaacgccagactgcccgtgctgaaggacgacaacgagagcgagatcagcgagctggaggacagcgacgtggagaacctgaccggcgagatcgtgtaccagcccgacggcagcgcctacatcatcgaggacagcaaggagagcggccagaacgcccagaccggcgccaacagcaagctgttcagcaccgccatgttcctggacagcctggccagcgccggcgagaagagcgaccagagcgccagcgcccccatgagcttctacccccagatcatcaacaccttccacatcgccagcagcctgggcaagcccttcaccgccgaccaggccttccccaacaccagcgccctggccggcgtgggccccgtgctgcacagcttcagagtgtacgacctgagacacaagagagagaaggactacctgaccagcgacggcagcgccaagaacagctgcgtgagcaaggacgtgcccaacaacgtggacctgagcaagttcgacggctgcgtgagcgacggcaagagaaagcccgtgctgatgtgcttcctgtgcaagctgagcttcggctacatcagaagcttcgtgacccacgccgtgcacgaccacagaatgaccctgaacgacgaggagcagaagctgctgagcaacaagtgcgtgagcgccatcatccagggcatcggcaaggacaaggagcccctgatcagcttcctggagcccaagaagagcaccagcgtgtacccccacttcagcaccaccaacctgatcggccccgaccccaccttcagaggcctgtggagcgccttccacgtggagaacggcgacagcctgcccgccggcttcgccttcctgaagggcagcgccagcaccagcagcagcgccgagcagcccctgggcatcacccagatgcccaaggccgaggtgaacctgggcggcctgagcagcctggtggtgaacacccccatcaccagcgtgagcctgagccacagcagcagcgagagcagcaagatgagcgagagcaaggaccaggagaacaactgcgagagacccaaggagagcaacgtgctgcaccccaacggcgagtgccccgtgaagagcgagcccaccgagcccggcgacgaggacgaggaggacgcctacagcaacgagctggacgacgaggaggtgctgggcgagctgaccgacagcatcggcaacaaggacttccccctgctgaaccagagcatcagccccctgagcagcagcgtgctgaagttcatcgagaagggcaccagcagcagcagcgccaccgtgagcgacgacaccgagaagaagaagcagaccgccgccgtgagagccagcggcagcgtggccagcaactacggcatcagcggcaaggacttcgccgacgccagcgccagcaaggacagcgccaccgccgcccaccccagcgagatcgccagaggcgacgaggacagcagcgccaccccccaccagcacggcttcacccccagcacccccggcacccccggccccggcggcgacggcagccccggcagcggcatcgagtgccccaagtgcgacaccgtgctgggcagcagcagaagcctgggcggccacatgaccatgatgcacagcagaaacagctgcaagaccctgaagtgccccaagtgcaactggcactacaagtaccagcagaccctggaggcccacatgaaggagaagcaccccgagcccggcggcagctgcgtgtactgcaagaccggccagccccaccccagactggccagaggcgagagctacacctgcggctacaagcccttcagatgcgaggtgtgcaactacagcaccaccaccaagggcaacctgagcatccacatgcagagcgacaagcacctgaacaacgtgcagaacctgcagaacggcaacggcgagcaggtgttcggccacagcgcccccgcccccaacaccagcctgagcggctgcggcacccccagccccagcaagcccaagcagaagcccacctggagatgcgaggtgtgcgactacgagaccaacgtggccagaaacctgagaatccacatgaccagcgagaagcacatgcacaacatgatgctgctgcagcagaacatgaagcagatccagcacaacctgcacctgggcctggcccccgccgaggccgagctgtaccagtactacctggcccagaacatcggcctgaccggcatgaagctggagaaccccgccgacccccagctgatgatcaaccccttccagctggaccccgccaccgccgccgccctggcccccggcctgggcgagctgagcccctacatcagcgaccccgccctgaagctgttccagtgcgccgtgtgcaacaagttcaccagcgacagcctggaggccctgagcgtgcacgtgagcagcgagagaagcctgcccgaggaggagtggagagccgtgatcggcgacatctaccagtgcaagctgtgcaactacaacacccagctgaaggccaacttccagctgcactgcaagaccgacaagcacatgcagaagtaccagctggtggcccacatcaaggagggcggcaagagcaacgagtggagactgaagtgcatcgccatcggcaaccccgtgcacctgaagtgcaacgcctgcgactactacaccaacagcgtggacaagctgagactgcacaccaccaaccacagacacgaggccgccctgaagctgtacaagcacctgcagaagcaggagggcgccgtgaaccccgagagctgctactactactgcgccgtgtgcgactacaccaccaaggtgaagctgaacctggtgcagcacgtgagaagcgtgaagcaccagcagaccgagggcctgagaaagctgcagctgcaccagcagggcctggcccccgaggaggacaacctgagcgagatcttcttcgtgaaggactgcccccccaacgagctggagaccgccagcctgggcgccagaacctgcgacgacgacctgaccgagcagcacgaggaggccgagggcgccatcaagcccaccgccgtggccgaggacgacgagaaggacaccagcgagagagacaacagcgagggcaagaacagcaacaaggacagcgtgagcgtggccggcggcacccagcccctgctgctggccaaggaggaggacgtggccaccaagagaagcaagcccaccgaggacaacaagttctgccacgagcagttctaccagtgcccctactgcaactacaacagcagagaccagagcagaatccagatgcacgtgctgagccagcacagcgtgcagcccgtgatctgctgccccctgtgccaggacgtgctgagcaacaagatgcacctgcagctgcacctgacccacctgcacagcgtgagccccgactgcgtggagaagctgctgatgaccgtgcccgtgcccgacgtgatgatgcccaacagcatgctgctgcccgccgccgccagcgagaagagcgagagagacacccccgccgccgtgaccgccgagggcagcggcaagtacagcggcgagagccccatggacgacaagagcatggccggcctggaggacagcaaggccaacgtggaggtgaagaacgaggagcagaagcccaccaaggagcccctggaggtgagcgagtggaacaagaacagcagcaaggacgtgaagatccccgacaccctgcaggaccagctgaacgagcagcagaagagacagcccctgagcgtgagcgacagacacgtgtacaagtacagatgcaaccactgcagcctggccttcaagaccatgcagaagctgcagatccacagccagtaccacgccatcagagccgccaccatgtgcaacctgtgccagagaagcttcagaaccttccaggccctgaagaagcacctggaggccggccaccccgagctgagcgaggccgagctgcagcagctgtacgccagcctgcccgtgaacggcgagctgtgggccgagagcgagaccatgagccaggacgaccacggcctggagcaggagatggagagagagtacgaggtggaccacgagggcaaggccagccccgtgggcagcgacagcagcagcatccccgacgacatgggcagcgagcccaagagaaccctgcccttcagaaagggccccaacttcaccatggagaagttcctggaccccagcagaccctacaagtgcaccgtgtgcaaggagagcttcacccagaagaacatcctgctggtgcactacaacagcgtgagccacctgcacaagctgaagaaggtgctgcaggaggccagcagccccgtgccccaggagaccaacagcaacaccgacaacaagccctacaagtgcagcatctgcaacgtggcctacagccagagcagcaccctggagatccacatgagaagcgtgctgcaccagaccaaggccagagccgccaagctggagcccagcggccacgtggccggcggccacagcatcgccgccaacgtgaacagccccggccagggcatgctggacagcatgagcctggccgccgtgaacagcaaggacacccacctggacgccaaggagctgaacaagaagcagacccccgacctgatcagcgcccagcccgcccaccaccccccccagagccccgcccagatccagatgcagctgcagcacgagctgcagcagcaggccgccttcttccagccccagttcctgaaccccgccttcctgccccacttccccatgacccccgaggccctgctgcagttccagcagccccagttcctgttccccttctacatccccggcaccgagttcagcctgggccccgacctgggcctgcccggcagcgccaccttcggcatgcccggcatgaccggcatggccggcagcctgctggaggacctgaagcagcagatccagacccagcaccacgtgggccagacccagctgcagatcctgcagcagcaggcccagcagtaccaggccacccagccccagctgcagccccagaagcagcagcagcagcccccccccccccagcagcagcagcagcagcaggccagcaagctgctgaagcaggagcagagcaacatcgtgagcgccgactgccagatcatgaaggacgtgcccagctacaaggaggccgaggacatcagcgagaagcccgagaagcccaagcaggagttcatcagcgagggcgagggcctgaaggagggcaaggacaccaagaagcagaagagcctggagcccagcatccccccccccagaatcgccagcggcgccagaggcaacgccgccaaggccctgctggagaacttcggcttcgagctggtgatccagtacaacgagaacagacagaaggtgcagaagaagggcaagagcggcgagggcgagaacaccgacaagctggagtgcggcacctgcggcaagctgttcagcaacgtgctgatcctgaagagccaccaggagcacgtgcacggccagttcttcccctacgccgccctggagaagttcgccagacagtacagagaggcctacgacaagctgtaccccatcagccccagcagccccgagacccccccccccccccccccccccccccccctgccccccgcccccccccagcccagcagcatgggccccgtgaagatccccaacaccgtgagcacccccctgcaggcccccccccccaccccccccccccccccccccccccccccccccccccccccccccccccccccccccccccccagcgcccccccccaggtgcagctgcccgtgagcctggacctgcccctgttccccagcatcatgatgcagcccgtgcagcaccccgccctgcccccccagctggccctgcagctgccccagatggacgccctgagcgccgacctgacccagctgtgccagcagcagctgggcctggaccccaacttcctgagacacagccagttcaagagacccagaaccagaatcaccgacgaccagctgaagatcctgagagcctacttcgacatcaacaacagccccagcgaggagcagatccaggagatggccgagaagagcggcctgagccagaaggtgatcaagcactggttcagaaacaccctgttcaaggagagacagagaaacaaggacagcccctacaacttcagcaacccccccatcaccgtgctggaggacatcagaatcgacccccagcccaccagcctggagcactacaagagcgacgccagcttcagcaagagaagcagcagaaccagattcaccgactaccagctgagagtgctgcaggacttcttcgacaccaacgcctaccccaaggacgacgagatcgagcagctgagcaccgtgctgaacctgcccaccagagtgatcgtggtgtggttccagaacgccagacagaaggccagaaagagctacgagaaccaggccgagaccaaggacaacgagaagagagagctgaccaacgagagatacatcagaaccagcaacatgcagtaccagtgcaagaagtgcaacgtggtgttccccagaatcttcgacctgatcacccaccagaagaagcagtgctacaaggacgaggacgacgacgcccaggacgagagccagaccgaggacagcatggacgccaccgaccaggtggtgtacaagcactgcaccgtgagcggccagaccgacgccgccaagaacgccgccgcccccgccgccagcagcggcagcggcaccagcacccccctgatccccagccccaagcccgagcccgagaagaccagccccaagcccgagtaccccgccgagaagcccaagcagagcgaccccagcccccccagccagggcaccaagcccgccctgcccctggccagcaccagcagcgaccccccccaggccagcaccgcccagccccagccccagccccagccccccaagcagccccagctgatcggcagaccccccagcgccagccagacccccgtgcccagcagccccctgcagatcagcatgaccagcctgcagaacagcctgcccccccagctgctgcagtaccagtgcgaccagtgcaccgtggccttccccaccctggagctgtggcaggagcaccagcacatgcacttcctggccgcccagaaccagttcctgcacagccccttcctggagagacccatggacatgccctacatgatcttcgaccccaacaaccccctgatgaccggccagctgctgggcagcagcctgacccagatgcccccccaggccagcagcagccacaccaccgcccccaccaccgtggccgccagcctgaagagaaagctggacgacaaggaggacaacaactgcagcgagaaggagggcggcaacagcggcgaggaccagcacagagacaagagactgagaaccaccatcacccccgagcagctggagatcctgtacgagaagtacctgctggacagcaaccccaccagaaagatgctggaccacatcgccagagaggtgggcctgaagaagagagtggtgcaggtgtggttccagaacaccagagccagagagagaaagggccagttcagagccgtgggccccgcccagagccacaagagatgccccttctgcagagccctgttcaaggccaagagcgccctggagagccacatcagaagcagacactggaacgagggcaagcaggccggctacagcctgccccccagccccctgatcagcaccgaggacggcggcgagagcccccagaagtacatctacttcgactaccccagcctgcccctgaccaagatcgacctgagcagcgagaacgagctggccagcaccgtgagcacccccgtgagcaagaccgccgagctgagccccaagaacctgctgagccccagcagcttcaaggccgagtgcagcgaggacgtggagaacctgaacgccccccccgccgaggccggctacgaccagaacaagaccgacttcgacgagaccagcagcatcaacaccgccatcagcgacgccaccaccggcgacgagggcaacaccgagatggagagcaccaccggcagcagcggcgacgtgaagcccgccctgagccccaaggagcccaagaccctggacaccctgcccaagcccgccaccacccccaccaccgaggtgtgcgacgacaagttcctgttcagcctgaccagccccagcatccacttcaacgacaaggacggcgaccacgaccagagcttctacatcaccgacgaccccgacgacaacgccgacagaagcgagaccagcagcatcgccgaccccagcagccccaaccccttcggcagcagcaaccccttcaagagcaagagcaacgacagacccggccacaagagattcagaacccagatgagcaacctgcagctgaaggtgctgaaggcctgcttcagcgactacagaacccccaccatgcaggagtgcgagatgctgggcaacgagatcggcctgcccaagagagtggtgcaggtgtggttccagaacgccagagccaaggagaagaagttcaagatcaacatcggcaagcccttcatgatcaaccagggcggcaccgagggcaccaagcccgagtgcaccctgtgcggcgtgaagtacagcgccagactgagcatcagagaccacatcttcagcaagcagcacatcagcaaggtgagagagaccgtgggcagccagctggacagagagaaggactacctggcccccaccaccgtgagacagctgatggcccagcaggagctggacagaatcaagaaggccagcgacgtgctgggcctgaccgtgcagcagcccggcatgatggacagcagcagcctgcacggcatcagcctgcccaccgcctaccccggcctgcccggcctgccccccgtgctgctgcccggcatgaacggccccagcagcctgcccggcttcccccagaacagcaacaccctgaccccccccggcgccggcatgctgggcttccccaccagcgccaccagcagccccgccctgagcctgagcagcgcccccaccaagcccctgctgcagaccccccccccccccccccccccccccccccccccccccagcagcagcctgagcggccagcagaccgagcagcagaacaaggagagcgagaagaagcagaccaagcccaacaaggtgaagaagatcaaggaggaggagctggaggccaccaagcccgagaagcaccccaagaaggaggagaagatcagcagcgccctgagcgtgctgggcaaggtggtgggcgagacccacgtggaccccatccagctgcaggccctgcagaacgccatcgccggcgaccccgccagcttcatcggcggccagttcctgccctacttcatccccggcttcgccagctacttcaccccccagctgcccggcaccgtgcagggcggctacttcccccccgtgtgcggcatggagagcctgttcccctacggccccaccatgccccagaccctggccggcctgagccccggcgccctgctgcagcagtaccagcagtaccagcagaacctgcaggagagcctgcagaagcagcagaagcagcagcaggagcagcagcagaagcccgtgcaggccaagaccagcaaggtggagagcgaccagccccagaacagcaacgacgccagcgagaccaaggaggacaagagcaccgccaccgagagcaccaaggaggagccccagctggagagcaagagcgccgacttcagcgacacctacgtggtgcccttcgtgaagtacgagttcatctgcagaaagtgccagatgatgttcaccgacgaggacgccgccgtgaaccaccagaagagcttctgctacttcggccagcccctgatcgacccccaggagaccgtgctgagagtgcccgtgagcaagtaccagtgcctggcctgcgacgtggccatcagcggcaacgaggccctgagccagcacctgcagagcagcctgcacaaggagaagaccatcaagcaggccatgagaaacgccaaggagcacgtgagactgctgccccacagcgtgtgcagccccaaccccaacaccaccagcaccagccagagcgccgccagcagcaacaacacctacccccacctgagctgcttcagcatgaagagctggcccaacatcctgttccaggccagcgccagaagagccgccagcccccccagcagcccccccagcctgagcctgcccagcaccgtgaccagcagcctgtgcagcaccagcggcgtgcagaccagcctgcccaccgagagctgcagcgacgagagcgacagcgagctgagccagaagctggaggacctggacaacagcctggaggtgaaggccaagcccgccagcggcctggacggcaacttcaacagcatcagaatggacatgttcagcgtgtag

SEQ ID NO: 105635 - DNA, 468 bp, Artificial Sequence
  Description of Artificial Sequence: Synthetic coding sequence
atggagacctgcgacagcccccccatcagcagacaggagaacggccagagcaccagcaagctgtgcggcaccacccagctggacaacgaggtgcccgagaaggtggccggcatggagcccgacagagagaacagcagcaccgacgacaacctgaagaccgacgagagaaagagcgaggccctgctgggcttcagcgtggagaacgccgccgccacccaggtgaccagcgccaaggagatcccctgcaacgagtgcgccaccagcttccccagcctgcagaagtacatggagcaccactgccccaacgccagactgcccgtgctgaaggacgacaacgagagcgagatcagcgagctggaggacagcgacgtggagaacctgaccggcgagatcgtgtaccagcccgacggcagcgcctacatcatcgaggacagcaaggagagcggccagaacgcccagaccggctag

SEQ ID NO: 105636 - DNA, 10773 bp, Artificial Sequence
  Description of Artificial Sequence: Synthetic coding sequence
atggagacctgcgacagcccccccatcagcagacaggagaacggccagagcaccagcaagctgtgcggcaccacccagctggacaacgaggtgcccgagaaggtggccggcatggagcccgacagagagaacagcagcaccgacgacaacctgaagaccgacgagagaaagagcgaggccctgctgggcttcagcgtggagaacgccgccgccacccaggtgaccagcgccaaggagatcccctgcaacgagtgcgccaccagcttccccagcctgcagaagtacatggagcaccactgccccaacgccagactgcccgtgctgaaggacgacaacgagagcgagatcagcgagctggaggacagcgacgtggagaacctgaccggcgagatcgtgtaccagcccgacggcagcgcctacatcatcgaggacagcaaggagagcggccagaacgcccagaccggcgccaacagcaagctgttcagcaccgccatgttcctggacagcctggccagcgccggcgagaagagcgaccagagcgccagcgcccccatgagcttctacccccagatcatcaacaccttccacatcgccagcagcctgggcaagcccttcaccgccgaccaggccttccccaacaccagcgccctggccggcgtgggccccgtgctgcacagcttcagagtgtacgacctgagacacaagagagagaaggactacctgaccagcgacggcagcgccaagaacagctgcgtgagcaaggacgtgcccaacaacgtggacctgagcaagttcgacggctgcgtgagcgacggcaagagaaagcccgtgctgatgtgcttcctgtgcaagctgagcttcggctacatcagaagcttcgtgacccacgccgtgcacgaccacagaatgaccctgaacgacgaggagcagaagctgctgagcaacaagtgcgtgagcgccatcatccagggcatcggcaaggacaaggagcccctgatcagcttcctggagcccaagaagagcaccagcgtgtacccccacttcagcaccaccaacctgatcggccccgaccccaccttcagaggcctgtggagcgccttccacgtggagaacggcgacagcctgcccgccggcttcgccttcctgaagggcagcgccagcaccagcagcagcgccgagcagcccctgggcatcacccagatgcccaaggccgaggtgaacctgggcggcctgagcagcctggtggtgaacacccccatcaccagcgtgagcctgagccacagcagcagcgagagcagcaagatgagcgagagcaaggaccaggagaacaactgcgagagacccaaggagagcaacgtgctgcaccccaacggcgagtgccccgtgaagagcgagcccaccgagcccggcgacgaggacgaggaggacgcctacagcaacgagctggacgacgaggaggtgctgggcgagctgaccgacagcatcggcaacaaggacttccccctgctgaaccagagcatcagccccctgagcagcagcgtgctgaagttcatcgagaagggcaccagcagcagcagcgccaccgtgagcgacgacaccgagaagaagaagcagaccgccgccgtgagagccagcggcagcgtggccagcaactacggcatcagcggcaaggacttcgccgacgccagcgccagcaaggacagcgccaccgccgcccaccccagcgagatcgccagaggcgacgaggacagcagcgccaccccccaccagcacggcttcacccccagcacccccggcacccccggccccggcggcgacggcagccccggcagcggcatcgagtgccccaagtgcgacaccgtgctgggcagcagcagaagcctgggcggccacatgaccatgatgcacagcagaaacagctgcaagaccctgaagtgccccaagtgcaactggcactacaagtaccagcagaccctggaggcccacatgaaggagaagcaccccgagcccggcggcagctgcgtgtactgcaagaccggccagccccaccccagactggccagaggcgagagctacacctgcggctacaagcccttcagatgcgaggtgtgcaactacagcaccaccaccaagggcaacctgagcatccacatgcagagcgacaagcacctgaacaacgtgcagaacctgcagaacggcaacggcgagcaggtgttcggccacagcgcccccgcccccaacaccagcctgagcggctgcggcacccccagccccagcaagcccaagcagaagcccacctggagatgcgaggtgtgcgactacgagaccaacgtggccagaaacctgagaatccacatgaccagcgagaagcacatgcacaacatgatgctgctgcagcagaacatgaagcagatccagcacaacctgcacctgggcctggcccccgccgaggccgagctgtaccagtactacctggcccagaacatcggcctgaccggcatgaagctggagaaccccgccgacccccagctgatgatcaaccccttccagctggaccccgccaccgccgccgccctggcccccggcctgggcgagctgagcccctacatcagcgaccccgccctgaagctgttccagtgcgccgtgtgcaacaagttcaccagcgacagcctggaggccctgagcgtgcacgtgagcagcgagagaagcctgcccgaggaggagtggagagccgtgatcggcgacatctaccagtgcaagctgtgcaactacaacacccagctgaaggccaacttccagctgcactgcaagaccgacaagcacatgcagaagtaccagctggtggcccacatcaaggagggcggcaagagcaacgagtggagactgaagtgcatcgccatcggcaaccccgtgcacctgaagtgcaacgcctgcgactactacaccaacagcgtggacaagctgagactgcacaccaccaaccacagacacgaggccgccctgaagctgtacaagcacctgcagaagcaggagggcgccgtgaaccccgagagctgctactactactgcgccgtgtgcgactacaccaccaaggtgaagctgaacctggtgcagcacgtgagaagcgtgaagcaccagcagaccgagggcctgagaaagctgcagctgcaccagcagggcctggcccccgaggaggacaacctgagcgagatcttcttcgtgaaggactgcccccccaacgagctggagaccgccagcctgggcgccagaacctgcgacgacgacctgaccgagcagcagctgagaagcaccagcgaggagcagagcgaggaggccgagggcgccatcaagcccaccgccgtggccgaggacgacgagaaggacaccagcgagagagacaacagcgagggcaagaacagcaacaaggacagcggcatcatcacccccgagaaggagctgaaggtgagcgtggccggcggcacccagcccctgctgctggccaaggaggaggacgtggccaccaagagaagcaagcccaccgaggacaacaagttctgccacgagcagttctaccagtgcccctactgcaactacaacagcagagaccagagcagaatccagatgcacgtgctgagccagcacagcgtgcagcccgtgatctgctgccccctgtgccaggacgtgctgagcaacaagatgcacctgcagctgcacctgacccacctgcacagcgtgagccccgactgcgtggagaagctgctgatgaccgtgcccgtgcccgacgtgatgatgcccaacagcatgctgctgcccgccgccgccagcgagaagagcgagagagacacccccgccgccgtgaccgccgagggcagcggcaagtacagcggcgagagccccatggacgacaagagcatggccggcctggaggacagcaaggccaacgtggaggtgaagaacgaggagcagaagcccaccaaggagcccctggaggtgagcgagtggaacaagaacagcagcaaggacgtgaagatccccgacaccctgcaggaccagctgaacgagcagcagaagagacagcccctgagcgtgagcgacagacacgtgtacaagtacagatgcaaccactgcagcctggccttcaagaccatgcagaagctgcagatccacagccagtaccacgccatcagagccgccaccatgtgcaacctgtgccagagaagcttcagaaccttccaggccctgaagaagcacctggaggccggccaccccgagctgagcgaggccgagctgcagcagctgtacgccagcctgcccgtgaacggcgagctgtgggccgagagcgagaccatgagccaggacgaccacggcctggagcaggagatggagagagagtacgaggtggaccacgagggcaaggccagccccgtgggcagcgacagcagcagcatccccgacgacatgggcagcgagcccaagagaaccctgcccttcagaaagggccccaacttcaccatggagaagttcctggaccccagcagaccctacaagtgcaccgtgtgcaaggagagcttcacccagaagaacatcctgctggtgcactacaacagcgtgagccacctgcacaagctgaagaaggtgctgcaggaggccagcagccccgtgccccaggagaccaacagcaacaccgacaacaagccctacaagtgcagcatctgcaacgtggcctacagccagagcagcaccctggagatccacatgagaagcgtgctgcaccagaccaaggccagagccgccaagctggagcccagcggccacgtggccggcggccacagcatcgccgccaacgtgaacagccccggccagggcatgctggacagcatgagcctggccgccgtgaacagcaaggacacccacctggacgccaaggagctgaacaagaagcagacccccgacctgatcagcgcccagcccgcccaccaccccccccagagccccgcccagatccagatgcagctgcagcacgagctgcagcagcaggccgccttcttccagccccagttcctgaaccccgccttcctgccccacttccccatgacccccgaggccctgctgcagttccagcagccccagttcctgttccccttctacatccccggcaccgagttcagcctgggccccgacctgggcctgcccggcagcgccaccttcggcatgcccggcatgaccggcatggccggcagcctgctggaggacctgaagcagcagatccagacccagcaccacgtgggccagacccagctgcagatcctgcagcagcaggcccagcagtaccaggccacccagccccagctgcagccccagaagcagcagcagcagcccccccccccccagcagcagcagcagcagcaggccagcaagctgctgaagcaggagcagagcaacatcgtgagcgccgactgccagatcatgaaggacgtgcccagctacaaggaggccgaggacatcagcgagaagcccgagaagcccaagcaggagttcatcagcgagggcgagggcctgaaggagggcaaggacaccaagaagcagaagagcctggagcccagcatccccccccccagaatcgccagcggcgccagaggcaacgccgccaaggccctgctggagaacttcggcttcgagctggtgatccagtacaacgagaacagacagaaggtgcagaagaagggcaagagcggcgagggcgagaacaccgacaagctggagtgcggcacctgcggcaagctgttcagcaacgtgctgatcctgaagagccaccaggagcacgtgcacggccagttcttcccctacgccgccctggagaagttcgccagacagtacagagaggcctacgacaagctgtaccccatcagccccagcagccccgagacccccccccccccccccccccccccccccctgccccccgcccccccccagcccagcagcatgggccccgtgaagatccccaacaccgtgagcacccccctgcaggcccccccccccaccccccccccccccccccccccccccccccccccccccccccccccccccccccccccccccagcgcccccccccaggtgcagctgcccgtgagcctggacctgcccctgttccccagcatcatgatgcagcccgtgcagcaccccgccctgcccccccagctggccctgcagctgccccagatggacgccctgagcgccgacctgacccagctgtgccagcagcagctgggcctggaccccaacttcctgagacacagccagttcaagagacccagaaccagaatcaccgacgaccagctgaagatcctgagagcctacttcgacatcaacaacagccccagcgaggagcagatccaggagatggccgagaagagcggcctgagccagaaggtgatcaagcactggttcagaaacaccctgttcaaggagagacagagaaacaaggacagcccctacaacttcagcaacccccccatcaccgtgctggaggacatcagaatcgacccccagcccaccagcctggagcactacaagagcgacgccagcttcagcaagagaagcagcagaaccagattcaccgactaccagctgagagtgctgcaggacttcttcgacaccaacgcctaccccaaggacgacgagatcgagcagctgagcaccgtgctgaacctgcccaccagagtgatcgtggtgtggttccagaacgccagacagaaggccagaaagagctacgagaaccaggccgagaccaaggacaacgagaagagagagctgaccaacgagagatacatcagaaccagcaacatgcagtaccagtgcaagaagtgcaacgtggtgttccccagaatcttcgacctgatcacccaccagaagaagcagtgctacaaggacgaggacgacgacgcccaggacgagagccagaccgaggacagcatggacgccaccgaccaggtggtgtacaagcactgcaccgtgagcggccagaccgacgccgccaagaacgccgccgcccccgccgccagcagcggcagcggcaccagcacccccctgatccccagccccaagcccgagcccgagaagaccagccccaagcccgagtaccccgccgagaagcccaagcagagcgaccccagcccccccagccagggcaccaagcccgccctgcccctggccagcaccagcagcgaccccccccaggccagcaccgcccagccccagccccagccccagccccccaagcagccccagctgatcggcagaccccccagcgccagccagacccccgtgcccagcagccccctgcagatcagcatgaccagcctgcagaacagcctgcccccccagctgctgcagtaccagtgcgaccagtgcaccgtggccttccccaccctggagctgtggcaggagcaccagcacatgcacttcctggccgcccagaaccagttcctgcacagccccttcctggagagacccatggacatgccctacatgatcttcgaccccaacaaccccctgatgaccggccagctgctgggcagcagcctgacccagatgcccccccaggccagcagcagccacaccaccgcccccaccaccgtggccgccagcctgaagagaaagctggacgacaaggaggacaacaactgcagcgagaaggagggcggcaacagcggcgaggaccagcacagagacaagagactgagaaccaccatcacccccgagcagctggagatcctgtacgagaagtacctgctggacagcaaccccaccagaaagatgctggaccacatcgccagagaggtgggcctgaagaagagagtggtgcaggtgtggttccagaacaccagagccagagagagaaagggccagttcagagccgtgggccccgcccagagccacaagagatgccccttctgcagagccctgttcaaggccaagagcgccctggagagccacatcagaagcagacactggaacgagggcaagcaggccggctacagcctgccccccagccccctgatcagcaccgaggacggcggcgagagcccccagaagtacatctacttcgactaccccagcctgcccctgaccaagatcgacctgagcagcgagaacgagctggccagcaccgtgagcacccccgtgagcaagaccgccgagctgagccccaagaacctgctgagccccagcagcttcaaggccgagtgcagcgaggacgtggagaacctgaacgccccccccgccgaggccggctacgaccagaacaagaccgacttcgacgagaccagcagcatcaacaccgccatcagcgacgccaccaccggcgacgagggcaacaccgagatggagagcaccaccggcagcagcggcgacgtgaagcccgccctgagccccaaggagcccaagaccctggacaccctgcccaagcccgccaccacccccaccaccgaggtgtgcgacgacaagttcctgttcagcctgaccagccccagcatccacttcaacgacaaggacggcgaccacgaccagagcttctacatcaccgacgaccccgacgacaacgccgacagaagcgagaccagcagcatcgccgaccccagcagccccaaccccttcggcagcagcaaccccttcaagagcaagagcaacgacagacccggccacaagagattcagaacccagatgagcaacctgcagctgaaggtgctgaaggcctgcttcagcgactacagaacccccaccatgcaggagtgcgagatgctgggcaacgagatcggcctgcccaagagagtggtgcaggtgtggttccagaacgccagagccaaggagaagaagttcaagatcaacatcggcaagcccttcatgatcaaccagggcggcaccgagggcaccaagcccgagtgcaccctgtgcggcgtgaagtacagcgccagactgagcatcagagaccacatcttcagcaagcagcacatcagcaaggtgagagagaccgtgggcagccagctggacagagagaaggactacctggcccccaccaccgtgagacagctgatggcccagcaggagctggacagaatcaagaaggccagcgacgtgctgggcctgaccgtgcagcagcccggcatgatggacagcagcagcctgcacggcatcagcctgcccaccgcctaccccggcctgcccggcctgccccccgtgctgctgcccggcatgaacggccccagcagcctgcccggcttcccccagaacagcaacaccctgaccccccccggcgccggcatgctgggcttccccaccagcgccaccagcagccccgccctgagcctgagcagcgcccccaccaagcccctgctgcagaccccccccccccccccccccccccccccccccccccccagcagcagcctgagcggccagcagaccgagcagcagaacaaggagagcgagaagaagcagaccaagcccaacaaggtgaagaagatcaaggaggaggagctggaggccaccaagcccgagaagcaccccaagaaggaggagaagatcagcagcgccctgagcgtgctgggcaaggtggtgggcgagacccacgtggaccccatccagctgcaggccctgcagaacgccatcgccggcgaccccgccagcttcatcggcggccagttcctgccctacttcatccccggcttcgccagctacttcaccccccagctgcccggcaccgtgcagggcggctacttcccccccgtgtgcggcatggagagcctgttcccctacggccccaccatgccccagaccctggccggcctgagccccggcgccctgctgcagcagtaccagcagtaccagcagaacctgcaggagagcctgcagaagcagcagaagcagcagcaggagcagcagcagaagcccgtgcaggccaagaccagcaaggtggagagcgaccagccccagaacagcaacgacgccagcgagaccaaggaggacaagagcaccgccaccgagagcaccaaggaggagccccagctggagagcaagagcgccgacttcagcgacacctacgtggtgcccttcgtgaagtacgagttcatctgcagaaagtgccagatgatgttcaccgacgaggacgccgccgtgaaccaccagaagagcttctgctacttcggccagcccctgatcgacccccaggagaccgtgctgagagtgcccgtgagcaagtaccagtgcctggcctgcgacgtggccatcagcggcaacgaggccctgagccagcacctgcagagcagcctgcacaaggagaagaccatcaagcaggccatgagaaacgccaaggagcacgtgagactgctgccccacagcgtgtgcagccccaaccccaacaccaccagcaccagccagagcgccgccagcagcaacaacacctacccccacctgagctgcttcagcatgaagagctggcccaacatcctgttccaggccagcgccagaagagccgccagcccccccagcagcccccccagcctgagcctgcccagcaccgtgaccagcagcctgtgcagcaccagcggcgtgcagaccagcctgcccaccgagagctgcagcgacgagagcgacagcgagctgagccagaagctggaggacctggacaacagcctggaggtgaaggccaagcccgccagcggcctggacggcaacttcaacagcatcagaatggacatgttcagcgtgtag

SEQ ID NO: 105637 - DNA, 468 bp, Artificial Sequence; identical to SEQ ID NO: 105635
  Description of Artificial Sequence: Synthetic coding sequence

SEQ ID NO: 105638 - DNA, 10851 bp, Artificial Sequence
  Description of Artificial Sequence: Synthetic coding sequence
atggagacctgcgacagcccccccatcagcagacaggagaacggccagagcaccagcaagctgtgcggcaccacccagctggacaacgaggtgcccgagaaggtggccggcatggagcccgacagagagaacagcagcaccgacgacaacctgaagaccgacgagagaaagagcgaggccctgctgggcttcagcgtggagaacgccgccgccacccaggtgaccagcgccaaggagatcccctgcaacgagtgcgccaccagcttccccagcctgcagaagtacatggagcaccactgccccaacgccagactgcccgtgctgaaggacgacaacgagagcgagatcagcgagctggaggacagcgacgtggagaacctgaccggcgagatcgtgtaccagcccgacggcagcgcctacatcatcgaggacagcaaggagagcggccagaacgcccagaccggcgccaacagcaagctgttcagcaccgccatgttcctggacagcctggccagcgccggcgagaagagcgaccagagcgccagcgcccccatgagcttctacccccagatcatcaacaccttccacatcgccagcagcctgggcaagcccttcaccgccgaccaggccttccccaacaccagcgccctggccggcgtgggccccgtgctgcacagcttcagagtgtacgacctgagacacaagagagagaaggactacctgaccagcgacggcagcgccaagaacagctgcgtgagcaaggacgtgcccaacaacgtggacctgagcaagttcgacggctgcgtgagcgacggcaagagaaagcccgtgctgatgtgcttcctgtgcaagctgagcttcggctacatcagaagcttcgtgacccacgccgtgcacgaccacagaatgaccctgaacgacgaggagcagaagctgctgagcaacaagtgcgtgagcgccatcatccagggcatcggcaaggacaaggagcccctgatcagcttcctggagcccaagaagagcaccagcgtgtacccccacttcagcaccaccaacctgatcggccccgaccccaccttcagaggcctgtggagcgccttccacgtggagaacggcgacagcctgcccgccggcttcgccttcctgaagggcagcgccagcaccagcagcagcgccgagcagcccctgggcatcacccagatgcccaaggccgaggtgaacctgggcggcctgagcagcctggtggtgaacacccccatcaccagcgtgagcctgagccacagcagcagcgagagcagcaagatgagcgagagcaaggaccaggagaacaactgcgagagacccaaggagagcaacgtgctgcaccccaacggcgagtgccccgtgaagagcgagcccaccgagcccggcgacgaggacgaggaggacgcctacagcaacgagctggacgacgaggaggtgctgggcgagctgaccgacagcatcggcaacaaggacttccccctgctgaaccagagcatcagccccctgagcagcagcgtgctgaagttcatcgagaagggcaccagcagcagcagcgccaccgtgagcgacgacaccgagaagaagaagcagaccgccgccgtgagagccagcggcagcgtggccagcaactacggcatcagcggcaaggacttcgccgacgccagcgccagcaaggacagcgccaccgccgcccaccccagcgagatcgccagaggcgacgaggacagcagcgccaccccccaccagcacggcttcacccccagcacccccggcacccccggccccggcggcgacggcagccccggcagcggcatcgagtgccccaagtgcgacaccgtgctgggcagcagcagaagcctgggcggccacatgaccatgatgcacagcagaaacagctgcaagaccctgaagtgccccaagtgcaactggcactacaagtaccagcagaccctggaggcccacatgaaggagaagcaccccgagcccggcggcagctgcgtgtactgcaagaccggccagccccaccccagactggccagaggcgagagctacacctgcggctacaagcccttcagatgcgaggtgtgcaactacagcaccaccaccaagggcaacctgagcatccacatgcagagcgacaagcacctgaacaacgtgcagaacctgcagaacggcaacggcgagcaggtgttcggccacagcgcccccgcccccaacaccagcctgagcggctgcggcacccccagccccagcaagcccaagcagaagcccacctggagatgcgaggtgtgcgactacgagaccaacgtggccagaaacctgagaatccacatgaccagcgagaagcacatgcacaacatgatgctgctgcagcagaacatgaagcagatccagcacaacctgcacctgggcctggcccccgccgaggccgagctgtaccagtactacctggcccagaacatcggcctgaccggcatgaagctggagaaccccgccgacccccagctgatgatcaaccccttccagctggaccccgccaccgccgccgccctggcccccggcctggtgaacaacgagctgccccccgagatcagactggccagcggccagctgatgggcgacgacctgagcctgctgaccgccggcgagctgagcccctacatcagcgaccccgccctgaagctgttccagtgcgccgtgtgcaacaagttcaccagcgacagcctggaggccctgagcgtgcacgtgagcagcgagagaagcctgcccgaggaggagtggagagccgtgatcggcgacatctaccagtgcaagctgtgcaactacaacacccagctgaaggccaacttccagctgcactgcaagaccgacaagcacatgcagaagtaccagctggtggcccacatcaaggagggcggcaagagcaacgagtggagactgaagtgcatcgccatcggcaaccccgtgcacctgaagtgcaacgcctgcgactactacaccaacagcgtggacaagctgagactgcacaccaccaaccacagacacgaggccgccctgaagctgtacaagcacctgcagaagcaggagggcgccgtgaaccccgagagctgctactactactgcgccgtgtgcgactacaccaccaaggtgaagctgaacctggtgcagcacgtgagaagcgtgaagcaccagcagaccgagggcctgagaaagctgcagctgcaccagcagggcctggcccccgaggaggacaacctgagcgagatcttcttcgtgaaggactgcccccccaacgagctggagaccgccagcctgggcgccagaacctgcgacgacgacctgaccgagcagcagctgagaagcaccagcgaggagcagagcgaggaggccgagggcgccatcaagcccaccgccgtggccgaggacgacgagaaggacaccagcgagagagacaacagcgagggcaagaacagcaacaaggacagcggcatcatcacccccgagaaggagctgaaggtgagcgtggccggcggcacccagcccctgctgctggccaaggaggaggacgtggccaccaagagaagcaagcccaccgaggacaacaagttctgccacgagcagttctaccagtgcccctactgcaactacaacagcagagaccagagcagaatccagatgcacgtgctgagccagcacagcgtgcagcccgtgatctgctgccccctgtgccaggacgtgctgagcaacaagatgcacctgcagctgcacctgacccacctgcacagcgtgagccccgactgcgtggagaagctgctgatgaccgtgcccgtgcccgacgtgatgatgcccaacagcatgctgctgcccgccgccgccagcgagaagagcgagagagacacccccgccgccgtgaccgccgagggcagcggcaagtacagcggcgagagccccatggacgacaagagcatggccggcctggaggacagcaaggccaacgtggaggtgaagaacgaggagcagaagcccaccaaggagcccctggaggtgagcgagtggaacaagaacagcagcaaggacgtgaagatccccgacaccctgcaggaccagctgaacgagcagcagaagagacagcccctgagcgtgagcgacagacacgtgtacaagtacagatgcaaccactgcagcctggccttcaagaccatgcagaagctgcagatccacagccagtaccacgccatcagagccgccaccatgtgcaacctgtgccagagaagcttcagaaccttccaggccctgaagaagcacctggaggccggccaccccgagctgagcgaggccgagctgcagcagctgtacgccagcctgcccgtgaacggcgagctgtgggccgagagcgagaccatgagccaggacgaccacggcctggagcaggagatggagagagagtacgaggtggaccacgagggcaaggccagccccgtgggcagcgacagcagcagcatccccgacgacatgggcagcgagcccaagagaaccctgcccttcagaaagggccccaacttcaccatggagaagttcctggaccccagcagaccctacaagtgcaccgtgtgcaaggagagcttcacccagaagaacatcctgctggtgcactacaacagcgtgagccacctgcacaagctgaagaaggtgctgcaggaggccagcagccccgtgccccaggagaccaacagcaacaccgacaacaagccctacaagtgcagcatctgcaacgtggcctacagccagagcagcaccctggagatccacatgagaagcgtgctgcaccagaccaaggccagagccgccaagctggagcccagcggccacgtggccggcggccacagcatcgccgccaacgtgaacagccccggccagggcatgctggacagcatgagcctggccgccgtgaacagcaaggacacccacctggacgccaaggagctgaacaagaagcagacccccgacctgatcagcgcccagcccgcccaccaccccccccagagccccgcccagatccagatgcagctgcagcacgagctgcagcagcaggccgccttcttccagccccagttcctgaaccccgccttcctgccccacttccccatgacccccgaggccctgctgcagttccagcagccccagttcctgttccccttctacatccccggcaccgagttcagcctgggccccgacctgggcctgcccggcagcgccaccttcggcatgcccggcatgaccggcatggccggcagcctgctggaggacctgaagcagcagatccagacccagcaccacgtgggccagacccagctgcagatcctgcagcagcaggcccagcagtaccaggccacccagccccagctgcagccccagaagcagcagcagcagcccccccccccccagcagcagcagcagcagcaggccagcaagctgctgaagcaggagcagagcaacatcgtgagcgccgactgccagatcatgaaggacgtgcccagctacaaggaggccgaggacatcagcgagaagcccgagaagcccaagcaggagttcatcagcgagggcgagggcctgaaggagggcaaggacaccaagaagcagaagagcctggagcccagcatccccccccccagaatcgccagcggcgccagaggcaacgccgccaaggccctgctggagaacttcggcttcgagctggtgatccagtacaacgagaacagacagaaggtgcagaagaagggcaagagcggcgagggcgagaacaccgacaagctggagtgcggcacctgcggcaagctgttcagcaacgtgctgatcctgaagagccaccaggagcacgtgcacggccagttcttcccctacgccgccctggagaagttcgccagacagtacagagaggcctacgacaagctgtaccccatcagccccagcagccccgagacccccccccccccccccccccccccccccctgccccccgcccccccccagcccagcagcatgggccccgtgaagatccccaacaccgtgagcacccccctgcaggcccccccccccaccccccccccccccccccccccccccccccccccccccccccccccccccccccccccccccagcgcccccccccaggtgcagctgcccgtgagcctggacctgcccctgttccccagcatcatgatgcagcccgtgcagcaccccgccctgcccccccagctggccctgcagctgccccagatggacgccctgagcgccgacctgacccagctgtgccagcagcagctgggcctggaccccaacttcctgagacacagccagttcaagagacccagaaccagaatcaccgacgaccagctgaagatcctgagagcctacttcgacatcaacaacagccccagcgaggagcagatccaggagatggccgagaagagcggcctgagccagaaggtgatcaagcactggttcagaaacaccctgttcaaggagagacagagaaacaaggacagcccctacaacttcagcaacccccccatcaccgtgctggaggacatcagaatcgacccccagcccaccagcctggagcactacaagagcgacgccagcttcagcaagagaagcagcagaaccagattcaccgactaccagctgagagtgctgcaggacttcttcgacaccaacgcctaccccaaggacgacgagatcgagcagctgagcaccgtgctgaacctgcccaccagagtgatcgtggtgtggttccagaacgccagacagaaggccagaaagagctacgagaaccaggccgagaccaaggacaacgagaagagagagctgaccaacgagagatacatcagaaccagcaacatgcagtaccagtgcaagaagtgcaacgtggtgttccccagaatcttcgacctgatcacccaccagaagaagcagtgctacaaggacgaggacgacgacgcccaggacgagagccagaccgaggacagcatggacgccaccgaccaggtggtgtacaagcactgcaccgtgagcggccagaccgacgccgccaagaacgccgccgcccccgccgccagcagcggcagcggcaccagcacccccctgatccccagccccaagcccgagcccgagaagaccagccccaagcccgagtaccccgccgagaagcccaagcagagcgaccccagcccccccagccagggcaccaagcccgccctgcccctggccagcaccagcagcgaccccccccaggccagcaccgcccagccccagccccagccccagccccccaagcagccccagctgatcggcagaccccccagcgccagccagacccccgtgcccagcagccccctgcagatcagcatgaccagcctgcagaacagcctgcccccccagctgctgcagtaccagtgcgaccagtgcaccgtggccttccccaccctggagctgtggcaggagcaccagcacatgcacttcctggccgcccagaaccagttcctgcacagccccttcctggagagacccatggacatgccctacatgatcttcgaccccaacaaccccctgatgaccggccagctgctgggcagcagcctgacccagatgcccccccaggccagcagcagccacaccaccgcccccaccaccgtggccgccagcctgaagagaaagctggacgacaaggaggacaacaactgcagcgagaaggagggcggcaacagcggcgaggaccagcacagagacaagagactgagaaccaccatcacccccgagcagctggagatcctgtacgagaagtacctgctggacagcaaccccaccagaaagatgctggaccacatcgccagagaggtgggcctgaagaagagagtggtgcaggtgtggttccagaacaccagagccagagagagaaagggccagttcagagccgtgggccccgcccagagccacaagagatgccccttctgcagagccctgttcaaggccaagagcgccctggagagccacatcagaagcagacactggaacgagggcaagcaggccggctacagcctgccccccagccccctgatcagcaccgaggacggcggcgagagcccccagaagtacatctacttcgactaccccagcctgcccctgaccaagatcgacctgagcagcgagaacgagctggccagcaccgtgagcacccccgtgagcaagaccgccgagctgagccccaagaacctgctgagccccagcagcttcaaggccgagtgcagcgaggacgtggagaacctgaacgccccccccgccgaggccggctacgaccagaacaagaccgacttcgacgagaccagcagcatcaacaccgccatcagcgacgccaccaccggcgacgagggcaacaccgagatggagagcaccaccggcagcagcggcgacgtgaagcccgccctgagccccaaggagcccaagaccctggacaccctgcccaagcccgccaccacccccaccaccgaggtgtgcgacgacaagttcctgttcagcctgaccagccccagcatccacttcaacgacaaggacggcgaccacgaccagagcttctacatcaccgacgaccccgacgacaacgccgacagaagcgagaccagcagcatcgccgaccccagcagccccaaccccttcggcagcagcaaccccttcaagagcaagagcaacgacagacccggccacaagagattcagaacccagatgagcaacctgcagctgaaggtgctgaaggcctgcttcagcgactacagaacccccaccatgcaggagtgcgagatgctgggcaacgagatcggcctgcccaagagagtggtgcaggtgtggttccagaacgccagagccaaggagaagaagttcaagatcaacatcggcaagcccttcatgatcaaccagggcggcaccgagggcaccaagcccgagtgcaccctgtgcggcgtgaagtacagcgccagactgagcatcagagaccacatcttcagcaagcagcacatcagcaaggtgagagagaccgtgggcagccagctggacagagagaaggactacctggcccccaccaccgtgagacagctgatggcccagcaggagctggacagaatcaagaaggccagcgacgtgctgggcctgaccgtgcagcagcccggcatgatggacagcagcagcctgcacggcatcagcctgcccaccgcctaccccggcctgcccggcctgccccccgtgctgctgcccggcatgaacggccccagcagcctgcccggcttcccccagaacagcaacaccctgaccccccccggcgccggcatgctgggcttccccaccagcgccaccagcagccccgccctgagcctgagcagcgcccccaccaagcccctgctgcagaccccccccccccccccccccccccccccccccccccccagcagcagcctgagcggccagcagaccgagcagcagaacaaggagagcgagaagaagcagaccaagcccaacaaggtgaagaagatcaaggaggaggagctggaggccaccaagcccgagaagcaccccaagaaggaggagaagatcagcagcgccctgagcgtgctgggcaaggtggtgggcgagacccacgtggaccccatccagctgcaggccctgcagaacgccatcgccggcgaccccgccagcttcatcggcggccagttcctgccctacttcatccccggcttcgccagctacttcaccccccagctgcccggcaccgtgcagggcggctacttcccccccgtgtgcggcatggagagcctgttcccctacggccccaccatgccccagaccctggccggcctgagccccggcgccctgctgcagcagtaccagcagtaccagcagaacctgcaggagagcctgcagaagcagcagaagcagcagcaggagcagcagcagaagcccgtgcaggccaagaccagcaaggtggagagcgaccagccccagaacagcaacgacgccagcgagaccaaggaggacaagagcaccgccaccgagagcaccaaggaggagccccagctggagagcaagagcgccgacttcagcgacacctacgtggtgcccttcgtgaagtacgagttcatctgcagaaagtgccagatgatgttcaccgacgaggacgccgccgtgaaccaccagaagagcttctgctacttcggccagcccctgatcgacccccaggagaccgtgctgagagtgcccgtgagcaagtaccagtgcctggcctgcgacgtggccatcagcggcaacgaggccctgagccagcacctgcagagcagcctgcacaaggagaagaccatcaagcaggccatgagaaacgccaaggagcacgtgagactgctgccccacagcgtgtgcagccccaaccccaacaccaccagcaccagccagagcgccgccagcagcaacaacacctacccccacctgagctgcttcagcatgaagagctggcccaacatcctgttccaggccagcgccagaagagccgccagcccccccagcagcccccccagcctgagcctgcccagcaccgtgaccagcagcctgtgcagcaccagcggcgtgcagaccagcctgcccaccgagagctgcagcgacgagagcgacagcgagctgagccagaagctggaggacctggacaacagcctggaggtgaaggccaagcccgccagcggcctggacggcaacttcaacagcatcagaatggacatgttcagcgtgtag

SEQ ID NO: 105639 - DNA, 423 bp, Artificial Sequence
  Description of Artificial Sequence: Synthetic coding sequence
atggagacctgcgacagcccccccatcagcagacaggagaacggccagagcaccagcaagctgtgcggcaccacccagctggacaacgaggtgcccgagaaggtggccggcatggagcccgacagagagaacagcagcaccgacgacaacctgaagaccgacgagagaaagagcgaggccctgctgggcttcagcgtggagaacgccgccgccacccaggtgaccagcgccaaggagatcccctgcaacgagtgcgccaccagcttccccagcctgcagaagtacatggagcaccactgccccaacgccagactgcccgtgctgaaggacgacaacgagagcgagatcagcgagctggaggacagcgacgtggagaacctgaccggcgagatcgtgtaccagcccgacggcagcgcctactag

SEQ ID NO: 105640 - DNA, 306 bp, Artificial Sequence
  Description of Artificial Sequence: Synthetic coding sequence
atggagacctgcgacagcccccccatcagcagacaggagaacggccagagcaccagcaagctgtgcggcaccacccagctggacaacgaggtgcccgagaaggtggccggcatggagcccgacagagagaacagcagcaccgacgacaacctgaagaccgacgagagaaagagcgaggccctgctgggcttcagcgtggagaacgccgccgccacccaggtgaccagcgccaaggagatcccctgcaacgagtgcgccaccagcttccccagcctgcagaagtacatggagcaccactgcccctag

SEQ ID NO: 105641 - DNA, 2253 bp, Artificial Sequence
  Description of Artificial Sequence: Synthetic coding sequence
atggagttcgtgagcggctacagagacgagttcctggacttcaccgccctgctgttcggctggttcagaaagttcgtggccgagagaggcgccgtgggcaccagcctggagggcagatgcagacagctggaggcccagatcagaagactgccccaggaccccgccctgtgggtgctgcacgtgctgcccaaccacagcgtgggcatcagcctgggccagggcgccgagcccggccccggccccggcctgggcaccgcctggctgctgggcgacaacccccccctgcacctgagagacctgagcccctacatcagcttcgtgagcctggaggacggcgaggagggcgaggaggaggaggaggaggacgaggaggaggagaagagagaggacggcggcgccggcagcaccgagaaggtggagcccgaggaggacagagagctggcccccaccagcagagagagcccccaggagaccaacccccccggcgagagcgaggaggccgccagagaggccggcggcggcaaggacggctgcagagaggacagagtggagaacgagaccagaccccagaagagaaagggccagagaagcgaggccgcccccctgcacgtgagctgcctgctgctggtgaccgacgagcacggcaccatcctgggcatcgacctgctggtggacggcgcccagggcaccgccagctggggcagcggcaccaaggacctggccccctgggcctacgccctgctgtgccacagcatggcctgccccatgggcagcggcgaccccagaaagcccagacagctgaccgtgggcgacgccagactgcacagagagctggagagcctggtgcccagactgggcgtgaagctggccaagacccccatgagaacctggggccccagacccggcttcaccttcgccagcctgagagccagaacctgccacgtgtgccacagacacagcttcgaggccaagctgaccccctgcccccagtgcagcgccgtgctgtactgcggcgaggcctgcctgagagccgactggcagagatgccccgacgacgtgagccacagattctggtgccccagactggccgccttcatggagagagccggcgagctggccaccctgcccttcacctacaccgccgaggtgaccagcgagaccttcaacaaggaggccttcctggccagcagaggcctgaccagaggctactggacccagctgagcatgctgatccccggccccggcttcagcagacaccccagaggcaacacccccagcctgagcctgctgagaggcggcgacccctaccagctgctgcagggcgacggcaccgccctgatgccccccgtgcccccccacccccccagaggcgtgttcggcagctggcaggactactacacctggagaggcctgagcctggacagccccatcgccgtgctgctgacctaccccctgaccgtgtactacgtgatcacccacctggtgccccagagcttccccgagctgaacatccagaacaagcagagcctgaagatccacgtggtggaggccggcaaggagttcgacctggtgatggtgttctgggagctgctggtgctgctgccccacgtggccctggagctgcagttcgtgggcgacggcctgccccccgagagcgacgagcagcacttcaccctgcagagagacagcctggaggtgagcgtgagacccggcagcggcatcagcgccagacccagcagcggcaccaaggagaagggcggcagaagagacctgcagatcaaggtgagcgccagaccctaccacctgttccagggccccaagcccgacctggtgatcgccagccccagcagcctgagcgccggcttcaacagcggcttcgccctgaaggacacctggctgagaagcctgcccagactgcagagcctgagagtgcccgccttcttcaccgagagcagcgagtacagctgcgtgatggacggccagaccatggccgtggccaccggcggcggcaccagccccccccagcccaaccccttcagaagccccttcagactgagagccgccgacaactgcatgagctggtactgcaacgccttcatcttccacctggtgtacaagcccgcccagggcagcggcgccagacccgcccccggcccccccccccccagccccacccccagcgccccccccgcccccaccagaagaagaagaggcgagaagaagcccggcagaggcgccagaagaagaaagtag

SEQ ID NO: 105642 - DNA, 2112 bp, Artificial Sequence
  Description of Artificial Sequence: Synthetic coding sequence
atggagttcgtgagcggctacagagacgagttcctggacttcaccgccctgctgttcggctggttcagaaagttcgtggccgagagaggcgccgtgggcaccagcctggagggcagatgcagacagctggaggcccagatcagaagactgccccaggaccccgccctgtgggtgctgcacgtgctgcccaaccacagcgtgggcatcagcctgggccagggcgccgagcccggccccggccccggcctgggcaccgcctggctgctgggcgacaacccccccctgcacctgagagacctgagcccctacatcagcttcgtgagcctggaggacggcgaggagggcgaggaggaggaggaggaggacgaggaggaggagaagagagaggacggcggcgccggcagcaccgagaaggtggagcccgaggaggacagagagctggcccccaccagcagagagagcccccaggagaccaacccccccggcgagagcgaggaggccgccagagaggccggcggcggcaaggacggctgcagagaggacagagtggagaacgagaccagaccccagaagagaaagggccagagaagcgaggccgcccccctgcacgtgagctgcctgctgctggtgaccgacgagcacggcaccatcctgggcatcgacctgctggtggacggcgcccagggcaccgccagctggggcagcggcaccaaggacctggccccctgggcctacgccctgctgtgccacagcatggcctgccccatgggcagcggcgaccccagaaagcccagacagctgaccgtgggcgacgccagactgcacagagagctggagagcctggtgcccagactgggcgtgaagctggccaagacccccatgagaacctggggccccagacccggcttcaccttcgccagcctgagagccagaacctgccacgtgtgccacagacacagcttcgaggccaagctgaccccctgcccccagtgcagcgccgtgctgtactgcggcgaggcctgcctgagagccgactggcagagatgccccgacgacgtgagccacagattctggtgccccagactggccgccttcatggagagagccggcgagctggccaccctgcccttcacctacaccgccgaggtgaccagcgagaccttcaacaaggaggccttcctggccagcagaggcctgaccagaggctactggacccagctgagcatgctgatccccggccccggcttcagcagacaccccagaggcaacacccccagcctgagcctgctgagaggcggcgacccctaccagctgctgcagggcgacggcaccgccctgatgccccccgtgcccccccacccccccagaggcgtgttcgtgcccgagctgaacatccagaacaagcagagcctgaagatccacgtggtggaggccggcaaggagttcgacctggtgatggtgttctgggagctgctggtgctgctgccccacgtggccctggagctgcagttcgtgggcgacggcctgccccccgagagcgacgagcagcacttcaccctgcagagagacagcctggaggtgagcgtgagacccggcagcggcatcagcgccagacccagcagcggcaccaaggagaagggcggcagaagagacctgcagatcaaggtgagcgccagaccctaccacctgttccagggccccaagcccgacctggtgatcggcttcaacagcggcttcgccctgaaggacacctggctgagaagcctgcccagactgcagagcctgagagtgcccgccttcttcaccgagagcagcgagtacagctgcgtgatggacggccagaccatggccgtggccaccggcggcggcaccagccccccccagcccaaccccttcagaagccccttcagactgagagccgccgacaactgcatgagctggtactgcaacgccttcatcttccacctggtgtacaagcccgcccagggcagcggcgccagacccgcccccggcccccccccccccagccccacccccagcgccccccccgcccccaccagaagaagaagaggcgagaagaagcccggcagaggcgccagaagaagaaagtag

SEQ ID NO: 105643 - DNA, 1722 bp, Artificial Sequence
  Description of Artificial Sequence: Synthetic coding sequence
atggacgccaagagcctgaccgcctggagcagaaccctggtgaccttcaaggacgtgttcgtggacttcaccagagaggagtggaagctgctggacaccgcccagcagatcgtgtacagaaacgtgatgctggagaactacaagaacctggtgagcctgggctaccagctgaccaagcccgacgtgatcctgagactggagaagggcgaggagccctggctggtggagagagagatccaccaggagacccaccccgacagcgagaccgccttcgagatcaagagcagcgtgagcagcagaagcatcttcaaggacaagcagagctgcgacatcaagatggagggcatggccagaaacgacctgtggtacctgagcctggaggaggtgtggaagtgcagagaccagctggacaagtaccaggagaaccccgagagacacctgagacaggtggccttcacccagaagaaggtgctgacccaggagagagtgagcgagagcggcaagtacggcggcaactgcctgctgcccgcccagctggtgctgagagagtacttccacaagagagacagccacaccaagagcctgaagcacgacctggtgctgaacggccaccaggacagctgcgccagcaacagcaacgagtgcggccagaccttctgccagaacatccacctgatccagttcgccagaacccacaccggcgacaagagctacaagtgccccgacaacgacaacagcctgacccacggcagcagcctgggcatcagcaagggcatccacagagagaagccctacgagtgcaaggagtgcggcaagttcttcagctggagaagcaacctgaccagacaccagctgatccacaccggcgagaagccctacgagtgcaaggagtgcggcaagagcttcagcagaagcagccacctgatcggccaccagaagacccacaccggcgaggagccctacgagtgcaaggagtgcggcaagagcttcagctggttcagccacctggtgacccaccagagaacccacaccggcgacaagctgtacacctgcaaccagtgcggcaagagcttcgtgcacagcagcagactgatcagacaccagagaacccacaccggcgagaagccctacgagtgccccgagtgcggcaagagcttcagacagagcacccacctgatcctgcaccagagaacccacgtgagagtgagaccctacgagtgcaacgagtgcggcaagagctacagccagagaagccacctggtggtgcaccacagaatccacaccggcctgaagcccttcgagtgcaaggactgcggcaagtgcttcagcagaagcagccacctgtacagccaccagagaacccacaccggcgagaagccctacgagtgccacgactgcggcaagagcttcagccagagcagcgccctgatcgtgcaccagagaatccacaccggcgagaagccctacgagtgctgccagtgcggcaaggccttcatcagaaagaacgacctgatcaagcaccagagaatccacgtgggcgaggagacctacaagtgcaaccagtgcggcatcatcttcagccagaacagccccttcatcgtgcaccagatcgcccacaccggcgagcagttcctgacctgcaaccagtgcggcaccgccctggtgaacaccagcaacctgatcggctaccagaccaaccacatcagagagaacgcctactag

SEQ ID NO: 105644 - DNA, 1722 bp, Artificial Sequence; identical to SEQ ID NO: 105643
  Description of Artificial Sequence: Synthetic coding sequence

SEQ ID NO: 105645 - DNA, 219 bp, Artificial Sequence
  Description of Artificial Sequence: Synthetic coding sequence
atggacgccaagagcctgaccgcctggagcagaaccctggtgaccttcaaggacgtgttcgtggacttcaccagagaggagtggaagctgctggacaccgcccagcagatcgtgtacagaaacgtgatgctggagaactacaagaacctggtgagcctgggctaccagctgaccaagcccgacgtgatcctgagactggagaagggcgaggagccctag

SEQ ID NO: 105646 - DNA, 132 bp, Artificial Sequence
  Description of Artificial Sequence: Synthetic coding sequence
atggacgccaagagcctgaccgcctggagcagaaccctggtgaccttcaaggacgtgttcgtggacttcaccagagaggagtggaagctgctggacaccgcccagcagatcgtgtacagaaacgtgatgtag

SEQ ID NO: 105647 - DNA, 144 bp, Artificial Sequence
  Description of Artificial Sequence: Synthetic coding sequence
atggacgccaagagcctgaccgcctggagcagaaccctggtgaccttcaaggacgtgttcgtggacttcaccagagaggagtggaagctgctggacaccgcccagcagatcgtgtacagaaacgtgatgctggagaactactag

SEQ ID NO: 105648 - DNA, 1629 bp, Artificial Sequence
  Description of Artificial Sequence: Synthetic coding sequence
atggacgaccccagatacggcatgtgccccctgaagggcgccagcggctgccccggcgccgagagaagcctgctggtgcagagctacttcgagaagggccccctgaccttcagagacgtggccatcgagttcagcctggaggagtggcagtgcctggacagcgcccagcagggcctgtacagaaaggtgatgctggagaactacagaaacctggtgttcctggccggcatcgccctgaccaagcccgacctgatcacctgcctggagcagggcaaggagccctggaacatcaagagacacgagatggtggccaagccccccgtgatctgcagccacttcccccaggacctgtgggccgagcaggacatcaaggacagcttccaggaggccatcctgaagaagtacggcaagtacggccacgacaacctgcagctgcagaagggctgcaagagcgtggacgagtgcaaggtgcacaaggagcacgacaacaagctgaaccagtgcctgatcaccacccagagcaacatcttccagtgcgaccccagcgccaaggtgttccacaccttcagcaacagcaacagacacaagatcagacacaccagaaagaagcccttcaagtgcaagaagtgcgagaagagcttctgcatgctgctgcacctgacccagcacaagagattccacatcaccgagaacagctaccagtgcaaggactgcggcaaggccttcaactggttcagcaccctgaccacccacagaagaatccacaccggcgagaagccctacaagtgcgaggagtgcggcaaggccttcaacagaagcagccacctgaccacccacaagatcatccacaccggcgagaagccctacagatgcgaggagtgcggcaaggccttcaacagaagcagccacctgaccacccacaagagaatccacaccggcgtgaagccctacaagtgcaccgagtgcggcaaggccttcaacagaagcagccacctgaccacccacagaatcatccacaccggcgagaagccctacaagtgcgaggagtgcggcaaggccttcaaccagagcagcaccctgaccacccacaagatcacccacgccggcgagaagccctacaagtgcgaggagtgcggcaaggccttctacagattcagctacctgaccaagcacaagaccagccacaccggcgagaagttctacaagtgcgaggagtgcggcaagggcttcaactggagcagcgccctgaccaagcacaagagaatccacaccggcgagaagccctacaagtgcgaggagtgcggcaaggccttcaacgagagcagcaacctgaccacccacaagatgatccacaccggcgagaagccctacaagtgcgacgagtgcggcaaggccttcaacagaagcagccagctgaccgcccacaagatgatccacaccggcgagaagccctacaagtgcgaggagtgcggcaaggccttcaacagaagcagcaccctgaccaagcacaagatcacccacaccggcgagaagagctacaagtgggaggagtgcggcaaggacttcaaccagagcctgagcctgatcaagcagaacaacagctactggagagagaccctgcagatgtag

SEQ ID NO: 105649 - DNA, 1311 bp, Artificial Sequence
  Description of Artificial Sequence: Synthetic coding sequence
atggacagcgtggccttcgaggacgtggccgtgaacttcacccaggaggagtgggccctgctgagccccagccagaagaacctgtacagagacgtgaccctggagaccttcagaaacctggccagcgtgggcatccagtggaaggaccaggacatcgagaacctgtaccagaacctgggcatcaagctgagaagcctggtggagagactgtgcggcagaaaggagggcaacgagcacagagagaccttcagccagatccccgactgccacctgaacaagaagagccagaccggcgtgaagccctgcaagtgcagcgtgtgcggcaaggtgttcctgagacacagcttcctggacagacacatgagagcccacgccggccacaagagaagcgagtgcggcggcgagtggagagagacccccagaaagcagaagcagcacggcaaggccagcatcagccccagcagcggcgccagaagaaccgtgacccccaccagaaagagaccctacgagtgcaaggtgtgcggcaaggccttcaacagccccaacctgttccagatccaccagagaacccacaccggcaagagaagctacaagtgcagagagatcgtgagagccttcaccgtgagcagcttcttcagaaagcacggcaagatgcacaccggcgagaagagatacgagtgcaagtactgcggcaagcccatcgactaccccagcctgttccagatccacgtgagaacccacaccggcgagaagccctacaagtgcaagcagtgcggcaaggccttcatcagcgccggctacctgagaacccacgagatcagaagccacgccctggagaagagccaccagtgccaggagtgcggcaagaagctgagctgcagcagcagcctgcacagacacgagagaacccacagcggcggcaagctgtacgagtgccagaagtgcgccaaggtgttcagatgccccaccagcctgcaggcccacgagagagcccacaccggcgagagaccctacgagtgcaacaagtgcggcaagaccttcaactaccccagctgcttcagaagacacaagaagacccacagcggcgagaagccctacgagtgcaccagatgcggcaaggccttcggctggtgcagcagcctgagaagacacgagatgacccacaccggcgagaagcccttcgactgcaagcagtgcggcaaggtgttcaccttcagcaactacctgagactgcacgagagaacccacctggccggcagaagccagtgcttcggcagaagacagggcgaccacctgagccccggcgtgtag

SEQ ID NO: 105650 - DNA, 1311 bp, Artificial Sequence; identical to SEQ ID NO: 105649
  Description of Artificial Sequence: Synthetic coding sequence

SEQ ID NO: 105651 - DNA, 951 bp, Artificial Sequence
  Description of Artificial Sequence: Synthetic coding sequence
atgagagcccacgccggccacaagagaagcgagtgcggcggcgagtggagagagacccccagaaagcagaagcagcacggcaaggccagcatcagccccagcagcggcgccagaagaaccgtgacccccaccagaaagagaccctacgagtgcaaggtgtgcggcaaggccttcaacagccccaacctgttccagatccaccagagaacccacaccggcaagagaagctacaagtgcagagagatcgtgagagccttcaccgtgagcagcttcttcagaaagcacggcaagatgcacaccggcgagaagagatacgagtgcaagtactgcggcaagcccatcgactaccccagcctgttccagatccacgtgagaacccacaccggcgagaagccctacaagtgcaagcagtgcggcaaggccttcatcagcgccggctacctgagaacccacgagatcagaagccacgccctggagaagagccaccagtgccaggagtgcggcaagaagctgagctgcagcagcagcctgcacagacacgagagaacccacagcggcggcaagctgtacgagtgccagaagtgcgccaaggtgttcagatgccccaccagcctgcaggcccacgagagagcccacaccggcgagagaccctacgagtgcaacaagtgcggcaagaccttcaactaccccagctgcttcagaagacacaagaagacccacagcggcgagaagccctacgagtgcaccagatgcggcaaggccttcggctggtgcagcagcctgagaagacacgagatgacccacaccggcgagaagcccttcgactgcaagcagtgcggcaaggtgttcaccttcagcaactacctgagactgcacgagagaacccacctggccggcagaagccagtgcttcggcagaagacagggcgaccacctgagccccggcgtgtag

SEQ ID NO: 105652 - DNA, 1311 bp, Artificial Sequence; identical to SEQ ID NO: 105649
  Description of Artificial Sequence: Synthetic coding sequence

SEQ ID NO: 105653 - DNA, 2352 bp, Artificial Sequence
  Description of Artificial Sequence: Synthetic coding sequence
atggtggccaagccccccgtgatgagcttccacttcgcccaggacctgtggcccgagcagaacatcaaggacagcttccagaaggtgaccctgagaagatacggcaagtgcgagtacgagaacctgcagctgagaaagggctgcaagcacgtggacgagtgcaccggccacaagggcggccacaacaccgtgaaccagtgcctgaccgccacccccagcaagatcttccagtgcaacaagtacgtgaaggtgttcgacaagttcagcaacagcaacagatacaagagaagacacaccggcaacaagcacttcaagtgcaaggagtgcagcaagagcttctgcgtgctgagccagctgacccagcacagaagaatccacaccagagtgaacagctacaagtgcgaggagtgcggcaaggccttcaactggttcagcaccctgaccaagcacaagagaatccacaccggcgagaagccctacaagtgcgaggagtgcggcaaggccttcaaccagagcagccagctgaccagacacaagatcatccacaccgaggagaagcccaacaagtgcgaggagtgcggcaaggccttcaagcaggccagccacctgaccatccacaagatcatccacaccggcgagaagccctacaagtacgaggagtgcggcaaggtgttcagccagagcagccacctgaccacccagaagatcctgcacaccggcgagaacctgtacaagtgcaaggagtgcggcaaggccttcaacctgttcagcaacctgaccaaccacaagagaatccacgccggcgagaagccctacaagtgcaaggagtgcggcagagccttcaacatcagcagcaacctgaacaagcaggagaagatccacaccggcggcaagctgaacaagtgcgaggagtgcgacaaggccttcaacagaagcctgaagctgaccgcccacaagaagatcctgatggaggagaagccctacaagtgcgaggagtgcggcaaggtgttcaaccagttcagcaccctgaccagacacaagatcatccacaccggcgagaagccctacaagtgcaaggagtgcggcaaggccttcaaccagagcagcaacctgaccgagcacaagaagatccacaccgccgagaagagctacaagtgcgaggagtgcggcaaggccttcaaccagcacagcaacctgatcaaccacagaaagatctacagcggcgagaagccctacaagtgcgaggagtgcggcaaggccttcaacagaagcagcaccctgaccagacacaagaagatccacaccggcgagaagccctacaagtgcgaggagtgcgacagagccttcagccagagcagcaacctgaccgagcacaagaagatccacaccggcgagaagccctacaagtgcgaggagtgcggcaaggccttcaacagattcagcaccctgaccaagcacaagagaatccacaccggcgagaagccctacaagtgcgaggagtgcggcaaggccttcaaccagagctaccagctgaccagacacaagatcgtgcacaccaaggagaagctgaacaagtgcgaggagttcggcaaggccttcaagcagagcagccacagaaccatccacaagatcatccacaccggcgagaagccctacaagtgcgaggagcacggcaaggtgttcaaccagagcagcaacctgaccacccagaagatcatccacaccggcgagaacctgtacaagttcgaggagcacggcaaggccttcaacctgttcagcaacatcaccaaccacaagatcatctacaccggcgagaagccccacaagtgcgaggagtgcggcaaggcctacaacagattcagcaacctgaccatccacaagagaatccacaccggcgagaagccctaccagtgcgccgagtgcggcaaggccttcaactgcagcagcaccctgaacagacacaagatcatccacaccggcgagaagccctacaagtgcaaggagtgcggcaaggccttcaacctgagcagcaccctgaccgcccacaagaagatccacaccggcgagaagccctacaagtgcgaggagtgcggcaaggccttcaaccagagcagcaacctgaccacccacaagaagatccacaccagcgagaagccctacaagtgcgaggagtgcggcaagagcttcaaccagttcagcagcctgaacatccacaagatcatccacaccggcgagaagccctacaagtgcggcgactacggcagagccttcaacctgagcagcaacctgaccacccacaagaagatccacaccggcgagaagccctacaagtgcgagtacggcaagacctag

SEQ ID NO: 105654 - DNA, 276 bp, Artificial Sequence
  Description of Artificial Sequence: Synthetic coding sequence
atggtggccaagccccccgtgatgagcttccacttcgcccaggacctgtggcccgagcagaacatcaaggacagcttccagaaggtgaccctgagaagatacggcaagtgcgagtacgagaacctgcagctgagaaagggctgcaagcacgtggacgagtgcaccggccacaagggcggccacaacaccgtgaaccagtgcctgaccgccacccccagcaagatcttccagtgcaacaagtacgtgaaggtgttcgacaagttcagcaacagctag

SEQ ID NO: 105655 - DNA, 2352 bp, Artificial Sequence; identical to SEQ ID NO: 105653
  Description of Artificial Sequence: Synthetic coding sequence

SEQ ID NO: 105656 - DNA, 2352 bp, Artificial Sequence; identical to SEQ ID NO: 105653
  Description of Artificial Sequence: Synthetic coding sequence

SEQ ID NO: 105657 - DNA, 453 bp, Artificial Sequence
  Description of Artificial Sequence: Synthetic coding sequence
atggtggccaagccccccgtgatgagcttccacttcgcccaggacctgtggcccgagcagaacatcaaggacagcttccagaaggtgaccctgagaagatacggcaagtgcgagtacgagaacctgcagctgagaaagggctgcaagcacgtggacgagtgcaccggccacaagggcggccacaacaccgtgaaccagtgcctgaccgccacccccagcaagatcttccagtgcaacaagtacgtgaaggtgttcgacaagttcagcaacagcaacagatacaagagaagacacaccggcaacaagcacttcaagtgcaaggagtgcagcaagagcttctgcgtgctgagccagctgacccagcacagaagaatccacaccagagtgaacagctacaagtgcgaggagtgcggcaaggccatcatcatctgcagcgacttcacccagcactag

SEQ ID NO: 105658 - DNA, 1254 bp, Artificial Sequence
  Description of Artificial Sequence: Synthetic coding sequence
atgagccaggacagcgtgaccttcgccgacgtggccgtgaacttcaccaaggaggagtggaccctgctggaccccgcccagagaaacctgtacagagacgtgatgctggagaacagcagaaacctggccttcatcgactgggccaccccctgcaagaccaaggacgccaccccccagcccgacatcctgcccaagagaaccttccccgaggccaacagagtgtgcctgaccagcatcagcagccagcacagcaccctgagagaggactggagatgccccaagaccgaggagccccacagacagggcgtgaacaacgtgaagccccccgccgtggcccccgagaaggacgagagccccgtgagcatctgcgaggaccacgagatgagaaaccacagcaagcccacctgcagactggtgcccagccagggcgacagcatcagacagtgcatcctgaccagagacagcagcatcttcaagtacaaccccgtgctgaacgacagccagaagacccacgagaacaacgaggacgacggcgtgctgggctggaacatccagtgggtgccctgcggcagaaagaccgagctgaagagcagcacctggaccggcagccagaacaccgtgcaccacatcagagacgagatcgacaccggcgccaacagacaccagagaaaccccttcggcaaggccttcagagaggacggcagcctgagagcccacaacacccacggcagagagaagatgtacgacttcacccagtgcgagaacaccagcagaaacaacagcatccacgccatgcagatgcagctgtacaccgccgagaccaacaagaaggactgccagaccggcgccaccagcgccaacgcccccaacagcggcagccacaagagccactgcaccggcgagaagacccacaagtgccccgagtgcggcagagccttcttctaccagagcttcctgatgagacacatgaagatccacaccggcgagaagccctacgagtgcggcaagtgcggcaaggccttcagatacagcctgcacctgaacaagcacctgagaaagcacgtggtgcagaagaagccctacgagtgcgaggagtgcggcaaggtgatcagagagagcagcaagtacacccacatcagaagccacaccggcgagaagccctacaagtgcaagacctgcggcaaggacttcgccaagagcagcggcctgaagaagcacctgaagacccacaaggacgagaagccctgcgagtag

SEQ ID NO: 105659 - DNA, 1254 bp, Artificial Sequence; identical to SEQ ID NO: 105658
  Description of Artificial Sequence: Synthetic coding sequence

SEQ ID NO: 105660 - DNA, 1452 bp, Artificial Sequence
  Description of Artificial Sequence: Synthetic coding sequence
atgaagagacacgagatggtggccaagcacctggtgatgttctactacttcgcccagcacctgtggcccgagcagaacatcagagacagcttccagaaggtgaccctgagaagatacagaaagtgcggctacgagaacctgcagctgagaaagggctgcaagagcgtggtggagtgcaagcagcacaagggcgactacagcggcctgaaccagtgcctgaagaccaccctgagcaagatcttccagtgcaacaagtacgtggaggtgttccacaagatcagcaacagcaacagacacaagatgagacacaccgagaacaagcacttcaagtgcaaggagtgcagaaagaccttctgcatgctgagccacctgacccagcacaagagaatccagaccagagtgaacttctacaagtgcgaggcctacggcagagccttcaactggagcagcaccctgaacaagcacaagagaatccacaccggcgagaagccctacaagtgcaaggagtgcggcaaggccttcaaccagaccagccacctgatcagacacaagagaatccacaccgaggagaagccctacaagtgcgaggagtgcggcaaggccttcaaccagagcagcaccctgaccacccacaacatcatccacaccggcgagatcccctacaagtgcgagaagtgcgtgagagccttcaaccaggccagcaagctgaccgagcacaagctgatccacaccggcgagaagagatacgagtgcgaggagtgcggcaaggccttcaacagaagcagcaagctgaccgagcacaagtacatccacaccggcgagaagctgtacaagtgcgaggagtgcggcaaggccttcaaccagagcagcaccctgaccacccacaagagaatccacagcggcgagaagccctacaagtgcgaggagtgcggcaaggccttcaagcagttcagcaacctgaccgaccacaagaagatccacaccggcgagaagccctacaagtgcgaggagtgcggcaaggccttcaaccagctgagcaacctgaccagacacaaggtgatccacaccggcgagaagccctacaagtgcggcgagtgcggcaaggccttcaaccagagcagcgccctgaacacccacaagatcatccacaccggcgagaacccccacaagtgcagagagagcggcaaggtgttccacctgagcagcaagctgagcacctgcaagaagatccacaccggcgagaagctgtacaagtgcgaggagtgcggcaaggccttcaacagaagcagcaccctgatcggccacaagagaatccacaccggcgagaagccctacaagtgcgaggagtgcggcaaggccttcaaccagagcagcaccctgaccacccacaagatcatccacaccgaggagaagcagtacaagtgcgacgagtgcggcaaggccagcacctag

SEQ ID NO: 105661 - DNA, 1152 bp, Artificial Sequence
  Description of Artificial Sequence: Synthetic coding sequence
atgaagagacacgagatggtggccaagcacctggtgatgttctactacttcgcccagcacctgtggcccgagcagaacatcagagacagcttccagaaggtgaccctgagaagatacagaaagtgcggctacgagaacctgcagctgagaaagggctgcaagagcgtggtggagtgcaagcagcacaagggcgactacagcggcctgaaccagtgcctgaagaccaccctgagcaagatcttccagtgcaacaagtacgtggaggtgttccacaagatcagcaacagcaacagacacaagatgagacacaccgagaacaagcacttcaagtgcaaggagtgcagaaagaccttctgcatgctgagccacctgacccagcacaagagaatccagaccagagtgaacttctacaagtgcgaggcctacggcagagccttcaactggagcagcaccctgaacaagcacaagagaatccacaccggcgagaagccctacaagtgcaaggagtgcggcaaggccttcaaccagaccagccacctgatcagacacaagagaatccacaccgaggagaagccctacaagtgcgaggagtgcggcaaggccttcaaccagagcagcaccctgaccacccacaacatcatccacaccggcgagatcccctacaagtgcgagaagtgcgtgagagccttcaaccaggccagcaagctgaccgagcacaagctgatccacaccggcgagaagagatacgagtgcgaggagtgcggcaaggccttcaacagaagcagcaagctgaccgagcacaagtacatccacaccggcgagaagctgtacaagtgcgaggagtgcggcaaggccttcaaccagagcagcaccctgaccacccacaagagaatccacagcggcgagaagccctacaagtgcgaggagtgcggcaaggccttcaagcagttcagcaacctgaccgaccacaagaagatccacaccggcgagaagccctacaagtgcgaggagtgcggcaaggccttcaaccagctgagcaacctgaccagacacaaggtgatccacaccggcgagaagccctacaagtgcggcgagtgcggcaaggccaacctgagcagcaccctgaccccccacaagaccatccacatctag

SEQ ID NO: 105662 - DNA, 1368 bp, Artificial Sequence
  Description of Artificial Sequence: Synthetic coding sequence
atgctggagaactacagcaacctggtgagcgtgggctaccacatcatcaagcccgacgtgatcagcaagctggagcagggcgaggagccctggatcgtggagggcgagttcctgctgcagagctaccccgacgaggtgtggcagaccgacgacctgatcgagagaatccaggaggaggagaacaagcccagcagacagaccgtgttcatcgagaccctgatcgaggagagaggcaacgtgcccggcaagaccttcgacgtggagaccaaccccgtgcccagcagaaagatcgcctacaagaacagcctgtgcgacagctgcgagaagtgcctgaccagcgtgagcgagtacatcagcagcgacggcagctacgccagaatgaaggccgacgagtgcagcggctgcggcaagagcctgctgcacatcaagctggagaagacccaccccggcgaccaggcctacgagttcaaccagaacggcgagccctacaccctgaacgaggagagcctgtaccagaagatcagaatcctggagaagcccttcgagtacatcgagtgccagaaggccttccagaaggacaccgtgttcgtgaaccacatggaggagaagccctacaagtggaacggcagcgagatcgccttcctgcagatgagcgacctgaccgtgcaccagaccagccacatggagatgaagccctacgagtgcagcgagtgcggcaagagcttctgcaagaagagcaagttcatcatccaccagagaacccacaccggcgagaagccctacgagtgcaaccagtgcggcaagagcttctgccagaagggcaccctgaccgtgcaccagagaacccacaccggcgagaagccctacgagtgcaacgagtgcggcaagaacttctaccagaagctgcacctgatccagcaccagagaacccacagcggcgagaagccctacgagtgcagctactgcggcaagagcttctgccagaagacccacctgacccagcaccagagaacccacagcggcgagagaccctacgtgtgccacgactgcggccccagcagaagaagccagcacctgatgcaccagaagatccacaccggcgtgaagctgtacaagtgcagcgagtgcggcaagtgcttctgcagaaagagcaccctgaccacccacctgagaacccacaccggcgagaagccctacgagtgcaacgagtgcggcaagttcttcagcagactgagctacctgaccgtgcactacagaacccacagcggcgagaagccctacgagtgcaacgagtgcggcaagaccttctacctgaacagcgccctgatgagacaccagagagtgcacaccggcgagaagccctactag

SEQ ID NO: 105663 - DNA, 1980 bp, Artificial Sequence
  Description of Artificial Sequence: Synthetic coding sequence
atgaacaagagcctgggccccgtgagcttcaaggacgtggccgtggacttcacccaggaggagtggcagcagctggaccccgagcagaagatcacctacagagacgtgatgctggagaactacagcaacctggtgagcgtgggctaccacatcatcaagcccgacgtgatcagcaagctggagcagggcgaggagccctggatcgtggagggcgagttcctgctgcagagctaccccgacgaggtgtggcagaccgacgacctgatcgagagaatccaggaggaggagaacaagcccagcagacagaccgtgttcatcgagaccctgatcgaggagagagagtacatcagcagcgacggcagctacgccagaatgaaggccgacgagtgcagcggctgcggcaagagcctgctgcacatcaagctggagaagacccaccccggcgaccaggcctacgagttcaaccagaacggcgagccctacaccctgaacgaggagagcctgtaccagaagatcagaatcctggagaagcccttcgagtacatcgagtgccagaaggccttccagaaggacaccgtgttcgtgaaccacatggaggagaagccctacaagtggaacggcagcgagatcgccttcctgcagatgagcgacctgaccgtgcaccagaccagccacatggagatgaagccctacgagtgcagcgagtgcggcaagagcttctgcaagaagagcaagttcatcatccaccagagaacccacaccggcgagaagccctacgagtgcaaccagtgcggcaagagcttctgccagaagggcaccctgaccgtgcaccagagaacccacaccggcgagaagccctacgagtgcaacgagtgcggcaagaacttctaccagaagctgcacctgatccagcaccagagaacccacagcggcgagaagccctacgagtgcagctactgcggcaagagcttctgccagaagacccacctgacccagcaccagagaacccacagcggcgagagaccctacgtgtgccacgactgcggcaagaccttcagccagaagagcgccctgaacgaccaccagaagatccacaccggcgtgaagctgtacaagtgcagcgagtgcggcaagtgcttctgcagaaagagcaccctgaccacccacctgagaacccacaccggcgagaagccctacgagtgcaacgagtgcggcaagttcttcagcagactgagctacctgaccgtgcactacagaacccacagcggcgagaagccctacgagtgcaacgagtgcggcaagaccttctacctgaacagcgccctgatgagacaccagagagtgcacaccggcgagaagccctacgagtgcaacgagtgcggcaagctgttcagccagctgagctacctgaccatccaccacagaacccacagcggcgtgaagccctacgagtgcagcgagtgcggcaagaccttctaccagaacagcgccctgtgcagacacagaagaatccacaagggcgagaagccctacgagtgctacatctgcggcaagttcttcagccagatgagctacctgaccatccaccacagaatccacagcggcgagaagccctacgagtgcagcgagtgcggcaagaccttctgccagaacagcgccctgaacagacaccagagaacccacaccggcgagaaggcctacgagtgctacgagtgcggcaagtgcttcagccagatgagctacctgaccatccaccacagaatccacagcggcgagaagcccttcgagtgcaacgagtgcggcaaggccttcagcagaatgagctacctgaccgtgcactacagaacccacagcggcgagaagccctacgagtgcaccgagtgcggcaagaagttctaccacaagagcgccttcaacagccaccagagaatccacagaagaggcaacatgaacgtgatcgacgtgggcagactgctgtag

SEQ ID NO: 105664 - DNA, 2268 bp, Artificial Sequence
  Description of Artificial Sequence: Synthetic coding sequence
atgagagccaccgccctggtgagatggaccggcagagacctggccagcagaagagcccccgccaccgccatcccccccagacccgtgggcagcggcggcgccgaggccgccgagccccaggaggacctgccccccctgagccagagcagcagattcttccaggagcagcagaagatgaacaagagcctgggccccgtgagcttcaaggacgtggccgtggacttcacccaggaggagtggcagcagctggaccccgagcagaagatcacctacagagacgtgatgctggagaactacagcaacctggtgagcgtgggctaccacatcatcaagcccgacgtgatcagcaagctggagcagggcgaggagccctggatcgtggagggcgagttcctgctgcagagctaccccgacgaggtgtggcagaccgacgacctgatcgagagaatccaggaggaggagaacaagcccagcagacagaccgtgttcatcgagaccctgatcgaggagagaggcaacgtgcccggcaagaccttcgacgtggagaccaaccccgtgcccagcagaaagatcgcctacaagaacagcctgtgcgacagctgcgagaagtgcctgaccagcgtgagcgagtacatcagcagcgacggcagctacgccagaatgaaggccgacgagtgcagcggctgcggcaagagcctgctgcacatcaagctggagaagacccaccccggcgaccaggcctacgagttcaaccagaacggcgagccctacaccctgaacgaggagagcctgtaccagaagatcagaatcctggagaagcccttcgagtacatcgagtgccagaaggccttccagaaggacaccgtgttcgtgaaccacatggaggagaagccctacaagtggaacggcagcgagatcgccttcctgcagatgagcgacctgaccgtgcaccagaccagccacatggagatgaagccctacgagtgcagcgagtgcggcaagagcttctgcaagaagagcaagttcatcatccaccagagaacccacaccggcgagaagccctacgagtgcaaccagtgcggcaagagcttctgccagaagggcaccctgaccgtgcaccagagaacccacaccggcgagaagccctacgagtgcaacgagtgcggcaagaacttctaccagaagctgcacctgatccagcaccagagaacccacagcggcgagaagccctacgagtgcagctactgcggcaagagcttctgccagaagacccacctgacccagcaccagagaacccacagcggcgagagaccctacgtgtgccacgactgcggcaagaccttcagccagaagagcgccctgaacgaccaccagaagatccacaccggcgtgaagctgtacaagtgcagcgagtgcggcaagtgcttctgcagaaagagcaccctgaccacccacctgagaacccacaccggcgagaagccctacgagtgcaacgagtgcggcaagttcttcagcagactgagctacctgaccgtgcactacagaacccacagcggcgagaagccctacgagtgcaacgagtgcggcaagaccttctacctgaacagcgccctgatgagacaccagagagtgcacaccggcgagaagccctacgagtgcaacgagtgcggcaagctgttcagccagctgagctacctgaccatccaccacagaacccacagcggcgtgaagccctacgagtgcagcgagtgcggcaagaccttctaccagaacagcgccctgtgcagacacagaagaatccacaagggcgagaagccctacgagtgctacatctgcggcaagttcttcagccagatgagctacctgaccatccaccacagaatccacagcggcgagaagccctacgagtgcagcgagtgcggcaagaccttctgccagaacagcgccctgaacagacaccagagaacccacaccggcgagaaggcctacgagtgctacgagtgcggcaagtgcttcagccagatgagctacctgaccatccaccacagaatccacagcggcgagaagcccttcgagtgcaacgagtgcggcaaggccttcagcagaatgagctacctgaccgtgcactacagaacccacagcggcgagaagccctacgagtgcaccgagtgcggcaagaagttctaccacaagagcgccttcaacagccaccagagaatccacagaagaggcaacatgaacgtgatcgacgtgggcagactgctgtag

SEQ ID NO: 105665 - DNA, 2094 bp, Artificial Sequence
  Description of Artificial Sequence: Synthetic coding sequence
atgaacaagagcctgggccccgtgagcttcaaggacgtggccgtggacttcacccaggaggagtggcagcagctggaccccgagcagaagatcacctacagagacgtgatgctggagaactacagcaacctggtgagcgtgggctaccacatcatcaagcccgacgtgatcagcaagctggagcagggcgaggagccctggatcgtggagggcgagttcctgctgcagagctaccccgacgaggtgtggcagaccgacgacctgatcgagagaatccaggaggaggagaacaagcccagcagacagaccgtgttcatcgagaccctgatcgaggagagaggcaacgtgcccggcaagaccttcgacgtggagaccaaccccgtgcccagcagaaagatcgcctacaagaacagcctgtgcgacagctgcgagaagtgcctgaccagcgtgagcgagtacatcagcagcgacggcagctacgccagaatgaaggccgacgagtgcagcggctgcggcaagagcctgctgcacatcaagctggagaagacccaccccggcgaccaggcctacgagttcaaccagaacggcgagccctacaccctgaacgaggagagcctgtaccagaagatcagaatcctggagaagcccttcgagtacatcgagtgccagaaggccttccagaaggacaccgtgttcgtgaaccacatggaggagaagccctacaagtggaacggcagcgagatcgccttcctgcagatgagcgacctgaccgtgcaccagaccagccacatggagatgaagccctacgagtgcagcgagtgcggcaagagcttctgcaagaagagcaagttcatcatccaccagagaacccacaccggcgagaagccctacgagtgcaaccagtgcggcaagagcttctgccagaagggcaccctgaccgtgcaccagagaacccacaccggcgagaagccctacgagtgcaacgagtgcggcaagaacttctaccagaagctgcacctgatccagcaccagagaacccacagcggcgagaagccctacgagtgcagctactgcggcaagagcttctgccagaagacccacctgacccagcaccagagaacccacagcggcgagagaccctacgtgtgccacgactgcggcaagaccttcagccagaagagcgccctgaacgaccaccagaagatccacaccggcgtgaagctgtacaagtgcagcgagtgcggcaagtgcttctgcagaaagagcaccctgaccacccacctgagaacccacaccggcgagaagccctacgagtgcaacgagtgcggcaagttcttcagcagactgagctacctgaccgtgcactacagaacccacagcggcgagaagccctacgagtgcaacgagtgcggcaagaccttctacctgaacagcgccctgatgagacaccagagagtgcacaccggcgagaagccctacgagtgcaacgagtgcggcaagctgttcagccagctgagctacctgaccatccaccacagaacccacagcggcgtgaagccctacgagtgcagcgagtgcggcaagaccttctaccagaacagcgccctgtgcagacacagaagaatccacaagggcgagaagccctacgagtgctacatctgcggcaagttcttcagccagatgagctacctgaccatccaccacagaatccacagcggcgagaagccctacgagtgcagcgagtgcggcaagaccttctgccagaacagcgccctgaacagacaccagagaacccacaccggcgagaaggcctacgagtgctacgagtgcggcaagtgcttcagccagatgagctacctgaccatccaccacagaatccacagcggcgagaagcccttcgagtgcaacgagtgcggcaaggccttcagcagaatgagctacctgaccgtgcactacagaacccacagcggcgagaagccctacgagtgcaccgagtgcggcaagaagttctaccacaagagcgccttcaacagccaccagagaatccacagaagaggcaacatgaacgtgatcgacgtgggcagactgctgtag

SEQ ID NO: 105666 - DNA, 1173 bp, Artificial Sequence
  Description of Artificial Sequence: Synthetic coding sequence
atggccgagatccacaacggcggcgagctgtgcgacttcatggagaacggcgagatcttcagcgagcacagctgcctgaacgcccacatgggcaccgagaacaccggcgacacctacgactgcgacgagtacggcgagaacttccccatgctgcacaacagcgcccccgccggcgagaccctgagcgtgctgaaccagtgcagaaaggccttcagcctgccccccaacgtgcaccagagaacctggatcggcgacaagagcttcgagtacagcgactgcgaggaggccttcgtggaccagagccacctgcaggccaacagaatcacccacaacggcgagaccctgtacgagcagaagcagtgcggcagagccttcacctacagcaccagccacgccgtgagcgtgaagatgcacaccgtggagaagccctacgagtgcaaggagtgcggcaagttcttcagatacagcagctacctgaacagccacatgagaacccacaccggcgagaagccctacgagtgcaaggagtgcggcaagtgcttcaccgtgagcagccacctggtggagcacgtgagaatccacaccggcgagaagccctaccagtgcaaggagtgcggcagagccttcgccggcagaagcggcctgaccaagcacgtgagaatccacaccggcgagaagccctacgagtgcaacgagtgcggcaaggcctacaacagattctacctgctgaccgagcacttcaagacccacaccgaggagaagcccttcgagtgcaaggtgtgcggcaagagcttcagaagcagcagctgcctgaagaaccacttcagaatccacaccggcatcaagccctacaagtgcaaggagtgcggcaaggccttcaccgtgagcagcagcctgcacaaccacgtgaagatccacaccggcgagaagccctacgagtgcaaggactgcggcaaggccttcgccaccagcagccagctgatcgagcacatcagaacccacaccggcgagaagccctacatctgcaaggagtgcggcaagaccttcagagccagcagccacctgcagaagcacgtgagaatccacaccggcgagaagccctacatctgcaacgagtgcggcaaggcctacaacagattctacctgctgaccaagcacctgaagacccactag

SEQ ID NO: 105667 - DNA, 1032 bp, Artificial Sequence
  Description of Artificial Sequence: Synthetic coding sequence
atggccgagatccacaacggcggcgagctgtgcgacttcatggagaacggcgagatcttcagcgagcacagctgcctgaacgcccacatgggcaccgagaacaccggcgacacctacgactgcgacgagtacggcgagaacttccccatgctgcacaacagcgcccccgccggcgagaccctgagcgtgctgaaccagtgcagaaaggccttcagcctgccccccaacgtgcaccagagaacctggatcggcgacaagagcttcgagtacagcgactgcgaggaggccttcgtggaccagagccacctgcaggccaacagaatcacccacaacggcgagaccctgtacgagcagaagcagtgcggcagagccttcacctacagcaccagccacgccgtgagcgtgaagatgcacaccgtggagaagccctacgagtgcaaggagtgcggcaagttcttcagatacagcagctacctgaacagccacatgagaacccacaccggcgagaagccctacgagtgcaaggagtgcggcaagtgcttcaccgtgagcagccacctggtggagcacgtgagaatccacaccggcgagaagccctaccagtgcaaggagtgcggcagagccttcgccggcagaagcggcctgaccaagcacgtgagaatccacaccggcgagaagccctacgagtgcaacgagtgcggcaaggcctacaacagattctacctgctgaccgagcacttcaagacccacaccgaggagaagcccttcgagtgcaaggtgtgcggcaagagcttcagaagcagcagctgcctgaagaaccacttcagaatccacaccggcatcaagccctacaagtgcaaggagtgcggcaaggccttcaccgtgagcagcagcctgcacaaccacgtgaagatccacaccggcgagaagccctacgagtgcaaggactgcggcaaggccttcgccaccagcagccagctgatcgagcacatcagaacccacacctgcaaccccagcaccctgagaggctag

SEQ ID NO: 105668 - DNA, 870 bp, Artificial Sequence
  Description of Artificial Sequence: Synthetic coding sequence
atgagcggccaccccggcagctgggagatgaacagcgtggccttcgaggacgtggccgtgaacttcacccaggaggagtgggccctgctggaccccagccagaagaacctgtacagagacgtgatgcaggagaccttcagaaacctggccagcatcggcaacaagggcgaggaccagagcatcgaggaccagtacaagaacagcagcagaaacctgagcagcttccagatccaccagagaaaccacaccggcgagaagccctacgagtgcatggagtgcggcaaggccctgggcttcagcagaagcctgaacagacacaagagaatccacaccggcgagaagagatacgagtgcaagcagtgcggcaaggccttcagcagaagcagccacctgagagaccacgagagaacccacaccggcgagaagccctacgagtgcaagcactgcggcaaggccttcagatacagcaactgcctgcactaccacgagagaacccacaccggcgagaagccctacgtgtgcatggagtgcggcaaggccttcagctgcctgagcagcctgcagggccacatcaaggcccacgccggcgaggagccctacccctgcaagcagtgcggcaaggccttcagatacgccagcagcctgcagaagcacgagaagacccacatcgcccagaagccctacgtgtgcaacaactgcggcaagggcttcagatgcagcagcagcctgagagaccacgagagaacccacaccggcgagaagccctacgagtgccagaagtgcggcaaggccttcagcagagccagcaccctgtggaagcacaagaagacccacaccggcgagaagccctacaagtgcaagaagatgtag

SEQ ID NO: 105669 - DNA, 939 bp, Artificial Sequence
  Description of Artificial Sequence: Synthetic coding sequence
atgcccaacttcaacctgaacaagaagatccccgccagagtgaagccccacgagtgcatcgtgtgcgagaagttcttcatcagacacagcagcctgcacagacacatcatcagccacagcggcaacaacccctacggctgcgaggagtgcggcaagaagccctgcacctgcaagcagtgccagaagaccagcctgagcgtgaccagagtgcacagagacaccgtgatgcacaccggcaacggccactacggctgcaccatctgcgagaaggtgttcaacatccccagcagcttccagatccaccagagaaaccacaccggcgagaagccctacgagtgcatggagtgcggcaaggccctgggcttcagcagaagcctgaacagacacaagagaatccacaccggcgagaagagatacgagtgcaagcagtgcggcaaggccttcagcagaagcagccacctgagagaccacgagagaacccacaccggcgagaagccctacgagtgcaagcactgcggcaaggccttcagatacagcaactgcctgcactaccacgagagaacccacaccggcgagaagccctacgtgtgcatggagtgcggcaaggccttcagctgcctgagcagcctgcagggccacatcaaggcccacgccggcgaggagccctacccctgcaagcagtgcggcaaggccttcagatacgccagcagcctgcagaagcacgagaagacccacatcgcccagaagccctacgtgtgcaacaactgcggcaagggcttcagatgcagcagcagcctgagagaccacgagagaacccacaccggcgagaagccctacgagtgccagaagtgcggcaaggccttcagcagagccagcaccctgtggaagcacaagaagacccacaccggcgagaagccctacaagtgcaagaagatgtag

SEQ ID NO: 105670 - DNA, 468 bp, Artificial Sequence
  Description of Artificial Sequence: Synthetic coding sequence
atgaacgccctgtgcgtgaagaacagcagctaccacagcagcctgcacagacacatcatcagccacagcggcaacaacccctacggctgcgaggagtgcggcaagaagccctgcacctgcaagcagtgccagaagaccagcctgagcgtgaccagagtgcacagagacaccgtgatgcacaccggcaacggccactacggctgcaccatctgcgagaaggtgttcaacatccccagcagcttccagatccaccagagaaaccacaccggcgagaagccctacgagtgcatggagtgcggcaaggccctgggcttcagcagaagcctgaacagacacaagagaatccacaccggcgagaagagatacgagtgcaagaagtgcggcaaggccttcagcagagccagcaccctgtggaagcacaagaagacccacaccggcgagaagccctacaagtgcaagaagatgtag

SEQ ID NO: 105671 - DNA, 888 bp, Artificial Sequence
  Description of Artificial Sequence: Synthetic coding sequence
atgaacgccctgtgcgtgaagaacagcagctaccacagcagcctgcacagacacatcatcagccacagcggcaacaacccctacggctgcgaggagtgcggcaagaagccctgcacctgcaagcagtgccagaagaccagcctgagcgtgaccagagtgcacagagacaccgtgatgcacaccggcaacggccactacggctgcaccatctgcgagaaggtgttcaacatccccagcagcttccagatccaccagagaaaccacaccggcgagaagccctacgagtgcatggagtgcggcaaggccctgggcttcagcagaagcctgaacagacacaagagaatccacaccggcgagaagagatacgagtgcaagcagtgcggcaaggccttcagcagaagcagccacctgagagaccacgagagaacccacaccggcgagaagccctacgagtgcaagcactgcggcaaggccttcagatacagcaactgcctgcactaccacgagagaacccacaccggcgagaagccctacgtgtgcatggagtgcggcaaggccttcagctgcctgagcagcctgcagggccacatcaaggcccacgccggcgaggagccctacccctgcaagcagtgcggcaaggccttcagatacgccagcagcctgcagaagcacgagaagacccacatcgcccagaagccctacgtgtgcaacaactgcggcaagggcttcagatgcagcagcagcctgagagaccacgagagaacccacaccggcgagaagccctacgagtgccagaagtgcggcaaggccttcagcagagccagcaccctgtggaagcacaagaagacccacaccggcgagaagccctacaagtgcaagaagatgtag

SEQ ID NO: 105672 - DNA, 222 bp, Artificial Sequence
  Description of Artificial Sequence: Synthetic coding sequence
atgagcggccaccccggcagctgggagatgaacagcgtggccttcgaggacgtggccgtgaacttcacccaggaggagtgggccctgctggaccccagccagaagaacctgtacagagacgtgatgcaggagaccttcagaaacctggccagcatcggcaacaagggcgaggaccagagcatcgaggaccagtacaagaacagcagcagaaacctgagatag

SEQ ID NO: 105673 - DNA, 1770 bp, Artificial Sequence
  Description of Artificial Sequence: Synthetic coding sequence
atggaggccgaggagaccatggagtgcctgcaggagttccccgagcaccacaagatgatcctggacagactgaacgagcagagagagcaggacagattcaccgacatcaccctgatcgtggacggccaccacttcaaggcccacaaggccgtgctggccgcctgcagcaagttcttctacaagttcttccaggagttcacccaggagcccctggtggagatcgagggcgtgagcaagatggccttcagacacctgatcgagttcacctacaccgccaagctgatgatccagggcgaggaggaggccaacgacgtgtggaaggccgccgagttcctgcagatgctggaggccatcaaggccctggaggtgagaaacaaggagaacagcgcccccctggaggagaacaccaccggcaagaacgaggccaagaagagaaagatcgccgagaccagcaacgtgatcaccgagagcctgcccagcgccgagagcgagcccgtggagatcgaggtggagatcgccgagggcaccatcgaggtggaggacgagggcatcgagaccctggaggaggtggccagcgccaagcagagcgtgaagtacatccagagcaccggcagcagcgacgacagcgccctggccctgctggccgacatcaccagcaagtacagacagggcgacagaaagggccagatcaaggaggacggctgccccagcgaccccaccagcaagcaggagcacatgaagagccacagcaccgagagcttcaagtgcgagatctgcaacaagagatacctgagagagagcgcctggaagcagcacctgaactgctaccacctggaggagggcggcgtgagcaagaagcagagaaccggcaagaagatccacgtgtgccagtactgcgagaagcagttcgaccacttcggccacttcaaggagcacctgagaaagcacaccggcgagaagcccttcgagtgccccaactgccacgagagattcgccagaaacagcaccctgaagtgccacctgaccgcctgccagaccggcgtgggcgccaagaagggcagaaagaagctgtacgagtgccaggtgtgcaacagcgtgttcaacagctgggaccagttcaaggaccacctggtgatccacaccggcgacaagcccaaccactgcaccctgtgcgacctgtggttcatgcagggcaacgagctgagaagacacctgagcgacgcccacaacatcagcgagagactggtgaccgaggaggtgctgagcgtggagaccagagtgcagaccgagcccgtgaccagcatgaccatcatcgagcaggtgggcaaggtgcacgtgctgcccctgctgcaggtgcaggtggacagcgcccaggtgaccgtggagcaggtgcaccccgacctgctgcaggacagccaggtgcacgacagccacatgagcgagctgcccgagcaggtgcaggtgagctacctggaggtgggcagaatccagaccgaggagggcaccgaggtgcacgtggaggagctgcacgtggagagagtgaaccagatgcccgtggaggtgcagaccgagctgctggaggccgacctggaccacgtgacccccgagatcatgaaccaggaggagagagagagcagccaggccgacgccgccgaggccgccagagaggaccacgaggacgccgaggacctggagaccaagcccaccgtggacagcgaggccgagaaggccgagaacgaggacagaaccgccctgcccgtgctggagtag

SEQ ID NO: 105674 - DNA, 1872 bp, Artificial Sequence
  Description of Artificial Sequence: Synthetic coding sequence
atggaggccgaggagaccatggagtgcctgcaggagttccccgagcaccacaagatgatcctggacagactgaacgagcagagagagcaggacagattcaccgacatcaccctgatcgtggacggccaccacttcaaggcccacaaggccgtgctggccgcctgcagcaagttcttctacaagttcttccaggagttcacccaggagcccctggtggagatcgagggcgtgagcaagatggccttcagacacctgatcgagttcacctacaccgccaagctgatgatccagggcgaggaggaggccaacgacgtgtggaaggccgccgagttcctgcagatgctggaggccatcaaggccctggaggtgagaaacaaggagaacagcgcccccctggaggagaacaccaccggcaagaacgaggccaagaagagaaagatcgccgagaccagcaacgtgatcaccgagagcctgcccagcgccgagagcgagcccgtggagatcgaggtggagatcgccgagggcaccatcgaggtggaggacgagggcatcgagaccctggaggaggtggccagcgccaagcagagcgtgaagtacatccagagcaccggcagcagcgacgacagcgccctggccctgctggccgacatcaccagcaagtacagacagggcgacagaaagggccagatcaaggaggacggctgccccagcgaccccaccagcaagcaggtggagggcatcgagatcgtggagctgcagctgagccacgtgaaggacctgttccactgcgagaagtgcaacagaagcttcaagctgttctaccacttcaaggagcacatgaagagccacagcaccgagagcttcaagtgcgagatctgcaacaagagatacctgagagagagcgcctggaagcagcacctgaactgctaccacctggaggagggcggcgtgagcaagaagcagagaaccggcaagaagatccacgtgtgccagtactgcgagaagcagttcgaccacttcggccacttcaaggagcacctgagaaagcacaccggcgagaagcccttcgagtgccccaactgccacgagagattcgccagaaacagcaccctgaagtgccacctgaccgcctgccagaccggcgtgggcgccaagaagggcagaaagaagctgtacgagtgccaggtgtgcaacagcgtgttcaacagctgggaccagttcaaggaccacctggtgatccacaccggcgacaagcccaaccactgcaccctgtgcgacctgtggttcatgcagggcaacgagctgagaagacacctgagcgacgcccacaacatcagcgagagactggtgaccgaggaggtgctgagcgtggagaccagagtgcagaccgagcccgtgaccagcatgaccatcatcgagcaggtgggcaaggtgcacgtgctgcccctgctgcaggtgcaggtggacagcgcccaggtgaccgtggagcaggtgcaccccgacctgctgcaggacagccaggtgcacgacagccacatgagcgagctgcccgagcaggtgcaggtgagctacctggaggtgggcagaatccagaccgaggagggcaccgaggtgcacgtggaggagctgcacgtggagagagtgaaccagatgcccgtggaggtgcagaccgagctgctggaggccgacctggaccacgtgacccccgagatcatgaaccaggaggagagagagagcagccaggccgacgccgccgaggccgccagagaggaccacgaggacgccgaggacctggagaccaagcccaccgtggacagcgaggccgagaaggccgagaacgaggacagaaccgccctgcccgtgctggagtag

SEQ ID NO: 105675 - DNA, 1770 bp, Artificial Sequence; identical to SEQ ID NO: 105673
  Description of Artificial Sequence: Synthetic coding sequence

SEQ ID NO: 105676 - DNA, 456 bp, Artificial Sequence
  Description of Artificial Sequence: Synthetic coding sequence
atggaggccgaggagaccatggagtgcctgcaggagttccccgagcaccacaagatgatcctggacagactgaacgagcagagagagcaggacagattcaccgacatcaccctgatcgtggacggccaccacttcaaggcccacaaggccgtgctggccgcctgcagcaagttcttctacaagttcttccaggagttcacccaggagcccctggtggagatcgagggcgtgagcaagatggccttcagacacctgatcgagttcacctacaccgccaagctgatgatccagggcgaggaggaggccaacgacgtgtggaaggccgccgagttcctgcagatgctggaggccatcaaggccctggaggtgagaaacaaggagaacagcgcccccctggaggagaacaccaccggcaagaacgaggccaagaagagaaagatcgccgagaccagctag

SEQ ID NO: 105677 - DNA, 1872 bp, Artificial Sequence; identical to SEQ ID NO: 105674
  Description of Artificial Sequence: Synthetic coding sequence

SEQ ID NO: 105678 - DNA, 420 bp, Artificial Sequence
  Description of Artificial Sequence: Synthetic coding sequence
atggaggccgaggagaccatggagtgcctgcaggagttccccgagcaccacaagatgatcctggacagactgaacgagcagagagagcaggacagattcaccgacatcaccctgatcgtggacggccaccacttcaaggcccacaaggccgtgctggccgcctgcagcaagttcttctacaagttcttccaggagttcacccaggagcccctggtggagatcgagggcgtgagcaagatggccttcagacacctgatcgagttcacctacaccgccaagctgatgatccagggcgaggaggaggccaacgacgtgtggaaggccgccgagttcctgcagatgctggaggccatcaaggccctggaggtgagaaacaaggagaacagcgcccccctggaggagaacaccaccggcaagtag

SEQ ID NO: 105679 - DNA, 1770 bp, Artificial Sequence; identical to SEQ ID NO: 105673
  Description of Artificial Sequence: Synthetic coding sequence

SEQ ID NO: 105680 - DNA, 798 bp, Artificial Sequence
  Description of Artificial Sequence: Synthetic coding sequence
atggaggccgaggagaccatggagtgcctgcaggagttccccgagcaccacaagatgatcctggacagactgaacgagcagagagagcaggacagattcaccgacatcaccctgatcgtggacggccaccacttcaaggcccacaaggccgtgctggccgcctgcagcaagttcttctacaagttcttccaggagttcacccaggagcccctggtggagatcgagggcgtgagcaagatggccttcagacacctgatcgagttcacctacaccgccaagctgatgatccagggcgaggaggaggccaacgacgtgtggaaggccgccgagttcctgcagatgctggaggccatcaaggccctggaggtgagaaacaaggagaacagcgcccccctggaggagaacaccaccggcaagaacgaggccaagaagagaaagatcgccgagaccagcaacgtgatcaccgagagcctgcccagcgccgagagcgagcccgtggagatcgaggtggagatcgccgagggcaccatcgaggtggaggacgagggcatcgagaccctggaggaggtggccagcgccaagcagagcgtgaagtacatccagagcaccggcagcagcgacgacagcgccctggccctgctggccgacatcaccagcaagtacagacagggcgacagaaagggccagatcaaggaggacggctgccccagcgaccccaccagcaagcaggagcacatgaagagccacagcaccgagagcttcaagtgcgagatctgcaacaagagatacctgagatag

SEQ ID NO: 105681 - DNA, 2121 bp, Artificial Sequence
  Description of Artificial Sequence: Synthetic coding sequence
atggccctgcccagcccccaggtgctgatgggcctgcccgccctgctgatgggccccgcccagcacaccagctggccctgcggcagcgccgtgcccaccctgaagagcatggtgaccttcgaggacgtggccgtgtacttcagccaggaggagtgggagctgctggacgccgcccagagacacctgtaccacagcgtgatgctggagaacctggagctggtgaccagcctgggcagctggcacggcgtggagggcgagggcgcccaccccaagcagaacgtgagcgtggaggtgctgcaggtgagaatccccaacgccgaccccagcaccaagaaggccaacagctgcgacatgtgcggccccttcctgaaggacatcctgcacctggccgagcaccagggcacccagagcgaggagaagccctacacctgcggcgcctgcggcagagacttctggctgaacgccaacctgcaccagcaccagaaggagcacagcggcggcaagcccttcagatggtacaaggacagagacgccctgatgaagagcagcaaggtgcacctgagcgagaaccccttcacctgcagagagggcggcaaggtgatcctgggcagctgcgacctgctgcagctgcaggccgtggacagcggccagaagccctacagcaacctgggccagctgcccgaggtgtgcaccacccagaagctgttcgagtgcagcaactgcggcaaggccttcctgaagagcagcaccctgcccaaccacctgagaacccacagcgaggagatccccttcacctgccccaccggcggcaacttcctggaggagaagagcatcctgggcaacaagaagttccacaccggcgagatcccccacgtgtgcaaggagtgcggcaaggccttcagccacagcagcaagctgagaaagcaccagaagttccacaccgaggtgaagtactacgagtgcatcgcctgcggcaagaccttcaaccacaagctgaccttcgtgcaccaccagagaatccacagcggcgagagaccctacgagtgcgacgagtgcggcaaggccttcagcaacagaagccacctgatcagacacgagaaggtgcacaccggcgagagacccttcgagtgcctgaagtgcggcagagccttcagccagagcagcaacttcctgagacaccagaaggtgcacacccaggtgagaccctacgagtgcagccagtgcggcaagagcttcagcagaagcagcgccctgatccagcactggagagtgcacaccggcgagagaccctacgagtgcagcgagtgcggcagagccttcaacaacaacagcaacctggcccagcaccagaaggtgcacaccggcgagagacccttcgagtgcagcgagtgcggcagagacttcagccagagcagccacctgctgagacaccagaaggtgcacaccggcgagagacccttcgagtgctgcgactgcggcaaggccttcagcaacagcagcaccctgatccagcaccagaaggtgcacaccggccagagaccctacgagtgcagcgagtgcagaaagagcttcagcagaagcagcagcctgatccagcactggagaatccacaccggcgagaagccctacgagtgcagcgagtgcggcaaggccttcgcccacagcagcaccctgatcgagcactggagagtgcacaccaaggagagaccctacgagtgcaacgagtgcggcaagttcttcagccagaacagcatcctgatcaagcaccagaaggtgcacaccggcgagaagccctacaagtgcagcgagtgcggcaagttcttcagcagaaagagcagcctgatctgccactggagagtgcacaccggcgagagaccctacgagtgcagcgagtgcggcagagccttcagcagcaacagccacctggtgagacaccagagagtgcacacccaggagagaccctacgagtgcatccagtgcggcaaggccttcagcgagagaagcaccctggtgagacaccagaaggtgcacaccagagagagaacctacgagtgcagccagtgcggcaagctgttcagccacctgtgcaacctggcccagcacaagaagatccacacctag

SEQ ID NO: 105682 - DNA, 1191 bp, Artificial Sequence
  Description of Artificial Sequence: Synthetic coding sequence
cccaccctgaagagcatggtgaccttcgaggacgtggccgtgtacttcagccaggaggagtgggagctgctggacgccgcccagagacacctgtaccacagcgtgatgctggagaacctggagctggtgaccagcctgggcaacgccctgagccagcacgtgtgcctgttccccatcgagagcagcgtgcaccccaaggccagaagctgggtgctgctgcccagcagagtgagctgctgcagatgctggggcgccgaggtgctgctgggcgtggagggcgagggcgcccaccccaagcagaacgtgagcgtggaggtgctgcagcaccagaaggagcacagcggcggcaagcccttcagatggtacaaggacagcagcggccagaagccctacagcaacctgggccagctgcccgaggtgtgcaccacccagaagctgttcgagtgcagcaactgcggcaaggccttcctgaagagcagcaccctgcccaaccacctgagaacccacagcgaggagatccccttcacctgccccaccggcggcaacttcctggaggagaagagcatcctgggcaacaagaagttccacaccggcgagatcccccacgtgtgcaaggagtgcggcaaggccttcagccacagcagcaagctgagaaagcaccagaagttccacaccgaggtgagaccctacgagtgcagccagtgcggcaagagcttcagcagaagcagcgccctgatccagcactggagaatccacaccggcgagaagccctacgagtgcagcgagtgcggcaaggccttcgcccacagcagcaccctgatcgagcactggagagtgcacaccaaggagagaccctacgagtgcaacgagtgcggcaagttcttcagccagaacagcatcctgatcaagcaccagaaggtgcacaccggcgagaagccctacaagtgcagcgagtgcggcaagttcttcagcagaaagagcagcctgatctgccactggagagtgcacaccggcgagagaccctacgagtgcagcgagtgcggcagagccttcagcagcaacagccacctggtgagacaccagagagtgcacacccaggagagaccctacgagtgcatccagtgcggcaaggccttcagcgagagaagcaccctggtgagacaccagaaggtgcacaccagagagagatag

SEQ ID NO: 105683 - DNA, 1965 bp, Artificial Sequence
  Description of Artificial Sequence: Synthetic coding sequence
atggccttcagagacgtggccgtggacttcacccaggacgagtggagactgctgagccccgcccagagaaccctgtacagagaggtgatgctggagaactacagcaacctggtgagcctgggcatcagcttcagcaagcccgagctgatcacccagctggagcagggcaaggagacctggagagaggagaagaagtgcagccccgccacctgccccgccgaccccgagcccgagctgtacctggaccccttctgcccccccggcttcagcagccagaagttccccatgcagcacgtgctgtgcaaccaccccccctggatcttcacctgcctgtgcgccgagggcaacatccagcccggcgaccccggccccggcgaccaggagaagcagcagcaggccagcgagggcagaccctggagcgaccaggccgagggccccgagggcgagggcgccatgcccctgttcggcagaaccaagaagagaaccctgggcgccttcagcagacccccccagagacagcccgtgagcagcagaaacggcctgagaggcgtggagctggaggccagccccgcccagagcggcaaccccgaggagaccgacaagctgctgaagagaatcgaggtgctgggcttcggcaccgtgaactgcggcgagtgcggcctgagcttcagcaagatgaccaacctgctgagccaccagagaatccacagcggcgagaagccctacgtgtgcggcgtgtgcgagaagggcttcagcctgaagaagagcctggccagacaccagaaggcccacagcggcgagaagcccatcgtgtgcagagagtgcggcagaggcttcaacagaaagagcaccctgatcatccacgagagaacccacagcggcgagaagccctacatgtgcagcgagtgcggcagaggcttcagccagaagagcaacctgatcatccaccagagaacccacagcggcgagaagccctacgtgtgcagagagtgcggcaagggcttcagccagaagagcgccgtggtgagacaccagagaacccacctggaggagaagaccatcgtgtgcagcgactgcggcctgggcttcagcgacagaagcaacctgatcagccaccagagaacccacagcggcgagaagccctacgcctgcaaggagtgcggcagatgcttcagacagagaaccaccctggtgaaccaccagagaacccacagcaaggagaagccctacgtgtgcggcgtgtgcggccacagcttcagccagaacagcaccctgatcagccacagaagaacccacaccggcgagaagccctacgtgtgcggcgtgtgcggcagaggcttcagcctgaagagccacctgaacagacaccagaacatccacagcggcgagaagcccatcgtgtgcaaggactgcggcagaggcttcagccagcagagcaacctgatcagacaccagagaacccacagcggcgagaagcccatggtgtgcggcgagtgcggcagaggcttcagccagaagagcaacctggtggcccaccagagaacccacagcggcgagagaccctacgtgtgcagagagtgcggcagaggcttcagccaccaggccggcctgatcagacacaagagaaagcacagcagagagaagccctacatgtgcagacagtgcggcctgggcttcggcaacaagagcgccctgatcacccacaagagagcccacagcgaggagaagccctgcgtgtgcagagagtgcggccagggcttcctgcagaagagccacctgaccctgcaccagatgacccacaccggcgagaagccctacgtgtgcaagacctgcggcagaggcttcagcctgaagagccacctgagcagacacagaaagaccaccagcgtgcaccacagactgcccgtgcagcccgaccccgagccctgcgccggccagcccagcgacagcctgtacagcctgtag

SEQ ID NO: 105684 - DNA, 300 bp, Artificial Sequence
  Description of Artificial Sequence: Synthetic coding sequence
atggccttcagagacgtggccgtggacttcacccaggacgagtggagactgctgagccccgcccagagaaccctgtacagagaggtgatgctggagaactacagcaacctggtgagcctgggcatcagcttcagcaagcccgagctgatcacccagctggagcagggcaaggagacctggagagaggagaagaagtgcagccccgccacctgccccgaccaccaggagtacggcaacaactgcgacctgcagaaggaggccgaccccgagcccgagctgtacctggaccccttctgctag

SEQ ID NO: 105685 - DNA, 1962 bp, Artificial Sequence
  Description of Artificial Sequence: Synthetic coding sequence
atggccttcagagacgtggccgtggacttcacccaggacgagtggagactgctgagccccgcccagagaaccctgtacagagaggtgatgctggagaactacagcaacctggtgagcctgggcatcagcttcagcaagcccgagctgatcacccagctggagcagggcaaggagacctggagagaggagaagaagtgcagccccgccacctgccccgaccccgagcccgagctgtacctggaccccttctgcccccccggcttcagcagccagaagttccccatgcagcacgtgctgtgcaaccaccccccctggatcttcacctgcctgtgcgccgagggcaacatccagcccggcgaccccggccccggcgaccaggagaagcagcagcaggccagcgagggcagaccctggagcgaccaggccgagggccccgagggcgagggcgccatgcccctgttcggcagaaccaagaagagaaccctgggcgccttcagcagacccccccagagacagcccgtgagcagcagaaacggcctgagaggcgtggagctggaggccagccccgcccagagcggcaaccccgaggagaccgacaagctgctgaagagaatcgaggtgctgggcttcggcaccgtgaactgcggcgagtgcggcctgagcttcagcaagatgaccaacctgctgagccaccagagaatccacagcggcgagaagccctacgtgtgcggcgtgtgcgagaagggcttcagcctgaagaagagcctggccagacaccagaaggcccacagcggcgagaagcccatcgtgtgcagagagtgcggcagaggcttcaacagaaagagcaccctgatcatccacgagagaacccacagcggcgagaagccctacatgtgcagcgagtgcggcagaggcttcagccagaagagcaacctgatcatccaccagagaacccacagcggcgagaagccctacgtgtgcagagagtgcggcaagggcttcagccagaagagcgccgtggtgagacaccagagaacccacctggaggagaagaccatcgtgtgcagcgactgcggcctgggcttcagcgacagaagcaacctgatcagccaccagagaacccacagcggcgagaagccctacgcctgcaaggagtgcggcagatgcttcagacagagaaccaccctggtgaaccaccagagaacccacagcaaggagaagccctacgtgtgcggcgtgtgcggccacagcttcagccagaacagcaccctgatcagccacagaagaacccacaccggcgagaagccctacgtgtgcggcgtgtgcggcagaggcttcagcctgaagagccacctgaacagacaccagaacatccacagcggcgagaagcccatcgtgtgcaaggactgcggcagaggcttcagccagcagagcaacctgatcagacaccagagaacccacagcggcgagaagcccatggtgtgcggcgagtgcggcagaggcttcagccagaagagcaacctggtggcccaccagagaacccacagcggcgagagaccctacgtgtgcagagagtgcggcagaggcttcagccaccaggccggcctgatcagacacaagagaaagcacagcagagagaagccctacatgtgcagacagtgcggcctgggcttcggcaacaagagcgccctgatcacccacaagagagcccacagcgaggagaagccctgcgtgtgcagagagtgcggccagggcttcctgcagaagagccacctgaccctgcaccagatgacccacaccggcgagaagccctacgtgtgcaagacctgcggcagaggcttcagcctgaagagccacctgagcagacacagaaagaccaccagcgtgcaccacagactgcccgtgcagcccgaccccgagccctgcgccggccagcccagcgacagcctgtacagcctgtag

SEQ ID NO: 105686 - DNA, 1974 bp, Artificial Sequence
  Description of Artificial Sequence: Synthetic coding sequence
atggcccacatggccttcagagacgtggccgtggacttcacccaggacgagtggagactgctgagccccgcccagagaaccctgtacagagaggtgatgctggagaactacagcaacctggtgagcctgggcatcagcttcagcaagcccgagctgatcacccagctggagcagggcaaggagacctggagagaggagaagaagtgcagccccgccacctgccccgccgaccccgagcccgagctgtacctggaccccttctgcccccccggcttcagcagccagaagttccccatgcagcacgtgctgtgcaaccaccccccctggatcttcacctgcctgtgcgccgagggcaacatccagcccggcgaccccggccccggcgaccaggagaagcagcagcaggccagcgagggcagaccctggagcgaccaggccgagggccccgagggcgagggcgccatgcccctgttcggcagaaccaagaagagaaccctgggcgccttcagcagacccccccagagacagcccgtgagcagcagaaacggcctgagaggcgtggagctggaggccagccccgcccagagcggcaaccccgaggagaccgacaagctgctgaagagaatcgaggtgctgggcttcggcaccgtgaactgcggcgagtgcggcctgagcttcagcaagatgaccaacctgctgagccaccagagaatccacagcggcgagaagccctacgtgtgcggcgtgtgcgagaagggcttcagcctgaagaagagcctggccagacaccagaaggcccacagcggcgagaagcccatcgtgtgcagagagtgcggcagaggcttcaacagaaagagcaccctgatcatccacgagagaacccacagcggcgagaagccctacatgtgcagcgagtgcggcagaggcttcagccagaagagcaacctgatcatccaccagagaacccacagcggcgagaagccctacgtgtgcagagagtgcggcaagggcttcagccagaagagcgccgtggtgagacaccagagaacccacctggaggagaagaccatcgtgtgcagcgactgcggcctgggcttcagcgacagaagcaacctgatcagccaccagagaacccacagcggcgagaagccctacgcctgcaaggagtgcggcagatgcttcagacagagaaccaccctggtgaaccaccagagaacccacagcaaggagaagccctacgtgtgcggcgtgtgcggccacagcttcagccagaacagcaccctgatcagccacagaagaacccacaccggcgagaagccctacgtgtgcggcgtgtgcggcagaggcttcagcctgaagagccacctgaacagacaccagaacatccacagcggcgagaagcccatcgtgtgcaaggactgcggcagaggcttcagccagcagagcaacctgatcagacaccagagaacccacagcggcgagaagcccatggtgtgcggcgagtgcggcagaggcttcagccagaagagcaacctggtggcccaccagagaacccacagcggcgagagaccctacgtgtgcagagagtgcggcagaggcttcagccaccaggccggcctgatcagacacaagagaaagcacagcagagagaagccctacatgtgcagacagtgcggcctgggcttcggcaacaagagcgccctgatcacccacaagagagcccacagcgaggagaagccctgcgtgtgcagagagtgcggccagggcttcctgcagaagagccacctgaccctgcaccagatgacccacaccggcgagaagccctacgtgtgcaagacctgcggcagaggcttcagcctgaagagccacctgagcagacacagaaagaccaccagcgtgcaccacagactgcccgtgcagcccgaccccgagccctgcgccggccagcccagcgacagcctgtacagcctgtag

SEQ ID NO: 105687 - DNA, 1965 bp, Artificial Sequence; identical to SEQ ID NO: 105683
  Description of Artificial Sequence: Synthetic coding sequence

SEQ ID NO: 105688 - DNA, 1776 bp, Artificial Sequence
  Description of Artificial Sequence: Synthetic coding sequence
atgtgcaacggcagaaagaccgtgctggccgaccccgagcccgagctgtacctggaccccttctgcccccccggcttcagcagccagaagttccccatgcagcacgtgctgtgcaaccaccccccctggatcttcacctgcctgtgcgccgagggcaacatccagcccggcgaccccggccccggcgaccaggagaagcagcagcaggccagcgagggcagaccctggagcgaccaggccgagggccccgagggcgagggcgccatgcccctgttcggcagaaccaagaagagaaccctgggcgccttcagcagacccccccagagacagcccgtgagcagcagaaacggcctgagaggcgtggagctggaggccagccccgcccagagcggcaaccccgaggagaccgacaagctgctgaagagaatcgaggtgctgggcttcggcaccgtgaactgcggcgagtgcggcctgagcttcagcaagatgaccaacctgctgagccaccagagaatccacagcggcgagaagccctacgtgtgcggcgtgtgcgagaagggcttcagcctgaagaagagcctggccagacaccagaaggcccacagcggcgagaagcccatcgtgtgcagagagtgcggcagaggcttcaacagaaagagcaccctgatcatccacgagagaacccacagcggcgagaagccctacatgtgcagcgagtgcggcagaggcttcagccagaagagcaacctgatcatccaccagagaacccacagcggcgagaagccctacgtgtgcagagagtgcggcaagggcttcagccagaagagcgccgtggtgagacaccagagaacccacctggaggagaagaccatcgtgtgcagcgactgcggcctgggcttcagcgacagaagcaacctgatcagccaccagagaacccacagcggcgagaagccctacgcctgcaaggagtgcggcagatgcttcagacagagaaccaccctggtgaaccaccagagaacccacagcaaggagaagccctacgtgtgcggcgtgtgcggccacagcttcagccagaacagcaccctgatcagccacagaagaacccacaccggcgagaagccctacgtgtgcggcgtgtgcggcagaggcttcagcctgaagagccacctgaacagacaccagaacatccacagcggcgagaagcccatcgtgtgcaaggactgcggcagaggcttcagccagcagagcaacctgatcagacaccagagaacccacagcggcgagaagcccatggtgtgcggcgagtgcggcagaggcttcagccagaagagcaacctggtggcccaccagagaacccacagcggcgagagaccctacgtgtgcagagagtgcggcagaggcttcagccaccaggccggcctgatcagacacaagagaaagcacagcagagagaagccctacatgtgcagacagtgcggcctgggcttcggcaacaagagcgccctgatcacccacaagagagcccacagcgaggagaagccctgcgtgtgcagagagtgcggccagggcttcctgcagaagagccacctgaccctgcaccagatgacccacaccggcgagaagccctacgtgtgcaagacctgcggcagaggcttcagcctgaagagccacctgagcagacacagaaagaccaccagcgtgcaccacagactgcccgtgcagcccgaccccgagccctgcgccggccagcccagcgacagcctgtacagcctgtag

SEQ ID NO: 105689 - DNA, 540 bp, Artificial Sequence
  Description of Artificial Sequence: Synthetic coding sequence
atggccttcagagacgtggccgtggacttcacccaggacgagtggagactgctgagccccgcccagagaaccctgtacagagaggtgatgctggagaactacagcaacctggtgagcctgggcatcagcttcagcaagcccgagctgatcacccagctggagcagggcaaggagacctggagagaggagaagaagtgcagccccgccacctgccccgccgaccccgagcccgagctgtacctggaccccttctgcccccccggcttcagcagccagaagttccccatgcagcacgtgctgtgcaaccaccccccctggatcttcacctgcctgtgcgccgagggcaacatccagcccggcgaccccggccccggcgaccaggagaagcagcagcaggccagcgagggcagaccctggagcgaccaggccgagggccccgagggcgagggcgccatgcccctgttcggcagaaccaagaagagaaccctgggcgccttcagcagacccccccagagacagcccgtgagcagcagaaactag

SEQ ID NO: 105690 - DNA, 432 bp, Artificial Sequence
  Description of Artificial Sequence: Synthetic coding sequence
atggccttcagagacgtggccgtggacttcacccaggacgagtggagactgctgagccccgcccagagaaccctgtacagagaggtgatgctggagaactacagcaacctggtgagcctgggcatcagcttcagcaagcccgagctgatcacccagctggagcagggcaaggagacctggagagaggagaagaagtgcagccccgccacctgccccgccgaccccgagcccgagctgtacctggaccccttctgcccccccggcttcagcagccagaagttccccatgcagcacgtgctgtgcaaccaccccccctggatcttcacctgcctgtgcgccgagggcaacatccagcccggcgaccccggccccggcgaccaggagaagcagcagcaggccagcgagggcagaccctggagcgaccaggcctag

SEQ ID NO: 105691 - DNA, 1680 bp, Artificial Sequence
  Description of Artificial Sequence: Synthetic coding sequence
atgcagcacgtgctgtgcaaccaccccccctggatcttcacctgcctgtgcgccgagggcaacatccagcccggcgaccccggccccggcgaccaggagaagcagcagcaggccagcgagggcagaccctggagcgaccaggccgagggccccgagggcgagggcgccatgcccctgttcggcagaaccaagaagagaaccctgggcgccttcagcagacccccccagagacagcccgtgagcagcagaaacggcctgagaggcgtggagctggaggccagccccgcccagagcggcaaccccgaggagaccgacaagctgctgaagagaatcgaggtgctgggcttcggcaccgtgaactgcggcgagtgcggcctgagcttcagcaagatgaccaacctgctgagccaccagagaatccacagcggcgagaagccctacgtgtgcggcgtgtgcgagaagggcttcagcctgaagaagagcctggccagacaccagaaggcccacagcggcgagaagcccatcgtgtgcagagagtgcggcagaggcttcaacagaaagagcaccctgatcatccacgagagaacccacagcggcgagaagccctacatgtgcagcgagtgcggcagaggcttcagccagaagagcaacctgatcatccaccagagaacccacagcggcgagaagccctacgtgtgcagagagtgcggcaagggcttcagccagaagagcgccgtggtgagacaccagagaacccacctggaggagaagaccatcgtgtgcagcgactgcggcctgggcttcagcgacagaagcaacctgatcagccaccagagaacccacagcggcgagaagccctacgcctgcaaggagtgcggcagatgcttcagacagagaaccaccctggtgaaccaccagagaacccacagcaaggagaagccctacgtgtgcggcgtgtgcggccacagcttcagccagaacagcaccctgatcagccacagaagaacccacaccggcgagaagccctacgtgtgcggcgtgtgcggcagaggcttcagcctgaagagccacctgaacagacaccagaacatccacagcggcgagaagcccatcgtgtgcaaggactgcggcagaggcttcagccagcagagcaacctgatcagacaccagagaacccacagcggcgagaagcccatggtgtgcggcgagtgcggcagaggcttcagccagaagagcaacctggtggcccaccagagaacccacagcggcgagagaccctacgtgtgcagagagtgcggcagaggcttcagccaccaggccggcctgatcagacacaagagaaagcacagcagagagaagccctacatgtgcagacagtgcggcctgggcttcggcaacaagagcgccctgatcacccacaagagagcccacagcgaggagaagccctgcgtgtgcagagagtgcggccagggcttcctgcagaagagccacctgaccctgcaccagatgacccacaccggcgagaagccctacgtgtgcaagacctgcggcagaggcttcagcctgaagagccacctgagcagacacagaaagaccaccagcgtgcaccacagactgcccgtgcagcccgaccccgagccctgcgccggccagcccagcgacagcctgtacagcctgtag

SEQ ID NO: 105692 - DNA, 1680 bp, Artificial Sequence; identical to SEQ ID NO: 105691
  Description of Artificial Sequence: Synthetic coding sequence

SEQ ID NO: 105693 - DNA, 1284 bp, Artificial Sequence
  Description of Artificial Sequence: Synthetic coding sequence
atgaccctggtgaccgccggcggcgcctggaccggccccggctgctggcacgaggtgaaggacgaggagagcagcagcgagcagagcatcagcatcgccgtgagccacgtgaacaccagcaaggccggcctgcccgcccagaccgccctgccctgcgacatctgcggccccatcctgaaggacatcctgcacctggacgagcaccagggcacccaccacggcctgaagctgcacacctgcggcgcctgcggcagacagttctggttcagcgccaacctgcaccagtaccagaagtgctacagcatcgagcagcccctgagaagagacaagagcgaggccagcatcgtgaagaactgcaccgtgagcaaggagccccaccccagcgagaagcccttcacctgcaaggaggagcagaagaacttccaggccaccctgggcggctgccagcagaaggccatccacagcaagagaaagacccacagaagcaccgagagcggcgacgccttccacggcgagcagatgcactacaagtgcagcgagtgcggcaaggccttcagcagaaaggacaccctggtgcagcaccagagaatccacagcggcgagaagccctacgagtgcagcgagtgcggcaaggccttcagcagaaaggccaccctggtgcagcaccagagaatccacaccggcgagagaccctacgagtgcagcgagtgcggcaagaccttcagcagaaaggacaacctgacccagcacaagagaatccacaccggcgagatgccctacaagtgcaacgagtgcggcaagtacttcagccaccacagcaacctgatcgtgcaccagagagtgcacaacggcgccagaccctacaagtgcagcgactgcggcaaggtgttcagacacaagagcaccctggtgcagcacgagagcatccacaccggcgagaacccctacgactgcagcgactgcggcaagagcttcggccacaagtacaccctgatcaagcaccagagaatccacaccgagagcaagcccttcgagtgcatcgagtgcggcaagttcttcagcagaagcagcgactacatcgcccaccagagagtgcacaccggcgagagacccttcgtgtgcagcaagtgcggcaaggacttcatcagaaccagccacctggtgagacaccagagagtgcacaccggcgagagaccctacgagtgcagcgagtgcggcaaggcctacagcctgagcagccacctgaacagacaccagaaggtgcacaccgccggcagactgtag

SEQ ID NO: 105694 - DNA, 1485 bp, Artificial Sequence
  Description of Artificial Sequence: Synthetic coding sequence
ctgagatggaaccacagaagcagaagcagcggcctgctgggcggcagcgaggtgaccgaggccggcggctgcggcagaagcagatgcagcctgtgcggcgtggccagacagagaagacccagactgagacccagaggcagaaccaccgccgtgcccggcagcagagacctgggcccccccagaggcagcggctggagcaccaactgcgacggcggcggcagaggcgacggccccggcgccggctgctggcacgaggtgaaggacgaggagagcagcagcgagcagagcatcagcatcgccgtgagccacgtgaacaccagcaaggccggcctgcccgcccagaccgccctgccctgcgacatctgcggccccatcctgaaggacatcctgcacctggacgagcaccagggcacccaccacggcctgaagctgcacacctgcggcgcctgcggcagacagttctggttcagcgccaacctgcaccagtaccagaagtgctacagcatcgagcagcccctgagaagagacaagagcgaggccagcatcgtgaagaactgcaccgtgagcaaggagccccaccccagcgagaagcccttcacctgcaaggaggagcagaagaacttccaggccaccctgggcggctgccagcagaaggccatccacagcaagagaaagacccacagaagcaccgagagcggcgacgccttccacggcgagcagatgcactacaagtgcagcgagtgcggcaaggccttcagcagaaaggacaccctggtgcagcaccagagaatccacagcggcgagaagccctacgagtgcagcgagtgcggcaaggccttcagcagaaaggccaccctggtgcagcaccagagaatccacaccggcgagagaccctacgagtgcagcgagtgcggcaagaccttcagcagaaaggacaacctgacccagcacaagagaatccacaccggcgagatgccctacaagtgcaacgagtgcggcaagtacttcagccaccacagcaacctgatcgtgcaccagagagtgcacaacggcgccagaccctacaagtgcagcgactgcggcaaggtgttcagacacaagagcaccctggtgcagcacgagagcatccacaccggcgagaacccctacgactgcagcgactgcggcaagagcttcggccacaagtacaccctgatcaagcaccagagaatccacaccgagagcaagcccttcgagtgcatcgagtgcggcaagttcttcagcagaagcagcgactacatcgcccaccagagagtgcacaccggcgagagacccttcgtgtgcagcaagtgcggcaaggacttcatcagaaccagccacctggtgagacaccagagagtgcacaccggcgagagaccctacgagtgcagcgagtgcggcaaggcctacagcctgagcagccacctgaacagacaccagaaggtgcacaccgccggcagactgtag

SEQ ID NO: 105695 - DNA, 1044 bp, Artificial Sequence
  Description of Artificial Sequence: Synthetic coding sequence
atgtggggcatgtgggagaccatcctggtgcagtgcctgcaccagtaccagaagtgctacagcatcgagcagcccctgagaagagacaagagcgaggccagcatcgtgaagaactgcaccgtgagcaaggagccccaccccagcgagaagcccttcacctgcaaggaggagcagaagaacttccaggccaccctgggcggctgccagcagaaggccatccacagcaagagaaagacccacagaagcaccgagagcggcgacgccttccacggcgagcagatgcactacaagtgcagcgagtgcggcaaggccttcagcagaaaggacaccctggtgcagcaccagagaatccacagcggcgagaagccctacgagtgcagcgagtgcggcaaggccttcagcagaaaggccaccctggtgcagcaccagagaatccacaccggcgagagaccctacgagtgcagcgagtgcggcaagaccttcagcagaaaggacaacctgacccagcacaagagaatccacaccggcgagatgccctacaagtgcaacgagtgcggcaagtacttcagccaccacagcaacctgatcgtgcaccagagagtgcacaacggcgccagaccctacaagtgcagcgactgcggcaaggtgttcagacacaagagcaccctggtgcagcacgagagcatccacaccggcgagaacccctacgactgcagcgactgcggcaagagcttcggccacaagtacaccctgatcaagcaccagagaatccacaccgagagcaagcccttcgagtgcatcgagtgcggcaagttcttcagcagaagcagcgactacatcgcccaccagagagtgcacaccggcgagagacccttcgtgtgcagcaagtgcggcaaggacttcatcagaaccagccacctggtgagacaccagagagtgcacaccggcgagagaccctacgagtgcagcgagtgcggcaaggcctacagcctgagcagccacctgaacagacaccagaaggtgcacaccgccggcagactgtag

SEQ ID NO: 105696 - DNA, 1977 bp, Artificial Sequence
  Description of Artificial Sequence: Synthetic coding sequence
atgacccccggcgtgagagtgagcaccgaccccgagcaggtgaccttcgaggacgtggtggtgggcttcagccaggaggagtggggccagctgaagcccgcccagagaaccctgtacagagacgtgatgctggacaccttcagactgctggtgagcgtgggccactggctgcccaagcccaacgtgatcagcctgctggagcaggaggccgagctgtgggccgtggagagcagactgccccagggcgtgtaccccgacctggagaccagacccaaggtgaagctgagcgtgctgaagcagggcatcagcgaggagatcagcaacagcgtgatcctggtggagagattcctgtgggacggcctgtggtactgcagaggcgaggacaccgagggccactgggagtggagctgcgagagcctggagagcctggccgtgcccgtggccttcacccccgtgaagacccccgtgctggagcagtggcagagaaacggcttcggcgagaacatcagcctgaaccccgacctgccccaccagcccatgacccccgagagacagagcccccacacctggggcaccagaggcaagagagagaagcccgacctgaacgtgctgcagaagacctgcgtgaaggagaagccctacaagtgccaggagtgcggcaaggccttcagccacagcagcgccctgatcgagcaccacagaacccacaccggcgagagaccctacgagtgccacgagtgcctgaagggcttcagaaacagcagcgccctgaccaagcaccagagaatccacaccggcgagaagccctacaagtgcacccagtgcggcagaaccttcaaccagatcgcccccctgatccagcaccagagaacccacaccggcgagaagccctacgagtgcagcgagtgcggcaagagcttcagcttcagaagcagcttcagccagcacgagagaacccacaccggcgagaagccctacgagtgcagcgagtgcggcaaggccttcagacagagcatccacctgacccagcacctgagaatccacaccggcgagaagccctaccagtgcggcgagtgcggcaaggccttcagccacagcagcagcctgaccaagcaccagagaatccacaccggcgagaagccctacgagtgccacgagtgcggcaaggccttcacccagatcacccccctgatccagcaccagagaacccacaccggcgagaagccctacgagtgcggcgagtgcggcaaggccttcagccagagcaccctgctgaccgagcacagaagaatccacaccggcgagaagccctacggctgcaacgagtgcggcaagaccttcagccacagcagcagcctgagccagcacgagagaacccacaccggcgagaagccctacgagtgcagccagtgcggcaaggccttcagacagagcacccacctgacccagcaccagagaatccacaccggcgagaagccctacgagtgcaacgactgcggcaaggccttcagccacagcagcagcctgaccaagcaccagagaatccacaccggcgagaagccctacgagtgcaaccagtgcggcagagccttcagccagctggcccccctgatccagcaccagagaatccacaccggcgagaagccctacgagtgcaaccagtgcggcagagccttcagccagagcagcctgctgatcgagcaccagagaatccacaccaaggagaagccctacggctgcaacgagtgcggcaagagcttcagccacagcagcagcctgagccagcacgagagaacccacaccggcgagaagccctacgagtgccacgactgcggcaagagcttcagacagagcacccacctgacccagcacagaagaatccacaccggcgagaagccctacgcctgcagagactgcggcaaggccttcacccacagcagcagcctgaccaagcaccagagaacccacaccggctag

SEQ ID NO: 105697 - DNA, 1173 bp, Artificial Sequence
  Description of Artificial Sequence: Synthetic coding sequence
atggagctgggcagcagaagaagaagcgtgggctgcagatgcagaggcctgtgcctggccgtgagaagagagcaggtgaccttcgaggacgtggtggtgggcttcagccaggaggagtggggccagctgaagcccgcccagagaaccctgtacagagacgtgatgctggacaccttcagactgctggtgagcgtgggccactggctgcccaagcccaacgtgatcagcctgctggagcaggaggccgagctgtgggccgtggagagcagactgccccagggcgtgtaccccgacctggagaccagacccaaggtgaagctgagcgtgctgaagcagggcatcagcgaggagatcagcaacagcgtgatcctggtggagagattcctgtgggacggcctgtggtactgcagaggcgaggacaccgagggccactgggagtggagctgcgagagcctggagagcctggccgtgcccgtggccttcacccccgtgaagacccccgtgctggagcagtggcagagaaacggcttcggcgagaacatcagcctgaaccccgacctgccccaccagcccatgacccccgagagacagagcccccacacctggggcaccagaggcaagagagagaagcccgacctgaacgtgctgcagaagacctgcgtgaaggagaagccctacaagtgccaggagtgcggcaaggccttcagccacagcagcgccctgatcgagcaccacagaacccacaccggcgagagaccctacgagtgccacgagtgcctgaagggcttcagaaacagcagcgccctgaccaagcaccagagaatccacaccggcgagaagccctacaagtgcacccagtgcggcagaaccttcaaccagatcgcccccctgatccagcaccagagaacccacaccggcgagaagccctacgagtgcagcgagtgcggcaagagcttcagcttcagaagcagcttcagccagcacgagagaacccacaccggcgagaagccctacgagtgcagcgagtgcggcaaggccttcagacagagcatccacctgacccagcacctgagaatccacaccggcgagaagccctaccagtgcggcgagtgcggcaaggccttcacccacagcagcagcctgaccaagcaccagagaacccacaccggctag

SEQ ID NO: 105698 - DNA, 2049 bp, Artificial Sequence
  Description of Artificial Sequence: Synthetic coding sequence
atggagctgggcagcagaagaagaagcgtgggctgcagatgcagaggcctgtgcctggccgtgagaagagagcaggtgaccttcgaggacgtggtggtgggcttcagccaggaggagtggggccagctgaagcccgcccagagaaccctgtacagagacgtgatgctggacaccttcagactgctggtgagcgtgggccactggctgcccaagcccaacgtgatcagcctgctggagcaggaggccgagctgtgggccgtggagagcagactgccccagggcgtgtaccccgagatcaagggccacttccagttcctgctgctgagcgacctggagaccagacccaaggtgaagctgagcgtgctgaagcagggcatcagcgaggagatcagcaacagcgtgatcctggtggagagattcctgtgggacggcctgtggtactgcagaggcgaggacaccgagggccactgggagtggagctgcgagagcctggagagcctggccgtgcccgtggccttcacccccgtgaagacccccgtgctggagcagtggcagagaaacggcttcggcgagaacatcagcctgaaccccgacctgccccaccagcccatgacccccgagagacagagcccccacacctggggcaccagaggcaagagagagaagcccgacctgaacgtgctgcagaagacctgcgtgaaggagaagccctacaagtgccaggagtgcggcaaggccttcagccacagcagcgccctgatcgagcaccacagaacccacaccggcgagagaccctacgagtgccacgagtgcctgaagggcttcagaaacagcagcgccctgaccaagcaccagagaatccacaccggcgagaagccctacaagtgcacccagtgcggcagaaccttcaaccagatcgcccccctgatccagcaccagagaacccacaccggcgagaagccctacgagtgcagcgagtgcggcaagagcttcagcttcagaagcagcttcagccagcacgagagaacccacaccggcgagaagccctacgagtgcagcgagtgcggcaaggccttcagacagagcatccacctgacccagcacctgagaatccacaccggcgagaagccctaccagtgcggcgagtgcggcaaggccttcagccacagcagcagcctgaccaagcaccagagaatccacaccggcgagaagccctacgagtgccacgagtgcggcaaggccttcacccagatcacccccctgatccagcaccagagaacccacaccggcgagaagccctacgagtgcggcgagtgcggcaaggccttcagccagagcaccctgctgaccgagcacagaagaatccacaccggcgagaagccctacggctgcaacgagtgcggcaagaccttcagccacagcagcagcctgagccagcacgagagaacccacaccggcgagaagccctacgagtgcagccagtgcggcaaggccttcagacagagcacccacctgacccagcaccagagaatccacaccggcgagaagccctacgagtgcaacgactgcggcaaggccttcagccacagcagcagcctgaccaagcaccagagaatccacaccggcgagaagccctacgagtgcaaccagtgcggcagagccttcagccagctggcccccctgatccagcaccagagaatccacaccggcgagaagccctacgagtgcaaccagtgcggcagagccttcagccagagcagcctgctgatcgagcaccagagaatccacaccaaggagaagccctacggctgcaacgagtgcggcaagagcttcagccacagcagcagcctgagccagcacgagagaacccacaccggcgagaagccctacgagtgccacgactgcggcaagagcttcagacagagcacccacctgacccagcacagaagaatccacaccggcgagaagccctacgcctgcagagactgcggcaaggccttcacccacagcagcagcctgaccaagcaccagagaacccacaccggctag

SEQ ID NO: 105699 - DNA, 1977 bp, Artificial Sequence; identical to SEQ ID NO: 105696
  Description of Artificial Sequence: Synthetic coding sequence

SEQ ID NO: 105700 - DNA, 1851 bp, Artificial Sequence
  Description of Artificial Sequence: Synthetic coding sequence
atgctggacaccttcagactgctggtgagcgtgggccactggctgcccaagcccaacgtgatcagcctgctggagcaggaggccgagctgtgggccgtggagagcagactgccccagggcgtgtaccccgacctggagaccagacccaaggtgaagctgagcgtgctgaagcagggcatcagcgaggagatcagcaacagcgtgatcctggtggagagattcctgtgggacggcctgtggtactgcagaggcgaggacaccgagggccactgggagtggagctgcgagagcctggagagcctggccgtgcccgtggccttcacccccgtgaagacccccgtgctggagcagtggcagagaaacggcttcggcgagaacatcagcctgaaccccgacctgccccaccagcccatgacccccgagagacagagcccccacacctggggcaccagaggcaagagagagaagcccgacctgaacgtgctgcagaagacctgcgtgaaggagaagccctacaagtgccaggagtgcggcaaggccttcagccacagcagcgccctgatcgagcaccacagaacccacaccggcgagagaccctacgagtgccacgagtgcctgaagggcttcagaaacagcagcgccctgaccaagcaccagagaatccacaccggcgagaagccctacaagtgcacccagtgcggcagaaccttcaaccagatcgcccccctgatccagcaccagagaacccacaccggcgagaagccctacgagtgcagcgagtgcggcaagagcttcagcttcagaagcagcttcagccagcacgagagaacccacaccggcgagaagccctacgagtgcagcgagtgcggcaaggccttcagacagagcatccacctgacccagcacctgagaatccacaccggcgagaagccctaccagtgcggcgagtgcggcaaggccttcagccacagcagcagcctgaccaagcaccagagaatccacaccggcgagaagccctacgagtgccacgagtgcggcaaggccttcacccagatcacccccctgatccagcaccagagaacccacaccggcgagaagccctacgagtgcggcgagtgcggcaaggccttcagccagagcaccctgctgaccgagcacagaagaatccacaccggcgagaagccctacggctgcaacgagtgcggcaagaccttcagccacagcagcagcctgagccagcacgagagaacccacaccggcgagaagccctacgagtgcagccagtgcggcaaggccttcagacagagcacccacctgacccagcaccagagaatccacaccggcgagaagccctacgagtgcaacgactgcggcaaggccttcagccacagcagcagcctgaccaagcaccagagaatccacaccggcgagaagccctacgagtgcaaccagtgcggcagagccttcagccagctggcccccctgatccagcaccagagaatccacaccggcgagaagccctacgagtgcaaccagtgcggcagagccttcagccagagcagcctgctgatcgagcaccagagaatccacaccaaggagaagccctacggctgcaacgagtgcggcaagagcttcagccacagcagcagcctgagccagcacgagagaacccacaccggcgagaagccctacgagtgccacgactgcggcaagagcttcagacagagcacccacctgacccagcacagaagaatccacaccggcgagaagccctacgcctgcagagactgcggcaaggccttcacccacagcagcagcctgaccaagcaccagagaacccacaccggctag

SEQ ID NO: 105701 - DNA, 2013 bp, Artificial Sequence
  Description of Artificial Sequence: Synthetic coding sequence
atgacccccggcgtgagagtgagcaccgaccccgagcaggtgaccttcgaggacgtggtggtgggcttcagccaggaggagtggggccagctgaagcccgcccagagaaccctgtacagagacgtgatgctggacaccttcagactgctggtgagcgtgggccactggctgcccaagcccaacgtgatcagcctgctggagcaggaggccgagctgtgggccgtggagagcagactgccccagggcgtgtaccccgagatcaagggccacttccagttcctgctgctgagcgacctggagaccagacccaaggtgaagctgagcgtgctgaagcagggcatcagcgaggagatcagcaacagcgtgatcctggtggagagattcctgtgggacggcctgtggtactgcagaggcgaggacaccgagggccactgggagtggagctgcgagagcctggagagcctggccgtgcccgtggccttcacccccgtgaagacccccgtgctggagcagtggcagagaaacggcttcggcgagaacatcagcctgaaccccgacctgccccaccagcccatgacccccgagagacagagcccccacacctggggcaccagaggcaagagagagaagcccgacctgaacgtgctgcagaagacctgcgtgaaggagaagccctacaagtgccaggagtgcggcaaggccttcagccacagcagcgccctgatcgagcaccacagaacccacaccggcgagagaccctacgagtgccacgagtgcctgaagggcttcagaaacagcagcgccctgaccaagcaccagagaatccacaccggcgagaagccctacaagtgcacccagtgcggcagaaccttcaaccagatcgcccccctgatccagcaccagagaacccacaccggcgagaagccctacgagtgcagcgagtgcggcaagagcttcagcttcagaagcagcttcagccagcacgagagaacccacaccggcgagaagccctacgagtgcagcgagtgcggcaaggccttcagacagagcatccacctgacccagcacctgagaatccacaccggcgagaagccctaccagtgcggcgagtgcggcaaggccttcagccacagcagcagcctgaccaagcaccagagaatccacaccggcgagaagccctacgagtgccacgagtgcggcaaggccttcacccagatcacccccctgatccagcaccagagaacccacaccggcgagaagccctacgagtgcggcgagtgcggcaaggccttcagccagagcaccctgctgaccgagcacagaagaatccacaccggcgagaagccctacggctgcaacgagtgcggcaagaccttcagccacagcagcagcctgagccagcacgagagaacccacaccggcgagaagccctacgagtgcagccagtgcggcaaggccttcagacagagcacccacctgacccagcaccagagaatccacaccggcgagaagccctacgagtgcaacgactgcggcaaggccttcagccacagcagcagcctgaccaagcaccagagaatccacaccggcgagaagccctacgagtgcaaccagtgcggcagagccttcagccagctggcccccctgatccagcaccagagaatccacaccggcgagaagccctacgagtgcaaccagtgcggcagagccttcagccagagcagcctgctgatcgagcaccagagaatccacaccaaggagaagccctacggctgcaacgagtgcggcaagagcttcagccacagcagcagcctgagccagcacgagagaacccacaccggcgagaagccctacgagtgccacgactgcggcaagagcttcagacagagcacccacctgacccagcacagaagaatccacaccggcgagaagccctacgcctgcagagactgcggcaaggccttcacccacagcagcagcctgaccaagcaccagagaacccacaccggctag

SEQ ID NO: 105702 - DNA, 2031 bp, Artificial Sequence
  Description of Artificial Sequence: Synthetic coding sequence
tgaagaagcgtgggctgcagatgcagaggcctgtgcctggccgtgagaagagagcaggtgaccttcgaggacgtggtggtgggcttcagccaggaggagtggggccagctgaagcccgcccagagaaccctgtacagagacgtgatgctggacaccttcagactgctggtgagcgtgggccactggctgcccaagcccaacgtgatcagcctgctggagcaggaggccgagctgtgggccgtggagagcagactgccccagggcgtgtaccccgagatcaagggccacttccagttcctgctgctgagcgacctggagaccagacccaaggtgaagctgagcgtgctgaagcagggcatcagcgaggagatcagcaacagcgtgatcctggtggagagattcctgtgggacggcctgtggtactgcagaggcgaggacaccgagggccactgggagtggagctgcgagagcctggagagcctggccgtgcccgtggccttcacccccgtgaagacccccgtgctggagcagtggcagagaaacggcttcggcgagaacatcagcctgaaccccgacctgccccaccagcccatgacccccgagagacagagcccccacacctggggcaccagaggcaagagagagaagcccgacctgaacgtgctgcagaagacctgcgtgaaggagaagccctacaagtgccaggagtgcggcaaggccttcagccacagcagcgccctgatcgagcaccacagaacccacaccggcgagagaccctacgagtgccacgagtgcctgaagggcttcagaaacagcagcgccctgaccaagcaccagagaatccacaccggcgagaagccctacaagtgcacccagtgcggcagaaccttcaaccagatcgcccccctgatccagcaccagagaacccacaccggcgagaagccctacgagtgcagcgagtgcggcaagagcttcagcttcagaagcagcttcagccagcacgagagaacccacaccggcgagaagccctacgagtgcagcgagtgcggcaaggccttcagacagagcatccacctgacccagcacctgagaatccacaccggcgagaagccctaccagtgcggcgagtgcggcaaggccttcagccacagcagcagcctgaccaagcaccagagaatccacaccggcgagaagccctacgagtgccacgagtgcggcaaggccttcacccagatcacccccctgatccagcaccagagaacccacaccggcgagaagccctacgagtgcggcgagtgcggcaaggccttcagccagagcaccctgctgaccgagcacagaagaatccacaccggcgagaagccctacggctgcaacgagtgcggcaagaccttcagccacagcagcagcctgagccagcacgagagaacccacaccggcgagaagccctacgagtgcagccagtgcggcaaggccttcagacagagcacccacctgacccagcaccagagaatccacaccggcgagaagccctacgagtgcaacgactgcggcaaggccttcagccacagcagcagcctgaccaagcaccagagaatccacaccggcgagaagccctacgagtgcaaccagtgcggcagagccttcagccagctggcccccctgatccagcaccagagaatccacaccggcgagaagccctacgagtgcaaccagtgcggcagagccttcagccagagcagcctgctgatcgagcaccagagaatccacaccaaggagaagccctacggctgcaacgagtgcggcaagagcttcagccacagcagcagcctgagccagcacgagagaacccacaccggcgagaagccctacgagtgccacgactgcggcaagagcttcagacagagcacccacctgacccagcacagaagaatccacaccggcgagaagccctacgcctgcagagactgcggcaaggccttcacccacagcagcagcctgaccaagcaccagagaacccacaccggctag

SEQ ID NO: 105703 - DNA, 1623 bp, Artificial Sequence
  Description of Artificial Sequence: Synthetic coding sequence
atggacagcgtggccttcgaggacgtggacgtgaacttcacccaggaggagtgggccctgctggaccccagccagaagaacctgtacagagacgtgatgtgggagaccatgagaaacctggccagcatcggcaagaagtggaaggaccagaacatcaaggaccactacaagcacagaggcagaaacctgagaagccacatgctggagagactgtaccagaccaaggacggcagccagagaggcggcatcttcagccagttcgccaaccagaacctgagcaagaagatccccggcgtgaagctgtgcgagagcatcgtgtacggcgaggtgagcatgggccagagcagcctgaacagacacatcaaggaccacagcggccacgagcccaaggagtaccaggagtacggcgagaagcccgacaccagaaaccagtgctggaagcccttcagcagccaccacagcttcagaacccacgagatcatccacaccggcgagaagctgtacgactgcaaggagtgcggcaagaccttcttcagcctgaagagaatcagaagacacatcatcacccacagcggctacaccccctacaagtgcaaggtgtgcggcaaggccttcgactaccccagcagattcagaacccacgagagaagccacaccggcgagaagccctacgagtgccaggagtgcggcaaggccttcacctgcatcaccagcgtgagaagacacatgatcaagcacaccggcgacggcccctacaagtgcaaggtgtgcggcaagcccttccacagcctgagcagcttccaggtgcacgagagaatccacaccggcgagaagcccttcaagtgcaagcagtgcggcaaggccttcagctgcagccccaccctgagaatccacgagagaacccacaccggcgagaagccctacgagtgcaagcagtgcggcaaggccttcagctacctgcccagcctgagactgcacgagagaatccacaccggcgagaagcccttcgtgtgcaagcagtgcggcaaggccttcagaagcgccagcaccttccagatccacgagagaacccacaccggcgagaagccctacgagtgcaaggagtgcggcgaggccttcagctgcatccccagcatgagaagacacatgatcaagcacaccggcgagggcccctacaagtgcaaggtgtgcggcaagcccttccacagcctgagccccttcagaatccacgagagaacccacaccggcgagaagccctacgtgtgcaagcactgcggcaaggccttcgtgagcagcaccagcatcagaatccacgagagaacccacaccggcgagaagccctacgagtgcaagcagtgcggcaaggccttcagctacctgaacagcttcagaacccacgagatgatccacaccggcgagaagcccttcgagtgcaagagatgcggcaaggccttcagaagcagcagcagcttcagactgcacgagagaacccacaccggccagaagccctaccactgcaaggagtgcggcaaggcctacagctgcagagccagcttccagagacacatgctgacccacgccgaggacggccccccctacaagtgcatgtgggagagcctgtag

SEQ ID NO: 105704 - DNA, 1425 bp, Artificial Sequence
  Description of Artificial Sequence: Synthetic coding sequence
atgctggagagactgtaccagaccaaggacggcagccagagaggcggcatcttcagccagttcgccaaccagaacctgagcaagaagatccccggcgtgaagctgtgcgagagcatcgtgtacggcgaggtgagcatgggccagagcagcctgaacagacacatcaaggaccacagcggccacgagcccaaggagtaccaggagtacggcgagaagcccgacaccagaaaccagtgctggaagcccttcagcagccaccacagcttcagaacccacgagatcatccacaccggcgagaagctgtacgactgcaaggagtgcggcaagaccttcttcagcctgaagagaatcagaagacacatcatcacccacagcggctacaccccctacaagtgcaaggtgtgcggcaaggccttcgactaccccagcagattcagaacccacgagagaagccacaccggcgagaagccctacgagtgccaggagtgcggcaaggccttcacctgcatcaccagcgtgagaagacacatgatcaagcacaccggcgacggcccctacaagtgcaaggtgtgcggcaagcccttccacagcctgagcagcttccaggtgcacgagagaatccacaccggcgagaagcccttcaagtgcaagcagtgcggcaaggccttcagctgcagccccaccctgagaatccacgagagaacccacaccggcgagaagccctacgagtgcaagcagtgcggcaaggccttcagctacctgcccagcctgagactgcacgagagaatccacaccggcgagaagcccttcgtgtgcaagcagtgcggcaaggccttcagaagcgccagcaccttccagatccacgagagaacccacaccggcgagaagccctacgagtgcaaggagtgcggcgaggccttcagctgcatccccagcatgagaagacacatgatcaagcacaccggcgagggcccctacaagtgcaaggtgtgcggcaagcccttccacagcctgagccccttcagaatccacgagagaacccacaccggcgagaagccctacgtgtgcaagcactgcggcaaggccttcgtgagcagcaccagcatcagaatccacgagagaacccacaccggcgagaagccctacgagtgcaagcagtgcggcaaggccttcagctacctgaacagcttcagaacccacgagatgatccacaccggcgagaagcccttcgagtgcaagagatgcggcaaggccttcagaagcagcagcagcttcagactgcacgagagaacccacaccggccagaagccctaccactgcaaggagtgcggcaaggcctacagctgcagagccagcttccagagacacatgctgacccacgccgaggacggccccccctacaagtgcatgtgggagagcctgtag

SEQ ID NO: 105705 - DNA, 960 bp, Artificial Sequence
  Description of Artificial Sequence: Synthetic coding sequence
atgggccccctgaccttcatggacgtggccatcgagttcagcctggaggagtggcagtgcctggacaccgcccagagaaacgtgtacagacacgtgatgctggagaactacagaaacctggtgttcctggacctgatcacctgcctggagcagggcaaggagccctggaacatgaagagacacgagatggtggtggccaagcacagcgccctgtgcagcagattcgcccaggacctgtggctggagcagaacatcaaggacagcttccagaaggtgaccctgagcagatacggcaagtacggccacaagaacctgcagctgagaaagggctgcaagagcgtggacgagtgcaagggccaccagggcggcttcaacggcctgaaccagtgcctgaagatcaccaccagcaagatcttccagtgcaacaagtacgtgaaggtgatgcacaagttcagcaacagcaacagacacaagatcagacacaccgagaacaagcacttcagatgcaaggagtgcgacaagagcctgtgcatgctgagcagactgacccagcacaagaagatccacaccagagagaacttctacaagtgcgaggagtgcggcaagaccttcaactggagcaccaacctgagcaagcccaagaagatccacaccggcgagaagccctacaagtgcgaggtgtgcggcaaggccttccaccagagcagcatcctgaccaagcacaagatcatcagaaccggcgagaagccctacaagtgcgcccactgcggcaaggccttcaagcagagcagccacctgaccagacacaagatcatccacaccgaggagaagccctacaagtgcgagcagtgcggcaaggtgttcaagcagagccccaccctgaccaagcaccagatcatctacaccggcgaggagccctacaagtgcgaggagtgcggcaaggccttcaacctgagctag

SEQ ID NO: 105706 - DNA, 789 bp, Artificial Sequence
  Description of Artificial Sequence: Synthetic coding sequence
atgaagagacacgagatggtggtggccaagcacagcgccctgtgcagcagattcgcccaggacctgtggctggagcagaacatcaaggacagcttccagaaggtgaccctgagcagatacggcaagtacggccacaagaacctgcagctgagaaagggctgcaagagcgtggacgagtgcaagggccaccagggcggcttcaacggcctgaaccagtgcctgaagatcaccaccagcaagatcttccagtgcaacaagtacgtgaaggtgatgcacaagttcagcaacagcaacagacacaagatcagacacaccgagaacaagcacttcagatgcaaggagtgcgacaagagcctgtgcatgctgagcagactgacccagcacaagaagatccacaccagagagaacttctacaagtgcgaggagtgcggcaagaccttcaactggagcaccaacctgagcaagcccaagaagatccacaccggcgagaagccctacaagtgcgaggtgtgcggcaaggccttccaccagagcagcatcctgaccaagcacaagatcatcagaaccggcgagaagccctacaagtgcgcccactgcggcaaggccttcaagcagagcagccacctgaccagacacaagatcatccacaccgaggagaagccctacaagtgcgagcagtgcggcaaggtgttcaagcagagccccaccctgaccaagcaccagatcatctacaccggcgaggagccctacaagtgcgaggagtgcggcaaggccttcaacctgagctag

SEQ ID NO: 105707 - DNA, 789 bp, Artificial Sequence; identical to SEQ ID NO: 105706
  Description of Artificial Sequence: Synthetic coding sequence

SEQ ID NO: 105708 - DNA, 864 bp, Artificial Sequence
  Description of Artificial Sequence: Synthetic coding sequence
atggacgtggccatcgagttcagcctggaggagtggcagtgcctggacaccgcccagagaaacgtgtacagacacgtgatgctggagaactacagaaacctggtgttcctggccctgtgcagcagattcgcccaggacctgtggctggagcagaacatcaaggacagcttccagaaggtgaccctgagcagatacggcaagtacggccacaagaacctgcagctgagaaagggctgcaagagcgtggacgagtgcaagggccaccagggcggcttcaacggcctgaaccagtgcctgaagatcaccaccagcaagatcttccagtgcaacaagtacgtgaaggtgatgcacaagttcagcaacagcaacagacacaagatcagacacaccgagaacaagcacttcagatgcaaggagtgcgacaagagcctgtgcatgctgagcagactgacccagcacaagaagatccacaccagagagaacttctacaagtgcgaggagtgcggcaagaccttcaactggagcaccaacctgagcaagcccaagaagatccacaccggcgagaagccctacaagtgcgaggtgtgcggcaaggccttccaccagagcagcatcctgaccaagcacaagatcatcagaaccggcgagaagccctacaagtgcgcccactgcggcaaggccttcaagcagagcagccacctgaccagacacaagatcatccacaccgaggagaagccctacaagtgcgagcagtgcggcaaggtgttcaagcagagccccaccctgaccaagcaccagatcatctacaccggcgaggagccctacaagtgcgaggagtgcggcaaggccttcaacctgagctag

SEQ ID NO: 105709 - DNA, 882 bp, Artificial Sequence
  Description of Artificial Sequence: Synthetic coding sequence
atgggccccctgaccttcatggacgtggccatcgagttcagcctggaggagtggcagtgcctggacaccgcccagagaaacgtgtacagacacgtgatgctggagaactacagaaacctggtgttcctggccctgtgcagcagattcgcccaggacctgtggctggagcagaacatcaaggacagcttccagaaggtgaccctgagcagatacggcaagtacggccacaagaacctgcagctgagaaagggctgcaagagcgtggacgagtgcaagggccaccagggcggcttcaacggcctgaaccagtgcctgaagatcaccaccagcaagatcttccagtgcaacaagtacgtgaaggtgatgcacaagttcagcaacagcaacagacacaagatcagacacaccgagaacaagcacttcagatgcaaggagtgcgacaagagcctgtgcatgctgagcagactgacccagcacaagaagatccacaccagagagaacttctacaagtgcgaggagtgcggcaagaccttcaactggagcaccaacctgagcaagcccaagaagatccacaccggcgagaagccctacaagtgcgaggtgtgcggcaaggccttccaccagagcagcatcctgaccaagcacaagatcatcagaaccggcgagaagccctacaagtgcgcccactgcggcaaggccttcaagcagagcagccacctgaccagacacaagatcatccacaccgaggagaagccctacaagtgcgagcagtgcggcaaggtgttcaagcagagccccaccctgaccaagcaccagatcatctacaccggcgaggagccctacaagtgcgaggagtgcggcaaggccttcaacctgagctag

SEQ ID NO: 105710 - DNA, 381 bp, Artificial Sequence
  Description of Artificial Sequence: Synthetic coding sequence
atgggccccctgaccttcatggacgtggccatcgagttcagcctggaggagtggcagtgcctggacaccgcccagagaaacgtgtacagacacgtgatgctggagaactacagaaacctggtgttcctggacctgatcacctgcctggagcagggcaaggagccctggaacatgaagagacacgagatggtggtggccaagcacagcgccgtggccttcaccttcgacctgagcggcctgaacatcctgagcttccagagcatcctgcccttcgtgagcgccctgtacgtgatgggcaacagaaaccagtgcctgcagaagcacctggaggccagaaacaaggacctgtgcgtgctggtgctgcccaagaccttcggctag

SEQ ID NO: 105711 - DNA, 1929 bp, Artificial Sequence
  Description of Artificial Sequence: Synthetic coding sequence
atggacagcgtgagcttcgaggacgtggccgtgaacttcaccctggaggagtgggccctgctggacagcagccagaagaagctgtacgaggacgtgatgcaggagaccttcaagaacctggtgtgcctgggcaagaagtgggaggaccaggacatcgaggacgaccacagaaaccagggcaagaacagaagatgccacatggtggagagactgtgcgagagcagaagaggcagcaagtgcggcgagaccaccagccagatgcccaacgtgaacatcaacaaggagaccttcaccggcgccaagccccacgagtgcagcttctgcggcagagacttcatccaccacagcagcctgaacagacacatgagaagccacaccggccagaagcccaacgagtaccaggagtacgagaagcagccctgcaagtgcaaggccgtgggcaagaccttcagctaccaccactgcttcagaaagcacgagagaacccacaccggcgtgaagccctacgagtgcaagcagtgcggcaaggccttcatctactaccagcccttccagagacacgagagaacccacgccggccagaagccctacgagtgcaagcagtgcggcaagaccttcatctactaccagagcttccagaagcacgcccacaccggcaagaagccctacgagtgcaagcagtgcggcaaggccttcatctgctaccagagcttccagagacacaagagaacccacaccggcgagaagccctacgagtgcaagcagtgcggcaaggccttcagctgccccacctacttcagaacccacgagagaacccacaccggcgagaagccctacaagtgcaaggagtgcggcaaggccttcagcttcctgagcagcttcagaagacacaagagaacccacagcggcgagaagccctacgagtgcaaggagtgcggcaaggccttcttctacagcgccagcttcagagcccacgtgatcatccacaccggcgccagaccctacaagtgcaaggagtgcggcaaggccttcaacagcagcaacagctgcagagtgcacgagagaacccacatcggcgagaagccctacgagtgcaagagatgcggcaagagcttcagctggagcatcagcctgagactgcacgagagaacccacaccggcgagaagccctacgagtgcaagcagtgccacaagaccttcagcttcagcagcagcctgagagagcacgagaccacccacaccggcgagaagccctacgagtgcaagcagtgcggcaagaccttcagcttcagcagcagcctgcagagacacgagagaacccacaacgccgagaagccctacgagtgcaagcagtgcggcaaggccttcagatgcagcagctacttcagaatccacgagagaagccacaccggcgagaagccctacgagtgcaagcagtgcggcaaggtgttcatcagaagcagcagcttcagactgcacgagagaacccacaccggcgagaagccctacgagtgcaagctgtgcggcaagaccttcagcttcagcagcagcctgagagagcacgagaagatccacaccggcaacaagcccttcgagtgcaagcagtgcggcaaggccttcctgagaagcagccagatcagactgcacgagagaacccacaccggcgagaagccctaccagtgcaagcagtgcggcaaggccttcatcagcagcagcaagttcagaatgcacgagagaacccacaccggcgagaagccctacagatgcaagcagtgcggcaaggccttcagattcagcagcagcgtgagaatccacgagagaagccacaccggcgagaagccctacgagtgcaagcagtgcggcaaggccttcatcagcagcagccacttcagactgcacgagagaacccacatgggcgagaaggtgtag

SEQ ID NO: 105712 - DNA, 1374 bp, Artificial Sequence
  Description of Artificial Sequence: Synthetic coding sequence
atgagccagggcagcgtgaccttcagagacgtggccatcgacttcagccaggaggagtggaagtggctgcagcccgcccagagagacctgtacagatgcgtgatgctggagaactacggccacctggtgagcctgggcctgagcatcagcaagcccgacgtggtgagcctgctggagcagggcaaggagccctggctgggcaagagagaggtgaagagagacctgttcagcgtgagcgagagcagcggcgagatcaaggacttcagccccaagaacgtgatctacgacgacagcagccagtacctgatcatggagagaatcctgagccagggccccgtgtacagcagcttcaagggcggctggaagtgcaaggaccacaccgagatgctgcaggagaaccagggctgcatcagaaaggtgaccgtgagccaccaggaggccctggcccagcacatgaacatcagcaccgtggagagaccctacggctgccacgagtgcggcaagaccttcggcagaagattcagcctggtgctgcaccagagaacccacaccggcgagaagccctacgcctgcaaggagtgcggcaagaccttcagccagatcagcaacctggtgaagcaccagatgatccacaccggcaagaagccccacgagtgcaaggactgcaacaagaccttcagctacctgagcttcctgatcgagcaccagagaacccacaccggcgagaagccctacgagtgcaccgagtgcggcaaggccttcagcagagccagcaacctgaccagacaccagagaatccacatcggcaagaagcagtacatctgcagaaagtgcggcaaggccttcagcagcggcagcgagctgatcagacaccagatcacccacaccggcgagaagccctacgagtgcatcgagtgcggcaaggccttcagaagattcagccacctgaccagacaccagagcatccacaccaccaagaccccctacgagtgcaacgagtgcagaaaggccttcagatgccacagcttcctgatcaagcaccagagaatccacgccggcgagaagctgtacgagtgcgacgagtgcggcaaggtgttcacctggcacgccagcctgatccagcacaccaagagccacaccggcgagaagccctacgcctgcgccgagtgcgacaaggccttcagcagaagcttcagcctgatcctgcaccagagaacccacaccggcgagaagccctacgtgtgcaaggtgtgcaacaagagcttcagctggagcagcaacctggccaagcaccagagaacccacaccctggacaacccctacgagtacgagaacagcttcaactaccacagcttcctgaccgagcaccagtag

SEQ ID NO: 105713 - DNA, 351 bp, Artificial Sequence
  Description of Artificial Sequence: Synthetic coding sequence
atgagccagggcagcgtgaccttcagagacgtggccatcgacttcagccaggaggagtggaagtggctgcagcccgcccagagagacctgtacagatgcgtgatgctggagaactacggccacctggtgagcctgggcctgagcatcagcaagcccgacgtggtgagcctgctggagcagggcaaggagccctggctgggcaagagagaggtgaagagagacctgttcagcgtgagcgagagcagcggcgagatcaaggacttcagccccaagaacgtgatctacgacgacagcagccagtacctgatcatggagagaatcctgagccagggccccgtgtacagcagctag

SEQ ID NO: 105714 - DNA, 684 bp, Artificial Sequence
  Description of Artificial Sequence: Synthetic coding sequence
acccacaccggcgagaagccctacgcctgcaaggagtgcggcaagaccttcagccagatcagcaacctggtgaagcaccagatgatccacaccggcaagaagccccacgagtgcaaggactgcaacaagaccttcagctacctgagcttcctgatcgagcaccagagaacccacaccggcgagaagccctacgagtgcaccgagtgcggcaaggccttcagcagagccagcaacctgaccagacaccagagaatccacatcggcaagaagcagtacatctgcagaaagtgcggcaaggccttcagcagcggcagcgagctgatcagacaccagatcacccacaccggcgagaagccctacgagtgcatcgagtgcggcaaggccttcagaagattcagccacctgaccagacaccagagaatccacgccggcgagaagctgtacgagtgcgacgagtgcggcaaggtgttcacctggcacgccagcctgatccagcacaccaagagccacaccggcgagaagccctacgcctgcgccgagtgcgacaaggccttcagcagaagcttcagcctgatcctgcaccagagaacccacaccggcgagaagccctacgtgtgcaaggtgtgcaacaagagcttcagctggagcagcaacctggccaagcaccagagaacccacacctag

SEQ ID NO: 105715 - DNA, 1065 bp, Artificial Sequence
  Description of Artificial Sequence: Synthetic coding sequence
atggagagaatcctgagccagggccccgtgtacagcagcttcaagggcggctggaagtgcaaggaccacaccgagatgctgcaggagaaccagggctgcatcagaaaggtgaccgtgagccaccaggaggccctggcccagcacatgaacatcagcaccgtggagagaccctacggctgccacgagtgcggcaagaccttcggcagaagattcagcctggtgctgcaccagagaacccacaccggcgagaagccctacgcctgcaaggagtgcggcaagaccttcagccagatcagcaacctggtgaagcaccagatgatccacaccggcaagaagccccacgagtgcaaggactgcaacaagaccttcagctacctgagcttcctgatcgagcaccagagaacccacaccggcgagaagccctacgagtgcaccgagtgcggcaaggccttcagcagagccagcaacctgaccagacaccagagaatccacatcggcaagaagcagtacatctgcagaaagtgcggcaaggccttcagcagcggcagcgagctgatcagacaccagatcacccacaccggcgagaagccctacgagtgcatcgagtgcggcaaggccttcagaagattcagccacctgaccagacaccagagcatccacaccaccaagaccccctacgagtgcaacgagtgcagaaaggccttcagatgccacagcttcctgatcaagcaccagagaatccacgccggcgagaagctgtacgagtgcgacgagtgcggcaaggtgttcacctggcacgccagcctgatccagcacaccaagagccacaccggcgagaagccctacgcctgcgccgagtgcgacaaggccttcagcagaagcttcagcctgatcctgcaccagagaacccacaccggcgagaagccctacgtgtgcaaggtgtgcaacaagagcttcagctggagcagcaacctggccaagcaccagagaacccacaccctggacaacccctacgagtacgagaacagcttcaactaccacagcttcctgaccgagcaccagtag

SEQ ID NO: 105716 - DNA, 1425 bp, Artificial Sequence
  Description of Artificial Sequence: Synthetic coding sequence
atggagctgctgaccttcagagacgtggccatcgagttcagccccgaggagtggaagtgcctggaccccgaccagcagaacctgtacagagacgtgatgctggagaactacagaaacctggtgagcctgggcgtggccatcagcaaccccgacctggtgacctgcctggagcagagaaaggagccctacaacgtgaagatccacaagatcgtggccagaccccccgccatgtgcagccacttcacccaggaccactggcccgtgcagggcatcgaggacagcttccacaagctgatcctgagaagatacgagaagtgcggccacgacaacctgcagctgagaaagggctgcaagagcctgaacgagtgcaagctgcagaagggcggctacaacgagttcaacgagtgcctgagcaccacccagagcaagatcctgcagtgcaaggccagcgtgaaggtggtgagcaagttcagcaacagcaacaagagaaagaccagacacaccggcgagaagcacttcaaggagtgcggcaagagcttccagaagttcagccacctgacccagcacaaggtgatccacgccggcgagaagccctacacctgcgaggagtgcggcaaggccttcaagtggagcctgatcttcaacgagcacaagagaatccacaccggcgagaagcccttcacctgcgaggagtgcggcagcatcttcaccaccagcagccacttcgccaagcacaagatcatccacaccggcgagaagccctacaagtgcgaggagtgcggcaaggccttcaacagattcaccaccctgaccaagcacaagagaatccacgccggcgagaagcccatcacctgcgaggagtgcagaaagatcttcaccagcagcagcaacttcgccaagcacaagagaatccacaccggcgagaagccctacaagtgcgaggagtgcggcaaggccttcaacagaagcaccaccctgaccaagcacaagagaatccacaccggcgagaagccctacacctgcgaggagtgcggcaaggccttcagacagagcagcaagctgaacgagcacaagaaggtgcacaccggcgagagaccctacaagtgcgacgagtgcggcaaggccttcggcagaagcagagtgctgaacgagcacaagaagatccacaccggcgagaagccctacaagtgcgaggagtgcggcaaggccttcagaagaagcaccgacagaagccagcacaagaagatccacagcgccgacaagccctacaagtgcaaggagtgcgacaaggccttcaagcagttcagcctgctgagccagcacaagaagatccacaccgtggacaagccctacaagtgcaaggactgcgacaaggccttcaagagattcagccacctgaacaagcacaagaagatccacacctag

SEQ ID NO: 105717 - DNA, 606 bp, Artificial Sequence
  Description of Artificial Sequence: Synthetic coding sequence
atggagctgctgaccttcagagacgtggccatcgagttcagccccgaggagtggaagtgcctggaccccgaccagcagaacctgtacagagacgtgatgctggagaactacagaaacctggtgagcctgggcgtggccatcagcaaccccgacctggtgacctgcctggagcagagaaaggagccctacaacgtgaagatccacaagatcgtggccagaccccccgccatgtgcagccacttcacccaggaccactggcccgtgcagggcatcgaggacagcttccacaagctgatcctgagaagatacgagaagtgcggccacgacaacctgcagctgagaaagggctgcaagagcctgaacgagtgcaagctgcagaagggcggctacaacgagttcaacgagtgcctgagcaccacccagagcaagatcctgcagtgcaaggccagcgtgaaggtggtgagcaagttcagcaacagcaacaagagaaagaccagacacaccggcgagaagcacttcaaggagtgcggcaagagcttccagaagttcagccacctgacccagcacaagaacagcagcatcagcatgaccaccagccccttctag

SEQ ID NO: 105718 - DNA, 5064 bp, Artificial Sequence
  Description of Artificial Sequence: Synthetic coding sequence
atgaccgaccccctgctggacagccagcccgccagcagcaccggcgagatggacggcctgtgccccgagctgctgctgatccccccccccctgagcaacagaggcatcctgggccccgtgcagagcccctgccccagcagagaccccgcccccatccccaccgagcccggctgcctgctggtggaggccaccgccaccgaggagggccccggcaacatggagatcatcgtggagaccgtggccggcaccctgacccccggcgcccccggcgagacccccgcccccaagctgccccccggcgagagagagcccagccaggaggccggcacccccctgcccggccaggagaccgccgaggaggagaacgtggagaaggaggagaagagcgacacccagaaggacagccagaaggccgtggacaagggccagggcgcccagagactggagggcgacgtggtgagcggcaccgagagcctgttcaagacccacatgtgccccgagtgcaagagatgcttcaagaagagaacccacctggtggagcacctgcacctgcacttccccgaccccagcctgcagtgccccaactgccagaagttcttcaccagcaagagcaagctgaagacccacctgctgagagagctgggcgagaaggcccaccactgccccctgtgccactacagcgccgtggagagaaacgccctgaacagacacatggccagcatgcacgaggacatcagcaacttctacagcgacacctacgcctgccccgtgtgcagagaggagttcagactgagccaggccctgaaggagcacctgaagagccacaccgccgccgccgccgccgagcccctgcccctgagatgcttccaggagggctgcagctacgccgcccccgacagaaaggccttcatcaagcacctgaaggagacccacggcgtgagagccgtggagtgcagacaccacagctgccccatgctgttcgccaccgccgaggccatggaggcccaccacaagagccactacgccttccactgcccccactgcgacttcgcctgcagcaacaagcacctgttcagaaagcacaagaagcagggccaccccggcagcgaggagctgagatgcaccttctgccccttcgccaccttcaaccccgtggcctaccaggaccacgtgggcaagatgcacgcccacgagaagatccaccagtgccccgagtgcaacttcgccaccgcccacaagagagtgctgatcagacacatgctgctgcacaccggcgagaagccccacaagtgcgagctgtgcgacttcacctgcagagacgtgagctacctgagcaagcacatgctgacccacagcaacaccaaggactacatgtgcaccgagtgcggctacgtgaccaagtggaagcactacctgagagtgcacatgagaaagcacgccggcgacctgagataccagtgcaaccagtgcagctacagatgccacagagccgaccagctgagcagccacaagctgagacaccagggcaagagcctgatgtgcgaggtgtgcgccttcgcctgcaagagaaagtacgagctgcagaagcacatggccagccagcaccaccccggcacccccgcccccctgtacccctgccactactgcagctaccagagcagacacaagcaggccgtgctgagccacgagaactgcaagcacaccagactgagagagttccactgcgccctgtgcgactacagaaccttcagcaacaccaccctgctgttccacaagagaaaggcccacggctacgtgcccggcgaccaggcctggcagctgagatacgccagccaggagcccgagggcgccatgcagggccccacccccccccccgacagcgagcccagcaaccagctgagcgccagacccgagggccccggccacgagcccggcaccgtggtggaccccagcctggaccaggccctgcccgagatgagcgaggaggtgaacaccggcagacaggagggcagcgaggccccccacggcggcgacctgggcggcagccccagccccgccgaggtggaggagggcagctgcaccctgcacctggaggccctgggcgtggagctggagagcgtgaccgagccccccctggaggaggtgaccgagaccgcccccatggagttcagacccctgggcctggagggccccgacggcctggagggccccgagctgagcagcttcgagggcatcggcaccagcgacctgagcgccgaggagaaccccctgctggagaagcccgtgagcgagcccagcaccaacccccccagcctggaggaggcccccaacaactgggtgggcaccttcaagaccaccccccccgccgagaccgcccccctgccccccctgcccgagagcgagagcctgctgaaggccctgagaagacaggacaaggagcaggccgaggccctggtgctggagggcagagtgcagatggtggtgatccagggcgagggcagagccttcagatgcccccactgccccttcatcaccagaagagagaaggccctgaacctgcacagcagaaccggctgccagggcagaagagagcccctgctgtgccccgagtgcggcgccagcttcaagcagcagagaggcctgagcacccacctgctgaagaagtgccccgtgctgctgagaaagaacaagggcctgcccagacccgacagccccatccccctgcagcccgtgctgcccggcacccaggccagcgaggacaccgagagcggcaagcccccccccgccagccaggaggccgagctgctgctgcccaaggacgcccccctggagctgcccagagagcccgaggagaccgaggagcccctggccaccgtgagcggcagccccgtgccccccgccggcaacagcctgcccaccgaggcccccaagaagcactgcttcgaccccgtgccccccgccggcaacagcagccccaccgaggcccccaagaagcaccacctggaccccgtgccccccgccggcaacagcagccccaccgaggccctgaagaagcacagattcgagcagggcaagttccactgcaacagctgccccttcctgtgcagcagactgagcagcatcaccagccacgtggccgagggctgcagaggcggcagaggcggcggcggcaagagaggcaccccccagacccagcccgacgtgagccccctgagcaacggcgacagcgccccccccaagaacggcagcaccgagagcagcagcggcgacggcgacaccgtgctggtgcagaagcagaagggcgccagattcagctgccccacctgccccttcagctgccagcaggagagagccctgagaacccaccagatcagaggctgccccctggaggagagcggcgagctgcactgcagcctgtgccccttcaccgcccccgccgccaccgccctgagactgcaccagaagagaagacaccccaccgccgcccccgccagaggccccagaccccacctgcagtgcggcgactgcggcttcacctgcaagcagagcagatgcatgcagcagcacagaagactgaagcacgagggcgtgaagccccaccagtgccccttctgcgacttcagcaccaccagaagatacagactggaggcccaccagagcagacacaccggcatcggcagaatcccctgcagcagctgcccccagaccttcggcaccaacagcaagctgagactgcacagactgagagtgcacgacaagacccccacccacttctgccccctgtgcgactacagcggctacctgagacacgacatcaccagacacgtgaacagctgccaccagggcacccccgccttcgcctgcagccagtgcgaggcccagttcagcagcgagaccgccctgaagcagcacgccctgagaagacaccccgagcccgcccagcccgcccccggcagccccgccgagaccaccgagggccccctgcactgcagcagatgcggcctgctgtgccccagccccgccagcctgagaggccacaccagaaagcagcaccccagactggagtgcggcgcctgccaggaggccttccccagcagactggccctggacgagcacagaagacagcagcacttcagccacagatgccagctgtgcgacttcgccgccagagagagagtgggcctggtgaagcactacctggagcagcacgaggagaccagcgccgccgtggccgccagcgacggcgacggcgacgccggccagccccccctgcactgccccttctgcgacttcacctgcagacaccagctggtgctggaccaccacgtgaagggccacggcggcaccagactgtacaagtgcaccgactgcgcctacagcaccaagaacagacagaagatcacctggcacagcagaatccacaccggcgagaagccctaccactgccacctgtgcccctacgcctgcgccgaccccagcagactgaagtaccacatgagaatccacaaggaggagagaaagtacctgtgccccgagtgcggctacaagtgcaagtgggtgaaccagctgaagtaccacatgaccaagcacaccggcctgaagccctaccagtgccccgagtgcgagtactgcaccaacagagccgacgccctgagagtgcaccaggagaccagacacagagaggccagagccttcatgtgcgagcagtgcggcaaggccttcaagaccagattcctgctgagaacccacctgagaaagcacagcgaggccaagccctacgtgtgcaacgtgtgccacagagccttcagatgggccgccggcctgagacaccacgccctgacccacaccgacagacaccccttcttctgcagactgtgcaactacaaggccaagcagaagttccaggtggtgaagcacgtgagaagacaccaccccgaccaggccgaccccaaccagggcgtgggcaaggaccccaccacccccaccgtgcacctgcacgacgtgcagctggaggaccccagcccccccgcccccgccgccccccacaccggccccgagggctag

SEQ ID NO: 105719 - DNA, 45 bp, Artificial Sequence
  Description of Artificial Sequence: Synthetic coding sequence
atgaccgaccccctgctggacagccagcccgccagcagcacctag

SEQ ID NO: 105720 - DNA, 5064 bp, Artificial Sequence; identical to SEQ ID NO: 105718
  Description of Artificial Sequence: Synthetic coding sequence

SEQ ID NO: 105721 - DNA, 81 bp, Artificial Sequence
  Description of Artificial Sequence: Synthetic coding sequence
atgaccgaccccctgctggacagccagcccgccagcagcaccggcgagatggacggcctgtgccccgagctgctgctgtag

SEQ ID NO: 105722 - DNA, 1824 bp, Artificial Sequence
  Description of Artificial Sequence: Synthetic coding sequence
atgctgctggcccagatcaacagagacagccagggcatgaccgagttccccggcggcggcatggaggcccagcacgtgaccctgtgcctgaccgaggccgtgaccgtggccgacgccaagctgatcgacggccaggtgatccagctggaggacggcagcgccgcctacgtgcagcacgtgcccatccccaagagcaccggcgacagcctgagactggaggacggccaggccgtgcagctggaggacggcaccaccgccttcatccaccacaccagcaaggacagctacgaccagagcgccctgcaggccgtgcagctggaggacggcaccaccgcctacatccaccacgccgtgcaggtgccccagagcgacaccatcctggccatccaggccgacggcaccgtggccggcctgcacaccggcgacgccaccatcgaccccgacaccatcagcgccctggagcagtacgccgccaaggtgagcatcgacggcagcgagagcgtggccggcaccggcatgatcggcgagaacgagcaggagaagaagatgcagatcgtgctgcagggccacgccaccagagtgaccgccaagagccagcagagcggcgagaaggccttcagatgcgagtacgacggctgcggcaagctgtacaccaccgcccaccacctgaaggtgcacgagagaagccacaccggcgacagaccctaccagtgcgagcacgccggctgcggcaaggccttcgccaccggctacggcctgaagagccacgtgagaacccacaccggcgagaagccctacagatgcagcgaggacaactgcaccaagagcttcaagaccagcggcgacctgcagaagcacatcagaacccacaccggcgagagacccttcaagtgccccttcgagggctgcggcagaagcttcaccaccagcaacatcagaaaggtgcacgtgagaacccacaccggcgagagaccctactactgcaccgagcccggctgcggcagagccttcgccagcgccaccaactacaagaaccacgtgagaatccacaccggcgagaagccctacgtgtgcaccgtgcccggctgcgacaagagattcaccgagtacagcagcctgtacaagcaccacgtggtgcacacccacagcaagccctacaactgcaaccactgcggcaagacctacaagcagatcagcaccctggccatgcacaagagaaccgcccacaacgacaccgagcccatcgaggaggagcaggaggccttcttcgagcccccccccggccagggcgaggacgtgctgaagggcagccagatcacctacgtgaccggcgtggagggcgacgacgtggtgagcacccaggtggccaccgtgacccagagcggcctgagccagcaggtgaccctgatcagccaggacggcacccagcacgtgaacatcagccaggccgacatgcaggccatcggcaacaccatcaccatggtgacccaggacggcacccccatcaccgtgcccgcccacgacgccgtgatcagcagcgccggcacccacagcgtggccatggtgaccgccgagggcaccgagggcgagcaggtggccatcgtggcccaggacctggccgccttccacaccgccagcagcgagatgggccaccagcagcacagccaccacctggtgaccaccgagaccagacccctgaccctggtggccaccagcaacggcacccagatcgccgtgcagctgggcgagcagcccagcctggaggaggccatcagaatcgccagcagaatccagcagggcgagacccccggcctggacgactag

SEQ ID NO: 105723 - DNA, 1917 bp, Artificial Sequence
  Description of Artificial Sequence: Synthetic coding sequence
atgctgctggcccagatcaacagagacagccagggcatgaccgagttccccggcggcggcatggaggcccagcacgtgaccctgtgcctgaccgaggccgtgaccgtggccgacggcgacaacctggagaacatggagggcgtgagcctgcaggccgtgaccctggccgacggcagcaccgcctacatccagcacaacagcaaggacgccaagctgatcgacggccaggtgatccagctggaggacggcagcgccgcctacgtgcagcacgtgcccatccccaagagcaccggcgacagcctgagactggaggacggccaggccgtgcagctggaggacggcaccaccgccttcatccaccacaccagcaaggacagctacgaccagagcgccctgcaggccgtgcagctggaggacggcaccaccgcctacatccaccacgccgtgcaggtgccccagagcgacaccatcctggccatccaggccgacggcaccgtggccggcctgcacaccggcgacgccaccatcgaccccgacaccatcagcgccctggagcagtacgccgccaaggtgagcatcgacggcagcgagagcgtggccggcaccggcatgatcggcgagaacgagcaggagaagaagatgcagatcgtgctgcagggccacgccaccagagtgaccgccaagagccagcagagcggcgagaaggccttcagatgcgagtacgacggctgcggcaagctgtacaccaccgcccaccacctgaaggtgcacgagagaagccacaccggcgacagaccctaccagtgcgagcacgccggctgcggcaaggccttcgccaccggctacggcctgaagagccacgtgagaacccacaccggcgagaagccctacagatgcagcgaggacaactgcaccaagagcttcaagaccagcggcgacctgcagaagcacatcagaacccacaccggcgagagacccttcaagtgccccttcgagggctgcggcagaagcttcaccaccagcaacatcagaaaggtgcacgtgagaacccacaccggcgagagaccctactactgcaccgagcccggctgcggcagagccttcgccagcgccaccaactacaagaaccacgtgagaatccacaccggcgagaagccctacgtgtgcaccgtgcccggctgcgacaagagattcaccgagtacagcagcctgtacaagcaccacgtggtgcacacccacagcaagccctacaactgcaaccactgcggcaagacctacaagcagatcagcaccctggccatgcacaagagaaccgcccacaacgacaccgagcccatcgaggaggagcaggaggccttcttcgagcccccccccggccagggcgaggacgtgctgaagggcagccagatcacctacgtgaccggcgtggagggcgacgacgtggtgagcacccaggtggccaccgtgacccagagcggcctgagccagcaggtgaccctgatcagccaggacggcacccagcacgtgaacatcagccaggccgacatgcaggccatcggcaacaccatcaccatggtgacccaggacggcacccccatcaccgtgcccgcccacgacgccgtgatcagcagcgccggcacccacagcgtggccatggtgaccgccgagggcaccgagggcgagcaggtggccatcgtggcccaggacctggccgccttccacaccgccagcagcgagatgggccaccagcagcacagccaccacctggtgaccaccgagaccagacccctgaccctggtggccaccagcaacggcacccagatcgccgtgcagctgggcgagcagcccagcctggaggaggccatcagaatcgccagcagaatccagcagggcgagacccccggcctggacgactag

SEQ ID NO: 105724 - DNA, 429 bp, Artificial Sequence
  Description of Artificial Sequence: Synthetic coding sequence
atgctgctggcccagatcaacagagacagccagggcatgaccgagttccccggcggcggcatggaggcccagcacgtgaccctgtgcctgaccgaggccgtgaccgtggccgacggcgacaacctggagaacatggagggcgtgagcctgcaggccgtgaccctggccgacggcagcaccgcctacatccagcacaacagcaaggacgccaagctgatcgacggccaggtgatccagctggaggacggcagcgccgcctacgtgcagcacgtgcccatccccaagagcagagacagcctgagactggaggacggccaggccgtgcagctggaggacggcaccaccgccttcatccaccacaccagcaaggacagctacgaccagagcgccctgcaggccgtgcagctggaggacggcaccaccgcctag

SEQ ID NO: 105725 - DNA, 255 bp, Artificial Sequence
  Description of Artificial Sequence: Synthetic coding sequence
atgctgctggcccagatcaacagagacagccagggcatgaccgagttccccggcggcggcatggaggcccagcacgtgaccctgtgcctgaccgaggccgtgaccgtggccgacggcgacaacctggagaacatggagggcgtgagcctgcaggccgtgaccctggccgacggcagcaccgcctacatccagcacaacagcaaggacgccaagctgatcgacggccaggtgatccagctggaggacggcagctag

SEQ ID NO: 105726 - DNA, 222 bp, Artificial Sequence
  Description of Artificial Sequence: Synthetic coding sequence
atgctgctggcccagatcaacagagacagccagggcatgaccgagttccccggcggcggcatggaggcccagcacgtgaccctgtgcctgaccgaggccgtgaccgtggccgacggcgacaacctggagaacatggagggcgtgagcctgcaggccgtgaccctggccgacggcagcaccgcctacatccagcacaacagcaaggacgccaagctgatctag

SEQ ID NO: 105727 - DNA, 573 bp, Artificial Sequence
  Description of Artificial Sequence: Synthetic coding sequence
atgctgctggcccagatcaacagagacagccagggcatgaccgagttccccggcggcggcatggaggcccagcacgtgaccctgtgcctgaccgaggccgtgaccgtggccgacggcgacaacctggagaacatggagggcgtgagcctgcaggccgtgaccctggccgacggcagcaccgcctacatccagcacaacagcaaggacgccaagctgatcgacggccaggtgatccagctggaggacggcagcgccgcctacgtgcagcacgtgcccatccccaagagcaccggcgacagcctgagactggaggacggccaggccgtgcagctggaggacggcaccaccgccttcatccaccacaccagcaaggacagctacgaccagagcgccctgcaggccgtgcagctggaggacggcaccaccgcctacatccaccacgccgtgcaggtgccccagagcgacaccatcctggccatccaggccgacggcaccgtggccggcctgcacaccggcgacgccaccatcgaccccgacaccatcagcgccctggagcagtacgccgccaagtag

SEQ ID NO: 105728 - DNA, 411 bp, Artificial Sequence
  Description of Artificial Sequence: Synthetic coding sequence
atgctgctggcccagatcaacagagacagccagggcatgaccgagttccccggcggcggcatggaggcccagcacgtgaccctgtgcctgaccgaggccgtgaccgtggccgacggcgacaacctggagaacatggagggcgtgagcctgcaggccgtgaccctggccgacggcagcaccgcctacatccagcacaacagcaaggacgccaagctgatcgacggccaggtgatccagctggaggacggcagcgccgcctacgtgcagcacgtgcccatccccaagagcaccggcgacagcctgagactggaggacggccaggccgtgcagctggaggacggcaccaccgccttcatccaccacaccagcaaggacagctacgaccagagcgccctgcaggccgtgcagtag

SEQ ID NO: 105729 - DNA, 528 bp, Artificial Sequence
  Description of Artificial Sequence: Synthetic coding sequence
atgctgctggcccagatcaacagagacagccagggcatgaccgagttccccggcggcggcatggaggcccagcacgtgaccctgtgcctgaccgaggccgtgaccgtggccgacggcgacaacctggagaacatggagggcgtgagcctgcaggccgtgaccctggccgacggcagcaccgcctacatccagcacaacagcaaggacgccaagctgatcgacggccaggtgatccagctggaggacggcagcgccgcctacgtgcagcacgtgcccatccccaagagcaccggcgacagcctgagactggaggacggccaggccgtgcagctggaggacggcaccaccgccttcatccaccacaccagcaaggacagctacgaccagagcgccctgcaggccgtgcagctggaggacggcaccaccgcctacatccaccacgccgtgcaggtgccccagagcgacaccatcctggccatccaggccgacggcaccgtggccggcctgcacaccggcgacgccacctag

SEQ ID NO: 105730 - DNA, 879 bp, Artificial Sequence
  Description of Artificial Sequence: Synthetic coding sequence
atgagccacctgagccagcagagaatctacagcggcgagaaccccttcgcctgcaaggtgtgcggcaaggtgttcagccacaagagcaacctgaccgagcacgagcacttccacaccagagagaagcccttcgagtgcaacgagtgcggcaaggccttcagccagaagcagtacgtgatcaagcaccagaacacccacaccggcgagaagctgttcgagtgcaacgagtgcggcaagagcttcagccagaaggagaacctgctgacccaccagaagatccacaccggcgagaagcccttcgagtgcaaggactgcggcaaggccttcatccagaagagcaacctgatcagacaccagagaacccacaccggcgagaagcccttcgtgtgcaaggagtgcggcaagaccttcagcggcaagagcaacctgaccgagcacgagaagatccacatcggcgagaagcccttcaagtgcagcgagtgcggcaccgccttcggccagaagaagtacctgatcaagcaccagaacatccacaccggcgagaagccctacgagtgcaacgagtgcggcaaggccttcagccagagaaccagcctgatcgtgcacgtgagaatccacagcggcgacaagccctacgagtgcaacgtgtgcggcaaggccttcagccagagcagcagcctgaccgtgcacgtgagaagccacaccggcgagaagccctacggctgcaacgagtgcggcaaggccttcagccagttcagcaccctggccctgcacctgagaatccacaccggcaagaagccctaccagtgcagcgagtgcggcaaggccttcagccagaagagccaccacatcagacaccagaagatccacacccactag

SEQ ID NO: 105731 - DNA, 879 bp, Artificial Sequence; identical to SEQ ID NO: 105730
  Description of Artificial Sequence: Synthetic coding sequence

SEQ ID NO: 105732 - DNA, 2385 bp, Artificial Sequence
  Description of Artificial Sequence: Synthetic coding sequence
atgaacatcgacgacaagctggagggcctgttcctgaagtgcggcggcatcgacgagatgcagagcagcagaaccatggtggtgatgggcggcgtgagcggccagagcaccgtgagcggcgagctgcaggacagcgtgctgcaggacagaagcatgccccaccaggagatcctggccgccgacgaggtgctgcaggagagcgagatgagacagcaggacatgatcagccacgacgagctgatggtgcacgaggagaccgtgaagaacgacgaggagcagatggagacccacgagagactgccccagggcctgcagtacgccctgaacgtgcccatcagcgtgaagcaggagatcaccttcaccgacgtgagcgagcagctgatgagagacaagaagcagatcagagagcccgtggacctgcagaagaagaagaagagaaagcagagaagccccgccaagatcctgaccatcaacgaggacggcagcctgggcctgaagacccccaagagccacgtgtgcgagcactgcaacgccgccttcagaaccaactaccacctgcagagacacgtgttcatccacaccggcgagaagcccttccagtgcagccagtgcgacatgagattcatccagaagtacctgctgcagagacacgagaagatccacaccggcgagaagcccttcagatgcgacgagtgcggcatgagattcatccagaagtaccacatggagagacacaagagaacccacagcggcgagaagccctaccagtgcgagtactgcctgcagtacttcagcagaaccgacagagtgctgaagcacaagagaatgtgccacgagaaccacgacaagaagctgaacagatgcgccatcaagggcggcctgctgaccagcgaggaggacagcggcttcagcaccagccccaaggacaacagcctgcccaagaagaagagacagaagaccgagaagaagagcagcggcatggacaaggagagcgccctggacaagagcgacctgaagaaggacaagaacgactacctgcccctgtacagcagcagcaccaaggtgaaggacgagtacatggtggccgagtacgccgtggagatgccccacagcagcgtgggcggcagccacctggaggacgccagcggcgagatccacccccccaagctggtgctgaagaagatcaacagcaagagaagcctgaagcagcccctggagcagaaccagaccatcagccccctgagcacctacgaggagagcaaggtgagcaagtacgccttcgagctggtggacaagcaggccctgctggacagcgagggcaacgccgacatcgaccaggtggacaacctgcaggagggccccagcaagcccgtgcacagcagcaccaactacgacgacgccatgcagttcctgaagaagaagagatacctgcaggccgccagcaacaacagcagagagtacgccctgaacgtgggcaccatcgccagccagcccagcgtgacccaggccgccgtggccagcgtgatcgacgagagcaccaccgccagcatcctggagagccaggccctgaacgtggagatcaagagcaaccacgacaagaacgtgatccccgacgaggtgctgcagaccctgctggaccactacagccacaaggccaacggccagcacgagatcagcttcagcgtggccgacaccgaggtgaccagcagcatcagcatcaacagcagcgaggtgcccgaggtgacccccagcgagaacgtgggcagcagcagccaggccagcagcagcgacaaggccaacatgctgcaggagtacagcaagttcctgcagcaggccctggacagaaccagccagaacgacgcctacctgaacagccccagcctgaacttcgtgaccgacaaccagaccctgcccaaccagcccgccttcagcagcatcgacaagcaggtgtacgccaccatgcccatcaacagcttcagaagcggcatgaacagccccctgagaaccacccccgacaagagccacttcggcctgatcgtgggcgacagccagcacagcttccccttcagcggcgacgagaccaaccacgccagcgccaccagcacccaggacttcctggaccaggtgaccagccagaagaaggccgaggcccagcccgtgcaccaggcctaccagatgagcagcttcgagcagcccttcagagccccctaccacggcagcagagccggcatcgccacccagttcagcaccgccaacggccaggtgaacctgagaggccccggcaccagcgccgagttcagcgagttccccctggtgaacgtgaacgacaacagagccggcatgaccagcagccccgacgccaccaccggccagaccttcggctag

SEQ ID NO: 105733 - DNA, 252 bp, Artificial Sequence
  Description of Artificial Sequence: Synthetic coding sequence
atgaacatcgacgacaagctggagggcctgttcctgaagtgcggcggcatcgacgagatgcagagcagcagaaccatggtggtgatgggcggcgtgagcggccagagcaccgtgagcggcgagctgcaggacagcgtgctgcaggacagaagcatgccccaccaggagatcctggccgccgacgaggtgctgcaggagagcgagatgagacagcaggacatgatcagccacgacgagctgatggtgcactag

SEQ ID NO: 105734 - DNA, 435 bp, Artificial Sequence
  Description of Artificial Sequence: Synthetic coding sequence
atgaagggcgagaagcccttccagtgcagccagtgcgacatgagattcatccagaagtacctgctgcagagacacgagaagatccacaccggcgagaagcccttcagatgcgacgagtgcggcgacgagaccaaccacgccagcgccaccagcacccaggacttcctggaccaggtgaccagccagaagaaggccgaggcccagcccgtgcaccaggcctaccagatgagcagcttcgagcagcccttcagagccccctaccacggcagcagagccggcatcgccacccagttcagcaccgccaacggccaggtgaacctgagaggccccggcaccagcgccgagttcagcgagttccccctggtgaacgtgaacgacaacagagccggcatgaccagcagccccgacgccaccaccggccagaccttcggctag

SEQ ID NO: 105735 - DNA, 78 bp, Artificial Sequence
  Description of Artificial Sequence: Synthetic coding sequence
atgaacatcgacgacaagctggagggcctgttcctgaagtgcggcggcatcgacgagatgcagagcagcagaacctag

SEQ ID NO: 105736 - DNA, 2385 bp, Artificial Sequence; identical to SEQ ID NO: 105732
  Description of Artificial Sequence: Synthetic coding sequence

SEQ ID NO: 105737 - DNA, 2385 bp, Artificial Sequence; identical to SEQ ID NO: 105732
  Description of Artificial Sequence: Synthetic coding sequence

SEQ ID NO: 105738 - DNA, 2385 bp, Artificial Sequence; identical to SEQ ID NO: 105732
  Description of Artificial Sequence: Synthetic coding sequence

SEQ ID NO: 105739 - DNA, 228 bp, Artificial Sequence
  Description of Artificial Sequence: Synthetic coding sequence
atgaacatcgacgacaagctggagggcctgttcctgaagtgcggcggcatcgacgagatgcagagcagcagaaccatggtggtgatgggcggcgtgagcggccagagcaccgtgagcggcgagctgcaggacagcgtgctgcaggacagaagcatgccccaccaggagatcctggccgccgacgaggtgctgcaggagagcgagatgagacagcaggacatgatctag

SEQ ID NO: 105740 - DNA, 1365 bp, Artificial Sequence
  Description of Artificial Sequence: Synthetic coding sequence
atgaacatcgacgacaagctggagggcctgttcctgaagtgcggcggcatcgacgagatgcagagcagcagaaccatggtggtgatgggcggcgtgagcggccagagcaccgtgagcggcgagctgcaggacagcgtgctgcaggacagaagcatgccccaccaggagatcctggccgccgacgaggtgctgcaggagagcgagatgagacagcaggacatgatcagccacgacgagctgatggtgcacgaggagaccgtgaagaacgacgaggagcagatggagacccacgagagactgccccagggcctgcagtacgccctgaacgtgcccatcagcgtgaagcaggagatcaccttcaccgacgtgagcgagcagctgatgagagacaagaagcagatcagagagcccgtggacctgcagaagaagaagaagagaaagcagagaagccccgccaagatcctgaccatcaacgaggacggcagcctgggcctgaagacccccaagagccacgtgtgcgagcactgcaacgccgccttcagaaccaactaccacctgcagagacacgtgttcatccacaccggcgagaagcccttccagtgcagccagtgcgacatgagattcatccagaagtacctgctgcagagacacgagaagatccacaccggcgagaagcccttcagatgcgacgagtgcggcatgagattcatccagaagtaccacatggagagacacaagagaacccacagcggcgagaagccctaccagtgcgagtactgcctgcagtacttcagcagaaccgacagagtgctgaagcacaagagaatgtgccacgagaaccacgacaagaagctgaacagatgcgccatcaagggcggcctgctgaccagcgaggaggacagcggcttcagcaccagccccaaggacaacagcctgcccaagaagaagagacagaagaccgagaagaagagcagcggcatggacaaggagagcgccctggacaagagcgacctgaagaaggacaagaacgactacctgcccctgtacagcagcagcaccaaggtgaaggacgagtacatggtggccgagtacgccgtggagatgccccacagcagcgtgggcggcagccacctggaggacgccagcggcgagatccacccccccaagctggtgctgaagaagatcaacagcaagagaagcctgaagcagcccctggagcagaaccagaccatcagccccctgagcacctacgaggagagcaagttccagagcatgctgctgaacctgtggatcaacagactgtactggacccagaaggccatgctgaccctgatcagactgatcatctgcagaagagcccagtag

SEQ ID NO: 105741 - DNA, 396 bp, Artificial Sequence
  Description of Artificial Sequence: Synthetic coding sequence
atgagattcatccagaagtacctgctgcagagacacgagaagatccacaccggcgagaagcccttcagatgcgacgagtgcggcgacgagaccaaccacgccagcgccaccagcacccaggacttcctggaccaggtgaccagccagaagaaggccgaggcccagcccgtgcaccaggcctaccagatgagcagcttcgagcagcccttcagagccccctaccacggcagcagagccggcatcgccacccagttcagcaccgccaacggccaggtgaacctgagaggccccggcaccagcgccgagttcagcgagttccccctggtgaacgtgaacgacaacagagccggcatgaccagcagccccgacgccaccaccggccagaccttcggctag

SEQ ID NO: 105742 - DNA, 432 bp, Artificial Sequence
  Description of Artificial Sequence: Synthetic coding sequence
aagacccactacaactgcggcgagcacaccaaggccttcagcggcaagcacaccctggtgcagcagcagagaaccctgaccaccgagagatgctacatctgcagcgagtgcggcaagagcttcagcaacaagagcaacctgatcaagcacagaagagtgcacaccggcgagagaccctacgagtgcagcgagtgcggcaagagcttcagccagagaagcgccctgctgcagcacagaggcgtgcacaccggcgagagaccctacgagtgcagcgagtgcggcaagttcttcacctaccacagcagcctgatcaagcaccagaaggtgcacagcggcagcagaccctacgagtgcagcgagtgcggcaagagcttcagccagaacagcagcctgatcgagcaccacagagtgcacaccggcgagagaccctag

SEQ ID NO: 105743 - DNA, 1314 bp, Artificial Sequence
  Description of Artificial Sequence: Synthetic coding sequence
atggccgccgccaccctgagaacccccacccagggcaccgtgaccttcgaggacgtggccgtgcacttcagctgggaggagtggggcctgctggacgaggcccagagatgcctgtacagagacgtgatgctggagaacctggccctgctgaccagcctggacgtgcaccaccagaagcagcacctgggcgagaagcacttcagaagcaacgtgggcagagccctgttcgtgaagacctgcaccttccacgtgagcggcgagcccagcacctgcagagaggtgggcaaggacttcctggccaagctgggcttcctgcaccagcaggccgcccacaccggcgagcagagcaacagcaagagcgacggcggcgccatcagccacagaggcaagacccactacaactgcggcgagcacaccaaggccttcagcggcaagcacaccctggtgcagcagcagagaaccctgaccaccgagagatgctacatctgcagcgagtgcggcaagagcttcagcaagagctacagcctgaacgaccactggagactgcacaccggcgagaagccctacgagtgcagagagtgcggcaagagcttcagacagagcagcagcctgatccagcacagaagagtgcacaccgccgtgagaccccacgagtgcgacgagtgcggcaagctgttcagcaacaagagcaacctgatcaagcacagaagagtgcacaccggcgagagaccctacgagtgcagcgagtgcggcaagagcttcagccagagaagcgccctgctgcagcacagaggcgtgcacaccggcgagagaccctacgagtgcagcgagtgcggcaagttcttcacctaccacagcagcctgatcaagcaccagaaggtgcacagcggcagcagaccctacgagtgcagcgagtgcggcaagagcttcagccagaacagcagcctgatcgagcaccacagagtgcacaccggcgagagaccctacaagtgcagcgagtgcggcaagagcttcagccagagaagcgccctgctgcagcacagaggcgtgcacaccggcgagagaccctacgagtgcagcgagtgcggcaagttcttcccctacagcagcagcctgagaaagcaccagagagtgcacaccggcagcagaccctacgagtgcagcgagtgcggcaagagcttcacccagaacagcggcctgatcaagcacagaagagtgcacaccggcgagaagccctacgagtgcaccgagtgcggcaagagcttcagccacaacagcagcctgatcaagcaccagagaatccacagcagatag

SEQ ID NO: 105744 - DNA, 1314 bp, Artificial Sequence; identical to SEQ ID NO: 105743
  Description of Artificial Sequence: Synthetic coding sequence

SEQ ID NO: 105745 - DNA, 1617 bp, Artificial Sequence
  Description of Artificial Sequence: Synthetic coding sequence
atgaccaccttcaaggaggccgtgaccttcaaggacgtggccgtggtgttcaccgaggaggagctgggcctgctggaccccgcccagagaaagctgtacagagacgtgatgctggagaacttcagaaacctgctgagcgtgggccaccagcccttccaccaggacacctgccacttcctgagagaggagaagttctggatgatgggcaccgccacccagagagagggcaacagcggcggcaagatccagaccgagctggagagcgtgcccgaggccggcgcccacgaggagtggagctgccagcagatctgggagcagatcgccaaggacctgaccagaagccaggacagcatcatcaacaacagccagttcttcgagaacggcgacgtgcccagccaggtggaggccggcctgcccaccatccacaccggccagaagcccagccagggcggcaagtgcaagcagagcatcagcgacgtgcccatcttcgacctgccccagcagctgtacagcgaggagaagagctacacctgcgacgagtgcggcaagagcatctgctacatcagcgccctgcacgtgcaccagagagtgcacgtgggcgagaagctgttcatgtgcgacgtgtgcggcaaggagttcagccagagcagccacctgcagacccaccagagagtgcacaccggcgagaagcccttcaagtgcgagcagtgcggcaagggcttcagcagaagaagcgccctgaacgtgcacagaaagctgcacaccggcgagaagccctacatctgcgaggcctgcggcaaggccttcatccacgacagccagctgaaggagcacaagagaatccacaccggcgagaagcccttcaagtgcgacatctgcggcaagaccttctacttcagaagcagactgaagagccacagcatggtgcacaccggcgagaagcccttcagatgcgacacctgcgacaagagcttccaccagagaagcgccctgaacagacactgcatggtgcacaccggcgagaagccctacagatgcgagcagtgcggcaagggcttcatcggcagactggacttctacaagcaccaggtggtgcacaccggcgagaagccctacaactgcaaggagtgcggcaagagcttcagatggagcagctgcctgctgaaccaccagagagtgcacagcggcgagaagagcttcaagtgcgaggagtgcggcaagggcttctacaccaacagccagctgagcagccaccagagaagccacagcggcgagaagccctacaagtgcgaggagtgcggcaagggctacgtgaccaagttcaacctggacctgcaccagagagtgcacaccggcgagagaccctacaactgcaaggagtgcggcaagaacttcagcagagccagcagcatcctgaaccacaagagactgcactgccagaagaagcccttcaagtgcgaggactgcggcaagagactggtgcacagaacctacagaaaggaccagcccagagactacagcggcgagaaccccagcaagtgcgaggactgcggcagaagatacaagagaagactgaacctggacatcctgctgagcctgttcctgaacgacacctag

SEQ ID NO: 105746 - DNA, 1650 bp, Artificial Sequence
  Description of Artificial Sequence: Synthetic coding sequence
atgatcaagagaagcaaggtgctggtgttctgcagcaagatcatggaggaggccgtgaccttcaaggacgtggccgtggtgttcaccgaggaggagctgggcctgctggaccccgcccagagaaagctgtacagagacgtgatgctggagaacttcagaaacctgctgagcgtgggccaccagcccttccaccaggacacctgccacttcctgagagaggagaagttctggatgatgggcaccgccacccagagagagggcaacagcggcggcaagatccagaccgagctggagagcgtgcccgaggccggcgcccacgaggagtggagctgccagcagatctgggagcagatcgccaaggacctgaccagaagccaggacagcatcatcaacaacagccagttcttcgagaacggcgacgtgcccagccaggtggaggccggcctgcccaccatccacaccggccagaagcccagccagggcggcaagtgcaagcagagcatcagcgacgtgcccatcttcgacctgccccagcagctgtacagcgaggagaagagctacacctgcgacgagtgcggcaagagcatctgctacatcagcgccctgcacgtgcaccagagagtgcacgtgggcgagaagctgttcatgtgcgacgtgtgcggcaaggagttcagccagagcagccacctgcagacccaccagagagtgcacaccggcgagaagcccttcaagtgcgagcagtgcggcaagggcttcagcagaagaagcgccctgaacgtgcacagaaagctgcacaccggcgagaagccctacatctgcgaggcctgcggcaaggccttcatccacgacagccagctgaaggagcacaagagaatccacaccggcgagaagcccttcaagtgcgacatctgcggcaagaccttctacttcagaagcagactgaagagccacagcatggtgcacaccggcgagaagcccttcagatgcgacacctgcgacaagagcttccaccagagaagcgccctgaacagacactgcatggtgcacaccggcgagaagccctacagatgcgagcagtgcggcaagggcttcatcggcagactggacttctacaagcaccaggtggtgcacaccggcgagaagccctacaactgcaaggagtgcggcaagagcttcagatggagcagctgcctgctgaaccaccagagagtgcacagcggcgagaagagcttcaagtgcgaggagtgcggcaagggcttctacaccaacagccagctgagcagccaccagagaagccacagcggcgagaagccctacaagtgcgaggagtgcggcaagggctacgtgaccaagttcaacctggacctgcaccagagagtgcacaccggcgagagaccctacaactgcaaggagtgcggcaagaacttcagcagagccagcagcatcctgaaccacaagagactgcactgccagaagaagcccttcaagtgcgaggactgcggcaagagactggtgcacagaacctacagaaaggaccagcccagagactacagcggcgagaaccccagcaagtgcgaggactgcggcagaagatacaagagaagactgaacctggacatcctgctgagcctgttcctgaacgacacctag

SEQ ID NO: 105747 - DNA, 693 bp, Artificial Sequence
  Description of Artificial Sequence: Synthetic coding sequence
atggtgatgagcccccccagactgaagcaggactacccccagttcatccaggacagaaacctgcccagagtgggcagcgtgaacagccccagcgtgatgttccccagcctgatcttcctgagcagctacacccagaagagaagcctgatccacgtgatgagcgtggagaaggccagcgtgaccagccagctgttcatgttcatcagagagagcacctgggagagaaacagcctgtgcgtgatgtgcgtggccagaaacctggtgaaggcccacatctgcaagctgatcagagagagcaccctggagagaaaccacagcaacgtgagcaacgtgggcaaggtgagcgtggtggaccagcacctgatgttcatcgtgaactacacccaggagagaaacctgaccttcgtgagacacgtgggcagacccagcttcatgatccccagcctgagaaacatcagagagagcatcctgggcagaaaccacagcaacgtgatctacgtggtgagacccagcatcctgggccaggacctgagagccatcccctggttcacccaggagaagaaccacctgggcgtgatccacgtgatcagagccttcatcagagaccagcacctgatcggcatcgcctggagcacccaggagagaaacagaaccgacgtgagcagcgtggagaaggccctgctggtgggctag

SEQ ID NO: 105748 - DNA, 1521 bp, Artificial Sequence
  Description of Artificial Sequence: Synthetic coding sequence
atgcccgccaacggcaccagcccccagagattccccgccctgatccccggcgagcccggcagaagcttcgagggcagcgtgagcttcgaggacgtggccgtggacttcaccagacaggagtggcacagactggaccccgcccagagaaccatgcacaaggacgtgatgctggagacctacagcaacctggccagcgtgggcctgtgcgtggccaagcccgagatgatcttcaagctggagagaggcgaggagctgtggatcctggaggaggagagcagcggccacggctacagcggcagcctgagcctgctgtgcggcaacggcagcgtgggcgacaacgccctgagacacgacaacgacctgctgcaccaccagaagatccagaccctggaccagaacgtggagtacaacggctgcagaaaggccttccacgagaagaccggcttcgtgagaagaaagagaacccccagaggcgacaagaacttcgagtgccacgagtgcggcaaggcctactgcagaaagagcaacctggtggagcacctgagaatccacaccggcgagagaccctacgagtgcggcgagtgcgccaagaccttcagcgccagaagctacctgatcgcccaccagaagacccacaccggcgagagacccttcgagtgcaacgagtgcggcaagagcttcggcagaaagagccagctgatcctgcacaccagaacccacaccggcgagagaccctacgagtgcaccgagtgcggcaagaccttcagcgagaaggccaccctgaccatccaccagagaacccacaccggcgagaagccctacgagtgcagcgagtgcggcaagaccttcagagtgaagatcagcctgacccagcaccacagaacccacaccggcgagaagccctacgagtgcggcgagtgcggcaagaacttcagagccaagaagagcctgaaccagcaccagagaatccacaccggcgagaagccctacgagtgcggcgagtgcggcaagttcttcagaatgaagatgaccctgaacaaccaccagagaacccacaccggcgagaagccctaccagtgcaacgagtgcggcaagagcttcagagtgcacagcagcctgggcatccaccagagaatccacaccggcgagaagccctacgagtgcaacgagtgcggcaacgccttctacgtgaaggccagactgatcgagcaccagagaatgcacagcggcgagaagccctacgagtgcagcgagtgcggcaagatcttcagcatgaagaagagcctgtgccagcacagaagaacccacaccggcgagaagccctacgagtgcagcgagtgcggcaacgccttctacgtgaaggtgagactgatcgagcaccagagaatccacaccggcgagagacccttcgagtgccaggagtgcggcaaggccttctgcagaaaggcccacctgaccgagcaccagagaacccacatcggctggagctggagatgcaccatgaagaaggccagccactag

SEQ ID NO: 105749 - DNA, 2049 bp, Artificial Sequence
  Description of Artificial Sequence: Synthetic coding sequence
atgcccagcctgagaaccagaagagaggaggccgagatggagctgagcgtgcccggccccagcccctggacccccgccgcccaggccagagtgagagacgcccccgccgtgacccaccccggcagcgccgcctgcggcaccccctgctgcagcgacaccgagctggaggccatctgcccccactaccagcagcccgactgcgacaccagaaccgaggacaaggagttcctgcacaaggaggacatccacgaggacctggagagccaggccgagatcagcgagaactacgccggcgacgtgagccaggtgcccgagctgggcgacctgtgcgacgacgtgagcgagagagactggggcgtgcccgagggcagaagactgccccagagcctgagccaggagggcgacttcacccccgccgccatgggcctgctgagaggccccctgggcgagaaggacctggactgcaacggcttcgacagcagattcagcctgagccccaacctgatggcctgccaggagatccccaccgaggagagaccccacccctacgacatgggcggccagagcttccagcacagcgtggacctgaccggccacgagggcgtgcccaccgccgagagccccctgatctgcaacgagtgcggcaagaccttccagggcaaccccgacctgatccagagacagatcgtgcacaccggcgaggccagcttcatgtgcgacgactgcggcaagaccttcagccagaacagcgtgctgaagaacagacacagaagccacatgagcgagaaggcctaccagtgcagcgagtgcggcaaggccttcagaggccacagcgacttcagcagacaccagagccaccacagcagcgagagaccctacatgtgcaacgagtgcggcaaggccttcagccagaacagcagcctgaagaagcaccagaagagccacatgagcgagaagccctacgagtgcaacgagtgcggcaaggccttcagaagaagcagcaacctgatccagcaccagagaatccacagcggcgagaagccctacgtgtgcagcgagtgcggcaaggccttcagaagaagcagcaacctgatcaagcaccacagaacccacaccggcgagaagcccttcgagtgcggcgagtgcggcaaggccttcagccagagcgcccacctgagaaagcaccagagagtgcacaccggcgagaagccctacgagtgcaacgactgcggcaagcccttcagcagagtgagcaacctgatcaagcaccacagagtgcacaccggcgagaagccctacaagtgcagcgactgcggcaaggccttcagccagagcagcagcctgatccagcacagaagaatccacaccggcgagaagccccacgtgtgcaacgtgtgcggcaaggccttcagctacagcagcgtgctgagaaagcaccagatcatccacaccggcgagaagccctacagatgcagcgtgtgcggcaaggccttcagccacagcagcgccctgatccagcaccagggcgtgcacaccggcgacaagccctacgcctgccacgagtgcggcaagaccttcggcagaagcagcaacctgatcctgcaccagagagtgcacaccggcgagaagccctacgagtgcaccgagtgcggcaagaccttcagccagagcagcaccctgatccagcaccagagaatccacaacggcctgaagccccacgagtgcaaccagtgcggcaaggccttcaacagaagcagcaacctgatccaccaccagaaggtgcacaccggcgagaagccctacacctgcgtggagtgcggcaagggcttcagccagagcagccacctgatccagcaccagatcatccacaccggcgagagaccctacaagtgcagcgagtgcggcaaggccttcagccagagaagcgtgctgatccagcaccagagaatccacaccggcgtgaagccctacgactgcgccgcctgcggcaaggccttcagccagagaagcaagctgatcaagcaccagctgatccacaccagagagtag

SEQ ID NO: 105750 - DNA, 2049 bp, Artificial Sequence; identical to SEQ ID NO: 105749
  Description of Artificial Sequence: Synthetic coding sequence

SEQ ID NO: 105751 - DNA, 444 bp, Artificial Sequence
  Description of Artificial Sequence: Synthetic coding sequence
atggccctgacccaggtgagactgaccttcagagacgtggccatcgagttcagccaggaggagtggaagtgcctggaccccgcccagagaatcctgtacagagacgtgatgctggagaactactggaacctggtgagcctgggcctgtgccacttcgacatgaacatcatcagcatgctggaggagggcaaggagccctggaccgtgaagagctgcgtgaagatcgccagaaagcccagaacccccgagtgcgtgaagggcgtggtgaccgacctgctgagaagatggaagcactggctgctgctgctgggcatctgctgccccaagccccacggcagagtgagcagcagactgagactgagcagaagcctgggccacttcttccacagcgccttcgccaccttcatgggcgtgtgcgacaagagagtgggcagcatcttctag

SEQ ID NO: 105752 - DNA, 2457 bp, Artificial Sequence
  Description of Artificial Sequence: Synthetic coding sequence
atggccctgacccaggtgagactgaccttcagagacgtggccatcgagttcagccaggaggagtggaagtgcctggaccccgcccagagaatcctgtacagagacgtgatgctggagaactactggaacctggtgagcctgggcctgtgccacttcgacatgaacatcatcagcatgctggaggagggcaaggagccctggaccgtgaagagctgcgtgaagatcgccagaaagcccagaacccccgagtgcgtgaagggcgtggtgaccgacatcccccccaagtgcaccatcaaggacctgctgcccaaggagaagagcagcaccgaggccgtgttccacaccgtggtgctggagagacacgagagccccgacatcgaggacttcagcttcaaggagccccagaagaacgtgcacgacttcgagtgccagtggagagacgacaccggcaactacaagggcgtgctgatggcccagaaggagggcaagagagaccagagagacagaagagacatcgagaacaagctgatgaacaaccagctgggcgtgagcttccacagccacctgcccgagctgcagctgttccagggcgagggcaagatgtacgagtgcaaccaggtggagaagagcaccaacaacggcagcagcgtgagccccctgcagcagatccccagcagcgtgcagacccacagaagcaagaagtaccacgagctgaaccacttcagcctgctgacccagagaagaaaggccaacagctgcggcaagccctacaagtgcaacgagtgcggcaaggccttcacccagaacagcaacctgaccagccacagaagaatccacagcggcgagaagccctacaagtgcagcgagtgcggcaagaccttcaccgtgagaagcaacctgaccatccaccaggtgatccacaccggcgagaagccctacaagtgccacgagtgcggcaaggtgttcagacacaacagctacctggccacccacagaagaatccacaccggcgagaagccctacaagtgcaacgagtgcggcaaggccttcagaggccacagcaacctgaccacccaccagctgatccacaccggcgagaagcccttcaagtgcaacgagtgcggcaagctgttcacccagaacagccacctgatcagccactggagaatccacaccggcgagaagccctacaagtgcaacgagtgcggcaaggccttcagcgtgagaagcagcctggccatccaccagaccatccacaccggcgagaagccctacaagtgcaacgagtgcggcaaggtgttcagatacaacagctacctgggcagacacagaagagtgcacaccggcgagaagccctacaagtgcaacgagtgcggcaaggccttcagcatgcacagcaacctggccacccaccaggtgatccacaccggcaccaagcccttcaagtgcaacgagtgcagcaaggtgttcacccagaacagccagctggccaaccacagaagaatccacaccggcgagaagccctacaagtgcaacgagtgcggcaaggccttcagcgtgagaagcagcctgaccacccaccaggccatccacagcggcgagaagccctacaagtgcatcgagtgcggcaagagcttcacccagaagagccacctgagaagccacagaggcatccacagcggcgagaagccctacaagtgcaacgagtgcggcaaggtgttcgcccagaccagccagctggccagacactggagagtgcacaccggcgagaagccctacaagtgcaacgactgcggcagagccttcagcgacagaagcagcctgaccttccaccaggccatccacaccggcgagaagccctacaagtgccacgagtgcggcaaggtgttcagacacaacagctacctggccacccacagaagaatccacaccggcgagaagccctacaagtgcaacgagtgcggcaaggccttcagcatgcacagcaacctgaccacccacaaggtgatccacaccggcgagaagccctacaagtgcaaccagtgcggcaaggtgttcacccagaacagccacctggccaaccaccagagaacccacaccggcgagaagccctacagatgcaacgagtgcggcaaggccttcagcgtgagaagcagcctgaccacccaccaggccatccacaccggcaagaagccctacaagtgcaacgagtgcggcaaggtgttcacccagaacgcccacctggccaaccacagaagaatccacaccggcgagaagccctacagatgcaccgagtgcggcaaggccttcagagtgagaagcagcctgaccacccacatggccatccacaccggcgagaagagatacaagtgcaacgagtgcggcaaggtgttcagacagagcagcaacctggccagccaccacagaatgcacaccggcgagaagccctacaagtag

SEQ ID NO: 105753 - DNA, 2457 bp, Artificial Sequence; identical to SEQ ID NO: 105752
  Description of Artificial Sequence: Synthetic coding sequence

SEQ ID NO: 105754 - DNA, 2457 bp, Artificial Sequence; identical to SEQ ID NO: 105752
  Description of Artificial Sequence: Synthetic coding sequence

SEQ ID NO: 105755 - DNA, 1350 bp, Artificial Sequence
  Description of Artificial Sequence: Synthetic coding sequence
atggagttcttcatcagcatgagcgagaccatcaagtacaacgacgacgaccacaagaccctgttcctgaagaccctgaacgagcagagactggagggcgagttctgcgacatcgccatcgtggtggaggacgtgaagttcagagcccacagatgcgtgctggccgcctgcagcacctacttcaagaagctgttcaagaagctggaggtggacagcagcagcgtgatcgagatcgacttcctgagaagcgacatcttcgaggaggtgctgaactacatgtacaccgccaagatcagcgtgaagaaggaggacgtgaacctgatgatgagcagcggccagatcctgggcatcagattcctggacaagctgtgcagccagaagagagacgtgagcagccccgacgagaacaacggccagagcaagagcaagtactgcctgaagatcaacagacccatcggcgacgccgccgacacccaggacgacgacgtggaggagatcggcgaccaggacgacagccccagcgacgacaccgtggagggcaccccccccagccaggaggacggcaagagccccaccaccaccctgagagtgcaggaggccatcctgaaggagctgggcagcgaggaggtgagaaaggtgaactgctacggccaggaggtggagagcatggagacccccgagagcaaggacctgggcagccagaccccccaggccctgaccttcaacgacggcatgagcgaggtgaaggacgagcagacccccggctggaccaccgccgccagcgacatgaagttcgagtacctgctgtacggccaccacagagagcagatcgcctgccaggcctgcggcaagaccttcagcgacgagggcagactgagaaagcacgagaagctgcacaccgccgacagacccttcgtgtgcgagatgtgcaccaagggcttcaccacccaggcccacctgaaggagcacctgaagatccacaccggctacaagccctacagctgcgaggtgtgcggcaagagcttcatcagagcccccgacctgaagaagcacgagagagtgcacagcaacgagagacccttcgcctgccacatgtgcgacaaggccttcaagcacaagagccacctgaaggaccacgagagaagacacagaggcgagaagcccttcgtgtgcggcagctgcaccaaggccttcgccaaggccagcgacctgaagagacacgagaacaacatgcacagcgagagaaagcaggtgacccccagcgccatccagagcgagaccgagcagctgcaggccgccgccatggccgccgaggccgagcagcagctggagaccatcgcctgcagctag

SEQ ID NO: 105756 - DNA, 1350 bp, Artificial Sequence; identical to SEQ ID NO: 105755
  Description of Artificial Sequence: Synthetic coding sequence

SEQ ID NO: 105757 - DNA, 1458 bp, Artificial Sequence
  Description of Artificial Sequence: Synthetic coding sequence
atggccaccgagcccaagaaggccgccgcccagaacagccccgaggacgagggcctgctgatcgtgaagatcgaggaggaggagttcatccacggccaggacacctgcctgcagagaagcgagctgctgaagcaggagctgtgcagacagctgttcagacagttctgctaccaggacagccccggccccagagaggccctgagcagactgagagagctgtgctgccagtggctgaagcccgagatccacaccaaggagcagatcctggagctgctggtgctggagcagttcctgaccatcctgcccggcgacctgcaggcctgggtgcacgagcactaccccgagagcggcgaggaggccgtgaccatcctggaggacctggagagaggcaccgacgaggccgtgctgcaggtgcaggcccacgagcacggccaggagatcttccagaagaaggtgagcccccccggccccgccctgaacgtgaagctgcagcccgtggagaccaaggcccacttcgacagcagcgagccccagctgctgtgggactgcgacaacgagagcgagaacagcagaagcatgcccaagctggagatcttcgagaagatcgagagccagagaatcatcagcggcagaatcagcggctacatcagcgaggccagcggcgagagccaggacatctgcaagagcgccggcagagtgaagagacagtgggagaaggagagcggcgagagccagagactgagcagcgcccaggacgagggcttcggcaagatcctgacccacaagaacaccgtgagaggcgagatcatcagccacgacggctgcgagagaagactgaacctgaacagcaacgagttcacccaccagaagagctgcaagcacggcacctgcgaccagagcttcaagtggaacagcgacttcatcaaccaccagatcatctacgccggcgagaagaaccaccagtacggcaagagcttcaagagccccaagctggccaagcacgccgccgtgttcagcggcgacaagacccaccagtgcaacgagtgcggcaaggccttcagacacagcagcaagctggccagacaccagagaatccacaccggcgagagatgctacgagtgcaacgagtgcggcaagagcttcgccgagagcagcgacctgaccagacacagaagaatccacaccggcgagagacccttcggctgcaaggagtgcggcagagccttcaacctgaacagccacctgatcagacaccagagaatccacaccagagagaagccctacgagtgcagcgagtgcggcaagaccttcagagtgagcagccacctgatcagacacttcagaatccacaccggcgagaagccctacgagtgcagcgagtgcggcagagccttcagccagagcagcaacctgagccagcaccagagaatccacatgagagagaacctgctgatgtag

SEQ ID NO: 105758 - DNA, 1239 bp, Artificial Sequence
  Description of Artificial Sequence: Synthetic coding sequence
atgagcctgggcggcagcgacaccatgctgaagggcgccgacaccagcgagagcggcgccgtgatcagaggcaactacagactgggcctgagcaagaagagcagcctgttcagccaccagaagcaccacgtgtgccccgagtgcggcagaggcttctgccagagaagcgacctgatcaagcaccagagaacccacaccggcgagaagccctacctgtgccccgagtgcggcagaagattcagccagaaggccagcctgagcatccaccagagaaagcacagcggcgagaagccctacgtgtgcagagagtgcggcagacacttcagatacaccagcagcctgaccaaccacaagagaatccacagcggcgagagacccttcgtgtgccaggagtgcggcagaggcttcagacagaagatcgccctgctgctgcaccagagaacccacctggaggagaagcccttcgtgtgccccgagtgcggcagaggcttctgccagaaggccagcctgctgcagcaccagagcagccacaccggcgagagacccttcctgtgcctggagtgcggcagaagcttcagacagcagagcctgctgctgagccaccaggtgacccacagcggcgagaagccctacgtgtgcgccgagtgcggccacagcttcagacagaaggtgaccctgatcagacaccagagaacccacaccggcgagaagccctacctgtgcccccagtgcggcagaggcttcagccagaaggtgaccctgatcggccaccagagaacccacaccggcgagaagccctacctgtgccccgactgcggcagaggcttcggccagaaggtgaccctgatcagacaccagagaacccacaccggcgagaagccctacctgtgccccaagtgcggcagagccttcggcttcaagagcctgctgaccagacaccagagaacccacagcgaggaggagctgtacgtggacagagtgtgcggccagggcctgggccagaagagccacctgatcagcgaccagagaacccacagcggcgagaagccctgcatctgcgacgagtgcggcagaggcttcggcttcaagagcgccctgatcagacaccagagaacccacagcggcgagaagccctacgtgtgcagagagtgcggcagaggcttcagccagaagagccacctgcacagacacagaagaaccaagagcggccaccagctgctgccccaggaggtgttctag

SEQ ID NO: 105759 - DNA, 291 bp, Artificial Sequence
  Description of Artificial Sequence: Synthetic coding sequence
atgagccccggcctgctgaccaccagaaaggaggccctgatggccttcagagacgtggccgtggccttcacccagaaggagtggaagctgctgagcagcgcccagagaaccctgtacagagaggtgatgctggagaactacagccacctggtgagcctgggcatcgccttcagcaagcccaagctgatcgagcagctggagcagggcgacgagccctggagagaggagaacgagcacctgctggacctgtgccccggcagaagaatcaccagaagcggcgtgagagactag

SEQ ID NO: 105760 - DNA, 1812 bp, Artificial Sequence
  Description of Artificial Sequence: Synthetic coding sequence
atgagccccggcctgctgaccaccagaaaggaggccctgatggccttcagagacgtggccgtggccttcacccagaaggagtggaagctgctgagcagcgcccagagaaccctgtacagagaggtgatgctggagaactacagccacctggtgagcctgggcatcgccttcagcaagcccaagctgatcgagcagctggagcagggcgacgagccctggagagaggagaacgagcacctgctggacctgtgccccgagcccagaaccgagttccagcccagcttcccccacctggtggccttcagcagcagccagctgctgagacagtacgccctgagcggccaccccacccagatcttccccagcagcagcgccggcggcgacttccagctggaggcccccagatgcagcagcgagaagggcgagagcggcgagaccgagggccccgacagcagcctgagaaagagacccagcagaatcagcagaaccttcttcagcccccaccagggcgaccccgtggagtgggtggagggcaacagagagggcggcaccgacctgagactggcccagagaatgagcctgggcggcagcgacaccatgctgaagggcgccgacaccagcgagagcggcgccgtgatcagaggcaactacagactgggcctgagcaagaagagcagcctgttcagccaccagaagcaccacgtgtgccccgagtgcggcagaggcttctgccagagaagcgacctgatcaagcaccagagaacccacaccggcgagaagccctacctgtgccccgagtgcggcagaagattcagccagaaggccagcctgagcatccaccagagaaagcacagcggcgagaagccctacgtgtgcagagagtgcggcagacacttcagatacaccagcagcctgaccaaccacaagagaatccacagcggcgagagacccttcgtgtgccaggagtgcggcagaggcttcagacagaagatcgccctgctgctgcaccagagaacccacctggaggagaagcccttcgtgtgccccgagtgcggcagaggcttctgccagaaggccagcctgctgcagcaccagagcagccacaccggcgagagacccttcctgtgcctggagtgcggcagaagcttcagacagcagagcctgctgctgagccaccaggtgacccacagcggcgagaagccctacgtgtgcgccgagtgcggccacagcttcagacagaaggtgaccctgatcagacaccagagaacccacaccggcgagaagccctacctgtgcccccagtgcggcagaggcttcagccagaaggtgaccctgatcggccaccagagaacccacaccggcgagaagccctacctgtgccccgactgcggcagaggcttcggccagaaggtgaccctgatcagacaccagagaacccacaccggcgagaagccctacctgtgccccaagtgcggcagagccttcggcttcaagagcctgctgaccagacaccagagaacccacagcgaggaggagctgtacgtggacagagtgtgcggccagggcctgggccagaagagccacctgatcagcgaccagagaacccacagcggcgagaagccctgcatctgcgacgagtgcggcagaggcttcggcttcaagagcgccctgatcagacaccagagaacccacagcggcgagaagccctacgtgtgcagagagtgcggcagaggcttcagccagaagagccacctgcacagacacagaagaaccaagagcggccaccagctgctgccccaggaggtgttctag

SEQ ID NO: 105761 - DNA, 1224 bp, Artificial Sequence
  Description of Artificial Sequence: Synthetic coding sequence
atggccgccaagatggagatcaccctgagcagcaacaccgaggccagcagcaagcaggagagacacatcatcgccaagctggaggagaagagaggcccccccctgcagaagaactgccccgaccccgagctgtgcagacagagcttcagaagattctgctaccaggaggtgagcggcccccaggaggccctgagccagctgagacagctgtgcagacagtggctgcagcccgagctgcacaccaaggagcagatcctggagctgctggtgatggagcagttcctgaccatcctgccccccgagatccaggccagagtgagacacagatgccccatgagcagcaaggagatcgtgaccctggtggaggacttccacagagccagcaagaagcccaagcagtgggtggccgtgtgcatgcagggccagaaggtgctgctggagaagaccggcagccagctgggcgagcaggagctgcccgacttccagccccagacccccagaagagacctgagagagagcagccccgccgagcccagccaggccggcgcctacgacagactgagcccccaccactgggagaagagccccctgctgcaggagcccacccccaagctggccggcaccgaggcccccagaatgagaagcgacaacaaggagaacccccagcaggagggcgccaagggcgccaagccctgcgccgtgagcgccggcagaagcaagggcaacggcctgcagaaccccgagcccagaggcgccaacatgagcgagcccagactgagcagaagacaggtgagcagccccaacgcccagaagcccttcgcccactaccagagacactgcagagtggagtacatcagcagccccctgaagagccaccccctgagagagctgaagaagagcaagggcggcaagagaagcctgagcaacagactgcagcacctgggccaccagcccaccagaagcgccaagaagccctacaagtgcgacgactgcggcaagagcttcacctggaacagcgagctgaagagacacaagagagtgcacaccggcgagagaccctacacctgcggcgagtgcggcaactgcttcggcagacagagcaccctgaagctgcaccagagaatccacaccggcgagaagccctaccagtgcggccagtgcggcaagagcttcagacagagcagcaacctgcaccagcaccacagactgcaccacggcgactag

SEQ ID NO: 105762 - DNA, 705 bp, Artificial Sequence
  Description of Artificial Sequence: Synthetic coding sequence
atggccgccaagatggagatcaccctgagcagcaacaccgaggccagcagcaagcaggagagacacatcatcgccaagctggaggagaagagaggcccccccctgcagaagaactgccccgaccccgagctgtgcagacagagcttcagaagattctgctaccaggaggtgagcggcccccaggaggccctgagccagctgagacagctgtgcagacagtggctgcagcccgagctgcacaccaaggagcagatcctggagctgctggtgatggagcagttcctgaccatcctgccccccgagatccaggccagagtgagacacagatgccccatgagcagcaaggagatcgtgaccctggtggaggacttccacagagccagcaagaagcccaagcagtgggtggccgtgtgcatgcagggccagaaggtgctgctggagaagaccggcagccagctgggcgagcaggagctgcccgacttccagccccagacccccagaagagacctgagagagagcagccccgccgagcccagccaggccggcgcctacgacagactgagcccccaccactgggagaagagccccctgctgcaggagcccacccccaagctggccggcaccgagctgctgatcgagaagaccgaccccaacatggccaccgacgagctgccctgcaagctgtggctgagcttcatcgcctag

SEQ ID NO: 105763 - DNA, 2136 bp, Artificial Sequence
  Description of Artificial Sequence: Synthetic coding sequence
atgcccgccgacgtgaacctgagccagaagccccaggtgctgggccccgagaagcaggacggcagctgcgaggccagcgtgagcttcgaggacgtgaccgtggacttcagcagagaggagtggcagcagctggaccccgcccagagatgcctgtacagagacgtgatgctggagctgtacagccacctgttcgccgtgggctaccacatccccaaccccgaggtgatcttcagaatgctgaaggagaaggagcccagagtggaggaggccgaggtgagccaccagagatgccaggagagagagttcggcctggagatcccccagaaggagatcagcaagaaggccagcttccagaaggacatggtgggcgagttcaccagagacggcagctggtgcagcatcctggaggagctgagactggacgccgacagaaccaagaaggacgagcagaaccagatccagcccatgagccacagcgccttcttcaacaagaagaccctgaacaccgagagcaactgcgagtacaaggaccccggcaagatgatcagaaccagaccccacctggccagcagccagaagcagccccagaagtgctgcctgttcaccgagagcctgaagctgaacctggaggtgaacggccagaacgagagcaacgacaccgagcagctggacgacgtggtgggcagcggccagctgttcagccacagcagcagcgacgcctgcagcaagaacatccacaccggcgagaccttctgcaagggcaaccagtgcagaaaggtgtgcggccacaagcagagcctgaagcagcaccagatccacacccagaagaagcccgacggctgcagcgagtgcggcggcagcttcacccagaagagccacctgttcgcccagcagagaatccacagcgtgggcaacctgcacgagtgcggcaagtgcggcaaggccttcatgccccagctgaagctgagcgtgtacctgaccgaccacaccggcgacatcccctgcatctgcaaggagtgcggcaaggtgttcatccagagaagcgagctgctgacccaccagaagacccacaccagaaagaagccctacaagtgccacgactgcggcaaggccttcttccagatgctgagcctgttcagacaccagagaacccacagcagagagaagctgtacgagtgcagcgagtgcggcaagggcttcagccagaacagcaccctgatcatccaccagaagatccacaccggcgagagacagtacgcctgcagcgagtgcggcaaggccttcacccagaagagcaccctgagcctgcaccagagaatccacagcggccagaagagctacgtgtgcatcgagtgcggccaggccttcatccagaaggcccacctgatcgtgcaccagagaagccacaccggcgagaagccctaccagtgccacaactgcggcaagagcttcatcagcaagagccagctggacatccaccacagaatccacaccggcgagaagccctacgagtgcagcgactgcggcaagaccttcacccagaagagccacctgaacatccaccagaagatccacaccggcgagagacaccacgtgtgcagcgagtgcggcaaggccttcaaccagaagagcatcctgagcatgcaccagagaatccacaccggcgagaagccctacaagtgcagcgagtgcggcaaggccttcaccagcaagagccagttcaaggagcaccagagaatccacaccggcgagaagccctacgtgtgcaccgagtgcggcaaggccttcaacggcagaagcaacttccacaagcaccagatcacccacaccagagagagacccttcgtgtgctacaagtgcggcaaggccttcgtgcagaagagcgagctgatcacccaccagagaacccacatgggcgagaagccctacgagtgcctggactgcggcaagagcttcagcaagaagccccagctgaaggtgcaccagagaatccacaccggcgagagaccctacgtgtgcagcgagtgcggcaaggccttcaacaacagaagcaacttcaacaagcaccagaccacccacaccagagacaagagctacaagtgcagctacagcgtgaagggcttcaccaagcagtag

SEQ ID NO: 105764 - DNA, 966 bp, Artificial Sequence
  Description of Artificial Sequence: Synthetic coding sequence
atggccgccggctggctgaccacctggagccagaacagcgtgaccttccaggaggtggccgtggacttcagccaggaggagtgggccctgctggaccccgcccagaagaacctgtacaaggacgtgatgctggagaacttcagaaacctggccagcgtgggctaccagctgtgcagacacagcctgatcagcaaggtggaccaggagcagctgaagaccgacgagagaggcatcctgcagggcgactgcgccgactgggagacccagctgaagcccaaggacaccatcgccatgcagaacatccccggcggcaagaccagcaacggcatcaacaccaactgcgtgagaacccacagcggcgagatgccctacgagtgcagcgactgcggcaaggccttcatcttccagagcagcctgaagaagcacatgagaagccacaccggcgagaagccctacgagtgcgaccactgcggcaagagcttcagccagagcagccacctgaacgtgcacaagagaacccacaccggcgagaagccctacgactgcaaggagtgcggcaaggccttcaccgtgcccagcagcctgcagaagcacgtgagaacccacaccggcgagaagccctacgagtgcagcgactgcggcaaggccttcatcgaccagagcagcctgaagaagcacaccagaagccacaccggcgagaagccctacgagtgcaaccagtgcggcaagagcttcagcaccggcagctacctgatcgtgcacaagagaacccacaccggcgagaagacctacgagtgcaaggagtgcggcaaggccttcagaaacagcagctgcctgagagtgcacgtgagaacccacaccggcgagaagccctacaagtgcatccagtgcgagaaggccttcagcaccagcaccaacctgatcatgcacaagagaatccacaacggccagaagctgcacgagtag

SEQ ID NO: 105765 - DNA, 1446 bp, Artificial Sequence
  Description of Artificial Sequence: Synthetic coding sequence
atggccgccggctggctgaccacctggagccagaacagcgtgaccttccaggaggtggccgtggacttcagccaggaggagtgggccctgctggaccccgcccagaagaacctgtacaaggacgtgatgctggagaacttcagaaacctggccagcgtgggctaccagctgtgcagacacagcctgatcagcaaggtggaccaggagcagctgaagaccgacgagagaggcatcctgcagggcgactgcgccgactgggagacccagctgaagcccaaggacaccatcgccatgcagaacatccccggcggcaagaccagcaacggcatcaacaccgccgagaaccagcccggcgagcacagcctggagtgcaaccactgcggcaagttcagaaagaacaccagattcatctgcaccagatactgcaagggcgagaagtgctacaagtacatcaagtacagcaaggtgttcaaccaccccagcaccctgagaagccacgtgagcatccacatcggcgagaagaccctggagttcaccgactgcagaaaggccttcaaccaggagagcagcctgagaaagcacctgagaacccccaccggccagaagttccaggagtacgagcagtgcgacatgagcttcagcctgcacagcagctgcagcgtgagagagcagatccccaccggcgagaagggcgacgagtgcagcgactacggcaagatcagccccctgagcgtgcacaccaagaccggcagcgtggaggagggcctggagtgcaacgagcacgagaagaccttcaccgaccccctgagcctgcagaactgcgtgagaacccacagcggcgagatgccctacgagtgcagcgactgcggcaaggccttcatcttccagagcagcctgaagaagcacatgagaagccacaccggcgagaagccctacgagtgcgaccactgcggcaagagcttcagccagagcagccacctgaacgtgcacaagagaacccacaccggcgagaagccctacgactgcaaggagtgcggcaaggccttcaccgtgcccagcagcctgcagaagcacgtgagaacccacaccggcgagaagccctacgagtgcagcgactgcggcaaggccttcatcgaccagagcagcctgaagaagcacaccagaagccacaccggcgagaagccctacgagtgcaaccagtgcggcaagagcttcagcaccggcagctacctgatcgtgcacaagagaacccacaccggcgagaagacctacgagtgcaaggagtgcggcaaggccttcagaaacagcagctgcctgagagtgcacgtgagaacccacaccggcgagaagccctacaagtgcatccagtgcgagaaggccttcagcaccagcaccaacctgatcatgcacaagagaatccacaacggccagaagctgcacgagtag

SEQ ID NO: 105766 - DNA, 363 bp, Artificial Sequence
  Description of Artificial Sequence: Synthetic coding sequence
atggccgccggctggctgaccacctggagccagaacagcgtgaccttccaggaggtggccgtggacttcagccaggaggagtgggccctgctggaccccgcccagaagaacctgtacaaggacgtgatgctggagaacttcagaaacctggccagcgtgggctaccagctgtgcagacacagcctgatcagcaaggtggaccaggagcagctgaagaccgacgagagaggcatcctgcagggcgactgcgccgactgggagacccagctgaagcccaaggacaccatcgccatgcagaacatccccggcggcaagaccagcaacggcatcaacaccaacccccacggcagagagttcctgtag

SEQ ID NO: 105767 - DNA, 966 bp, Artificial Sequence; identical to SEQ ID NO: 105764
  Description of Artificial Sequence: Synthetic coding sequence

SEQ ID NO: 105768 - DNA, 1650 bp, Artificial Sequence
  Description of Artificial Sequence: Synthetic coding sequence
atgcccgtggacctgggccaggccctgggcctgctgcccagcctggccaaggccgaggacagccagttcagcgagagcgacgccgccctgcaggaggagctgagcagccccgagaccgccagacagctgttcagacagttcagataccaggtgatgagcggcccccacgagaccctgaagcagctgagaaagctgtgcttccagtggctgcagcccgaggtgcacaccaaggagcagatcctggagatcctgatgctggagcagttcctgaccatcctgcccggcgagatccagatgtgggtgagaaagcagtgccccggcagcggcgaggaggccgtgaccctggtggagagcctgaagggcgacccccagagactgtggcagtggatcagcatccaggtgctgggccaggacatcctgagcgagaagatggagagccccagctgccaggtgggcgaggtggagccccacctggaggtggtgccccaggagctgggcctggagaacagcagcagcggccccggcgagctgctgagccacatcgtgaaggaggagagcgacaccgaggccgagctggccctggccgccagccagcccgccagactggaggagagactgatcagagaccaggacctgggcgccagcctgctgcccgccgccccccaggagcagtggagacagctggacagcacccagaaggagcagtactgggacctgatgctggagacctacggcaagatggtgagcggcgccggcatcagccaccccaagagcgacctgaccaacagcatcgagttcggcgaggagctggccggcatctacctgcacgtgaacgagaagatccccagacccacctgcatcggcgacagacaggagaacgacaaggagaacctgaacctggagaaccacagagaccaggagctgctgcacgccagctgccaggccagcggcgaggtgcccagccaggccagcctgagaggcttcttcaccgaggacgagcccggctgcttcggcgagggcgagaacctgcccgaggccctgcagaacatccaggacgagggcaccggcgagcagctgagcccccaggagagaatcagcgagaagcagctgggccagcacctgcccaacccccacagcggcgagatgagcaccatgtggctggaggagaagagagagaccagccagaagggccagcccagagcccccatggcccagaagctgcccacctgcagagagtgcggcaagaccttctacagaaacagccagctgatcttccaccagagaacccacaccggcgagacctacttccagtgcaccatctgcaagaaggccttcctgagaagcagcgacttcgtgaagcaccagagaacccacaccggcgagaagccctgcaagtgcgactactgcggcaagggcttcagcgacttcagcggcctgagacaccacgagaagatccacaccggcgagaagccctacaagtgccccatctgcgagaagagcttcatccagagaagcaacttcaacagacaccagagagtgcacaccggcgagaagccctacaagtgcagccactgcggcaagagcttcagctggagcagcagcctggacaagcaccagagaagccacctgggcaagaagcccttccagtag

SEQ ID NO: 105769 - DNA, 1650 bp, Artificial Sequence; identical to SEQ ID NO: 105768
  Description of Artificial Sequence: Synthetic coding sequence

SEQ ID NO: 105770 - DNA, 1959 bp, Artificial Sequence
  Description of Artificial Sequence: Synthetic coding sequence
atgatcaacgcccaggagctgctgaccctggaggacgtgaccgtggagttcacctgggaggagtggcagctgctgggccccttccagaaggacctgtacagagacgtgatgctggagatctacagcaacctgctgagcatgggctaccaggtgagcaagcccgacgccctgagcaagctggagagaggcgaggagccctggaccatggaggacgagagacacagcagaatctgccccgagaacaacgaggtggacgaccacctgcaggaccacctggagaaccagagaatgctgaagagcgtggagcagtaccacgagcacaacgccttcggcaacaccgccagccagaccaagagcctgtgcctgttcagagagaaccacgacaccttcgagctgtacatcaagaccctgaagagcaacctgagcctggtgaaccagaacaagagctgcgagatcaacaacagcaccaagttcagcggcgacggcaagagcttcctgcacggcaactacgaggagctgtacagcgccgccaagttcagcgtgagcaccaaggccaacagcaccaagagccaggtgagcaagcaccagagaacccacgagatcgagaagaaccacgtgtgcagcgagtgcggcaaggccttcgtgaagaagagccagctgaccgaccacgagagagtgcacaccggcgagaagccctacggctgcaccctgtgcgccaaggtgttcagcagaaagagcagactgaacgagcaccagagaatccacaagagagagaagagcttcatctgcagcgagtgcggcaaggtgttcaccatgaagagcagactgatcgagcaccagagaacccacaccggcgagaagccctacatctgcaacgagtgcggcaagggcttccccggcaagagaaacctgatcgtgcaccagagaaaccacaccggcgagaagagctacatctgcagcgagtgcggcaagggcttcaccggcaagagcatgctgatcatccaccagagaacccacaccggcgagaagccctacatctgcagcgagtgcggcaagggcttcaccaccaagcactacgtgatcatccaccagagaaaccacaccggcgagaagccctacatctgcaacgagtgcggcaagggcttcaccatgaagagcagaatgatcgagcaccagagaacccacaccggcgagaagccctacatctgcagcgagtgcggcaagggcttccccagaaagagcaacctgatcgtgcaccagagaaaccacaccgtggagaagagctacctgtgcagcgagtgcggcaagggcttcaccgtgaagagcatgctgatcatccaccagagaacccacaccggcgagaagccctacacctgcagcgagtgcggcaagggcttccccctgaagagcagactgatcgtgcaccagagaacccacaccggcgagaagccctacagatgcagcgagtgcggcaagggcttcatcgtgaacagcggcctgatgctgcaccagagaacccacaccggcgagaagccctacatctgcaacgagtgcggcaagggcttcgccttcaagagcaacctggtggtgcaccagagaacccacaccggcgagaagcccttcatgtgcagcgagtgcggcaagggcttcaccatgaagagatacctgatcgtgcaccagcagatccacaccgaggagaagagctgcatctgcagcgagtgcggcagaggcttcgccaaggagaccgagctggccctgcacaagcaggtgcacaccggcgagaagccctacggctgcaacgagtgcggcaagggcttcaccatgaagagcagactgatcgtgcaccagagaacccacaccggcgagaagcccttcgtgtgcagcgagtgcagaaaggccttcagcagcaagagaaacctgatcgtgcaccagagaacccacaacggcaacaagccctag

SEQ ID NO: 105771 - DNA, 2004 bp, Artificial Sequence
  Description of Artificial Sequence: Synthetic coding sequence
atgagagcctgcgccggcagcaccagagaggccggcagcggcgcccaggacctgagcaccctgctgtgcctggaggagagcatggaggagcaggacgagaagccccccgagccccccaaggcctgcgcccaggagggcgtgaacttcaagatcgtgaccgtggacttcaccagagaggagcagggcacctggaaccccgcccagagaaccctggacagagacgtgatcctggagaaccacagagacctggtgagctgggacctggccaccgccgtgggcaagaaggacagcaccagcaagcagagaatcttcgacgaggagcccgccaacggcgtgaagatcgagagattcaccagagacgacccctggctgagcagctgcgaggaggtggacgactgcaaggaccagctggagaagcagcaggagaagcaggagatcctgctgcaggaggtggccttcacccagagaaaggccgtgatccacgagagagtgtgcaagagcgacgagaccggcgagaagagcggcctgaacagcagcctgttcagcagccccgtgatccccatcagaaaccacttccacaagcacgtgagccacgccaagaagtggcacctgaacgccgccgtgaacagccaccagaagatcaacgagaacgagaccctgtacgagaacaacgagtgcggcaagcccccccagagcatccacctgatccagttcaccagaacccagaccaaggacaagtgctacggcttcagcgacagaatccagagcttctgccacggcacccccctgcacatccacgagaagatccacggcggcggcaagaccttcgacttcaaggagtgcggccaggtgctgaaccccaagatcagccacaacgagcagcagagaatccccttcgaggagagccagtacaagtgcagcgagaccagccacagcagcagcctgacccagaacatgagaaacaacagcgaggagaagcccttcgagtgcaaccagtgcggcaagagcttcagctggagcagccacctggtggcccaccagagaacccacaccggcgagaagccctacgagtgcagcgagtgcggcaagagcttcagcagaagcagccacctggtgagccaccagagaacccacaccggcgagaagccctacagatgcaaccagtgcggcaagagcttcagccagagctacgtgctggtggtgcaccagagaacccacaccggcgagaagccctacgagtgcaaccagtgcggcaagagcttcagacagagctacaagctgatcgcccaccagagaacccacaccggcgagaagccctacgagtgcaaccagtgcggcaagagcttcatccagagctacaagctgatcgcccaccagagaatccacaccggcgagaagccctacgagtgcaaccagtgcggcaagagcttcagccagagctacaagctggtggcccaccagagaacccacaccggcgagaagcccttcgagtgcaaccagtgcggcaagagcttcagctggagcagccagctggtggcccaccagagaacccacaccggcgagaagccctacgagtgcagcgagtgcggcaagagcttcaacagaagcagccacctggtgatgcaccagagaatccacaccggcgagaagccctacgagtgcaaccagtgcggcaagagcttcagccagagctacgtgctggtggtgcaccagagaacccacaccggcgagaagccctacgagtgcagccagtgcggcaagagcttcagacagagcagctgcctgacccagcaccagagaacccacaccggcgagaagcccttcgagtgcaaccagtgcggcaagaccttcagcctgagcgccagactgatcgtgcaccagagaacccacaccggcgagaagcccttcacctgcatccagtgcggcaaggccttcatcaacagctacaagctgatcagacaccaggccacccacaccgaggagaagctgtacgagtgcaactag

SEQ ID NO: 105772 - DNA, 1848 bp, Artificial Sequence
  Description of Artificial Sequence: Synthetic coding sequence
atgccccagctgcagtaccccgagggctacctggcccccaacagatgcctggtgagcaactgcggcgtgaacaagatgagcaacgacgagctggtgggccagaaccacggcatggagggcgaggcctgcatcggcggcgacgtgaccttcaacgacgtggccatcgacttcacccacgaggagtggggctggctgagcagcgcccagagagacctgtacaaggacgtgatggtgcagaactacgagaacctggtgagcgtggccggcctgagcgtgaccaagccctacgtgatcaccctgctggaggacggcaaggagccctggatgatggagaagaagctgagcaagggcatgatccccgactgggagagcagatgggagaacaaggagctgagcaccaagaaggacaactacgacgaggacagcccccagaccgtgatcatcgagaaggtggtgaagcagagctacgagttcagcaacagcaagaagaacctggagtacatcgagaagctggagggcaagcacggcagccaggtggaccacttcagacccgccatcctgaccagcagagagagccccaccgccgacagcgtgtacaagtacaacatcttcagaagcaccttccacagcaagagcaccctgagcgagccccagaagatcagcgccgagggcaacagccacaagtacgacatcctgaagaagaacctgcccaagaagagcgtgatcaagaacgagaaggtgaacggcggcaagaagctgctgaacagcaacaagagcggcgccgccttcagccagggcaagagcctgaccctgccccagacctgcaacagagagaagatctacacctgcagcgagtgcggcaaggccttcggcaagcagagcatcctgaacagacactggagaatccacaccggcgagaagccctacgagtgcagagagtgcggcaagaccttcagccacggcagcagcctgaccagacacctgatcagccacagcggcgagaagccctacaagtgcatcgagtgcggcaaggccttcagccacgtgagcagcctgaccaaccaccagagcacccacaccggcgagaagccctacgagtgcatgaactgcggcaagagcttcagcagagtgagccacctgatcgagcacctgagaatccacacccaggagaagctgtacgagtgcagaatctgcggcaaggccttcatccacagaagcagcctgatccaccaccagaagatccacaccggcgagaagccctacgagtgcagagagtgcggcaaggccttctgctgcagcagccacctgaccagacaccagagaatccacaccatggagaagcagtacgagtgcaacaagtgcctgaaggtgttcagcagcctgagcttcctggtgcagcaccagagcatccacaccgaggagaagcccttcgagtgccagaagtgcagaaagagcttcaaccagctggagagcctgaacatgcacctgagaaaccacatcagactgaagccctacgagtgcagcatctgcggcaaggccttcagccacagaagcagcctgctgcagcaccacagaatccacaccggcgagaagccctacgagtgcatcaagtgcggcaagaccttcagctgcagcagcaacctgaccgtgcaccagagaatccacaccggcgagaagccctacaagtgcaacgagtgcggcaaggccttcagcaagggcagcaacctgaccgcccaccagagagtgcacaacggcgagaagcccaacagcgtggtgagcgtggagaagcccctggactacatgaaccactacacctgcgagaagagctacagaagagagaccgtgtag

SEQ ID NO: 105773 - DNA, 1404 bp, Artificial Sequence
  Description of Artificial Sequence: Synthetic coding sequence
atgccccaggtgaccttcaacgacgtggccatcgacttcacccacgaggagtggggctggctgagcagcgcccagagagacctgtacaaggacgtgatggtgcagaactacgagaacctggtgagcgtgggcctgagcgtgaccaagccctacgtgatcaccctgctggaggacggcaaggagccctggatgatggagaagaagctgagcaagggcatgatccccgactgggagagcagatgggagaacaaggagctgagcaccaagaaggacaactacgacgaggacagcccccagaccgtgatcatcgagaaggtggtgaagcagagctacgagttcagcaacagcaagaagaacctggagtacatcgagaagctggagggcaagcacggcagccaggtggaccacttcagacccgccatcctgaccagcagagagagccccaccgccgacagcgtgtacaagtacaacatcttcagaagcaccttccacagcaagagcaccctgagcgagccccagaagatcagcgccgagggcaacagccacaagtacgacatcctgaagaagaacctgcccaagaagagcgtgatcaagaacgagaaggtgaacggcggcaagaagctgctgaacagcaacaagagcggcgccgccttcagccagggcaagagcctgaccctgccccagacctgcaacagagagaagatctacacctgcagcgagtgcggcaaggccttcggcaagcagagcatcctgaacagacactggagaatccacaccggcgagaagccctacgagtgcagagagtgcggcaagaccttcagccacggcagcagcctgaccagacacctgatcagccacagcggcgagaagccctacaagtgcatcgagtgcggcaaggccttcagccacgtgagcagcctgaccaaccaccagagcacccacaccggcgagaagccctacgagtgcatgaactgcggcaagagcttcagcagagtgagccacctgatcgagcacctgagaatccacacccaggagaagctgtacgagtgcagaatctgcggcaaggccttcatccacagaagcagcctgatccaccaccagaagatccacaccggcgagaagccctacgagtgcagagagtgcggcaaggccttctgctgcagcagccacctgaccagacaccagagaatccacaccatggagaagcagtacgagtgcaacaagtgcctgaaggtgttcagcagcctgagcttcctggtgcagcaccagagcatccacaccgaggagaagcccttcgagtgccagaagtgcagaaagagcttcaaccagctggagagcctgaacatgcacctgagaaaccacatcgagaccctgagaatgcagtacatgtgggagagcctgtag

SEQ ID NO: 105774 - DNA, 1713 bp, Artificial Sequence
  Description of Artificial Sequence: Synthetic coding sequence
atgccccaggtgaccttcaacgacgtggccatcgacttcacccacgaggagtggggctggctgagcagcgcccagagagacctgtacaaggacgtgatggtgcagaactacgagaacctggtgagcgtgggcctgagcgtgaccaagccctacgtgatcaccctgctggaggacggcaaggagccctggatgatggagaagaagctgagcaagggcatgatccccgactgggagagcagatgggagaacaaggagctgagcaccaagaaggacaactacgacgaggacagcccccagaccgtgatcatcgagaaggtggtgaagcagagctacgagttcagcaacagcaagaagaacctggagtacatcgagaagctggagggcaagcacggcagccaggtggaccacttcagacccgccatcctgaccagcagagagagccccaccgccgacagcgtgtacaagtacaacatcttcagaagcaccttccacagcaagagcaccctgagcgagccccagaagatcagcgccgagggcaacagccacaagtacgacatcctgaagaagaacctgcccaagaagagcgtgatcaagaacgagaaggtgaacggcggcaagaagctgctgaacagcaacaagagcggcgccgccttcagccagggcaagagcctgaccctgccccagacctgcaacagagagaagatctacacctgcagcgagtgcggcaaggccttcggcaagcagagcatcctgaacagacactggagaatccacaccggcgagaagccctacgagtgcagagagtgcggcaagaccttcagccacggcagcagcctgaccagacacctgatcagccacagcggcgagaagccctacaagtgcatcgagtgcggcaaggccttcagccacgtgagcagcctgaccaaccaccagagcacccacaccggcgagaagccctacgagtgcatgaactgcggcaagagcttcagcagagtgagccacctgatcgagcacctgagaatccacacccaggagaagctgtacgagtgcagaatctgcggcaaggccttcatccacagaagcagcctgatccaccaccagaagatccacaccggcgagaagccctacgagtgcagagagtgcggcaaggccttctgctgcagcagccacctgaccagacaccagagaatccacaccatggagaagcagtacgagtgcaacaagtgcctgaaggtgttcagcagcctgagcttcctggtgcagcaccagagcatccacaccgaggagaagcccttcgagtgccagaagtgcagaaagagcttcaaccagctggagagcctgaacatgcacctgagaaaccacatcagactgaagccctacgagtgcagcatctgcggcaaggccttcagccacagaagcagcctgctgcagcaccacagaatccacaccggcgagaagccctacgagtgcatcaagtgcggcaagaccttcagctgcagcagcaacctgaccgtgcaccagagaatccacaccggcgagaagccctacaagtgcaacgagtgcggcaaggccttcagcaagggcagcaacctgaccgcccaccagagagtgcacaacggcgagaagcccaacagcgtggtgagcgtggagaagcccctggactacatgaaccactacacctgcgagaagagctacagaagagagaccgtgtag

SEQ ID NO: 105775 - DNA, 1716 bp, Artificial Sequence
  Description of Artificial Sequence: Synthetic coding sequence
atgccccaggtgaccttcaacgacgtggccatcgacttcacccacgaggagtggggctggctgagcagcgcccagagagacctgtacaaggacgtgatggtgcagaactacgagaacctggtgagcgtggccggcctgagcgtgaccaagccctacgtgatcaccctgctggaggacggcaaggagccctggatgatggagaagaagctgagcaagggcatgatccccgactgggagagcagatgggagaacaaggagctgagcaccaagaaggacaactacgacgaggacagcccccagaccgtgatcatcgagaaggtggtgaagcagagctacgagttcagcaacagcaagaagaacctggagtacatcgagaagctggagggcaagcacggcagccaggtggaccacttcagacccgccatcctgaccagcagagagagccccaccgccgacagcgtgtacaagtacaacatcttcagaagcaccttccacagcaagagcaccctgagcgagccccagaagatcagcgccgagggcaacagccacaagtacgacatcctgaagaagaacctgcccaagaagagcgtgatcaagaacgagaaggtgaacggcggcaagaagctgctgaacagcaacaagagcggcgccgccttcagccagggcaagagcctgaccctgccccagacctgcaacagagagaagatctacacctgcagcgagtgcggcaaggccttcggcaagcagagcatcctgaacagacactggagaatccacaccggcgagaagccctacgagtgcagagagtgcggcaagaccttcagccacggcagcagcctgaccagacacctgatcagccacagcggcgagaagccctacaagtgcatcgagtgcggcaaggccttcagccacgtgagcagcctgaccaaccaccagagcacccacaccggcgagaagccctacgagtgcatgaactgcggcaagagcttcagcagagtgagccacctgatcgagcacctgagaatccacacccaggagaagctgtacgagtgcagaatctgcggcaaggccttcatccacagaagcagcctgatccaccaccagaagatccacaccggcgagaagccctacgagtgcagagagtgcggcaaggccttctgctgcagcagccacctgaccagacaccagagaatccacaccatggagaagcagtacgagtgcaacaagtgcctgaaggtgttcagcagcctgagcttcctggtgcagcaccagagcatccacaccgaggagaagcccttcgagtgccagaagtgcagaaagagcttcaaccagctggagagcctgaacatgcacctgagaaaccacatcagactgaagccctacgagtgcagcatctgcggcaaggccttcagccacagaagcagcctgctgcagcaccacagaatccacaccggcgagaagccctacgagtgcatcaagtgcggcaagaccttcagctgcagcagcaacctgaccgtgcaccagagaatccacaccggcgagaagccctacaagtgcaacgagtgcggcaaggccttcagcaagggcagcaacctgaccgcccaccagagagtgcacaacggcgagaagcccaacagcgtggtgagcgtggagaagcccctggactacatgaaccactacacctgcgagaagagctacagaagagagaccgtgtag

SEQ ID NO: 105776 - DNA, 1920 bp, Artificial Sequence
  Description of Artificial Sequence: Synthetic coding sequence
atgacccccgccagcgccagcggcgaggacagcggcagcttctacagctggcagaaggccaagagagagcagggcctggtgaccttcgaggacgtggccgtggacttcacccaggaggagtggcagtacctgaaccccccccagagaaccctgtacagagacgtgatgctggagacctacagcaacctggtgttcgtgggccagcaggtgaccaagcccaacctgatcctgaagctggaggtggaggagtgccccgccgagggcaagatccccttctggaacttccccgaggtgtgccaggtggacgagcagatcgagagacagcaccaggacgaccaggacaagtgcctgctgatgcaggtgggcttcagcgacaagaagaccatcatcaccaagagcgccagagactgccacgagttcggcaacatcctgcacctgagcaccaacctggtggccagcatccagagacccgacaagcacgagagcttcggcaacaacatggtggacaacctggacctgttcagcagaagcagcgccgagaacaagtacgacaacggctgcgccaagctgttcttccacaccgagtacgagaagaccaaccccggcatgaagccctacggctacaaggagtgcggcaagggcctgagaagaaagaagggcctgagcctgcaccagagaatcaagaacggcgagaagcccttcgagtgcaccgcctgcagaaagaccttcagcaagaagagccacctgatcgtgcactggagaacccacaccggcgagaagcccttcggctgcaccgagtgcggcaaggccttcagccagaagagccagctgatcatccacctgagaacccacaccggcgagagacccttcgagtgccccgagtgcggcaaggccttcagagagaagagcaccgtgatcatccactacagaacccacaccggcgagaagccctacgagtgcaacgagtgcggcaaggccttcacccagaagagcaacctgatcgtgcaccagaagacccacaccggcgagaagacctacgagtgcaccaagtgcggcgagagcttcatccagaagctggacctgatcatccaccacagcacccacaccggcaagaagccccacgagtgcaacgagtgcaagaagaccttcagcgacaagagcaccctgatcatccaccagagaacccacaccggcgagaagccccacaagtgcaccgagtgcggcaagagcttcaacgagaagagcaccctgatcgtgcaccagagaacccacaccggcgagaagccctacgagtgcgacgtgtgcggcaagaccttcacccagaagagcaacctgggcgtgcaccagagaacccacagcggcgagaagcccttcgagtgcaacgagtgcgagaaggccttcagccagaagagctacctgatgctgcaccagagaggccacaccggcgagaagccctacgagtgcaacgagtgcgagaaggccttcagccagaagagctacctgatcatccaccagagaacccacaccgaggagaagccctacaagtgcaacgagtgcggcaaggccttcagagagaagagcaagctgatcatccaccagagaatccacaccggcgagaagccctacgagtgccccgtgtgctggaaggccttcagccagaagagccagctgatcatccaccagagaacccacaccggcgagaagccctacgcctgcaccgagtgcggcaaggccttcagagagaagagcaccttcaccgtgcaccagagaacccacaccggcgagaagccctacaagtgcaccgagtgcggcaaggccttcacccagaagagcaacctgatcgtgcaccagagaacccacgccggcaagaaggcccacggcagaggccacaccagaaagagcaagttcatggcccactag

SEQ ID NO: 105777 - DNA, 1863 bp, Artificial Sequence
  Description of Artificial Sequence: Synthetic coding sequence
atggccaagccccagggcctggtgaccttcgaggacgtggccgtggacttcacccaggaggagtggcagtacctgaaccccccccagagaaccctgtacagagacgtgatgctggagacctacagcaacctggtgttcgtgggccagcaggtgaccaagcccaacctgatcctgaagctggaggtggaggagtgccccgccgagggcaagatccccttctggaacttccccgaggtgtgccaggtggacgagcagatcgagagacagcaccaggacgaccaggacaagtgcctgctgatgcaggtgggcttcagcgacaagaagaccatcatcaccaagagcgccagagactgccacgagttcggcaacatcctgcacctgagcaccaacctggtggccagcatccagagacccgacaagcacgagagcttcggcaacaacatggtggacaacctggacctgttcagcagaagcagcgccgagaacaagtacgacaacggctgcgccaagctgttcttccacaccgagtacgagaagaccaaccccggcatgaagccctacggctacaaggagtgcggcaagggcctgagaagaaagaagggcctgagcctgcaccagagaatcaagaacggcgagaagcccttcgagtgcaccgcctgcagaaagaccttcagcaagaagagccacctgatcgtgcactggagaacccacaccggcgagaagcccttcggctgcaccgagtgcggcaaggccttcagccagaagagccagctgatcatccacctgagaacccacaccggcgagagacccttcgagtgccccgagtgcggcaaggccttcagagagaagagcaccgtgatcatccactacagaacccacaccggcgagaagccctacgagtgcaacgagtgcggcaaggccttcacccagaagagcaacctgatcgtgcaccagaagacccacaccggcgagaagacctacgagtgcaccaagtgcggcgagagcttcatccagaagctggacctgatcatccaccacagcacccacaccggcaagaagccccacgagtgcaacgagtgcaagaagaccttcagcgacaagagcaccctgatcatccaccagagaacccacaccggcgagaagccccacaagtgcaccgagtgcggcaagagcttcaacgagaagagcaccctgatcgtgcaccagagaacccacaccggcgagaagccctacgagtgcgacgtgtgcggcaagaccttcacccagaagagcaacctgggcgtgcaccagagaacccacagcggcgagaagcccttcgagtgcaacgagtgcgagaaggccttcagccagaagagctacctgatgctgcaccagagaggccacaccggcgagaagccctacgagtgcaacgagtgcgagaaggccttcagccagaagagctacctgatcatccaccagagaacccacaccgaggagaagccctacaagtgcaacgagtgcggcaaggccttcagagagaagagcaagctgatcatccaccagagaatccacaccggcgagaagccctacgagtgccccgtgtgctggaaggccttcagccagaagagccagctgatcatccaccagagaacccacaccggcgagaagccctacgcctgcaccgagtgcggcaaggccttcagagagaagagcaccttcaccgtgcaccagagaacccacaccggcgagaagccctacaagtgcaccgagtgcggcaaggccttcacccagaagagcaacctgatcgtgcaccagagaacccacgccggcaagaaggcccacggcagaggccacaccagaaagagcaagttcatggcccactag

SEQ ID NO: 105778 - DNA, 1920 bp, Artificial Sequence; identical to SEQ ID NO: 105776
  Description of Artificial Sequence: Synthetic coding sequence

SEQ ID NO: 105779 - DNA, 921 bp, Artificial Sequence
  Description of Artificial Sequence: Synthetic coding sequence
atgagcagcgagaagagcggcctgcccgacagcgtgccccacaccagcccccccccctacaacgccccccagccccccgccgagccccccgccccccccccccaggccgcccccagcagccaccaccaccaccaccaccactaccaccagagcggcaccgccaccctgcccagactgggcgccggcggcctggccagcagcgccgccaccgcccagagaggccccagcagcagcgccaccctgcccagacccccccaccacgccccccccggccccgccgccggcgcccccccccccggctgcgccaccctgcccagaatgccccccgacccctacctgcaggagaccagattcgagggccccctgcccccccccccccccgccgccgccgccccccccccccccgcccccgcccagaccgcccaggcccccggcttcgtggtgcccacccacgccggcaccgtgggcaccctgcccctgggcggctacgtggcccccggctaccccctgcagctgcagccctgcaccgcctacgtgcccgtgtaccccgtgggcaccccctacgccggcggcacccccggcggcaccggcgtgaccagcaccctgcccccccccccccagggccccggcctggccctgctggagcccagaagacccccccacgactacatgcccatcgccgtgctgaccaccatctgctgcttctggcccaccggcatcatcgccatcttcaaggccgtgcaggtgagaaccgccctggccagaggcgacatggtgagcgccgagatcgccagcagagaggccagaaacttcagcttcatcagcctggccgtgggcatcgccgccatggtgctgtgcaccatcctgaccgtggtgatcatcatcgccgcccagcaccacgagaactactgggacccctag

SEQ ID NO: 105780 - DNA, 2004 bp, Artificial Sequence
  Description of Artificial Sequence: Synthetic coding sequence
atggaggacctgagcagccccgacagcaccctgctgcagggcggccacaacctgctgagcagcgccagcttccaggaggccgtgaccttcaaggacgtgatcgtggacttcacccaggaggagtggaagcagctggaccccggccagagagacctgttcagagacgtgaccctggagaactacacccacctggtgagcatcggcctgcaggtgagcaagcccgacgtgatcagccagctggagcagggcaccgagccctggatcatggagcccagcatccccgtgggcacctgcgccgactgggagaccagactggagaacagcgtgagcgcccccgagcccgacatcagcgaggaggagctgagccccgaggtgatcgtggagaagcacaagagagacgacagctggagcagcaacctgctggagagctgggagtacgagggcagcctggagagacagcaggccaaccagcagaccctgcccaaggagatcaaggtgaccgagaagaccatccccagctgggagaagggccccgtgaacaacgagttcggcaagagcgtgaacgtgagcagcaacctggtgacccaggagcccagccccgaggagaccagcaccaagagaagcatcaagcagaacagcaaccccgtgaagaaggagaagagctgcaagtgcaacgagtgcggcaaggccttcagctactgcagcgccctgatcagacaccagagaacccacaccggcgagaagccctacaagtgcaacgagtgcgagaaggccttcagcagaagcgagaacctgatcaaccaccagagaatccacaccggcgacaagccctacaagtgcgaccagtgcggcaagggcttcatcgagggccccagcctgacccagcaccagagaatccacaccggcgagaagccctacaagtgcgacgagtgcggcaaggccttcagccagagaacccacctggtgcagcaccagagaatccacaccggcgagaagccctacacctgcaacgagtgcggcaaggccttcagccagagaggccacttcatggagcaccagaagatccacaccggcgagaagcccttcaagtgcgacgagtgcgacaagaccttcaccagaagcacccacctgacccagcaccagaagatccacaccggcgagaagacctacaagtgcaacgagtgcggcaaggccttcaacggccccagcaccttcatcagacaccacatgatccacaccggcgagaagccctacgagtgcaacgagtgcggcaaggccttcagccagcacagcaacctgacccagcaccagaagacccacacccaggagaaggcctacgagtgcaaggagtgcggcaaggccttcatcagaagcagcagcctggccaagcacgagagaatccacaccggcgagaagccctaccagtgccacgagtgcggcaagaccttcagctacggcagcagcctgatccagcacagaaagatccacaccggcgagagaccctacaagtgcaacgagtgcggcagagccttcaaccagaacatccacctgacccagcacaagagaatccacaccggcgccaagccctacgagtgcgccgagtgcggcaaggccttcagacactgcagcagcctggcccagcaccagaagacccacaccgaggagaagccctaccagtgcaacaagtgcgagaagaccttcagccagagcagccacctgacccagcaccagagaatccacaccggcgagaagccctacaagtgcaacgagtgcgacaaggccttcagcagaagcacccacctgaccgagcaccagaacacccacaccggcgagaagccctacaactgcaacgagtgcagaaagaccttcagccagagcacctacctgatccagcaccagagaatccacagcggcgagaagcccttcggctgcaacgactgcggcaagagcttcagatacagaagcgccctgaacaagcaccagagactgcaccccggcatctag

SEQ ID NO: 105781 - DNA, 2256 bp, Artificial Sequence
  Description of Artificial Sequence: Synthetic coding sequence
atggaggacctgagcagccccgacagcaccctgctgcagggcggccacaacctgctgagcagcgccagcttccaggaggccgtgaccttcaaggacgtgatcgtggacttcacccaggaggagtggaagcagctggaccccggccagagagacctgttcagagacgtgaccctggagaactacacccacctggtgagcatcggcctgcaggtgagcaagcccgacgtgatcagccagctggagcagggcaccgagccctggatcatggagcccagcatccccgtgggcacctgcgccgactgggagaccagactggagaacagcgtgagcgcccccgagcccgacatcagcgaggaggagctgagccccgaggtgatcgtggagaagcacaagagagacgacagctggagcagcaacctgctggagagctgggagtacgagggcagcctggagagacagcaggccaaccagcagaccctgcccaaggagatcaaggtgaccgagaagaccatccccagctgggagaagggccccgtgaacaacgagttcggcaagagcgtgaacgtgagcagcaacctggtgacccaggagcccagccccgaggagaccagcaccaagagaagcatcaagcagaacagcaaccccgtgaagaaggagaagagctgcaagtgcaacgagtgcggcaaggccttcagctactgcagcgccctgatcagacaccagagaacccacaccggcgagaagccctacaagtgcaacgagtgcgagaaggccttcagcagaagcgagaacctgatcaaccaccagagaatccacaccggcgacaagccctacaagtgcgaccagtgcggcaagggcttcatcgagggccccagcctgacccagcaccagagaatccacaccggcgagaagccctacaagtgcgacgagtgcggcaaggccttcagccagagaacccacctggtgcagcaccagagaatccacaccggcgagaagccctacacctgcaacgagtgcggcaaggccttcagccagagaggccacttcatggagcaccagaagatccacaccggcgagaagcccttcaagtgcgacgagtgcgacaagaccttcaccagaagcacccacctgacccagcaccagaagatccacaccggcgagaagacctacaagtgcaacgagtgcggcaaggccttcaacggccccagcaccttcatcagacaccacatgatccacaccggcgagaagccctacgagtgcaacgagtgcggcaaggccttcagccagcacagcaacctgacccagcaccagaagacccacaccggcgagaagccctacgactgcgccgagtgcggcaagagcttcagctactggagcagcctggcccagcacctgaagatccacaccggcgagaagccctacaagtgcaacgagtgcggcaaggccttcagctactgcagcagcctgacccagcacagaagaatccacaccagagagaagcccttcgagtgcagcgagtgcggcaaggccttcagctacctgagcaacctgaaccagcaccagaagacccacacccaggagaaggcctacgagtgcaaggagtgcggcaaggccttcatcagaagcagcagcctggccaagcacgagagaatccacaccggcgagaagccctaccagtgccacgagtgcggcaagaccttcagctacggcagcagcctgatccagcacagaaagatccacaccggcgagagaccctacaagtgcaacgagtgcggcagagccttcaaccagaacatccacctgacccagcacaagagaatccacaccggcgccaagccctacgagtgcgccgagtgcggcaaggccttcagacactgcagcagcctggcccagcaccagaagacccacaccgaggagaagccctaccagtgcaacaagtgcgagaagaccttcagccagagcagccacctgacccagcaccagagaatccacaccggcgagaagccctacaagtgcaacgagtgcgacaaggccttcagcagaagcacccacctgaccgagcaccagaacacccacaccggcgagaagccctacaactgcaacgagtgcagaaagaccttcagccagagcacctacctgatccagcaccagagaatccacagcggcgagaagcccttcggctgcaacgactgcggcaagagcttcagatacagaagcgccctgaacaagcaccagagactgcaccccggcatctag

SEQ ID NO: 105782 - DNA, 234 bp, Artificial Sequence
  Description of Artificial Sequence: Synthetic coding sequence
aaggccttcagccagagaacccacctggtgcagcaccagagaatccacaccggcgagaagccctacacctgcaacgagtgcggcaaggccttcagccagagaggccacttcatggagcaccagaagatccacaccggcgagaagcccttcaagtgcgacgagtgcgacaagaccttcaccagaagcacccacctgaccaccagcaagaacagctactggagaaagaacctgtag

SEQ ID NO: 105783 - DNA, 1755 bp, Artificial Sequence
  Description of Artificial Sequence: Synthetic coding sequence
atgatggagaactacggcaacctggtgagcctggacgtgctgaacagagacaaggacgaggagcccaccgtgaagcaggagatcgaggagatcgaggaggaggtggagccccagggcgtgatcgtgaccagaatcaagagcgagatcgaccaggaccccatgggcagagagaccttcgagctggtgggcagactggacaagcagagaggcatcttcctgtgggagatccccagagagagcctgacccaggagcagagaatgttcagagagaacaccaacatcatcagaaagagacccaacagcgaggagaagtgccacaagtgcgaggagtgcggcaagggcttcgtgagaaaggcccacttcatccagcaccagagagtgcacaccggcgagaagcccttccagtgcaacgagtgcggcaagagcttcagcagaagcagcttcgtgatcgagcaccagagaatccacaccggcgagagaccctacgagtgcaactactgcggcaagaccttcagcgtgagcagcaccctgatcagacaccagagaatccacaccggcgagagaccctaccagtgcaaccagtgcaagcagagcttcagccagagaagaagcctggtgaagcaccagagaatccacaccggcgagaagccccacaagtgcagcgactgcggcaaggccttcagctggaagagccacctgatcgagcaccagagaacccacaccggcgagaagccctaccactgcaccaagtgcaagaagagcttcagcagaaacagcctgctggtggagcaccagagaatccacaccggcgagagaccccacaagtgcggcgagtgcggcaaggccttcagactgagcacctacctgatccagcaccagaagatccacaccggcgagaagcccttcctgtgcatcgagtgcggcaagagcttcagcagaagcagcttcctgatcgagcaccagagaatccacaccggcgagagaccctaccagtgcaaggagtgcggcaagagcttcagccagctgtgcaacctgaccagacaccagagaatccacaccggcgacaagccccacaagtgcgaggagtgcggcaaggccttcagcagaagcagcggcctgatccagcaccagagaatccacaccagagagaagacctacccctacaacgagaccaaggagagcttcgaccccaactgcagcctggtgatccagcaggaggtgtaccccaaggagaagagctacaagtgcgacgagtgcggcaagaccttcagcgtgagcgcccacctggtgcagcaccagagaatccacaccggcgagaagccctacctgtgcaccgtgtgcggcaagagcttcagcagaagcagcttcctgatcgagcaccagagaatccacaccggcgagagaccctacctgtgcagacagtgcggcaagagcttcagccagctgtgcaacctgatcagacaccagggcgtgcacaccggcaacaagccccacaagtgcgacgagtgcggcaaggccttcagcagaaacagcggcctgatccagcaccagagaatccacaccggcgagaagccctacaagtgcgagaagtgcgacaagagcttcagccagcagagaagcctggtgaaccaccagaagatccacgccgaggtgaagacccaggagacccacgagtgcgacgcctgcggcgaggccttcaactgcagaatcagcctgatccagcaccagaagctgcacaccgcctggatgcagtag

SEQ ID NO: 105784 - DNA, 1881 bp, Artificial Sequence
  Description of Artificial Sequence: Synthetic coding sequence
atggccagccccagccccccccccgagagcaagggcctgctgaccttcgaggacgtggccgtgttcttcacccaggaggagtgggactacctggaccccgcccagagaagcctgtacaaggacgtgatgatggagaactacggcaacctggtgagcctggacgtgctgaacagagacaaggacgaggagcccaccgtgaagcaggagatcgaggagatcgaggaggaggtggagccccagggcgtgatcgtgaccagaatcaagagcgagatcgaccaggaccccatgggcagagagaccttcgagctggtgggcagactggacaagcagagaggcatcttcctgtgggagatccccagagagagcctgacccaggagcagagaatgttcagagagaacaccaacatcatcagaaagagacccaacagcgaggagaagtgccacaagtgcgaggagtgcggcaagggcttcgtgagaaaggcccacttcatccagcaccagagagtgcacaccggcgagaagcccttccagtgcaacgagtgcggcaagagcttcagcagaagcagcttcgtgatcgagcaccagagaatccacaccggcgagagaccctacgagtgcaactactgcggcaagaccttcagcgtgagcagcaccctgatcagacaccagagaatccacaccggcgagagaccctaccagtgcaaccagtgcaagcagagcttcagccagagaagaagcctggtgaagcaccagagaatccacaccggcgagaagccccacaagtgcagcgactgcggcaaggccttcagctggaagagccacctgatcgagcaccagagaacccacaccggcgagaagccctaccactgcaccaagtgcaagaagagcttcagcagaaacagcctgctggtggagcaccagagaatccacaccggcgagagaccccacaagtgcggcgagtgcggcaaggccttcagactgagcacctacctgatccagcaccagaagatccacaccggcgagaagcccttcctgtgcatcgagtgcggcaagagcttcagcagaagcagcttcctgatcgagcaccagagaatccacaccggcgagagaccctaccagtgcaaggagtgcggcaagagcttcagccagctgtgcaacctgaccagacaccagagaatccacaccggcgacaagccccacaagtgcgaggagtgcggcaaggccttcagcagaagcagcggcctgatccagcaccagagaatccacaccagagagaagacctacccctacaacgagaccaaggagagcttcgaccccaactgcagcctggtgatccagcaggaggtgtaccccaaggagaagagctacaagtgcgacgagtgcggcaagaccttcagcgtgagcgcccacctggtgcagcaccagagaatccacaccggcgagaagccctacctgtgcaccgtgtgcggcaagagcttcagcagaagcagcttcctgatcgagcaccagagaatccacaccggcgagagaccctacctgtgcagacagtgcggcaagagcttcagccagctgtgcaacctgatcagacaccagggcgtgcacaccggcaacaagccccacaagtgcgacgagtgcggcaaggccttcagcagaaacagcggcctgatccagcaccagagaatccacaccggcgagaagccctacaagtgcgagaagtgcgacaagagcttcagccagcagagaagcctggtgaaccaccagaagatccacgccgaggtgaagacccaggagacccacgagtgcgacgcctgcggcgaggccttcaactgcagaatcagcctgatccagcaccagaagctgcacaccgcctggatgcagtag

SEQ ID NO: 105785 - DNA, 1839 bp, Artificial Sequence
  Description of Artificial Sequence: Synthetic coding sequence
atggccagccccagccccccccccgagagcaaggaggagtgggactacctggaccccgcccagagaagcctgtacaaggacgtgatgatggagaactacggcaacctggtgagcctggacgtgctgaacagagacaaggacgaggagcccaccgtgaagcaggagatcgaggagatcgaggaggaggtggagccccagggcgtgatcgtgaccagaatcaagagcgagatcgaccaggaccccatgggcagagagaccttcgagctggtgggcagactggacaagcagagaggcatcttcctgtgggagatccccagagagagcctgacccaggagcagagaatgttcagagagaacaccaacatcatcagaaagagacccaacagcgaggagaagtgccacaagtgcgaggagtgcggcaagggcttcgtgagaaaggcccacttcatccagcaccagagagtgcacaccggcgagaagcccttccagtgcaacgagtgcggcaagagcttcagcagaagcagcttcgtgatcgagcaccagagaatccacaccggcgagagaccctacgagtgcaactactgcggcaagaccttcagcgtgagcagcaccctgatcagacaccagagaatccacaccggcgagagaccctaccagtgcaaccagtgcaagcagagcttcagccagagaagaagcctggtgaagcaccagagaatccacaccggcgagaagccccacaagtgcagcgactgcggcaaggccttcagctggaagagccacctgatcgagcaccagagaacccacaccggcgagaagccctaccactgcaccaagtgcaagaagagcttcagcagaaacagcctgctggtggagcaccagagaatccacaccggcgagagaccccacaagtgcggcgagtgcggcaaggccttcagactgagcacctacctgatccagcaccagaagatccacaccggcgagaagcccttcctgtgcatcgagtgcggcaagagcttcagcagaagcagcttcctgatcgagcaccagagaatccacaccggcgagagaccctaccagtgcaaggagtgcggcaagagcttcagccagctgtgcaacctgaccagacaccagagaatccacaccggcgacaagccccacaagtgcgaggagtgcggcaaggccttcagcagaagcagcggcctgatccagcaccagagaatccacaccagagagaagacctacccctacaacgagaccaaggagagcttcgaccccaactgcagcctggtgatccagcaggaggtgtaccccaaggagaagagctacaagtgcgacgagtgcggcaagaccttcagcgtgagcgcccacctggtgcagcaccagagaatccacaccggcgagaagccctacctgtgcaccgtgtgcggcaagagcttcagcagaagcagcttcctgatcgagcaccagagaatccacaccggcgagagaccctacctgtgcagacagtgcggcaagagcttcagccagctgtgcaacctgatcagacaccagggcgtgcacaccggcaacaagccccacaagtgcgacgagtgcggcaaggccttcagcagaaacagcggcctgatccagcaccagagaatccacaccggcgagaagccctacaagtgcgagaagtgcgacaagagcttcagccagcagagaagcctggtgaaccaccagaagatccacgccgaggtgaagacccaggagacccacgagtgcgacgcctgcggcgaggccttcaactgcagaatcagcctgatccagcaccagaagctgcacaccgcctggatgcagtag

SEQ ID NO: 105786 - DNA, 1377 bp, Artificial Sequence
  Description of Artificial Sequence: Synthetic coding sequence
atggccgccatgcccctgaaggcccagtaccaggagatggtgaccttcgaggacgtggccgtgcacttcaccaagaccgagtggaccggcctgagccccgcccagagagccctgtacagaagcgtgatgctggagaacttcggcaacctgaccgccctgggctaccccgtgcccaagcccgccctgatcagcctgctggagagaggcgacatggcctggggcctggaggcccaggacgacccccccgccgagagaaccaagaacgtgtgcaaggacgtggagaccaacatcgacagcgagagcaccctgatccagggcatcagcgaggagagagacggcatgatgagccacggccagctgaagagcgtgccccagagaaccgacttccccgagaccagaaacgtggagaagcaccaggacatccccaccgtgaagaacatccagggcaaggtgcccagaatcccctgcgccagaaagcccttcatctgcgaggagtgcggcaagagcttcagctacttcagctactacgccagacaccagagaatccacaccggcgagaagcccttcgagtgcagcgagtgcggcaaggccttcaacggcaacagcagcctgatcagacaccagagaatccacaccggcgagagaccctaccagtgcgaggagtgcggcagagccttcaacgacaacgccaacctgatcagacaccagagaatccacagcggcgacagaccctactactgcaccgagtgcggcaacagcttcaccagcagcagcgagttcgtgatccaccagagaatccacaccggcgagaagccctacgagtgcaacgagtgcggcaaggccttcgtgggcaacagccccctgctgagacaccagaagatccacaccggcgagaagccctacgagtgcaacgagtgcggcaagagcttcggcagaaccagccacctgagccagcaccagagaatccacaccggcgagaagccctacagctgcaaggtgtgcggccaggccttcaacttccacaccaagctgaccagacaccagagaatccacagcgaggagaagcccttcgactgcgtggactgcggcaaggccttcagcgcccaggagcagctgaagagacacctgagaatccacacccaggagagcagctacgtgtgcgacgagtgcggcaaggccctgaccagcaagagaaacctgcaccagcaccagagaatccacaccggcgagaagccctacgagtgcagcaagtacgagaaggccttcggcaccagcagccagctgggccacctggagcacgtgtacagcggcgagaagcccgtgctggacatctgcagattcggcctgcccgagttcttcacccccttctactggtag

SEQ ID NO: 105787 - DNA, 1737 bp, Artificial Sequence
  Description of Artificial Sequence: Synthetic coding sequence
atggccgaggagagcagaaagcccagcgcccccagcccccccgaccagacccccgaggaggacctggtgatcgtgaaggtggaggaggaccacggctgggaccaggagagcagcctgcacgagagcaaccccctgggccaggaggtgttcagactgagattcagacagctgagataccaggagaccctgggccccagagaggccctgatccagctgagagccctgtgccaccagtggctgagacccgacctgaacaccaaggagcagatcctggagctgctggtgctggagcagttcctgaccatcctgcccgaggagctgcagaccctggtgaaggagcaccagctggagaacggcgaggaggtggtgaccctgctggaggacctggagagacagatcgacatcctgggcagacccgtgagcgccagagtgcacggccacagagtgctgtgggaggaggtggtgcacagcgccagcgcccccgagccccccaacacccagctgcagagcgaggccacccagcacaagagccccgtgccccaggagagccaggagagagccatgagcaccagccagagccccaccagaagccagaagggcagcagcggcgaccaggagatgaccgccaccctgctgaccgccggcttccagaccctggagaagatcgaggacatggccgtgagcctgatcagagaggagtggctgctggaccccagccagaaggacctgtgcagagacaacagacccgagaacttcagaaacatgttcagcctgggcggcgagaccagaagcgagaacagagagctggccagcaagcaggtgatcagcaccggcatccagccccacggcgagaccgccgccaagtgcaacggcgacgtgatcagaggcctggagcacgaggaggccagagacctgctgggcagactggagagacagagaggcaaccccacccaggagagaagacacaagtgcgacgagtgcggcaagagcttcgcccagagcagcggcctggtgagacactggagaatccacaccggcgagaagccctaccagtgcaacgtgtgcggcaaggccttcagctacagaagcgccctgctgagccaccaggacatccacaacaaggtgaagagataccactgcaaggagtgcggcaaggccttcagccagaacaccggcctgatcctgcaccagagaatccacaccggcgagaagccctaccagtgcaaccagtgcggcaaggccttcagccagagcgccggcctgatcctgcaccagagaatccacagcggcgagagaccctacgagtgcaacgagtgcggcaaggccttcagccacagcagccacctgatcggccaccagagaatccacaccggcgagaagccctacgagtgcgacgagtgcggcaagaccttcagaagaagcagccacctgatcggccaccagagaagccacaccggcgagaagccctacaagtgcaacgagtgcggcagagccttcagccagaagagcggcctgatcgagcaccagagaatccacaccggcgagagaccctacaagtgcaaggagtgcggcaaggccttcaacggcaacaccggcctgatccagcacctgagaatccacaccggcgagaagccctaccagtgcaacgagtgcggcaaggccttcatccagagaagcagcctgatcagacaccagagaatccacagcggcgagaagagcgagagcatcagcgtgtag

SEQ ID NO: 105788 - DNA, 1737 bp, Artificial Sequence; identical to SEQ ID NO: 105787
  Description of Artificial Sequence: Synthetic coding sequence

SEQ ID NO: 105789 - DNA, 477 bp, Artificial Sequence
  Description of Artificial Sequence: Synthetic coding sequence
atggccgaggagagcagaaagcccagcgcccccagcccccccgaccagacccccgaggaggacctggtgatcgtgaaggtggaggaggaccacggctgggaccaggagagcagcctgcacgagagcaaccccctgggccaggaggtgttcagactgagattcagacagctgagataccaggagaccctgggccccagagaggccctgatccagctgagagccctgtgccaccagtggctgagacccgacctgaacaccaaggagcagatcctggagctgctggtgctggagcagttcctgaccatcctgcccgaggagctgcagaccctggtgaaggagcaccagctggagaacggcgaggaggtggtgaccctgctggaggacctggagagacagatcgacatcctgggcagacccgtgagcagaagaagaagccagctggcctacatggacatcggctacagcggcagaagatag

SEQ ID NO: 105790 - DNA, 1185 bp, Artificial Sequence
  Description of Artificial Sequence: Synthetic coding sequence
atgaacaccaacagcaaggaggtgctgagcctgggcgtgcaggtgcccgaggcctgggaggagctgctgaccatgaaggtggaggccaagagccacctgcagtggcaggagagcagactgaagagaagcaaccccctggccagagagatcttcagaagacacttcagacagctgtgctaccaggagacccccggccccagagaggccctgaccagactgcaggagctgtgctaccagtggctgagaccccacgtgagcaccaaggagcagatcctggacctgctggtgctggagcagttcctgagcatcctgcccaaggagctgcagggctgggtgagagagcactgccccgagagcggcgaggaggccgtgatcctgctggaggacctggagagagagctggacgagccccagcacgagatggtggcccacagacacagacaggaggtgctgtgcaaggagatggtgcccctggccgagcagacccccctgaccctgcagagccagcccaaggagccccagctgacctgcgacagcgcccagaagtgccacagcatcggcgagaccgacgaggtgaccaagaccgaggacagagagctggtgctgagaaaggactgccccaagatcgtggagccccacggcaagatgttcaacgagcagacctgggaggtgagccagcaggaccccagccacggcgaggtgggcgagcacaaggacagaatcgagagacagtggggcaacctgctgggcgagggccagcacaagtgcgacgagtgcggcaagagcttcacccagagcagcggcctgatcagacaccagagaatccacaccggcgagagaccctacgagtgcaacgagtgcggcaaggccttcagcagaagcagcggcctgttcaaccacagaggcatccacaacatccagaagagataccactgcaaggagtgcggcaaggtgttcagccagagcgccggcctgatccagcaccagagaatccacaagggcgagaagccctaccagtgcagccagtgcagcaagagctacagcagaagaagcttcctgatcgagcaccagagaagccacaccggcgagagaccccaccagtgcatcgagtgcggcaagagcttcaacagacactgcaacctgatcagacaccagaagatccacaccgtggccgagctggtgtag

SEQ ID NO: 105791 - DNA, 126 bp, Artificial Sequence
  Description of Artificial Sequence: Synthetic coding sequence
atgaacaccaacagcaaggaggtgctgagcctgggcgtgcaggtgcccgaggcctgggaggagctgctgaccatgaaggtggaggccaagagccacctgcagtggcaggagagcagactgaagtag

SEQ ID NO: 105792 - DNA, 1185 bp, Artificial Sequence; identical to SEQ ID NO: 105790
  Description of Artificial Sequence: Synthetic coding sequence

SEQ ID NO: 105793 - DNA, 1338 bp, Artificial Sequence
  Description of Artificial Sequence: Synthetic coding sequence
atgaacaccaacagcaaggaggtgctgagcctgggcgtgcaggtgcccgaggcctgggaggagctgctgaccatgaaggtggaggccaagagccacctgcagtggcaggagagcagactgaagagaagcaaccccctggccagagagatcttcagaagacacttcagacagctgtgctaccaggagacccccggccccagagaggccctgaccagactgcaggagctgtgctaccagtggctgagaccccacgtgagcaccaaggagcagatcctggacctgctggtgctggagcagttcctgagcatcctgcccaaggagctgcagggctgggtgagagagcactgccccgagagcggcgaggaggccgtgatcctgctggaggacctggagagagagctggacgagccccagcacgagatggtggcccacagacacagacaggaggtgctgtgcaaggagatggtgcccctggccgagcagacccccctgaccctgcagagccagcccaaggagccccagctgacctgcgacagcgcccagaagtgccacagcatcggcgagaccgacctgatcagaagcctgagaagaagagccgtgctgatccccctgggcgcccacctgttcagcaccgacaccttcctgttcagcaagcccgtggtgatcccccagctgaagggcggcggcgagacctggcccaacaacagaggcgtgctgagagacgaggtgaccaagaccgaggacagagagctggtgctgagaaaggactgccccaagatcgtggagccccacggcaagatgttcaacgagcagacctgggaggtgagccagcaggaccccagccacggcgaggtgggcgagcacaaggacagaatcgagagacagtggggcaacctgctgggcgagggccagcacaagtgcgacgagtgcggcaagagcttcacccagagcagcggcctgatcagacaccagagaatccacaccggcgagagaccctacgagtgcaacgagtgcggcaaggccttcagcagaagcagcggcctgttcaaccacagaggcatccacaacatccagaagagataccactgcaaggagtgcggcaaggtgttcagccagagcgccggcctgatccagcaccagagaatccacaagggcgagaagccctaccagtgcagccagtgcagcaagagctacagcagaagaagcttcctgatcgagcaccagagaagccacaccggcgagagaccccaccagtgcatcgagtgcggcaagagcttcaacagacactgcaacctgatcagacaccagaagatccacaccgtggccgagctggtgtag

SEQ ID NO: 105794 - DNA, 1821 bp, Artificial Sequence
  Description of Artificial Sequence: Synthetic coding sequence
atgaccctgctgaccttcagagacgtggccatcgagttcagcctggaggagtggaagtgcctggacctggcccagcagaacctgtacagagacgtgatgctggagaactacagaaacctgttcagcgtgggcctgaccgtgtgcaagcccggcctgatcacctgcctggagcagagaaaggagccctggaacgtgaagagacaggaggccgccgacggccaccccgagatgggcttccaccacgccacccaggcctgcctggagctgctgggcagcagcgacctgcccgccagcgccagccagagcgccggcatcaccggcgtgaaccacagagcccagcccggcctgaacgtgagcgtggacaagttcaccgccatgagcagccacttcacccaggacctgctgcccgagcagggcatccaggacgccttccccaagagaatcctgagaggctacggcaactgcggcctggacaacctgtacctgagaaaggactgggagagcctggacgagtgcaagctgcagaaggactacaacggcctgaaccagtgcagcagcaccacccacagcaagatcttccagtacaacaagtacgtgaagatcttcgacaacttcagcaacctgcacagaagaaacatcagcaacaccggcgagaagcccttcaagtgccaggagtgcggcaagagcttccagatgctgagcttcctgaccgagcaccagaagatccacaccggcaagaagttccagaagtgcggcgagtgcggcaagaccttcatccagtgcagccacttcaccgagcccgagaacatcgacaccggcgagaagccctacaagtgccaggagtgcaacaacgtgatcaagacctgcagcgtgctgaccaagaacagaatctacgccggcggcgagcactacagatgcgaggagttcggcaaggtgttcaaccagtgcagccacctgaccgagcacgagcacggcaccgaggagaagccctgcaagtacgaggagtgcagcagcgtgttcatcagctgcagcagcctgagcaaccagcagatgatcctggccggcgagaagctgagcaagtgcgagacctggtacaagggcttcaaccacagccccaaccccagcaagcaccagagaaacgagatcggcggcaagcccttcaagtgcgaggagtgcgacagcatcttcaagtggttcagcgacctgaccaagcacaagagaatccacaccggcgagaagccctacaagtgcgacgagtgcggcaaggcctacacccagagcagccacctgagcgagcacagaagaatccacaccggcgagaagccctaccagtgcgaggagtgcggcaaggtgttcagaacctgcagcagcctgagcaaccacaagagaacccacagcgaggagaagccctacacctgcgaggagtgcggcaacatcttcaagcagctgagcgacctgaccaagcacaagaagacccacaccggcgagaagccctacaagtgcgacgagtgcggcaagaacttcacccagagcagcaacctgatcgtgcacaagagaatccacaccggcgagaagccctacaagtgcgaggagtgcggcagagtgttcatgtggttcagcgacatcaccaagcacaagaagacccacaccggcgagaagccctacaagtgcgacgagtgcggcaagaacttcacccagagcagcaacctgatcgtgcacaagagaatccacaccggcgagaagccctacaagtgcgagaagtgcggcaaggccttcacccagttcagccacctgaccgtgcacgagagcatccacacctag

SEQ ID NO: 105795 - DNA, 1686 bp, Artificial Sequence
  Description of Artificial Sequence: Synthetic coding sequence
atggccggcgcccagaccctgctgaccttcagagacgtggccatcgagttcagcctggaggagtggaagtgcctggacctggcccagcagaacctgtacagagacgtgatgctggagaactacagaaacctgttcagcgtgggcctgaccgtgtgcaagcccggcctgatcacctgcctggagcagagaaaggagccctggaacgtgaagagacaggaggccgccgacggccaccccgccatgagcagccacttcacccaggacctgctgcccgagcagggcatccaggacgccttccccaagagaatcctgagaggctacggcaactgcggcctggacaacctgtacctgagaaaggactgggagagcctggacgagtgcaagctgcagaaggactacaacggcctgaaccagtgcagcagcaccacccacagcaagatcttccagtacaacaagtacgtgaagatcttcgacaacttcagcaacctgcacagaagaaacatcagcaacaccggcgagaagcccttcaagtgccaggagtgcggcaagagcttccagatgctgagcttcctgaccgagcaccagaagatccacaccggcaagaagttccagaagtgcggcgagtgcggcaagaccttcatccagtgcagccacttcaccgagcccgagaacatcgacaccggcgagaagccctacaagtgccaggagtgcaacaacgtgatcaagacctgcagcgtgctgaccaagaacagaatctacgccggcggcgagcactacagatgcgaggagttcggcaaggtgttcaaccagtgcagccacctgaccgagcacgagcacggcaccgaggagaagccctgcaagtacgaggagtgcagcagcgtgttcatcagctgcagcagcctgagcaaccagcagatgatcctggccggcgagaagctgagcaagtgcgagacctggtacaagggcttcaaccacagccccaaccccagcaagcaccagagaaacgagatcggcggcaagcccttcaagtgcgaggagtgcgacagcatcttcaagtggttcagcgacctgaccaagcacaagagaatccacaccggcgagaagccctacaagtgcgacgagtgcggcaaggcctacacccagagcagccacctgagcgagcacagaagaatccacaccggcgagaagccctaccagtgcgaggagtgcggcaaggtgttcagaacctgcagcagcctgagcaaccacaagagaacccacagcgaggagaagccctacacctgcgaggagtgcggcaacatcttcaagcagctgagcgacctgaccaagcacaagaagacccacaccggcgagaagccctacaagtgcgacgagtgcggcaagaacttcacccagagcagcaacctgatcgtgcacaagagaatccacaccggcgagaagccctacaagtgcgaggagtgcggcagagtgttcatgtggttcagcgacatcaccaagcacaagaagacccacaccggcgagaagccctacaagtgcgacgagtgcggcaagaacttcacccagagcagcaacctgatcgtgcacaagagaatccacaccggcgagaagccctacaagtgcgagaagtgcggcaaggccttcacccagttcagccacctgaccgtgcacgagagcatccacacctag

SEQ ID NO: 105796 - DNA, 1674 bp, Artificial Sequence
  Description of Artificial Sequence: Synthetic coding sequence
atgaccctgctgaccttcagagacgtggccatcgagttcagcctggaggagtggaagtgcctggacctggcccagcagaacctgtacagagacgtgatgctggagaactacagaaacctgttcagcgtgggcctgaccgtgtgcaagcccggcctgatcacctgcctggagcagagaaaggagccctggaacgtgaagagacaggaggccgccgacggccaccccgccatgagcagccacttcacccaggacctgctgcccgagcagggcatccaggacgccttccccaagagaatcctgagaggctacggcaactgcggcctggacaacctgtacctgagaaaggactgggagagcctggacgagtgcaagctgcagaaggactacaacggcctgaaccagtgcagcagcaccacccacagcaagatcttccagtacaacaagtacgtgaagatcttcgacaacttcagcaacctgcacagaagaaacatcagcaacaccggcgagaagcccttcaagtgccaggagtgcggcaagagcttccagatgctgagcttcctgaccgagcaccagaagatccacaccggcaagaagttccagaagtgcggcgagtgcggcaagaccttcatccagtgcagccacttcaccgagcccgagaacatcgacaccggcgagaagccctacaagtgccaggagtgcaacaacgtgatcaagacctgcagcgtgctgaccaagaacagaatctacgccggcggcgagcactacagatgcgaggagttcggcaaggtgttcaaccagtgcagccacctgaccgagcacgagcacggcaccgaggagaagccctgcaagtacgaggagtgcagcagcgtgttcatcagctgcagcagcctgagcaaccagcagatgatcctggccggcgagaagctgagcaagtgcgagacctggtacaagggcttcaaccacagccccaaccccagcaagcaccagagaaacgagatcggcggcaagcccttcaagtgcgaggagtgcgacagcatcttcaagtggttcagcgacctgaccaagcacaagagaatccacaccggcgagaagccctacaagtgcgacgagtgcggcaaggcctacacccagagcagccacctgagcgagcacagaagaatccacaccggcgagaagccctaccagtgcgaggagtgcggcaaggtgttcagaacctgcagcagcctgagcaaccacaagagaacccacagcgaggagaagccctacacctgcgaggagtgcggcaacatcttcaagcagctgagcgacctgaccaagcacaagaagacccacaccggcgagaagccctacaagtgcgacgagtgcggcaagaacttcacccagagcagcaacctgatcgtgcacaagagaatccacaccggcgagaagccctacaagtgcgaggagtgcggcagagtgttcatgtggttcagcgacatcaccaagcacaagaagacccacaccggcgagaagccctacaagtgcgacgagtgcggcaagaacttcacccagagcagcaacctgatcgtgcacaagagaatccacaccggcgagaagccctacaagtgcgagaagtgcggcaaggccttcacccagttcagccacctgaccgtgcacgagagcatccacacctag

SEQ ID NO: 105797 - DNA, 1890 bp, Artificial Sequence
  Description of Artificial Sequence: Synthetic coding sequence
atgaccctgctgaccttcagagacgtggccatcgagttcagcctggaggagtggaagtgcctggacctggcccagcagaacctgtacagagacgtgatgctggagaactacagaaacctgttcagcgtgggcctgaccgtgtgcaagcccggcctgatcacctgcctggagcagagaaaggagccctggaacgtgaagagacaggaggccgccgacggccaccccgagatgggcttccaccacgccacccaggcctgcctggagctgctgggcagcagcgacctgcccgccagcgccagccagagcgccggcatcaccggcgtgaaccacagagcccagcccggcctgaacgtgagcgtggacaagttcaccgccctgtgcagccccggcgtgctgcagaccgtgaagtggttcctggagttcagatgcatcttcagcctggccatgagcagccacttcacccaggacctgctgcccgagcagggcatccaggacgccttccccaagagaatcctgagaggctacggcaactgcggcctggacaacctgtacctgagaaaggactgggagagcctggacgagtgcaagctgcagaaggactacaacggcctgaaccagtgcagcagcaccacccacagcaagatcttccagtacaacaagtacgtgaagatcttcgacaacttcagcaacctgcacagaagaaacatcagcaacaccggcgagaagcccttcaagtgccaggagtgcggcaagagcttccagatgctgagcttcctgaccgagcaccagaagatccacaccggcaagaagttccagaagtgcggcgagtgcggcaagaccttcatccagtgcagccacttcaccgagcccgagaacatcgacaccggcgagaagccctacaagtgccaggagtgcaacaacgtgatcaagacctgcagcgtgctgaccaagaacagaatctacgccggcggcgagcactacagatgcgaggagttcggcaaggtgttcaaccagtgcagccacctgaccgagcacgagcacggcaccgaggagaagccctgcaagtacgaggagtgcagcagcgtgttcatcagctgcagcagcctgagcaaccagcagatgatcctggccggcgagaagctgagcaagtgcgagacctggtacaagggcttcaaccacagccccaaccccagcaagcaccagagaaacgagatcggcggcaagcccttcaagtgcgaggagtgcgacagcatcttcaagtggttcagcgacctgaccaagcacaagagaatccacaccggcgagaagccctacaagtgcgacgagtgcggcaaggcctacacccagagcagccacctgagcgagcacagaagaatccacaccggcgagaagccctaccagtgcgaggagtgcggcaaggtgttcagaacctgcagcagcctgagcaaccacaagagaacccacagcgaggagaagccctacacctgcgaggagtgcggcaacatcttcaagcagctgagcgacctgaccaagcacaagaagacccacaccggcgagaagccctacaagtgcgacgagtgcggcaagaacttcacccagagcagcaacctgatcgtgcacaagagaatccacaccggcgagaagccctacaagtgcgaggagtgcggcagagtgttcatgtggttcagcgacatcaccaagcacaagaagacccacaccggcgagaagccctacaagtgcgacgagtgcggcaagaacttcacccagagcagcaacctgatcgtgcacaagagaatccacaccggcgagaagccctacaagtgcgagaagtgcggcaaggccttcacccagttcagccacctgaccgtgcacgagagcatccacacctag

SEQ ID NO: 105798 - DNA, 1686 bp, Artificial Sequence; identical to SEQ ID NO: 105795
  Description of Artificial Sequence: Synthetic coding sequence

SEQ ID NO: 105799 - DNA, 1833 bp, Artificial Sequence
  Description of Artificial Sequence: Synthetic coding sequence
atggccggcgcccagaccctgctgaccttcagagacgtggccatcgagttcagcctggaggagtggaagtgcctggacctggcccagcagaacctgtacagagacgtgatgctggagaactacagaaacctgttcagcgtgggcctgaccgtgtgcaagcccggcctgatcacctgcctggagcagagaaaggagccctggaacgtgaagagacaggaggccgccgacggccaccccgagatgggcttccaccacgccacccaggcctgcctggagctgctgggcagcagcgacctgcccgccagcgccagccagagcgccggcatcaccggcgtgaaccacagagcccagcccggcctgaacgtgagcgtggacaagttcaccgccatgagcagccacttcacccaggacctgctgcccgagcagggcatccaggacgccttccccaagagaatcctgagaggctacggcaactgcggcctggacaacctgtacctgagaaaggactgggagagcctggacgagtgcaagctgcagaaggactacaacggcctgaaccagtgcagcagcaccacccacagcaagatcttccagtacaacaagtacgtgaagatcttcgacaacttcagcaacctgcacagaagaaacatcagcaacaccggcgagaagcccttcaagtgccaggagtgcggcaagagcttccagatgctgagcttcctgaccgagcaccagaagatccacaccggcaagaagttccagaagtgcggcgagtgcggcaagaccttcatccagtgcagccacttcaccgagcccgagaacatcgacaccggcgagaagccctacaagtgccaggagtgcaacaacgtgatcaagacctgcagcgtgctgaccaagaacagaatctacgccggcggcgagcactacagatgcgaggagttcggcaaggtgttcaaccagtgcagccacctgaccgagcacgagcacggcaccgaggagaagccctgcaagtacgaggagtgcagcagcgtgttcatcagctgcagcagcctgagcaaccagcagatgatcctggccggcgagaagctgagcaagtgcgagacctggtacaagggcttcaaccacagccccaaccccagcaagcaccagagaaacgagatcggcggcaagcccttcaagtgcgaggagtgcgacagcatcttcaagtggttcagcgacctgaccaagcacaagagaatccacaccggcgagaagccctacaagtgcgacgagtgcggcaaggcctacacccagagcagccacctgagcgagcacagaagaatccacaccggcgagaagccctaccagtgcgaggagtgcggcaaggtgttcagaacctgcagcagcctgagcaaccacaagagaacccacagcgaggagaagccctacacctgcgaggagtgcggcaacatcttcaagcagctgagcgacctgaccaagcacaagaagacccacaccggcgagaagccctacaagtgcgacgagtgcggcaagaacttcacccagagcagcaacctgatcgtgcacaagagaatccacaccggcgagaagccctacaagtgcgaggagtgcggcagagtgttcatgtggttcagcgacatcaccaagcacaagaagacccacaccggcgagaagccctacaagtgcgacgagtgcggcaagaacttcacccagagcagcaacctgatcgtgcacaagagaatccacaccggcgagaagccctacaagtgcgagaagtgcggcaaggccttcacccagttcagccacctgaccgtgcacgagagcatccacacctag

SEQ ID NO: 105800 - DNA, 396 bp, Artificial Sequence
  Description of Artificial Sequence: Synthetic coding sequence
atggccggcgcccagaccctgctgaccttcagagacgtggccatcgagttcagcctggaggagtggaagtgcctggacctggcccagcagaacctgtacagagacgtgatgctggagaactacagaaacctgttcagcgtgggcctgaccgtgtgcaagcccggcctgatcacctgcctggagcagagaaaggagccctggaacgtgaagagacaggaggccgccgacggccaccccgccatgagcagccacttcacccaggacctgctgcccgagcagggcatccaggacgccttccccaagagaatcctgagaggctacggcaactgcggcctggacaacctgtacctgagaaaggactgggagagcctggacgagtgcaagctgcagaagtag

SEQ ID NO: 105801 - DNA, 348 bp, Artificial Sequence
  Description of Artificial Sequence: Synthetic coding sequence
atggccggcgcccagaccctgctgaccttcagagacgtggccatcgagttcagcctggaggagtggaagtgcctggacctggcccagcagaacctgtacagagacgtgatgctggagaactacagaaacctgttcagcgtgggcctgaccgtgtgcaagcccggcctgatcacctgcctggagcagagaaaggagccctggaacgtgaagagacaggaggccgccgacggccaccccgagatgggcttccaccacgccacccaggcctgcctggagctgctgggcagcagcgacctgcccgccagcgccagccagagcgccggcatcaccggcgtgaaccacagatag

SEQ ID NO: 105802 - DNA, 1281 bp, Artificial Sequence
  Description of Artificial Sequence: Synthetic coding sequence
atggccgccgtgagccccaccaccagatgccaggagagcgtgaccttcgaggacgtggccgtggtgttcaccgacgaggagtggagcagactggtgcccatccagagagacctgtacaaggaggtgatgctggagaactacaacagcatcgtgagcctgggcctgcccgtgccccagcccgacgtgatcttccagctgaagagaggcgacaagccctggatggtggacctgcacggcagcgaggagagagagtggcccgagagcgtgagcctggactgggagaccaagcccgagatccacgacgccagcgacaagaagagcgagggcagcctgagagagtgcctgggcagacagagccccctgtgccccaagttcgaggtgcacacccccaacggcagaatgggcaccgagaagcagagccccagcggcgagaccagaaagaagagcctgagcagagacaagggcctgagaagaagaagaagcgccctgagcagagagatcctgaccaaggagagacaccaggagtgcagcgactgcggcaagaccttcttcgaccacagcagcctgaccagacaccagagaacccacaccggcgagaagccctacgactgcagagagtgcggcaaggccttcagccacagaagcagcctgagcagacacctgatgagccacaccggcgagagcccctacgagtgcagcgtgtgcagcaaggccttcttcgacagaagcagcctgaccgtgcaccagagaatccacaccggcgagaagcccttccagtgcaacgagtgcggcaaggccttcttcgacagaagcagcctgaccagacaccagagaatccacaccggcgagagcccctacgagtgccaccagtgcggcaaggccttcagccagaagagcatcctgaccagacaccagctgatccacaccggcagaaagccctacgagtgcaacgagtgcggcaaggccttctacggcgtgagcagcctgaacagacaccagaaggcccacgccggcgaccccagataccagtgcaacgagtgcggcaaggccttcttcgacagaagcagcctgacccagcaccagaagatccacaccggcgacaagccctacgagtgcagcgagtgcggcaaggccttcagccagagatgcagactgaccagacaccagagagtgcacaccggcgagaagcccttcgagtgcaccgtgtgcggcaaggtgttcagcagcaagagcagcgtgatccagcaccagagaagatacgccaagcagggcatcgactag

SEQ ID NO: 105803 - DNA, 1155 bp, Artificial Sequence
  Description of Artificial Sequence: Synthetic coding sequence
atgctggagaactacaacagcatcgtgagcctgggcctgcccgtgccccagcccgacgtgatcttccagctgaagagaggcgacaagccctggatggtggacctgcacggcagcgaggagagagagtggcccgagagcgtgagcctggactgggagaccaagcccgagatccacgacgccagcgacaagaagagcgagggcagcctgagagagtgcctgggcagacagagccccctgtgccccaagttcgaggtgcacacccccaacggcagaatgggcaccgagaagcagagccccagcggcgagaccagaaagaagagcctgagcagagacaagggcctgagaagaagaagaagcgccctgagcagagagatcctgaccaaggagagacaccaggagtgcagcgactgcggcaagaccttcttcgaccacagcagcctgaccagacaccagagaacccacaccggcgagaagccctacgactgcagagagtgcggcaaggccttcagccacagaagcagcctgagcagacacctgatgagccacaccggcgagagcccctacgagtgcagcgtgtgcagcaaggccttcttcgacagaagcagcctgaccgtgcaccagagaatccacaccggcgagaagcccttccagtgcaacgagtgcggcaaggccttcttcgacagaagcagcctgaccagacaccagagaatccacaccggcgagagcccctacgagtgccaccagtgcggcaaggccttcagccagaagagcatcctgaccagacaccagctgatccacaccggcagaaagccctacgagtgcaacgagtgcggcaaggccttctacggcgtgagcagcctgaacagacaccagaaggcccacgccggcgaccccagataccagtgcaacgagtgcggcaaggccttcttcgacagaagcagcctgacccagcaccagaagatccacaccggcgacaagccctacgagtgcagcgagtgcggcaaggccttcagccagagatgcagactgaccagacaccagagagtgcacaccggcgagaagcccttcgagtgcaccgtgtgcggcaaggtgttcagcagcaagagcagcgtgatccagcaccagagaagatacgccaagcagggcatcgactag

SEQ ID NO: 105804 - DNA, 1041 bp, Artificial Sequence
  Description of Artificial Sequence: Synthetic coding sequence
atgctggagaactacaacagcatcgtgagcctggactgggagaccaagcccgagatccacgacgccagcgacaagaagagcgagggcagcctgagagagtgcctgggcagacagagccccctgtgccccaagttcgaggtgcacacccccaacggcagaatgggcaccgagaagcagagccccagcggcgagaccagaaagaagagcctgagcagagacaagggcctgagaagaagaagaagcgccctgagcagagagatcctgaccaaggagagacaccaggagtgcagcgactgcggcaagaccttcttcgaccacagcagcctgaccagacaccagagaacccacaccggcgagaagccctacgactgcagagagtgcggcaaggccttcagccacagaagcagcctgagcagacacctgatgagccacaccggcgagagcccctacgagtgcagcgtgtgcagcaaggccttcttcgacagaagcagcctgaccgtgcaccagagaatccacaccggcgagaagcccttccagtgcaacgagtgcggcaaggccttcttcgacagaagcagcctgaccagacaccagagaatccacaccggcgagagcccctacgagtgccaccagtgcggcaaggccttcagccagaagagcatcctgaccagacaccagctgatccacaccggcagaaagccctacgagtgcaacgagtgcggcaaggccttctacggcgtgagcagcctgaacagacaccagaaggcccacgccggcgaccccagataccagtgcaacgagtgcggcaaggccttcttcgacagaagcagcctgacccagcaccagaagatccacaccggcgacaagccctacgagtgcagcgagtgcggcaaggccttcagccagagatgcagactgaccagacaccagagagtgcacaccggcgagaagcccttcgagtgcaccgtgtgcggcaaggtgttcagcagcaagagcagcgtgatccagcaccagagaagatacgccaagcagggcatcgactag

SEQ ID NO: 105805 - DNA, 1320 bp, Artificial Sequence
  Description of Artificial Sequence: Synthetic coding sequence
atggccgccgtgagccccaccaccagatgccaggagagcgtgaccttcgaggacgtggccgtggtgttcaccgacgaggagtggagcagactggtgcccatccagagagacctgtacaaggaggtgatgctggagaactacaacagcatcgtgagcctgggcctgcccgtgccccagcccgacgtgatcttccagctgaagagaggcgacaagccctggatggtggacctgcacggcagcgaggagagagagtggcccgagagcgtgagcctggcccaggagaagaactgcatctgcttcctgttcgtgcccgactgggagaccaagcccgagatccacgacgccagcgacaagaagagcgagggcagcctgagagagtgcctgggcagacagagccccctgtgccccaagttcgaggtgcacacccccaacggcagaatgggcaccgagaagcagagccccagcggcgagaccagaaagaagagcctgagcagagacaagggcctgagaagaagaagaagcgccctgagcagagagatcctgaccaaggagagacaccaggagtgcagcgactgcggcaagaccttcttcgaccacagcagcctgaccagacaccagagaacccacaccggcgagaagccctacgactgcagagagtgcggcaaggccttcagccacagaagcagcctgagcagacacctgatgagccacaccggcgagagcccctacgagtgcagcgtgtgcagcaaggccttcttcgacagaagcagcctgaccgtgcaccagagaatccacaccggcgagaagcccttccagtgcaacgagtgcggcaaggccttcttcgacagaagcagcctgaccagacaccagagaatccacaccggcgagagcccctacgagtgccaccagtgcggcaaggccttcagccagaagagcatcctgaccagacaccagctgatccacaccggcagaaagccctacgagtgcaacgagtgcggcaaggccttctacggcgtgagcagcctgaacagacaccagaaggcccacgccggcgaccccagataccagtgcaacgagtgcggcaaggccttcttcgacagaagcagcctgacccagcaccagaagatccacaccggcgacaagccctacgagtgcagcgagtgcggcaaggccttcagccagagatgcagactgaccagacaccagagagtgcacaccggcgagaagcccttcgagtgcaccgtgtgcggcaaggtgttcagcagcaagagcagcgtgatccagcaccagagaagatacgccaagcagggcatcgactag

SEQ ID NO: 105806 - DNA, 1611 bp, Artificial Sequence
  Description of Artificial Sequence: Synthetic coding sequence
atgatgttccaggacagcgtggccttcgaggacgtggccgtgagcttcacccaggaggagtgggccctgctggaccccagccagaagaacctgtacagagacgtgatgcaggagaccttcaagaacctgaccagcgtgggcaagacctggaaggtgcagaacatcgaggacgagtacaagaaccccagaagaaacctgagcctgatgagagagaagctgtgcgagagcaaggagagccaccactgcggcgagagcttcaaccagatcgccgacgacatgctgaacagaaagaccctgcccggcatcaccccctgcgagagcagcgtgtgcggcgaggtgggcaccggccacagcagcctgaacacccacatcagagccgacaccggccacaagagcagcgagtaccaggagtacggcgagaacccctacagaaacaaggagtgcaagaaggccttcagctacctggacagcttccagagccacgacaaggcctgcaccaaggagaagccctacgacggcaaggagtgcaccgagaccttcatcagccacagctgcatccagagacacagagtgatgcacagcggcgacggcccctacaagtgcaagttctgcggcaaggccttctacttcctgaacctgtgcctgatccacgagagaatccacaccggcgtgaagccctacaagtgcaagcagtgcggcaaggccttcaccagaagcaccaccctgcccgtgcacgagagaacccacaccggcgtgaacgccgacgagtgcaaggagtgcggcaacgccttcagcttccccagcgagatcagaagacacaagagaagccacaccggcgagaagccctacgagtgcaagcagtgcggcaaggtgttcatcagcttcagcagcatccagtaccacaagatgacccacaccggcgagaagccctacgagtgcaagcagtgcggcaaggccttcagatgcggcagccacctgcagaagcacggcagaacccacaccggcgagaagccctacgagtgcagacagtgcggcaaggccttcagatgcaccagcgacctgcagagacacgagaagacccacaccgaggacaagccctacggctgcaagcagtgcggcaagggcttcagatgcgccagccagctgcagatccacgagagaacccacagcggcgagaagccccacgagtgcaaggagtgcggcaaggtgttcaagtacttcagcagcctgagaatccacgagagaacccacaccggcgagaagccccacgagtgcaagcagtgcggcaaggccttcagatacttcagcagcctgcacatccacgagagaacccacaccggcgacaagccctacgagtgcaaggtgtgcggcaaggccttcacctgcagcagcagcatcagataccacgagagaacccacaccggcgagaagccctacgagtgcaagcactgcggcaaggccttcatcagcaactacatcagataccacgagagaacccacaccggcgagaagccctaccagtgcaagcagtgcggcaaggccttcatcgtgcccgtgcacgtggagaacatgaaggagctgatccccctgatcgacgagaagagcttctag

SEQ ID NO: 105807 - DNA, 1599 bp, Artificial Sequence
  Description of Artificial Sequence: Synthetic coding sequence
atgatgttccaggacagcgtggccttcgaggacgtggccgtgagcttcacccaggaggagtgggccctgctggaccccagccagaagaacctgtacagagacgtgatgcaggagaccttcaagaacctgaccagcgtgggcaagacctggaaggtgcagaacatcgaggacgagtacaagaaccccagaagaaacctgagcctgatgagagagaagctgtgcgagagcaaggagagccaccactgcggcgagagcttcaaccagatcgccgacgacatgctgaacagaaagaccctgcccggcatcaccccctgcgagagcagcgtgtgcggcgaggtgggcaccggccacagcagcctgaacacccacatcagagccgacaccggccacaagagcagcgagtaccaggagtacggcgagaacccctacagaaacaaggagtgcaagaaggccttcagctacctggacagcttccagagccacgacaaggcctgcaccaaggagaagccctacgacggcaaggagtgcaccgagaccttcatcagccacagctgcatccagagacacagagtgatgcacagcggcgacggcccctacaagtgcaagttctgcggcaaggccttctacttcctgaacctgtgcctgatccacgagagaatccacaccggcgtgaagccctacaagtgcaagcagtgcggcaaggccttcaccagaagcaccaccctgcccgtgcacgagagaacccacaccggcgtgaacgccgacgagtgcaaggagtgcggcaacgccttcagcttccccagcgagatcagaagacacaagagaagccacaccggcgagaagccctacgagtgcaagcagtgcggcaaggtgttcatcagcttcagcagcatccagtaccacaagatgacccacaccggcgagaagccctacgagtgcaagcagtgcggcaaggccttcagatgcggcagccacctgcagaagcacggcagaacccacaccggcgagaagccctacgagtgcagacagtgcggcaaggccttcagatgcaccagcgacctgcagagacacgagaagacccacaccgaggacaagccctacggctgcaagcagtgcggcaagggcttcagatgcgccagccagctgcagatccacgagagaacccacagcggcgagaagccccacgagtgcaaggagtgcggcaaggtgttcaagtacttcagcagcctgagaatccacgagagaacccacaccggcgagaagccccacgagtgcaagcagtgcggcaaggccttcagatacttcagcagcctgcacatccacgagagaacccacaccggcgacaagccctacgagtgcaaggtgtgcggcaaggccttcacctgcagcagcagcatcagataccacgagagaacccacaccggcgagaagccctacgagtgcaagcactgcggcaaggccttcatcagcaactacatcagataccacgagagaacccacaccggcgagaagccctaccagtgcaagcagtgcggcaaggccttcatcagagccagcagctgcagagagcacgagagaacccacaccatcaacagatag

SEQ ID NO: 105808 - DNA, 1185 bp, Artificial Sequence
  Description of Artificial Sequence: Synthetic coding sequence
atgatggccgccaaggtggtgcccatgccccccaagcccaagcagagcttcatcctgagagtgccccccgacagcaagctgggccaggacctgctgagagacgccaccaacggccccaagaccatccaccagctggtgctggagcacttcctgaccttcctgcccaagcccagcctggtgcagcccagccagaaggtgaaggagaccctggtgatcatgaaggacgtgagcagcagcctgcagaacagagtgcaccccagacccctggtgaagctgctgcccaagggcgtgcagaaggagcaggagaccgtgagcctgtacctgaaggccaaccccgagctggtggtgttcgaggacctgaacgtgttccactgccaggaggagtgcgtgagcctggaccccacccagcagctgaccagcgagaaggaggacgacagcagcgtgggcgagatgatgctgctggccgtgaacggcagcaaccccgagggcgaggaccccgagagagagcccgtggagaacgaggactacagagagaagagcagcgacgacgacgagatggacagcagcctggtgagccagcagccccccgacaaccaggagaaggagagactgaacaccagcatcccccagaagagaaagatgagaaacctgctggtgaccatcgagaacgacacccccctggaggagctgagcaagtacgtggacatcagcatcatcgccctgaccagaaacagaagaaccagaagatggtacacctgccccctgtgcggcaagcagttcaacgagagcagctacctgatcagccaccagagaacccacaccggcgagaagccctacgactgcaaccactgcggcaagagcttcaaccacaagaccaacctgaacaagcacgagagaatccacaccggcgagaagccctacagctgcagccagtgcggcaagaacttcagacagaacagccacagaagcagacacgagggcatccacatcagagagaagatcttcaagtgccccgagtgcggcaagaccttccccaagaacgaggagttcgtgctgcacctgcagagccacgaggccgagagaccctacggctgcaagaagtgcggcagaagattcggcagactgagcaactgcaccagacacgagaagacccacagcgcctgcaagaccagaaagcagaagtag

SEQ ID NO: 105809 - DNA, 1188 bp, Artificial Sequence
  Description of Artificial Sequence: Synthetic coding sequence
atgatggccgccaaggtggtgcccatgccccccaagcccaagcagagcttcatcctgagagtgccccccgacagcaagctgggccaggacctgctgagagacgccaccaacggccccaagaccatccaccagctggtgctggagcacttcctgaccttcctgcccaagcccagcctggtgcagcccagccagaaggtgaaggagaccctggtgatcatgaaggacgtgagcagcagcctgcagaacagagtgcaccccagacccctggtgaagctgctgcccaagggcgtgcagaaggagcaggagaccgtgagcctgtacctgaaggccaaccccgaggagctggtggtgttcgaggacctgaacgtgttccactgccaggaggagtgcgtgagcctggaccccacccagcagctgaccagcgagaaggaggacgacagcagcgtgggcgagatgatgctgctggccgtgaacggcagcaaccccgagggcgaggaccccgagagagagcccgtggagaacgaggactacagagagaagagcagcgacgacgacgagatggacagcagcctggtgagccagcagccccccgacaaccaggagaaggagagactgaacaccagcatcccccagaagagaaagatgagaaacctgctggtgaccatcgagaacgacacccccctggaggagctgagcaagtacgtggacatcagcatcatcgccctgaccagaaacagaagaaccagaagatggtacacctgccccctgtgcggcaagcagttcaacgagagcagctacctgatcagccaccagagaacccacaccggcgagaagccctacgactgcaaccactgcggcaagagcttcaaccacaagaccaacctgaacaagcacgagagaatccacaccggcgagaagccctacagctgcagccagtgcggcaagaacttcagacagaacagccacagaagcagacacgagggcatccacatcagagagaagatcttcaagtgccccgagtgcggcaagaccttccccaagaacgaggagttcgtgctgcacctgcagagccacgaggccgagagaccctacggctgcaagaagtgcggcagaagattcggcagactgagcaactgcaccagacacgagaagacccacagcgcctgcaagaccagaaagcagaagtag

SEQ ID NO: 105810 - DNA, 1185 bp, Artificial Sequence
  Description of Artificial Sequence: Synthetic coding sequence
atgatggccgccaaggtggtgcccatgccccccaagcccaagcagagcttcatcctgagagtgccccccgacagcaagctgggccaggacctgctgagagacgccaccaacggccccaagaccatccaccagctggtgctggagcacttcctgaccttcctgcccaagcccagcctggtgcagcccagccagaaggtgaaggagaccctggtgatcatgaaggacgtgagcagcagcctgcagaacagagtgcaccccagacccctggtgaagctgctgcccaagggcgtgcagaaggagcaggagaccgtgagcctgtacctgaaggccaaccccgaggagctggtggtgttcgaggacctgaacgtgttccactgccaggaggagtgcgtgagcctggaccccacccagcagctgaccagcgagaaggaggacgacagcagcgtgggcgagatgatgctgctggtgaacggcagcaaccccgagggcgaggaccccgagagagagcccgtggagaacgaggactacagagagaagagcagcgacgacgacgagatggacagcagcctggtgagccagcagccccccgacaaccaggagaaggagagactgaacaccagcatcccccagaagagaaagatgagaaacctgctggtgaccatcgagaacgacacccccctggaggagctgagcaagtacgtggacatcagcatcatcgccctgaccagaaacagaagaaccagaagatggtacacctgccccctgtgcggcaagcagttcaacgagagcagctacctgatcagccaccagagaacccacaccggcgagaagccctacgactgcaaccactgcggcaagagcttcaaccacaagaccaacctgaacaagcacgagagaatccacaccggcgagaagccctacagctgcagccagtgcggcaagaacttcagacagaacagccacagaagcagacacgagggcatccacatcagagagaagatcttcaagtgccccgagtgcggcaagaccttccccaagaacgaggagttcgtgctgcacctgcagagccacgaggccgagagaccctacggctgcaagaagtgcggcagaagattcggcagactgagcaactgcaccagacacgagaagacccacagcgcctgcaagaccagaaagcagaagtag

SEQ ID NO: 105811 - DNA, 1185 bp, Artificial Sequence; identical to SEQ ID NO: 105810
  Description of Artificial Sequence: Synthetic coding sequence

SEQ ID NO: 105812 - DNA, 1188 bp, Artificial Sequence; identical to SEQ ID NO: 105809
  Description of Artificial Sequence: Synthetic coding sequence

SEQ ID NO: 105813 - DNA, 1947 bp, Artificial Sequence
  Description of Artificial Sequence: Synthetic coding sequence
atggccaccgccgtggagcccgaggaccaggacctgtgggaggaggagggcatcctgatggtgaagctggaggacgacttcacctgcagacccgagagcgtgctgcagagagacgaccccgtgctggagaccagccaccagaacttcagaagattcagataccaggaggccgccagccccagagaggccctgatcagactgagagagctgtgccaccagtggctgagacccgagagaagaaccaaggagcagatcctggagctgctggtgctggagcagttcctgaccgtgctgcccggcgagctgcagagctgggtgagaggccagagacccgagagcggcgaggaggccgtgaccctggtggagggcctgcagaagcagcccagaagacccagaagatgggtgaccgtgcacgtgcacggccaggaggtgctgagcgaggagaccgtgcacctgggcgtggagcccgagagccccaacgagctgcaggaccccgtgcagagcagcacccccgagcagagccccgaggagaccacccagagccccgacctgggcgcccccgccgagcagagaccccaccaggaggaggagctgcagaccctgcaggagagcgaggtgcccgtgcccgaggaccccgacctgcccgccgagagaagcagcggcgacagcgagatggtggccctgctgaccgccctgagccagggcctggtgaccttcaaggacgtggccgtgtgcttcagccaggaccagtggagcgacctggaccccacccagaaggagttctacggcgagtacgtgctggaggaggactgcggcatcgtggtgagcctgagcttccccatccccagacccgacgagatcagccaggtgagagaggaggagccctgggtgcccgacatccaggagccccaggagacccaggagcccgagatcctgagcttcacctacaccggcgacagaagcaaggacgaggaggagtgcctggagcaggaggacctgagcctggaggacatccacagacccgtgctgggcgagcccgagatccaccagacccccgactgggagatcgtgttcgaggacaaccccggcagactgaacgagagaagattcggcaccaacatcagccaggtgaacagcttcgtgaacctgagagagaccacccccgtgcaccccctgctgggcagacaccacgactgcagcgtgtgcggcaagagcttcacctgcaacagccacctggtgagacacctgagaacccacaccggcgagaagccctacaagtgcatggagtgcggcaagagctacaccagaagcagccacctggccagacaccagaaggtgcacaagatgaacgccccctacaagtaccccctgaacagaaagaacctggaggagaccagccccgtgacccaggccgagagaacccccagcgtggagaagccctacagatgcgacgactgcggcaagcacttcagatggaccagcgacctggtgagacaccagagaacccacaccggcgagaagcccttcttctgcaccatctgcggcaagagcttcagccagaagagcgtgctgaccacccaccagagaatccacctgggcggcaagccctacctgtgcggcgagtgcggcgaggacttcagcgagcacagaagatacctggcccacagaaagacccacgccgccgaggagctgtacctgtgcagcgagtgcggcagatgcttcacccacagcgccgccttcgccaagcacctgagaggccacgccagcgtgagaccctgcagatgcaacgagtgcggcaagagcttcagcagaagagaccacctggtgagacaccagagaacccacaccggcgagaagcccttcacctgccccacctgcggcaagagcttcagcagaggctaccacctgatcagacaccagagaacccacagcgagaagaccagctag

SEQ ID NO: 105814 - DNA, 1947 bp, Artificial Sequence; identical to SEQ ID NO: 105813
  Description of Artificial Sequence: Synthetic coding sequence

SEQ ID NO: 105815 - DNA, 1947 bp, Artificial Sequence; identical to SEQ ID NO: 105813
  Description of Artificial Sequence: Synthetic coding sequence

SEQ ID NO: 105816 - DNA, 399 bp, Artificial Sequence
  Description of Artificial Sequence: Synthetic coding sequence
atgaccgccgccgccagcctgctggccagcctgctgcccgccctgccccccctgaacctgcaggacgccaagttcgtggaggagagaagaaagcagctgcagaactacctgagaagcgtgatgaacaaggtgatccagatggtgcccgagttcgccgccagccccaagaaggagaccctgatccagctgatgcccttcttcgtgatgggcctgcaggtgggcatgtacggcctgttccacttcggcgtgatgatggaccagccccagcccagcctgaccagagccgacgagagcccctgcgacagagtgctgagcccctgcgccgcccacagaaagcagagagactgctgcctgagctggaaggccgagcccgagagattcctggtgaagaagaagtag

SEQ ID NO: 105817 - DNA, 1665 bp, Artificial Sequence; identical to SEQ ID NO: 92025
  Description of Artificial Sequence: Synthetic coding sequence

SEQ ID NO: 105818 - DNA, 840 bp, Artificial Sequence
  Description of Artificial Sequence: Synthetic coding sequence
atgagcgccgacggcggcggcatccaggacacccaggacaaggagaccccccccgaggtgcccgacagaggccacccccaccaggagatgcccagcaagctgggcgaggccgtgcccagcggcgacacccaggagagcctgcacatcaagatggagcccgaggagccccacagcgagggcgccagccaggaggacggcgcccagggcgcctggggctgggcccccctgagccacggcagcaaggagaaggccctgttcctgcccggcggcgccctgcccagccccagaatccccgtgctgagcagagagggcagaaccagagacagacagatggccgccgccctgctgaccgcctggagccagatgcccgtgaccttcgaggacgtggccctgtacctgagcagagaggagtggggcagactggaccacacccagcagaacttctacagagacgtgctgcagaagaagaacggcctgagcctgggcttccccttcagcagacccttctgggccccccaggcccacggcaagggcgaggccagcggcagcagcagacaggccggcgacgagaaggagtggagaggcgcctgcaccggcgccgtggaggtgggccagagagtgcagaccagcagcgtggccgccctgggcaacgtgaagcccttcagaaccagagccggcagagtgcagtggggcgtgccccagtgcgcccaggaggccgcctgcggcagaagcagcggccccgccaaggacagcggccagcccgccgagcccgacagaacccccgacgccgccccccccgaccccagccccaccgagccccaggagtacagagtgccctag

SEQ ID NO: 105819 - DNA, 357 bp, Artificial Sequence
  Description of Artificial Sequence: Synthetic coding sequence
atgagcgccgacggcggcggcatccaggacacccaggacaaggagaccccccccgaggtgcccgacagaggccacccccaccaggagatgcccagcaagctgggcgaggccgtgcccagcggcgacacccaggagagcctgcacatcaagatggagcccgaggagccccacagcgagggcgccagccaggaggacggcgcccagggcgcctggggctgggcccccctgagccacggcagcaaggagaaggccctgttcctgcccggcggcgccctgcccagccccagaatccccgtgctgagcagagagggcagaaccagagacagacagatggccgccgccctgctgaccgcctag

SEQ ID NO: 105820 - DNA, 1392 bp, Artificial Sequence
  Description of Artificial Sequence: Synthetic coding sequence
atgggcagaaagaagaagaagcagctgaagccctggtgctggtactgcaacagagacttcgacgacgagaagatcctgatccagcaccagaaggccaagcacttcaagtgccacatctgccacaagaagctgtacaccggccccggcctggccatccactgcatgcaggtgcacaaggagaccatcgacgccgtgcccaacgccatccccggcagaaccgacatcgagctggagatctacggcatggagggcatccccgagaaggacatggacgagagaagaagactgctggagcagaagacccaggagagccagaagaagaagcagcaggacgacagcgacgagtacgacgacgacgacagcgccgccagcaccagcttccagccccagcccgtgcagccccagcagggctacatcccccccatggcccagcccggcctgccccccgtgcccggcgcccccggcatgccccccggcatcccccccctgatgcccggcgtgccccccctgatgcccggcatgccccccgtgatgcccggcatgccccccggcctgcaccaccagagaaagtacacccagagcttctgcggcgagaacatcatgatgcccatgggcggcatgatgccccccggccccggcatcccccccctgatgcccggcatgccccccggcatgcccccccccgtgcccagacccggcatcccccccatgacccaggcccaggccgtgagcgcccccggcatcctgaacagaccccccgcccccaccgccaccgtgcccgccccccagccccccgtgaccaagcccctgttccccagcgccggccaggcccaggccgccgtgcagggccccgtgggcaccgacttcaagcccctgaacagcacccccgccaccaccaccgagccccccaagcccaccttccccgcctacacccagagcaccgccagcaccaccagcaccaccaacagcaccgccgccaagcccgccgccagcatcaccagcaagcccgccaccctgaccaccaccagcgccaccagcaagctgatccaccccgacgaggacatcagcctggaggagagaagagcccagctgcccaagtaccagagaaacctgcccagacccggccaggcccccatcggcaacccccccgtgggccccatcggcggcatgatgcccccccagcccggcatcccccagcagcagggcatgagaccccccatgcccccccacggccagtacggcggccaccaccagggcatgcccggctacctgcccggcgccatgcccccctacggccagggcccccccatggtgcccccctaccagggcggcccccccagaccccccatgggcatgagaccccccgtgatgagccagggcggcagatactag

SEQ ID NO: 105821 - DNA, 1188 bp, Artificial Sequence
  Description of Artificial Sequence: Synthetic coding sequence
atgggcagaaagaagaagaagcagctgaagccctggtgctggtactgcaacagagacttcgacgacgagaagatcctgatccagcaccagaaggccaagcacttcaagtgccacatctgccacaagaagctgtacaccggcctgccccccgtgcccggcgcccccggcatgccccccggcatcccccccctgatgcccggcgtgccccccctgatgcccggcatgccccccgtgatgcccggcatgccccccggcctgcaccaccagagaaagtacacccagagcttctgcggcgagaacatcatgatgcccatgggcggcatgatgccccccggccccggcatcccccccctgatgcccggcatgccccccggcatgcccccccccgtgcccagacccggcatcccccccatgacccaggcccaggccgtgagcgcccccggcatcctgaacagaccccccgcccccaccgccaccgtgcccgccccccagccccccgtgaccaagcccctgttccccagcgccggccagatgggcacccccgtgaccagcagcagcaccgccagcagcaacagcgagagcctgagcgccagcagcaaggccctgttccccagcaccgcccaggcccaggccgccgtgcagggccccgtgggcaccgacttcaagcccctgaacagcacccccgccaccaccaccgagccccccaagcccaccttccccgcctacacccagagcaccgccagcaccaccagcaccaccaacagcaccgccgccaagcccgccgccagcatcaccagcaagcccgccaccctgaccaccaccagcgccaccagcaagctgatccaccccgacgaggacatcagcctggaggagagaagagcccagctgcccaagtaccagagaaacctgcccagacccggccaggcccccatcggcaacccccccgtgggccccatcggcggcatgatgcccccccagcccggcatcccccagcagcagggcatgagaccccccatgcccccccacggccagtacggcggccaccaccagggcatgcccggctacctgcccggcgccatgcccccctacggccagggcccccccatggtgcccccctaccagggcggcccccccagaccccccatgggcatgagaccccccgtgatgagccagggcggcagatactag

SEQ ID NO: 105822 - DNA, 1437 bp, Artificial Sequence
  Description of Artificial Sequence: Synthetic coding sequence
atgggcagaaagaagaagaagcagctgaagccctggtgctggtactgcaacagagacttcgacgacgagaagatcctgatccagcaccagaaggccaagcacttcaagtgccacatctgccacaagaagctgtacaccggccccggcctggccatccactgcatgcaggtgcacaaggagaccatcgacgccgtgcccaacgccatccccggcagaaccgacatcgagctggagatctacggcatggagggcatccccgagaaggacatggacgagagaagaagactgctggagcagaagacccaggagagccagaagaagaagcagcaggacgacagcgacgagtacgacgacgacgacagcgccgccagcaccagcttccagccccagcccgtgcagccccagcagggctacatcccccccatggcccagcccggcctgccccccgtgcccggcgcccccggcatgccccccggcatcccccccctgatgcccggcgtgccccccctgatgcccggcatgccccccgtgatgcccggcatgccccccggcatgatgcccatgggcggcatgatgccccccggccccggcatcccccccctgatgcccggcatgccccccggcatgcccccccccgtgcccagacccggcatcccccccatgacccaggcccaggccgtgagcgcccccggcatcctgaacagaccccccgcccccaccgccaccgtgcccgccccccagccccccgtgaccaagcccctgttccccagcgccggccagatgggcacccccgtgaccagcagcagcaccgccagcagcaacagcgagagcctgagcgccagcagcaaggccctgttccccagcaccgcccaggcccaggccgccgtgcagggccccgtgggcaccgacttcaagcccctgaacagcacccccgccaccaccaccgagccccccaagcccaccttccccgcctacacccagagcaccgccagcaccaccagcaccaccaacagcaccgccgccaagcccgccgccagcatcaccagcaagcccgccaccctgaccaccaccagcgccaccagcaagctgatccaccccgacgaggacatcagcctggaggagagaagagcccagctgcccaagtaccagagaaacctgcccagacccggccaggcccccatcggcaacccccccgtgggccccatcggcggcatgatgcccccccagcccggcatcccccagcagcagggcatgagaccccccatgcccccccacggccagtacggcggccaccaccagggcatgcccggctacctgcccggcgccatgcccccctacggccagggcccccccatggtgcccccctaccagggcggcccccccagaccccccatgggcatgagaccccccgtgatgagccagggcggcagatactag

SEQ ID NO: 105823 - DNA, 1485 bp, Artificial Sequence
  Description of Artificial Sequence: Synthetic coding sequence
atgggcagaaagaagaagaagcagctgaagccctggtgctggtactgcaacagagacttcgacgacgagaagatcctgatccagcaccagaaggccaagcacttcaagtgccacatctgccacaagaagctgtacaccggccccggcctggccatccactgcatgcaggtgcacaaggagaccatcgacgccgtgcccaacgccatccccggcagaaccgacatcgagctggagatctacggcatggagggcatccccgagaaggacatggacgagagaagaagactgctggagcagaagacccaggagagccagaagaagaagcagcaggacgacagcgacgagtacgacgacgacgacagcgccgccagcaccagcttccagccccagcccgtgcagccccagcagggctacatcccccccatggcccagcccggcctgccccccgtgcccggcgcccccggcatgccccccggcatcccccccctgatgcccggcgtgccccccctgatgcccggcatgccccccgtgatgcccggcatgccccccggcctgcaccaccagagaaagtacacccagagcttctgcggcgagaacatcatgatgcccatgggcggcatgatgccccccggccccggcatcccccccctgatgcccggcatgccccccggcatgcccccccccgtgcccagacccggcatcccccccatgacccaggcccaggccgtgagcgcccccggcatcctgaacagaccccccgcccccaccgccaccgtgcccgccccccagccccccgtgaccaagcccctgttccccagcgccggccagatgggcacccccgtgaccagcagcagcaccgccagcagcaacagcgagagcctgagcgccagcagcaaggccctgttccccagcaccgcccaggcccaggccgccgtgcagggccccgtgggcaccgacttcaagcccctgaacagcacccccgccaccaccaccgagccccccaagcccaccttccccgcctacacccagagcaccgccagcaccaccagcaccaccaacagcaccgccgccaagcccgccgccagcatcaccagcaagcccgccaccctgaccaccaccagcgccaccagcaagctgatccaccccgacgaggacatcagcctggaggagagaagagcccagctgcccaagtaccagagaaacctgcccagacccggccaggcccccatcggcaacccccccgtgggccccatcggcggcatgatgcccccccagcccggcatcccccagcagcagggcatgagaccccccatgcccccccacggccagtacggcggccaccaccagggcatgcccggctacctgcccggcgccatgcccccctacggccagggcccccccatggtgcccccctaccagggcggcccccccagaccccccatgggcatgagaccccccgtgatgagccagggcggcagatactag

SEQ ID NO: 105824 - DNA, 1344 bp, Artificial Sequence
  Description of Artificial Sequence: Synthetic coding sequence
atgggcagaaagaagaagaagcagctgaagccctggtgctggtactgcaacagagacttcgacgacgagaagatcctgatccagcaccagaaggccaagcacttcaagtgccacatctgccacaagaagctgtacaccggccccggcctggccatccactgcatgcaggtgcacaaggagaccatcgacgccgtgcccaacgccatccccggcagaaccgacatcgagctggagatctacggcatggagggcatccccgagaaggacatggacgagagaagaagactgctggagcagaagacccaggagagccagaagaagaagcagcaggacgacagcgacgagtacgacgacgacgacagcgccgccagcaccagcttccagccccagcccgtgcagccccagcagggctacatcccccccatggcccagcccggcctgccccccgtgcccggcgcccccggcatgccccccggcatcccccccctgatgcccggcgtgccccccctgatgcccggcatgccccccgtgatgcccggcatgccccccggcatgatgcccatgggcggcatgatgccccccggccccggcatcccccccctgatgcccggcatgccccccggcatgcccccccccgtgcccagacccggcatcccccccatgacccaggcccaggccgtgagcgcccccggcatcctgaacagaccccccgcccccaccgccaccgtgcccgccccccagccccccgtgaccaagcccctgttccccagcgccggccaggcccaggccgccgtgcagggccccgtgggcaccgacttcaagcccctgaacagcacccccgccaccaccaccgagccccccaagcccaccttccccgcctacacccagagcaccgccagcaccaccagcaccaccaacagcaccgccgccaagcccgccgccagcatcaccagcaagcccgccaccctgaccaccaccagcgccaccagcaagctgatccaccccgacgaggacatcagcctggaggagagaagagcccagctgcccaagtaccagagaaacctgcccagacccggccaggcccccatcggcaacccccccgtgggccccatcggcggcatgatgcccccccagcccggcatcccccagcagcagggcatgagaccccccatgcccccccacggccagtacggcggccaccaccagggcatgcccggctacctgcccggcgccatgcccccctacggccagggcccccccatggtgcccccctaccagggcggcccccccagaccccccatgggcatgagaccccccgtgatgagccagggcggcagatactag

SEQ ID NO: 105825 - DNA, 1491 bp, Artificial Sequence
  Description of Artificial Sequence: Synthetic coding sequence
aacaccgtgatgggcagaaagaagaagaagcagctgaagccctggtgctggtactgcaacagagacttcgacgacgagaagatcctgatccagcaccagaaggccaagcacttcaagtgccacatctgccacaagaagctgtacaccggccccggcctggccatccactgcatgcaggtgcacaaggagaccatcgacgccgtgcccaacgccatccccggcagaaccgacatcgagctggagatctacggcatggagggcatccccgagaaggacatggacgagagaagaagactgctggagcagaagacccaggagagccagaagaagaagcagcaggacgacagcgacgagtacgacgacgacgacagcgccgccagcaccagcttccagccccagcccgtgcagccccagcagggctacatcccccccatggcccagcccggcctgccccccgtgcccggcgcccccggcatgccccccggcatcccccccctgatgcccggcgtgccccccctgatgcccggcatgccccccgtgatgcccggcatgccccccggcctgcaccaccagagaaagtacacccagagcttctgcggcgagaacatcatgatgcccatgggcggcatgatgccccccggccccggcatcccccccctgatgcccggcatgccccccggcatgcccccccccgtgcccagacccggcatcccccccatgacccaggcccaggccgtgagcgcccccggcatcctgaacagaccccccgcccccaccgccaccgtgcccgccccccagccccccgtgaccaagcccctgttccccagcgccggccagatgggcacccccgtgaccagcagcagcaccgccagcagcaacagcgagagcctgagcgccagcagcaaggccctgttccccagcaccgcccaggcccaggccgccgtgcagggccccgtgggcaccgacttcaagcccctgaacagcacccccgccaccaccaccgagccccccaagcccaccttccccgcctacacccagagcaccgccagcaccaccagcaccaccaacagcaccgccgccaagcccgccgccagcatcaccagcaagcccgccaccctgaccaccaccagcgccaccagcaagctgatccaccccgacgaggacatcagcctggaggagagaagagcccagctgcccaagtaccagagaaacctgcccagacccggccaggcccccatcggcaacccccccgtgggccccatcggcggcatgatgcccccccagcccggcatcccccagcagcagggcatgagaccccccatgcccccccacggccagtacggcggccaccaccagggcatgcccggctacctgcccggcgccatgcccccctacggccagggcccccccatggtgcccccctaccagggcggcccccccagaccccccatgggcatgagaccccccgtgatgagccagggcctgccctag

SEQ ID NO: 105826 - DNA, 3843 bp, Artificial Sequence
  Description of Artificial Sequence: Synthetic coding sequence
atgggcagcctgaccttcagagacgtggccatcgagttcagcctggaggagtggcagtgcctggacaccgcccagcagaacctgtacagaaacgtgatgctggagaactacagaaacctggtgttcctgggcatcgccgccttcaagcccgacctgatcatcttcctggaggagggcaaggagagctggaacatgaagagacacgagatggtggaggagagccccgtgatctgcagccacttcgcccaggacctgtggcccgagcagggcatcgaggacagcttccagaaggtgatcctgagaagatacgagaagtgcggccacgagaacctgcacctgaagatcggctacaccaacgtggacgagtgcaaggtgcacaaggagggctacaacaagctgaaccagagcctgaccaccacccagagcaaggtgttccagagaggcaagtacgccaacgtgttccacaagtgcagcaacagcaacagacacaagatcagacacaccggcaagaagcacctgcagtgcaaggagtacgtgagaagcttctgcatgctgagccacctgagccagcacaagagaatctacaccagagagaacagctacaagtgcgaggagggcggcaaggccttcaactggagcagcaccctgacctactacaagagcgcccacaccggcgagaagccctacagatgcaaggagtgcggcaaggccttcagcaagttcagcatcctgaccaagcacaaggtgatccacaccggcgagaagagctacaagtgcgaggagtgcggcaaggccttcaaccagagcgccatcctgaccaagcacaagatcatccacaccggcgagaagcccaacaagtgcgaggagtgcggcaaggccttcagcaaggtgagcaccctgaccacccacaaggccatccacgccggcgagaagccctacaagtgcaaggagtgcggcaaggccttcagcaaggtgagcaccctgatcacccacaaggccatccacgccggcgagaagccctacaagtgcaaggagtgcggcaaggccttcagcaagttcagcatcctgaccaagcacaaggtgatccacaccggcgagaagccctacaagtgcgaggagtgcggcaaggcctacaagtggcccagcaccctgagctaccacaagaagatccacaccggcgagaagccctacaagtgcgaggagtgcggcaagggcttcagcatgttcagcatcctgaccaagcacgaggtgatccacaccggcgagaagccctacaagtgcgaggagtgcggcaaggccttcaactggagcagcaacctgatggagcacaagaagatccacaccggcgagaccccctacaagtgcgaggagtgcggcaagggcttcagcatgttcagcatcctgaccaagcacaaggtgatccacaacggcgagaagccctacaagtgcgaggagtgcgacaaggccacccacgccggcgagaagccctacaagtgcgaggagtgcggcaaggccttcaactggagcagcaacctgatggagcacaagagaatccacaccggcgagaagccctacaagtgcgaggagtgcggcaagagcttcagcaccttcagcatcctgaccaagcacaaggtgatccacaccggcgagaagccctacaagtgcgaggagtgcggcaaggcctacaagtggagcagcaccctgagctaccacaagaagatccacaccgtggagaagccctacaagtgcgaggagtgcggcaaggccttcaaccagagcgccatcctgatcaagcacaagagaatccacaccggcgagaagccctacaagtgcgaggagtgcggcaagaccttcagcaaggtgagcaccctgaccacccacaaggccatccacgccggcgagaagccctacaagtgcaaggagtgcggcaagaccttcatcaaggtgagcaccctgaccacccacaaggccatccacgccggcgagaagccctacaagtgcaaggagtgcggcaaggccttcagcaagttcagcatcctgaccaagcacaaggtgatccacaccggcgagaagccctacaagtgcgaggagtgcggcaaggccttcaactggagcagcaacctgatggagcacaagagaatccacaccggcgagaagccctacaagtgcgaggagtgcggcaagagcttcagcaccttcagcgtgctgaccaagcacaaggtgatccacaccggcgagaagccctacaagtgcgaggagtgcggcaaggcctacaagtggagcagcaccctgagctaccacaagaagatccacaccgtggagaagccctacaagtgcgaggagtgcggcaaggccttcaacagaagcgccatcctgatcaagcacaagagaatccacaccgacgagaagccctacaagtgcgaggagtgcggcaagaccttcagcaaggtgagcaccctgaccacccacaaggccatccacgccggcgagaagccctacaagtgcaaggagtgcggcaaggccttcagcaagttcagcatcctgaccaagcacaaggtgatccacaccggcgagaagccctacaagtgcgaggagtgcggcaaggcctacaagtggcccagcaccctgagctaccacaagaagatccacaccggcgagaagccctacaagtgcgaggagtgcggcaagggcttcagcatgttcagcatcctgaccaagcacgaggtgatccacaccggcgagaagccctacaagtgcgaggagtgcggcaaggccttcagctggctgagcgtgttcagcaagcacaagaagacccacgccggcgagaagttctacaagtgcgaggcctgcggcaaggcctacaagagcagcagcaccctgagctaccacaagaagatccacaccgaggagaagccctacaagtacgaggagtgcggcaagggcttcagcaccttcagcatcctgaccaagcacaaggtgatccacaccggcgagaagccctacaagtgcgaggagtgcggcaaggccttcaactggagcagcaacctgatggagcacaagaagatccacaccggcgagaccccctacaagtgcgaggagtgcgacaaggccttcagctggcccagcagcctgaccgagcacaaggccacccacgccggcgagaagccctacaagtgcgaggagtgcggcaaggccttcagctggcccagcagactgaccgagcacaaggccacccacgccggcgaggagccctacaagtgcgaggagtgcggcaaggccttcaactggagcagcaacctgatggagcacaagagaatccacaccggcgagaagccctacaagtgcgaggagtgcggcaagagcttcagcaccttcagcatcctgaccaagcacaaggtgatccacaccggcgagaagccctacaagtgcgaggagtgcggcaaggcctacaagtggagcagcaccctgagctaccacaagaagatccacaccgtggagaagccctacaagtgcgaggagtgcggcaagggcttcgtgatgttcagcatcctggccaagcacaaggtgatccacaccggcgagaagctgtacaagtgcgaggagtgcggcaaggcctacaagtggcccagcaccctgagataccacaagaagatccacaccggcgagaagccctacaagtgcgaggagtgcggcaaggccttcagcaccttcagcatcctgaccaagcacaaggtgatccacaccggcgagaagccctacaagtgcgaggagtgcggcaaggccttcagctggctgagcgtgttcagcaagcacaagaagatccacaccggcgagaagctgtag

SEQ ID NO: 105827 - DNA, 123 bp, Artificial Sequence
  Description of Artificial Sequence: Synthetic coding sequence
ggcaagggcttcagcatgttcagcatcctgaccaagcacaaggccacccacgccggcgagaagccctacaagtgcgaggagtgcggcaaggccttcaactggagcagcaacctgatggagtag

SEQ ID NO: 105828 - DNA, 3504 bp, Artificial Sequence
  Description of Artificial Sequence: Synthetic coding sequence
atgggcagcctgaccttcagagacgtggccatcgagttcagcctggaggagtggcagtgcctggacaccgcccagcagaacctgtacagaaacgtgatgctggagaactacagaaacctggtgttcctgggcatcgccgccttcaagcccgacctgatcatcttcctggaggagggcaaggagagctggaacatgaagagacacgagatggtggaggagagccccgtgatctgcagccacttcgcccaggacctgtggcccgagcagggcatcgaggacagcttccagaaggtgatcctgagaagatacgagaagtgcggccacgagaacctgcacctgaagatcggctacaccaacgtggacgagtgcaaggtgcacaaggagggctacaacaagctgaaccagagcctgaccaccacccagagcaaggtgttccagagaggcaagtacgccaacgtgttccacaagtgcagcaacagcaacagacacaagatcagacacaccggcaagaagcacctgcagtgcaaggagtacgtgagaagcttctgcatgctgagccacctgagccagcacaagagaatctacaccagagagaacagctacaagtgcgaggagggcggcaaggccttcaactggagcagcaccctgacctactacaagagcgcccacaccggcgagaagccctacagatgcaaggagtgcggcaaggccttcagcaagttcagcatcctgaccaagcacaaggtgatccacaccggcgagaagagctacaagtgcgaggagtgcggcaaggccttcaaccagagcgccatcctgaccaagcacaagatcatccacaccggcgagaagcccaacaagtgcgaggagtgcggcaaggccttcagcaaggtgagcaccctgaccacccacaaggccatccacgccggcgagaagccctacaagtgcaaggagtgcggcaaggccttcagcaaggtgagcaccctgatcacccacaaggccatccacgccggcgagaagccctacaagtgcaaggagtgcggcaaggccttcagcaagttcagcatcctgaccaagcacaaggtgatccacaccggcgagaagccctacaagtgcgaggagtgcggcaaggcctacaagtggcccagcaccctgagctaccacaagaagatccacaccggcgagaagccctacaagtgcgaggagtgcggcaagggcttcagcatgttcagcatcctgaccaagcacgaggtgatccacaccggcgagaagccctacaagtgcgaggagtgcggcaaggccttcaactggagcagcaacctgatggagcacaagaagatccacaccggcgagaccccctacaagtgcgaggagtgcggcaagggcttcaagtggagcagcaccctgagctaccacaagaagatccacaccgtggagaagccctacaagtgcgaggagtgcggcaaggccttcaaccagagcgccatcctgatcaagcacaagagaatccacaccggcgagaagccctacaagtgcgaggagtgcggcaagaccttcagcaaggtgagcaccctgaccacccacaaggccatccacgccggcgagaagccctacaagtgcaaggagtgcggcaagaccttcatcaaggtgagcaccctgaccacccacaaggccatccacgccggcgagaagccctacaagtgcaaggagtgcggcaaggccttcagcaagttcagcatcctgaccaagcacaaggtgatccacaccggcgagaagccctacaagtgcgaggagtgcggcaaggccttcaactggagcagcaacctgatggagcacaagagaatccacaccggcgagaagccctacaagtgcgaggagtgcggcaagagcttcagcaccttcagcgtgctgaccaagcacaaggtgatccacaccggcgagaagccctacaagtgcgaggagtgcggcaaggcctacaagtggagcagcaccctgagctaccacaagaagatccacaccgtggagaagccctacaagtgcgaggagtgcggcaaggccttcaacagaagcgccatcctgatcaagcacaagagaatccacaccgacgagaagccctacaagtgcgaggagtgcggcaagaccttcagcaaggtgagcaccctgaccacccacaaggccatccacgccggcgagaagccctacaagtgcaaggagtgcggcaaggccttcagcaagttcagcatcctgaccaagcacaaggtgatccacaccggcgagaagccctacaagtgcgaggagtgcggcaaggcctacaagtggcccagcaccctgagctaccacaagaagatccacaccggcgagaagccctacaagtgcgaggagtgcggcaagggcttcagcatgttcagcatcctgaccaagcacgaggtgatccacaccggcgagaagccctacaagtgcgaggagtgcggcaaggccttcagctggctgagcgtgttcagcaagcacaagaagacccacgccggcgagaagttctacaagtgcgaggcctgcggcaaggcctacaacaccttcagcatcctgaccaagcacaaggtgatccacaccggcgagaagccctacaagtgcgaggagtgcggcaaggccttcaactggagcagcaacctgatggagcacaagaagatccacaccggcgagaccccctacaagtgcgaggagtgcgacaaggccttcagctggcccagcagcctgaccgagcacaaggccacccacgccggcgagaagccctacaagtgcgaggagtgcggcaaggccttcagctggcccagcagactgaccgagcacaaggccacccacgccggcgaggagccctacaagtgcgaggagtgcggcaaggccttcaactggagcagcaacctgatggagcacaagagaatccacaccggcgagaagccctacaagtgcgaggagtgcggcaagagcttcagcaccttcagcatcctgaccaagcacaaggtgatccacaccggcgagaagccctacaagtgcgaggagtgcggcaaggcctacaagtggagcagcaccctgagctaccacaagaagatccacaccgtggagaagccctacaagtgcgaggagtgcggcaagggcttcgtgatgttcagcatcctggccaagcacaaggtgatccacaccggcgagaagctgtacaagtgcgaggagtgcggcaaggcctacaagtggcccagcaccctgagataccacaagaagatccacaccggcgagaagccctacaagtgcgaggagtgcggcaaggccttcagcaccttcagcatcctgaccaagcacaaggtgatccacaccggcgagaagccctacaagtgcgaggagtgcggcaaggccttcagctggctgagcgtgttcagcaagcacaagaagatccacaccggcgtgcccaacccccccacccacaagaagatccacgccggcgagaagctgtacaagtag

SEQ ID NO: 105829 - DNA, 1488 bp, Artificial Sequence
  Description of Artificial Sequence: Synthetic coding sequence
atggccgagagcgcccccgccagacacagaagaaagagaagaagcacccccctgaccagcagcaccctgcccagccaggccaccgagaagagcagctacttccagaccaccgagatcagcctgtggaccgtggtggccgccatccaggccgtggagaagaagatggagagccaggccgccagactgcagagcctggagggcagaaccggcaccgccgagaagaagctggccgactgcgagaagatggccgtggagttcggcaaccagctggagggcaagtgggccgtgctgggcaccctgctgcaggagtacggcctgctgcagagaagactggagaacgtggagaacctgctgagaaacagaaacttctggatcctgagactgccccccggcagcaagggcgaggcccccaaggtgagcagaagcctggagaacgacggcgtgtgcttcaccgagcaggagtgggagaacctggaggactggcagaaggagctgtacagaaacgtgatggagagcaactacgagaccctggtgagcctgaaggtgctgggccagaccgagggcgaggccgagctgggcaccgagatgctgggcgacctggaggaggagggccccggcggcgcccaccccgccggcggcgtgatgatcaagcaggagctgcagtacacccaggagggccccgccgacctgcccggcgagttcagctgcatcgccgaggagcaggccttcctgagccccgagcagaccgagctgtggggcggccagggcagcagcgtgctgctggagaccggccccggcgacagcaccctggaggagcccgtgggcagcagagtgcccagcagcagcagaaccgtgggctgccccaagcagaagagccacagacaggtgcagctggaccaggagtgcggccagggcctgaagctgaagaaggacaccagcagaccctacgagtgcagcgagtgcgagatcaccttcagatacaagcagcagctggccacccacctgagaagccacagcggctggggcagctgcacccccgaggagcccgaggagagcctgagacccagacccagactgaagccccagaccaagaaggccaagctgcaccagtgcgacgtgtgcctgagaagcttcagctgcaaggtgagcctggtgacccaccagagatgccacctgcaggagggccccagcgccggccagcacgtgcaggagagattcagccccaacagcctggtggccctgcccggccacatcccctggagaaagagcagaagcagcctgatctgcggctactgcggcaagagcttcagccaccccagcgacctggtgagacaccagagaatccacaccggcgagagaccctacagctgcaccgagtgcgagaagagcttcgtgcagaagcagcacctgctgcagcaccagaagatccaccagagagagagaggcggcctggccctggagcccggcagacccaacggcctgctgtag

SEQ ID NO: 105830 - DNA, 1380 bp, Artificial Sequence
  Description of Artificial Sequence: Synthetic coding sequence
atggccgcccccctggaggcccaggaccaggcccccggcgagggcgagggcctgctgatcgtgaaggtggaggacagcagctgggagcaggagagcgcccagcacgaggacggcagagacagcgaggcctgcagacagagattcagacagttctgctacggcgacgtgcacggcccccacgaggccttcagccagctgtgggagctgtgctgcagatggctgagacccgagctgagaaccaaggagcagatcctggagctgctggtgctggagcagttcctgaccgtgctgcccggcgagatccagggctgggtgagagagcagcaccccggcagcggcgaggaggccgtggccctggtggaggacctgcagaagcagcccgtgaaggcctggagacaggacgtgcccagcgaggaggccgagcccgaggccgccggcagaggcagccaggccaccggccccccccccaccgtgggcgccagaagaagacccagcgtgccccaggagcagcacagccacagcgcccagccccccgccctgctgaaggagggcagacccggcgagaccaccgacacctgcttcgtgagcggcgtgcacggccccgtggccctgggcgacatccccttctacttcagcagagaggagtggggcaccctggaccccgcccagagagacctgttctgggacatcaagagagagaacagcagaaacaccaccctgggcttcggcctgaagggccagagcgagaagagcctgctgcaggagatggtgcccgtggtgcccggccagaccggcagcgacgtgaccgtgagctggagccccgaggaggccgaggcctgggagagcgagaacagacccagagccgccctgggccccgtggtgggcgccagaagaggcagaccccccaccagaagaagacagttcagagacctggccgccgagaagccccacagctgcggccagtgcggcaagagattcagatggggcagcgacctggccagacaccagagaacccacaccggcgagaagccccacaagtgccccgagtgcgacaagagcttcagaagcagcagcgacctggtgagacaccagggcgtgcacaccggcgagaagcccttcagctgcagcgagtgcggcaagagcttcagcagaagcgcctacctggccgaccaccagagaatccacaccggcgagaagcccttcggctgcagcgactgcggcaagagcttcagcctgagaagctacctgctggaccacagaagagtgcacaccggcgagagacccttcggctgcggcgagtgcgacaagagcttcaagcagagagcccacctgatcgcccaccagagcctgcacgccaagatggcccagcccgtgggctag

SEQ ID NO: 105831 - DNA, 906 bp, Artificial Sequence
  Description of Artificial Sequence: Synthetic coding sequence
atgtgccccagaagaagaagaaaccccagactgcaggccggcgaccccagacccagaggcctgcccagaagatggggccacggcggcggcagactgttccccagaagcagcaccgccatcgccggccccgtggccctgggcgacatccccttctacttcagcagagaggagtggggcaccctggaccccgcccagagagacctgttctgggacatcaagagagagaacagcagaaacaccaccctgggcttcggcctgaagggccagagcgagaagagcctgctgcaggagatggtgcccgtggtgcccggccagaccggcagcgacgtgaccgtgagctggagccccgaggaggccgaggcctgggagagcgagaacagacccagagccgccctgggccccgtggtgggcgccagaagaggcagaccccccaccagaagaagacagttcagagacctggccgccgagaagccccacagctgcggccagtgcggcaagagattcagatggggcagcgacctggccagacaccagagaacccacaccggcgagaagccccacaagtgccccgagtgcgacaagagcttcagaagcagcagcgacctggtgagacaccagggcgtgcacaccggcgagaagcccttcagctgcagcgagtgcggcaagagcttcagcagaagcgcctacctggccgaccaccagagaatccacaccggcgagaagcccttcggctgcagcgactgcggcaagagcttcagcctgagaagctacctgctggaccacagaagagtgcacaccggcgagagacccttcggctgcggcgagtgcgacaagagcttcaagcagagagcccacctgatcgcccaccagagcctgcacgccaagatggcccagcccgtgggctag

SEQ ID NO: 105832 - DNA, 1821 bp, Artificial Sequence
  Description of Artificial Sequence: Synthetic coding sequence
atggccgtgaccttcgaggacgtgaccatcatcttcacctgggaggagtggaagttcctggacagcagccagaagagactgtacagagaggtgatgtgggagaactacaccaacgtgatgagcgtggagaactggaacgagagctacaagagccaggaggagaagttcagatacctggagtacgagaacttcagctactggcagggctggtggaacgccggcgcccagatgtacgagaaccagaactacggcgagaccgtgcagggcaccgacagcaaggacctgacccagcaggacagaagccagtgccaggagtggctgatcctgagcacccaggtgcccggctacggcaactacgagctgaccttcgagagcaagagcctgagaaacctgaagtacaagaacttcatgccctggcagagcctggagaccaagaccacccaggactacggcagagagatctacatgagcggcagccacggcttccagggcggcagatacagactgggcatcagcagaaagaacctgagcatggagaaggagcagaagctgatcgtgcagcacagctacatccccgtggaggaggccctgccccagtacgtgggcgtgatctgccaggaggacctgctgagagacagcatggaggagaagtactgcggctgcaacaagtgcaagggcatctactactggaacagcagatgcgtgttccacaagagaaaccagcccggcgagaacctgtgccagtgcagcatctgcaaggcctgcttcagccagagaagcgacctgtacagacaccccagaaaccacatcggcaagaagctgtacggctgcgacgaggtggacggcaacttccaccagagcagcggcgtgcacttccaccagagagtgcacatcggcgaggtgccctacagctgcaacgcctgcggcaagagcttcagccagatcagcagcctgcacaaccaccagagagtgcacaccgaggagaagttctacaagatcgagtgcgacaaggacctgagcagaaacagcctgctgcacatccaccagagactgcacatcggcgagaagcccttcaagtgcaaccagtgcggcaagagcttcaacagaagcagcgtgctgcacgtgcaccagagagtgcacaccggcgagaagccctacaagtgcgacgagtgcggcaagggcttcagccagagcagcaacctgagaatccaccagctggtgcacaccggcgagaagagctacaagtgcgaggactgcggcaagggcttcacccagagaagcaacctgcagatccaccagagagtgcacaccggcgagaagccctacaagtgcgacgactgcggcaaggacttcagccacagcagcgacctgagaatccaccagagagtgcacaccggcgagaagccctacacctgccccgagtgcggcaagggcttcagcaagagcagcaagctgcacacccaccagagagtgcacaccggcgagaagccctacaagtgcgaggagtgcggcaagggcttcagccagagaagccacctgctgatccaccagagagtgcacaccggcgagaagccctacaagtgccacgactgcggcaagggcttcagccacagcagcaacctgcacatccaccagagagtgcacaccggcgagaagccctaccagtgcgccaagtgcggcaagggcttcagccacagcagcgccctgagaatccaccagagagtgcacgccggcgagaagccctacaagtgcagagagtactacaagggcttcgaccacaacagccacctgcacaacaaccacagaagaggcaacctgtag

SEQ ID NO: 105833 - DNA, 1821 bp, Artificial Sequence; identical to SEQ ID NO: 105832
  Description of Artificial Sequence: Synthetic coding sequence

SEQ ID NO: 105834 - DNA, 1554 bp, Artificial Sequence
  Description of Artificial Sequence: Synthetic coding sequence
atgcagcccctgagcaagctgatggccatcagcaagcccagaaacctgagcctgagagagcagagagaggtgctgagagccgacatgagctggcagcaggagaccaaccccgtggtggagacccacgacagcgaggccagcagacagaagttcagacacttccagtacctgaaggtgagcggcccccacgaggccctgagccagctgtgggagctgtgcctgcagtggctgagacccgagatccacaccaagaagcagatcatcgagctgctggtgctggagcagttcctggccatcctgcccgaggaggtgagaacctgggtgaacctgcagcaccccaacaacagcaaggacatggtgaccctgatcgaggacgtgatcgagatgctggaggacgaggacatgccctgcaaggacagcgccctgcagatgggcagcatcaaggagaagatgaaggccggcagcagaaccggcaagccccaggagcccgtgaccttcaaggacgtggtggtggagttcagcaaggaggagtggggccagctggacagcgccgtgaagaacctgtacagaaacgtgatgctggagaacttcagaaacctgaacagcctgagaaaggcccacctgctgagcaagcccttcgagagcctgaagctggagagcaagaagaagagatggatcatggagaaggagatccccagaaagaccatcttcgacatgaagagcatcagcggcgaggagagcagccacggcgtgatcatgaccagactgaccgagagcggccaccccagcagcgacgcctggaagggcgagaactggctgtacagaaaccagaagaagtgggacatcaacctgccccaggaggccttcatccccgagaccatctacaccgaggaggaggacttcgagtgcagcgagaacaagaagagcttcgacatcaacagcgtgagcagcatctgcgccatccaggtgggcatccccagcagaaagggcagccccaagtgcgacaagttcaagacctacttcaagttcaacctggacagcgtgggcaagcagcacagcgagtacgagtacggcaacgacctgagcctgagcaccgacatcagacaccagaagagccacaccaccatgaacagctacgagtgctaccagtgcggcaaggccttctgcagaagcagcagcctgatcagacaccagatcatccacaccggcgagaagccctacaagtgcagcgagtgcggcagattcttcaacagaagaaccaacctgaccaagcaccagaagctgcacgccgaggccaaggcctgcaccagcaacaagtgcggcaaggccttcagcaagagcgaggacagcaacaaccccaccctgcacttcggcaacaacttctaccagtgcgtgaactgcggcaagagcttcaacagaagcagcagcctgatcagacaccagatgatccacaccggcgagaagcccttcaagtgcaaggagtgcagcaaggccttcaacagaagcagcaacctggtgaagcaccagaagctgcacaccagagacaagagctag

SEQ ID NO: 105835 - DNA, 1554 bp, Artificial Sequence; identical to SEQ ID NO: 105834
  Description of Artificial Sequence: Synthetic coding sequence

SEQ ID NO: 105836 - DNA, 915 bp, Artificial Sequence
  Description of Artificial Sequence: Synthetic coding sequence
atgcagcccctgagcaagctgatggccatcagcaagcccagaaacctgagcctgagagagcagagagaggtgctgagagccgacatgagctggcagcaggagaccaaccccgtggtggagacccacgacagcgaggccagcagacagaagttcagacacttccagtacctgaaggtgagcggcccccacgaggccctgagccagctgtgggagctgtgcctgcagtggctgagacccgagatccacaccaagaagcagatcatcgagctgctggtgctggagcagttcctggccatcctgcccgaggaggtgagaacctgggtgaacctgcagcaccccaacaacagcaaggacatggtgaccctgatcgaggacgtgatcgagatgctggaggacgaggacatgccctgcaaggacagcgccctgcagatgggcagcatcaaggagaagatgaaggccggcagcagaaccggcaagccccaggagcccgtgaccttcaaggacgtggtggtggagttcagcaaggaggagtggggccagctggacagcgccgtgaagaacctgtacagaaacgtgatgctggagaacttcagaaacctgaacagcctgagaaaggcccacctgctgagcaagcccttcgagagcctgaagctggagagcaagaagaagagatggatcatggagaaggagatccccagaaagaccatcttcgacatgaagagcatcagcggcgaggagagcagccacggcgtgatcatgaccagactgaccgagagcggccaccccagcagcgacgcctggaaggacggcgtgagcctgctgctgcccagactggagtacaacgacgccgtgagcgcccactgcaacctgcacctgtgggtgcaggtgatcctgctgccccagccccccgagtag

SEQ ID NO: 105837 - DNA, 3147 bp, Artificial Sequence
  Description of Artificial Sequence: Synthetic coding sequence
atgcagagcaaggtgaccggcaacatgcccacccagagcctgctgatgtacatggacggccccgaggtgatcggcagcagcctgggcagccccatggagatggaggacgccctgagcatgaagggcaccgccgtggtgcccttcagagccacccaggagaagaacgtgatccagatcgagggctacatgcccctggactgcatgttctgcagccagaccttcacccacagcgaggacctgaacaagcacgtgctgatgcagcacagacccaccctgtgcgagcccgccgtgctgagagtggaggccgagtacctgagccccctggacaagagccaggtgagaaccgagccccccaaggagaagaactgcaaggagaacgagttcagctgcgaggtgtgcggccagaccttcagagtggccttcgacgtggagatccacatgagaacccacaaggacagcttcacctacggctgcaacatgtgcggcagaagattcaaggagccctggttcctgaagaaccacatgagaacccacaacggcaagagcggcgccagaagcaagctgcagcagggcctggagagcagccccgccaccatcaacgaggtggtgcaggtgcacgccgccgagagcatcagcagcccctacaagatctgcatggtgtgcggcttcctgttccccaacaaggagagcctgatcgagcacagaaaggtgcacaccaagaagaccgccttcggcaccagcagcgcccagaccgacagcccccagggcggcatgcccagcagcagagaggacttcctgcagctgttcaacctgagacccaagagccaccccgagaccggcaagaagcccgtgagatgcatcccccagctggaccccttcaccaccttccaggcctggcagctggccaccaagggcaaggtggccatctgccaggaggtgaaggagagcggccaggagggcagcaccgacaacgacgacagcagcagcgagaaggagctgggcgagaccaacaagggcagctgcgccggcctgagccaggagaaggagaagtgcaagcacagccacggcgaggcccccagcgtggacgccgaccccaagctgcccagcagcaaggagaagcccacccactgcagcgagtgcggcaaggccttcagaacctaccaccagctggtgctgcacagcagagtgcacaagaaggacagaagagccggcgccgagagccccaccatgagcgtggacggcagacagcccggcacctgcagccccgacctggccgcccccctggacgagaacggcgccgtggacagaggcgagggcggcagcgaggacggcagcgaggacggcctgcccgagggcatccacctggacaagaacgacgacggcggcaagatcaagcacctgaccagcagcagagagtgcagctactgcggcaagttcttcagaagcaactactacctgaacatccacctgagaacccacaccggcgagaagccctacaagtgcgagttctgcgagtacgccgccgcccagaagaccagcctgagataccacctggagagacaccacaaggagaagcagaccgacgtggccgccgaggtgaagaacgacggcaagaaccaggacaccgaggacgccctgctgaccgccgacagcgcccagaccaagaacctgaagagattcttcgacggcgccaaggacgtgaccggcagcccccccgccaagcagctgaaggagatgcccagcgtgttccagaacgtgctgggcagcgccgtgctgagccccgcccacaaggacacccaggacttccacaagaacgccgccgacgacagcgccgacaaggtgaacaagaaccccacccccgcctacctggacctgctgaagaagagaagcgccgtggagacccaggccaacaacctgatctgcagaaccaaggccgacgtgacccccccccccgacggcagcaccacccacaacctggaggtgagccccaaggagaagcagaccgagaccgccgccgactgcagatacagacccagcgtggactgccacgagaagcccctgaacctgagcgtgggcgccctgcacaactgccccgccatcagcctgagcaagagcctgatccccagcatcacctgccccttctgcaccttcaagaccttctaccccgaggtgctgatgatgcaccagagactggagcacaagtacaaccccgacgtgcacaagaactgcagaaacaagagcctgctgagaagcagaagaaccggctgcccccccgccctgctgggcaaggacgtgccccccctgagcagcttctgcaagcccaagcccaagagcgccttccccgcccagagcaagagcctgcccagcgccaagggcaagcagagcccccccggccccggcaaggcccccctgaccagcggcatcgacagcagcaccctggcccccagcaacctgaagagccacagaccccagcagaacgtgggcgtgcagggcgccgccaccagacagcagcagagcgagatgttccccaagaccagcgtgagccccgcccccgacaagaccaagagacccgagaccaagctgaagcccctgcccgtggcccccagccagcccaccctgggcagcagcaacatcaacggcagcatcgactaccccgccaagaacgacagcccctgggccccccccggcagagactacttctgcaacagaagcgccagcaacaccgccgccgagttcggcgagcccctgcccaagagactgaagagcagcgtggtggccctggacgtggaccagcccggcgccaactacagaagaggctacgacctgcccaagtaccacatggtgagaggcatcaccagcctgctgccccaggactgcgtgtaccccagccaggccctgccccccaagcccagattcctgagcagcagcgaggtggacagccccaacgtgctgaccgtgcagaagccctacggcggcagcggccccctgtacacctgcgtgcccgccggcagccccgccagcagcagcaccctggagggcaagagacccgtgagctaccagcacctgagcaacagcatggcccagaagagaaactacgagaacttcatcggcaacgcccactacagacccaacgacaagaagacctag

SEQ ID NO: 105838 - DNA, 3147 bp, Artificial Sequence; identical to SEQ ID NO: 105837
  Description of Artificial Sequence: Synthetic coding sequence

SEQ ID NO: 105839 - DNA, 666 bp, Artificial Sequence
  Description of Artificial Sequence: Synthetic coding sequence
atgttccccaagaccagcgtgagccccgcccccgacaagaccaagagacccgagaccaagctgaagcccctgcccgtggcccccagccagcccaccctgggcagcagcaacatcaacggcagcatcgactaccccgccaagaacgacagcccctgggccccccccggcagagactacttctgcaacagaagcgccagcaacaccgccgccgagttcggcgagcccctgcccaagagactgaagagcagcgtggtggccctggacgtggaccagcccggcgccaactacagaagaggctacgacctgcccaagtaccacatggtgagaggcatcaccagcctgctgccccaggactgcgtgtaccccagccaggccctgccccccaagcccagattcctgagcagcagcgaggtggacagccccaacgtgctgaccgtgcagaagccctacggcggcagcggccccctgtacacctgcgtgcccgccggcagccccgccagcagcagcaccctggagggcctgggcggctgccagtgcctgctgcccatgaagctgaacttcaccagcagcttcgagaagagaatggtgaaggccaccgagatcagctgcgactgcaccgtgcacaagacctacgaggagagcgccagaaacaccaccgtggtgtag

SEQ ID NO: 105840 - DNA, 288 bp, Artificial Sequence
  Description of Artificial Sequence: Synthetic coding sequence
atgcagagcaaggtgaccggcaacatgcccacccagagcctgctgatgtacatggacggccccgaggtgatcggcagcagcctgggcagccccatggagatggaggacgccctgagcatgaagggcaccgccgtggtgcccttcagagccacccaggagaagaacgtgatccagatcgagggctacatgcccctggactgcatgttctgcagccagaccttcacccacagcgaggacctgaacaagcacgtgctgatgcagcacagacccaccctgtgcgagccctag

SEQ ID NO: 105841 - DNA, 2169 bp, Artificial Sequence
  Description of Artificial Sequence: Synthetic coding sequence
atggagggcagcagacccagagcccccagcggccacctggcccccagcccccccgccttcgacggcgagctggacctgcagagatacagcaacggccccgccgtgagcgccggcagcctgggcatgggcgccgtgagctggagcgagagcagagccggcgagagaagattcccctgccccgtgtgcggcaagagattcagattcaacagcatcctggccctgcacctgagagcccaccccggcgcccaggccttccagtgcccccactgcggccacagagccgcccagagagccctgctgagaagccacctgagaacccaccagcccgagagacccagaagccccgccgccagactgctgctggagctggaggagagagccctgctgagagaggccagactgggcagagccagaagcagcggcggcatgcaggccacccccgccaccgagggcctggccagaccccaggcccccagcagcagcgccttcagatgcccctactgcaagggcaagttcagaaccagcgccgagagagagagacacctgcacatcctgcacagaccctggaagtgcggcctgtgcagcttcggcagcagccaggaggaggagctgctgcaccacagcctgaccgcccacggcgcccccgagagacccctggccgccaccagcgccgccccccccccccagccccagccccagccccccccccagcccgagcccagaagcgtgccccagcccgagcccgagcccgagcccgagagagaggccacccccacccccgcccccgccgcccccgaggagccccccgccccccccgagttcagatgccaggtgtgcggccagagcttcacccagagctggttcctgaagggccacatgagaaagcacaaggccagcttcgaccacgcctgccccgtgtgcggcagatgcttcaaggagccctggttcctgaagaaccacatgaaggtgcacgccagcaagctgggccccctgagagcccccggccccgccagcggccccgccagagccccccagccccccgacctgggcctgctggcctacgagcccctgggccccgccctgctgctggcccccgcccccacccccgccgagagaagagagccccccagcctgctgggctacctgagcctgagagccggcgagggcagacccaacggcgagggcgccgagcccggccccggcagaagcttcggcggcttcagacccctgagcagcgccctgcccgccagagccagaagacacagagccgaggagcccgaggaggaggaggaggtggtggaggccgaggaggagacctgggccagaggcagaagcctgggcagcctggccagcctgcaccccagacccggcgagggccccggccacagcgccagcgccgccggcgcccaggccagaagcaccgccacccaggaggagaacggcctgctggtgggcggcaccagacccgagggcggcagaggcgccaccggcaaggactgccccttctgcggcaagagcttcagaagcgcccaccacctgaaggtgcacctgagagtgcacaccggcgagagaccctacaagtgcccccactgcgactacgccggcacccagagcggcagcctgaagtaccacctgcagagacaccacagagagcagagaagcggcgccggccccggccccccccccgagccccccccccccagccagagaggcagcgccccccagagcggcgccaagcccagcccccagcccgccacctgggtggagggcgccagcagccccagaccccccagcagcggcgccggccccggcagcagaagaaagcccgccagccccggcagaaccctgagaaacggcagaggcggcgaggccgagcccctggacctgagcctgagagccggccccggcggcgaggccggccccggcggcgccctgcacagatgcctgttctgccccttcgccaccggcgcccccgagctgatggccctgcacctgcaggtgcaccacagcagaagagccagaggcagaagacccccccaggccgacgccagccccccctacgccagagtgcccagcggcgagaccccccccagccccagccaggagggcgaggagggcagcggcctgagcagacccggcgaggccggcctgggcggccaggagagatag

SEQ ID NO: 105842 - DNA, 2169 bp, Artificial Sequence; identical to SEQ ID NO: 105841
  Description of Artificial Sequence: Synthetic coding sequence

SEQ ID NO: 105843 - DNA, 2169 bp, Artificial Sequence; identical to SEQ ID NO: 105841
  Description of Artificial Sequence: Synthetic coding sequence

SEQ ID NO: 105844 - DNA, 324 bp, Artificial Sequence
  Description of Artificial Sequence: Synthetic coding sequence
atggagggcagcagacccagagcccccagcggccacctggcccccagcccccccgccttcgacggcgagctggacctgcagagatacagcaacggccccgccgtgagcgccggcagcctgggcatgggcgccgtgagctggagcgagagcagagccggcgagagaagattcccctgccccgtgtgcggcaagagattcagattcaacagcatcctggccctgcacctgagagcccaccccggcgcccaggccttccagtgcccccactgcggccacagagccgcccagagagccctgctgagaagccacctgagaacccactag

SEQ ID NO: 105845 - DNA, 636 bp, Artificial Sequence
  Description of Artificial Sequence: Synthetic coding sequence
atggagggcagcagacccagagcccccagcggccacctggcccccagcccccccgccttcgacggcgagctggacctgcagagatacagcaacggccccgccgtgagcgccggcagcctgggcatgggcgccgtgagctggagcgagagcagagccggcgagagaagattcccctgccccgtgtgcggcaagagattcagattcaacagcatcctggccctgcacctgagagcccaccccggcgcccaggccttccagtgcccccactgcggccacagagccgcccagagagccctgctgagaagccacctgagaacccaccagcccgagagacccagaagccccgccgccagactgctgctggagctggaggagagagccctgctgagagaggccagactgggcagagccagaagcagcggcggcatgcaggccacccccgccaccgagggcctggccagaccccaggcccccagcagcagcgccttcagatgcccctactgcaagggcaagttcagaaccagcgccgagagagagagacacctgcacatcctgcacagaccctggaagtgcggcctgtgcagcttcggcagcagccaggaggaggagctgctgcaccacagcctgaccgcctag

SEQ ID NO: 105846 - DNA, 96 bp, Artificial Sequence
  Description of Artificial Sequence: Synthetic coding sequence
atggagggcagcagacccagagcccccagcggccacctggcccccagcccccccgccttcgacggcgagctggacctgcagagatacagcaactag

SEQ ID NO: 105847 - DNA, 336 bp, Artificial Sequence
  Description of Artificial Sequence: Synthetic coding sequence
atggagggcagcagacccagagcccccagcggccacctggcccccagcccccccgccttcgacggcgagctggacctgcagagatacagcaacggccccgccgtgagcgccggcagcctgggcatgggcgccgtgagctggagcgagagcagagccggcgagagaagattcccctgccccgtgtgcggcaagagattcagattcaacagcatcctggccctgcacctgagagcccaccccggcgcccaggccttccagtgcccccactgcggccacagagccgcccagagagccctgctgagaagccacctgagaacccaccagcccgagagatag

SEQ ID NO: 105848 - DNA, 675 bp, Artificial Sequence
  Description of Artificial Sequence: Synthetic coding sequence
atgagactggccaagcccaaggccggcatcagcagaagcagcagccagggcaaggcctacgagaacaagagaaagaccggcagacagagacagaagtggggcatgaccatcagattcgacagcagcttcagcagactgagaagaagcctggacgacaagccctacaagtgcaccgagtgcgagaagagcttcagccagagcagcaccctgttccagcaccagaagatccacaccggcaagaagagccacaagtgcgccgactgcggcaagagcttcttccagagcagcaacctgatccagcacagaagaatccacaccggcgagaagccctacaagtgcgacgagtgcggcgagagcttcaagcagagcagcaacctgatccagcaccagagaatccacaccggcgagaagccctaccagtgcgacgagtgcggcagatgcttcagccagagcagccacctgatccagcaccagagaacccacaccggcgagaagccctaccagtgcagcgagtgcggcaagtgcttcagccagagcagccacctgagacagcacatgaaggtgcacaaggaggagaagcccagaaagaccagaggcaagaacatcagagtgaagacccacctgcccagctggaaggccggcaccggcagaaagagcgtggccggcctgagatag

SEQ ID NO: 105849 - DNA, 237 bp, Artificial Sequence
  Description of Artificial Sequence: Synthetic coding sequence
atgaccaccttcaaggaggccatgaccttcaaggacgtggccgtggtgttcaccgaggaggagctgggcctgctggacctggcccagagaaagctgtacagagacgtgatgctggagaacttcagaaacctgctgagcgtgggccaccaggccttccacagagacaccttccacttcctgagagaggagaagatctggatgatgaagaccgccatccagagagagggcaacagctag

SEQ ID NO: 105850 - DNA, 2124 bp, Artificial Sequence
  Description of Artificial Sequence: Synthetic coding sequence
atgaccaccttcaaggaggccatgaccttcaaggacgtggccgtggtgttcaccgaggaggagctgggcctgctggacctggcccagagaaagctgtacagagacgtgatgctggagaacttcagaaacctgctgagcgtgggccaccaggccttccacagagacaccttccacttcctgagagaggagaagatctggatgatgaagaccgccatccagagagagggcaacagcggcgacaagatccagaccgagatggagaccgtgagcgaggccggcacccaccaggagtggagcttccagcagatctgggagaagatcgccagcgacctgaccagaagccaggacctgatgatcaacagcagccagttcagcaaggagggcgacttcccctgccagaccgaggccggcctgagcgtgatccacaccagacagaagagcagccagggcaacggctacaagcccagcttcagcgacgtgagccacttcgacttccaccagcagctgcacagcggcgagaagagccacacctgcgacgagtgcggcaagaacttctgctacatcagcgccctgagaatccaccagagagtgcacatgggcgagaagtgctacaagtgcgacgtgtgcggcaaggagttcagccagagcagccacctgcagacccaccagagagtgcacaccggcgagaagcccttcaagtgcgtggagtgcggcaagggcttcagcagaagaagcgccctgaacgtgcaccacaagctgcacaccggcgagaagccctacaactgcgaggagtgcggcaaggccttcatccacgacagccagctgcaggagcaccagagaatccacaccggcgagaagcccttcaagtgcgacatctgcggcaagagcttctgcggcagaagcagactgaacagacacagcatggtgcacaccgccgagaagcccttcagatgcgacacctgcgacaagagcttcagacagagaagcgccctgaacagccacagaatgatccacaccggcgagaagccctacaagtgcgaggagtgcggcaagggcttcatctgcagaagagacctgtacacccaccacatggtgcacaccggcgagaagccctacaactgcaaggagtgcggcaagagcttcagatgggccagctgcctgctgaagcaccagagagtgcacagcggcgagaagcccttcaagtgcgaggagtgcggcaagggcttctacaccaacagccagtgctacagccaccagagaagccacagcggcgagaagccctacaagtgcgtggagtgcggcaagggctacaagagaagactggacctggacttccaccagagagtgcacaccggcgagaagctgtacaactgcaaggagtgcggcaagagcttcagcagagccccctgcctgctgaagcacgagagactgcacagcggcgagaagcccttccagtgcgaggagtgcggcaagagattcacccagaacagccacctgcacagccaccagagagtgcacaccggcgagaagccctacaagtgcgagaagtgcggcaagggctacaacagcaagttcaacctggacatgcaccagaaggtgcacaccggcgagagaccctacaactgcaaggagtgcggcaagagcttcggctgggccagctgcctgctgaagcaccagagactgcacagcggcgagaagcccttcaagtgcgaggagtgcggcaagagattcacccagaacagccagctgcacagccaccagagagtgcacaccggcgagaagccctacaagtgcgacgagtgcggcaagggcttcagctggagcagcaccagactgacccaccagagaagacacagcagagagacccccctgaagtgcgagcagcacggcaagaacatcgtgcagaacagcttcagcaaggtgcaggagaaggtgcacagcgtggagaagccctacaagtgcgaggactgcggcaagggctacaacagaagactgaacctggacatgcaccagagagtgcacatgggcgagaagacctggaagtgcagagagtgcgacatgtgcttcagccaggccagcagcctgagactgcaccagaacgtgcacgtgggcgagaagccctag

SEQ ID NO: 105851 - DNA, 1932 bp, Artificial Sequence
  Description of Artificial Sequence: Synthetic coding sequence
atgctggagaactacggcaacgtggccagcctgggcttccccctgctgaagcccgccgtgatcagccagctggagggcggcagcgagctgggcggcagcagccccctggccgccggcaccggcctgcagggcctgcagaccgacatccagaccgacaacgacctgaccaaggagatgtacgagggcaaggagaacgtgagcttcgagctgcagagagacttcagccaggagaccgacttcagcgaggccagcctgctggagaagcagcaggaggtgcacagcgccggcaacatcaagaaggagaagagcaacaccatcgacggcaccgtgaaggacgagaccagccccgtggaggagtgcttcttcagccagagcagcaacagctaccagtgccacaccatcaccggcgagcagcccagcggctgcaccggcctgggcaagagcatcagcttcgacaccaagctggtgaagcacgagatcatcaacagcgaggagagacccttcaagtgcgaggagctggtggagcccttcagatgcgacagccagctgatccagcaccaggagaacaacaccgaggagaagccctaccagtgcagcgagtgcggcaaggccttcagcatcaacgagaagctgatctggcaccagagactgcacagcggcgagaagcccttcaagtgcgtggagtgcggcaagagcttcagctacagcagccactacatcacccaccagaccatccacagcggcgagaagccctaccagtgcaagatgtgcggcaaggccttcagcgtgaacggcagcctgagcagacaccagagaatccacaccggcgagaagccctaccagtgcaaggagtgcggcaacggcttcagctgcagcagcgcctacatcacccaccagagagtgcacaccggcgagaagccctacgagtgcaacgactgcggcaaggccttcaacgtgaacgccaagctgatccagcaccagagaatccacaccggcgagaagccctacgagtgcaacgagtgcggcaagggcttcagatgcagcagccagctgagacagcaccagagcatccacaccggcgagaagccctaccagtgcaaggagtgcggcaagggcttcaacaacaacaccaagctgatccagcaccagagaatccacaccggcgagaagccctacgagtgcaccgagtgcggcaaggccttcagcgtgaagggcaagctgatccagcaccagagaatccacaccggcgagaagccctacgagtgcaacgagtgcggcaaggccttcagatgcaacagccagttcagacagcacctgagaatccacaccggcgagaagccctacgagtgcaacgagtgcggcaaggccttcagcgtgaacggcaagctgatgagacaccagagaatccacaccggcgagaagcccttcgagtgcaacgagtgcggcagatgcttcaccagcaagagaaacctgctggaccaccacagaatccacaccggcgagaagccctaccagtgcaaggagtgcggcaaggccttcagcatcaacgccaagctgaccagacaccagagaatccacaccggcgagaagcccttcaagtgcatggagtgcgagaaggccttcagctgcagcagcaactacatcgtgcaccagagaatccacaccggcgagaagcccttccagtgcaaggagtgcggcaaggccttccacgtgaacgcccacctgatcagacaccagagaagccacaccggcgagaagcccttcagatgcgtggagtgcggcaagggcttcagcttcagcagcgactacatcatccaccagaccgtgcacacctggaagaagccctacatgtgcagcgtgtgcggcaaggccttcagattcagcttccagctgagccagcaccagagcgtgcacagcgagggcaagagctag

SEQ ID NO: 105852 - DNA, 1248 bp, Artificial Sequence
  Description of Artificial Sequence: Synthetic coding sequence
tgcggcaaggccttcagcatcaacgagaagctgatctggcaccagagactgcacagcggcgagaagcccttcaagtgcgtggagtgcggcaagagcttcagctacagcagccactacatcacccaccagaccatccacagcggcgagaagccctaccagtgcaagatgtgcggcaaggccttcagcgtgaacggcagcctgagcagacaccagagaatccacaccggcgagaagccctaccagtgcaaggagtgcggcaacggcttcagctgcagcagcgcctacatcacccaccagagagtgcacaccggcgagaagccctacgagtgcaacgactgcggcaaggccttcaacgtgaacgccaagctgatccagcaccagagaatccacaccggcgagaagccctacgagtgcaacgagtgcggcaagggcttcagatgcagcagccagctgagacagcaccagagcatccacaccggcgagaagccctaccagtgcaaggagtgcggcaagggcttcaacaacaacaccaagctgatccagcaccagagaatccacaccggcgagaagccctacgagtgcaacgagtgcggcaaggccttcagatgcaacagccagttcagacagcacctgagaatccacaccggcgagaagccctacgagtgcaacgagtgcggcaaggccttcagcgtgaacggcaagctgatgagacaccagagaatccacaccggcgagaagcccttcgagtgcaacgagtgcggcagatgcttcaccagcaagagaaacctgctggaccaccacagaatccacaccggcgagaagccctaccagtgcaaggagtgcggcaaggccttcagcatcaacgccaagctgaccagacaccagagaatccacaccggcgagaagcccttcaagtgcatggagtgcgagaaggccttcagctgcagcagcaactacatcgtgcaccagagaatccacaccggcgagaagcccttccagtgcaaggagtgcggcaaggccttccacgtgaacgcccacctgatcagacaccagagaagccacaccggcgagaagcccttcagatgcgtggagtgcggcaagggcttcagcttcagcagcgactacatcatccaccagaccgtgcacacctggaagaagccctacatgtgcagcgtgtgcggcaaggccttcagattcagcttccagctgagccagcaccagagcgtgcacagcgagggcaagagctag

SEQ ID NO: 105853 - DNA, 1932 bp, Artificial Sequence; identical to SEQ ID NO: 105851
  Description of Artificial Sequence: Synthetic coding sequence

SEQ ID NO: 105854 - DNA, 1932 bp, Artificial Sequence; identical to SEQ ID NO: 105851
  Description of Artificial Sequence: Synthetic coding sequence

SEQ ID NO: 105855 - DNA, 1758 bp, Artificial Sequence
  Description of Artificial Sequence: Synthetic coding sequence
atgtacgagggcaaggagaacgtgagcttcgagctgcagagagacttcagccaggagaccgacttcagcgaggccagcctgctggagaagcagcaggaggtgcacagcgccggcaacatcaagaaggagaagagcaacaccatcgacggcaccgtgaaggacgagaccagccccgtggaggagtgcttcttcagccagagcagcaacagctaccagtgccacaccatcaccggcgagcagcccagcggctgcaccggcctgggcaagagcatcagcttcgacaccaagctggtgaagcacgagatcatcaacagcgaggagagacccttcaagtgcgaggagctggtggagcccttcagatgcgacagccagctgatccagcaccaggagaacaacaccgaggagaagccctaccagtgcagcgagtgcggcaaggccttcagcatcaacgagaagctgatctggcaccagagactgcacagcggcgagaagcccttcaagtgcgtggagtgcggcaagagcttcagctacagcagccactacatcacccaccagaccatccacagcggcgagaagccctaccagtgcaagatgtgcggcaaggccttcagcgtgaacggcagcctgagcagacaccagagaatccacaccggcgagaagccctaccagtgcaaggagtgcggcaacggcttcagctgcagcagcgcctacatcacccaccagagagtgcacaccggcgagaagccctacgagtgcaacgactgcggcaaggccttcaacgtgaacgccaagctgatccagcaccagagaatccacaccggcgagaagccctacgagtgcaacgagtgcggcaagggcttcagatgcagcagccagctgagacagcaccagagcatccacaccggcgagaagccctaccagtgcaaggagtgcggcaagggcttcaacaacaacaccaagctgatccagcaccagagaatccacaccggcgagaagccctacgagtgcaccgagtgcggcaaggccttcagcgtgaagggcaagctgatccagcaccagagaatccacaccggcgagaagccctacgagtgcaacgagtgcggcaaggccttcagatgcaacagccagttcagacagcacctgagaatccacaccggcgagaagccctacgagtgcaacgagtgcggcaaggccttcagcgtgaacggcaagctgatgagacaccagagaatccacaccggcgagaagcccttcgagtgcaacgagtgcggcagatgcttcaccagcaagagaaacctgctggaccaccacagaatccacaccggcgagaagccctaccagtgcaaggagtgcggcaaggccttcagcatcaacgccaagctgaccagacaccagagaatccacaccggcgagaagcccttcaagtgcatggagtgcgagaaggccttcagctgcagcagcaactacatcgtgcaccagagaatccacaccggcgagaagcccttccagtgcaaggagtgcggcaaggccttccacgtgaacgcccacctgatcagacaccagagaagccacaccggcgagaagcccttcagatgcgtggagtgcggcaagggcttcagcttcagcagcgactacatcatccaccagaccgtgcacacctggaagaagccctacatgtgcagcgtgtgcggcaaggccttcagattcagcttccagctgagccagcaccagagcgtgcacagcgagggcaagagctag

SEQ ID NO: 105856 - DNA, 1758 bp, Artificial Sequence; identical to SEQ ID NO: 105855
  Description of Artificial Sequence: Synthetic coding sequence

SEQ ID NO: 105857 - DNA, 5538 bp, Artificial Sequence
  Description of Artificial Sequence: Synthetic coding sequence
atgggcctgtgcggcctgctggagagatgctggctgcaccacgaccccgacggcgtgctgaccctgaacgccgagaacaccaactacgcctaccaggtgcccaacttccacaagtgcgagatctgcctgctgagcttccccaaggagagccagttccagagacacatgagagaccacgagagaaacgacaagccccacagatgcgaccagtgcccccagaccttcaacgtggagttcaacctgaccctgcacaagtgcacccacagcggcgaggaccccacctgccccgtgtgcaacaagaagttcagcagagtggccagcctgaaggcccacatcatgctgcacgagaaggaggagaacctgatctgcagcgagtgcggcgacgagttcaccctgcagagccagctggccgtgcacatggaggagcacagacaggagctggccggcaccagacagcacgcctgcaaggcctgcaagaaggagttcgagaccagcagcgagctgaaggagcacatgaagacccactacaagatcagagtgagcagcaccagaagctacaacagaaacatcgacagaagcggcttcacctacagctgcccccactgcggcaagaccttccagaagcccagccagctgaccagacacatcagaatccacaccggcgagagacccttcaagtgcagcgagtgcggcaaggccttcaaccagaagggcgccctgcagacccacatgatcaagcacaccggcgagaagccccacgcctgcgccttctgccccgccgccttcagccagaagggcaacctgcagagccacgtgcagagagtgcacagcgaggtgaagaacggccccacctacaactgcaccgagtgcagctgcgtgttcaagagcctgggcagcctgaacacccacatcagcaagatgcacatgggcggcccccagaacagcaccagcagcaccgagaccgcccacgtgctgaccgccaccctgttccagaccctgcccctgcagcagaccgaggcccaggccaccagcgccagcagccagcccagcagccaggccgtgagcgacgtgatccagcagctgctggagctgagcgagcccgcccccgtggagagcggccagagcccccagcccggccagcagctgagcatcaccgtgggcatcaaccaggacatcctgcagcaggccctggagaacagcggcctgagcagcatccccgccgccgcccaccccaacgacagctgccacgccaagaccagcgccccccacgcccagaaccccgacgtgagcagcgtgagcaacgagcagaccgaccccaccgacgccgagcaggagaaggagcaggagagccccgagaagctggacaagaaggagaagaagatgatcaagaagaagagccccttcctgcccggcagcatcagagaggagaacggcgtgagatggcacgtgtgcccctactgcgccaaggagttcagaaagcccagcgacctggtgagacacatcagaatccacacccacgagaagcccttcaagtgcccccagtgcttcagagccttcgccgtgaagagcaccctgaccgcccacatcaagacccacaccggcatcaaggccttcaagtgccagtactgcatgaagagcttcagcaccagcggcagcctgaaggtgcacatcagactgcacaccggcgtgagacccttcgcctgcccccactgcgacaagaagttcagaaccagcggccacagaaagacccacatcgccagccacttcaagcacaccgagctgagaaagatgagacaccagagaaagcccgccaaggtgagagtgggcaagaccaacatccccgtgcccgacatccccctgcaggagcccatcctgatcaccgacctgggcctgatccagcccatccccaagaaccagttcttccagagctacttcaacaacaacttcgtgaacgaggccgacagaccctacaagtgcttctactgccacagagcctacaagaagagctgccacctgaagcagcacatcagaagccacaccggcgagaagcccttcaagtgcagccagtgcggcagaggcttcgtgagcgccggcgtgctgaaggcccacatcagaacccacaccggcctgaagagcttcaagtgcctgatctgcaacggcgccttcaccaccggcggcagcctgagaagacacatgggcatccacaacgacctgagaccctacatgtgcccctactgccagaagaccttcaagaccagcctgaactgcaagaagcacatgaagacccacagatacgagctggcccagcagctgcagcagcaccagcaggccgccagcatcgacgacagcaccgtggaccagcagagcatgcaggccagcacccagatgcaggtggagatcgagagcgacgagctgccccagaccgccgaggtggtggccgccaaccccgaggccatgctggacctggagccccagcacgtggtgggcaccgaggaggccggcctgggccagcagctggccgaccagcccctggaggccgacgaggacggcttcgtggccccccaggaccccctgagaggccacgtggaccagttcgaggagcagagccccgcccagcagagcttcgagcccgccggcctgccccagggcttcaccgtgaccgacacctaccaccagcagccccagttcccccccgtgcagcagctgcaggacagcagcaccctggagagccaggccctgagcaccagcttccaccagcagagcctgctgcaggcccccagcagcgacggcatgaacgtgaccaccagactgatccaggagagcagccaggaggagctggacctgcaggcccagggcagccagttcctggaggacaacgaggaccagagcagaagaagctacagatgcgactactgcaacaagggcttcaagaagagcagccacctgaagcagcacgtgagaagccacaccggcgagaagccctacaagtgcaagctgtgcggcagaggcttcgtgagcagcggcgtgctgaagagccacgagaagacccacaccggcgtgaaggccttcagctgcagcgtgtgcaacgccagcttcaccaccaacggcagcctgaccagacacatggccacccacatgagcatgaagccctacaagtgccccttctgcgaggagggcttcagaaccaccgtgcactgcaagaagcacatgaagagacaccagaccgtgcccagcgccgtgagcgccaccggcgagaccgagggcggcgacatctgcatggaggaggaggaggagcacagcgacagaaacgccagcagaaagagcagacccgaggtgatcaccttcaccgaggaggagaccgcccagctggccaagatcagaccccaggagagcgccaccgtgagcgagaaggtgctggtgcagagcgccgccgagaaggacagaatcagcgagctgagagacaagcaggccgagctgcaggacgagcccaagcacgccaactgctgcacctactgccccaagagcttcaagaagcccagcgacctggtgagacacgtgagaatccacaccggcgagaagccctacaagtgcgacgagtgcggcaagagcttcaccgtgaagagcaccctggactgccacgtgaagacccacaccggccagaagctgttcagctgccacgtgtgcagcaacgccttcagcaccaagggcagcctgaaggtgcacatgagactgcacaccggcgccaagcccttcaagtgcccccactgcgagctgagattcagaaccagcggcagaagaaagacccacatgcagttccactacaagcccgaccccaagaaggccagaaagcccatgaccagaagcagcagcgagggcctgcagcccgtgaacctgctgaacagcagcagcaccgaccccaacgtgttcatcatgaacaacagcgtgctgaccggccagttcgaccagaacctgctgcagcccggcctggtgggccaggccatcctgcccgccagcgtgagcgccggcggcgacctgaccgtgagcctgaccgacggcagcctggccaccctggagggcatccagctgcagctggccgccaacctggtgggccccaacgtgcagatcagcggcatcgacgccgccagcatcaacaacatcaccctgcagatcgaccccagcatcctgcagcagaccctgcagcagggcaacctgctggcccagcagctgaccggcgagcccggcctggccccccagaacagcagcctgcagaccagcgacagcaccgtgcccgccagcgtggtgatccagcccatcagcggcctgagcctgcagcccaccgtgaccagcgccaacctgaccatcggccccctgagcgagcaggacagcgtgctgaccaccaacagcagcggcacccaggacctgacccaggtgatgaccagccagggcctggtgagccccagcggcggcccccacgagatcaccctgaccatcaacaacagcagcctgagccaggtgctggcccaggccgccggccccaccgccaccagcagcagcggcagcccccaggagatcaccctgaccatcagcgagctgaacaccaccagcggcagcctgcccagcaccacccccatgagccccagcgccatcagcacccagaacctggtgatgagcagcagcggcgtgggcggcgacgccagcgtgaccctgaccctggccgacacccagggcatgctgagcggcggcctggacaccgtgaccctgaacatcaccagccagggccagcagttccccgccctgctgaccgaccccagcctgagcggccagggcggcgccggcagcccccaggtgatcctggtgagccacaccccccagagcgccagcgccgcctgcgaggagatcgcctaccaggtggccggcgtgagcggcaacctggcccccggcaaccagcccgagaaggagggcagagcccaccagtgcctggagtgcgacagagccttcagcagcgccgccgtgctgatgcaccacagcaaggaggtgcacggcagagagagaatccacggctgccccgtgtgcagaaaggccttcaagagagccacccacctgaaggagcacatgcagacccaccaggccggccccagcctgagcagccagaagcccagagtgttcaagtgcgacacctgcgagaaggccttcgccaagcccagccagctggagagacacagcagaatccacaccggcgagagacccttccactgcaccctgtgcgagaaggccttcaaccagaagagcgccctgcaggtgcacatgaagaagcacaccggcgagagaccctacaagtgcgcctactgcgtgatgggcttcacccagaagagcaacatgaagctgcacatgaagagagcccacagctacgccggcgccctgcaggagagcgccggccaccccgagcaggacggcgaggagctgagcagaaccctgcacctggaggaggtggtgcaggaggccgccggcgagtggcaggccctgacccacgtgttctag

SEQ ID NO: 105858 - DNA, 4677 bp, Artificial Sequence
  Description of Artificial Sequence: Synthetic coding sequence
atgggcctgtgcggcctgctggagagatgctggctgcaccacgaccccgacggcgtgctgaccctgaacgccgagaacaccaactacgcctaccaggtgcccaacttccacaagtgcgagatctgcctgctgagcttccccaaggagagccagttccagagacacatgagagaccacgagagaaacgacaagccccacagatgcgaccagtgcccccagaccttcaacgtggagttcaacctgaccctgcacaagtgcacccacagcggcgaggaccccacctgccccgtgtgcaacaagaagttcagcagagtggccagcctgaaggcccacatcatgctgcacgagaaggaggagaacctgatctgcagcgagtgcggcgacgagttcaccctgcagagccagctggccgtgcacatggaggagcacagacaggagctggccggcaccagacagcacgcctgcaaggcctgcaagaaggagttcgagaccagcagcgagctgaaggagcacatgaagacccactacaagatcagagtgagcagcaccagaagctacaacagaaacatcgacagaagcggcttcacctacagctgcccccactgcggcaagaccttccagaagcccagccagctgaccagacacatcagaatccacaccggcgagagacccttcaagtgcagcgagtgcggcaaggccttcaaccagaagggcgccctgcagacccacatgatcaagcacaccggcgagaagccccacgcctgcgccttctgccccgccgccttcagccagaagggcaacctgcagagccacgtgcagagagtgcacagcgaggtgaagaacggccccacctacaactgcaccgagtgcagctgcgtgttcaagagcctgggcagcctgaacacccacatcagcaagatgcacatgggcggcccccagaacagcaccagcagcaccgagaccgcccacgtgctgaccgccaccctgttccagaccctgcccctgcagcagaccgaggcccaggccaccagcgccagcagccagcccagcagccaggccgtgagcgacgtgatccagcagctgctggagctgagcgagcccgcccccgtggagagcggccagagcccccagcccggccagcagctgagcatcaccgtgggcatcaaccaggacatcctgcagcaggccctggagaacagcggcctgagcagcatccccgccgccgcccaccccaacgacagctgccacgccaagaccagcgccccccacgcccagaaccccgacgtgagcagcgtgagcaacgagcagaccgaccccaccgacgccgagcaggagaaggagcaggagagccccgagaagctggacaagaaggagaagaagatgatcaagaagaagagccccttcctgcccggcagcatcagagaggagaacggcgtgagatggcacgtgtgcccctactgcgccaaggagttcagaaagcccagcgacctggtgagacacatcagaatccacacccacgagaagcccttcaagtgcccccagtgcttcagagccttcgccgtgaagagcaccctgaccgcccacatcaagacccacaccggcatcaaggccttcaagtgccagtactgcatgaagagcttcagcaccagcggcagcctgaaggtgcacatcagactgcacaccggcgtgagacccttcgcctgcccccactgcgacaagaagttcagaaccagcggccacagaaagacccacatcgccagccacttcaagcacaccgagctgagaaagatgagacaccagagaaagcccgccaaggtgagagtgggcaagaccaacatccccgtgcccgacatccccctgcaggagcccatcctgatcaccgacctgggcctgatccagcccatccccaagaaccagttcttccagagctacttcaacaacaacttcgtgaacgaggccgacagaccctacaagtgcttctactgccacagagcctacaagaagagctgccacctgaagcagcacatcagaagccacaccggcgagaagcccttcaagtgcagccagtgcggcagaggcttcgtgagcgccggcgtgctgaaggcccacatcagaacccacaccggcctgaagagcttcaagtgcctgatctgcaacggcgccttcaccaccggcggcagcctgagaagacacatgggcatccacaacgacctgagaccctacatgtgcccctactgccagaagaccttcaagaccagcctgaactgcaagaagcacatgaagacccacagatacgagctggcccagcagctgcagcagcaccagcaggccgccagcatcgacgacagcaccgtggaccagcagagcatgcaggccagcacccagatgcaggtggagatcgagagcgacgagctgccccagaccgccgaggtggtggccgccaaccccgaggccatgctggacctggagccccagcacgtggtgggcaccgaggaggccggcctgggccagcagctggccgaccagcccctggaggccgacgaggacggcttcgtggccccccaggaccccctgagaggccacgtggaccagttcgaggagcagagccccgcccagcagagcttcgagcccgccggcctgccccagggcttcaccgtgaccgacacctaccaccagcagccccagttcccccccgtgcagcagctgcaggacagcagcaccctggagagccaggccctgagcaccagcttccaccagcagagcctgctgcaggcccccagcagcgacggcatgaacgtgaccaccagactgatccaggagagcagccaggaggagctggacctgcaggcccagggcagccagttcctggaggacaacgaggaccagagcagaagaagctacagatgcgactactgcaacaagggcttcaagaagagcagccacctgaagcagcacgtgagaagccacaccggcgagaagccctacaagtgcaagctgtgcggcagaggcttcgtgagcagcggcgtgctgaagagccacgagaagacccacaccggcgtgaaggccttcagctgcagcgtgtgcaacgccagcttcaccaccaacggcagcctgaccagacacatggccacccacatgagcatgaagccctacaagtgccccttctgcgaggagggcttcagaaccaccgtgcactgcaagaagcacatgaagagacaccagaccgtgcccagcgccgtgagcgccaccggcgagaccgagggcggcgacatctgcatggaggaggaggaggagcacagcgacagaaacgccagcagaaagagcagacccgaggtgatcaccttcaccgaggaggagaccgcccagctggccaagatcagaccccaggagagcgccaccgtgagcgagaaggtgctggtgcagagcgccgccgagaaggacagaatcagcgagctgagagacaagcaggccgagctgcaggacgagcccaagcacgccaactgctgcacctactgccccaagagcttcaagaagcccagcgacctggtgagacacgtgagaatccacaccggcgagaagccctacaagtgcgacgagtgcggcaagagcttcaccgtgaagagcaccctggactgccacgtgaagacccacaccggccagaagctgttcagctgccacgtgtgcagcaacgccttcagcaccaagggcagcctgaaggtgcacatgagactgcacaccggcgccaagcccttcaagtgcccccactgcgagctgagattcagaaccagcggcagaagaaagacccacatgcagttccactacaagcccgaccccaagaaggccagaaagcccatgaccagaagcagcagcgagggcctgcagcccgtgaacctgctgaacagcagcagcaccgaccccaacgtgttcatcatgaacaacagcgtgctgaccggccagttcgaccagaacctgctgcagcccggcctggtgggccaggccatcctgcccgccagcgtgagcgccggcggcgacctgaccgtgagcctgaccgacggcagcctggccaccctggagggcatccagctgcagctggccgccaacctggtgggccccaacgtgcagatcagcggcatcgacgccgccagcatcaacaacatcaccctgcagatcgaccccagcatcctgcagcagaccctgcagcagggcaacctgctggcccagcagctgaccggcgagcccggcctggccccccagaacagcagcctgcagaccagcgacagcaccgtgcccgccagcgtggtgatccagcccatcagcggcctgagcctgcagcccaccgtgaccagcgccaacctgaccatcggccccctgagcgagcaggacagcgtgctgaccaccaacagcagcggcacccaggacctgacccaggtgatgaccagccagggcctggtgagccccagcggcggcccccacgagatcaccctgaccatcaacaacagcagcctgagccaggtgctggcccaggccgccggccccaccgccaccagcagcagcggcagcccccaggagatcaccctgaccatcagcggcagcagaagcgtgcagcacagcgtgggcccccaggagtgcggcagcgtggaggccctgtacctggagaacagcagcgacaagacctag

SEQ ID NO: 105859 - DNA, 4677 bp, Artificial Sequence; identical to SEQ ID NO: 105858
  Description of Artificial Sequence: Synthetic coding sequence

SEQ ID NO: 105860 - DNA, 1596 bp, Artificial Sequence
  Description of Artificial Sequence: Synthetic coding sequence
atgtgccccaagggctacgaggacagcatggagttccccgaccacagcagacacctgctgcagtgcctgagcgagcagagacaccagggcttcctgtgcgactgcaccgtgctggtgggcgacgcccagttcagagcccacagagccgtgctggccagctgcagcatgtacttccacctgttctacaaggaccagctggacaagagagacatcgtgcacctgaacagcgacatcgtgaccgcccccgccttcgccctgctgctggagttcatgtacgagggcaagctgcagttcaaggacctgcccatcgaggacgtgctggccgccgccagctacctgcacatgtacgacatcgtgaaggtgtgcaagaagaagctgaaggagaaggccaccaccgaggccgacagcaccaagaaggaggaggacgccagcagctgcagcgacaaggtggagagcctgagcgacggcagcagccacatcgccggcgacctgcccagcgacgaggacgagggcgaggacgagaagctgaacatcctgcccagcaagagagacctggccgccgagcccggcaacatgtggatgagactgcccagcgacagcgccggcatcccccaggccggcggcgaggccgagccccacgccaccgccgccggcaagaccgtggccagcccctgcagcagcaccgagagcctgagccagagaagcgtgaccagcgtgagagacagcgccgacgtggactgcgtgctggacctgagcgtgaagagcagcctgagcggcgtggagaacctgaacagcagctacttcagcagccaggacgtgctgagaagcaacctggtgcaggtgaaggtggagaaggaggccagctgcgacgagagcgacgtgggcaccaacgactacgacatggagcacagcaccgtgaaggagagcgtgagcaccaacaacagagtgcagtacgagcccgcccacctggcccccctgagagaggacagcgtgctgagagagctggacagagaggacaaggccagcgacgacgagatgatgacccccgagagcgagagagtgcaggtggagggcggcatggagagcagcctgctgccctacgtgagcaacatcctgagccccgccggccagatcttcatgtgccccctgtgcaacaaggtgttccccagcccccacatcctgcagatccacctgagcacccacttcagagagcaggacggcatcagaagcaagcccgccgccgacgtgaacgtgcccacctgcagcctgtgcggcaagaccttcagctgcatgtacaccctgaagagacacgagagaacccacagcggcgagaagccctacacctgcacccagtgcggcaagagcttccagtacagccacaacctgagcagacacgccgtggtgcacaccagagagaagccccacgcctgcaagtggtgcgagagaagattcacccagagcggcgacctgtacagacacatcagaaagttccactgcgagctggtgaacagcctgagcgtgaagagcgaggccctgagcctgcccaccgtgagagactggaccctggaggacagcagccaggagctgtggaagtag

SEQ ID NO: 105861 - DNA, 1464 bp, Artificial Sequence
  Description of Artificial Sequence: Synthetic coding sequence
atgtgccccaagggctacgaggacagcatggagttccccgaccacagcagacacctgctgcagtgcctgagcgagcagagacaccagggcttcctgtgcgactgcaccgtgctggtgggcgacgcccagttcagagcccacagagccgtgctggccagctgcagcatgtacttccacctgttctacaaggaccagctggacaagagagacatcgtgcacctgaacagcgacatcgtgaccgcccccgccttcgccctgctgctggagttcatgtacgagggcaagctgcagttcaaggacctgcccatcgaggacgtgctggccgccgccagctacctgcacatgtacgacatcgtgaaggtgtgcaagaagaagctgaaggagaaggccaccaccgaggccgacagcaccaagaaggaggaggacgccagcagctgcagcgacaaggtggagagcctgagcgacggcagcagccacatcgccggcgacctgcccagcgacgaggacgagggcgaggacgagaagctgaacatcctgcccagcaagagagacctggccgccgagcccggcaacatgtggatgagactgcccagcgacagcgccggcatcccccaggccggcggcgaggccgagccccacgccaccgccgccggcaagaccgtggccagcccctgcagcagcaccgagagcctgagccagagaagcgtgaccagcgtgagagacagcgccgacgtggactgcgtgctggacctgagcgtgaagagcagcctgagcggcgtggagaacctgaacagcagctacttcagcagccaggacgtgctgagaagcaacctggtgcaggtgaaggtggagaaggaggccagctgcgacgagagcgacgtgggcaccaacgactacgacatggagcacagcaccgtgaaggagagcgtgagcaccaacaacagagtgcagtacgagcccgcccacctggcccccctgagagaggacagcgtgctgagagagctggacagagaggacaaggccagcgacgacgagatgatgacccccgagagcgagagagtgcaggtggagggcggcatggagagcagcctgctgccctacgtgagcaacatcctgagccccgccggccagatcttcatgtgccccctgtgcaacaaggtgttccccagcccccacatcctgcagatccacctgagcacccacttcagagagcaggacggcatcagaagcaagcccgccgccgacgtgaacgtgcccacctgcagcctgtgcggcaagaccttcagctgcatgtacaccctgaagagacacgagagaacccacagcggcgagaagccctacacctgcacccagtgcggcaagagcttccagtacagccacaacctgagcagactgcaggtggtgagagcccaggtgcacgccgtgagaggccccgtgcagacccacagccaggtgcccctgtag

SEQ ID NO: 105862 - DNA, 1377 bp, Artificial Sequence
  Description of Artificial Sequence: Synthetic coding sequence
atggccagcaccatcaccggcagccaggactgcatcgtgaaccacagaggcgaggtggacggcgagcccgagctggacatcagcccctgccagcagtggggcgaggccagcagccccatcagcagaaacagagacagcgtgatgaccctgcagagcggctgcttcgagaacatcgagagcgagacctacctgcccctgaaggtgagcagccagatcgacacccaggacagcagcgtgaagttctgcaagaacgagccccaggaccaccaggagagcagaagactgttcgtgatggaggagagcaccgagagaaaggtgatcaagggcgagagctgcagcgagaacctgcaggtgaagctggtgagcgacggccaggagctggccagccccctgctgaacggcgaggccacctgccagaacggccagctgaaggagagcctggaccccatcgactgcaactgcaaggacatccacggctggaagagccaggtggtgagctgcagccagcagagagcccacaccgaggagaagccctgcgaccacaacaactgcggcaagatcctgaacaccagccccgacggccacccctacgagaagatccacaccgccgagaagcagtacgagtgcagccagtgcggcaagaacttcagccagagcagcgagctgctgctgcaccagagagaccacaccgaggagaagccctacaagtgcgagcagtgcggcaagggcttcaccagaagcagcagcctgctgatccaccaggccgtgcacaccgacgagaagccctacaagtgcgacaagtgcggcaagggcttcaccagaagcagcagcctgctgatccaccacgccgtgcacaccggcgagaagccctacaagtgcgacaagtgcggcaagggcttcagccagagcagcaagctgcacatccaccagagagtgcacaccggcgagaagccctacgagtgcgaggagtgcggcatgagcttcagccagagaagcaacctgcacatccaccagagagtgcacaccggcgagagaccctacaagtgcggcgagtgcggcaagggcttcagccagagcagcaacctgcacatccacagatgcatccacaccggcgagaagccctaccagtgctacgagtgcggcaagggcttcagccagagcagcgacctgagaatccacctgagagtgcacaccggcgagaagccctaccactgcggcaagtgcggcaagggcttcagccagagcagcaagctgctgatccaccagagagtgcacaccggcgagaagccctacgagtgcagcaagtgcggcaagggcttcagccagagcagcaacctgcacatccaccagagagtgcacaagaaggaccccagatag

SEQ ID NO: 105863 - DNA, 1377 bp, Artificial Sequence; identical to SEQ ID NO: 105862
  Description of Artificial Sequence: Synthetic coding sequence

SEQ ID NO: 105864 - DNA, 1377 bp, Artificial Sequence; identical to SEQ ID NO: 105862
  Description of Artificial Sequence: Synthetic coding sequence

SEQ ID NO: 105865 - DNA, 1377 bp, Artificial Sequence; identical to SEQ ID NO: 105862
  Description of Artificial Sequence: Synthetic coding sequence

SEQ ID NO: 105866 - DNA, 1377 bp, Artificial Sequence; identical to SEQ ID NO: 105862
  Description of Artificial Sequence: Synthetic coding sequence

SEQ ID NO: 105867 - DNA, 1107 bp, Artificial Sequence
  Description of Artificial Sequence: Synthetic coding sequence
atgagcgcccagagcgtggaggaggacagcatcctgatcatccccacccccgacgaggaggagaagatcctgagagtgaagctggaggaggaccccgacggcgaggagggcagcagcatcccctggaaccacctgcccgaccccgagatcttcagacagagattcagacagttcggctaccaggacagccccggccccagagaggccgtgagccagctgagagagctgtgcagactgtggctgagacccgagacccacaccaaggagcagatcctggagctggtggtgctggagcagttcgtggccatcctgcccaaggagctgcagacctgggtgagagaccaccaccccgagaacggcgaggaggccgtgaccgtgctggaggacctggagagcgagctggacgaccccggccagcccgtgagcctgagaagaagaaagagagaggtgctggtggaggacatggtgagccaggaggaggcccagggcctgcccagcagcgagctggacgccgtggagaaccagctgaagtgggccagctgggagctgcacagcctgagacactgcgacgacgacggcagaaccgagaacggcgccctggcccccaagcaggagctgcccagcgccctggagagccacgaggtgcccggcaccctgaacatgggcgtgccccagatcttcaagtacggcgagacctgcttccccaagggcagattcgagagaaagagaaaccccagcagaaagaagcagcacatctgcgacgagtgcggcaagcacttcagccagggcagcgccctgatcctgcaccagagaatccacagcggcgagaagccctacggctgcgtggagtgcggcaaggccttcagcagaagcagcatcctggtgcagcaccagagagtgcacaccggcgagaagccctacaagtgcctggagtgcggcaaggccttcagccagaacagcggcctgatcaaccaccagagaatccacaccggcgagaagccctacgagtgcgtgcagtgcggcaagagctacagccagagcagcaacctgttcagacaccagagaagacacaacgccgagaagctgctgaacgtggtgaaggtgtag

SEQ ID NO: 105868 - DNA, 1107 bp, Artificial Sequence; identical to SEQ ID NO: 105867
  Description of Artificial Sequence: Synthetic coding sequence

SEQ ID NO: 105869 - DNA, 1371 bp, Artificial Sequence
  Description of Artificial Sequence: Synthetic coding sequence
atgaacaagttccagggccccgtgaccctgaaggacgtgatcgtggagttcaccaaggaggagtggaagctgctgacccccgcccagagaaccctgtacaaggacgtgatgctggagaactacagccacctggtgagcgtgggctaccacgtgaacaagcccaacgccgtgttcaagctgaagcagggcaaggagccctggatcctggaggtggagttcccccacagaggcttccccgaggacctgtggagcatccacgacctggaggccagataccaggagagccaggccggcaacagcagaaacggcgagctgaccaagcaccagaagacccacaccaccgagaaggcctgcgagtgcaaggagtgcggcaagttcttctgccagaagagcgccctgatcgtgcaccagcacacccacagcaagggcaagagctacgactgcgacaagtgcggcaagagcttcagcaagaacgaggacctgatcagacaccagaagatccacaccagagacaagacctacgagtgcaaggagtgcaagaagatcttctaccacctgagcagcctgagcagacacctgagaacccacgccggcgagaagccctacgagtgcaaccagtgcgagaagagcttctaccagaagccccacctgaccgagcaccagaagacccacaccggcgagaagcccttcgagtgcaccgagtgcggcaagttcttctacgtgaaggcctacctgatggtgcaccagaagacccacaccggcgagaagccctacgagtgcaaggagtgcggcaaggccttcagccagaagagccacctgaccgtgcaccagagaatgcacaccggcgagaagccctacaagtgcaaggagtgcggcaagttcttcagcagaaacagccacctgaagacccaccagagaagccacaccggcgagaagccctacgagtgcaaggagtgcagaaagtgcttctaccagaagagcgccctgaccgtgcaccagagaacccacaccggcgagaagcccttcgagtgcaacaagtgcggcaagaccttctactacaagagcgacctgaccaagcaccagagaaagcacaccggcgagaagccctacgagtgcaccgagtgcggcaagagcttcgccgtgaacagcgtgctgagactgcaccagagaacccacaccggcgagaagccctacgcctgcaaggagtgcggcaagagcttcagccagaagagccacttcatcatccaccagagaaagcacaccggcgagaagccctacgagtgccaggagtgcggcgagaccttcatccagaagagccagctgaccgcccaccagaagacccacaccaagaagagaaacgccgagaagtag

SEQ ID NO: 105870 - DNA, 1263 bp, Artificial Sequence
  Description of Artificial Sequence: Synthetic coding sequence
atgctggagaactacagccacctggtgagcgtgggctaccacgtgaacaagcccaacgccgtgttcaagctgaagcagggcaaggagccctggatcctggaggtggagttcccccacagaggcttccccgaggacctgtggagcatccacgacctggaggccagataccaggagagccaggccggcaacagcagaaacggcgagctgaccaagcaccagaagacccacaccaccgagaaggcctgcgagtgcaaggagtgcggcaagttcttctgccagaagagcgccctgatcgtgcaccagcacacccacagcaagggcaagagctacgactgcgacaagtgcggcaagagcttcagcaagaacgaggacctgatcagacaccagaagatccacaccagagacaagacctacgagtgcaaggagtgcaagaagatcttctaccacctgagcagcctgagcagacacctgagaacccacgccggcgagaagccctacgagtgcaaccagtgcgagaagagcttctaccagaagccccacctgaccgagcaccagaagacccacaccggcgagaagcccttcgagtgcaccgagtgcggcaagttcttctacgtgaaggcctacctgatggtgcaccagaagacccacaccggcgagaagccctacgagtgcaaggagtgcggcaaggccttcagccagaagagccacctgaccgtgcaccagagaatgcacaccggcgagaagccctacaagtgcaaggagtgcggcaagttcttcagcagaaacagccacctgaagacccaccagagaagccacaccggcgagaagccctacgagtgcaaggagtgcagaaagtgcttctaccagaagagcgccctgaccgtgcaccagagaacccacaccggcgagaagcccttcgagtgcaacaagtgcggcaagaccttctactacaagagcgacctgaccaagcaccagagaaagcacaccggcgagaagccctacgagtgcaccgagtgcggcaagagcttcgccgtgaacagcgtgctgagactgcaccagagaacccacaccggcgagaagccctacgcctgcaaggagtgcggcaagagcttcagccagaagagccacttcatcatccaccagagaaagcacaccggcgagaagccctacgagtgccaggagtgcggcgagaccttcatccagaagagccagctgaccgcccaccagaagacccacaccaagaagagaaacgccgagaagtag

SEQ ID NO: 105871 - DNA, 1500 bp, Artificial Sequence
  Description of Artificial Sequence: Synthetic coding sequence
atgggccccctgcagttcagagacgtggccatcgagttcagcctggaggagtggcactgcctggacaccgcccagagaaacctgtacagagacgtgatgctggagaactacagaaacctggtgttcctgggcatcgtggtgagcaagcccgacctggtgacctgcctggagcagggcaagaagcccctgaccatggagagacacgagatgatcgccaagccccccgtgatgagcagccacttcgcccaggacctgtggcccgagaacatccagaacagcttccagatcggcatgctgagaagatacgaggagtgcagacacgacaacctgcagctgaagaagggctgcaagagcgtgggcgagcacaaggtgcacaagggcggctacaacggcctgaaccagtgcctgaccaccacccagaaggagatcttccagtgcgacaagtacggcaaggtgttccacaagttcagcaacagcaacacctacaagaccagacacaccggcatcaacctgttcaagtgcatcatctgcggcaaggccttcaagagaagcagcaccctgaccacccacaagaagatccacaccggcgagaagccctacagatgcgaggagtgcggcaaggccttcaaccagagcgccaacctgaccacccacaagagaatccacaccggcgagaagccctacagatgcgaggagtgcggcaaggccttcaagcagagcagcaacctgaccacccacaagaagatccacaccggcgagaagccctacaagtgcgaggagtgcggcaaggccttcaacagaagcaccgacctgaccacccacaagatcgtgcacaccggcgagaagccctacaagtgcgaggagtgcggcaaggccttcaagcaccccagccacgtgaccacccacaagaagatccacaccagaggcaagccctacaactgcgaggagtgcggcaagagcttcaagcactgcagcaacctgaccatccacaagagaatccacaccggcgagaagccctacaagtgcgaggagtgcggcaaggccttccacctgagcagccacctgaccacccacaagatcctgcacaccggcgagaagccctacagatgcagagagtgcggcaaggccttcaaccacagcaccaccctgttcagccacgagaagatccacaccggcgagaagccctacaagtgcgacgagtgcggcaagaccttcacctggcccagcatcctgagcaagcacaagagaacccacaccggcgagaagccctacaagtgcgaggagtgcggcaagagcttcaccgccagcagcaccctgaccacccacaagagaatccacaccggcgagaagccctacaagtgcgaggagtgcggcaaggccttcaactggagcagcgacctgaacaagcacaagaagatccacatcgagagaaagccctacatcgtgaagaacgtgaccgacctgctgaacgtgccccccctgctgatcagcatcagatag

SEQ ID NO: 105872 - DNA, 1500 bp, Artificial Sequence; identical to SEQ ID NO: 105871
  Description of Artificial Sequence: Synthetic coding sequence

SEQ ID NO: 105873 - DNA, 276 bp, Artificial Sequence
  Description of Artificial Sequence: Synthetic coding sequence
atgcccggcccccccagaagcctggagatgggcctgctgaccttcagagacgtggccatcgagttcagcctggaggagtggcagcacctggacatcgcccagcagaacctgtacagaaacgtgatgctggagaactacagaaacctggccttcctgggcatcgccgtgagcaagcccgacctgatcacctgcctggagcagggcaaggagccctggaacatgaagagacacgagatggtggacgagccccccggcctggacttcagcctgctgtag

SEQ ID NO: 105874 - DNA, 1725 bp, Artificial Sequence
  Description of Artificial Sequence: Synthetic coding sequence
atgtgcccccacttcgcccaggacctgtggcccgagcagggcatggaggacagcttccagaaggccatcctgagaagatacggcaagtacggccacgagaacctgcagctgagaaagggctgcaagagcgtggacgagtacaaggtgaacaaggagggctacaacggcctgaaccagtgcttcaccaccgcccagagcaaggtgttccagtgcgacaagtacctgaaggtgttctacaagttcctgaacagcaacagacccaagatcagacacaccgagaagaagagcttcaagtgcaagaagagagtgaagctgttctgcatgctgagccacaagacccagcacaagagcatctaccacagagagaagagctacaagtgcaaggagtgcggcaagaccttcaactggagcagcaccctgaccaaccacagaaagatctacaccgaggagaagccctacaagtgcgaggagtacaacaagagccccaagcagctgagcaccctgaccacccacgagatcatccacgccggcgagaagctgtacaagtgcgaggagtgcggcgaggccttcaacagaagcagcaacctgaccacccacaagatcatccacaccggcgagaagccctacaagtgcgaggagtgcggcaaggccttcatctggagcagcaccctgaccgagcacaagaagatccacaccagaaagaagccctacaagtgcgaggagtgcggcaaggccttcatctggagcagcaccctgaccagacacaagagaatgcacaccggcgagaagccctacaagtgcgaggagtgcggcaaggccttcagccagagcagcaccctgaccacccacaagatcatccacaccggcgagaagagatacaagtgcctggagtgcggcaaggccttcaagcagctgagcaccctgaccacccacaagatcatccacgtgggcgagaagctgtacaagtgcgaggagtgcggcaagggcttcaacagaagcagcaacctgaccacccacaagatcatccacaccggcgagaagccctacaagtgcgaggagtgcggcaaggccttcatctggagcagcaccctgaccaagcacaagagaatccacaccagagagaagccctacaagtgcgaggagtgcggcaaggccttcatctggagcagcaccctgaccagacacaagagaatgcacaccggcgagaagccctacaagtgcgaggagtgcggcaagagcttcagccagagcagcaccctgaccacccacaagatcatccacaccggcgagaagccctacaagtgcgaggagtgcggcaaggccttcaactggagcagcaccctgaccaagcacaagatcatccacaccgaggagaagccctacaagtgcgagaagtgcggcaaggccttcaagcagagcagcatcctgaccaaccacaagagaatccacaccggcgagaagccctacaagtgcgaggagtgcggcaagagcttcaacagaagcagcaccttcaccaagcacaaggtgatccacaccggcgtgaagccctacaagtgcgaggagtgcggcaaggccttcttctggagcagcaccctgaccaagcacaagagaatccacaccggcgagcagccctacaagtgggagaagttcggcaaggccttcaacagaagcagccacctgaccaccgacaagatcacccactggagagagatcctgcaggtgtag

SEQ ID NO: 105875 - DNA, 1980 bp, Artificial Sequence
  Description of Artificial Sequence: Synthetic coding sequence
atgcccggcccccccagaagcctggagatgggcctgctgaccttcagagacgtggccatcgagttcagcctggaggagtggcagcacctggacatcgcccagcagaacctgtacagaaacgtgatgctggagaactacagaaacctggccttcctgggcatcgccgtgagcaagcccgacctgatcacctgcctggagcagggcaaggagccctggaacatgaagagacacgagatggtggacgagccccccggcatgtgcccccacttcgcccaggacctgtggcccgagcagggcatggaggacagcttccagaaggccatcctgagaagatacggcaagtacggccacgagaacctgcagctgagaaagggctgcaagagcgtggacgagtacaaggtgaacaaggagggctacaacggcctgaaccagtgcttcaccaccgcccagagcaaggtgttccagtgcgacaagtacctgaaggtgttctacaagttcctgaacagcaacagacccaagatcagacacaccgagaagaagagcttcaagtgcaagaagagagtgaagctgttctgcatgctgagccacaagacccagcacaagagcatctaccacagagagaagagctacaagtgcaaggagtgcggcaagaccttcaactggagcagcaccctgaccaaccacagaaagatctacaccgaggagaagccctacaagtgcgaggagtacaacaagagccccaagcagctgagcaccctgaccacccacgagatcatccacgccggcgagaagctgtacaagtgcgaggagtgcggcgaggccttcaacagaagcagcaacctgaccacccacaagatcatccacaccggcgagaagccctacaagtgcgaggagtgcggcaaggccttcatctggagcagcaccctgaccgagcacaagaagatccacaccagaaagaagccctacaagtgcgaggagtgcggcaaggccttcatctggagcagcaccctgaccagacacaagagaatgcacaccggcgagaagccctacaagtgcgaggagtgcggcaaggccttcagccagagcagcaccctgaccacccacaagatcatccacaccggcgagaagagatacaagtgcctggagtgcggcaaggccttcaagcagctgagcaccctgaccacccacaagatcatccacgtgggcgagaagctgtacaagtgcgaggagtgcggcaagggcttcaacagaagcagcaacctgaccacccacaagatcatccacaccggcgagaagccctacaagtgcgaggagtgcggcaaggccttcatctggagcagcaccctgaccaagcacaagagaatccacaccagagagaagccctacaagtgcgaggagtgcggcaaggccttcatctggagcagcaccctgaccagacacaagagaatgcacaccggcgagaagccctacaagtgcgaggagtgcggcaagagcttcagccagagcagcaccctgaccacccacaagatcatccacaccggcgagaagccctacaagtgcgaggagtgcggcaaggccttcaactggagcagcaccctgaccaagcacaagatcatccacaccgaggagaagccctacaagtgcgagaagtgcggcaaggccttcaagcagagcagcatcctgaccaaccacaagagaatccacaccggcgagaagccctacaagtgcgaggagtgcggcaagagcttcaacagaagcagcaccttcaccaagcacaaggtgatccacaccggcgtgaagccctacaagtgcgaggagtgcggcaaggccttcttctggagcagcaccctgaccaagcacaagagaatccacaccggcgagcagccctacaagtgggagaagttcggcaaggccttcaacagaagcagccacctgaccaccgacaagatcacccactggagagagatcctgcaggtgtag

SEQ ID NO: 105876 - DNA, 1056 bp, Artificial Sequence
  Description of Artificial Sequence: Synthetic coding sequence
atgcccggcccccccagaagcctggagatgggcctgctgaccttcagagacgtggccatcgagttcagcctggaggagtggcagcacctggacatcgcccagcagaacctgtacagaaacgtgatgctggagaactacagaaacctggccttcctgggcatcgccgtgagcaagcccgacctgatcacctgcctggagcagggcaaggagccctggaacatgaagagacacgagatggtggacgagccccccggcatgtgcccccacttcgcccaggacctgtggcccgagcagggcatggaggacagcttccagaaggccatcctgagaagatacggcaagtacggccacgagaacctgcagctgagaaagggctgcaagagcgtggacgagtacaaggtgaacaaggagggctacaacggcctgaaccagtgcttcaccaccgcccagagcaaggtgttccagtgcgacaagtacctgaaggtgttctacaagttcctgaacagcaacagacccaagatcagacacaccgagaagaagagcttcaagtgcaagaagagagtgaagctgttctgcatgctgagccacaagacccagcacaagagcatctaccacagagagaagagctacaagtgcaaggagtgcggcaagaccttcaactggagcagcaccctgaccaaccacagaaagatctacaccgaggagaagccctacaagtgcgaggagtacaacaagagccccaagcagctgagcaccctgaccacccacgagatcatccacgccggcgagaagctgtacaagtgcgaggagtgcggcgaggccttcaacagaagcagcaccttcaccaagcacaaggtgatccacaccggcgtgaagccctacaagtgcgaggagtgcggcaaggccttcttctggagcagcaccctgaccaagcacaagagaatccacaccggcgagcagccctacaagtgggagaagttcggcaaggccttcaacagaagcagccacctgaccaccgacaagatcacccactggagagagatcctgcaggtgtag

SEQ ID NO: 105877 - DNA, 1884 bp, Artificial Sequence
  Description of Artificial Sequence: Synthetic coding sequence
atggccgccgccgagctgaccgcccccgcccagggcatcgtgaccttcgaggacgtggccgtgtacttcagctggaaggagtggggcctgctggacgaggcccagaagtgcctgtaccacgacgtgatgctggagaacctgaccctgaccaccagcctgggcggcagcggcgccggcgacgaggaggccccctaccagcagagcaccagcccccagagagtgagccaggtgagaatccccaaggccctgcccagcccccagaagaccaacccctgcgagatctgcggccccgtgctgagacagatcctgcacctggtggagcaccagggcacccaccacggccagaagctgtacaccgacggcgcctgcagaaagcagctgcagttcaccgcctacctgcaccagcaccagaagcagcacgtgggccagaagcacttcagaagcaacggcggcagagacatgttcctgagcagctgcaccttcgaggtgagcggcaagcccttcacctgcaaggaggtgggcaaggacttcctggtgagaagcagattcctgcagcagcaggccgcccacaccagaaagaagagcaacagaaccaagagcgccgtggccttccacagcgtgaagaaccactacaactggggcgagtgcgtgaaggccttcagctacaagcacgtgagagtgcagcaccagggcgacctgatcagagagagaagctacatgtgcagcgagtgcggcaagagcttcagcaccagctgcagcctgagcgaccacctgagagtgcacaccagcgagaagccctacacctgcggcgagtgcggcaagagctacagacagagcagcagcctgatcacccacagaagaatccacaccggcgtgagaccccaccagtgcgacgagtgcggcaagctgttcaacagaaagtacgacctgctgatccaccagagagtgcacaccggcgagagaccctacaagtgcagcgagtgcggcaagagcttcagccacagcagcagcctgatcacccaccagagaatccacaccggcatgagaccctacgagtgcagcgagtgcggcaagagcttcatccacagcagcagcctgatcacccaccagagagtgcacaccggcaccagaccctacatgtgcagcgagtgcggcaagagcttcagccagagctgccacctgatcaagcacagaagactgcacatcggcgagggcccctacgagtgcagcgagtgcggcaagctgttcacctacagaagcagattcttccagcaccagagagtgcacaccggcgtgagaagccacgagtgccacgagtgcggcaagctgttcagcagaaagttcgacctgatcgtgcacgagagagtgcacaccggcgagagaccctacgagtgcagcgagtgcggcaagagcttcacctgcaagagctacctgatcagccactggaaggtgcacaccggcgccagaccctacgagtgcggcgagtgcggcaagagcttcacccacagcagcaccctgctgcagcaccagagagtgcacaccggcgagagaccctacgagtgcaacgagtgcggcaagttcttcagccagagcagcagcctgatcagacacagaagaagccacaccggcgagagaccctacgagtgcagcgagtgctggaagagcttcagcaaccacagcagcctggtgaagcacagaagagtgcacaccggcgagagaccctacgagtgcagcgagtgcggcaagagcttcagccagagcagcaacctgaccaaccaccagagaatccacagcggcgagagaccctacgagtgcagcgactgcggcaagttcttcaccttcaacagcaacctgctgaagcaccagaacgtgcacaagggctag

SEQ ID NO: 105878 - DNA, 1608 bp, Artificial Sequence
  Description of Artificial Sequence: Synthetic coding sequence
atgggccccctgaccatcagagacgtgaccgtggagttcagcctggaggagtggcactgcctggacaccgcccagcagaacctgtacagagacgtgatgctggagaactacagaaacctggtgttcctgggcatcgccgtgagcaagcccgacctgatcacctgcctggagcagggcaaggagccctgcaacatgaagagacacgagatggtggccaagccccccgtgatgtgcagccacatcgccgaggacctgtgccccgagagagacatcaagtacttcttccagaaggtgatcctgagaagatacgacaagtgcgagcacgagaacctgcagctgagaaagggctgcaagagcgtggacgagtgcaaggtgtgcaagggcggctacaacggcctgaaccagtgcctgatcaccacccagagcaagatgtaccagtgcgacaagtacgtgaaggtgttctacaagttcagcaacagcgacagacacaagatcagacacaccgagaagaagacctgcaagtgcaaggagtgcggcaaggccttcaaccagagcagcgccctgaccagacacaagatgacccacaccggcgagaagccctacaagtgcgaggagtgcggcaaggccttcaacagaagcagccacctgacccagcacaaggtgatccacaccagagagaagccctacaagtgcgaggagtgcggcaaggccttcaacagaagcagccacatcacccagcacaagagaatccacaacagagagaagcccttcaagtacgacgagtgctgcaaggccttcaagtggagcagcgccctgaccaccctgacccagcacaagagaatccacaccggcgagaagccctacaagtgcgaggagtgcggcaaggccttcaaccagagcagcgccctgaccagacacaagatgatccacaccggcgagaagcccttccagtgcgaggagtgcggcaaggccttcaacagaagcagccacctgacccagcacaagatcatccacaccaaggagaagccctacaagtgcgaggagtgcggcaaggccttcaacagaagcagccacctgaccaagcacaagagaatccacaccagagagaaggcctacaagtgcgacgagtactgcaaggccttcaactggagcagcgccctgaccaccctgacccagcacaagatcatccacaccggcgagaagccctacaagtgcgaggagtgcggcaaggccttcaacagaagcagctacctgatcagacacaagatcatccacaccggcgagaagccctacaagtgcgaggagtgcggcaaggccttcaaccagagcagccacctgacccagcacaagatcatccacaccggcgagaagccctacaagtgcgaggagtgcggcaaggccttcaacagaagcagccacctgagccagcacaagatcatccacaccggcgagaagccctacaagtgcgaggagtgcggcaagcccttcaacagattcagctacctgaccgtgcacaagagaatccacgccggcgagaaccccaacaagtacgaggagtgcggcaaggcctgcaaccacagcagcaacctgaccaagcacaacagctag

SEQ ID NO: 105879 - DNA, 1692 bp, Artificial Sequence
  Description of Artificial Sequence: Synthetic coding sequence
atgggccccctgaccatcagagacgtgaccgtggagttcagcctggaggagtggcactgcctggacaccgcccagcagaacctgtacagagacgtgatgctggagaactacagaaacctggtgttcctgggcatcgccgtgagcaagcccgacctgatcacctgcctggagcagggcaaggagccctgcaacatgaagagacacgagatggtggccaagccccccgtgatgtgcagccacatcgccgaggacctgtgccccgagagagacatcaagtacttcttccagaaggtgatcctgagaagatacgacaagtgcgagcacgagaacctgcagctgagaaagggctgcaagagcgtggacgagtgcaaggtgtgcaagggcggctacaacggcctgaaccagtgcctgatcaccacccagagcaagatgtaccagtgcgacaagtacgtgaaggtgttctacaagttcagcaacagcgacagacacaagatcagacacaccgagaagaagacctgcaagtgcaaggagtgcggcaagagcttctgcatgctgagccagctgaccagacacaagagaatccacatcagagagaacagccacaagtgcgaggagtgcggcaaggccttcaaccagagcagcgccctgaccagacacaagatgacccacaccggcgagaagccctacaagtgcgaggagtgcggcaaggccttcaacagaagcagccacctgacccagcacaaggtgatccacaccagagagaagccctacaagtgcgaggagtgcggcaaggccttcaacagaagcagccacatcacccagcacaagagaatccacaacagagagaagcccttcaagtacgacgagtgctgcaaggccttcaagtggagcagcgccctgaccaccctgacccagcacaagagaatccacaccggcgagaagccctacaagtgcgaggagtgcggcaaggccttcaaccagagcagcgccctgaccagacacaagatgatccacaccggcgagaagcccttccagtgcgaggagtgcggcaaggccttcaacagaagcagccacctgacccagcacaagatcatccacaccaaggagaagccctacaagtgcgaggagtgcggcaaggccttcaacagaagcagccacctgaccaagcacaagagaatccacaccagagagaaggcctacaagtgcgacgagtactgcaaggccttcaactggagcagcgccctgaccaccctgacccagcacaagatcatccacaccggcgagaagccctacaagtgcgaggagtgcggcaaggccttcaacagaagcagctacctgatcagacacaagatcatccacaccggcgagaagccctacaagtgcgaggagtgcggcaaggccttcaaccagagcagccacctgacccagcacaagatcatccacaccggcgagaagccctacaagtgcgaggagtgcggcaaggccttcaacagaagcagccacctgagccagcacaagatcatccacaccggcgagaagccctacaagtgcgaggagtgcggcaagcccttcaacagattcagctacctgaccgtgcacaagagaatccacgccggcgagaaccccaacaagtacgaggagtgcggcaaggcctgcaaccacagcagcaacctgaccaagcacaacagctag

SEQ ID NO: 105880 - DNA, 1692 bp, Artificial Sequence; identical to SEQ ID NO: 105879
  Description of Artificial Sequence: Synthetic coding sequence

SEQ ID NO: 105881 - DNA, 1602 bp, Artificial Sequence
  Description of Artificial Sequence: Synthetic coding sequence
atggccaccagcttcagaaccgccagctgctggggcctgctgagcttcaaggacatcagcatggagttcacctgggacgagtggcagctgctggacagcacccagaagtacctgtacagagacgtgatcctggagaactaccacaacctgatcagcgtgggctaccacggcaccaagcccgacctgatcttcaagctggagcagggcgaggacccctggatcatcaacgccaagatcagcagacagagctgccccgacggctgggaggagtggtaccagaacaaccaggacgagctggagagcatcgagagaagctacgcctgcagcgtgctgggcagactgaacctgagcaagacccacgacagcagcagacagagactgtacaacaccagaggcaagagcctgacccagaacagcgcccccagcagaagctacctgagaaagaaccccgacaagttccacggctacgaggagccctacttcctgaagcaccagagagcccacagcatcgagaagaactgcgtgtgcagcgagtgcggcaaggccttcagatgcaagagccagctgatcgtgcacctgagaatccacaccggcgagagaccctacgagtgcagcaagtgcgagagagccttcagcgccaagagcaacctgaacgcccaccagagagtgcacaccggcgagaagccctacagctgcagcgagtgcgagaaggtgttcagcttcagaagccagctgatcgtgcaccaggagatccacaccggcggcaagccctacggctgcagcgagtgcggcaaggcctacagctggaagagccagctgctgctgcaccagagaagccacaccggcgtgaagccctacgagtgcagcgagtgcggcaaggccttcagcctgaagagccccttcgtggtgcaccagagaacccacaccggcgtgaagccccacaagtgcagcgagtgcggcaaggccttcagaagcaagagctacctgctggtgcacatcagaatgcacaccggcgagaagccctaccagtgcagcgactgcggcaaggccttcaacatgaagacccagctgatcgtgcaccagggcgtgcacaccggcaacaacccctaccagtgcggcgagtgcggcaaggccttcggcagaaaggagcagctgaccgcccacctgagagcccacgccggcgagaagccctacggctgcagcgagtgcggcaaggccttcagcagcaagagctacctggtgatccacagaagaacccacaccggcgagagaccctacgagtgcagcctgtgcgagagagccttctgcggcaagagccagctgatcatccaccagagaacccacagcaccgagaagccctacgagtgcaacgagtgcgagaaggcctaccccagaaaggccagcctgcagatccaccagaagacccacagcggcgagaagcccttcaagtgcagcgagtgcggcaaggccttcacccagaagagcagcctgagcgagcaccagagagtgcacaccggcgagaagccctggaagtgcagcgagtgcggcaagagcttctgctggaacagcggcctgagaatccacagaaagacccacaagtag

SEQ ID NO: 105882 - DNA, 1542 bp, Artificial Sequence
  Description of Artificial Sequence: Synthetic coding sequence
atggagttcacctgggacgagtggcagctgctggacagcacccagaagtacctgtacagagacgtgatcctggagaactaccacaacctgatcagcgtgggctaccacggcaccaagcccgacctgatcttcaagctggagcagggcgaggacccctggatcatcaacgccaagatcagcagacagagctgccccgacggctgggaggagtggtaccagaacaaccaggacgagctggagagcatcgagagaagctacgcctgcagcgtgctgggcagactgaacctgagcaagacccacgacagcagcagacagagactgtacaacaccagaggcaagagcctgacccagaacagcgcccccagcagaagctacctgagaaagaaccccgacaagttccacggctacgaggagccctacttcctgaagcaccagagagcccacagcatcgagaagaactgcgtgtgcagcgagtgcggcaaggccttcagatgcaagagccagctgatcgtgcacctgagaatccacaccggcgagagaccctacgagtgcagcaagtgcgagagagccttcagcgccaagagcaacctgaacgcccaccagagagtgcacaccggcgagaagccctacagctgcagcgagtgcgagaaggtgttcagcttcagaagccagctgatcgtgcaccaggagatccacaccggcggcaagccctacggctgcagcgagtgcggcaaggcctacagctggaagagccagctgctgctgcaccagagaagccacaccggcgtgaagccctacgagtgcagcgagtgcggcaaggccttcagcctgaagagccccttcgtggtgcaccagagaacccacaccggcgtgaagccccacaagtgcagcgagtgcggcaaggccttcagaagcaagagctacctgctggtgcacatcagaatgcacaccggcgagaagccctaccagtgcagcgactgcggcaaggccttcaacatgaagacccagctgatcgtgcaccagggcgtgcacaccggcaacaacccctaccagtgcggcgagtgcggcaaggccttcggcagaaaggagcagctgaccgcccacctgagagcccacgccggcgagaagccctacggctgcagcgagtgcggcaaggccttcagcagcaagagctacctggtgatccacagaagaacccacaccggcgagagaccctacgagtgcagcctgtgcgagagagccttctgcggcaagagccagctgatcatccaccagagaacccacagcaccgagaagccctacgagtgcaacgagtgcgagaaggcctaccccagaaaggccagcctgcagatccaccagaagacccacagcggcgagaagcccttcaagtgcagcgagtgcggcaaggccttcacccagaagagcagcctgagcgagcaccagagagtgcacaccggcgagaagccctggaagtgcagcgagtgcggcaagagcttctgctggaacagcggcctgagaatccacagaaagacccacaagtag

SEQ ID NO: 105883 - DNA, 1239 bp, Artificial Sequence
  Description of Artificial Sequence: Synthetic coding sequence
atgatcggcatgctggagagcctgcagcacgagagcgacctgctgcagcacgaccagatccacaccggcgagaagccctacgagtgcaacgagtgcagaaagaccttcagcctgaagcagaacctggtggagcacaagaagatgcacaccggcgagaagagccacgagtgcaccgagtgcggcaaggtgtgcagcagagtgagcagcctgaccctgcacctgagaagccacaccggcaagaaggcctacaagtgcaacaagtgcggcaaggccttcagccagaaggagaacttcctgagccaccagaagcaccacaccggcgagaagccctacgagtgcgagaaggtgagcatccagatgcccaccatcatcagacaccagaagaaccacaccggcaccaagccctacgcctgcaaggagtgcggcaaggccttcaacggcaaggcctacctgaccgagcacgagaagatccacaccggcgagaagcccttcgagtgcaaccagtgcggcagagccttcagccagaagcagtacctgatcaagcaccagaacatccacaccggcaagaagcccttcaagtgcagcgagtgcggcaaggccttcagccagaaggagaacctgatcatccaccagagaatccacaccggcgagaagccctacgagtgcaagggctgcggcaaggccttcatccagaagagcagcctgatcagacaccagagaagccacaccggcgagaagccctacacctgcaaggagtgcggcaaggccttcagcggcaagagcaacctgaccgagcacgagaagatccacatcggcgagaagccctacaagtgcaacgagtgcggcaccatcttcagacagaagcagtacctgatcaagcaccacaacatccacaccggcgagaagccctacgagtgcaacaagtgcggcaaggccttcagcagaatcaccagcctgatcgtgcacgtgagaatccacaccggcgacaagccctacgagtgcaaggtgtgcggcaaggccttctgccagagcagcagcctgaccgtgcacatgagaagccacaccggcgagaagccctacggctgcaacgagtgcggcaaggccttcagccagttcagcaccctggccctgcacatgagaatccacaccggcgagaagccctaccagtgcagcgagtgcggcaaggccttcagccagaagagccaccacatcagacaccagagaatccacacccactag

SEQ ID NO: 105884 - DNA, 1239 bp, Artificial Sequence; identical to SEQ ID NO: 105883
  Description of Artificial Sequence: Synthetic coding sequence

SEQ ID NO: 105885 - DNA, 1884 bp, Artificial Sequence
  Description of Artificial Sequence: Synthetic coding sequence
atggccgccgccgtgctgaccgacagagcccaggtgagcgtgaccttcgacgacgtggccgtgaccttcaccaaggaggagtggggccagctggacctggcccagagaaccctgtaccaggaggtgatgctggagaactgcggcctgctggtgagcctgggctgccccgtgcccaaggccgagctgatctgccacctggagcacggccaggagccctggaccagaaaggaggacctgagccaggacacctgccccggcgacaagggcaagcccaagaccaccgagcccaccacctgcgagcccgccctgagcgagggcatcagcctgcagggccaggtgacccagggcaacagcgtggacagccagctgggccaggccgaggaccaggacggcctgagcgagatgcaggagggccacttcagacccggcatcgacccccaggagaagagccccggcaagatgagccccgagtgcgacggcctgggcaccgccgacggcgtgtgcagcagaatcggccaggagcaggtgagccccggcgacagagtgagaagccacaacagctgcgagagcggcaaggaccccatgatccaggaggaggagaacaacttcaagtgcagcgagtgcggcaaggtgttcaacaagaagcacctgctggccggccacgagaagatccacagcggcgtgaagccctacgagtgcaccgagtgcggcaagaccttcatcaagagcacccacctgctgcagcaccacatgatccacaccggcgagagaccctacgagtgcatggagtgcggcaaggccttcaacagaaagagctacctgacccagcaccagagaatccacagcggcgagaagccctacaagtgcaacgagtgcggcaaggccttcacccacagaagcaacttcgtgctgcacaacagaagacacaccggcgagaagagcttcgtgtgcaccgagtgcggccaggtgttcagacacagacccggcttcctgagacactacgtggtgcacagcggcgagaacccctacgagtgcctggagtgcggcaaggtgttcaagcacagaagctacctgatgtggcaccagcagacccacaccggcgagaagccctacgagtgcagcgagtgcggcaaggtgttcctggagagcgccgccctgatccaccactacgtgatccacaccggcgagaagcccttcgagtgcctggagtgcggcaaggccttcaaccacagaagctacctgaagagacaccagagaatccacaccggcgagaagcccttcgtgtgcagcgagtgcggcaaggccttcacccactgcagcaccttcatcctgcacaagagagcccacaccggcgagaagcccttcgagtgcaaggagtgcggcaaggccttcagcaacagaaaggacctgatcagacacttcagcatccacaccggcgagaagccctacgagtgcgtggagtgcggcaaggccttcaccagaatgagcggcctgaccagacacaagagaatccacagcggcgagaagccctacgagtgcgtggagtgcggcaagagcttctgctggagcaccaacctgatcagacacgccatcatccacaccggcgagaagccctacaagtgcagcgagtgcggcaaggccttcagcagaagcagcagcctgacccagcaccagagaatgcacaccggcaagaaccccatcagcgtgaccgacgtgggcagacccttcaccagcggccagaccagcgtgaccctgagagagctgctgctgggcaaggacttcctgaacgtgaccaccgaggccaacatcctgcccgaggagaccagcagcagcgccagcgaccagccctaccagagagagaccccccaggtgagcagcctgtag

SEQ ID NO: 105886 - DNA, 1884 bp, Artificial Sequence; identical to SEQ ID NO: 105885
  Description of Artificial Sequence: Synthetic coding sequence

SEQ ID NO: 105887 - DNA, 1650 bp, Artificial Sequence
  Description of Artificial Sequence: Synthetic coding sequence
atgctggagaactacaagaacctggccaccgtgggctaccagctgttcaagcccagcctgatcagctggctggagcaggaggagagcagaaccgtgcagagaggcgacttccaggccagcgagtggaaggtgcagctgaagaccaaggagctggccctgcagcaggacgtgctgggcgagcccaccagcagcggcatccagatgatcggcagccacaacggcggcgaggtgagcgacgtgaagcagtgcggcgacgtgagcagcgagcacagctgcctgaagacccacgtgagaacccagaacagcgagaacaccttcgagtgctacctgtacggcgtggacttcctgaccctgcacaagaagaccagcaccggcgagcagagaagcgtgttcagccagtgcggcaaggccttcagcctgaaccccgacgtggtgtgccagagaacctgcaccggcgagaaggccttcgactgcagcgacagcggcaagagcttcatcaaccacagccacctgcagggccacctgagaacccacaacggcgagagcctgcacgagtggaaggagtgcggcagaggcttcatccacagcaccgacctggccgtgagaatccagacccacagaagcgagaagccctacaagtgcaaggagtgcggcaagggcttcagatacagcgcctacctgaacatccacatgggcacccacaccggcgacaacccctacgagtgcaaggagtgcggcaaggccttcaccagaagctgccagctgacccagcacagaaagacccacaccggcgagaagccctacaagtgcaaggactgcggcagagccttcaccgtgagcagctgcctgagccagcacatgaagatccacgtgggcgagaagccctacgagtgcaaggagtgcggcatcgccttcaccagaagcagccagctgaccgagcacctgaagacccacaccgccaaggaccccttcgagtgcaagatctgcggcaagagcttcagaaacagcagctgcctgagcgaccacttcagaatccacaccggcatcaagccctacaagtgcaaggactgcggcaaggccttcacccagaacagcgacctgaccaagcacgccagaacccacagcggcgagagaccctacgagtgcaaggagtgcggcaaggccttcgccagaagcagcagactgagcgagcacaccagaacccacaccggcgagaagcccttcgagtgcgtgaagtgcggcaaggccttcgccatcagcagcaacctgagcggccacctgagaatccacaccggcgagaagcccttcgagtgcctggagtgcggcaaggccttcacccacagcagcagcctgaacaaccacatgagaacccacagcgccaagaagcccttcacctgcatggagtgcggcaaggccttcaagttccccacctgcgtgaacctgcacatgagaatccacaccggcgagaagccctacaagtgcaagcagtgcggcaagagcttcagctacagcaacagcttccagctgcacgagagaacccacaccggcgagaagccctacgagtgcaaggagtgcggcaaggccttcagcagcagcagcagcttcagaaaccacgagagaagacacgccgacgagagactgagcgcctag

SEQ ID NO: 105888 - DNA, 1650 bp, Artificial Sequence; identical to SEQ ID NO: 105887
  Description of Artificial Sequence: Synthetic coding sequence

SEQ ID NO: 105889 - DNA, 1650 bp, Artificial Sequence; identical to SEQ ID NO: 105887
  Description of Artificial Sequence: Synthetic coding sequence

SEQ ID NO: 105890 - DNA, 2232 bp, Artificial Sequence
  Description of Artificial Sequence: Synthetic coding sequence
atgggcctgctgaccttcagagacgtggccgtggagttcagcctggaggagtgggagcacctggagcccgcccagaagaacctgtaccaggacgtgatgctggagaactacagaaacctggtgagcctgggcctggtggtgagcaagcccgacctgatcaccttcctggagcagagaaaggagccctggaacgtgaagagcgaggagaccgtggccatccagcccgacgtgttcagccactacaacaaggacctgctgaccgagcactgcaccgaggccagcttccagaaggtgatcagcagaagacacggcagctgcgacctggagaacctgcacctgagaaagagatggaagagagaggagtgcgagggccacaacggctgctacgacgagaagaccttcaagtacgaccagttcgacgagagcagcgtggagagcctgttccaccagcagatcctgagcagctgcgccaagagctacaacttcgaccagtacagaaaggtgttcacccacagcagcctgctgaaccagcaggaggagatcgacatctggggcaagcaccacatctacgacaagaccagcgtgctgttcagacaggtgagcaccctgaacagctacagaaacgtgttcatcggcgagaagaactaccactgcaacaacagcgagaagaccctgaaccagagcagcagccccaagaaccaccaggagaactacttcctggagaagcagtacaagtgcaaggagttcgaggaggtgttcctgcagagcatgcacggccaggagaagcaggagcagagctacaagtgcaacaagtgcgtggaggtgtgcacccagagcctgaagcacatccagcaccagaccatccacatcagagagaacagctacagctacaacaagtacgacaaggacctgagccagagcagcaacctgagaaagcagatcatccacaacgaggagaagccctacaagtgcgagaagtgcggcgacagcctgaaccacagcctgcacctgacccagcaccagatcatccccaccgaggagaagccctgcaagtggaaggagtgcggcaaggtgttcaacctgaactgcagcctgtacctgaccaagcagcagcagatcgacaccggcgagaacctgtacaagtgcaaggcctgcagcaagagcttcaccagaagcagcaacctgatcgtgcaccagagaatccacaccggcgagaagccctacaagtgcaaggagtgcggcaaggccttcagatgcagcagctacctgaccaagcacaagagaatccacaccggcgagaagccctacaagtgcaaggagtgcggcaaggccttcaacagaagcagctgcctgacccagcaccagaccacccacaccggcgagaagctgtacaagtgcaaggtgtgcagcaagagctacgccagaagcagcaacctgatcatgcaccagagagtgcacaccggcgagaagccctacaagtgcaaggagtgcggcaaggtgttcagcagaagcagctgcctgacccagcacagaaagatccacaccggcgagaacctgtacaagtgcaaggtgtgcgccaagcccttcacctgcttcagcaacctgatcgtgcacgagagaatccacaccggcgagaagccctacaagtgcaaggagtgcggcaaggccttcccctacagcagccacctgatcagacaccacagaatccacaccggcgagaagccctacaagtgcaaggcctgcagcaagagcttcagcgacagcagcggcctgaccgtgcacagaagaacccacaccggcgagaagccctacacctgcaaggagtgcggcaaggccttcagctacagcagcgacgtgatccagcacagaagaatccacaccggccagagaccctacaagtgcgaggagtgcggcaaggccttcaactacagaagctacctgaccacccaccagagaagccacaccggcgagagaccctacaagtgcgaggagtgcggcaaggccttcaacagcagaagctacctgaccacccacagaagaagacacaccggcgagagaccctacaagtgcgacgagtgcggcaaggccttcagctacagaagctacctgaccacccacagaagaagccacagcggcgagagaccctacaagtgcgaggagtgcggcaaggccttcaacagcagaagctacctgatcgcccaccagagaagccacaccagagagaagctgtag

SEQ ID NO: 105891 - DNA, 840 bp, Artificial Sequence
  Description of Artificial Sequence: Synthetic coding sequence
atgggcctgctgaccttcagagacgtggccgtggagttcagcctggaggagtgggagcacctggagcccgcccagaagaacctgtaccaggacgtgatgctggagaactacagaaacctggtgagcctgggcctggtggtgagcaagcccgacctgctgaccgagcactgcaccgaggccagcttccagaaggtgatcagcagaagacacggcagctgcgacctggagaacctgcacctgagaaagagatggaagagagaggagtgcgagggccacaacggctgctacgacgagaagaccttcaagtacgaccagttcgacgagagcagcgtggagagcctgttccaccagcagatcctgagcagctgcgccaagagctacaacttcgaccagtacagaaaggtgttcacccacagcagcctgctgaaccagcaggaggagatcgacatctggggcaagcaccacatctacgacaagaccagcgtgctgttcagacaggtgagcaccctgaacagctacagaaacgtgttcatcggcgagaagaactaccactgcaacaacagcgagaagaccctgaaccagagcagcagccccaagaaccaccaggagaactacttcctggagaagcagtacaagtgcaaggagttcgaggaggtgttcctgcagagcatgcacggccaggagaagcaggagcagagctacaagtgcaacaagtgcgtggaggtgtgcacccagagcctgaagcacatccagcaccagaccatccacatcagagagaacagctacagctacaacaagtacgacaaggacctgagccagagcagcaacctgagaaagtag

SEQ ID NO: 105892 - DNA, 2892 bp, Artificial Sequence
  Description of Artificial Sequence: Synthetic coding sequence
atggccaccgccgccgagaccagcgccagcgagcccgaggccgagagcaaggccggccccaaggccgacggcgaggaggacgaggtgaaggccgccagaaccagaagaaaggtgctgagcagagccgtggccgccgccacctacaagaccatgggccccgcctgggaccagcaggaggagggcgtgagcgagagcgacggcgacgagtacgccatggccagcagcgccgagagcagccccggcgagtacgagtgggagtacgacgaggaggaggagaagaaccagctggagatcgagagactggaggagcagctgagcatcaacgtgtacgactacaactgccacgtggacctgatcagactgctgagactggagggcgagctgaccaaggtgagaatggccagacagaagatgagcgagatcttccccctgaccgaggagctgtggctggagtggctgcacgacgagatcagcatggcccaggacggcctggacagagagcacgtgtacgacctgttcgagaaggccgtgaaggactacatctgccccaacatctggctggagtacggccagtacagcgtgggcggcatcggccagaagggcggcctggagaaggtgagaagcgtgttcgagagagccctgagcagcgtgggcctgcacatgaccaagggcctggccctgtgggaggcctacagagagttcgagagcgccatcgtggaggccgccagactggagaaggtgcacagcctgttcagaagacagctggccatccccctgtacgacatggaggccaccttcgccgagtacgaggagtggagcgaggaccccatccccgagagcgtgatccagaactacaacaaggccctgcagcagctggagaagtacaagccctacgaggaggccctgctgcaggccgaggcccccagactggccgagtaccaggcctacatcgacttcgagatgaagatcggcgaccccgccagaatccagctgatcttcgagagagccctggtggagaactgcctggtgcccgacctgtggatcagatacagccagtacctggacagacagctgaaggtgaaggacctggtgctgagcgtgcacaacagagccatcagaaactgcccctggaccgtggccctgtggagcagatacctgctggccatggagagacacggcgtggaccaccaggtgatcagcgtgaccttcgagaaggccctgaacgccggcttcatccaggccaccgactacgtggagatctggcaggcctacctggactacctgagaagaagagtggacttcaagcaggacagcagcaaggagctggaggagctgagagccgccttcaccagagccctggagtacctgaagcaggaggtggaggagagattcaacgagagcggcgaccccagctgcgtgatcatgcagaactgggccagaatcgaggccagactgtgcaacaacatgcagaaggccagagagctgtgggacagcatcatgaccagaggcaacgccaagtacgccaacatgtggctggagtactacaacctggagagagcccacggcgacacccagcactgcagaaaggccctgcacagagccgtgcagtgcaccagcgactaccccgagcacgtgtgcgaggtgctgctgaccatggagagaaccgagggcagcctggaggactgggacatcgccgtgcagaagaccgagaccagactggccagagtgaacgagcagagaatgaaggccgccgagaaggaggccgccctggtgcagcaggaggaggagaaggccgagcagagaaagagagccagagccgagaagaaggccctgaagaagaagaagaagatcagaggccccgagaagagaggcgccgacgaggacgacgagaaggagtggggcgacgacgaggaggagcagcccagcaagagaagaagagtggagaacagcatccccgccgccggcgagacccagaacgtggaggtggccgccggccccgccggcaagtgcgccgccgtggacgtggagccccccagcaagcagaaggagaaggccgccagcctgaagagagacatgcccaaggtgctgcacgacagcagcaaggacagcatcaccgtgttcgtgagcaacctgccctacagcatgcaggagcccgacaccaagctgagacccctgttcgaggcctgcggcgaggtggtgcagatcagacccatcttcagcaacagaggcgacttcagaggctactgctacgtggagttcaaggaggagaagagcgccctgcaggccctggagatggacagaaagagcgtggagggcagacccatgttcgtgagcccctgcgtggacaagagcaagaaccccgacttcaaggtgttcagatacagcaccagcctggagaagcacaagctgttcatcagcggcctgcccttcagctgcaccaaggaggagctggaggagatctgcaaggcccacggcaccgtgaaggacctgagactggtgaccaacagagccggcaagcccaagggcctggcctacgtggagtacgagaacgagagccaggccagccaggccgtgatgaagatggacggcatgaccatcaaggagaacatcatcaaggtggccatcagcaaccccccccagagaaaggtgcccgagaagcccgagaccagaaaggcccccggcggccccatgctgctgccccagacctacggcgccagaggcaagggcagaacccagctgagcctgctgcccagagccctgcagagacccagcgccgccgccccccaggccgagaacggccccgccgccgcccccgccgtggccgcccccgccgccaccgaggcccccaagatgagcaacgccgacttcgccaagctgttcctgagaaagtag

SEQ ID NO: 105893 - DNA, 1077 bp, Artificial Sequence
  Description of Artificial Sequence: Synthetic coding sequence
atggacgccaagagcctgaccgcctggagcagaaccctggtgaccttcaaggacgtgttcgtggacttcaccagagaggagtggaagctgctggacaccgcccagcagatcgtgtacagaaacgtgatgctggagaactacaagaacctggtgagcctgggctaccagctgaccaagcccgacgtgatcctgagactggagaagggcgaggagccctggctggtggagagagagatccaccaggagacccaccccgacagcgagaccgccttcgagatcaagagcagcgtgagcagcagaagcatcttcaaggacaagcagagctgcgacatcaagatggagggcatggccagaaacgacctgtggtacctgagcctggaggaggtgtggaagtgcagagaccagctggacaagtaccaggagaaccccgagagacacctgagcatccccagagtgctgagcctgcccgccagacacaccaagctgaccgtgggcatggccaccagagtgagaaccgccagcatctgggtgccccccctgcaggagagaaacagcagctgggacagaatcagaaagctgcagggccaggagagcatcctgggccagggcacccccggcctgcagcccctgcccggcacccccagacagaagcagaagagcagaagaatcgagaaggtgctggagtggctgttcatcagccaggagcagcccaagatcaccaagagctggggccccctgagcttcatggacgtgttcgtggacttcacctgggaggagtggcagctgctggaccccgcccagaagtgcctgtacagaagcgtgatgctggagaactacagcaacctggtgagcctgggctaccagcacaccaagcccgacatcatcttcaagctggagcagggcgaggagctgtgcatggtgcaggcccaggtgcccaaccagacctgccccatcctgaaggccggcaagagcaaggccaaggtgctggccggcctggtgagcggcgagggcctgctgtgcgccagcaagatgaccccctgctgctgcatcctgtggagacacagcctggagaactag

SEQ ID NO: 105894 - DNA, 504 bp, Artificial Sequence
  Description of Artificial Sequence: Synthetic coding sequence
atggccaccagagtgagaaccgccagcatctgggtgccccccctgcaggagagaaacagcagctgggacagaatcagaaagctgcagggccaggagagcatcctgggccagggcacccccggcctgcagcccctgcccggcacccccagacagaagcagaagagcagaagaatcgagaaggtgctggagtggctgttcatcagccaggagcagcccaagatcaccaagagctggggcaccaacacccccaacctgatcagcagcagcagctggaacaaggagaagagctgcgtgtggtgcagacccaagttccagatcagacccgtgcagacccagagcggcaagctgatgatcctgtggatcggcatcagaaagatcaagaccagctgggaggtgagacagaaggccctgaacgccctgcacctggagaactacgtgttcctggtgcagagcatcttccaggacaagaacctgatcaacgtggccagaatggagagagtgtag

SEQ ID NO: 105895 - DNA, 2361 bp, Artificial Sequence
  Description of Artificial Sequence: Synthetic coding sequence
atggactggcaccaggagaacaaggacaagctgggcagcaccgccaagagcttcgagtgcaccaccttcggcaagctgtgcctgctgagcaccaagtacctgagcagacagaagccccacaagtgcggcacccacggcaagagcctgaagtacatcgacttcaccagcgactacgccagaaacaaccccaacggcttccaggtgcacggcaagagcttcttccacagcaagcacgagcagaccgtgatcggcatcaagtactgcgagagcatcgagagcggcaagaccgtgaacaagaagagccagctgatgtgccagcagatgtacatgggcgagaagcccttcggctgcagctgctgcgagaaggccttcagcagcaagagctacctgctggtgcaccagcagacccacgccgaggagaagccctacggctgcaacgagtgcggcaaggacttcagcagcaagagctacctgatcgtgcaccagagaatccacaccggcgagaagctgcacgagtgcagcgagtgcagaaagaccttcagcttccacagccagctggtgatccaccagagaatccacaccggcgagaacccctacgagtgctgcgagtgcggcaaggtgttcagcagaaaggaccagctggtgagccaccagaagacccacagcggccagaagccctacgtgtgcaacgagtgcggcaaggccttcggcctgaagagccagctgatcatccacgagagaatccacaccggcgagaagccctacgagtgcaacgagtgccagaaggccttcaacaccaagagcaacctgatggtgcaccagagaacccacaccggcgagaagccctacgtgtgcagcgactgcggcaaggccttcaccttcaagagccagctgatcgtgcaccagggcatccacaccggcgtgaagccctacggctgcatccagtgcggcaagggcttcagcctgaagagccagctgatcgtgcaccagagaagccacaccggcatgaagccctacgtgtgcaacgagtgcggcaaggccttcagaagcaagagctacctgatcatccacaccagaacccacaccggcgagaagctgcacgagtgcaacaactgcggcaaggccttcagcttcaagagccagctgatcatccaccagagaatccacaccggcgagaacccctacgagtgccacgagtgcggcaaggccttcagcagaaagtaccagctgatcagccaccagagaacccacgccggcgagaagccctacgagtgcaccgactgcggcaaggccttcggcctgaagagccagctgatcatccaccagagaacccacaccggcgagaagcccttcgagtgcagcgagtgccagaaggccttcaacaccaagagcaacctgatcgtgcaccagagaacccacaccggcgagaagccctacagctgcaacgagtgcggcaaggccttcaccttcaagagccagctgatcgtgcacaagggcgtgcacaccggcgtgaagccctacggctgcagccagtgcgccaagaccttcagcctgaagagccagctgatcgtgcaccagagaagccacaccggcgtgaagccctacggctgcagcgagtgcggcaaggccttcagaagcaagagctacctgatcatccacatgagaacccacaccggcgagaagccccacgagtgcagagagtgcggcaagagcttcagcttcaacagccagctgatcgtgcaccagagaatccacaccggcgagaacccctacgagtgcagcgagtgcggcaaggccttcaacagaaaggaccagctgatcagccaccagagaacccacgccggcgagaagccctacggctgcagcgagtgcggcaaggccttcagcagcaagagctacctgatcatccacatgagaacccacagcggcgagaagccctacgagtgcaacgagtgcggcaaggccttcatctggaagagcctgctgatcgtgcacgagagaacccacgccggcgtgaacccctacaagtgcagccagtgcgagaagagcttcagcggcaagctgagactgctggtgcaccagagaatgcacaccagagagaagccctacgagtgcagcgagtgcggcaaggccttcatcagaaacagccagctgatcgtgcaccagagaacccacagcggcgagaagccctacggctgcaacgagtgcggcaagaccttcagccagaagagcatcctgagcgcccaccagagaacccacaccggcgagaagccctgcaagtgcaccgagtgcggcaaggccttctgctggaagagccagctgatcatgcaccagagaacccacgtggacgacaagcactag

SEQ ID NO: 105896 - DNA, 2844 bp, Artificial Sequence; identical to SEQ ID NO: 97572
  Description of Artificial Sequence: Synthetic coding sequence

SEQ ID NO: 105897 - DNA, 2193 bp, Artificial Sequence
  Description of Artificial Sequence: Synthetic coding sequence
atggactggcaccaggagaacaaggacaagctgggcagcaccgccaagagcttcgagtgcaccaccttcggcaagctgtgcctgctgagcaccaagtacctgagcagacagaagccccacaagtgcggcacccacggcaagagcctgaagtacatcgacttcaccagcgactacgccagaaacaaccccaacggcttccaggtgcacggcaagagcttcttccacagcaagcacgagcagaccgtgatcggcatcaagtactgcgagagcatcgagagcggcaagaccgtgaacaagaagagccagctgatgtgccagcagatgtacatgggcgagaagcccttcggctgcagctgctgcgagaaggccttcagcagcaagagctacctgctggtgcaccagcagacccacgccgaggagaagccctacggctgcaacgagtgcggcaaggacttcagcagcaagagctacctgatcgtgcaccagagaatccacaccggcgagaagctgcacgagtgcagcgagtgcagaaagaccttcagcttccacagccagctggtgatccaccagagaatccacaccggcgagaacccctacgagtgctgcgagtgcggcaaggtgttcagcagaaaggaccagctggtgagccaccagaagacccacagcggccagaagccctacgtgtgcaacgagtgcggcaaggccttcggcctgaagagccagctgatcatccacgagagaatccacaccggcgagaagccctacgagtgcaacgagtgccagaaggccttcaacaccaagagcaacctgatggtgcaccagagaacccacaccggcgagaagccctacgtgtgcagcgactgcggcaaggccttcaccttcaagagccagctgatcgtgcaccagggcatccacaccggcgtgaagccctacggctgcatccagtgcggcaagggcttcagcctgaagagccagctgatcgtgcaccagagaagccacaccggcatgaagccctacgtgtgcaacgagtgcggcaaggccttcagaagcaagagctacctgatcatccacaccagaacccacaccggcgagaagctgcacgagtgcaacaactgcggcaaggccttcagcttcaagagccagctgatcatccaccagagaatccacaccggcgagaacccctacgagtgccacgagtgcggcaaggccttcagcagaaagtaccagctgatcagccaccagagaacccacgccggcgagaagccctacgagtgcaccgactgcggcaaggccttcggcctgaagagccagctgatcatccaccagagaacccacaccggcgagaagcccttcgagtgcagcgagtgccagaaggccttcaacaccaagagcaacctgatcgtgcaccagagaacccacaccggcgagaagccctacagctgcaacgagtgcggcaaggccttcaccttcaagagccagctgatcgtgcacaagggcgtgcacaccggcgtgaagccctacggctgcagccagtgcgccaagaccttcagcctgaagagccagctgatcgtgcaccagagaagccacaccggcgtgaagccctacggctgcagcgagtgcggcaaggccttcagaagcaagagctacctgatcatccacatgagaacccacaccggcgagaagccccacgagtgcagagagtgcggcaagagcttcagcttcaacagccagctgatcgtgcaccagagaatccacaccggcgagaacccctacgagtgcagcgagtgcggcaaggccttcaacagaaaggaccagctgatcagccaccagagaacccacgccggcgagaagccctacggctgcagcgagtgcggcaaggccttcagcagcaagagctacctgatcatccacatgagaacccacagcggcgagaagccctacgagtgcaacgagtgcggcaaggccttcatctggaagagcctgctgatcgtgcacgagagaacccacgccggcgtgaacccctacaagtgcagccagtgcgagaagagcttcagcggcaagctgagactgctggtgcaccagagaatgcacaccagagagaagccctacgagtgcaccgagtgcggcaaggccttctgctggaagagccagctgatcatgcaccagagaacccacgtggacgacaagcactag

SEQ ID NO: 105898 - DNA, 303 bp, Artificial Sequence
  Description of Artificial Sequence: Synthetic coding sequence
atggccaccagagtgagaaccgccagcatctggggcaccaacacccccaacctgatcagcagcagcagctggaacaaggagaagagctgcgtgtggtgcagacccaagttccagatcagacccgtgcagacccagagcggcaagctgatgatcctgtggatcggcatcagaaagatcaagaccagctgggaggtgagacagaaggccctgaacgccctgcacctggagaactacgtgttcctggtgcagagcatcttccaggacaagaacctgatcaacgtggccagaatggagagagtgtag

SEQ ID NO: 105899 - DNA, 381 bp, Artificial Sequence
  Description of Artificial Sequence: Synthetic coding sequence
atggccaccagagtgagaaccgccagcatctggggccccctgagcttcatggacgtgttcgtggacttcacctgggaggagtggcagctgctggaccccgcccagaagtgcctgtacagaagcgtgatgctggagaactacagcaacctggtgagcctgggctaccagcacaccaagcccgacatcatcttcaagctggagcagggcgaggagctgtgcatggtgcaggcccaggtgcccaaccagacctgccccatcctgaaggccggcaagagcaaggccaaggtgctggccggcctggtgagcggcgagggcctgctgtgcgccagcaagatgaccccctgctgctgcatcctgtggagacacagcctggagaactag

SEQ ID NO: 105900 - DNA, 207 bp, Artificial Sequence
  Description of Artificial Sequence: Synthetic coding sequence
atggccaccagagtgagaaccgccagcatctggacccagagcggcaagctgatgatcctgtggatcggcatcagaaagatcaagaccagctgggaggtgagacagaaggccctgaacgccctgcacctggagaactacgtgttcctggtgcagagcatcttccaggacaagaacctgatcaacgtggccagaatggagagagtgtag

SEQ ID NO: 105901 - DNA, 504 bp, Artificial Sequence; identical to SEQ ID NO: 105894
  Description of Artificial Sequence: Synthetic coding sequence

SEQ ID NO: 105902 - DNA, 381 bp, Artificial Sequence; identical to SEQ ID NO: 105899
  Description of Artificial Sequence: Synthetic coding sequence

SEQ ID NO: 105903 - DNA, 1959 bp, Artificial Sequence
  Description of Artificial Sequence: Synthetic coding sequence
atggccagcagactgcccaccgcctggagctgcgagcccgtgaccttcgaggacgtgaccctgggcttcacccccgaggagtggggcctgctggacctgaagcagaagagcctgtacagagaggtgatgctggagaactacagaaacctggtgagcgtggagcaccagctgagcaagcccgacgtggtgagccagctggaggaggccgaggacttctggcccgtggagagaggcatcccccaggacaccatccccgagtaccccgagctgcagctggaccccaagctggaccccctgcccgccgagagccccctgatgaacatcgaggtggtggaggtgctgaccctgaaccaggaggtggccggccccagaaacgcccagatccaggccctgtacgccgaggacggcagcctgagcgccgacgcccccagcgagcaggtgcagcagcagggcaagcaccccggcgaccccgaggccgccagacagagattcagacagttcagatacaaggacatgaccggccccagagagctggaccagctgagagagctgtgccaccagtggctgcagcccaaggccagaagcaaggagcagatcctggagctgctggtgctggagcagttcctgggcgccctgcccgtgaagctgagaacctgggtggagagccagcaccccgagaactgccaggaggtggtggccctggtggagggcgtgacctggatgagcgaggaggaggtgctgcccgccggccagcccgccgagggcaccacctgctgcctggaggtgaccgcccagcaggaggagaagcaggaggacgccgccatctgccccgtgaccgtgctgcccgaggagcccgtgaccttccaggacgtggccgtggacttcagcagagaggagtggggcctgctgggccccacccagagaaccgagtacagagacgtgatgctggagaccttcggccacctggtgagcgtgggctgggagaccaccctggagaacaaggagctggcccccaacagcgacatccccgaggaggagcccgcccccagcctgaaggtgcaggagagcagcagagactgcgccctgagcagcaccctggaggacaccctgcagggcggcgtgcaggaggtgcaggacaccgtgctgaagcagatggagagcgcccaggagaaggacctgccccagaagaagcacttcgacaacagagagagccaggccaacagcggcgccctggacaccaaccaggtgagcctgcagaagatcgacaaccccgagagccaggccaacagcggcgccctggacaccaaccaggtgctgctgcacaagatcccccccagaaagagactgagaaagagagacagccaggtgaagagcatgaagcacaacagcagagtgaagatccaccagaagagctgcgagagacagaaggccaaggagggcaacggctgcagaaagaccttcagcagaagcaccaagcagatcaccttcatcagaatccacaagggcagccaggtgtgcagatgcagcgagtgcggcaagatcttcagaaaccccagatacttcagcgtgcacaagaagatccacaccggcgagagaccctacgtgtgccaggactgcggcaagggcttcgtgcagagcagcagcctgacccagcaccagagagtgcacagcggcgagagacccttcgagtgccaggagtgcggcagaaccttcaacgacagaagcgccatcagccagcacctgagaacccacaccggcgccaagccctacaagtgccaggactgcggcaaggccttcagacagagcagccacctgatcagacaccagagaacccacaccggcgagagaccctacgcctgcaacaagtgcggcaaggccttcacccagagcagccacctgatcggccaccagagaacccacaacagaaccaagagaaagaagaagcagcccaccagctag

SEQ ID NO: 105904 - DNA, 1863 bp, Artificial Sequence
  Description of Artificial Sequence: Synthetic coding sequence
atggccagcagactgcccaccgcctggagctgcgagcccgtgaccttcgaggacgtgaccctgggcttcacccccgaggagtggggcctgctggacctgaagcagaagagcctgtacagagaggtgatgctggagaactacagaaacctggtgagcgtggagtaccccgagctgcagctggaccccaagctggaccccctgcccgccgagagccccctgatgaacatcgaggtggtggaggtgctgaccctgaaccaggaggtggccggccccagaaacgcccagatccaggccctgtacgccgaggacggcagcctgagcgccgacgcccccagcgagcaggtgcagcagcagggcaagcaccccggcgaccccgaggccgccagacagagattcagacagttcagatacaaggacatgaccggccccagagagctggaccagctgagagagctgtgccaccagtggctgcagcccaaggccagaagcaaggagcagatcctggagctgctggtgctggagcagttcctgggcgccctgcccgtgaagctgagaacctgggtggagagccagcaccccgagaactgccaggaggtggtggccctggtggagggcgtgacctggatgagcgaggaggaggtgctgcccgccggccagcccgccgagggcaccacctgctgcctggaggtgaccgcccagcaggaggagaagcaggaggacgccgccatctgccccgtgaccgtgctgcccgaggagcccgtgaccttccaggacgtggccgtggacttcagcagagaggagtggggcctgctgggccccacccagagaaccgagtacagagacgtgatgctggagaccttcggccacctggtgagcgtgggctgggagaccaccctggagaacaaggagctggcccccaacagcgacatccccgaggaggagcccgcccccagcctgaaggtgcaggagagcagcagagactgcgccctgagcagcaccctggaggacaccctgcagggcggcgtgcaggaggtgcaggacaccgtgctgaagcagatggagagcgcccaggagaaggacctgccccagaagaagcacttcgacaacagagagagccaggccaacagcggcgccctggacaccaaccaggtgagcctgcagaagatcgacaaccccgagagccaggccaacagcggcgccctggacaccaaccaggtgctgctgcacaagatcccccccagaaagagactgagaaagagagacagccaggtgaagagcatgaagcacaacagcagagtgaagatccaccagaagagctgcgagagacagaaggccaaggagggcaacggctgcagaaagaccttcagcagaagcaccaagcagatcaccttcatcagaatccacaagggcagccaggtgtgcagatgcagcgagtgcggcaagatcttcagaaaccccagatacttcagcgtgcacaagaagatccacaccggcgagagaccctacgtgtgccaggactgcggcaagggcttcgtgcagagcagcagcctgacccagcaccagagagtgcacagcggcgagagacccttcgagtgccaggagtgcggcagaaccttcaacgacagaagcgccatcagccagcacctgagaacccacaccggcgccaagccctacaagtgccaggactgcggcaaggccttcagacagagcagccacctgatcagacaccagagaacccacaccggcgagagaccctacgcctgcaacaagtgcggcaaggccttcacccagagcagccacctgatcggccaccagagaacccacaacagaaccaagagaaagaagaagcagcccaccagctag

SEQ ID NO: 105905 - DNA, 1644 bp, Artificial Sequence
  Description of Artificial Sequence: Synthetic coding sequence
atgaacatcgaggtggtggaggtgctgaccctgaaccaggaggtggccggccccagaaacgcccagatccaggccctgtacgccgaggacggcagcctgagcgccgacgcccccagcgagcaggtgcagcagcagggcaagcaccccggcgaccccgaggccgccagacagagattcagacagttcagatacaaggacatgaccggccccagagagctggaccagctgagagagctgtgccaccagtggctgcagcccaaggccagaagcaaggagcagatcctggagctgctggtgctggagcagttcctgggcgccctgcccgtgaagctgagaacctgggtggagagccagcaccccgagaactgccaggaggtggtggccctggtggagggcgtgacctggatgagcgaggaggaggtgctgcccgccggccagcccgccgagggcaccacctgctgcctggaggtgaccgcccagcaggaggagaagcaggaggacgccgccatctgccccgtgaccgtgctgcccgaggagcccgtgaccttccaggacgtggccgtggacttcagcagagaggagtggggcctgctgggccccacccagagaaccgagtacagagacgtgatgctggagaccttcggccacctggtgagcgtgggctgggagaccaccctggagaacaaggagctggcccccaacagcgacatccccgaggaggagcccgcccccagcctgaaggtgcaggagagcagcagagactgcgccctgagcagcaccctggaggacaccctgcagggcggcgtgcaggaggtgcaggacaccgtgctgaagcagatggagagcgcccaggagaaggacctgccccagaagaagcacttcgacaacagagagagccaggccaacagcggcgccctggacaccaaccaggtgagcctgcagaagatcgacaaccccgagagccaggccaacagcggcgccctggacaccaaccaggtgctgctgcacaagatcccccccagaaagagactgagaaagagagacagccaggtgaagagcatgaagcacaacagcagagtgaagatccaccagaagagctgcgagagacagaaggccaaggagggcaacggctgcagaaagaccttcagcagaagcaccaagcagatcaccttcatcagaatccacaagggcagccaggtgtgcagatgcagcgagtgcggcaagatcttcagaaaccccagatacttcagcgtgcacaagaagatccacaccggcgagagaccctacgtgtgccaggactgcggcaagggcttcgtgcagagcagcagcctgacccagcaccagagagtgcacagcggcgagagacccttcgagtgccaggagtgcggcagaaccttcaacgacagaagcgccatcagccagcacctgagaacccacaccggcgccaagccctacaagtgccaggactgcggcaaggccttcagacagagcagccacctgatcagacaccagagaacccacaccggcgagagaccctacgcctgcaacaagtgcggcaaggccttcacccagagcagccacctgatcggccaccagagaacccacaacagaaccaagagaaagaagaagcagcccaccagctag

SEQ ID NO: 105906 - DNA, 1353 bp, Artificial Sequence
  Description of Artificial Sequence: Synthetic coding sequence
atggccgccagcaagacccagggcgccgtggccagaatgcaggaggacagagacggcagctgcagcaccgtgggcggcgtgggctacggcgacagcaaggactgcatcctggagcccctgagcctgcccgagagccccggcggcaccaccaccctggagggcagccccagcgtgccctgcatcttctgcgaggagcacttccccgtggccgagcaggacaagctgctgaagcacatgatcatcgagcacaagatcgtgatcgccgacgtgaagctggtggccgacttccagagatacatcctgtactggagaaagagattcaccgagcagcccatcaccgacttctgcagcgtgatcagaatcaacagcaccgcccccttcgaggagcaggagaactacttcctgctgtgcgacgtgctgcccgaggacagaatcctgagagaggagctgcagaagcagagactgagagagatcctggagcagcagcagcaggagagaaacgacaccaacttccacggcgtgtgcatgttctgcaacgaggagttcctgggcaacagaagcgtgatcctgaaccacatggccagagagcacgccttcaacatcggcctgcccgacaacatcgtgaactgcaacgagttcctgtgcaccctgcagaagaagctggacaacctgcagtgcctgtactgcgagaagaccttcagagacaagaacaccctgaaggaccacatgagaaagaagcagcacagaaagatcaaccccaagaacagagagtacgacagattctacgtgatcaactacctggagctgggcaagagctgggaggaggtgcagctggaggacgacagagagctgctggaccaccaggaggacgactggagcgactgggaggagcaccccgccagcgccgtgtgcctgttctgcgagaagcaggccgagaccatcgagaagctgtacgtgcacatggaggacgcccacgagttcgacctgctgaagatcaagagcgagctgggcctgaacttctaccagcaggtgaagctggtgaacttcatcagaagacaggtgcaccagtgcagatgctacggctgccacgtgaagttcaagagcaaggccgacctgagaacccacatggaggagaccaagcacaccagcctgctgcccgacagaaagacctgggaccagctggagtactacttccccacctacgagaacgacaccctgctgtgcaccctgagcgacagcgagagcgacctgaccgcccaggagcagaacgagaacgtgcccatcatcagcgaggacaccagcaagctgtacgccctgaagcagagcagcatcctgaaccagctgctgctgtag

SEQ ID NO: 105907 - DNA, 873 bp, Artificial Sequence
  Description of Artificial Sequence: Synthetic coding sequence
atggccgccagcaagacccagggcgccgtggccagaatgcaggaggacagagacggcagctgcagcaccgtgggcggcgtgggctacggcgacagcaaggactgcatcctggagcccctgagcctgcccgagagccccggcggcaccaccaccctggagggcagccccagcgtgccctgcatcttctgcgaggagcacttccccgtggccgagcaggacaagctgctgaagcacatgatcatcgagcacaagatcgtgatcgccgacgtgaagctggtggccgacttccagagatacatcctgtactggagaaagagattcaccgagcagcccatcaccgacttctgcagcgtgatcagaatcaacagcaccgcccccttcgaggagcaggagaactacttcctgctgtgcgacgtgctgcccgaggacagaatcctgagagaggagctgcagaagcagagactgagagagatcctggagcagcagcagcaggagagaaacgacaccaacttccacggcgtgtgcatgttctgcaacgaggagttcctgggcaacagaagcgtgatcctgaaccacatggccagagagcacgccttcaacatcggcctgcccgacaacatcgtgaactgcaacgagttcctgtgcaccctgcagaagaagctggacaacctgcagtgcctgtactgcgagaagaccttcagagacaagaacaccctgaaggaccacatgagaaagaagcagcacagaaagatcaaccccaagaacagagagtacgacagattctacgtgatcaactacctggtgagactgagcttccacaacctgaagttcgactgcagcaccgccaacaagatcttcctgagaaccaactag

SEQ ID NO: 105908 - DNA, 1428 bp, Artificial Sequence
  Description of Artificial Sequence: Synthetic coding sequence
atgagcagaagaaaggccggcagcgcccccagaagagtggagcccgcccccgccgccaaccccgacgacgagatggagatgcaggacctggtgatcgagctgaagcccgagcccgacgcccagccccagcaggcccccagactgggccccttcagccccaaggaggtgagcagcgccggcagattcggcggcgagccccaccacagccccggccccatgcccgccggcgccgccctgctggccctgggccccagaaacccctggaccctgtggacccccctgacccccaactaccccgacagacagccctggaccgacaagcaccccgacctgctgacctgcggcagatgcctgcagaccttccccctggaggccatcaccgccttcatggaccacaagaagctgggctgccagctgttcagaggccccagcagaggccagggcagcgagagagaggagctgaaggccctgagctgcctgagatgcggcaagcagttcaccgtggcctggaagctgctgagacacgcccagtgggaccacggcctgagcatctaccagaccgagagcgaggcccccgaggcccccctgctgggcctggccgaggtggccgccgccgtgagcgccgtggtgggccccgccgccgaggccaagagccccagagccagcggcagcggcctgaccagaagaagccccacctgccccgtgtgcaagaagaccctgagcagcttcagcaacctgaaggtgcacatgagaagccacaccggcgagagaccctacgcctgcgaccagtgcccctacgcctgcgcccagagcagcaagctgaacagacacaagaagacccacagacaggtgcccccccagagccccctgatggccgacaccagccaggagcaggccagcgccgccccccccgagcccgccgtgcacgccgccgcccccaccagcaccctgccctgcagcggcggcgagggcgccggcgccgccgccaccgccggcgtgcaggagcccggcgcccccggcagcggcgcccaggccggccccggcggcgacacctggggcgccatcaccaccgagcagagaaccgaccccgccaacagccagaaggccagccccaagaagatgcccaagagcggcggcaagagcagaggccccggcggcagctgcgagttctgcggcaagcacttcaccaacagcagcaacctgaccgtgcacagaagaagccacaccggcgagagaccctacacctgcgagttctgcaactacgcctgcgcccagagcagcaagctgaacagacacagaagaatgcacggcatgacccccggcagcaccagattcgagtgcccccactgccacgtgcccttcggcctgagagccaccctggacaagcacctgagacagaagcaccccgaggccgccggcgaggcctag

SEQ ID NO: 105909 - DNA, 1356 bp, Artificial Sequence
  Description of Artificial Sequence: Synthetic coding sequence
atggagatgcaggacctggtgatcgagctgaagcccgagcccgacgcccagccccagcaggcccccagactgggccccttcagccccaaggaggtgagcagcgccggcagattcggcggcgagccccaccacagccccggccccatgcccgccggcgccgccctgctggccctgggccccagaaacccctggaccctgtggacccccctgacccccaactaccccgacagacagccctggaccgacaagcaccccgacctgctgacctgcggcagatgcctgcagaccttccccctggaggccatcaccgccttcatggaccacaagaagctgggctgccagctgttcagaggccccagcagaggccagggcagcgagagagaggagctgaaggccctgagctgcctgagatgcggcaagcagttcaccgtggcctggaagctgctgagacacgcccagtgggaccacggcctgagcatctaccagaccgagagcgaggcccccgaggcccccctgctgggcctggccgaggtggccgccgccgtgagcgccgtggtgggccccgccgccgaggccaagagccccagagccagcggcagcggcctgaccagaagaagccccacctgccccgtgtgcaagaagaccctgagcagcttcagcaacctgaaggtgcacatgagaagccacaccggcgagagaccctacgcctgcgaccagtgcccctacgcctgcgcccagagcagcaagctgaacagacacaagaagacccacagacaggtgcccccccagagccccctgatggccgacaccagccaggagcaggccagcgccgccccccccgagcccgccgtgcacgccgccgcccccaccagcaccctgccctgcagcggcggcgagggcgccggcgccgccgccaccgccggcgtgcaggagcccggcgcccccggcagcggcgcccaggccggccccggcggcgacacctggggcgccatcaccaccgagcagagaaccgaccccgccaacagccagaaggccagccccaagaagatgcccaagagcggcggcaagagcagaggccccggcggcagctgcgagttctgcggcaagcacttcaccaacagcagcaacctgaccgtgcacagaagaagccacaccggcgagagaccctacacctgcgagttctgcaactacgcctgcgcccagagcagcaagctgaacagacacagaagaatgcacggcatgacccccggcagcaccagattcgagtgcccccactgccacgtgcccttcggcctgagagccaccctggacaagcacctgagacagaagcaccccgaggccgccggcgaggcctag

SEQ ID NO: 105910 - DNA, 1341 bp, Artificial Sequence
  Description of Artificial Sequence: Synthetic coding sequence
atggagacccaggccgacctggtgagccaggagccccaggccctgctggacagcgccctgcccagcaaggtgcccgccttcagcgacaaggacagcctgggcgacgagatgctggccgccgccctgctgaaggccaagagccaggagctggtgaccttcgaggacgtggccgtgtacttcatcagaaaggagtggaagagactggagcccgcccagagagacctgtacagagacgtgatgctggagaactacggcaacgtgttcagcctggacagagagaccagaaccgagaacgaccaggagatcagcgaggacaccagaagccacggcgtgctgctgggcagattccagaaggacatcagccagggcctgaagttcaaggaggcctacgagagagaggtgagcctgaagagacccctgggcaacagccccggcgagagactgaacagaaagatgcccgacttcggccaggtgaccgtggaggagaagctgacccccagaggcgagagaagcgagaagtacaacgacttcggcaacagcttcaccgtgaacagcaacctgatcagccaccagagactgcccgtgggcgacagaccccacaagtgcgacgagtgcagcaagagcttcaacagaaccagcgacctgatccagcaccagagaatccacaccggcgagaagccctacgagtgcaacgagtgcggcaaggccttcagccagagcagccacctgatccagcaccagagaatccacaccggcgagaagccctacgagtgcagcgactgcggcaagaccttcagctgcagcagcgccctgatcctgcacagaagaatccacaccggcgagaagccctacgagtgcaacgagtgcggcaagaccttcagctggagcagcaccctgacccaccaccagagaatccacaccggcgagaagccctacgcctgcaacgagtgcggcaaggccttcagcagaagcagcaccctgatccaccaccagagaatccacaccggcgagaagccctacgagtgcaacgagtgcggcaaggccttcagccagagcagccacctgtaccagcaccagagaatccacaccggcgagaagccctacgagtgcatggagtgcggcggcaagttcacctacagcagcggcctgatccagcaccagagaatccacaccggcgagaacccctacgagtgcagcgagtgcggcaaggccttcagatacagcagcgccctggtgagacaccagagaatccacaccggcgagaagcccctgaacggcatcggcatgagcaagagcagcctgagagtgaccaccgagctgaacatcagagagagcacctag

SEQ ID NO: 105911 - DNA, 1341 bp, Artificial Sequence; identical to SEQ ID NO: 105910
  Description of Artificial Sequence: Synthetic coding sequence

SEQ ID NO: 105912 - DNA, 396 bp, Artificial Sequence
  Description of Artificial Sequence: Synthetic coding sequence
atggagacccaggccgacctggtgagccaggagccccaggccctgctggacagcgccctgcccagcaaggtgcccgccttcagcgacaaggacagcctgggcgacgagatgctggccgccgccctgctgaaggccaagagccaggagctggtgaccttcgaggacgtggccgtgtacttcatcagaaaggagtggaagagactggagcccgcccagagagacctgtacagagacgtgatgctggagaactacggcaacgtgttcagcctggactggatccacgtgtgcctgaccacccagaaggtgatgctggcctggctgaccggcaccctgagcgtggccaagggcctgtgcagcagcgagctggccagcgtggagccccccgacaccttctag

SEQ ID NO: 105913 - DNA, 315 bp, Artificial Sequence
  Description of Artificial Sequence: Synthetic coding sequence
atggagacccaggccgacctggtgagccaggagccccaggccctgctggacagcgccctgcccagcaaggtgcccgccttcagcgacaaggacagcctgggcgacgagatgctggccgccgccctgctgaaggccaagagccaggagctggtgaccttcgaggacgtggccgtgtacttcatcagaaaggagtggaagagactggagcccgcccagagagacctgtacagagacgtgatgctggagaactacggcaacgtgttcagcctggacagagagaccagaaccgagaacgaccaggagatcagcgagtag

SEQ ID NO: 105914 - DNA, 1341 bp, Artificial Sequence; identical to SEQ ID NO: 105910
  Description of Artificial Sequence: Synthetic coding sequence

SEQ ID NO: 105915 - DNA, 558 bp, Artificial Sequence
  Description of Artificial Sequence: Synthetic coding sequence
atggagacccaggccgacctggtgagccaggagccccaggccctgctggacagcgccctgcccagcaaggtgcccgccttcagcgacaaggacagcctgggcgacgagatgctggccgccgccctgctgaaggccaagagccaggagctggtgaccttcgaggacgtggccgtgtacttcatcagaaaggagtggaagagactggagcccgcccagagagacctgtacagagacgtgatgctggagaactacggcaacgtgttcagcctggacagagagaccagaaccgagaacgaccaggagatcagcgaggacaccagaagccacggcgtgctgctgggcagattccagaaggacatcagccagggcctgaagttcaaggaggcctacgagagagaggtgagcctgaagagacccctgggcaacagccccggcgagagactgaacagaaagatgcccgacttcggccaggtgaccgtggaggagaagctgacccccagaggcgagagaagcgagaagtacaacgacttcggcaacagcttcaccgtgaacagctag

SEQ ID NO: 105916 - DNA, 558 bp, Artificial Sequence; identical to SEQ ID NO: 105915
  Description of Artificial Sequence: Synthetic coding sequence

SEQ ID NO: 105917 - DNA, 1509 bp, Artificial Sequence
  Description of Artificial Sequence: Synthetic coding sequence
atgggcaccgagaacaaggaggtgatccccaaggaggagatcagcgaggagagcgagccccacggcagcctgctggagaagttccccaaggtggtgtaccagggccacgagttcggcgccggctgcgaggaggacatgctggagggccacagcagagagagcatggaggaggtgatcgagcagatgagcccccaggagagagacttccccagcggcctgatgatcttcaagaagagccccagcagcgagaaggacagagagaacaacgagagcgagagaggctgcagccccagccccaacctggtgacccaccagggcgacaccaccgagggcgtgagcgccttcgccaccagcggccagaacttcctggagatcctggagagcaacaagacccagagaagcagcgtgggcgagaagccccacacctgcaaggagtgcggcaaggccttcaaccagaacagccacctgatccagcacatgagagtgcacagcggcgagaagcccttcgagtgcaaggagtgcggcaagaccttcggcaccaacagcagcctgagaagacacctgagaatccacgccggcgagaagcccttcgcctgcaacgagtgcggcaaggccttcatccagagcagccacctgatccaccaccacagaatccacaccggcgagagaccctacaagtgcgaggagtgcggcaaggccttcagccagaacagcgccctgatcctgcaccagagaatccacaccggcgagaagccctacgagtgcaacgagtgcggcaagaccttcagagtgagcagccagctgatccagcaccagagaatccacaccgaggagagataccacgagtgcaacgagtgcggcaaggccttcaagcacagcagcggcctgatcagacaccagaagatccacaccggcgagaagccctacctgtgcaacgagtgcggcaagggcttcggccagagcagcgagctgatcagacaccagagaatccacaccggcgacaagccctacgagtgcaacgagtgcggcaagaccttcggccagaacagcgagatcatcagacacatcagaatccacaccggcgagaagccctacgtgtgcaaggagtgcggcaaggccttcagaggcaacagcgagctgctgagacacgagagaatccacaccggcgagaagccctacgagtgcttcgagtgcggcaaggccttcagaagaaccagccacctgatcgtgcaccagagaatccacaccggcgagaagccccaccagtgcaacgagtgcgccagaaccttctgggacaacagcgagctgctgctgcaccagaagatccacatcggcgagaagccctacgagtgcagcgagtgcgagaagaccttcagccagcacagccagctgatcatccaccagagaatccacaccggcgagaagccctacgagtgccaggagtgccagaagaccttcagcagaagcagccacctgctgagacaccagagcgtgcactgcatggagtag

SEQ ID NO: 105918 - DNA, 1815 bp, Artificial Sequence
  Description of Artificial Sequence: Synthetic coding sequence
atgatgaagagccagggcctggtgagcttcaaggacgtggccgtggacttcacccaggaggagtggcagcagctggaccccagccagagaaccctgtacagagacgtgatgctggagaactacagccacctggtgagcatgggctaccccgtgagcaagcccgacgtgatcagcaagctggagcagggcgaggagccctggatcatcaagggcgacatcagcaactggatctaccccgacgagtaccaggccgacggcagacaggacagaaagagcaacctgcacaacagccagagctgcatcctgggcaccgtgagcttccaccacaagatcctgaagggcgtgaccagagacggcagcctgtgcagcatcctgaaggtgtgccagggcgacggccagctgcagagattcctggagaaccaggacaagctgttcagacaggtgaccttcgtgaacagcaagaccgtgaccgaggccagcggccacaagtacaaccccctgggcaagatcttccaggagtgcatcgagaccgacatcagcatccagagattccacaagtacgacgccttcaagaagaacctgaagcccaacatcgacctgcccagctgctacaagagcaacagcagaaagaagcccgaccagagcttcggcggcggcaagagcagcagccagagcgagcccaacagcaacctggagaagatccacaacggcgtgatccccttcgacgacaaccagtgcggcaacgtgttcagaaacacccagagcctgatccagtaccagaacgtggagaccaaggagaagagctgcgtgtgcgtgacctgcggcaaggccttcgccaagaagagccagctgatcgtgcaccagagaatccacaccggcaagaagccctacgactgcggcgcctgcggcaaggccttcagcgagaagttccacctggtggtgcaccagagaacccacaccggcgagaagccctacgactgcagcgagtgcggcaaggccttcagccagaagagcagcctgatcatccaccagagagtgcacaccggcgagaagccctacgagtgcagcgagtgcggcaaggccttcagccagaagagccccctgatcatccaccagagaatccacaccggcgagaagccctacgagtgcagagagtgcggcaaggccttcagccagaagagccagctgatcatccaccacagagcccacaccggcgagaagccctacgagtgcaccgagtgcggcaaggccttctgcgagaagagccacctgatcatccacaagagaatccacaccggcgagaagccctacaagtgcgcccagtgcgaggaggccttcagcagaaagaccgagctgatcacccaccagctggtgcacaccggcgagaagccctacgagtgcaccgagtgcggcaagaccttcagcagaaagagccagctgatcatccaccagagaacccacaccggcgagaagccctacaagtgcagcgagtgcggcaaggccttctgccagaagagccacctgatcggccaccagagaatccacaccggcgagaagccctacatctgcaccgagtgcggcaaggccttcagccagaagagccacctgcccggccaccagagaatccacaccggcgagaagccctacatctgcgccgagtgcggcaaggccttcagccagaagagcgacctggtgctgcaccagagaatccacaccggcgagagaccctaccagtgcgccatctgcggcaaggccttcatccagaagagccagctgaccgtgcaccagagaatccacaccgtggtgaagagctag

SEQ ID NO: 105919 - DNA, 1815 bp, Artificial Sequence
  Description of Artificial Sequence: Synthetic coding sequence
atgatgaagagccagggcctggtgagcttcaaggacgtggccgtggacttcacccaggaggagtggcagcagctggaccccagccagagaaccctgtacagagacgtgatgctggagaactacagccacctggtgagcatgggctaccccgtgagcaagcccgacgtgatcagcaagctggagcagggcgaggagccctggatcatcaagggcgacatcagcaactggatctaccccgacgagtaccaggccgacggcagacagggcaagaagagcaacctgcacaacagccagagctgcatcctgggcaccgtgagcttccaccacaagatcctgaagggcgtgaccagagacggcagcctgtgcagcatcctgaaggtgtgccagggcgacggccagctgcagagattcctggagaaccaggacaagctgttcagacaggtgaccttcgtgaacagcaagaccgtgaccgaggccagcggccacaagtacaaccccctgggcaagatcttccaggagtgcatcgagaccgacatcagcatccagagattccacaagtacgacgccttcaagaagaacctgaagcccaacatcgacctgcccagctgctacaagagcaacagcagaaagaagcccgaccagagcttcggcggcggcaagagcagcagccagagcgagcccaacagcaacctggagaagatccacaacggcgtgatccccttcgacgacaaccagtgcggcaacgtgttcagaaacacccagagcctgatccagtaccagaacgtggagaccaaggagaagagctgcgtgtgcgtgacctgcggcaaggccttcgccaagaagagccagctgatcgtgcaccagagaatccacaccggcaagaagccctacgactgcggcgcctgcggcaaggccttcagcgagaagttccacctggtggtgcaccagagaacccacaccggcgagaagccctacgactgcagcgagtgcggcaaggccttcagccagaagagcagcctgatcatccaccagagagtgcacaccggcgagaagccctacgagtgcagcgagtgcggcaaggccttcagccagaagagccccctgatcatccaccagagaatccacaccggcgagaagccctacgagtgcagagagtgcggcaaggccttcagccagaagagccagctgatcatccaccacagagcccacaccggcgagaagccctacgagtgcaccgagtgcggcaaggccttctgcgagaagagccacctgatcatccacaagagaatccacaccggcgagaagccctacaagtgcgcccagtgcgaggaggccttcagcagaaagaccgagctgatcacccaccagctggtgcacaccggcgagaagccctacgagtgcaccgagtgcggcaagaccttcagcagaaagagccagctgatcatccaccagagaacccacaccggcgagaagccctacaagtgcagcgagtgcggcaaggccttctgccagaagagccacctgatcggccaccagagaatccacaccggcgagaagccctacatctgcaccgagtgcggcaaggccttcagccagaagagccacctgcccggccaccagagaatccacaccggcgagaagccctacatctgcgccgagtgcggcaaggccttcagccagaagagcgacctggtgctgcaccagagaatccacaccggcgagagaccctaccagtgcgccatctgcggcaaggccttcatccagaagagccagctgaccgtgcaccagagaatccacaccgtggtgaagagctag

SEQ ID NO: 105920 - DNA, 1707 bp, Artificial Sequence
  Description of Artificial Sequence: Synthetic coding sequence
atgctggagaactacagccacctggtgagcatgggctaccccgtgagcaagcccgacgtgatcagcaagctggagcagggcgaggagccctggatcatcaagggcgacatcagcaactggatctaccccgacgagtaccaggccgacggcagacaggacagaaagagcaacctgcacaacagccagagctgcatcctgggcaccgtgagcttccaccacaagatcctgaagggcgtgaccagagacggcagcctgtgcagcatcctgaaggtgtgccagggcgacggccagctgcagagattcctggagaaccaggacaagctgttcagacaggtgaccttcgtgaacagcaagaccgtgaccgaggccagcggccacaagtacaaccccctgggcaagatcttccaggagtgcatcgagaccgacatcagcatccagagattccacaagtacgacgccttcaagaagaacctgaagcccaacatcgacctgcccagctgctacaagagcaacagcagaaagaagcccgaccagagcttcggcggcggcaagagcagcagccagagcgagcccaacagcaacctggagaagatccacaacggcgtgatccccttcgacgacaaccagtgcggcaacgtgttcagaaacacccagagcctgatccagtaccagaacgtggagaccaaggagaagagctgcgtgtgcgtgacctgcggcaaggccttcgccaagaagagccagctgatcgtgcaccagagaatccacaccggcaagaagccctacgactgcggcgcctgcggcaaggccttcagcgagaagttccacctggtggtgcaccagagaacccacaccggcgagaagccctacgactgcagcgagtgcggcaaggccttcagccagaagagcagcctgatcatccaccagagagtgcacaccggcgagaagccctacgagtgcagcgagtgcggcaaggccttcagccagaagagccccctgatcatccaccagagaatccacaccggcgagaagccctacgagtgcagagagtgcggcaaggccttcagccagaagagccagctgatcatccaccacagagcccacaccggcgagaagccctacgagtgcaccgagtgcggcaaggccttctgcgagaagagccacctgatcatccacaagagaatccacaccggcgagaagccctacaagtgcgcccagtgcgaggaggccttcagcagaaagaccgagctgatcacccaccagctggtgcacaccggcgagaagccctacgagtgcaccgagtgcggcaagaccttcagcagaaagagccagctgatcatccaccagagaacccacaccggcgagaagccctacaagtgcagcgagtgcggcaaggccttctgccagaagagccacctgatcggccaccagagaatccacaccggcgagaagccctacatctgcaccgagtgcggcaaggccttcagccagaagagccacctgcccggccaccagagaatccacaccggcgagaagccctacatctgcgccgagtgcggcaaggccttcagccagaagagcgacctggtgctgcaccagagaatccacaccggcgagagaccctaccagtgcgccatctgcggcaaggccttcatccagaagagccagctgaccgtgcaccagagaatccacaccgtggtgaagagctag

SEQ ID NO: 105921 - DNA, 1863 bp, Artificial Sequence
  Description of Artificial Sequence: Synthetic coding sequence
atggtgcccgccgagaccagcagcagcggcctgctggaggagcagaagatgatgaagagccagggcctggtgagcttcaaggacgtggccgtggacttcacccaggaggagtggcagcagctggaccccagccagagaaccctgtacagagacgtgatgctggagaactacagccacctggtgagcatgggctaccccgtgagcaagcccgacgtgatcagcaagctggagcagggcgaggagccctggatcatcaagggcgacatcagcaactggatctaccccgacgagtaccaggccgacggcagacaggacagaaagagcaacctgcacaacagccagagctgcatcctgggcaccgtgagcttccaccacaagatcctgaagggcgtgaccagagacggcagcctgtgcagcatcctgaaggtgtgccagggcgacggccagctgcagagattcctggagaaccaggacaagctgttcagacaggtgaccttcgtgaacagcaagaccgtgaccgaggccagcggccacaagtacaaccccctgggcaagatcttccaggagtgcatcgagaccgacatcagcatccagagattccacaagtacgacgccttcaagaagaacctgaagcccaacatcgacctgcccagctgctacaagagcaacagcagaaagaagcccgaccagagcttcggcggcggcaagagcagcagccagagcgagcccaacagcaacctggagaagatccacaacggcgtgatccccttcgacgacaaccagtgcggcaacgtgttcagaaacacccagagcctgatccagtaccagaacgtggagaccaaggagaagagctgcgtgtgcgtgacctgcggcaaggccttcgccaagaagagccagctgatcgtgcaccagagaatccacaccggcaagaagccctacgactgcggcgcctgcggcaaggccttcagcgagaagttccacctggtggtgcaccagagaacccacaccggcgagaagccctacgactgcagcgagtgcggcaaggccttcagccagaagagcagcctgatcatccaccagagagtgcacaccggcgagaagccctacgagtgcagcgagtgcggcaaggccttcagccagaagagccccctgatcatccaccagagaatccacaccggcgagaagccctacgagtgcagagagtgcggcaaggccttcagccagaagagccagctgatcatccaccacagagcccacaccggcgagaagccctacgagtgcaccgagtgcggcaaggccttctgcgagaagagccacctgatcatccacaagagaatccacaccggcgagaagccctacaagtgcgcccagtgcgaggaggccttcagcagaaagaccgagctgatcacccaccagctggtgcacaccggcgagaagccctacgagtgcaccgagtgcggcaagaccttcagcagaaagagccagctgatcatccaccagagaacccacaccggcgagaagccctacaagtgcagcgagtgcggcaaggccttctgccagaagagccacctgatcggccaccagagaatccacaccggcgagaagccctacatctgcaccgagtgcggcaaggccttcagccagaagagccacctgcccggccaccagagaatccacaccggcgagaagccctacatctgcgccgagtgcggcaaggccttcagccagaagagcgacctggtgctgcaccagagaatccacaccggcgagagaccctaccagtgcgccatctgcggcaaggccttcatccagaagagccagctgaccgtgcaccagagaatccacaccgtggtgaagagctag

SEQ ID NO: 105922 - DNA, 1980 bp, Artificial Sequence
  Description of Artificial Sequence: Synthetic coding sequence
atggccgccgccgtgctgatggacagagtgcagagctgcgtgaccttcgaggacgtgttcgtgtacttcagcagagaggagtgggagctgctggaggaggcccagagattcctgtacagagacgtgatgctggagaacttcgccctggtggccaccctgggcttctggtgcgaggccgagcacgaggcccccagcgagcagagcgtgagcgtggagggcgtgagccaggtgagaaccgccgagagcggcctgttccagaaggcccacccctgcgagatgtgcgaccccctgctgaaggacatcctgcacctggccgagcaccagggcagccacctgacccagaagctgtgcaccagaggcctgtgcagaagaagattcagcttcagcgccaacttctaccagcaccagaagcagcacaacggcgagaactgcttcagaggcgacgacggcggcgccagcttcgtgaagagctgcaccgtgcacatgctgggcagaagcttcacctgcagagaggagggcatggacctgcccgacagcagcggcctgttccagcaccagaccacctacaacagagtgagcccctgcagaagaaccgagtgcatggagagcttcccccacagcagcagcctgagacagcaccagggcgactacgacggccagatgctgttcagctgcggcgacgagggcaaggccttcctggacaccttcaccctgctggacagccagatgacccacgccgaggtgagacccttcagatgcctgccctgcggcaacgtgttcaaggagaagagcgccctgatcaaccacagaaagatccacagcggcgagatcagccacgtgtgcaaggagtgcggcaaggccttcatccacctgcaccacctgaagatgcaccagaagttccacaccggcaagagacactacacctgcagcgagtgcggcaaggccttcagcagaaaggacaccctggtgcagcaccagagagtgcacaccggcgagagaagctacgactgcagcgagtgcggcaaggcctacagcagaagcagccacctggtgcagcaccagagaatccacaccggcgagagaccctacaagtgcaacaagtgcggcaaggccttcagcagaaaggacaccctggtgcagcaccagagattccacaccggcgagagaccctacgagtgcagcgagtgcggcaagttcttcagccagagcagccacctgatcgagcactggagaatccacaccggcgccagaccctacgagtgcatcgagtgcggcaagttcttcagccacaacagcagcctgatcaagcacagaagagtgcacaccggcgccagaagctacgtgtgcagcaagtgcggcaaggccttcggctgcaaggacaccctggtgcagcaccagatcatccacaccggcgccagaccctacgagtgcagcgagtgcggcaaggccttcagcagaaaggacaccctggtgcagcaccagaagatccacaccggcgagagaccctacgagtgcggcgagtgcggcaagttcttcagccacagcagcaacctgatcgtgcaccagagaatccacaccggcgccaagccctacgagtgcaacgagtgcggcaagtgcttcagccacaacagcagcctgatcctgcaccagagagtgcacaccggcgccagaccctacgtgtgcagcgagtgcggcaaggcctacatcagcagcagccacctggtgcagcacaagaaggtgcacaccggcgccagaccctacgagtgcagcgagtgcggcaagttcttcagcagaaacagcggcctgatcctgcaccagagagtgcacaccggcgagaagccctacgtgtgcagcgagtgcggcaaggcctacagcagaagcagccacctggtgagacaccagaaggcccacaccggcgagagagcccacgagtgcaacagcttcggcggccccctggccgccagcctgaagctggtgtag

SEQ ID NO: 105923 - DNA, 1980 bp, Artificial Sequence; identical to SEQ ID NO: 105922
  Description of Artificial Sequence: Synthetic coding sequence

SEQ ID NO: 105924 - DNA, 2121 bp, Artificial Sequence
  Description of Artificial Sequence: Synthetic coding sequence
atggccgccgccgtgctgatggacagagtgcagagctgcgtgaccttcgaggacgtgttcgtgtacttcagcagagaggagtgggagctgctggaggaggcccagagattcctgtacagagacgtgatgctggagaacttcgccctggtggccaccctggccttcatcttccccgtgccctgcagctgcgccgtgggcggcggcagaaagccctgggtgcccgacagagccgacatcaccgccgccaccgtgaaggagacctacagaggccacggccccgccgagtgggagctggaggagggcttctggtgcgaggccgagcacgaggcccccagcgagcagagcgtgagcgtggagggcgtgagccaggtgagaaccgccgagagcggcctgttccagaaggcccacccctgcgagatgtgcgaccccctgctgaaggacatcctgcacctggccgagcaccagggcagccacctgacccagaagctgtgcaccagaggcctgtgcagaagaagattcagcttcagcgccaacttctaccagcaccagaagcagcacaacggcgagaactgcttcagaggcgacgacggcggcgccagcttcgtgaagagctgcaccgtgcacatgctgggcagaagcttcacctgcagagaggagggcatggacctgcccgacagcagcggcctgttccagcaccagaccacctacaacagagtgagcccctgcagaagaaccgagtgcatggagagcttcccccacagcagcagcctgagacagcaccagggcgactacgacggccagatgctgttcagctgcggcgacgagggcaaggccttcctggacaccttcaccctgctggacagccagatgacccacgccgaggtgagacccttcagatgcctgccctgcggcaacgtgttcaaggagaagagcgccctgatcaaccacagaaagatccacagcggcgagatcagccacgtgtgcaaggagtgcggcaaggccttcatccacctgcaccacctgaagatgcaccagaagttccacaccggcaagagacactacacctgcagcgagtgcggcaaggccttcagcagaaaggacaccctggtgcagcaccagagagtgcacaccggcgagagaagctacgactgcagcgagtgcggcaaggcctacagcagaagcagccacctggtgcagcaccagagaatccacaccggcgagagaccctacaagtgcaacaagtgcggcaaggccttcagcagaaaggacaccctggtgcagcaccagagattccacaccggcgagagaccctacgagtgcagcgagtgcggcaagttcttcagccagagcagccacctgatcgagcactggagaatccacaccggcgccagaccctacgagtgcatcgagtgcggcaagttcttcagccacaacagcagcctgatcaagcacagaagagtgcacaccggcgccagaagctacgtgtgcagcaagtgcggcaaggccttcggctgcaaggacaccctggtgcagcaccagatcatccacaccggcgccagaccctacgagtgcagcgagtgcggcaaggccttcagcagaaaggacaccctggtgcagcaccagaagatccacaccggcgagagaccctacgagtgcggcgagtgcggcaagttcttcagccacagcagcaacctgatcgtgcaccagagaatccacaccggcgccaagccctacgagtgcaacgagtgcggcaagtgcttcagccacaacagcagcctgatcctgcaccagagagtgcacaccggcgccagaccctacgtgtgcagcgagtgcggcaaggcctacatcagcagcagccacctggtgcagcacaagaaggtgcacaccggcgccagaccctacgagtgcagcgagtgcggcaagttcttcagcagaaacagcggcctgatcctgcaccagagagtgcacaccggcgagaagccctacgtgtgcagcgagtgcggcaaggcctacagcagaagcagccacctggtgagacaccagaaggcccacaccggcgagagagcccacgagtgcaacagcttcggcggccccctggccgccagcctgaagctggtgtag

SEQ ID NO: 105925 - DNA, 1788 bp, Artificial Sequence
  Description of Artificial Sequence: Synthetic coding sequence
atggccgccctgagccccaccttcgccaccagcacccaggacagcacctgcctgcaggacagcgagttccccgtgagcagcaaggaccacagctgcccccagaacctggacctgttcgtgtgcagcggcctggagccccacacccccagcgtgggcagccaggagagcgtgaccttccaggacgtggccgtggacttcaccgagaaggagtggcccctgctggacagcagccagagaaagctgtacaaggacgtgatgctggagaactacagcaacctgaccagcctgggctaccaggtgggcaagcccagcctgatcagccacctggagcaggaggaggagcccagaaccgaggagagaggcgcccaccagggcgcctgcgccgactgggagacccccagcaagaccaagtggagcctgctgatggaggacatcttcggcaaggagacccccagcggcgtgaccatggagagagccggcctgggcgagaagagcaccgagtacgcccacctgttcgaggtgttcggcatggacccccacctgacccagcccatgggcagacacgccggcaagagaccctaccacagaagagactacggcgtggccttcaagggcagaccccacctgacccagcacatgagcatgtacgacggcagaaagatgcacgagtgccaccagtgccagaaggccttcaccaccagcgccagcctgaccagacacagaagaatccacaccggcgagaagccctacgagtgcagcgactgcggcaaggccttcaacgaccccagcgccctgagaagccacgccagaacccacctgaaggagaagcccttcgactgcagccagtgcggcaacgccttcagaaccctgagcgccctgaagatccacatgagagtgcacaccggcgagagaccctacaagtgcgaccagtgcggcaaggcctacggcagaagctgccacctgatcgcccacaagagaacccacaccggcgagagaccctacgagtgccacgactgcggcaaggccttccagcaccccagccacctgaaggagcacgtgagaaaccacaccggcgagaagccctacgcctgcacccagtgcggcaaggccttcagatggaagagcaacttcaacctgcacaagaagaaccacatggtggagaagacctacgagtgcaaggagtgcggcaagagcttcggcgacctggtgagcagaagaaagcacatgagaatccacatcgtgaagaagcccgtggagtgcagacagtgcggcaagaccttcagaaaccagagcatcctgaagacccacatgaacagccacaccggcgagaagccctacggctgcgacctgtgcggcaaggccttcagcgccagcagcaacctgaccgcccacagaaagatccacacccaggagagaagatacgagtgcgccgcctgcggcaaggtgttcggcgactacctgagcagaagaagacacatgagcgtgcacctggtgaagaagagagtggagtgcagacagtgcggcaaggccttcagaaaccagagcaccctgaagacccacatgagaagccacaccggcgagaagccctacgagtgcgaccactgcggcaaggccttcagcatcggcagcaacctgaacgtgcacagaagaatccacaccggcgagaagccctacgagtgcctggtgtgcggcaaggccttcagcgaccacagcagcctgagaagccacgtgaagacccacagaggcgagaagctgttcgtgagcagcgtgtggaagagactgcagtag

SEQ ID NO: 105926 - DNA, 1692 bp, Artificial Sequence
  Description of Artificial Sequence: Synthetic coding sequence
atggccgccctgagccccaccttcgccaccagcacccaggacagcacctgcctgcaggacagcgagttccccgtgagcagcaaggaccacagctgcccccagaacctggacctgttcgtgtgcagcggcctggagccccacacccccagcgtgggcagccaggagagcgtgaccttccaggacgtggccgtggacttcaccgagaaggagtggcccctgctggacagcagccagagaaagctgtacaaggacgtgatgctggagaactacagcaacctgaccagcctggactgggagacccccagcaagaccaagtggagcctgctgatggaggacatcttcggcaaggagacccccagcggcgtgaccatggagagagccggcctgggcgagaagagcaccgagtacgcccacctgttcgaggtgttcggcatggacccccacctgacccagcccatgggcagacacgccggcaagagaccctaccacagaagagactacggcgtggccttcaagggcagaccccacctgacccagcacatgagcatgtacgacggcagaaagatgcacgagtgccaccagtgccagaaggccttcaccaccagcgccagcctgaccagacacagaagaatccacaccggcgagaagccctacgagtgcagcgactgcggcaaggccttcaacgaccccagcgccctgagaagccacgccagaacccacctgaaggagaagcccttcgactgcagccagtgcggcaacgccttcagaaccctgagcgccctgaagatccacatgagagtgcacaccggcgagagaccctacaagtgcgaccagtgcggcaaggcctacggcagaagctgccacctgatcgcccacaagagaacccacaccggcgagagaccctacgagtgccacgactgcggcaaggccttccagcaccccagccacctgaaggagcacgtgagaaaccacaccggcgagaagccctacgcctgcacccagtgcggcaaggccttcagatggaagagcaacttcaacctgcacaagaagaaccacatggtggagaagacctacgagtgcaaggagtgcggcaagagcttcggcgacctggtgagcagaagaaagcacatgagaatccacatcgtgaagaagcccgtggagtgcagacagtgcggcaagaccttcagaaaccagagcatcctgaagacccacatgaacagccacaccggcgagaagccctacggctgcgacctgtgcggcaaggccttcagcgccagcagcaacctgaccgcccacagaaagatccacacccaggagagaagatacgagtgcgccgcctgcggcaaggtgttcggcgactacctgagcagaagaagacacatgagcgtgcacctggtgaagaagagagtggagtgcagacagtgcggcaaggccttcagaaaccagagcaccctgaagacccacatgagaagccacaccggcgagaagccctacgagtgcgaccactgcggcaaggccttcagcatcggcagcaacctgaacgtgcacagaagaatccacaccggcgagaagccctacgagtgcctggtgtgcggcaaggccttcagcgaccacagcagcctgagaagccacgtgaagacccacagaggcgagaagctgttcgtgagcagcgtgtggaagagactgcagtag

SEQ ID NO: 105927 - DNA, 369 bp, Artificial Sequence
  Description of Artificial Sequence: Synthetic coding sequence
atgaacttcagcagccacagaagaagactgcccagcccccccctgcccagaagctacagccagagcagcaccagcacccaggacagcacctgcctgcaggacagcgagttccccgtgagcagcaaggaccacagctgcccccagaacctggacctgttcgtgtgcagcggcctggagccccacacccccagcgtgggcagccaggagagcgtgaccttccaggacgtggccgtggacttcaccgagaaggagtggcccctgctggacagcagccagagaaagctgtacaaggacgtgatgctggagaactacagcaacctgaccagcctgggcaaggccagcgccatcagccccctgatccacccctag

SEQ ID NO: 105928 - DNA, 822 bp, Artificial Sequence
  Description of Artificial Sequence: Synthetic coding sequence
atgttcggcttccccaccgccaccctgctggactgccacggcagatacgcccagaacgtggccttcttcaacgtgatgaccgaggcccaccacaagtacgaccacagcgaggccaccggcagcagcagctgggacatccagaacagcttcagaagagagaagctggagcagaagagccccgacagcaagaccctgcaggaggacagccccggcgtgagacagagagtgtacgagtgccaggagtgcggcaagagcttcagacagaagggcagcctgaccctgcacgagagaatccacaccggccagaagcccttcgagtgcacccactgcggcaagagcttcagagccaagggcaacctggtgacccaccagagaatccacaccggcgagaagccctaccagtgcaaggagtgcggcaagagcttcagccagagaggcagcctggccgtgcacgagagactgcacaccggccagaagccctacgagtgcgccatctgccagagaagcttcagaaaccagagcaacctggccgtgcacagaagagtgcacagcggcgagaagccctacagatgcgaccagtgcggcaaggccttcagccagaagggcagcctgatcgtgcacatcagagtgcacaccggcctgaagccctacgcctgcacccagtgcagaaagagcttccacaccagaggcaactgcatcctgcacggcaagatccacaccggcgagaccccctacctgtgcggccagtgcggcaagagcttcacccagagaggcagcctggccgtgcaccagagaagctgcagccagagactgaccctgtag

SEQ ID NO: 105929 - DNA, 822 bp, Artificial Sequence; identical to SEQ ID NO: 105928
  Description of Artificial Sequence: Synthetic coding sequence

SEQ ID NO: 105930 - DNA, 1530 bp, Artificial Sequence
  Description of Artificial Sequence: Synthetic coding sequence
atggccctgagccagggcctgctgaccttcagagacgtggccatcgagttcagccaggaggagtggaagtgcctggaccccgcccagagaaccctgtacagagacgtgatgctggagaactacagaaacctggtgagcctggacatcagcagcaagtgcatgatgaacaccctgagcagcaccggccagggcaacaccgaggtgatccacaccggcaccctgcagagacaggccagctaccacatcggcgccttctgcagccaggagatcgagaaggacatccacgacttcgtgttccagtggcaggaggacgagaccaacgaccacgaggcccccatgaccgagatcaagaagctgaccagcagcaccgacagatacgaccagagacacgccggcaacaagcccatcaagggccagctggagagcagattccacctgcacctgagaagacacagaagaatccacaccggcgagaagccctacaagtgcgaggagtgcgagaaggtgttcagctgcaagagccacctggagatccacagaatcatccacaccggcgagaagccctacaagtgcaaggtgtgcgacaaggccttcaagcacgacagccacctggccaagcacaccagaatccacagaggcgacaagcactacacctgcaacgagtgcggcaaggtgttcgaccagaaggccaccctggcctgccaccacagaagccacaccggcgagaagccctacaagtgcaacgagtgcggcaagaccttcagccagaccagccacctggtgtaccaccacagactgcacaccggcgagaagccctacaagtgcaacgagtgcggcaagaccttcgccagaaacagcgtgctggtgatccacaaggccgtgcacaccgccgagaagccctacaagtgcaacgagtgcggcaaggtgttcaagcagagagccaccctggccggccacagaagagtgcacaccggcgagaagccctacagatgcgaggagtgcgacaaggtgttcagcagaaagagccacctggagagacacagaagaatccacaccggcgagaagccctacaagtgcaaggtgtgcgacaaggccttcagaagcgacagcagactggccgagcaccagagagtgcacaccggcgagagaccctacacctgcaacgagtgcggcaaggtgttcagcaccaaggcctacctggcctgccaccagaagctgcacaccggcgagaagctgtacgagtgcgaggagtgcgacaaggtgtacatcagaaagagccacctggagagacacagaagaatccacaccggcgagaagccccacaagtgcggcgactgcggcaaggccttcaacagccccagccacctgatcagacaccagagaatccacaccggccagaagagctacaagtgccaccagtgcggcaaggtgttcagcctgagaagcctgctggccgagcaccagaagatccccttcggcgacaactgcttcaagtgcaacgagtacagcaagcccagcagcatcaactag

SEQ ID NO: 105931 - DNA, 1530 bp, Artificial Sequence; identical to SEQ ID NO: 105930
  Description of Artificial Sequence: Synthetic coding sequence

SEQ ID NO: 105932 - DNA, 1209 bp, Artificial Sequence
  Description of Artificial Sequence: Synthetic coding sequence
atgtacaccagcgaggagaagtgcaaccagagaacccagaagagaaagatctacaacgtgtgccccagaaagggcaagaagatcttcatccacatgcacgagatcatccagatcgacggccacatctaccagtgcctggagtgcaagcagaacttctgcgagaacctggccctgatcatgtgcgagagaacccacaccggcgagaagccctacaagtgcgacatgtgcgagaagaccttcgtgcagagcagcgacctgaccagccaccagagaatccacaactacgagaagccctacaagtgcagcaagtgcgagaagagcttctggcaccacctggccctgagcggccaccagagaacccacgccggcaagaagttctacacctgcgacatctgcggcaagaacttcggccagagcagcgacctgctggtgcaccagagaagccacaccggcgagaagccctacctgtgcagcgagtgcgacaagtgcttcagcagaagcaccaacctgatcagacacagaagaacccacaccggcgagaagcccttcaagtgcctggagtgcgagaaggccttcagcggcaagagcgacctgatcagccaccagagaacccacaccggcgagagaccctacaagtgcaacaagtgcgagaagagctacagacacagaagcgccttcatcgtgcacaagagagtgcacaccggcgagaagccctacaagtgcggcgcctgcgagaagtgcttcggccagaagagcgacctgatcgtgcaccagagagtgcacaccggcgagaagccctacaagtgcctggagtgcatgagaagcttcaccagaagcgccaacctgatcagacaccaggccacccacacccacaccttcaagtgcctggagtacgagaagagcttcaactgcagcagcgacctgatcgtgcaccagagaatccacatggaggagaagccccaccagtggagcgcctgcgagagcggcttcctgctgggcatggacttcgtggcccagcagaagatgagaacccagaccgaggagctgcactacaagtacaccgtgtgcgacaagagcttccaccagagcagcgccctgctgcagcaccagaccgtgcacatcggcgagaagcccttcgtgtgcaacgtgagcgagaagggcctggagctgagccccccccacgccagcgaggccagccagatgagctag

SEQ ID NO: 105933 - DNA, 1209 bp, Artificial Sequence; identical to SEQ ID NO: 105932
  Description of Artificial Sequence: Synthetic coding sequence

SEQ ID NO: 105934 - DNA, 81 bp, Artificial Sequence
  Description of Artificial Sequence: Synthetic coding sequence
atgtacaccagcgaggagaagtgcaaccagagaacccagaagagaaagatctacaacgtgtgccccagaaagggcaagtag

SEQ ID NO: 105935 - DNA, 1221 bp, Artificial Sequence
  Description of Artificial Sequence: Synthetic coding sequence
atggccagcaccgaggagcagtacgacctgaagatcgtgaaggtggaggaggaccccatctgggaccaggagacccacctgagaggcaacaacttcagcggccaggaggccagcagacagctgttcagacagttctgctaccaggagacccccggccccagagaggccctgagcagactgagagagctgtgccaccagtggctgagacccgagatccacaccaaggagcagatcctggagctgctggtgctggagcagttcctgaccatcctgcccgaggagctgcaggcctgggtgagagagcaccaccccgagagcggcgaggaggccgtggccgtggtggaggacctggagcaggagctgagcgagcccggcaaccaggcccccgaccacgagcacggccacagcgaggtgctgctggaggacgtggagcacctgaaggtgaagcaggagcccaccgacatccagctgcagcccatggtgacccagctgagatacgagagcttctgcctgcaccagttccaggagcaggacggcgagagcatccccgagaaccaggagctggccagcaagcaggagatcctgaaggagatggagcacctgggcgacagcaagctgcagagagacgtgagcctggacagcaagtacagagagacctgcaagagagacagcaaggccgagaagcagcaggcccacagcaccggcgagagaagacacagatgcaacgagtgcggcaagagcttcaccaagagcagcgtgctgatcgagcaccagagaatccacaccggcgagaagccctacgagtgcgaggagtgcggcaaggccttcagcagaagaagcagcctgaacgagcacagaagaagccacaccggcgagaagccctaccagtgcaaggagtgcggcaaggccttcagcgccagcaacggcctgaccagacacagaagaatccacaccggcgagaagccctacgagtgcaaggtgtgcggcaaggccttcctgctgagcagctgcctggtgcagcaccagagaatccacaccggcgagaagagataccagtgcagagagtgcggcaaggccttcatccagaacgccggcctgttccagcacctgagagtgcacaccggcgagaagccctaccagtgcagccagtgcagcaagctgttcagcaagagaaccctgctgaagaagcaccagaagatccacaccggcgagagaccctag

SEQ ID NO: 105936 - DNA, 1221 bp, Artificial Sequence; identical to SEQ ID NO: 105935
  Description of Artificial Sequence: Synthetic coding sequence

SEQ ID NO: 105937 - DNA, 1221 bp, Artificial Sequence; identical to SEQ ID NO: 105935
  Description of Artificial Sequence: Synthetic coding sequence

SEQ ID NO: 105938 - DNA, 324 bp, Artificial Sequence
  Description of Artificial Sequence: Synthetic coding sequence
atggccagcaccgaggagcagtacgacctgaagatcgtgaaggtggaggaggaccccatctgggaccaggagacccacctgagaggcaacaacttcagcggccaggaggccagcagacagctgttcagacagttctgctaccaggagacccccggccccagagaggccctgagcagactgagagagctgtgccaccagtggctgagacccgagatccacaccaaggagcagatcctggagctgctggtgctggagcagttcctgaccatcctgcccgaggagctgcaggcctgggtgagagagcaccaccccgagagcggctag

SEQ ID NO: 105939 - DNA, 237 bp, Artificial Sequence
  Description of Artificial Sequence: Synthetic coding sequence
atggccagcaccgaggagcagtacgacctgaagatcgtgaaggtggaggaggaccccatctgggaccaggagacccacctgagaggcaacaacttcagcggccaggaggccagcagacagctgttcagacagttctgctaccaggagacccccggccccagagaggccctgagcagactgagagagctgtgccaccagtggctgagacccgagatccacaccaaggagcagatctag

SEQ ID NO: 105940 - DNA, 1221 bp, Artificial Sequence; identical to SEQ ID NO: 105935
  Description of Artificial Sequence: Synthetic coding sequence

SEQ ID NO: 105941 - DNA, 54 bp, Artificial Sequence
  Description of Artificial Sequence: Synthetic coding sequence
atggccagcaccgaggagcagtacgacctgaagatcgtgaaggtggaggagtag

SEQ ID NO: 105942 - DNA, 468 bp, Artificial Sequence
  Description of Artificial Sequence: Synthetic coding sequence
atggccagcaccgaggagcagtacgacctgaagatcgtgaaggtggaggaggaccccatctgggaccaggagacccacctgagaggcaacaacttcagcggccaggaggccagcagacagctgttcagacagttctgctaccaggagacccccggccccagagaggccctgagcagactgagagagctgtgccaccagtggctgagacccgagatccacaccaaggagcagatcctggagctgctggtgctggagcagttcctgaccatcctgcccgaggagctgcaggcctgggtgagagagcaccaccccgagagcggcgaggaggccgtggccgtggtggaggacctggagcaggagctgagcgagcccggcaaccaggcccccgaccacgagcacggccacagcgaggtgctgctggaggacgtggagcacctgaaggtgaagcaggagcccaccgacatctag

SEQ ID NO: 105943 - DNA, 75 bp, Artificial Sequence
  Description of Artificial Sequence: Synthetic coding sequence
atggccagcaccgaggagcagtacgacctgaagatcgtgaaggtggaggaggaccccatctgggaccaggagtag

SEQ ID NO: 105944 - DNA, 312 bp, Artificial Sequence
  Description of Artificial Sequence: Synthetic coding sequence
atggccagcaccgaggagcagtacgacctgaagatcgtgaaggtggaggaggaccccatctgggaccaggagacccacctgagaggcaacaacttcagcggccaggaggccagcagacagctgttcagacagttctgctaccaggagacccccggccccagagaggccctgagcagactgagagagctgtgccaccagtggctgagacccgagatccacaccaaggagcagatcctggagctgctggtgctggagcagttcctgaccatcctgcccgaggagctgcaggcctgggtgagagagcaccactag

SEQ ID NO: 105945 - DNA, 447 bp, Artificial Sequence
  Description of Artificial Sequence: Synthetic coding sequence
atggccagcaccgaggagcagtacgacctgaagatcgtgaaggtggaggaggaccccatctgggaccaggagacccacctgagaggcaacaacttcagcggccaggaggccagcagacagctgttcagacagttctgctaccaggagacccccggccccagagaggccctgagcagactgagagagctgtgccaccagtggctgagacccgagatccacaccaaggagcagatcctggagctgctggtgctggagcagttcctgaccatcctgcccgaggagctgcaggcctgggtgagagagcaccaccccgagagcggcgaggaggccgtggccgtggtggaggacctggagcaggagctgagcgagcccggcaaccaggcccccgaccacgagcacggccacagcgaggtgctgctggaggacgtggagcacctgaaggtgtag

SEQ ID NO: 105946 - DNA, 654 bp, Artificial Sequence
  Description of Artificial Sequence: Synthetic coding sequence
atggccagcaccgaggagcagtacgacctgaagatcgtgaaggtggaggaggaccccatctgggaccaggagacccacctgagaggcaacaacttcagcggccaggaggccagcagacagctgttcagacagttctgctaccaggagacccccggccccagagaggccctgagcagactgagagagctgtgccaccagtggctgagacccgagatccacaccaaggagcagatcctggagctgctggtgctggagcagttcctgaccatcctgcccgaggagctgcaggcctgggtgagagagcaccaccccgagagcggcgaggaggccgtggccgtggtggaggacctggagcaggagctgagcgagcccggcaaccaggcccccgaccacgagcacggccacagcgaggtgctgctggaggacgtggagcacctgaaggtgaagcaggagcccaccgacatccagctgcagcccatggtgacccagctgagatacgagagcttctgcctgcaccagttccaggagcaggacggcgagagcatccccgagaaccaggagctggccagcaagcaggagatcctgaaggagatggagcacctgggcgacagcaagctgcagagagacgtgagcctggacagcaagtacagatag

SEQ ID NO: 105947 - DNA, 963 bp, Artificial Sequence
  Description of Artificial Sequence: Synthetic coding sequence
atgcccaagaagaagaccggcgccagaaagaaggccgagaacagaagagagagagagaagcagctgagagccagcagaagcaccatcgacctggccaagcacccctgcaacgccagcatggagtgcgacaagtgccagagaagacagaagaacagagccttctgctacttctgcaacagcgtgcagaagctgcccatctgcgcccagtgcggcaagaccaagtgcatgatgaagagcagcgactgcgtgatcaagcacgccggcgtgtacagcaccggcctggccatggtgggcgccatctgcgacttctgcgaggcctgggtgtgccacggcagaaagtgcctgagcacccacgcctgcgcctgccccctgaccgacgccgagtgcgtggagtgcgagagaggcgtgtgggaccacggcggcagaatcttcagctgcagcttctgccacaacttcctgtgcgaggacgaccagttcgagcaccaggccagctgccaggtgctggaggccgagaccttcaagtgcgtgagctgcaacagactgggccagcacagctgcctgagatgcaaggcctgcttctgcgacgaccacaccagaagcaaggtgttcaagcaggagaagggcaagcagcccccctgccccaagtgcggccacgagacccaggagaccaaggacctgagcatgagcaccagaagcctgaagttcggcagacagaccggcggcgaggagggcgacggcgccagcggctacgacgcctactggaagaacctgagcagcgacaagtacggcgacaccagctaccacgacgaggaggaggacgagtacgaggccgaggacgacgaggaggaggaggacgagggcagaaaggacagcgacaccgagagcagcgacctgttcaccaacctgaacctgggcagaacctacgccagcggctacgcccactacgaggagcaggagaactag

SEQ ID NO: 105948 - DNA, 783 bp, Artificial Sequence
  Description of Artificial Sequence: Synthetic coding sequence
atgccccagtggaacgtgaccagcgtgagaggcaagaccaagtgcatgatgaagagcagcgactgcgtgatcaagcacgccggcgtgtacagcaccggcctggccatggtgggcgccatctgcgacttctgcgaggcctgggtgtgccacggcagaaagtgcctgagcacccacgcctgcgcctgccccctgaccgacgccgagtgcgtggagtgcgagagaggcgtgtgggaccacggcggcagaatcttcagctgcagcttctgccacaacttcctgtgcgaggacgaccagttcgagcaccaggccagctgccaggtgctggaggccgagaccttcaagtgcgtgagctgcaacagactgggccagcacagctgcctgagatgcaaggcctgcttctgcgacgaccacaccagaagcaaggtgttcaagcaggagaagggcaagcagcccccctgccccaagtgcggccacgagacccaggagaccaaggacctgagcatgagcaccagaagcctgaagttcggcagacagaccggcggcgaggagggcgacggcgccagcggctacgacgcctactggaagaacctgagcagcgacaagtacggcgacaccagctaccacgacgaggaggaggacgagtacgaggccgaggacgacgaggaggaggaggacgagggcagaaaggacagcgacaccgagagcagcgacctgttcaccaacctgaacctgggcagaacctacgccagcggctacgcccactacgaggagcaggagaactag

SEQ ID NO: 105949 - DNA, 423 bp, Artificial Sequence
  Description of Artificial Sequence: Synthetic coding sequence
atgcccaagaagaagaccggcgccagaaagaaggccgagaacagaagagagagagagaagcagctgagagccagcagaagcaccatcgacctggccaagcacccctgcaacgccagcatggagtgcgacaagtgccagagaagacagaagaacagagccttctgctacttctgcaacagcgtgcagaagctgcccatctgcgcccagtgcggcaagaccaagtgcatgatgaagagcagcgactgcgtgatcaagcacgccggcgtgtacagcaccggcctggccatggtgggcgccatctgcgacttctgcgaggcctgggtgtgccacggcagaaagtgcctgagcacccacgcctgcgcctgccccctgaccgacgccgagtgcgtggagtgcgagagaggcgtgtgggaccacggctag

SEQ ID NO: 105950 - DNA, 462 bp, Artificial Sequence
  Description of Artificial Sequence: Synthetic coding sequence
atgcccaagaagaagaccggcgccagaaagaaggccgagaacagaagagagagagagaagcagctgagagccagcagaagcaccatcgacctggccaagcacccctgcaacgccagcatggagtgcgacaagtgccagagaagacagaagaacagagccttctgctacttctgcaacagcgtgcagaagctgcccatctgcgcccagtgcggcaagaccaagtgcatgatgaagagcagcgactgcgtgatcaagcacgccggcgtgtacagcaccggcctggccatggtgggcgccatctgcgacttctgcgaggcctgggtgtgccacggcagaaagtgcctgagcacccacgcctgcgcctgccccctgaccgacgccgagtgcgtggagtgcgagagaggcgtgtgggaccacggcggcagaatcttcagctgcagcttctgccacaacttcctgtag

SEQ ID NO: 105951 - DNA, 690 bp, Artificial Sequence
  Description of Artificial Sequence: Synthetic coding sequence
atgcccaagaagaagaccggcgccagaaagaaggccgagaacagaagagagagagagaagcagctgagagccagcagaagcaccatcgacctggccaagcacccctgcaacgccagcatggagtgcgacaagtgccagagaagacagaagaacagagccttctgctacttctgcaacagcgtgcagaagctgcccatctgcgcccagtgcggcaagaccaagtgcatgatgaagagcagcgactgcgtgatcaagcacgccggcgtgtacagcaccggcctggccatggtgggcgccatctgcgacttctgcgaggcctgggtgtgccacggcagaaagtgcctgagcacccacgcctgcgcctgccccctgaccgacgccgagtgcgtggagtgcgagagaggcgtgtgggaccacggcggcagaatcttcagctgcagcttctgccacaacttcctgtgcgaggacgaccagttcgagcaccaggccagctgccaggtgctggaggccgagaccttcaagtgcgtgagctgcaacagactgggccagcacagctgcctgagatgcaaggcctgcttctgcgacgaccacaccagaagcaaggtgttcaagcaggagaagggcaagcagcccccctgccccaagtgcggccacgagacccaggagaccaaggacctgagcatgagctag

SEQ ID NO: 105952 - DNA, 1392 bp, Artificial Sequence
  Description of Artificial Sequence: Synthetic coding sequence
atggcccagggcctggtgaccttcgccgacgtggccatcgacttcagccaggaggagtgggcctgcctgaacagcgcccagagagacctgtactgggacgtgatgctggagaactacagcaacctggtgagcctggacctggagagcgcctacgagaacaagagcctgcccaccgagaagaacatccacgagatcagagccagcaagagaaacagcgacagaagaagcaagagcctgggcagaaactggatctgcgagggcaccctggagagaccccagagaagcagaggcagatacgtgaaccagatgatcatcaactacgtgaagagacccgccaccagagagggcaccccccccagaacccaccagagacaccacaaggagaacagcttcgagtgcaaggactgcggcaaggccttcagcagaggctaccagctgagccagcaccagaagatccacaccggcgagaagccctacgagtgcaaggagtgcaagaaggccttcagatggggcaaccagctgacccagcaccagaagatccacaccggcgagaagccctacgagtgcaaggactgcggcaaggccttcagatggggcagcagcctggtgatccacaagagaatccacaccggcgagaagccctacgagtgcaaggactgcggcaaggccttcagaagaggcgacgagctgacccagcaccagagattccacaccggcgagaaggactacgagtgcaaggactgcggcaagaccttcagcagagtgtacaagctgatccagcacaagagaatccacagcggcgagaagccctacgagtgcaaggactgcggcaaggccttcatctgcggcagcagcctgatccagcacaagagaatccacaccggcgagaagccctacgagtgccaggagtgcggcaaggccttcaccagagtgaactacctgacccagcaccagaagatccacaccggcgagaagccccacgagtgcaaggagtgcggcaaggccttcagatggggcagcagcctggtgaagcacgagagaatccacaccggcgagaagccctacaagtgcaccgagtgcggcaaggccttcaactgcggctaccacctgacccagcacgagagaatccacaccggcgagaccccctacaagtgcaaggagtgcggcaaggccttcatctacggcagcagcctggtgaagcacgagagaatccacaccggcgtgaagccctacggctgcaccgagtgcggcaagagcttcagccacggccaccagctgacccagcaccagaagacccacagcggcgccaagagctacgagtgcaaggagtgcggcaaggcctgcaaccacctgaaccacctgagagagcaccagagaatccacaacagctag

SEQ ID NO: 105953 - DNA, 1392 bp, Artificial Sequence; identical to SEQ ID NO: 105952
  Description of Artificial Sequence: Synthetic coding sequence

SEQ ID NO: 105954 - DNA, 1392 bp, Artificial Sequence; identical to SEQ ID NO: 105952
  Description of Artificial Sequence: Synthetic coding sequence

SEQ ID NO: 105955 - DNA, 192 bp, Artificial Sequence
  Description of Artificial Sequence: Synthetic coding sequence
atggcccagggcctggtgaccttcgccgacgtggccatcgacttcagccaggaggagtgggcctgcctgaacagcgcccagagagacctgtactgggacgtgatgctggagaactacagcaacctggtgagcctggacctggagagcgcctacgagaacaagagcctgcccaccgagaagaacatccactag

SEQ ID NO: 105956 - DNA, 258 bp, Artificial Sequence
  Description of Artificial Sequence: Synthetic coding sequence
atggcccagggcctggtgaccttcgccgacgtggccatcgacttcagccaggaggagtgggcctgcctgaacagcgcccagagagacctgtactgggacgtgatgctggagaactacagcaacctggtgagcctggacctggagagcgcctacgagaacaagagcctgcccaccgagaagaacatccacgagatcagagccagcaagagaaacagcgacagaagaagcaagagcctgggcagaaactggatctgctag

SEQ ID NO: 105957 - DNA, 201 bp, Artificial Sequence
  Description of Artificial Sequence: Synthetic coding sequence
atggcccagggcctggtgaccttcgccgacgtggccatcgacttcagccaggaggagtgggcctgcctgaacagcgcccagagagacctgtactgggacgtgatgctggagaactacagcaacctggtgagcctggacctggagagcgcctacgagaacaagagcctgcccaccgagaagaacatccacgagatcagatag

SEQ ID NO: 105958 - DNA, 195 bp, Artificial Sequence
  Description of Artificial Sequence: Synthetic coding sequence
atggcccagggcctggtgaccttcgccgacgtggccatcgacttcagccaggaggagtgggcctgcctgaacagcgcccagagagacctgtactgggacgtgatgctggagaactacagcaacctggtgagcctggacctggagagcgcctacgagaacaagagcctgcccaccgagaagaacatccacgagtag

SEQ ID NO: 105959 - DNA, 534 bp, Artificial Sequence
  Description of Artificial Sequence: Synthetic coding sequence
atggcccagggcctggtgaccttcgccgacgtggccatcgacttcagccaggaggagtgggcctgcctgaacagcgcccagagagacctgtactgggacgtgatgctggagaactacagcaacctggtgagcctggacctggagagcgcctacgagaacaagagcctgcccaccgagaagaacatccacgagatcagagccagcaagagaaacagcgacagaagaagcaagagcctgggcagaaactggatctgcgagggcaccctggagagaccccagagaagcagaggcagatacgtgaaccagatgatcatcaactacgtgaagagacccgccaccagagagggcaccccccccagaacccaccagagacaccacaaggagaacagcttcgagtgcaaggactgcggcaaggccttcagcagaggctaccagctgagccagcaccagaagatccacaccggcgagaagccctacgagtgcaaggagtgcaagaaggccttcagatggggcaaccagctgacccagcactag

SEQ ID NO: 105960 - DNA, 264 bp, Artificial Sequence
  Description of Artificial Sequence: Synthetic coding sequence
atggcccagggcctggtgaccttcgccgacgtggccatcgacttcagccaggaggagtgggcctgcctgaacagcgcccagagagacctgtactgggacgtgatgctggagaactacagcaacctggtgagcctggacctggagagcgcctacgagaacaagagcctgcccaccgagaagaacatccacgagatcagagccagcaagagaaacagcgacagaagaagcaagagcctgggcagaaactggatctgcgagggctag

SEQ ID NO: 105961 - DNA, 144 bp, Artificial Sequence
  Description of Artificial Sequence: Synthetic coding sequence
atggcccagggcctggtgaccttcgccgacgtggccatcgacttcagccaggaggagtgggcctgcctgaacagcgcccagagagacctgtactgggacgtgatgctggagaactacagcaacctggtgagcctggacctgtag

SEQ ID NO: 105962 - DNA, 1392 bp, Artificial Sequence; identical to SEQ ID NO: 105952
  Description of Artificial Sequence: Synthetic coding sequence

SEQ ID NO: 105963 - DNA, 318 bp, Artificial Sequence
  Description of Artificial Sequence: Synthetic coding sequence
atggcccagggcctggtgaccttcgccgacgtggccatcgacttcagccaggaggagtgggcctgcctgaacagcgcccagagagacctgtactgggacgtgatgctggagaactacagcaacctggtgagcctggacctggagagcgcctacgagaacaagagcctgcccaccgagaagaacatccacgagatcagagccagcaagagaaacagcgacagaagaagcaagagcctgggcagaaactggatctgcgagggcaccctggagagaccccagagaagcagaggcagatacgtgaaccagatgatcatctag

SEQ ID NO: 105964 - DNA, 1392 bp, Artificial Sequence; identical to SEQ ID NO: 105952
  Description of Artificial Sequence: Synthetic coding sequence

SEQ ID NO: 105965 - DNA, 1392 bp, Artificial Sequence; identical to SEQ ID NO: 105952
  Description of Artificial Sequence: Synthetic coding sequence

SEQ ID NO: 105966 - DNA, 297 bp, Artificial Sequence
  Description of Artificial Sequence: Synthetic coding sequence
atggcccagggcctggtgaccttcgccgacgtggccatcgacttcagccaggaggagtgggcctgcctgaacagcgcccagagagacctgtactgggacgtgatgctggagaactacagcaacctggtgagcctggacctggagagcgcctacgagaacaagagcctgcccaccgagaagaacatccacgagatcagagccagcaagagaaacagcgacagaagaagcaagagcctgggcagaaactggatctgcgagggcaccctggagagaccccagagaagcagaggcagatag

SEQ ID NO: 105967 - DNA, 1392 bp, Artificial Sequence; identical to SEQ ID NO: 105952
  Description of Artificial Sequence: Synthetic coding sequence

SEQ ID NO: 105968 - DNA, 504 bp, Artificial Sequence
  Description of Artificial Sequence: Synthetic coding sequence
atggcccagggcctggtgaccttcgccgacgtggccatcgacttcagccaggaggagtgggcctgcctgaacagcgcccagagagacctgtactgggacgtgatgctggagaactacagcaacctggtgagcctggacctggagagcgcctacgagaacaagagcctgcccaccgagaagaacatccacgagatcagagccagcaagagaaacagcgacagaagaagcaagagcctgggcagaaactggatctgcgagggcaccctggagagaccccagagaagcagaggcagatacgtgaaccagatgatcatcaactacgtgaagagacccgccaccagagagggcaccccccccagaacccaccagagacaccacaaggagaacagcttcgagtgcaaggactgcggcaaggccttcagcagaggctaccagctgagccagcaccagaagatccacaccggcgagaagccctacgagtgcaaggagtgcaagaaggcctag

SEQ ID NO: 105969 - DNA, 303 bp, Artificial Sequence
  Description of Artificial Sequence: Synthetic coding sequence
atggcccagggcctggtgaccttcgccgacgtggccatcgacttcagccaggaggagtgggcctgcctgaacagcgcccagagagacctgtactgggacgtgatgctggagaactacagcaacctggtgagcctggacctggagagcgcctacgagaacaagagcctgcccaccgagaagaacatccacgagatcagagccagcaagagaaacagcgacagaagaagcaagagcctgggcagaaactggatctgcgagggcaccctggagagaccccagagaagcagaggcagatacgtgtag

SEQ ID NO: 105970 - DNA, 1998 bp, Artificial Sequence
  Description of Artificial Sequence: Synthetic coding sequence
atggagagcgtgaccttcgaggacgtggccgtggagttcatccaggagtgggccctgctggacagcgccagaagaagcctgtgcaagtacagaatgctggaccagtgcagaaccctggccagcagaggcacccccccctgcaagcccagctgcgtgagccagctgggccagagagccgagcccaaggccaccgagagaggcatcctgagagccaccggcgtggcctgggagagccagctgaagcccgaggagctgcccagcatgcaggacctgctggaggaggccagcagcagagacatgcagatgggccccggcctgttcctgagaatgcagctggtgcccagcatcgaggagagagagacccccctgaccagagaggacagacccgccctgcaggagcccccctggagcctgggctgcaccggcctgaaggccgccatgcagatccagagagtggtgatccccgtgcccaccctgggccacagaaacccctgggtggccagagacagcgccgtgcccgccagagaccccgcctggctgcaggaggacaaggtggaggaggaggccatggcccccggcctgcccaccgcctgcagccaggagcccgtgaccttcgccgacgtggccgtggtgttcacccccgaggagtgggtgttcctggacagcacccagagaagcctgtacagagacgtgatgctggagaactacagaaacctggccagcgtggccgaccagctgtgcaagcccaacgccctgagctacctggaggagagaggcgagcagtggaccaccgacagaggcgtgctgagcgacacctgcgccgagccccagtgccagccccaggaggccatccccagccaggacaccttcaccgagatcctgagcatcgacgtgaagggcgagcagccccagcccggcgagaagctgtacaagtacaacgagctggagaagcccttcaacagcatcgagcccctgttccagtaccagagaatccacgccggcgaggccagctgcgagtgccaggagatcagaaacagcttcttccagagcgcccacctgatcgtgcccgagaagatcagaagcggcgacaagagctacgcctgcaacaagtgcgagaagagcttcagatacagcagcgacctgatcagacacgagaagacccacaccgccgagaagtgcttcgactgccaggagtgcggccaggccttcaagtacagcagcaacctgagaagacacatgagaacccacaccggcgagaagcccttcgagtgcagccagtgcggcaagaccttcaccagaaacttcaacctgatcctgcaccagagaaaccacaccggcgagaagccctacgagtgcaaggactgcggcaaggccttcaaccagcccagcagcctgagaagccacgtgagaacccacaccggcgagaagcccttcgagtgcagccagtgcggcaaggccttcagagagcacagcagcctgaagacccacctgagaacccacaccagagagaagccctacgagtgcaaccagtgcggcaagcccttcagaaccagcacccacctgaacgtgcacaagagaatccacaccggcgagaagctgtacgagtgcgccacctgcggccaggtgctgagcagactgagcaccctgaagagccacatgagaacccacaccggcgagaagccctacgtgtgccaggagtgcggcagagccttcagcgagcccagcagcctgagaaagcacgccagaacccacagcggcaagaagccctacgcctgccaggagtgcggcagagccttcggccagagcagccacctgatcgtgcacgtgagaacccacagcgccggcagaccctaccagtgcaaccagtgcgagaaggccttcagacacagcagcagcctgaccgtgcacaagagaacccacgtgggcagagagaccatcagaaacggcagcctgcccctgagcatgagccacccctactgcggccccctggccaactag

SEQ ID NO: 105971 - DNA, 549 bp, Artificial Sequence
  Description of Artificial Sequence: Synthetic coding sequence
atggagagcgtgaccttcgaggacgtggccgtggagttcatccaggagtgggccctgctggacagcgccagaagaagcctgtgcaagtacagaatgctggaccagtgcagaaccctggccagcagaggcacccccccctgcaagcccagctgcgtgagccagctgggccagagagccgagcccaaggccaccgagagaggcatcctgagagccaccggcgtggcctgggagagccagctgaagcccgaggagctgcccagcatgcaggacctgctggaggaggccagcagcagagacatgcagatgggccccggcctgttcctgagaatgcagctggtgcccagcatcgaggagagagagacccccctgaccagagaggacagacccgccctgcaggagcccccctggagcctgggctgcaccctgcccctgctgagcctgctgctgcccagctgccccgagccccccctggtgctgctggacagcagcagcgcccccgacagacacctgggcagcaccctggacaccgaggccagaggcatcccctag

SEQ ID NO: 105972 - DNA, 1671 bp, Artificial Sequence
  Description of Artificial Sequence: Synthetic coding sequence
atgcagctggtgcccagcatcgaggagagagagacccccctgaccagagaggacagacccgccctgcaggagcccccctggagcctgggctgcaccggcctgaaggccgccatgcagatccagagagtggtgatccccgtgcccaccctgggccacagaaacccctgggtggccagagacagcgccgtgcccgccagagaccccgcctggctgcaggaggacaaggtggaggaggaggccatggcccccggcctgcccaccgcctgcagccaggagcccgtgaccttcgccgacgtggccgtggtgttcacccccgaggagtgggtgttcctggacagcacccagagaagcctgtacagagacgtgatgctggagaactacagaaacctggccagcgtggccgaccagctgtgcaagcccaacgccctgagctacctggaggagagaggcgagcagtggaccaccgacagaggcgtgctgagcgacacctgcgccgagccccagtgccagccccaggaggccatccccagccaggacaccttcaccgagatcctgagcatcgacgtgaagggcgagcagccccagcccggcgagaagctgtacaagtacaacgagctggagaagcccttcaacagcatcgagcccctgttccagtaccagagaatccacgccggcgaggccagctgcgagtgccaggagatcagaaacagcttcttccagagcgcccacctgatcgtgcccgagaagatcagaagcggcgacaagagctacgcctgcaacaagtgcgagaagagcttcagatacagcagcgacctgatcagacacgagaagacccacaccgccgagaagtgcttcgactgccaggagtgcggccaggccttcaagtacagcagcaacctgagaagacacatgagaacccacaccggcgagaagcccttcgagtgcagccagtgcggcaagaccttcaccagaaacttcaacctgatcctgcaccagagaaaccacaccggcgagaagccctacgagtgcaaggactgcggcaaggccttcaaccagcccagcagcctgagaagccacgtgagaacccacaccggcgagaagcccttcgagtgcagccagtgcggcaaggccttcagagagcacagcagcctgaagacccacctgagaacccacaccagagagaagccctacgagtgcaaccagtgcggcaagcccttcagaaccagcacccacctgaacgtgcacaagagaatccacaccggcgagaagctgtacgagtgcgccacctgcggccaggtgctgagcagactgagcaccctgaagagccacatgagaacccacaccggcgagaagccctacgtgtgccaggagtgcggcagagccttcagcgagcccagcagcctgagaaagcacgccagaacccacagcggcaagaagccctacgcctgccaggagtgcggcagagccttcggccagagcagccacctgatcgtgcacgtgagaacccacagcgccggcagaccctaccagtgcaaccagtgcgagaaggccttcagacacagcagcagcctgaccgtgcacaagagaacccacgtgggcagagagaccatcagaaacggcagcctgcccctgagcatgagccacccctactgcggccccctggccaactag

SEQ ID NO: 105973 - DNA, 912 bp, Artificial Sequence
  Description of Artificial Sequence: Synthetic coding sequence
atggagagcgtgaccttcgaggacgtggccgtggagttcatccaggagtgggccctgctggacagcgccagaagaagcctgtgcaagtacagaatgctggaccagtgcagaaccctggccagcagaggcacccccccctgcaagcccagctgcgtgagccagctgggccagagagccgagcccaaggccaccgagagaggcatcctgagagccaccggcgtggcctgggagagccagctgaagcccgaggagctgcccagcatgcaggacctgctggaggaggccagcagcagagacatgcagatgggccccggcctgttcctgagaatgcagctggtgcccagcatcgaggagagagagacccccctgaccagagaggacagacccgccctgcaggagcccccctggagcctgggctgcaccggcctgaaggccgccatgcagatccagagagtggtgatccccgtgcccaccctgggccacagaaacccctgggtggccagagacagcgccgtgcccgccagagaccccgcctggctgcaggaggacaaggtggaggaggaggccatggcccccggcctgcccaccgcctgcagccaggagcccgtgaccttcgccgacgtggccgtggtgttcacccccgaggagtgggtgttcctggacagcacccagagaagcctgtacagagacgtgatgctggagaactacagaaacctggccagcgtggccgaccagctgtgcaagcccaacgccctgagctacctggaggagagaggcgagcagtggaccaccgacagaggcgtgctgagcgacacctgcgccgagccccagtgccagccccaggaggccatccccagccaggacaccttcaccgagatcctgagcatcgacgtgaagggcccccccaactag

SEQ ID NO: 105974 - DNA, 3360 bp, Artificial Sequence
  Description of Artificial Sequence: Synthetic coding sequence
gccgccgaggagagaggctggagacccagaagatgcagaagccagagaggcacctggctgagaaagcccagaagcgaggtgcccagaccctacgcccccctgagcggcagcccccccatcagatggagaagaaccagatggagagccgccgccaccagacccctgggcctggccggccccagaagccccctgagagccgcctgggtgtgggcccccagcagagtgagaagacagcagagaagaagaggcagacccggcgccggcagaggcatcgacgacctggaggaggacagcgactacaaccccgccgaggacgagcccagaggcagacagctgagactgcagagacccacccccagcacccccagacccagaagaagacccggcagacccagaaagctgcccagactggagatcagcgacctgcccgacggcgtggagggcgagcccctggtgagcagccagagcggccagagcccccccgagccccaggaccccgaggcccccagcagcagcggccccggccacctggtggccatgggcaaggtgagcagaacccccgtggaggccggcgtgagccagagcgacgccgagaacgccgcccccagctgccccgacgagcacgacaccctgcccagaagaagaggcagacccagcagaagattcctgggcaagaagtacagaaagtactactacaagagccccaagcccctgctgagacccttcctgtgcagaatctgcggcagcagattcctgagccacgaggacctgagattccacgtgaacagccacgaggccggcgacccccagctgttcaagtgcctgcagtgcagctacagaagcagaagatggagcagcctgaaggagcacatgttcaaccacgtgggcagcaagccctacaagtgcgacgagtgcagctacaccagcgtgtacagaaaggacgtgatcagacacgccgccgtgcacagcagagacagaaagaagagacccgaccccacccccaagctgagcagcttcccctgccccgtgtgcggcagagtgtaccccatgcagaagagactgacccagcacatgaagacccacagcaccgagaagccccacatgtgcgacaagtgcggcaagagcttcaagaagagatacaccttcaagatgcacctgctgacccacatccaggccgtggccaacagaagattcaagtgcgagttctgcgagttcgtgtgcgaggacaagaaggccctgctgaaccaccagctgagccacgtgagcgacaagcccttcaagtgcagcttctgcccctacagaaccttcagagaggacttcctgctgagccacgtggccgtgaagcacaccggcgccaagcccttcgcctgcgagtactgccacttcagcaccagacacaagaagaacctgagactgcacgtgagatgcagacacgccagcagcttcgaggagtggggcagaagacaccccgaggagccccccagcagaagaagacccttcttcagcctgcagcagatcgaggagctgaagcagcagcacagcgccgcccccggccccccccccagcagccccggcccccccgagatcccccccgaggccaccaccttccagagcagcgaggcccccagcctgctgtgcagcgacaccctgggcggcgccaccatcatctaccagcagggcgccgaggagagcaccgccatggccacccagaccgccctggacctgctgctgaacatgagcgcccagagagagctgggcggcaccgccctgcaggtggccgtggtgaagagcgaggacgtggaggccggcctggccagccccggcggccagcccagccccgagggcgccaccccccaggtggtgaccctgcacgtggccgagcccggcggcggcgccgccgccgagagccagctgggcccccccgacctgccccagatcaccctggcccccggccccttcggcggcaccggctacagcgtgatcaccgccccccccatggaggagggcaccagcgcccccggcaccccctacagcgaggagcccgccggcgaggccgcccaggccgtggtggtgagcgacaccctgaaggaggccggcacccactacatcatggccaccgacggcacccagctgcaccacatcgagctgaccgccgacggcagcatcagcttccccagccccgacgccctggccagcggcgccaagtggcccctgctgcagtgcggcggcctgcccagagacggccccgagccccccagccccgccaagacccactgcgtgggcgacagccagagcagcgccagcagcccccccgccaccagcaaggccctgggcctggccgtgccccccagcccccccagcgccgccaccgccgccagcaagaagttcagctgcaagatctgcgccgaggccttccccggcagagccgagatggagagccacaagagagcccacgccggccccggcgccttcaagtgccccgactgccccttcagcgccagacagtggcccgaggtgagagcccacatggcccagcacagcagcctgagaccccaccagtgcagccagtgcagcttcgccagcaagaacaagaaggacctgagaagacacatgctgacccacaccaaggagaagcccttcgcctgccacctgtgcggccagagattcaacagaaacggccacctgaagttccacatccagagactgcacagccccgacggcagaaagagcggcacccccaccgccagagcccccacccagacccccacccagaccatcatcctgaacagcgacgacgagaccctggccaccctgcacaccgccctgcagagcagccacggcgtgctgggccccgagagactgcagcaggccctgagccaggagcacatcatcgtggcccaggagcagaccgtgaccaaccaggaggaggccgcctacatccaggagatcaccaccgccgacggccagaccgtgcagcacctggtgaccagcgacaaccaggtgcagtacatcatcagccaggacggcgtgcagcacctgctgccccaggagtacgtggtggtgcccgagggccaccacatccaggtgcaggagggccagatcacccacatccagtacgagcagggcgcccccttcctgcaggagagccagatccagtacgtgcccgtgagccccggccagcagctggtgacccaggcccagctggaggccgccgcccacagcgccgtgaccgccgtggccgacgccgccatggcccaggcccagggcctgttcggcaccgacgagaccgtgcccgagcacatccagcagctgcagcaccagggcatcgagtacgacgtgatcaccctggccgacgactag

SEQ ID NO: 105975 - DNA, 4029 bp, Artificial Sequence
  Description of Artificial Sequence: Synthetic coding sequence
atggaggagaacgaggtggagagcagcagcgacgccgcccccggccccggcagacccgaggagcccagcgagagcggcctgggcgtgggcaccagcgaggccgtgagcgccgacagcagcgacgccgccgccgcccccggccaggccgaggccgacgacagcggcgtgggccagagcagcgacagaggcagcagaagccaggaggaggtgagcgagagcagcagcagcgccgaccccctgcccaacagctacctgcccgacagcagcagcgtgagccacggccccgtggccggcgtgaccggcggcccccccgccctggtgcacagcagcgccctgcccgaccccaacatgctggtgagcgactgcaccgccagcagcagcgacctgggcagcgccatcgacaagatcatcgagagcaccatcggccccgacctgatccagaactgcatcaccgtgaccagcgccgaggacggcggcgccgagaccaccagatacctgatcctgcagggccccgacgacggcgcccccatgaccagccccatgagcagcagcaccctggcccacagcctggccgccatcgaggccctggccgacggccccaccagcaccagcacctgcctggaggcccagggcggccccagcagccccgtgcagctgccccccgccagcggcgccgaggagcccgacctgcagagcctggaggccatgatggaggtggtggtggtgcagcagttcaagtgcaagatgtgccagtacagaagcagcaccaaggccaccctgctgagacacatgagagagagacacttcagacccgtggccgccgccgccgccgccgccggcaagaagggcagactgagaaagtggagcaccagcaccaagagccaggaggaggagggccccgaggaggaggacgacgacgacatcgtggacgccggcgccatcgacgacctggaggaggacagcgactacaaccccgccgaggacgagcccagaggcagacagctgagactgcagagacccacccccagcacccccagacccagaagaagacccggcagacccagaaagctgcccagactggagatcagcgacctgcccgacggcgtggagggcgagcccctggtgagcagccagagcggccagagcccccccgagccccaggaccccgaggcccccagcagcagcggccccggccacctggtggccatgggcaaggtgagcagaacccccgtggaggccggcgtgagccagagcgacgccgagaacgccgcccccagctgccccgacgagcacgacaccctgcccagaagaagaggcagacccagcagaagattcctgggcaagaagtacagaaagtactactacaagagccccaagcccctgctgagacccttcctgtgcagaatctgcggcagcagattcctgagccacgaggacctgagattccacgtgaacagccacgaggccggcgacccccagctgttcaagtgcctgcagtgcagctacagaagcagaagatggagcagcctgaaggagcacatgttcaaccacgtgggcagcaagccctacaagtgcgacgagtgcagctacaccagcgtgtacagaaaggacgtgatcagacacgccgccgtgcacagcagagacagaaagaagagacccgaccccacccccaagctgagcagcttcccctgccccgtgtgcggcagagtgtaccccatgcagaagagactgacccagcacatgaagacccacagcaccgagaagccccacatgtgcgacaagtgcggcaagagcttcaagaagagatacaccttcaagatgcacctgctgacccacatccaggccgtggccaacagaagattcaagtgcgagttctgcgagttcgtgtgcgaggacaagaaggccctgctgaaccaccagctgagccacgtgagcgacaagcccttcaagtgcagcttctgcccctacagaaccttcagagaggacttcctgctgagccacgtggccgtgaagcacaccggcgccaagcccttcgcctgcgagtactgccacttcagcaccagacacaagaagaacctgagactgcacgtgagatgcagacacgccagcagcttcgaggagtggggcagaagacaccccgaggagccccccagcagaagaagacccttcttcagcctgcagcagatcgaggagctgaagcagcagcacagcgccgcccccggccccccccccagcagccccggcccccccgagatcccccccgaggccaccaccttccagagcagcgaggcccccagcctgctgtgcagcgacaccctgggcggcgccaccatcatctaccagcagggcgccgaggagagcaccgccatggccacccagaccgccctggacctgctgctgaacatgagcgcccagagagagctgggcggcaccgccctgcaggtggccgtggtgaagagcgaggacgtggaggccggcctggccagccccggcggccagcccagccccgagggcgccaccccccaggtggtgaccctgcacgtggccgagcccggcggcggcgccgccgccgagagccagctgggcccccccgacctgccccagatcaccctggcccccggccccttcggcggcaccggctacagcgtgatcaccgccccccccatggaggagggcaccagcgcccccggcaccccctacagcgaggagcccgccggcgaggccgcccaggccgtggtggtgagcgacaccctgaaggaggccggcacccactacatcatggccaccgacggcacccagctgcaccacatcgagctgaccgccgacggcagcatcagcttccccagccccgacgccctggccagcggcgccaagtggcccctgctgcagtgcggcggcctgcccagagacggccccgagccccccagccccgccaagacccactgcgtgggcgacagccagagcagcgccagcagcccccccgccaccagcaaggccctgggcctggccgtgccccccagcccccccagcgccgccaccgccgccagcaagaagttcagctgcaagatctgcgccgaggccttccccggcagagccgagatggagagccacaagagagcccacgccggccccggcgccttcaagtgccccgactgccccttcagcgccagacagtggcccgaggtgagagcccacatggcccagcacagcagcctgagaccccaccagtgcagccagtgcagcttcgccagcaagaacaagaaggacctgagaagacacatgctgacccacaccaaggagaagcccttcgcctgccacctgtgcggccagagattcaacagaaacggccacctgaagttccacatccagagactgcacagccccgacggcagaaagagcggcacccccaccgccagagcccccacccagacccccacccagaccatcatcctgaacagcgacgacgagaccctggccaccctgcacaccgccctgcagagcagccacggcgtgctgggccccgagagactgcagcaggccctgagccaggagcacatcatcgtggcccaggagcagaccgtgaccaaccaggaggaggccgcctacatccaggagatcaccaccgccgacggccagaccgtgcagcacctggtgaccagcgacaaccaggtgcagtacatcatcagccaggacggcgtgcagcacctgctgccccaggagtacgtggtggtgcccgagggccaccacatccaggtgcaggagggccagatcacccacatccagtacgagcagggcgcccccttcctgcaggagagccagatccagtacgtgcccgtgagccccggccagcagctggtgacccaggcccagctggaggccgccgcccacagcgccgtgaccgccgtggccgacgccgccatggcccaggcccagggcctgttcggcaccgacgagaccgtgcccgagcacatccagcagctgcagcaccagggcatcgagtacgacgtgatcaccctggccgacgactag

SEQ ID NO: 105976 - DNA, 3564 bp, Artificial Sequence
  Description of Artificial Sequence: Synthetic coding sequence
atggccaccagcagcatgcccgagagcgagagaaacgtggccaccaaggccagcggcgcccccatgaccagccccatgagcagcagcaccctggcccacagcctggccgccatcgaggccctggccgacggccccaccagcaccagcacctgcctggaggcccagggcggccccagcagccccgtgcagctgccccccgccagcggcgccgaggagcccgacctgcagagcctggaggccatgatggaggtggtggtggtgcagcagttcaagtgcaagatgtgccagtacagaagcagcaccaaggccaccctgctgagacacatgagagagagacacttcagacccgtggccgccgccgccgccgccgccggcaagaagggcagactgagaaagtggagcaccagcaccaagagccaggaggaggagggccccgaggaggaggacgacgacgacatcgtggacgccggcgccatcgacgacctggaggaggacagcgactacaaccccgccgaggacgagcccagaggcagacagctgagactgcagagacccacccccagcacccccagacccagaagaagacccggcagacccagaaagctgcccagactggagatcagcgacctgcccgacggcgtggagggcgagcccctggtgagcagccagagcggccagagcccccccgagccccaggaccccgaggcccccagcagcagcggccccggccacctggtggccatgggcaaggtgagcagaacccccgtggaggccggcgtgagccagagcgacgccgagaacgccgcccccagctgccccgacgagcacgacaccctgcccagaagaagaggcagacccagcagaagattcctgggcaagaagtacagaaagtactactacaagagccccaagcccctgctgagacccttcctgtgcagaatctgcggcagcagattcctgagccacgaggacctgagattccacgtgaacagccacgaggccggcgacccccagctgttcaagtgcctgcagtgcagctacagaagcagaagatggagcagcctgaaggagcacatgttcaaccacgtgggcagcaagccctacaagtgcgacgagtgcagctacaccagcgtgtacagaaaggacgtgatcagacacgccgccgtgcacagcagagacagaaagaagagacccgaccccacccccaagctgagcagcttcccctgccccgtgtgcggcagagtgtaccccatgcagaagagactgacccagcacatgaagacccacagcaccgagaagccccacatgtgcgacaagtgcggcaagagcttcaagaagagatacaccttcaagatgcacctgctgacccacatccaggccgtggccaacagaagattcaagtgcgagttctgcgagttcgtgtgcgaggacaagaaggccctgctgaaccaccagctgagccacgtgagcgacaagcccttcaagtgcagcttctgcccctacagaaccttcagagaggacttcctgctgagccacgtggccgtgaagcacaccggcgccaagcccttcgcctgcgagtactgccacttcagcaccagacacaagaagaacctgagactgcacgtgagatgcagacacgccagcagcttcgaggagtggggcagaagacaccccgaggagccccccagcagaagaagacccttcttcagcctgcagcagatcgaggagctgaagcagcagcacagcgccgcccccggccccccccccagcagccccggcccccccgagatcccccccgaggccaccaccttccagagcagcgaggcccccagcctgctgtgcagcgacaccctgggcggcgccaccatcatctaccagcagggcgccgaggagagcaccgccatggccacccagaccgccctggacctgctgctgaacatgagcgcccagagagagctgggcggcaccgccctgcaggtggccgtggtgaagagcgaggacgtggaggccggcctggccagccccggcggccagcccagccccgagggcgccaccccccaggtggtgaccctgcacgtggccgagcccggcggcggcgccgccgccgagagccagctgggcccccccgacctgccccagatcaccctggcccccggccccttcggcggcaccggctacagcgtgatcaccgccccccccatggaggagggcaccagcgcccccggcaccccctacagcgaggagcccgccggcgaggccgcccaggccgtggtggtgagcgacaccctgaaggaggccggcacccactacatcatggccaccgacggcacccagctgcaccacatcgagctgaccgccgacggcagcatcagcttccccagccccgacgccctggccagcggcgccaagtggcccctgctgcagtgcggcggcctgcccagagacggccccgagccccccagccccgccaagacccactgcgtgggcgacagccagagcagcgccagcagcccccccgccaccagcaaggccctgggcctggccgtgccccccagcccccccagcgccgccaccgccgccagcaagaagttcagctgcaagatctgcgccgaggccttccccggcagagccgagatggagagccacaagagagcccacgccggccccggcgccttcaagtgccccgactgccccttcagcgccagacagtggcccgaggtgagagcccacatggcccagcacagcagcctgagaccccaccagtgcagccagtgcagcttcgccagcaagaacaagaaggacctgagaagacacatgctgacccacaccaaggagaagcccttcgcctgccacctgtgcggccagagattcaacagaaacggccacctgaagttccacatccagagactgcacagccccgacggcagaaagagcggcacccccaccgccagagcccccacccagacccccacccagaccatcatcctgaacagcgacgacgagaccctggccaccctgcacaccgccctgcagagcagccacggcgtgctgggccccgagagactgcagcaggccctgagccaggagcacatcatcgtggcccaggagcagaccgtgaccaaccaggaggaggccgcctacatccaggagatcaccaccgccgacggccagaccgtgcagcacctggtgaccagcgacaaccaggtgcagtacatcatcagccaggacggcgtgcagcacctgctgccccaggagtacgtggtggtgcccgagggccaccacatccaggtgcaggagggccagatcacccacatccagtacgagcagggcgcccccttcctgcaggagagccagatccagtacgtgcccgtgagccccggccagcagctggtgacccaggcccagctggaggccgccgcccacagcgccgtgaccgccgtggccgacgccgccatggcccaggcccagggcctgttcggcaccgacgagaccgtgcccgagcacatccagcagctgcagcaccagggcatcgagtacgacgtgatcaccctggccgacgactag

SEQ ID NO: 105977 - DNA, 330 bp, Artificial Sequence
  Description of Artificial Sequence: Synthetic coding sequence
atgctggagaactacagcaacctggtgagcgtgggctactgcgtgcacaagcccgaggtgatcttcagactgcagcagggcgaggagccctggaagcaggaggaggagttccccagccagagcttccccgagatgggcttccaccacgtgcccgccggcctgaagctgctgagcagcagcgacccccccgccctggccagccagagcggcagaatcaccggcatgagccacagcatcccccccgtgatgggcagcttcaagttcaccaccagcatcttcacctgcgtgggcctgttcagattcttcttcttctacctgagctggttctag

SEQ ID NO: 105978 - DNA, 417 bp, Artificial Sequence
  Description of Artificial Sequence: Synthetic coding sequence
atgaacaaggtggagcagaagagccaggagagcgtgagcttcaaggacgtgaccgtgggcttcacccaggaggagtggcagcacctggaccccagccagagagccctgtacagagacgtgatgctggagaactacagcaacctggtgagcgtgggctactgcgtgcacaagcccgaggtgatcttcagactgcagcagggcgaggagccctggaagcaggaggaggagttccccagccagagcttccccgaggtgtggaccgccgaccacctgaaggagagaagccaggagaaccagagcaagcacctgtgggaggtggtgttcatcaacaacgagatgctgaccaaggagcagggcgacgtgatcggcatccccttcaacgtggacgcccccgagatgctgatgcccctggactag

SEQ ID NO: 105979 - DNA, 2433 bp, Artificial Sequence
  Description of Artificial Sequence: Synthetic coding sequence
atgaacaaggtggagcagaagagccaggagagcgtgagcttcaaggacgtgaccgtgggcttcacccaggaggagtggcagcacctggaccccagccagagagccctgtacagagacgtgatgctggagaactacagcaacctggtgagcgtgggctactgcgtgcacaagcccgaggtgatcttcagactgcagcagggcgaggagccctggaagcaggaggaggagttccccagccagagcttccccgtgtggaccgccgaccacctgaaggagagaagccaggagaaccagagcaagcacctgtgggaggtggtgttcatcaacaacgagatgctgaccaaggagcagggcgacgtgatcggcatccccttcaacgtggacgtgagcagcttccccagcagaaagatgttctgccagtgcgacagctgcggcatgagcttcaacaccgtgagcgagctggtgatcagcaagatcaactacctgggcaagaagagcgacgagttcaacgcctgcggcaagctgctgctgaacatcaagcacgacgagacccacacccaggagaagaacgaggtgctgaagaacagaaacaccctgagccaccacgaggagaccctgcagcacgagaagatccagaccctggagcacaacttcgagtacagcatctgccaggagaccctgctggagaaggccgtgttcaacacccagaagagagagaacgccgaggagaacaactgcgactacaacgagttcggcagaaccctgtgcgacagcagcagcctgctgttccaccagatcagccccagcagagacaaccactacgagttcagcgactgcgagaagttcctgtgcgtgaagagcaccctgagcaagccccacggcgtgagcatgaagcactacgactgcggcgagagcggcaacaacttcagaagaaagctgtgcctgagccacctgcagaagggcgacaagggcgagaagcacttcgagtgcaacgagtgcggcaaggccttctgggagaagagccacctgaccagacaccagagagtgcacaccggccagaagcccttccagtgcaacgagtgcgagaaggccttctgggacaagagcaacctgaccaagcaccagagaagccacaccggcgagaagcccttcgagtgcaacgagtgcggcaaggccttcagccacaagagcgccctgaccctgcaccagagaacccacaccggcgagaagccctaccagtgcaacgcctgcggcaagaccttctgccagaagagcgacctgaccaagcaccagagaacccacaccggcctgaagccctacgagtgctacgagtgcggcaagagcttcagagtgaccagccacctgaaggtgcaccagagaacccacaccggcgagaagcccttcgagtgcctggagtgcggcaagagcttcagcgagaagagcaacctgacccagcaccagagaatccacatcggcgacaagagctacgagtgcaacgcctgcggcaagaccttctaccacaagagcctgctgaccagacaccagatcatccacaccggctggaagccctacgagtgctacgagtgcggcaagaccttctgcctgaagagcgacctgaccgtgcaccagagaacccacaccggccagaagcccttcgcctgccccgagtgcggcaagttcttcagccacaagagcaccctgagccagcactacagaacccacaccggcgagaagccctacgagtgccacgagtgcggcaagatcttctacaacaagagctacctgaccaagcacaacagaacccacaccggcgagaagccctacgagtgcaacgagtgcggcaaggccttctaccagaagagccagctgacccagcaccagagaatccacatcggcgagaagccctacaagtgcaacgagtgcggcaaggccttctgccacaagagcgccctgatcgtgcaccagagaacccacacccaggagaagccctacaagtgcaacgagtgcggcaagagcttctgcgtgaagagcggcctgatcttccacgagagaaagcacaccggcgagaagccctacgagtgcaacgagtgcggcaagttcttcagacacaagagcagcctgaccgtgcaccacagagcccacaccggcgagaagagctgccagtgcaacgagtgcggcaagatcttctacagaaagagcgagctggcccagcaccagagaagccacaccggcgagaagccctacgagtgcaacacctgcagaaagaccttcagccagaagagcaacctgatcgtgcaccagagaagacacatcggcgagaacctgatgaacgagatggacatcagaaacttccagccccaggtgagcctgcacaacgccagcgagtacagccactgcggcgagagccccgacgacatcctgaacgtgcagtag

SEQ ID NO: 105980 - DNA, 2436 bp, Artificial Sequence
  Description of Artificial Sequence: Synthetic coding sequence
atgaacaaggtggagcagaagagccaggagagcgtgagcttcaaggacgtgaccgtgggcttcacccaggaggagtggcagcacctggaccccagccagagagccctgtacagagacgtgatgctggagaactacagcaacctggtgagcgtgggctactgcgtgcacaagcccgaggtgatcttcagactgcagcagggcgaggagccctggaagcaggaggaggagttccccagccagagcttccccgaggtgtggaccgccgaccacctgaaggagagaagccaggagaaccagagcaagcacctgtgggaggtggtgttcatcaacaacgagatgctgaccaaggagcagggcgacgtgatcggcatccccttcaacgtggacgtgagcagcttccccagcagaaagatgttctgccagtgcgacagctgcggcatgagcttcaacaccgtgagcgagctggtgatcagcaagatcaactacctgggcaagaagagcgacgagttcaacgcctgcggcaagctgctgctgaacatcaagcacgacgagacccacacccaggagaagaacgaggtgctgaagaacagaaacaccctgagccaccacgaggagaccctgcagcacgagaagatccagaccctggagcacaacttcgagtacagcatctgccaggagaccctgctggagaaggccgtgttcaacacccagaagagagagaacgccgaggagaacaactgcgactacaacgagttcggcagaaccctgtgcgacagcagcagcctgctgttccaccagatcagccccagcagagacaaccactacgagttcagcgactgcgagaagttcctgtgcgtgaagagcaccctgagcaagccccacggcgtgagcatgaagcactacgactgcggcgagagcggcaacaacttcagaagaaagctgtgcctgagccacctgcagaagggcgacaagggcgagaagcacttcgagtgcaacgagtgcggcaaggccttctgggagaagagccacctgaccagacaccagagagtgcacaccggccagaagcccttccagtgcaacgagtgcgagaaggccttctgggacaagagcaacctgaccaagcaccagagaagccacaccggcgagaagcccttcgagtgcaacgagtgcggcaaggccttcagccacaagagcgccctgaccctgcaccagagaacccacaccggcgagaagccctaccagtgcaacgcctgcggcaagaccttctgccagaagagcgacctgaccaagcaccagagaacccacaccggcctgaagccctacgagtgctacgagtgcggcaagagcttcagagtgaccagccacctgaaggtgcaccagagaacccacaccggcgagaagcccttcgagtgcctggagtgcggcaagagcttcagcgagaagagcaacctgacccagcaccagagaatccacatcggcgacaagagctacgagtgcaacgcctgcggcaagaccttctaccacaagagcctgctgaccagacaccagatcatccacaccggctggaagccctacgagtgctacgagtgcggcaagaccttctgcctgaagagcgacctgaccgtgcaccagagaacccacaccggccagaagcccttcgcctgccccgagtgcggcaagttcttcagccacaagagcaccctgagccagcactacagaacccacaccggcgagaagccctacgagtgccacgagtgcggcaagatcttctacaacaagagctacctgaccaagcacaacagaacccacaccggcgagaagccctacgagtgcaacgagtgcggcaaggccttctaccagaagagccagctgacccagcaccagagaatccacatcggcgagaagccctacaagtgcaacgagtgcggcaaggccttctgccacaagagcgccctgatcgtgcaccagagaacccacacccaggagaagccctacaagtgcaacgagtgcggcaagagcttctgcgtgaagagcggcctgatcttccacgagagaaagcacaccggcgagaagccctacgagtgcaacgagtgcggcaagttcttcagacacaagagcagcctgaccgtgcaccacagagcccacaccggcgagaagagctgccagtgcaacgagtgcggcaagatcttctacagaaagagcgagctggcccagcaccagagaagccacaccggcgagaagccctacgagtgcaacacctgcagaaagaccttcagccagaagagcaacctgatcgtgcaccagagaagacacatcggcgagaacctgatgaacgagatggacatcagaaacttccagccccaggtgagcctgcacaacgccagcgagtacagccactgcggcgagagccccgacgacatcctgaacgtgcagtag

SEQ ID NO: 105981 - DNA, 2454 bp, Artificial Sequence
  Description of Artificial Sequence: Synthetic coding sequence
atggccaacgccaccagaagaggcagcggcgtggagcagaagagccaggagagcgtgagcttcaaggacgtgaccgtgggcttcacccaggaggagtggcagcacctggaccccagccagagagccctgtacagagacgtgatgctggagaactacagcaacctggtgagcgtgggctactgcgtgcacaagcccgaggtgatcttcagactgcagcagggcgaggagccctggaagcaggaggaggagttccccagccagagcttccccgtgtggaccgccgaccacctgaaggagagaagccaggagaaccagagcaagcacctgtgggaggtggtgttcatcaacaacgagatgctgaccaaggagcagggcgacgtgatcggcatccccttcaacgtggacgtgagcagcttccccagcagaaagatgttctgccagtgcgacagctgcggcatgagcttcaacaccgtgagcgagctggtgatcagcaagatcaactacctgggcaagaagagcgacgagttcaacgcctgcggcaagctgctgctgaacatcaagcacgacgagacccacacccaggagaagaacgaggtgctgaagaacagaaacaccctgagccaccacgaggagaccctgcagcacgagaagatccagaccctggagcacaacttcgagtacagcatctgccaggagaccctgctggagaaggccgtgttcaacacccagaagagagagaacgccgaggagaacaactgcgactacaacgagttcggcagaaccctgtgcgacagcagcagcctgctgttccaccagatcagccccagcagagacaaccactacgagttcagcgactgcgagaagttcctgtgcgtgaagagcaccctgagcaagccccacggcgtgagcatgaagcactacgactgcggcgagagcggcaacaacttcagaagaaagctgtgcctgagccacctgcagaagggcgacaagggcgagaagcacttcgagtgcaacgagtgcggcaaggccttctgggagaagagccacctgaccagacaccagagagtgcacaccggccagaagcccttccagtgcaacgagtgcgagaaggccttctgggacaagagcaacctgaccaagcaccagagaagccacaccggcgagaagcccttcgagtgcaacgagtgcggcaaggccttcagccacaagagcgccctgaccctgcaccagagaacccacaccggcgagaagccctaccagtgcaacgcctgcggcaagaccttctgccagaagagcgacctgaccaagcaccagagaacccacaccggcctgaagccctacgagtgctacgagtgcggcaagagcttcagagtgaccagccacctgaaggtgcaccagagaacccacaccggcgagaagcccttcgagtgcctggagtgcggcaagagcttcagcgagaagagcaacctgacccagcaccagagaatccacatcggcgacaagagctacgagtgcaacgcctgcggcaagaccttctaccacaagagcctgctgaccagacaccagatcatccacaccggctggaagccctacgagtgctacgagtgcggcaagaccttctgcctgaagagcgacctgaccgtgcaccagagaacccacaccggccagaagcccttcgcctgccccgagtgcggcaagttcttcagccacaagagcaccctgagccagcactacagaacccacaccggcgagaagccctacgagtgccacgagtgcggcaagatcttctacaacaagagctacctgaccaagcacaacagaacccacaccggcgagaagccctacgagtgcaacgagtgcggcaaggccttctaccagaagagccagctgacccagcaccagagaatccacatcggcgagaagccctacaagtgcaacgagtgcggcaaggccttctgccacaagagcgccctgatcgtgcaccagagaacccacacccaggagaagccctacaagtgcaacgagtgcggcaagagcttctgcgtgaagagcggcctgatcttccacgagagaaagcacaccggcgagaagccctacgagtgcaacgagtgcggcaagttcttcagacacaagagcagcctgaccgtgcaccacagagcccacaccggcgagaagagctgccagtgcaacgagtgcggcaagatcttctacagaaagagcgagctggcccagcaccagagaagccacaccggcgagaagccctacgagtgcaacacctgcagaaagaccttcagccagaagagcaacctgatcgtgcaccagagaagacacatcggcgagaacctgatgaacgagatggacatcagaaacttccagccccaggtgagcctgcacaacgccagcgagtacagccactgcggcgagagccccgacgacatcctgaacgtgcagtag

SEQ ID NO: 105982 - DNA, 2433 bp, Artificial Sequence; identical to SEQ ID NO: 105979
  Description of Artificial Sequence: Synthetic coding sequence

SEQ ID NO: 105983 - DNA, 417 bp, Artificial Sequence; identical to SEQ ID NO: 105978
  Description of Artificial Sequence: Synthetic coding sequence

SEQ ID NO: 105984 - DNA, 2337 bp, Artificial Sequence
  Description of Artificial Sequence: Synthetic coding sequence
atgaacaaggtggaccagaagttccagggcagcgtgagcttcaaggacgtgaccgtgggcttcacccaggaggagtggcagcacctggaccccagccagagagccctgtacagagacgtgatgctggagaactacagcaacctggtgagcgtgggctactgcgcccacaagcccgaggtgatcttcagactggagcagggcgaggagccctggagactggaggaggagttccccagccagagcttccccgaggtgtggaccgccgaccacctgaaggagagaagccaggagaaccagagcaagcacctgtgggaggtggtgttcatcaacaacgagatgctgaccaaggagcagggcaacgtgatcggcatccccttcaacatggacgtgagcagcttccccagcagaaagatgttctgccagtacgacagcagaggcatgagcttcaacaccgtgagcgagctggtgatcagcaagatcaactacctgggcaagaagagcgacgagttcaacgcctgcggcaagctgctgctgaacatcaagcacgacgagacccacaccagagagaagaacgaggtgctgaagaacagaaacaccctgagccacagagagaacaccctgcagcacgagaagatccagaccctggaccacaacttcgagtacagcatctgccaggagaccctgctggagaaggccgtgttcaacaccagaaagagagagaacgccgaggagaacaactgcgactacaacgagttcggcagaaccttctgcgacagcagcagcctgctgttccaccagatcccccccagcaaggacagccactacgagttcagcgactgcgagaagttcctgtgcgtgaagagcaccctgagcaagcacgacggcgtgcccgtgaagcactacgactgcggcgagagcggcaacaacttcagaagaaagctgtgcctgagccagctgcagaagggcgacaagggcgagaagcacttcgagtgcaacgagtgcggcaaggccttctgggagaagagccacctgaccagacaccagagagtgcacaccggcgagaagcacttccagtgcaaccagtgcggcaagaccttctgggagaagagcaacctgaccaagcaccagagaagccacaccggcgagaagcccttcgagtgcaacgagtgcggcaaggccttcagccacaagagcgccctgaccctgcaccagagaacccacaccggcgagaagccctaccagtgcaacgcctgcggcaagaccttctaccagaagagcgacctgaccaagcaccagagaacccacaccggccagaagccctacgagtgctacgagtgcggcaagagcttctgcatgaacagccacctgaccgtgcaccagagaacccacaccggcgagaagcccttcgagtgcctggagtgcggcaagagcttctgccagaagagccacctgacccagcaccagagaacccacatcggcgacaagccctacgagtgcaacgcctgcggcaagaccttctaccacaagagcgtgctgaccagacaccagatcatccacaccggcctgaagccctacgagtgctacgagtgcggcaagaccttctgcctgaagagcgacctgaccatccaccagagaacccacaccggcgagaagcccttcgcctgccccgagtgcggcaagttcttcagccacaagagcaccctgagccagcactacagaacccacaccggcgagaagccctacgagtgccacgagtgcggcaagatcttctacaacaagagctacctgaccaagcacaacagaacccacaccggcgagaagccctacgagtgcaacgagtgcggcaagaccttctgccagaagagccagctgacccagcaccagagaatccacatcggcgagaagccctacgagtgcaacgagtgcggcaaggccttctgccacaagagcgccctgatcgtgcaccagagaacccacacccaggagaagccctacaagtgcaacgagtgcggcaagagcttctgcgtgaagagcggcctgatcctgcacgagagaaagcacaccggcgagaagccctacgagtgcaacgagtgcggcaagagcttcagccacaagagcagcctgaccgtgcaccacagagcccacaccggcgagaagagctgccagtgcaacgagtgcggcaagatcttctacagaaagagcgacctggccaagcaccagagaagccacaccggcgagaagccctacgagtgcaacacctgcagaaagaccttcagccagaagagcaacctgatcgtgcaccagagaacccacatcggcgagaagccctacgagtag

SEQ ID NO: 105985 - DNA, 2235 bp, Artificial Sequence
  Description of Artificial Sequence: Synthetic coding sequence
atgaacaaggtggaccagaagttccagggcagcgtgagcttcaaggacgtgaccgtgggcttcacccaggaggagtggcagcacctggaccccagccagagagccctgtacagagacgtgatgctggagaactacagcaacctggtgagcgtgggcaccgccgaccacctgaaggagagaagccaggagaaccagagcaagcacctgtgggaggtggtgttcatcaacaacgagatgctgaccaaggagcagggcaacgtgatcggcatccccttcaacatggacgtgagcagcttccccagcagaaagatgttctgccagtacgacagcagaggcatgagcttcaacaccgtgagcgagctggtgatcagcaagatcaactacctgggcaagaagagcgacgagttcaacgcctgcggcaagctgctgctgaacatcaagcacgacgagacccacaccagagagaagaacgaggtgctgaagaacagaaacaccctgagccacagagagaacaccctgcagcacgagaagatccagaccctggaccacaacttcgagtacagcatctgccaggagaccctgctggagaaggccgtgttcaacaccagaaagagagagaacgccgaggagaacaactgcgactacaacgagttcggcagaaccttctgcgacagcagcagcctgctgttccaccagatcccccccagcaaggacagccactacgagttcagcgactgcgagaagttcctgtgcgtgaagagcaccctgagcaagcacgacggcgtgcccgtgaagcactacgactgcggcgagagcggcaacaacttcagaagaaagctgtgcctgagccagctgcagaagggcgacaagggcgagaagcacttcgagtgcaacgagtgcggcaaggccttctgggagaagagccacctgaccagacaccagagagtgcacaccggcgagaagcacttccagtgcaaccagtgcggcaagaccttctgggagaagagcaacctgaccaagcaccagagaagccacaccggcgagaagcccttcgagtgcaacgagtgcggcaaggccttcagccacaagagcgccctgaccctgcaccagagaacccacaccggcgagaagccctaccagtgcaacgcctgcggcaagaccttctaccagaagagcgacctgaccaagcaccagagaacccacaccggccagaagccctacgagtgctacgagtgcggcaagagcttctgcatgaacagccacctgaccgtgcaccagagaacccacaccggcgagaagcccttcgagtgcctggagtgcggcaagagcttctgccagaagagccacctgacccagcaccagagaacccacatcggcgacaagccctacgagtgcaacgcctgcggcaagaccttctaccacaagagcgtgctgaccagacaccagatcatccacaccggcctgaagccctacgagtgctacgagtgcggcaagaccttctgcctgaagagcgacctgaccatccaccagagaacccacaccggcgagaagcccttcgcctgccccgagtgcggcaagttcttcagccacaagagcaccctgagccagcactacagaacccacaccggcgagaagccctacgagtgccacgagtgcggcaagatcttctacaacaagagctacctgaccaagcacaacagaacccacaccggcgagaagccctacgagtgcaacgagtgcggcaagaccttctgccagaagagccagctgacccagcaccagagaatccacatcggcgagaagccctacgagtgcaacgagtgcggcaaggccttctgccacaagagcgccctgatcgtgcaccagagaacccacacccaggagaagccctacaagtgcaacgagtgcggcaagagcttctgcgtgaagagcggcctgatcctgcacgagagaaagcacaccggcgagaagccctacgagtgcaacgagtgcggcaagagcttcagccacaagagcagcctgaccgtgcaccacagagcccacaccggcgagaagagctgccagtgcaacgagtgcggcaagatcttctacagaaagagcgacctggccaagcaccagagaagccacaccggcgagaagccctacgagtgcaacacctgcagaaagaccttcagccagaagagcaacctgatcgtgcaccagagaacccacatcggcgagaagccctacgagtag

SEQ ID NO: 105986 - DNA, 1683 bp, Artificial Sequence
  Description of Artificial Sequence: Synthetic coding sequence
atgctgctgctgctgagcgaccagctgctgctgaccgccctgagaaagcccaacccccaggccatggccgccctgttcctgagcgcccccccccaggccgaggtgaccttcgaggacgtggccgtgtacctgagcagagaggagtggggcagactgggccccgcccagagaggcctgtacagagacgtgatgctggagacctacggcaacctggtgagcctgggcgtgggccccgccggccccaagcccggcgtgatcagccagctggagagaggcgacgagccctgggtgctggacgtgcagggcaccagcggcaaggagcacctgagagtgaacagccccgccctgggcaccagaaccgagtacaaggagctgaccagccaggagaccttcggcgaggaggacccccagggcagcgagcccgtggaggcctgcgaccacatcagcaagagcgagggcagcctggagaagctggtggagcagagaggccccagagccgtgaccctgaccaacggcgagagcagcagagagagcggcggcaacctgagactgctgagcagacccgtgcccgaccagagaccccacaagtgcgacatctgcgagcagagcttcgagcagagaagctacctgaacaaccacaagagagtgcacagaagcaagaagaccaacaccgtgagaaacagcggcgagatcttcagcgccaacctggtggtgaaggaggaccagaagatccccaccggcaagaagctgcactactgcagctactgcggcaagaccttcagatacagcgccaacctggtgaagcaccagagactgcacaccgaggagaagccctacaagtgcgacgagtgcggcaaggccttcagccagagctgcgagttcatcaaccacagaagaatgcacagcggcgagatcccctacagatgcgacgagtgcggcaagaccttcaccagaagacccaacctgatgaagcaccagagaatccacaccggcgagaagccctacaagtgcggcgagtgcggcaagcacttcagcgcctacagcagcctgatctaccaccagagaatccacaccggcgagaagccctacaagtgcaacgactgcggcaaggccttcagcgacggcagcatcctgatcagacacagaagaacccacaccggcgagaagcccttcgagtgcaaggagtgcggcaagggcttcacccagagcagcaacctgatccagcaccagagaatccacaccggcgagaagccctacaagtgcaacgagtgcgagaaggccttcatccagaagaccaagctggtggagcaccagagaagccacaccggcgagaagccctacgagtgcaacgactgcggcaaggtgttcagccagagcacccacctgatccagcaccagagaatccacaccggcgagaagccctacaagtgcagcgagtgcggcaaggccttccacaacagcagcagactgatccaccaccagagactgcaccacggcgagaagccctacagatgcagcgactgcaagaaggccttcagccagagcacctacctgatccagcacagaagaatccacaccggcgagaagccctacaagtgcagcgagtgcggcaaggccttcagacacagcagcaacatgtgccagcaccagagaatccacctgagagaggacttcagcatgtag

SEQ ID NO: 105987 - DNA, 1620 bp, Artificial Sequence
  Description of Artificial Sequence: Synthetic coding sequence
atggccgccctgttcctgagcgcccccccccaggccgaggtgaccttcgaggacgtggccgtgtacctgagcagagaggagtggggcagactgggccccgcccagagaggcctgtacagagacgtgatgctggagacctacggcaacctggtgagcctgggcgtgggccccgccggccccaagcccggcgtgatcagccagctggagagaggcgacgagccctgggtgctggacgtgcagggcaccagcggcaaggagcacctgagagtgaacagccccgccctgggcaccagaaccgagtacaaggagctgaccagccaggagaccttcggcgaggaggacccccagggcagcgagcccgtggaggcctgcgaccacatcagcaagagcgagggcagcctggagaagctggtggagcagagaggccccagagccgtgaccctgaccaacggcgagagcagcagagagagcggcggcaacctgagactgctgagcagacccgtgcccgaccagagaccccacaagtgcgacatctgcgagcagagcttcgagcagagaagctacctgaacaaccacaagagagtgcacagaagcaagaagaccaacaccgtgagaaacagcggcgagatcttcagcgccaacctggtggtgaaggaggaccagaagatccccaccggcaagaagctgcactactgcagctactgcggcaagaccttcagatacagcgccaacctggtgaagcaccagagactgcacaccgaggagaagccctacaagtgcgacgagtgcggcaaggccttcagccagagctgcgagttcatcaaccacagaagaatgcacagcggcgagatcccctacagatgcgacgagtgcggcaagaccttcaccagaagacccaacctgatgaagcaccagagaatccacaccggcgagaagccctacaagtgcggcgagtgcggcaagcacttcagcgcctacagcagcctgatctaccaccagagaatccacaccggcgagaagccctacaagtgcaacgactgcggcaaggccttcagcgacggcagcatcctgatcagacacagaagaacccacaccggcgagaagcccttcgagtgcaaggagtgcggcaagggcttcacccagagcagcaacctgatccagcaccagagaatccacaccggcgagaagccctacaagtgcaacgagtgcgagaaggccttcatccagaagaccaagctggtggagcaccagagaagccacaccggcgagaagccctacgagtgcaacgactgcggcaaggtgttcagccagagcacccacctgatccagcaccagagaatccacaccggcgagaagccctacaagtgcagcgagtgcggcaaggccttccacaacagcagcagactgatccaccaccagagactgcaccacggcgagaagccctacagatgcagcgactgcaagaaggccttcagccagagcacctacctgatccagcacagaagaatccacaccggcgagaagccctacaagtgcagcgagtgcggcaaggccttcagacacagcagcaacatgtgccagcaccagagaatccacctgagagaggacttcagcatgtag

SEQ ID NO: 105988 - DNA, 1560 bp, Artificial Sequence
  Description of Artificial Sequence: Synthetic coding sequence
atgtacctgatcagagagagccacgccagcggcagcagcagcgtgaccagcagctgcagcctgcccagcgagagccccaccctgagacagtggagaccctgcagctgcctgccccaccccagacccggcgtgatcagccagctggagagaggcgacgagccctgggtgctggacgtgcagggcaccagcggcaaggagcacctgagagtgaacagccccgccctgggcaccagaaccgagtacaaggagctgaccagccaggagaccttcggcgaggaggacccccagggcagcgagcccgtggaggcctgcgaccacatcagcaagagcgagggcagcctggagaagctggtggagcagagaggccccagagccgtgaccctgaccaacggcgagagcagcagagagagcggcggcaacctgagactgctgagcagacccgtgcccgaccagagaccccacaagtgcgacatctgcgagcagagcttcgagcagagaagctacctgaacaaccacaagagagtgcacagaagcaagaagaccaacaccgtgagaaacagcggcgagatcttcagcgccaacctggtggtgaaggaggaccagaagatccccaccggcaagaagctgcactactgcagctactgcggcaagaccttcagatacagcgccaacctggtgaagcaccagagactgcacaccgaggagaagccctacaagtgcgacgagtgcggcaaggccttcagccagagctgcgagttcatcaaccacagaagaatgcacagcggcgagatcccctacagatgcgacgagtgcggcaagaccttcaccagaagacccaacctgatgaagcaccagagaatccacaccggcgagaagccctacaagtgcggcgagtgcggcaagcacttcagcgcctacagcagcctgatctaccaccagagaatccacaccggcgagaagccctacaagtgcaacgactgcggcaaggccttcagcgacggcagcatcctgatcagacacagaagaacccacaccggcgagaagcccttcgagtgcaaggagtgcggcaagggcttcacccagagcagcaacctgatccagcaccagagaatccacaccggcgagaagccctacaagtgcaacgagtgcgagaaggccttcatccagaagaccaagctggtggagcaccagagaagccacaccggcgagaagccctacgagtgcaacgactgcggcaaggtgttcagccagagcacccacctgatccagcaccagagaatccacaccggcgagaagccctacaagtgcagcgagtgcggcaaggccttccacaacagcagcagactgatccaccaccagagactgcaccacggcgagaagccctacagatgcagcgactgcaagaaggccttcagccagagcacctacctgatccagcacagaagaatccacaccggcgagaagccctacaagtgcagcgagtgcggcaaggccttcagacacagcagcaacatgtgccagcaccagagaatccacctgagagaggacttcagcatgtag

SEQ ID NO: 105989 - DNA, 1584 bp, Artificial Sequence
  Description of Artificial Sequence: Synthetic coding sequence
atgaccgccgagctgagagaggccatggccctggccccctggggccccgtgaaggtgaagaaggaggaggaggaggaggagaacttccccggccaggccagcagccagcaggtgcacagcgagaacatcaaggtgtgggcccccgtgcagggcctgcagaccggcctggacggcagcgaggaggaggagaagggccagaacatcagctgggacatggccgtggtgctgaaggccacccaggaggcccccgccgccagcaccctgggcagctacagcctgcccggcaccctggccaagagcgagatcctggagacccacggcaccatgaacttcctgggcgccgagaccaagaacctgcagctgctggtgcccaagaccgagatctgcgaggaggccgagaagcccctgatcatcagcgagagaatccagaaggccgacccccagggccccgagctgggcgaggcctgcgagaagggcaacatgctgaagagacagagaatcaagagagagaagaaggacttcagacaggtgatcgtgaacgactgccacctgcccgagagcttcaaggaggaggagaaccagaagtgcaagaagagcggcggcaagtacagcctgaacagcggcgccgtgaagaaccccaagacccagctgggccagaagcccttcacctgcagcgtgtgcggcaagggcttcagccagagcgccaacctggtggtgcaccagagaatccacaccggcgagaagcccttcgagtgccacgagtgcggcaaggccttcatccagagcgccaacctggtggtgcaccagagaatccacaccggccagaagccctacgtgtgcagcaagtgcggcaaggccttcacccagagcagcaacctgaccgtgcaccagaagatccacagcctggagaagaccttcaagtgcaacgagtgcgagaaggccttcagctacagcagccagctggccagacaccagaaggtgcacatcaccgagaagtgctacgagtgcaacgagtgcggcaagaccttcaccagaagcagcaacctgatcgtgcaccagagaatccacaccggcgagaagcccttcgcctgcaacgactgcggcaaggccttcacccagagcgccaacctgatcgtgcaccagagaagccacaccggcgagaagccctacgagtgcaaggagtgcggcaaggccttcagctgcttcagccacctgatcgtgcaccagagaatccacaccgccgagaagccctacgactgcagcgagtgcggcaaggccttcagccagctgagctgcctgatcgtgcaccagagaatccacagcggcgacctgccctacgtgtgcaacgagtgcggcaaggccttcacctgcagcagctacctgctgatccaccagagaatccacaacggcgagaagccctacacctgcaacgagtgcggcaaggccttcagacagagaagcagcctgaccgtgcaccagagaacccacaccggcgagaagccctacgagtgcgagaagtgcggcgccgccttcatcagcaacagccacctgatgagacaccacagaacccacctggtggagtag

SEQ ID NO: 105990 - DNA, 405 bp, Artificial Sequence
  Description of Artificial Sequence: Synthetic coding sequence
atgaccgccgagctgagagaggccatggccctggccccctggggccccgtgaaggtgaagaaggaggaggaggaggaggagaacttccccggccaggccagcagccagcaggtgcacagcgagaacatcaaggtgtgggcccccgtgcagggcctgcagaccggcctggacggcagcgaggaggaggagaagggccagaacatcagctgggacatggccgtggtgctgaaggccacccaggaggcccccgccgccagcaccctgggcagctacagcctgcccggcaccctggccaagagcgagatcctggagacccacggcaccatgaacttcctgggcgccgagaccaagaacctgcagctgctggtgcccaagaccgagatctgcgaggaggccgagaagtag

SEQ ID NO: 105991 - DNA, 339 bp, Artificial Sequence
  Description of Artificial Sequence: Synthetic coding sequence
atgaccgccgagctgagagaggccatggccctggccccctggggccccgtgaaggtgaagaaggaggaggaggaggaggagaacttccccggccaggccagcagccagcaggtgcacagcgagaacatcaaggtgtgggcccccgtgcagggcctgcagaccggcctggacggcagcgaggaggaggagaagggccagaacatcagctgggacatggccgtggtgctgaaggccacccaggaggcccccgccgccagcaccctgggcagctacagcctgcccggcaccctggccaagagcgagatcctggagacccacggcaccatgaacttcctgtag

SEQ ID NO: 105992 - DNA, 1104 bp, Artificial Sequence
  Description of Artificial Sequence: Synthetic coding sequence
atgctgaagagacagagaatcaagagagagaagaaggacttcagacaggtgatcgtgaacgactgccacctgcccgagagcttcaaggaggaggagaaccagaagtgcaagaagagcggcggcaagtacagcctgaacagcggcgccgtgaagaaccccaagacccagctgggccagaagcccttcacctgcagcgtgtgcggcaagggcttcagccagagcgccaacctggtggtgcaccagagaatccacaccggcgagaagcccttcgagtgccacgagtgcggcaaggccttcatccagagcgccaacctggtggtgcaccagagaatccacaccggccagaagccctacgtgtgcagcaagtgcggcaaggccttcacccagagcagcaacctgaccgtgcaccagaagatccacagcctggagaagaccttcaagtgcaacgagtgcgagaaggccttcagctacagcagccagctggccagacaccagaaggtgcacatcaccgagaagtgctacgagtgcaacgagtgcggcaagaccttcaccagaagcagcaacctgatcgtgcaccagagaatccacaccggcgagaagcccttcgcctgcaacgactgcggcaaggccttcacccagagcgccaacctgatcgtgcaccagagaagccacaccggcgagaagccctacgagtgcaaggagtgcggcaaggccttcagctgcttcagccacctgatcgtgcaccagagaatccacaccgccgagaagccctacgactgcagcgagtgcggcaaggccttcagccagctgagctgcctgatcgtgcaccagagaatccacagcggcgacctgccctacgtgtgcaacgagtgcggcaaggccttcacctgcagcagctacctgctgatccaccagagaatccacaacggcgagaagccctacacctgcaacgagtgcggcaaggccttcagacagagaagcagcctgaccgtgcaccagagaacccacaccggcgagaagccctacgagtgcgagaagtgcggcgccgccttcatcagcaacagccacctgatgagacaccacagaacccacctggtggagtag

SEQ ID NO: 105993 - DNA, 981 bp, Artificial Sequence
  Description of Artificial Sequence: Synthetic coding sequence
atggacctgaccgccatctacgagagcctgctgagcctgagccccgacgtgcccgtgcccagcgaccacggcggcaccgagagcagccccggctggggcagcagcggcccctggagcctgagccccagcgacagcagccccagcggcgtgaccagcagactgcccggcagaagcaccagcctggtggagggcagaagctgcggctgggtgccccccccccccggcttcgcccccctggcccccagactgggccccgagctgagccccagccccaccagccccaccgccaccagcaccacccccagcagatacaagaccgagctgtgcagaaccttcagcgagagcggcagatgcagatacggcgccaagtgccagttcgcccacggcctgggcgagctgagacaggccaacagacaccccaagtacaagaccgagctgtgccacaagttctacctgcagggcagatgcccctacggcagcagatgccacttcatccacaaccccagcgaggacctggccgcccccggccacccccccgtgctgagacagagcatcagcttcagcggcctgcccagcggcagaagaaccagcccccccccccccggcctggccggccccagcctgagcagcagcagcttcagccccagcagcagcccccccccccccggcgacctgcccctgagccccagcgccttcagcgccgcccccggcacccccctggccagaagagaccccacccccgtgtgctgccccagctgcagaagagccacccccatcagcgtgtggggccccctgggcggcctggtgagaacccccagcgtgcagagcctgggcagcgaccccgacgagtacgccagcagcggcagcagcctgggcggcagcgacagccccgtgttcgaggccggcgtgttcgcccccccccagcccgtggccgcccccagaagactgcccatcttcaacagaatcagcgtgagcgagtag

SEQ ID NO: 105994 - DNA, 1017 bp, Artificial Sequence
  Description of Artificial Sequence: Synthetic coding sequence
atgaccaccaccctggtgagcgccaccatcttcgacctgagcgaggtgctgtgcaagggcaacaagatgctgaactacagcgcccccagcgccggcggctgcctgctggacagaaaggccgtgggcacccccgccggcggcggcttccccagaagacacagcgtgaccctgcccagcagcaagttccaccagaaccagctgctgagcagcctgaagggcgagcccgcccccgccctgagcagcagagacagcagattcagagacagaagcttcagcgagggcggcgagagactgctgcccacccagaagcagcccggcggcggccaggtgaacagcagcagatacaagaccgagctgtgcagacccttcgaggagaacggcgcctgcaagtacggcgacaagtgccagttcgcccacggcatccacgagctgagaagcctgaccagacaccccaagtacaagaccgagctgtgcagaaccttccacaccatcggcttctgcccctacggccccagatgccacttcatccacaacgccgaggagagaagagccctggccggcgccagagacctgagcgccgacagacccagactgcagcacagcttcagcttcgccggcttccccagcgccgccgccaccgccgccgccaccggcctgctggacagccccaccagcatcacccccccccccatcctgagcgccgacgacctgctgggcagccccaccctgcccgacggcaccaacaaccccttcgccttcagcagccaggagctggccagcctgttcgcccccagcatgggcctgcccggcggcggcagccccaccaccttcctgttcagacccatgagcgagagcccccacatgttcgacagcccccccagcccccaggacagcctgagcgaccaggagggctacctgagcagcagcagcagcagccacagcggcagcgacagccccaccctggacaacagcagaagactgcccatcttcagcagactgagcatcagcgacgactag

SEQ ID NO: 105995 - DNA, 501 bp, Artificial Sequence
  Description of Artificial Sequence: Synthetic coding sequence
atgaacacctacaccagaagcgccagcttcacccccaagaccttcaccttccccctggcccagaacagaaccagccaccccaccaccaccagcaagctgaagtacctgggcagacccagccccagaagagacgccctgcaggccaacggcgagggccccgaggtgggccccggcaccgaggagcccgcccacagactgcccgtgggcagcggcagcgccggcgaggccgccgccagcctgggcaccgccagagtgagaagcggcagagccgagtgcaccgccaagctggccggcgacggccacgccagactggccagcgccttcctgcacagaagagccgccctgcccccccccctgggcacctgcagacccagactgggcgagggcggcagcgcccccgccctgggccccagccccagaagaggcagaagagtgagcgagggcctgagagacagcctgccccccctgggcagcctgaccctgggcaagagccccaagtag

SEQ ID NO: 105996 - DNA, 966 bp, Artificial Sequence
  Description of Artificial Sequence: Synthetic coding sequence
atgaccaccaccctggtgagcgccaccatcttcgacctgagcgaggtgctgtgcaagggcaacaagatgctgaactacagcgcccccagcgccggcggctgcctgctggacagaaaggccgtgggcacccccgccggcggcggcttccccagaagacacagcgtgaccctgcccagcagcaagttccaccagaaccagctgctgagcagcctgaagggcgagcccgcccccgccctgagcagcagagacagcagattcagagacagaagcttcagcgagggcggcgagagactgctgcccacccagaagcagcccttcgaggagaacggcgcctgcaagtacggcgacaagtgccagttcgcccacggcatccacgagctgagaagcctgaccagacaccccaagtacaagaccgagctgtgcagaaccttccacaccatcggcttctgcccctacggccccagatgccacttcatccacaacgccgaggagagaagagccctggccggcgccagagacctgagcgccgacagacccagactgcagcacagcttcagcttcgccggcttccccagcgccgccgccaccgccgccgccaccggcctgctggacagccccaccagcatcacccccccccccatcctgagcgccgacgacctgctgggcagccccaccctgcccgacggcaccaacaaccccttcgccttcagcagccaggagctggccagcctgttcgcccccagcatgggcctgcccggcggcggcagccccaccaccttcctgttcagacccatgagcgagagcccccacatgttcgacagcccccccagcccccaggacagcctgagcgaccaggagggctacctgagcagcagcagcagcagccacagcggcagcgacagccccaccctggacaacagcagaagactgcccatcttcagcagactgagcatcagcgacgactag

SEQ ID NO: 105997 - DNA, 1017 bp, Artificial Sequence; identical to SEQ ID NO: 105994
  Description of Artificial Sequence: Synthetic coding sequence

SEQ ID NO: 105998 - DNA, 1485 bp, Artificial Sequence
  Description of Artificial Sequence: Synthetic coding sequence
atgagcaccaccctgctgagcgccttctacgacgtggacttcctgtgcaagaccgagaagagcctggccaacctgaacctgaacaacatgctggacaagaaggccgtgggcacccccgtggccgccgcccccagcagcggcttcgcccccggcttcctgagaagacacagcgccagcaacctgcacgccctggcccaccccgcccccagccccggcagctgcagccccaagttccccggcgccgccaacggcagcagctgcggcagcgccgccgccggcggccccaccagctacggcaccctgaaggagcccagcggcggcggcggcaccgccctgctgaacaaggagaacaagttcagagacagaagcttcagcgagaacggcgacagaagccagcacctgctgcacctgcagcagcagcagaagggcggcggcggcagccagatcaacagcaccagatacaagaccgagctgtgcagacccttcgaggagagcggcacctgcaagtacggcgagaagtgccagttcgcccacggcttccacgagctgagaagcctgaccagacaccccaagtacaagaccgagctgtgcagaaccttccacaccatcggcttctgcccctacggccccagatgccacttcatccacaacgccgacgagagaagacccgcccccagcggcggcgccagcggcgacctgagagccttcggcaccagagacgccctgcacctgggcttccccagagagcccagacccaagctgcaccacagcctgagcttcagcggcttccccagcggccaccaccagccccccggcggcctggagagccccctgctgctggacagccccaccagcagaaccccccccccccccagctgcagcagcgccagcagctgcagcagcagcgccagcagctgcagcagcgccagcgccgccagcacccccagcggcgcccccacctgctgcgccagcgccgccgccgccgccgccgccgccctgctgtacggcaccggcggcgccgaggacctgctggcccccggcgccccctgcgccgcctgcagcagcgccagctgcgccaacaacgccttcgccttcggccccgagctgagcagcctgatcacccccctggccatccagacccacaacttcgccgccgtggccgccgccgcctactacagaagccagcagcagcagcagcagcagggcctggccccccccgcccagccccccgccccccccagcgccaccctgcccgccggcgccgccgccccccccagcccccccttcagcttccagctgcccagaagactgagcgacagccccgtgttcgacgccccccccagcccccccgacagcctgagcgacagagacagctacctgagcggcagcctgagcagcggcagcctgagcggcagcgagagccccagcctggaccccggcagaagactgcccatcttcagcagactgagcatcagcgacgactag

SEQ ID NO: 105999 - DNA, 651 bp, Artificial Sequence
  Description of Artificial Sequence: Synthetic coding sequence
atgagcgccctgggccagatcaccatcaccgtgagcagatgctggaacaccgagagaaaccagaccgacaagaacccctgcctgcacggcgcctacctgcagctgagagagaccgtgaagaacaagagcacccacctgaagaagcccctgatgaagcaggcccccccctggaaggaccacctgaccttccagcccctgcaccccgccgagagaaagacccaggtgtggagatggcagagcggcaacagcagcgacctggagaccaccagcagcgccagcccctggcccaccggcagcaacagagacgtggtgctgaacaccctggccgagagctgctgcggcctgagcgagctgatcaccgcccccccctacgccggcgtgagcatccagggcttcagccagatctgggtgctgttccccttctgcggcggcaccttccaccacaacgagaaggacgtgctgggcctgcaggacttcgagagagagagcgtgagcaccagccagagcagaaacatcagcctgctgaccctgggccagctgcagaactgcgtgatcggcaagctgaccatcatcgacctgctgaccgagcacctgctgggcgtgagacacggcgtgatctgcttcccctggggcctgcccagcagcagctag

SEQ ID NO: 106000 - DNA, 1224 bp, Artificial Sequence
  Description of Artificial Sequence: Synthetic coding sequence
atgcagcagaaggccttcgaggagagcagatacccctggcaggagagcttcgagaacgtggccgtgtgcctgcccctgagatgccccagatgcggcgaccacaccagattcagaagcctgagcagcctgagagcccacctggagttcagccacagctacgaggagagaaccctgctgaccaagtgcagcctgttccccagcctgaaggacaccgacctggtgaccagcagcgagctgctgaagcccggcaagctgcagagcagcggcaacgtggtgaagcagaagcccagctacgtgaacctgtacagcatcagccacgagcacagcaaggacagaaagcccttcgaggtggtggccgagagacccgtgagctacgtgcagacctacaccgccatggacctgcacgccgacagcctggacggcaccagaagcggccccggcctgcccaccagcgacaccaaggccagcttcgaggcccacgtgagagagaagttcaacagaatggtggaggccgtggacagaaccatcgagaagagaatcgacaagctgaccaaggagctggcccagaagaccgccgagctgctggaggtgagagccgccttcgtgcagctgacccagaagaagcaggaggtgcagagaagagagagagccctgaacagacaggtggacgtggccgtggagatgatcgccgtgctgagacagagactgaccgagagcgaggaggagctgctgagaaaggaggaggaggtggtgaccttcaaccacttcctggaggccgccgccgagaaggaggtgcagggcaaggccagactgcaggacttcatcgagaacctgctgcagagagtggagctggccgagaagcagctggagtactaccagagccagcaggccagcggcttcgtgagagacctgagcggccacgtgctgaccgacatcagcagcaacagaaagcccaagtgcctgagcagaggccacccccacagcgtgtgcaaccaccccgacctgaaggcccacttccaccccaagggcagaaaccacctgaagaaggccaaggacgacagagccagcatgcagcccgccaaggccatccacgagcaggccgagagcagcagagacctgtgcagaccccccaagaagggcgagctgctgggcttcggcagaaagggcaacatcagacccaagatggccaagaagaagcccaccgccatcgtgaacatcatctag

SEQ ID NO: 106001 - DNA, 1002 bp, Artificial Sequence
  Description of Artificial Sequence: Synthetic coding sequence
atgcagcagaaggccttcgaggagagcagatacccctggcaggagagcttcgagaacgtggccgtgtgcctgcccctgagatgccccagatgcggcgaccacaccagattcagaagcctgagcagcctgagagcccacctggagttcagccacagctacgaggagagaaccctgctgaccaagtgcagcctgttccccagcctgaaggacaccgacctggtgaccagcagcgagctgctgaagcccggcaagctgcagagcagcggcaacgtggtgaagcagaagcccagctacgtgaacctgtacagcatcagccacgagcacagcaaggacagaaagcccttcgaggtggtggccgagagacccgtgagctacgtgcagacctacaccgccatggacctgcacgccgacagcctggacggcaccagaagcggccccggcctgcccaccagcgacaccaaggccagcttcgaggcccacgtgagagagaagttcaacagaatggtggaggccgtggacagaaccatcgagaagagaatcgacaagctgaccaaggagctggcccagaagaccgccgagctgctggaggtgagagccgccttcgtgcagctgacccagaagaagcaggaggtgcagagaagagagagagccctgaacagacaggtggacgtggccgtggagatgatcgccgtgctgagacagagactgaccgagagcgaggaggagctgctgagaaaggaggaggaggtggtgaccttcaaccacttcctggaggccgccgccgagaaggaggtgcagggcaaggccagactgcaggacttcatcgagaacctgctgcagagagtggagctggccgagaagcagctggagtactaccagagccagcaggccagcggcttcgtgagagacctgagcggccacgtgagctggaagggcgccggcgaggccagactggtgtgccagaacgacctggagctggaggagagcgccatcgtggagtag

SEQ ID NO: 106002 - DNA, 1389 bp, Artificial Sequence
  Description of Artificial Sequence: Synthetic coding sequence
atgcagcagaaggccttcgaggagagcagatacccctggcaggagagcttcgagaacgtggccgtgtgcctgcccctgagatgccccagatgcggcgaccacaccagattcagaagcctgagcagcctgagagcccacctggagttcagccacagctacgaggagagaaccctgctgaccaagtgcagcctgttccccagcctgaaggacaccgacctggtgaccagcagcgagctgctgaagcccggcaagctgcagagcagcggcaacgtggtgaagcagaagcccagctacgtgaacctgtacagcatcagccacgagcacagcaaggacagaaagcccttcgaggtggtggccgagagacccgtgagctacgtgcagacctacaccgccatggacctgcacgccgacagcctggacggcaccagaagcggccccggcctgcccaccagcgacaccaaggccagcttcgaggcccacgtgagagagaagttcaacagaatggtggaggccgtggacagaaccatcgagaagagaatcgacaagctgaccaaggagctggcccagaagaccgccgagctgctggaggtgagagccgccttcgtgcagctgacccagaagaagcaggaggtgcagagaagagagagagccctgaacagacaggtggacgtggccgtggagatgatcgccgtgctgagacagagactgaccgagagcgaggaggagctgctgagaaaggaggaggaggtggtgaccttcaaccacttcctggaggccgccgccgagaaggaggtgcagggcaaggccagactgcaggacttcatcgagaacctgctgcagagagtggagctggccgagaagcagctggagtactaccagagccagcaggccagcggcttcgtgagagacctgagcggccacgtgagctggaagggcgccggcgaggccagactggtgtgccagaacgacctggagctggagatcttcggccacatcaaccaccacctgagcggcctgaaggacagccactgcctggtgttcctgcaggccccccccgtgccctggatcatcctggccagcttcctgtggatcctgggcaacccctggaccagcagcaccgccaccgccggcttcagccagatctgggtgctgttccccttctgcggcggcaccttccaccacaacgagaaggacgtgctgggcctgcaggacttcgagagagagagcgtgagcaccagccagagcagaaacatcagcctgctgaccctgggccagctgcagaactgcgtgatcggcaagctgaccatcatcgacctgctgaccgagcacctgctgggcgtgagacacggcgtgatctgcttcccctggggcctgcccagcagcagctag

SEQ ID NO: 106003 - DNA, 162 bp, Artificial Sequence
  Description of Artificial Sequence: Synthetic coding sequence
atgcagcagaaggccttcgaggagagcagatacccctggcaggagagcttcgagaacgtggccgtgtgcctgcccctgagatgccccagatgcggcgaccacaccagattcagaagcctgagcagcctgagagcccacctggagttcagccacagctactag

SEQ ID NO: 106004 - DNA, 1893 bp, Artificial Sequence
  Description of Artificial Sequence: Synthetic coding sequence
atgagcgtgagcagcggcgtgcagatcctgaccaagcccgagaccgtggacagaagaagaagcgccgagaccaccaaggaggccggcagacccctggagatggccgtgagcgagcccgaggccagcgccgccgagtggaagcagctggaccccgcccagagcaacctgtacaacgacgtgatgctggagaactactgcaaccaggccagcatgggctgccaggcccccaagcccgacatgatcagcaagctggagaagggcgaggccccctggctgggcaagggcaagagacccagccagggctgccccagcaagatcgccagacccaagcagaaggagaccgacggcaaggtgcagaaggacgacgaccagctggagaacatccagaagagccagaacaagctgctgagagaggtggccgtgaagaagaagacccaggccaagaagaacggcagcgactgcggcagcctgggcaagaagaacaacctgcacaagaagcacgtgcccagcaagaagagactgctgaagttcgagagctgcggcaagatcctgaagcagaacctggacctgcccgaccacagcagaaactgcgtgaagagaaagagcgacgccgccaaggagcacaagaagagcttcaaccacagcctgagcgacaccagaaagggcaagaagcagaccggcaagaagcacgagaagctgagcagccacagcagcagcgacaagtgcaacaagaccggcaagaagcacgacaagctgtgctgccacagcagcagccacatcaagcaggacaagatccagaccggcgagaagcacgagaagagccccagcctgagcagcagcaccaagcacgagaagccccaggcctgcgtgaagccctacgagtgcaaccagtgcggcaaggtgctgagccacaagcagggcctgatcgaccaccagagagtgcacaccggcgagaagccctacgagtgcaacgagtgcggcatcgccttcagccagaagagccacctggtggtgcaccagagaacccacaccggcgagaagccctacgagtgcatccagtgcggcaaggcccacggccacaagcacgccctgaccgaccacctgagaatccacaccggcgagaagccctacgagtgcgccgagtgcggcaagaccttcagacacagcagcaacctgatccagcacgtgagaagccacaccggcgagaagccctacgagtgcaaggagtgcggcaagagcttcagatacaacagcagcctgaccgagcacgtgagaacccacaccggcgagatcccctacgagtgcaacgagtgcggcaaggccttcaagtacagcagcagcctgaccaagcacatgagaatccacaccggcgagaagcccttcgagtgcaacgagtgcggcaaggccttcagcaagaagagccacctgatcatccaccagagaacccacaccaaggagaagccctacaagtgcaacgagtgcggcaaggccttcggccacagcagcagcctgacctaccacatgagaacccacaccggcgagagccccttcgagtgcaaccagtgcggcaagggcttcaagcagatcgagggcctgacccagcaccagagagtgcacaccggcgagaagccctacgagtgcaacgagtgcggcaaggccttcagccagaagagccacctgatcgtgcaccagagaacccacaccggcgagaagccctacgagtgcaacgagtgcgagaaggccttcaacgccaagagccagctggtgatccaccagagaagccacaccggcgagaagccctacgagtgcaacgagtgcggcaagaccttcaagcagaacgccagcctgaccaagcacgtgaagacccacagcgaggacaagagccacgagtag

SEQ ID NO: 106005 - DNA, 1938 bp, Artificial Sequence
  Description of Artificial Sequence: Synthetic coding sequence
atgagcgtgagcagcggcgtgcagatcctgaccaagcccgagaccgtggacagaagaagaagcgccgagaccaccaaggaggccggcagacccctggagatggccgtgagcgagcccgaggccagcgccgccgtgagcgtgaccttcaagcacgtgaccatggccttcacccagaaggagtggaagcagctggaccccgcccagagcaacctgtacaacgacgtgatgctggagaactactgcaaccaggccagcatgggctgccaggcccccaagcccgacatgatcagcaagctggagaagggcgaggccccctggctgggcaagggcaagagacccagccagggctgccccagcaagatcgccagacccaagcagaaggagaccgacggcaaggtgcagaaggacgacgaccagctggagaacatccagaagagccagaacaagctgctgagagaggtggccgtgaagaagaagacccaggccaagaagaacggcagcgactgcggcagcctgggcaagaagaacaacctgcacaagaagcacgtgcccagcaagaagagactgctgaagttcgagagctgcggcaagatcctgaagcagaacctggacctgcccgaccacagcagaaactgcgtgaagagaaagagcgacgccgccaaggagcacaagaagagcttcaaccacagcctgagcgacaccagaaagggcaagaagcagaccggcaagaagcacgagaagctgagcagccacagcagcagcgacaagtgcaacaagaccggcaagaagcacgacaagctgtgctgccacagcagcagccacatcaagcaggacaagatccagaccggcgagaagcacgagaagagccccagcctgagcagcagcaccaagcacgagaagccccaggcctgcgtgaagccctacgagtgcaaccagtgcggcaaggtgctgagccacaagcagggcctgatcgaccaccagagagtgcacaccggcgagaagccctacgagtgcaacgagtgcggcatcgccttcagccagaagagccacctggtggtgcaccagagaacccacaccggcgagaagccctacgagtgcatccagtgcggcaaggcccacggccacaagcacgccctgaccgaccacctgagaatccacaccggcgagaagccctacgagtgcgccgagtgcggcaagaccttcagacacagcagcaacctgatccagcacgtgagaagccacaccggcgagaagccctacgagtgcaaggagtgcggcaagagcttcagatacaacagcagcctgaccgagcacgtgagaacccacaccggcgagatcccctacgagtgcaacgagtgcggcaaggccttcaagtacagcagcagcctgaccaagcacatgagaatccacaccggcgagaagcccttcgagtgcaacgagtgcggcaaggccttcagcaagaagagccacctgatcatccaccagagaacccacaccaaggagaagccctacaagtgcaacgagtgcggcaaggccttcggccacagcagcagcctgacctaccacatgagaacccacaccggcgagagccccttcgagtgcaaccagtgcggcaagggcttcaagcagatcgagggcctgacccagcaccagagagtgcacaccggcgagaagccctacgagtgcaacgagtgcggcaaggccttcagccagaagagccacctgatcgtgcaccagagaacccacaccggcgagaagccctacgagtgcaacgagtgcgagaaggccttcaacgccaagagccagctggtgatccaccagagaagccacaccggcgagaagccctacgagtgcaacgagtgcggcaagaccttcaagcagaacgccagcctgaccaagcacgtgaagacccacagcgaggacaagagccacgagtag

SEQ ID NO: 106006 - DNA, 1896 bp, Artificial Sequence
  Description of Artificial Sequence: Synthetic coding sequence
atgagcgtgagcagcggcgtgcagatcctgaccaagcccgagaccgtggacagaagaagaagcgccgagaccaccaaggaggccggcagacccctggagatggccgtgagcgagcccgaggccagcgccgccaaggagtggaagcagctggaccccgcccagagcaacctgtacaacgacgtgatgctggagaactactgcaaccaggccagcatgggctgccaggcccccaagcccgacatgatcagcaagctggagaagggcgaggccccctggctgggcaagggcaagagacccagccagggctgccccagcaagatcgccagacccaagcagaaggagaccgacggcaaggtgcagaaggacgacgaccagctggagaacatccagaagagccagaacaagctgctgagagaggtggccgtgaagaagaagacccaggccaagaagaacggcagcgactgcggcagcctgggcaagaagaacaacctgcacaagaagcacgtgcccagcaagaagagactgctgaagttcgagagctgcggcaagatcctgaagcagaacctggacctgcccgaccacagcagaaactgcgtgaagagaaagagcgacgccgccaaggagcacaagaagagcttcaaccacagcctgagcgacaccagaaagggcaagaagcagaccggcaagaagcacgagaagctgagcagccacagcagcagcgacaagtgcaacaagaccggcaagaagcacgacaagctgtgctgccacagcagcagccacatcaagcaggacaagatccagaccggcgagaagcacgagaagagccccagcctgagcagcagcaccaagcacgagaagccccaggcctgcgtgaagccctacgagtgcaaccagtgcggcaaggtgctgagccacaagcagggcctgatcgaccaccagagagtgcacaccggcgagaagccctacgagtgcaacgagtgcggcatcgccttcagccagaagagccacctggtggtgcaccagagaacccacaccggcgagaagccctacgagtgcatccagtgcggcaaggcccacggccacaagcacgccctgaccgaccacctgagaatccacaccggcgagaagccctacgagtgcgccgagtgcggcaagaccttcagacacagcagcaacctgatccagcacgtgagaagccacaccggcgagaagccctacgagtgcaaggagtgcggcaagagcttcagatacaacagcagcctgaccgagcacgtgagaacccacaccggcgagatcccctacgagtgcaacgagtgcggcaaggccttcaagtacagcagcagcctgaccaagcacatgagaatccacaccggcgagaagcccttcgagtgcaacgagtgcggcaaggccttcagcaagaagagccacctgatcatccaccagagaacccacaccaaggagaagccctacaagtgcaacgagtgcggcaaggccttcggccacagcagcagcctgacctaccacatgagaacccacaccggcgagagccccttcgagtgcaaccagtgcggcaagggcttcaagcagatcgagggcctgacccagcaccagagagtgcacaccggcgagaagccctacgagtgcaacgagtgcggcaaggccttcagccagaagagccacctgatcgtgcaccagagaacccacaccggcgagaagccctacgagtgcaacgagtgcgagaaggccttcaacgccaagagccagctggtgatccaccagagaagccacaccggcgagaagccctacgagtgcaacgagtgcggcaagaccttcaagcagaacgccagcctgaccaagcacgtgaagacccacagcgaggacaagagccacgagtag

SEQ ID NO: 106007 - DNA, 1653 bp, Artificial Sequence
  Description of Artificial Sequence: Synthetic coding sequence
atgcccctgcagggcagcgtgagcttcaaggacgtgaccgtggacttcacccaggaggagtggcagcagctggaccccgcccagaaggccctgtacagagacgtgatgctggagaactactgccacttcgtgagcgtgggcttccacatggccaagcccgacatgatcagaaagctggagcagggcgaggagctgtggacccagagaatcttccccagctacagctacctggaggaggacggcaagaccgaggacgtgctggtgaagttcaaggagtaccaggacagacacagcagacccctgatcttcatcaaccacaagaagctgatcaaggagagaagcaacatctacggcaagaccttcaccctgggcaagaacagaatcagcaagaccatcctgtgcgagtacaagcccgacggcaaggtgctgaagaacatcagcgagctggtgatcagaaacatcagccccatcaaggagaagttcggcgacagcaccggctgggagaagagcctgctgaacaccaagcacgagaagatccaccccgccgtgaacctgcacaagcagaccgagagagtgctgagcggcaagcaggagctgatccagcaccagaaggtgcaggcccccgagcagcccttcgaccacaacgagtgcgagaagagcttcctgatgaagggcatgctgttcacccacaccagagcccacagaggcgagagaaccttcgagtacaacaaggacggcatcgccttcatcgagaagagcagcctgagcgtgcaccccagcaacctgatggagaagaagcccagcgcctacaacaagtacggcaagttcctgtgcagaaagcccgtgttcatcatgccccagagaccccagaccgaggagaagcccttccactgcccctactgcggcaacaacttcagaagaaagagctacctgatcgagcaccagagaatccacaccggcgagaagccctacgtgtgcaaccagtgcggcaaggccttcagacagaagaccgccctgaccctgcacgagaagacccacatcgagggcaagcccttcatctgcatcgactgcggcaagagcttcagacagaaggccaccctgaccagacaccacaagacccacaccggcgagaaggcctacgagtgcccccagtgcggcagcgccttcagaaagaagagctacctgatcgaccaccagagaacccacaccggcgagaagccctaccagtgcaacgagtgcggcaaggccttcatccagaagaccaccctgaccgtgcaccagagaacccacaccggcgagaagccctacatctgcaacgagtgcggcaagagcttctgccagaagaccaccctgaccctgcaccagagaatccacaccggcgagaagccctacatctgcaacgagtgcggcaagagcttcagacagaaggccatcctgaccgtgcaccacagaatccacaccggcgagaagagcaacggctgcccccagtgcggcaaggccttcagcagaaagagcaacctgatcagacaccagaagacccacaccggcgagaagccctacgagtgcaagcagtgcggcaagttcttcagctgcaagagcaacctgatcgtgcaccagaagacccacaaggtggagaccaccggcatccagtag

SEQ ID NO: 106008 - DNA, 1650 bp, Artificial Sequence
  Description of Artificial Sequence: Synthetic coding sequence
atgagccagggcagcgtgagcttcaaggacgtgaccgtggacttcacccaggaggagtggcagcagctggaccccgcccagaaggccctgtacagagacgtgatgctggagaactactgccacttcgtgagcgtgggcttccacatggccaagcccgacatgatcagaaagctggagcagggcgaggagctgtggacccagagaatcttccccagctacagctacctggaggaggacggcaagaccgaggacgtgctggtgaagttcaaggagtaccaggacagacacagcagacccctgatcttcatcaaccacaagaagctgatcaaggagagaagcaacatctacggcaagaccttcaccctgggcaagaacagaatcagcaagaccatcctgtgcgagtacaagcccgacggcaaggtgctgaagaacatcagcgagctggtgatcagaaacatcagccccatcaaggagaagttcggcgacagcaccggctgggagaagagcctgctgaacaccaagcacgagaagatccaccccgccgtgaacctgcacaagcagaccgagagagtgctgagcggcaagcaggagctgatccagcaccagaaggtgcaggcccccgagcagcccttcgaccacaacgagtgcgagaagagcttcctgatgaagggcatgctgttcacccacaccagagcccacagaggcgagagaaccttcgagtacaacaaggacggcatcgccttcatcgagaagagcagcctgagcgtgcaccccagcaacctgatggagaagaagcccagcgcctacaacaagtacggcaagttcctgtgcagaaagcccgtgttcatcatgccccagagaccccagaccgaggagaagcccttccactgcccctactgcggcaacaacttcagaagaaagagctacctgatcgagcaccagagaatccacaccggcgagaagccctacgtgtgcaaccagtgcggcaaggccttcagacagaagaccgccctgaccctgcacgagaagacccacatcgagggcaagcccttcatctgcatcgactgcggcaagagcttcagacagaaggccaccctgaccagacaccacaagacccacaccggcgagaaggcctacgagtgcccccagtgcggcagcgccttcagaaagaagagctacctgatcgaccaccagagaacccacaccggcgagaagccctaccagtgcaacgagtgcggcaaggccttcatccagaagaccaccctgaccgtgcaccagagaacccacaccggcgagaagccctacatctgcaacgagtgcggcaagagcttctgccagaagaccaccctgaccctgcaccagagaatccacaccggcgagaagccctacatctgcaacgagtgcggcaagagcttcagacagaaggccatcctgaccgtgcaccacagaatccacaccggcgagaagagcaacggctgcccccagtgcggcaaggccttcagcagaaagagcaacctgatcagacaccagaagacccacaccggcgagaagccctacgagtgcaagcagtgcggcaagttcttcagctgcaagagcaacctgatcgtgcaccagaagacccacaaggtggagaccaccggcatccagtag

SEQ ID NO: 106009 - DNA, 1503 bp, Artificial Sequence
  Description of Artificial Sequence: Synthetic coding sequence
atggaggagagccacttcaacagcaacccctacttctggcccagcatccccaccgtgagcggccagatcgagaacaccatgttcatcaacaagatgaaggaccagctgctgcccgagaagggctgcggcctggcccccccccactaccccaccctgctgaccgtgcccgccagcgtgagcctgcccagcggcatcagcatggacaccgagagcaagagcgaccagctgaccccccacagccaggccagcgtgacccagaacatcaccgtggtgcccgtgcccagcaccggcctgatgaccgccggccccggcctggtgatcaccagccccagcggcagcctggtgaccaccgccagcagcgcccagaccttccccatcagcgcccccatgatcgtgagcgccctgccccccggcagccaggccctgcaggtggtgcccgacctgagcaagaaggtggccagcaccctgaccgaggagggcggcggcggcggcggcggcggcggcagcgtggcccccaagccccccagaggcagaaagaagaagagaatgctggagagcggcctgcccgagatgaacgacccctacgtgctgagccccgaggacgacgacgaccaccagaaggacggcaagacctacagatgcagaatgtgcagcctgaccttctacagcaagagcgagatgcagatccacagcaagagccacaccgagaccaagccccacaagtgcccccactgcagcaagaccttcgccaacagcagctacctggcccagcacatcagaatccacagcggcgccaagccctacagctgcaacttctgcgagaagagcttcagacagctgagccacctgcagcagcacaccagaatccacaccggcgacagaccctacaagtgcgcccaccccggctgcgagaaggccttcacccagctgagcaacctgcagagccacagaagacagcacaacaaggacaagcccttcaagtgccacaactgccacagagcctacaccgacgccgccagcctggaggtgcacctgagcacccacaccgtgaagcacgccaaggtgtacacctgcaccatctgcagcagagcctacaccagcgagacctacctgatgaagcacatgagaaagcacaacccccccgacctgcagcagcaggtgcaggccgccgccgccgccgccgccgtggcccaggcccaggcccaggcccaggcccaggcccaggcccaggcccaggcccaggcccaggcccaggccagccaggccagccagcagcagcagcagcagcagcagcagcagcagcagcagcagcagcagccccccccccacttccagagccccggcgccgccccccagggcggcggcggcggcgacagcaaccccaacccccccccccagtgcagcttcgacctgaccccctacaagaccgccgagcaccacaaggacatctgcctgaccgtgaccaccagcaccatccaggtggagcacctggccagcagctag

SEQ ID NO: 106010 - DNA, 1734 bp, Artificial Sequence
  Description of Artificial Sequence: Synthetic coding sequence
atggaggagagccacttcaacagcaacccctacttctggcccagcatccccaccgtgagcggccagatcgagaacaccatgttcatcaacaagatgaaggaccagctgctgcccgagaagggctgcggcctggcccccccccactaccccaccctgctgaccgtgcccgccagcgtgagcctgcccagcggcatcagcatggacaccgagagcaagagcgaccagctgaccccccacagccaggccagcgtgacccagaacatcaccgtggtgcccgtgcccagcaccggcctgatgaccgccggcgtgagctgcagccagagatggagaagagagggcagccagagcagaggccccggcctggtgatcaccagccccagcggcagcctggtgaccaccgccagcagcgcccagaccttccccatcagcgcccccatgatcgtgagcgccctgccccccggcagccaggccctgcaggtggtgcccgacctgagcaagaaggtggccagcaccctgaccgaggagggcggcggcggcggcggcggcggcggcagcgtggcccccaagccccccagaggcagaaagaagaagagaatgctggagagcggcctgcccgagatgaacgacccctacgtgctgagccccgaggacgacgacgaccaccagaaggacggcaagacctacagatgcagaatgtgcagcctgaccttctacagcaagagcgagatgcagatccacagcaagagccacaccgagaccaagccccacaagtgcccccactgcagcaagaccttcgccaacagcagctacctggcccagcacatcagaatccacagcggcgccaagccctacagctgcaacttctgcgagaagagcttcagacagctgagccacctgcagcagcacaccagaatccacagcaagatgcacaccgagaccatcaagccccacaagtgcccccactgcagcaagaccttcgccaacaccagctacctggcccagcacctgagaatccacagcggcgccaagccctacaactgcagctactgccagaaggccttcagacagctgagccacctgcagcagcacaccagaatccacaccggcgacagaccctacaagtgcgcccaccccggctgcgagaaggccttcacccagctgagcaacctgcagagccacagaagacagcacaacaaggacaagcccttcaagtgccacaactgccacagagcctacaccgacgccgccagcctggaggtgcacctgagcacccacaccgtgaagcacgccaaggtgtacacctgcaccatctgcagcagagcctacaccagcgagacctacctgatgaagcacatgagaaagcacaacccccccgacctgcagcagcaggtgcaggccgccgccgccgccgccgccgtggcccaggcccaggcccaggcccaggcccaggcccaggcccaggcccaggcccaggcccaggcccaggccagccaggccagccagcagcagcagcagcagcagcagcagcagcagcagcagcagcagcagccccccccccacttccagagccccggcgccgccccccagggcggcggcggcggcgacagcaaccccaacccccccccccagtgcagcttcgacctgaccccctacaagaccgccgagcaccacaaggacatctgcctgaccgtgaccaccagcaccatccaggtggagcacctggccagcagctag

SEQ ID NO: 106011 - DNA, 1551 bp, Artificial Sequence
  Description of Artificial Sequence: Synthetic coding sequence
atggaggagagccacttcaacagcaacccctacttctggcccagcatccccaccgtgagcggccagatcgagaacaccatgttcatcaacaagatgaaggaccagctgctgcccgagaagggctgcggcctggcccccccccactaccccaccctgctgaccgtgcccgccagcgtgagcctgcccagcggcatcagcatggacaccgagagcaagagcgaccagctgaccccccacagccaggccagcgtgacccagaacatcaccgtggtgcccgtgcccagcaccggcctgatgaccgccggcgtgagctgcagccagagatggagaagagagggcagccagagcagaggccccggcctggtgatcaccagccccagcggcagcctggtgaccaccgccagcagcgcccagaccttccccatcagcgcccccatgatcgtgagcgccctgccccccggcagccaggccctgcaggtggtgcccgacctgagcaagaaggtggccagcaccctgaccgaggagggcggcggcggcggcggcggcggcggcagcgtggcccccaagccccccagaggcagaaagaagaagagaatgctggagagcggcctgcccgagatgaacgacccctacgtgctgagccccgaggacgacgacgaccaccagaaggacggcaagacctacagatgcagaatgtgcagcctgaccttctacagcaagagcgagatgcagatccacagcaagagccacaccgagaccaagccccacaagtgcccccactgcagcaagaccttcgccaacagcagctacctggcccagcacatcagaatccacagcggcgccaagccctacagctgcaacttctgcgagaagagcttcagacagctgagccacctgcagcagcacaccagaatccacaccggcgacagaccctacaagtgcgcccaccccggctgcgagaaggccttcacccagctgagcaacctgcagagccacagaagacagcacaacaaggacaagcccttcaagtgccacaactgccacagagcctacaccgacgccgccagcctggaggtgcacctgagcacccacaccgtgaagcacgccaaggtgtacacctgcaccatctgcagcagagcctacaccagcgagacctacctgatgaagcacatgagaaagcacaacccccccgacctgcagcagcaggtgcaggccgccgccgccgccgccgccgtggcccaggcccaggcccaggcccaggcccaggcccaggcccaggcccaggcccaggcccaggcccaggccagccaggccagccagcagcagcagcagcagcagcagcagcagcagcagcagcagcagcagccccccccccacttccagagccccggcgccgccccccagggcggcggcggcggcgacagcaaccccaacccccccccccagtgcagcttcgacctgaccccctacaagaccgccgagcaccacaaggacatctgcctgaccgtgaccaccagcaccatccaggtggagcacctggccagcagctag

SEQ ID NO: 106012 - DNA, 1551 bp, Artificial Sequence; identical to SEQ ID NO: 106011
  Description of Artificial Sequence: Synthetic coding sequence

SEQ ID NO: 106013 - DNA, 1734 bp, Artificial Sequence; identical to SEQ ID NO: 106010
  Description of Artificial Sequence: Synthetic coding sequence

SEQ ID NO: 106014 - DNA, 1008 bp, Artificial Sequence
  Description of Artificial Sequence: Synthetic coding sequence
atggaggagagccacttcaacagcaacccctacttctggcccagcatccccaccgtgagcggccagatcgagaacaccatgttcatcaacaagatgaaggaccagctgctgcccgagaagggctgcggcctggcccccccccactaccccaccctgctgaccgtgcccgccagcgtgagcctgcccagcggcatcagcatggacaccgagagcaagagcgaccagctgaccccccacagccaggccagcgtgacccagaacatcaccgtggtgcccgtgcccagcaccggcctgatgaccgccggcgtgagctgcagccagagatggagaagagagggcagccagagcagaggccccggcctggtgatcaccagccccagcggcagcctggtgaccaccgccagcagcgcccagaccttccccatcagcgcccccatgatcgtgagcgccctgccccccggcagccaggccctgcaggtggtgcccgacctgagcaagaaggtggccagcaccctgaccgaggagggcggcggcggcggcggcggcggcggcagcgtggcccccaagccccccagaggcagaaagaagaagagaatgctggagagcggcctgcccgagatgaacgacccctacgtgctgagccccgaggacgacgacgaccaccagaaggacggcaagacctacagaagcgagggcaactgcggcaccggcaacggccagagcctgggcctgatggacagcgtgcccggcagcaccaccaacctgctgtgcgaccccggctgcagaatgtgcagcctgaccttctacagcaagagcgagatgcagatccacagcaagagccacaccgagaccaagccccacaagtgcccccactgcagcaagaccttcgccaacagcagctacctggcccagcacatcagaatccacagcggcgccaagccctacagctgcaacttctgcgagaagagcttcagacagctgagccacctgcagcagcacaccagatag

SEQ ID NO: 106015 - DNA, 834 bp, Artificial Sequence
  Description of Artificial Sequence: Synthetic coding sequence
atggaggagagccacttcaacagcaacccctacttctggcccagcatccccaccgtgagcggccagatcgagaacaccatgttcatcaacaagatgaaggaccagctgctgcccgagaagggctgcggcctggcccccccccactaccccaccctgctgaccgtgcccgccagcgtgagcctgcccagcggcatcagcatggacaccgagagcaagagcgaccagctgaccccccacagccaggccagcgtgacccagaacatcaccgtggtgcccgtgcccagcaccggcctgatgaccgccggccccggcctggtgatcaccagccccagcggcagcctggtgaccaccgccagcagcgcccagaccttccccatcagcgcccccatgatcgtgagcgccctgccccccggcagccaggccctgcaggtggtgcccgacctgagcaagaaggtggccagcaccctgaccgaggagggcggcggcggcggcggcggcggcggcagcgtggcccccaagccccccagaggcagaaagaagaagagaatgctggagagcggcctgcccgagatgaacgacccctacgtgctgagccccgaggacgacgacgaccaccagaaggacggcaagacctacagatgcagaatgtgcagcctgaccttctacagcaagagcgagatgcagatccacagcaagagccacaccgagaccaagccccacaagtgcccccactgcagcaagaccttcgccaacagcagctacctggcccagcacatcagaatccacagcggcgccaagccctacagctgcaacttctgcgagaagagcttctag

SEQ ID NO: 106016 - DNA, 1386 bp, Artificial Sequence
  Description of Artificial Sequence: Synthetic coding sequence
atggaggagagccacttcaacagcaacccctacttctggcccagcatccccaccgtgagcggccagatcgagaacaccatgttcatcaacaagatgaaggaccagctgctgcccgagaagggctgcggcctggcccccccccactaccccaccctgctgaccgtgcccgccagcgtgagcctgcccagcggcatcagcatggacaccgagagcaagagcgaccagctgaccccccacagccaggccagcgtgacccagaacatcaccgtggtgcccgtgcccagcaccggcctgatgaccgccgccctgcaggtggtgcccgacctgagcaagaaggtggccagcaccctgaccgaggagggcggcggcggcggcggcggcggcggcagcgtggcccccaagccccccagaggcagaaagaagaagagaatgctggagagcggcctgcccgagatgaacgacccctacgtgctgagccccgaggacgacgacgaccaccagaaggacggcaagacctacagatgcagaatgtgcagcctgaccttctacagcaagagcgagatgcagatccacagcaagagccacaccgagaccaagccccacaagtgcccccactgcagcaagaccttcgccaacagcagctacctggcccagcacatcagaatccacagcggcgccaagccctacagctgcaacttctgcgagaagagcttcagacagctgagccacctgcagcagcacaccagaatccacaccggcgacagaccctacaagtgcgcccaccccggctgcgagaaggccttcacccagctgagcaacctgcagagccacagaagacagcacaacaaggacaagcccttcaagtgccacaactgccacagagcctacaccgacgccgccagcctggaggtgcacctgagcacccacaccgtgaagcacgccaaggtgtacacctgcaccatctgcagcagagcctacaccagcgagacctacctgatgaagcacatgagaaagcacaacccccccgacctgcagcagcaggtgcaggccgccgccgccgccgccgccgtggcccaggcccaggcccaggcccaggcccaggcccaggcccaggcccaggcccaggcccaggcccaggccagccaggccagccagcagcagcagcagcagcagcagcagcagcagcagcagcagcagcagccccccccccacttccagagccccggcgccgccccccagggcggcggcggcggcgacagcaaccccaacccccccccccagtgcagcttcgacctgaccccctacaagaccgccgagcaccacaaggacatctgcctgaccgtgaccaccagcaccatccaggtggagcacctggccagcagctag

SEQ ID NO: 106017 - DNA, 1161 bp, Artificial Sequence
  Description of Artificial Sequence: Synthetic coding sequence
atgatcctgggcagcctgagcagagccggccccctgcccctgctgagacagccccccatcatgcagccccccctggacctgaagcagatcctgcccttccccctggagcccgcccccaccctgggcctgttcagcaactacagcaccatggaccccgtgcagaaggccgtgctgagccacaccttcggcggccccctgctgaagaccaagagacccgtgatcagctgcaacatctgccagatcagattcaacagccagagccaggccgaggcccactacaagggcaacagacacgccagaagagtgaagggcatcgaggccgccaagaccagaggcagagagcccggcgtgagagagcccggcgaccccgccccccccggcagcacccccaccaacggcgacggcgtggcccccagacccgtgagcatggagaacggcctgggccccgcccccggcagccccgagaagcagcccggcagccccagcccccccagcatccccgagaccggccagggcgtgaccaagggcgagggcggcacccccgcccccgccagcctgcccggcggcagcaaggaggaggaggagaaggccaagagactgctgtactgcgccctgtgcaaggtggccgtgaacagcctgagccagctggaggcccacaacaagggcaccaagcacaagaccatcctggaggccagaagcggcctgggccccatcaaggcctaccccagactgggcccccccacccccggcgagcccgaggcccccgcccaggacagaaccttccactgcgagatctgcaacgtgaaggtgaacagcgaggtgcagctgaagcagcacatcagcagcagaagacacagagacggcgtggccggcaagcccaaccccctgctgagcagacacaagaagagcagaggcgccggcgagctggccggcaccctgaccttcagcaaggagctgcccaagagcctggccggcggcctgctgcccagccccctggccgtggccgccgtgatggccgccgccgccggcagccccctgagcctgagacccgcccccgccgcccccctgctgcagggcccccccatcacccaccccctgctgcaccccgcccccggccccatcagaaccgcccacggccccatcctgttcagcccctactag

SEQ ID NO: 106018 - DNA, 918 bp, Artificial Sequence
  Description of Artificial Sequence: Synthetic coding sequence
atgatcctgggcagcctgagcagagccggccccctgcccctgctgagacagccccccatcatgcagccccccctggacctgaagcagatcctgcccttccccctggagcccgcccccaccctgggcctgttcagcaactacagcaccatggaccccgtgcagaaggccgtgctgagccacaccttcggcggccccctgctgaagaccaagagacccgtgatcagctgcaacatctgccagatcagattcaacagccagagccaggccgaggcccactacaagggcaacagacacgccagaagagtgaagggcatcgaggccgccaagaccagaggcagagagcccggcgtgagagagcccggcgaccccgccccccccggcagcacccccaccaacggcgacggcgtggcccccagacccggcaccaagcacaagaccatcctggaggccagaagcggcctgggccccatcaaggcctaccccagactgggcccccccacccccggcgagcccgaggcccccgcccaggacagaaccttccactgcgagatctgcaacgtgaaggtgaacagcgaggtgcagctgaagcagcacatcagcagcagaagacacagagacggcgtggccggcaagcccaaccccctgctgagcagacacaagaagagcagaggcgccggcgagctggccggcaccctgaccttcagcaaggagctgcccaagagcctggccggcggcctgctgcccagccccctggccgtggccgccgtgatggccgccgccgccggcagccccctgagcctgagacccgcccccgccgcccccctgctgcagggcccccccatcacccaccccctgctgcaccccgcccccggccccatcagaaccgcccacggccccatcctgttcagcccctactag

SEQ ID NO: 106019 - DNA, 1101 bp, Artificial Sequence
  Description of Artificial Sequence: Synthetic coding sequence
atgcagccccccctggacctgaagcagatcctgcccttccccctggagcccgcccccaccctgggcctgttcagcaactacagcaccatggaccccgtgcagaaggccgtgctgagccacaccttcggcggccccctgctgaagaccaagagacccgtgatcagctgcaacatctgccagatcagattcaacagccagagccaggccgaggcccactacaagggcaacagacacgccagaagagtgaagggcatcgaggccgccaagaccagaggcagagagcccggcgtgagagagcccggcgaccccgccccccccggcagcacccccaccaacggcgacggcgtggcccccagacccgtgagcatggagaacggcctgggccccgcccccggcagccccgagaagcagcccggcagccccagcccccccagcatccccgagaccggccagggcgtgaccaagggcgagggcggcacccccgcccccgccagcctgcccggcggcagcaaggaggaggaggagaaggccaagagactgctgtactgcgccctgtgcaaggtggccgtgaacagcctgagccagctggaggcccacaacaagggcaccaagcacaagaccatcctggaggccagaagcggcctgggccccatcaaggcctaccccagactgggcccccccacccccggcgagcccgaggcccccgcccaggacagaaccttccactgcgagatctgcaacgtgaaggtgaacagcgaggtgcagctgaagcagcacatcagcagcagaagacacagagacggcgtggccggcaagcccaaccccctgctgagcagacacaagaagagcagaggcgccggcgagctggccggcaccctgaccttcagcaaggagctgcccaagagcctggccggcggcctgctgcccagccccctggccgtggccgccgtgatggccgccgccgccggcagccccctgagcctgagacccgcccccgccgcccccctgctgcagggcccccccatcacccaccccctgctgcaccccgcccccggccccatcagaaccgcccacggccccatcctgttcagcccctactag

SEQ ID NO: 106020 - DNA, 699 bp, Artificial Sequence
  Description of Artificial Sequence: Synthetic coding sequence
atgcagccccccctggacctgaagcagatcctgcccttccccctggagcccgcccccaccctgggcctgttcagcaactacagcaccatggaccccgtgcagaaggccgtgctgagccacaccttcggcggccccctgctgaagaccaagagacccgtgatcagctgcaacatctgccagatcagattcaacagccagagccaggccgaggcccactacaagggcaacagacacgccagaagagtgaagggcatcgaggccgccaagaccagaggcagagagcccggcgtgagagagcccggcgaccccgccccccccggcagcacccccaccaacggcgacggcgtggcccccagacccgtgagcatggagaacggcctgggccccgcccccggcagccccgagaagcagcccggcagccccagcccccccagcatccccgagaccggccagggcgtgaccaagggcgagggcggcacccccgcccccgccagcctgcccggcggcagcaaggaggaggaggagaaggccaagagactgctgtactgcgccctgtgcaaggtggccgtgaacagcctgagccagctggaggcccacaacaagggcaccaagcacaagaccatcctggaggccagaagcggcctgggccccatcaaggcctaccccagactgggcccccccacccccggcgagccctag

SEQ ID NO: 106021 - DNA, 1101 bp, Artificial Sequence; identical to SEQ ID NO: 106019
  Description of Artificial Sequence: Synthetic coding sequence

SEQ ID NO: 106022 - DNA, 498 bp, Artificial Sequence
  Description of Artificial Sequence: Synthetic coding sequence
atgcagccccccctggacctgaagcagatcctgcccttccccctggagcccgcccccaccctgggcctgttcagcaactacagcaccatggaccccgtgcagaaggccgtgctgagccacaccttcggcggccccctgctgaagaccaagagacccgtgatcagctgcaacatctgccagatcagattcaacagccagagccaggccgaggcccactacaagggcaacagacacgccagaagagtgaagggcatcgaggccgccaagaccagaggcagagagcccggcgtgagagagcccggcgaccccgccccccccggcagcacccccaccaacggcgacggcgtggcccccagacccgtgagcatggagaacggcctgggccccgcccccggcagccccgagaagcagcccggcagccccagcccccccagcatccccgagaccggccagggcgtgaccaagggcgagggcggcacccccgcccccgccagctag

SEQ ID NO: 106023 - DNA, 438 bp, Artificial Sequence
  Description of Artificial Sequence: Synthetic coding sequence
atgcagccccccctggacctgaagcagatcctgcccttccccctggagcccgcccccaccctgggcctgttcagcaactacagcaccatggaccccgtgcagaaggccgtgctgagccacaccttcggcggccccctgctgaagaccaagagacccgtgatcagctgcaacatctgccagatcagattcaacagccagagccaggccgaggcccactacaagggcaacagacacgccagaagagtgaagggcatcgaggccgccaagaccagaggcagagagcccggcgtgagagagcccggcgaccccgccccccccggcagcacccccaccaacggcgacggcgtggcccccagacccgtgagcatggagaacggcctgggccccgcccccggcagccccgagaagcagcccggcagccccagcccccccagctag

SEQ ID NO: 106024 - DNA, 1101 bp, Artificial Sequence; identical to SEQ ID NO: 106019
  Description of Artificial Sequence: Synthetic coding sequence

SEQ ID NO: 106025 - DNA, 858 bp, Artificial Sequence
  Description of Artificial Sequence: Synthetic coding sequence
atgcagccccccctggacctgaagcagatcctgcccttccccctggagcccgcccccaccctgggcctgttcagcaactacagcaccatggaccccgtgcagaaggccgtgctgagccacaccttcggcggccccctgctgaagaccaagagacccgtgatcagctgcaacatctgccagatcagattcaacagccagagccaggccgaggcccactacaagggcaacagacacgccagaagagtgaagggcatcgaggccgccaagaccagaggcagagagcccggcgtgagagagcccggcgaccccgccccccccggcagcacccccaccaacggcgacggcgtggcccccagacccggcaccaagcacaagaccatcctggaggccagaagcggcctgggccccatcaaggcctaccccagactgggcccccccacccccggcgagcccgaggcccccgcccaggacagaaccttccactgcgagatctgcaacgtgaaggtgaacagcgaggtgcagctgaagcagcacatcagcagcagaagacacagagacggcgtggccggcaagcccaaccccctgctgagcagacacaagaagagcagaggcgccggcgagctggccggcaccctgaccttcagcaaggagctgcccaagagcctggccggcggcctgctgcccagccccctggccgtggccgccgtgatggccgccgccgccggcagccccctgagcctgagacccgcccccgccgcccccctgctgcagggcccccccatcacccaccccctgctgcaccccgcccccggccccatcagaaccgcccacggccccatcctgttcagcccctactag

SEQ ID NO: 106026 - DNA, 1110 bp, Artificial Sequence
  Description of Artificial Sequence: Synthetic coding sequence
atgatgcagcccagcctggacatcaagcccttcatgagcttccccgtggacagcagcagcgccgtgggcctgttccccaacttcaacaccatggaccccgtgcagaaggccgtgatcaaccacaccttcggcgtgagcatcccccccaagaagaagcaggtgatcagctgcaacgtgtgccagctgagattcaacagcgacagccaggccgaggcccactacaagggcagcaagcacgccaagaaggtgaaggccctggacgccaccaagaacaagcccaagatggtgcccagcaaggacagcgccaaggccaaccccagctgcagcatcacccccatcaccggcaacaacagcgacaagagcgaggacaagggcaagctgaaggccagcagcagcagccagcccagcagcagcgagagcggcagcttcctgctgaagagcggcaccacccccctgccccccggcgccgccaccagccccagcaagagcaccaacggcgcccccggcaccgtggtggagagcgaggaggagaaggccaagaagctgctgtactgcagcctgtgcaaggtggccgtgaacagcctgagccagctggaggcccacaacaccggcagcaagcacaagaccatggtggaggccagaaacggcgccggccccatcaagagctaccccagacccggcagcagactgaagatgcagaacggcagcaagggcagcggcctgcagaacaagaccttccactgcgagatctgcgacgtgcacgtgaacagcgagatccagctgaagcagcacatcagcagcagaagacacaaggacagagtggccggcaagcccctgaagcccaagtacagcccctacaacaagctgcagagaagccccagcatcctggccgccaagctggccttccagaaggacatgatgaagcccctggcccccgccttcctgagcagccccctggccgccgccgccgccgtgagcagcgccctgagcctgccccccagacccagcgccagcctgttccaggcccccgccatcccccccgccctgctgagacccggccacggccccatcagagccacccccgccagcatcctgttcgccccctactag

SEQ ID NO: 106027 - DNA, 1188 bp, Artificial Sequence
  Description of Artificial Sequence: Synthetic coding sequence
atgtggagcggcctgcccagcagaggcagcacctgccacaccaccaccctgcccgccctggtgagaacccccaccctgatgatgcagcccagcctggacatcaagcccttcatgagcttccccgtggacagcagcagcgccgtgggcctgttccccaacttcaacaccatggaccccgtgcagaaggccgtgatcaaccacaccttcggcgtgagcatcccccccaagaagaagcaggtgatcagctgcaacgtgtgccagctgagattcaacagcgacagccaggccgaggcccactacaagggcagcaagcacgccaagaaggtgaaggccctggacgccaccaagaacaagcccaagatggtgcccagcaaggacagcgccaaggccaaccccagctgcagcatcacccccatcaccggcaacaacagcgacaagagcgaggacaagggcaagctgaaggccagcagcagcagccagcccagcagcagcgagagcggcagcttcctgctgaagagcggcaccacccccctgccccccggcgccgccaccagccccagcaagagcaccaacggcgcccccggcaccgtggtggagagcgaggaggagaaggccaagaagctgctgtactgcagcctgtgcaaggtggccgtgaacagcctgagccagctggaggcccacaacaccggcagcaagcacaagaccatggtggaggccagaaacggcgccggccccatcaagagctaccccagacccggcagcagactgaagatgcagaacggcagcaagggcagcggcctgcagaacaagaccttccactgcgagatctgcgacgtgcacgtgaacagcgagatccagctgaagcagcacatcagcagcagaagacacaaggacagagtggccggcaagcccctgaagcccaagtacagcccctacaacaagctgcagagaagccccagcatcctggccgccaagctggccttccagaaggacatgatgaagcccctggcccccgccttcctgagcagccccctggccgccgccgccgccgtgagcagcgccctgagcctgccccccagacccagcgccagcctgttccaggcccccgccatcccccccgccctgctgagacccggccacggccccatcagagccacccccgccagcatcctgttcgccccctactag

SEQ ID NO: 106028 - DNA, 1110 bp, Artificial Sequence; identical to SEQ ID NO: 106026
  Description of Artificial Sequence: Synthetic coding sequence

SEQ ID NO: 106029 - DNA, 1416 bp, Artificial Sequence
  Description of Artificial Sequence: Synthetic coding sequence
atgaacatggccaacttcctgagaggcttcgaggagaagggcatcaagaacgacagacccgaggaccagctgagcaaggagaagaagaagatcctgttcagcttctgcgaggtgtgcaacatccagctgaacagcgccgcccaggcccaggtgcacagcaacggcaagagccacagaaagagagtgaagcagctgagcgacggccagccccccccccccgcccaggccagccccagcagcaacagcagcaccggcagcacctgccacaccaccaccctgcccgccctggtgagaacccccaccctgatgatgcagcccagcctggacatcaagcccttcatgagcttccccgtggacagcagcagcgccgtgggcctgttccccaacttcaacaccatggaccccgtgcagaaggccgtgatcaaccacaccttcggcgtgagcatcccccccaagaagaagcaggtgatcagctgcaacgtgtgccagctgagattcaacagcgacagccaggccgaggcccactacaagggcagcaagcacgccaagaaggtgaaggccctggacgccaccaagaacaagcccaagatggtgcccagcaaggacagcgccaaggccaaccccagctgcagcatcacccccatcaccggcaacaacagcgacaagagcgaggacaagggcaagctgaaggccagcagcagcagccagcccagcagcagcgagagcggcagcttcctgctgaagagcggcaccacccccctgccccccggcgccgccaccagccccagcaagagcaccaacggcgcccccggcaccgtggtggagagcgaggaggagaaggccaagaagctgctgtactgcagcctgtgcaaggtggccgtgaacagcctgagccagctggaggcccacaacaccggcagcaagcacaagaccatggtggaggccagaaacggcgccggccccatcaagagctaccccagacccggcagcagactgaagatgcagaacggcagcaagggcagcggcctgcagaacaagaccttccactgcgagatctgcgacgtgcacgtgaacagcgagatccagctgaagcagcacatcagcagcagaagacacaaggacagagtggccggcaagcccctgaagcccaagtacagcccctacaacaagctgcagagaagccccagcatcctggccgccaagctggccttccagaaggacatgatgaagcccctggcccccgccttcctgagcagccccctggccgccgccgccgccgtgagcagcgccctgagcctgccccccagacccagcgccagcctgttccaggcccccgccatcccccccgccctgctgagacccggccacggccccatcagagccacccccgccagcatcctgttcgccccctactag

SEQ ID NO: 106030 - DNA, 96 bp, Artificial Sequence
  Description of Artificial Sequence: Synthetic coding sequence
atgaacatggccaacttcctgagaggcttcgaggagaagggcatcaagaacgacagacccgaggaccagctgagcaaggagaagaagaagatctag

SEQ ID NO: 106031 - DNA, 417 bp, Artificial Sequence
  Description of Artificial Sequence: Synthetic coding sequence
atgctgggcagcacctgccacaccaccaccctgcccgccctggtgagaacccccaccctgatgatgcagcccagcctggacatcaagcccttcatgagcttccccgtggacagcagcagcgccgtgggcctgttccccaacttcaacaccaagagaagaggcctgttcgagaccaacaagttctgccagatggaccccgtgcagaaggccgtgatcaaccacaccttcggcgtgagcatcccccccaagaagaagcaggtgatcagctgcaacgtgtgccagctgagattcaacagcgacagccaggccgaggcccactacaagggcagcaagcacgccaagaaggtgaaggccctggacgccaccaagaacaagcccaagatggtgcccagcaaggacagcgccaaggccaactag

SEQ ID NO: 106032 - DNA, 228 bp, Artificial Sequence
  Description of Artificial Sequence: Synthetic coding sequence
atgaacatggccaacttcctgagaggcttcgaggagaagggcatcaagaacgacagacccgaggaccagctgagcaaggagaagaagaagatcctgttcagcttctgcgaggtgtgcaacatccagctgaacagcgccgcccaggcccaggtgcacagcaacggcaagagccacagaaagagagtgaagcagctgagcgacggccagccccccccccccgcccagtag

SEQ ID NO: 106033 - DNA, 792 bp, Artificial Sequence
  Description of Artificial Sequence: Synthetic coding sequence
atgatgcagcccagcctggacatcaagcccttcatgagcttccccgtggacagcagcagcgccgtgggcctgttccccaacttcaacaccatggaccccgtgcagaaggccgtgatcaaccacaccttcggcgtgagcatcccccccaagaagaagcaggtgatcagctgcaacgtgtgccagctgagattcaacagcgacagccaggccgaggcccactacaagggcagcaagcacgccaagaaggtgaaggccctggacgccaccaagaacaagcccaagatggtgcccagcaaggacagcgccaaggccaaccccagctgcagcatcacccccatcaccggcaacaacagcgacaagagcgaggacaagggcaagctgaaggccagcagcagcagccagcccagcagcagcgagagcggcagcttcctgctgaagagcggcaccacccccctgccccccggcgccgccaccagccccagcaagagcaccaacggcgcccccggcaccgtggtggagagcgaggaggagaaggccaagaagctgctgtactgcagcctgtgcaaggtggccgtgaacagcctgagccagctggaggcccacaacaccggcagcaagcacaagaccatggtggaggccagaaacggcgccggccccatcaagagctaccccagacccggcagcagactgaagatgcagaacggcagcaagggcagcggcctgcagaacaagaccttccactgcgagatctgcgacgtgcacgtgaacagcgagatccagctgaagcagtag

SEQ ID NO: 106034 - DNA, 1002 bp, Artificial Sequence
  Description of Artificial Sequence: Synthetic coding sequence
atgagcgccaagctgggcaagagcagcagcctgctgacccagaccagcgaggagtgcaacggcatcctgaccgagaagatggaggaggaggagcagacctgcgaccccgacagcagcctgcactggagcagcagctacagccccgagaccttcagacagcagttcagacagttcggctaccaggacagccccggcccccacgaggccctgagcagactgtgggagctgtgccacctgtggctgagacccgaggtgcacaccaaggagcagatcctggagctgctggtgctggagcagttcctggccatcctgcccaaggagctgcaggcctgggtgcagaagcaccaccccgagaacggcgaggagaccgtgaccatgctggaggacgtggagagagagctggacggccccaagcagatcttcttcggcagaagaaaggacatgatcgccgagaagctggcccccagcgagatcaccgaggagctgcccagcagccagctgatgcccgtgaagaagcagctgcagggcgccagctgggagctgcagagcctgagaccccacgacgaggacatcaagaccaccaacgtgaagagcgccagcagacagaagaccagcctgggcatcgagctgcactgcaacgtgagcaacatcctgcacatgaacggcagccagagcagcacctacagaggcacctacgagcaggacggcagattcgagaagagacagggcaaccccagctggaagaagcagcagaagtgcgacgagtgcggcaagatcttcagccagagcagcgccctgatcctgcaccagagaatccacagcggcaagaagccctacgcctgcgacgagtgcgccaaggccttcagcagaagcgccatcctgatccagcacagaagaacccacaccgacagcaagtacgagcacgccatcgccgaggcccagaagaacatgtacttcaagaccagactgaagtgccccagaagcctgagcggcggcagatag

SEQ ID NO: 106035 - DNA, 1008 bp, Artificial Sequence
  Description of Artificial Sequence: Synthetic coding sequence
atgagcgccaagctgggcaagagcagcagcctgctgacccagaccagcgaggagtgcaacggcatcctgaccgagaagatggaggaggaggagcagacctgcgaccccgacagcagcctgcactggagcagcagctacagccccgagaccttcagacagcagttcagacagttcggctaccaggacagccccggcccccacgaggccctgagcagactgtgggagctgtgccacctgtggctgagacccgaggtgcacaccaaggagcagatcctggagctgctggtgctggagcagttcctggccatcctgcccaaggagctgcaggcctgggtgcagaagcaccaccccgagaacggcgaggagaccgtgaccatgctggaggacgtggagagagagctggacggccccaagcagatcttcttcggcagaagaaaggacatgatcgccgagaagctggcccccagcgagatcaccgaggagctgcccagcagccagctgatgcccgtgaagaagcagctgcagggcgccagctgggagctgcagagcctgagaccccacgacgaggacatcaagaccaccaacgtgaagagcgccagcagacagaagaccagcctgggcatcgagctgcactgcaacgtgagcaacatcctgcacatgaacggcagccagagcagcacctacagaggcacctacgagcaggacggcagattcgagaagagacagggcaaccccagctggaagaagcagcagaagtgcgacgagtgcggcaagatcttcagccagagcagcgccctgatcctgcaccagagaatccacagcggcaagaagccctacgcctgcgacgagtgcgccaaggccttcagcagaagcgccatcctgatccagcacagaagaacccacaccggcgagaagccctacaagtgccacgactgcggcaaggccttcagccagagcagcaacctgttcagacacagaaagagacacatcagaaagaaggtgccctag

SEQ ID NO: 106036 - DNA, 828 bp, Artificial Sequence
  Description of Artificial Sequence: Synthetic coding sequence
atggccgtggagagcggcgtgatcagcaccctgatcccccaggacccccccgagcaggagctgatcctggtgaaggtggaggacaacttcagctgggacgagaagttcaagcagaacggcagcacccagagctgccaggagctgttcagacagcagttcagaaagttctgctaccaggagacccccggccccagagaggccctgagcagactgcaggagctgtgctaccagtggctgatgcccgagctgcacaccaaggagcagatcctggagctgctggtgctggagcagttcctgagcatcctgcccgaggagctgcagatctgggtgcagcagcacaaccccgagagcggcgaggaggccgtgaccctgctggaggacctggagagagagttcgacgaccccggccagcaggtgcccgccagcccccagggccccgccgtgccctggaaggacctgacctgcctgagagccagccaggagagcaccgacatccacctgcagcccctgaagacccagctgaagagctggaagccctgcctgagccccaagagcgactgcgagaacagcgagaccgccaccaaggagggcatcagcgaggagaagagccagggcctgccccaggagcccagcttcagaggcatcaagctgagcagaccccccaaggccagcagcgccatcagatgggagtgcgtgagccccggcagcttccccggcgacatcatcgccgccgaggccacccacagcaccatcagctgcttcgccatcaacaccctgcccgccaccatcctgcccagcaagaacgtgaacagaaagtacttcagctag

SEQ ID NO: 106037 - DNA, 1605 bp, Artificial Sequence
  Description of Artificial Sequence: Synthetic coding sequence
atggccgtggagagcggcgtgatcagcaccctgatcccccaggacccccccgagcaggagctgatcctggtgaaggtggaggacaacttcagctgggacgagaagttcaagcagaacggcagcacccagagctgccaggagctgttcagacagcagttcagaaagttctgctaccaggagacccccggccccagagaggccctgagcagactgcaggagctgtgctaccagtggctgatgcccgagctgcacaccaaggagcagatcctggagctgctggtgctggagcagttcctgagcatcctgcccgaggagctgcagatctgggtgcagcagcacaaccccgagagcggcgaggaggccgtgaccctgctggaggacctggagagagagttcgacgaccccggccagcaggtgcccgccagcccccagggccccgccgtgccctggaaggacctgacctgcctgagagccagccaggagagcaccgacatccacctgcagcccctgaagacccagctgaagagctggaagccctgcctgagccccaagagcgactgcgagaacagcgagaccgccaccaaggagggcatcagcgaggagaagagccagggcctgccccaggagcccagcttcagaggcatcagcgagcacgagagcaacctggtgtggaagcagggcagcgccaccggcgagaagctgagaagccccagccagggcggcagcttcagccaggtgatcttcaccaacaagagcctgggcaagagagacctgtacgacgaggccgagagatgcctgatcctgaccaccgacagcatcatgtgccagaaggtgccccccgaggagagaccctacagatgcgacgtgtgcggccacagcttcaagcagcacagcagcctgacccagcaccagagaatccacaccggcgagaagccctacaagtgcaaccagtgcggcaaggccttcagcctgagaagctacctgatcatccaccagagaatccacagcggcgagaaggcctacgagtgcagcgagtgcggcaaggccttcaaccagagcagcgccctgatcagacacagaaagatccacaccggcgagaaggcctgcaagtgcaacgagtgcggcaaggccttcagccagagcagctacctgatcatccaccagagaatccacaccggcgagaagccctacgagtgcaacgagtgcggcaagaccttcagccagagcagcaagctgatcagacaccagagaatccacaccggcgagagaccctacgagtgcaacgagtgcggcaaggccttcagacagagcagcgagctgatcacccaccagagaatccacagcggcgagaagccctacgagtgcagcgagtgcggcaaggccttcagcctgagcagcaacctgatcagacaccagagaatccacagcggcgaggagccctaccagtgcaacgagtgcggcaagaccttcaagagaagcagcgccctggtgcagcaccagagaatccacagcggcgacgaggcctacatctgcaacgagtgcggcaaggccttcagacacagaagcgtgctgatgagacaccagagagtgcacaccatcaagtag

SEQ ID NO: 106038 - DNA, 738 bp, Artificial Sequence
  Description of Artificial Sequence: Synthetic coding sequence
atggccgtggagagcggcgtgatcagcaccctgatcccccaggacccccccgagcaggagctgatcctggtgaaggtggaggacaacttcagctgggacgagaagttcaagcagaacggcagcacccagagctgccaggagctgttcagacagcagttcagaaagttctgctaccaggagacccccggccccagagaggccctgagcagactgcaggagctgtgctaccagtggctgatgcccgagctgcacaccaaggagcagatcctggagctgctggtgctggagcagttcctgagcatcctgcccgaggagctgcagatctgggtgcagcagcacaaccccgagagcggcgaggaggccgtgaccctgctggaggacctggagagagagttcgacgaccccggccagcaggtgcccgccagcccccagggccccgccgtgccctggaaggacctgacctgcctgagagccagccaggagagcaccgacatccacctgcagcccctgaagacccagctgaagagctggaagccctgcctgagccccaagagcgagctgagcagaccccccaaggccagcagcgccatcagatgggagtgcgtgagccccggcagcttccccggcgacatcatcgccgccgaggccacccacagcaccatcagctgcttcgccatcaacaccctgcccgccaccatcctgcccagcaagaacgtgaacagaaagtacttcagctag

SEQ ID NO: 106039 - DNA, 2340 bp, Artificial Sequence
  Description of Artificial Sequence: Synthetic coding sequence
atggccgccaacggcgacagccccccctggagccccgccctggccgccgagggcagaggcagcagctgcgaggccagcgtgagcttcgaggacgtgaccgtggacttcagcaaggaggagtggcagcacctggaccccgcccagagaagactgtactgggacgtgaccctggagaactacagccacctgctgagcgtgggctaccagatccccaagagcgaggccgccttcaagctggagcagggcgagggcccctggatgctggagggcgaggccccccaccagagctgcagcggcgaggccatcggcaagatgcagcagcagggcatccccggcggcatcttcttccactgcgagagattcgaccagcccatcggcgaggacagcctgtgcagcatcctggaggagctgtggcaggacaacgaccagctggagcagagacaggagaaccagaacaacctgctgagccacgtgaaggtgctgatcaaggagagaggctacgagcacaagaacatcgagaagatcatccacgtgaccaccaagctggtgcccagcatcaagagactgcacaactgcgacaccatcctgaagcacaccctgaacagccacaaccacaacagaaacagcgccaccaagaacctgggcaagatcttcggcaacggcaacaacttcccccacagccccagcagcaccaagaacgagaacgccaagaccggcgccaacagctgcgagcacgaccactacgagaagcacctgagccacaagcaggcccccacccaccaccagaagatccaccccgaggagaagctgtacgtgtgcaccgagtgcgtgatgggcttcacccagaagagccacctgttcgagcaccagagaatccacgccggcgagaagagcagagagtgcgacaagagcaacaaggtgttcccccagaagccccaggtggacgtgcaccccagcgtgtacaccggcgagaagccctacctgtgcacccagtgcggcaaggtgttcaccctgaagagcaacctgatcacccaccagaagatccacaccggccagaagccctacaagtgcagcgagtgcggcaaggccttcttccagagaagcgacctgttcagacacctgagaatccacaccggcgagaagccctacgagtgcagcgagtgcggcaagggcttcagccagaacagcgacctgagcatccaccagaagacccacaccggcgagaagcactacgagtgcaacgagtgcggcaaggccttcaccagaaagagcgccctgagaatgcaccagagaatccacaccggcgagaagccctacgtgtgcgccgactgcggcaaggccttcatccagaagagccacttcaacacccaccagagaatccacaccggcgagaagccctacgagtgcagcgactgcggcaagagcttcaccaagaagagccagctgcacgtgcaccagagaatccacaccggcgagaagccctacatctgcaccgagtgcggcaaggtgttcacccacagaaccaacctgaccacccaccagaagacccacaccggcgagaagccctacatgtgcgccgagtgcggcaaggccttcaccgaccagagcaacctgatcaagcaccagaagacccacaccggcgagaagccctacaagtgcaacggctgcggcaaggccttcatctggaagagcagactgaagatccaccagaagagccacatcggcgagagacactacgagtgcaaggactgcggcaaggccttcatccagaagagcaccctgagcgtgcaccagagaatccacaccggcgagaagccctacgtgtgccccgagtgcggcaaggccttcatccagaagagccacttcatcgcccaccacagaatccacaccggcgagaagccctacgagtgcagcgactgcggcaagtgcttcaccaagaagagccagctgagagtgcaccagaagatccacaccggcgagaagcccaacatctgcgccgagtgcggcaaggccttcaccgacagaagcaacctgatcacccaccagaagatccacaccagagagaagccctacgagtgcggcgactgcggcaagaccttcacctggaagagcagactgaacatccaccagaagagccacaccggcgagagacactacgagtgcagcaagtgcggcaaggccttcatccagaaggccaccctgagcatgcaccagatcatccacaccggcaagaagccctacgcctgcaccgagtgccagaaggccttcaccgacagaagcaacctgatcaagcaccagaagatgcacagcggcgagaagagatacaaggccagcgactag

SEQ ID NO: 106040 - DNA, 2340 bp, Artificial Sequence; identical to SEQ ID NO: 106039
  Description of Artificial Sequence: Synthetic coding sequence

SEQ ID NO: 106041 - DNA, 2370 bp, Artificial Sequence
  Description of Artificial Sequence: Synthetic coding sequence
atgggcaccctgccccacggccccagaccctggctgcagagagacgtggccgcccacgtgagcgccgaccacgccgccctgaacagcatcgtgagcctgcaggccagcgtgagcttcgaggacgtgaccgtggacttcagcaaggaggagtggcagcacctggaccccgcccagagaagactgtactgggacgtgaccctggagaactacagccacctgctgagcgtgggctaccagatccccaagagcgaggccgccttcaagctggagcagggcgagggcccctggatgctggagggcgaggccccccaccagagctgcagcggcgaggccatcggcaagatgcagcagcagggcatccccggcggcatcttcttccactgcgagagattcgaccagcccatcggcgaggacagcctgtgcagcatcctggaggagctgtggcaggacaacgaccagctggagcagagacaggagaaccagaacaacctgctgagccacgtgaaggtgctgatcaaggagagaggctacgagcacaagaacatcgagaagatcatccacgtgaccaccaagctggtgcccagcatcaagagactgcacaactgcgacaccatcctgaagcacaccctgaacagccacaaccacaacagaaacagcgccaccaagaacctgggcaagatcttcggcaacggcaacaacttcccccacagccccagcagcaccaagaacgagaacgccaagaccggcgccaacagctgcgagcacgaccactacgagaagcacctgagccacaagcaggcccccacccaccaccagaagatccaccccgaggagaagctgtacgtgtgcaccgagtgcgtgatgggcttcacccagaagagccacctgttcgagcaccagagaatccacgccggcgagaagagcagagagtgcgacaagagcaacaaggtgttcccccagaagccccaggtggacgtgcaccccagcgtgtacaccggcgagaagccctacctgtgcacccagtgcggcaaggtgttcaccctgaagagcaacctgatcacccaccagaagatccacaccggccagaagccctacaagtgcagcgagtgcggcaaggccttcttccagagaagcgacctgttcagacacctgagaatccacaccggcgagaagccctacgagtgcagcgagtgcggcaagggcttcagccagaacagcgacctgagcatccaccagaagacccacaccggcgagaagcactacgagtgcaacgagtgcggcaaggccttcaccagaaagagcgccctgagaatgcaccagagaatccacaccggcgagaagccctacgtgtgcgccgactgcggcaaggccttcatccagaagagccacttcaacacccaccagagaatccacaccggcgagaagccctacgagtgcagcgactgcggcaagagcttcaccaagaagagccagctgcacgtgcaccagagaatccacaccggcgagaagccctacatctgcaccgagtgcggcaaggtgttcacccacagaaccaacctgaccacccaccagaagacccacaccggcgagaagccctacatgtgcgccgagtgcggcaaggccttcaccgaccagagcaacctgatcaagcaccagaagacccacaccggcgagaagccctacaagtgcaacggctgcggcaaggccttcatctggaagagcagactgaagatccaccagaagagccacatcggcgagagacactacgagtgcaaggactgcggcaaggccttcatccagaagagcaccctgagcgtgcaccagagaatccacaccggcgagaagccctacgtgtgccccgagtgcggcaaggccttcatccagaagagccacttcatcgcccaccacagaatccacaccggcgagaagccctacgagtgcagcgactgcggcaagtgcttcaccaagaagagccagctgagagtgcaccagaagatccacaccggcgagaagcccaacatctgcgccgagtgcggcaaggccttcaccgacagaagcaacctgatcacccaccagaagatccacaccagagagaagccctacgagtgcggcgactgcggcaagaccttcacctggaagagcagactgaacatccaccagaagagccacaccggcgagagacactacgagtgcagcaagtgcggcaaggccttcatccagaaggccaccctgagcatgcaccagatcatccacaccggcaagaagccctacgcctgcaccgagtgccagaaggccttcaccgacagaagcaacctgatcaagcaccagaagatgcacagcggcgagaagagatacaaggccagcgactag

SEQ ID NO: 106042 - DNA, 537 bp, Artificial Sequence
  Description of Artificial Sequence: Synthetic coding sequence
atgggcaccctgccccacggccccagaccctggctgcagagagacgtggccgcccacgtgagcgccgaccacgccgccctgaacagcatcgtgagcctgcaggccagcgtgagcttcgaggacgtgaccgtggacttcagcaaggaggagtggcagcacctggaccccgcccagagaagactgtactgggacgtgaccctggagaactacagccacctgctgagcgtgggctaccagatccccaagagcgaggccgccttcaagctggagcagggcgagggcccctggatgctggagggcgaggccccccaccagagctgcagcggcgaggccatcggcaagatgcagcagcagggcatccccggcggcatcttcttccactgcgagagattcgaccagcccatcggcgaggacagcctgtgcagcatcctggaggagctgtggcaggacaacgaccagctggagcagagacaggagaaccagaacaacctgctgagccacgtgaaggtgctgatcaaggagagaggctacgagtag

SEQ ID NO: 106043 - DNA, 3855 bp, Artificial Sequence
  Description of Artificial Sequence: Synthetic coding sequence
atgcacaagaagagagtggaggagggcgaggccagcgacttcagcctggcctgggacagcagcgtgaccgccgccggcggcctggagggcgagcccgagtgcgaccagaagaccagcagagccctggaggacagaaacagcgtgaccagccaggaggagagaaacgaggacgacgaggacatggaggacgagagcatctacacctgcgaccactgccagcaggacttcgagagcctggccgacctgaccgaccacagagcccacagatgccccggcgacggcgacgacgacccccagctgagctgggtggccagcagccccagcagcaaggacgtggccagccccacccagatgatcggcgacggctgcgacctgggcctgggcgaggaggagggcggcaccggcctgccctacccctgccagttctgcgacaagagcttcatcagactgagctacctgaagagacacgagcagatccacagcgacaagctgcccttcaagtgcacctactgcagcagactgttcaagcacaagagaagcagagacagacacatcaagctgcacaccggcgacaagaagtaccactgccacgagtgcgaggccgccttcagcagaagcgaccacctgaagatccacctgaagacccacagcagcagcaagcccttcaagtgcaccgtgtgcaagagaggcttcagcagcaccagcagcctgcagagccacatgcaggcccacaagaagaacaaggagcacctggccaagagcgagaaggaggccaagaaggacgacttcatgtgcgactactgcgaggacaccttcagccagaccgaggagctggagaagcacgtgctgaccagacacccccagctgagcgagaaggccgacctgcagtgcatccactgccccgaggtgttcgtggacgagaacaccctgctggcccacatccaccaggcccacgccaaccagaagcacaagtgccccatgtgccccgagcagttcagcagcgtggagggcgtgtactgccacctggacagccacagacagcccgacagcagcaaccacagcgtgagccccgaccccgtgctgggcagcgtggccagcatgagcagcgccacccccgacagcagcgccagcgtggagagaggcagcacccccgacagcaccctgaagcccctgagaggccagaagaagatgagagacgacggccagggctggaccaaggtggtgtacagctgcccctactgcagcaagagagacttcaacagcctggccgtgctggagatccacctgaagaccatccacgccgacaagccccagcagagccacacctgccagatctgcctggacagcatgcccaccctgtacaacctgaacgagcacgtgagaaagctgcacaagaaccacgcctaccccgtgatgcagttcggcaacatcagcgccttccactgcaactactgccccgagatgttcgccgacatcaacagcctgcaggagcacatcagagtgagccactgcggccccaacgccaaccccagcgacggcaacaacgccttcttctgcaaccagtgcagcatgggcttcctgaccgagagcagcctgaccgagcacatccagcaggcccactgcagcgtgggcagcgccaagctggagagccccgtggtgcagcccacccagagcttcatggaggtgtacagctgcccctactgcaccaacagccccatcttcggcagcatcctgaagctgaccaagcacatcaaggagaaccacaagaacatccccctggcccacagcaagaagagcaaggccgagcagagccccgtgagcagcgacgtggaggtgagcagccccaagagacagagactgagcgccagcgccaacagcatcagcaacggcgagtacccctgcaaccagtgcgacctgaagttcagcaacttcgagagcttccagacccacctgaagctgcacctggagctgctgctgagaaagcaggcctgcccccagtgcaaggaggacttcgacagccaggagagcctgctgcagcacctgaccgtgcactacatgaccaccagcacccactacgtgtgcgagagctgcgacaagcagttcagcagcgtggacgacctgcagaagcacctgctggacatgcacaccttcgtgctgtaccactgcaccctgtgccaggaggtgttcgacagcaaggtgagcatccaggtgcacctggccgtgaagcacagcaacgagaagaagatgtacagatgcaccgcctgcaactgggacttcagaaaggaggccgacctgcaggtgcacgtgaagcacagccacctgggcaaccccgccaaggcccacaagtgcatcttctgcggcgagaccttcagcaccgaggtggagctgcagtgccacatcaccacccacagcaagaagtacaactgcaagttctgcagcaaggccttccacgccatcatcctgctggagaagcacctgagagagaagcactgcgtgttcgacgccgccaccgagaacggcaccgccaacggcgtgccccccatggccaccaagaaggccgagcccgccgacctgcagggcatgctgctgaagaaccccgaggcccccaacagccacgaggccagcgaggacgacgtggacgccagcgagcccatgtacggctgcgacatctgcggcgccgcctacaccatggaggtgctgctgcagaaccacagactgagagaccacaacatcagacccggcgaggacgacggcagcagaaagaaggccgagttcatcaagggcagccacaagtgcaacgtgtgcagcagaaccttcttcagcgagaacggcctgagagagcacctgcagacccacagaggccccgccaagcactacatgtgccccatctgcggcgagagattccccagcctgctgaccctgaccgagcacaaggtgacccacagcaagagcctggacaccggcacctgcagaatctgcaagatgcccctgcagagcgaggaggagttcatcgagcactgccagatgcaccccgacctgagaaacagcctgaccggcttcagatgcgtggtgtgcatgcagaccgtgaccagcaccctggagctgaagatccacggcaccttccacatgcagaagctggccggcagcagcgccgccagcagccccaacggccagggcctgcagaagctgtacaagtgcgccctgtgcctgaaggagttcagaagcaagcaggacctggtgaagctggacgtgaacggcctgccctacggcctgtgcgccggctgcatggccagaagcgccaacggccaggtgggcggcctggccccccccgagcccgccgacagaccctgcgccggcctgagatgccccgagtgcagcgtgaagttcgagagcgccgaggacctggagagccacatgcaggtggaccacagagacctgacccccgagaccagcggccccagaaagggcacccagaccagccccgtgcccagaaagaagacctaccagtgcatcaagtgccagatgaccttcgagaacgagagagagatccagatccacgtggccaaccacatgatcgaggagggcatcaaccacgagtgcaagctgtgcaaccagatgttcgacagccccgccaagctgctgtgccacctgatcgagcacagcttcgagggcatgggcggcaccttcaagtgccccgtgtgcttcaccgtgttcgtgcaggccaacaagctgcagcagcacatcttcgccgtgcacggccaggaggacaagatctacgactgcagccagtgcccccagaagttcttcttccagaccgagctgcagaaccacaccatgagccagcacgcccagtag

SEQ ID NO: 106044 - DNA, 3504 bp, Artificial Sequence
  Description of Artificial Sequence: Synthetic coding sequence
atgatcggcgacggctgcgacctgggcctgggcgaggaggagggcggcaccggcctgccctacccctgccagttctgcgacaagagcttcatcagactgagctacctgaagagacacgagcagatccacagcgacaagctgcccttcaagtgcacctactgcagcagactgttcaagcacaagagaagcagagacagacacatcaagctgcacaccggcgacaagaagtaccactgccacgagtgcgaggccgccttcagcagaagcgaccacctgaagatccacctgaagacccacagcagcagcaagcccttcaagtgcaccgtgtgcaagagaggcttcagcagcaccagcagcctgcagagccacatgcaggcccacaagaagaacaaggagcacctggccaagagcgagaaggaggccaagaaggacgacttcatgtgcgactactgcgaggacaccttcagccagaccgaggagctggagaagcacgtgctgaccagacacccccagctgagcgagaaggccgacctgcagtgcatccactgccccgaggtgttcgtggacgagaacaccctgctggcccacatccaccaggcccacgccaaccagaagcacaagtgccccatgtgccccgagcagttcagcagcgtggagggcgtgtactgccacctggacagccacagacagcccgacagcagcaaccacagcgtgagccccgaccccgtgctgggcagcgtggccagcatgagcagcgccacccccgacagcagcgccagcgtggagagaggcagcacccccgacagcaccctgaagcccctgagaggccagaagaagatgagagacgacggccagggctggaccaaggtggtgtacagctgcccctactgcagcaagagagacttcaacagcctggccgtgctggagatccacctgaagaccatccacgccgacaagccccagcagagccacacctgccagatctgcctggacagcatgcccaccctgtacaacctgaacgagcacgtgagaaagctgcacaagaaccacgcctaccccgtgatgcagttcggcaacatcagcgccttccactgcaactactgccccgagatgttcgccgacatcaacagcctgcaggagcacatcagagtgagccactgcggccccaacgccaaccccagcgacggcaacaacgccttcttctgcaaccagtgcagcatgggcttcctgaccgagagcagcctgaccgagcacatccagcaggcccactgcagcgtgggcagcgccaagctggagagccccgtggtgcagcccacccagagcttcatggaggtgtacagctgcccctactgcaccaacagccccatcttcggcagcatcctgaagctgaccaagcacatcaaggagaaccacaagaacatccccctggcccacagcaagaagagcaaggccgagcagagccccgtgagcagcgacgtggaggtgagcagccccaagagacagagactgagcgccagcgccaacagcatcagcaacggcgagtacccctgcaaccagtgcgacctgaagttcagcaacttcgagagcttccagacccacctgaagctgcacctggagctgctgctgagaaagcaggcctgcccccagtgcaaggaggacttcgacagccaggagagcctgctgcagcacctgaccgtgcactacatgaccaccagcacccactacgtgtgcgagagctgcgacaagcagttcagcagcgtggacgacctgcagaagcacctgctggacatgcacaccttcgtgctgtaccactgcaccctgtgccaggaggtgttcgacagcaaggtgagcatccaggtgcacctggccgtgaagcacagcaacgagaagaagatgtacagatgcaccgcctgcaactgggacttcagaaaggaggccgacctgcaggtgcacgtgaagcacagccacctgggcaaccccgccaaggcccacaagtgcatcttctgcggcgagaccttcagcaccgaggtggagctgcagtgccacatcaccacccacagcaagaagtacaactgcaagttctgcagcaaggccttccacgccatcatcctgctggagaagcacctgagagagaagcactgcgtgttcgacgccgccaccgagaacggcaccgccaacggcgtgccccccatggccaccaagaaggccgagcccgccgacctgcagggcatgctgctgaagaaccccgaggcccccaacagccacgaggccagcgaggacgacgtggacgccagcgagcccatgtacggctgcgacatctgcggcgccgcctacaccatggaggtgctgctgcagaaccacagactgagagaccacaacatcagacccggcgaggacgacggcagcagaaagaaggccgagttcatcaagggcagccacaagtgcaacgtgtgcagcagaaccttcttcagcgagaacggcctgagagagcacctgcagacccacagaggccccgccaagcactacatgtgccccatctgcggcgagagattccccagcctgctgaccctgaccgagcacaaggtgacccacagcaagagcctggacaccggcacctgcagaatctgcaagatgcccctgcagagcgaggaggagttcatcgagcactgccagatgcaccccgacctgagaaacagcctgaccggcttcagatgcgtggtgtgcatgcagaccgtgaccagcaccctggagctgaagatccacggcaccttccacatgcagaagctggccggcagcagcgccgccagcagccccaacggccagggcctgcagaagctgtacaagtgcgccctgtgcctgaaggagttcagaagcaagcaggacctggtgaagctggacgtgaacggcctgccctacggcctgtgcgccggctgcatggccagaagcgccaacggccaggtgggcggcctggccccccccgagcccgccgacagaccctgcgccggcctgagatgccccgagtgcagcgtgaagttcgagagcgccgaggacctggagagccacatgcaggtggaccacagagacctgacccccgagaccagcggccccagaaagggcacccagaccagccccgtgcccagaaagaagacctaccagtgcatcaagtgccagatgaccttcgagaacgagagagagatccagatccacgtggccaaccacatgatcgaggagggcatcaaccacgagtgcaagctgtgcaaccagatgttcgacagccccgccaagctgctgtgccacctgatcgagcacagcttcgagggcatgggcggcaccttcaagtgccccgtgtgcttcaccgtgttcgtgcaggccaacaagctgcagcagcacatcttcgccgtgcacggccaggaggacaagatctacgactgcagccagtgcccccagaagttcttcttccagaccgagctgcagaaccacaccatgagccagcacgcccagtag

SEQ ID NO: 106045 - DNA, 3855 bp, Artificial Sequence; identical to SEQ ID NO: 106043
  Description of Artificial Sequence: Synthetic coding sequence

SEQ ID NO: 106046 - DNA, 2430 bp, Artificial Sequence
  Description of Artificial Sequence: Synthetic coding sequence
atgggccccctgaccttcatggacgtggccatcgagttctgcctggaggagtggcagtgcctggacatcgcccagcagaacctgtacagaaacgtgatgctggagaactacagaaacctggtgttcctgggcatcgccgtgagcaagcccgacctgatcacctgcctggagcaggagaaggagccctgggagcccatgagaagacacgagatggtggccaagccccccgtgatgtgcagccacttcacccaggacttctggcccgagcagcacatcaaggaccccttccagaaggccaccctgagaagatacaagaactgcgagcacaagaacgtgcacctgaagaaggaccacaagagcgtggacgagtgcaaggtgcacagaggcggctacaacggcttcaaccagtgcctgcccgccacccagagcaagatcttcctgttcgacaagtgcgtgaaggccttccacaagttcagcaacagcaacagacacaagatcagccacaccgagaagaagctgttcaagtgcaaggagtgcggcaagagcttctgcatgctgccccacctggcccagcacaagatcatccacaccagagtgaacttctgcaagtgcgagaagtgcggcaaggccttcaactgccccagcatcatcaccaagcacaagagaatcaacaccggcgagaagccctacacctgcgaggagtgcggcaaggtgttcaactggagcagcagactgaccacccacaagaagaactacaccagatacaagctgtacaagtgcgaggagtgcggcaaggccttcaacaagagcagcatcctgaccacccacaagatcatcagaaccggcgagaagttctacaagtgcaaggagtgcgccaaggccttcaaccagagcagcaacctgaccgagcacaagaagatccaccccggcgagaagccctacaagtgcgaggagtgcggcaaggccttcaactggcccagcaccctgaccaagcacaagagaatccacaccggcgagaagccctacacctgcgaggagtgcggcaaggccttcaaccagttcagcaacctgaccacccacaagagaatccacaccgccgagaagttctacaagtgcaccgagtgcggcgaggccttcagcagaagcagcaacctgaccaagcacaagaagatccacaccgagaagaagccctacaagtgcgaggagtgcggcaaggccttcaagtggagcagcaagctgaccgagcacaagctgacccacaccggcgagaagccctacaagtgcgaggagtgcggcaaggccttcaactggcccagcaccctgaccaagcacaacagaatccacaccggcgagaagccctacaagtgcgaggtgtgcggcaaggccttcaaccagttcagcaacctgaccacccacaagagaatccacaccgccgagaagccctacaagtgcgaggagtgcggcaaggccttcagcagaagcagcaacctgaccaagcacaagaagatccacatcgagaagaagccctacaagtgcgaggagtgcggcaaggccttcaagtggagcagcaagctgaccgagcacaagatcacccacaccggcgagaagccctacaagtgcgaggagtgcggcaaggccttcaaccacttcagcatcctgaccaagcacaagagaatccacaccggcgagaagccctacaagtgcgaggagtgcggcaaggccttcacccagagcagcaacctgaccacccacaagaagatccacaccggcgagaagttctacaagtgcgaggagtgcggcaaggccttcacccagagcagcaacctgaccacccacaagaagatccacaccggcggcaagccctacaagtgcgaggagtgcggcaaggccttcaaccagttcagcaccctgaccaagcacaagatcatccacaccgaggagaagccctacaagtgcgaggagtgcggcaaggccttcaagtggagcagcaccctgaccaagcacaagatcatccacaccggcgagaagccctacaagtgcgaggagtgcggcaaggccttcaagctgagcagcaccctgagcacccacaagatcatccacaccggcgagaagccctacaagtgcgagaagtgcggcaaggccttcaacagaagcagcaacctgatcgagcacaagaagatccacaccggcgagcagccctacaagtgcgaggagtgcggcaaggccttcaactacagcagccacctgaacacccacaagagaatccacaccaaggagcagccctacaagtgcaaggagtgcggcaaggccttcaaccagtacagcaacctgaccacccacaacaagatccacaccggcgagaagctgtacaagcccgaggacgtgaccgtgatcctgaccaccccccagaccttcagcaacatcaagtag

SEQ ID NO: 106047 - DNA, 2427 bp, Artificial Sequence
  Description of Artificial Sequence: Synthetic coding sequence
ggccccctgaccttcatggacgtggccatcgagttctgcctggaggagtggcagtgcctggacatcgcccagcagaacctgtacagaaacgtgatgctggagaactacagaaacctggtgttcctgggcatcgccgtgagcaagcccgacctgatcacctgcctggagcaggagaaggagccctgggagcccatgagaagacacgagatggtggccaagccccccgtgatgtgcagccacttcacccaggacttctggcccgagcagcacatcaaggaccccttccagaaggccaccctgagaagatacaagaactgcgagcacaagaacgtgcacctgaagaaggaccacaagagcgtggacgagtgcaaggtgcacagaggcggctacaacggcttcaaccagtgcctgcccgccacccagagcaagatcttcctgttcgacaagtgcgtgaaggccttccacaagttcagcaacagcaacagacacaagatcagccacaccgagaagaagctgttcaagtgcaaggagtgcggcaagagcttctgcatgctgccccacctggcccagcacaagatcatccacaccagagtgaacttctgcaagtgcgagaagtgcggcaaggccttcaactgccccagcatcatcaccaagcacaagagaatcaacaccggcgagaagccctacacctgcgaggagtgcggcaaggtgttcaactggagcagcagactgaccacccacaagaagaactacaccagatacaagctgtacaagtgcgaggagtgcggcaaggccttcaacaagagcagcatcctgaccacccacaagatcatcagaaccggcgagaagttctacaagtgcaaggagtgcgccaaggccttcaaccagagcagcaacctgaccgagcacaagaagatccaccccggcgagaagccctacaagtgcgaggagtgcggcaaggccttcaactggcccagcaccctgaccaagcacaagagaatccacaccggcgagaagccctacacctgcgaggagtgcggcaaggccttcaaccagttcagcaacctgaccacccacaagagaatccacaccgccgagaagttctacaagtgcaccgagtgcggcgaggccttcagcagaagcagcaacctgaccaagcacaagaagatccacaccgagaagaagccctacaagtgcgaggagtgcggcaaggccttcaagtggagcagcaagctgaccgagcacaagctgacccacaccggcgagaagccctacaagtgcgaggagtgcggcaaggccttcaactggcccagcaccctgaccaagcacaacagaatccacaccggcgagaagccctacaagtgcgaggtgtgcggcaaggccttcaaccagttcagcaacctgaccacccacaagagaatccacaccgccgagaagccctacaagtgcgaggagtgcggcaaggccttcagcagaagcagcaacctgaccaagcacaagaagatccacatcgagaagaagccctacaagtgcgaggagtgcggcaaggccttcaagtggagcagcaagctgaccgagcacaagatcacccacaccggcgagaagccctacaagtgcgaggagtgcggcaaggccttcaaccacttcagcatcctgaccaagcacaagagaatccacaccggcgagaagccctacaagtgcgaggagtgcggcaaggccttcacccagagcagcaacctgaccacccacaagaagatccacaccggcgagaagttctacaagtgcgaggagtgcggcaaggccttcacccagagcagcaacctgaccacccacaagaagatccacaccggcggcaagccctacaagtgcgaggagtgcggcaaggccttcaaccagttcagcaccctgaccaagcacaagatcatccacaccgaggagaagccctacaagtgcgaggagtgcggcaaggccttcaagtggagcagcaccctgaccaagcacaagatcatccacaccggcgagaagccctacaagtgcgaggagtgcggcaaggccttcaagctgagcagcaccctgagcacccacaagatcatccacaccggcgagaagccctacaagtgcgagaagtgcggcaaggccttcaacagaagcagcaacctgatcgagcacaagaagatccacaccggcgagcagccctacaagtgcgaggagtgcggcaaggccttcaactacagcagccacctgaacacccacaagagaatccacaccaaggagcagccctacaagtgcaaggagtgcggcaaggccttcaaccagtacagcaacctgaccacccacaacaagatccacaccggcgagaagctgtacaagcccgaggacgtgaccgtgatcctgaccaccccccagaccttcagcaacatcaagtag

SEQ ID NO: 106048 - DNA, 2412 bp, Artificial Sequence
  Description of Artificial Sequence: Synthetic coding sequence
atggacgtggccatcgagttctgcctggaggagtggcagtgcctggacatcgcccagcagaacctgtacagaaacgtgatgctggagaactacagaaacctggtgttcctgggcatcgccgtgagcaagcccgacctgatcacctgcctggagcaggagaaggagccctgggagcccatgagaagacacgagatggtggccaagccccccgtgatgtgcagccacttcacccaggacttctggcccgagcagcacatcaaggaccccttccagaaggccaccctgagaagatacaagaactgcgagcacaagaacgtgcacctgaagaaggaccacaagagcgtggacgagtgcaaggtgcacagaggcggctacaacggcttcaaccagtgcctgcccgccacccagagcaagatcttcctgttcgacaagtgcgtgaaggccttccacaagttcagcaacagcaacagacacaagatcagccacaccgagaagaagctgttcaagtgcaaggagtgcggcaagagcttctgcatgctgccccacctggcccagcacaagatcatccacaccagagtgaacttctgcaagtgcgagaagtgcggcaaggccttcaactgccccagcatcatcaccaagcacaagagaatcaacaccggcgagaagccctacacctgcgaggagtgcggcaaggtgttcaactggagcagcagactgaccacccacaagaagaactacaccagatacaagctgtacaagtgcgaggagtgcggcaaggccttcaacaagagcagcatcctgaccacccacaagatcatcagaaccggcgagaagttctacaagtgcaaggagtgcgccaaggccttcaaccagagcagcaacctgaccgagcacaagaagatccaccccggcgagaagccctacaagtgcgaggagtgcggcaaggccttcaactggcccagcaccctgaccaagcacaagagaatccacaccggcgagaagccctacacctgcgaggagtgcggcaaggccttcaaccagttcagcaacctgaccacccacaagagaatccacaccgccgagaagttctacaagtgcaccgagtgcggcgaggccttcagcagaagcagcaacctgaccaagcacaagaagatccacaccgagaagaagccctacaagtgcgaggagtgcggcaaggccttcaagtggagcagcaagctgaccgagcacaagctgacccacaccggcgagaagccctacaagtgcgaggagtgcggcaaggccttcaactggcccagcaccctgaccaagcacaacagaatccacaccggcgagaagccctacaagtgcgaggtgtgcggcaaggccttcaaccagttcagcaacctgaccacccacaagagaatccacaccgccgagaagccctacaagtgcgaggagtgcggcaaggccttcagcagaagcagcaacctgaccaagcacaagaagatccacatcgagaagaagccctacaagtgcgaggagtgcggcaaggccttcaagtggagcagcaagctgaccgagcacaagatcacccacaccggcgagaagccctacaagtgcgaggagtgcggcaaggccttcaaccacttcagcatcctgaccaagcacaagagaatccacaccggcgagaagccctacaagtgcgaggagtgcggcaaggccttcacccagagcagcaacctgaccacccacaagaagatccacaccggcgagaagttctacaagtgcgaggagtgcggcaaggccttcacccagagcagcaacctgaccacccacaagaagatccacaccggcggcaagccctacaagtgcgaggagtgcggcaaggccttcaaccagttcagcaccctgaccaagcacaagatcatccacaccgaggagaagccctacaagtgcgaggagtgcggcaaggccttcaagtggagcagcaccctgaccaagcacaagatcatccacaccggcgagaagccctacaagtgcgaggagtgcggcaaggccttcaagctgagcagcaccctgagcacccacaagatcatccacaccggcgagaagccctacaagtgcgagaagtgcggcaaggccttcaacagaagcagcaacctgatcgagcacaagaagatccacaccggcgagcagccctacaagtgcgaggagtgcggcaaggccttcaactacagcagccacctgaacacccacaagagaatccacaccaaggagcagccctacaagtgcaaggagtgcggcaaggccttcaaccagtacagcaacctgaccacccacaacaagatccacaccggcgagaagctgtacaagcccgaggacgtgaccgtgatcctgaccaccccccagaccttcagcaacatcaagtag

SEQ ID NO: 106049 - DNA, 1713 bp, Artificial Sequence
  Description of Artificial Sequence: Synthetic coding sequence
atggagaacctgaagagcggcgtgtaccccctgaaggaggccagcggctgccccggcgccgacagaaacctgctggtgtacagcttctacgagaagggccccctgaccttcagagacgtggccatcgagttcagcctggaggagtggcagtgcctggacaccgcccagcaggacctgtacagaaaggtgatgctggagaactacagaaacctggtgttcctggccggcatcgccgtgagcaagcccgacctgatcacctgcctggagcagggcaaggagccctggaacatgaagagacacgccatggtggaccagccccccgtgacctacagccacttcgcccaggacctgtggcccgagcagggcatcaaggacagcttccaggaggtgatcctgagaagatacggcaagtgcggccacgaggacctgcagctgagaaccggctgcaagagcgtggacgagtgcaacctgcacaaggagtgctacgacgagctgaaccagtgcctgaccaccacccagagcgagatcttccagtacgacaagtacgtgaacgtgttctacaagttcagcaaccccaacatccagaagatcagacacaccggcaagaagcccttcaagtgcaagaagtgcgacaagagcttctgcatgctgctgcacctgacccagcacaagagaatccacatcagagagaacagctaccagtgcgaggagtgcggcaaggtgttcaactggttcagcaccctgaccagacacagaagaatccacaccggcgagaagccctacaagtgcgagcagtgcggcaaggccttcaagcagagcagcaccctgaccacccacaagatcatccacaccggcgagaagccctacagatgcgaggagtgcggcaagaccttcaacagaagcagccacctgaccacccacaagagaatccacaccggcgagaagccctacagatgcgaggagtgcggcagagccttcaacagaagcagccacctgaccacccacaagatcatccacaccggcgagaagccctacaagtgcgaggagtgcggcaaggccttcaaccagagcagcaccctgaccacccacaagatcatccacgccggcgagaagccctacaagtgcgaggagtgcggcaaggccttctacagattcagctacctgaccaagcacaagatcatccacaccggcgagaagttctacaagtgcgaggagtgcggcaagggcttcaactggagcagcaccctgaccaagcacaagagaatccacaccggcgagaagccctacaagtgcgagcagtgcggcaaggccttcaacgagagcagcaacctgaccgcccacaagatcatccacaccggcgagaagccctacaagtgcgaggagtgcggcaaggccttcaacagaagccccaagctgaccgcccacaaggtgatccacagcggcgagaagccctacaagtgcgaggagtgcggcaaggccttcaaccagttcagcaacctgaccaagcacaagatcacccacatcggcgacaccagctacaagtacctggagtgcgacaaggccttcagccagagcagcaccctgaccaagcacaaggtgatccacaccggcgagaagccctacaactgcgaggagtacggcaaggccttcaaccagagcagcaacctgatcgagcagagcaacagctactggagagagaccctgcagatgtag

SEQ ID NO: 106050 - DNA, 1413 bp, Artificial Sequence
  Description of Artificial Sequence: Synthetic coding sequence
atggccgccaccctgctgatggccggcagccaggcccccgtgaccttcgaggacatggccatgtacctgaccagagaggagtggagacccctggacgccgcccagagagacctgtacagagacgtgatgcaggagaactacggcaacgtggtgagcctggacttcgagatcagaagcgagaacgaggtgaaccccaagcaggagatcagcgaggacgtgcagttcggcaccaccagcgagagacccgccgagaacgccgaggagaaccccgagagcgaggagggcttcgagagcggcgacagaagcgagagacagtggggcgacctgaccgccgaggagtgggtgagctaccccctgcagcccgtgaccgacctgctggtgcacaaggaggtgcacaccggcatcagataccacatctgcagccactgcggcaaggccttcagccagatcagcgacctgaacagacaccagaagacccacaccggcgacagaccctacaagtgctacgagtgcggcaagggcttcagcagaagcagccacctgatccagcaccagagaacccacaccggcgagagaccctacgactgcaacgagtgcggcaagagcttcggcagaagcagccacctgatccagcaccagaccatccacaccggcgagaagccccacaagtgcaacgagtgcggcaagagcttctgcagactgagccacctgatccagcaccagagaacccacagcggcgagaagccctacgagtgcgaggagtgcggcaagagcttcagcagaagcagccacctggcccagcaccagagaacccacaccggcgagaagccctacgagtgcaacgagtgcggcagaggcttcagcgagagaagcgacctgatcaagcactacagagtgcacaccggcgagagaccctacaagtgcgacgagtgcggcaagaacttcagccagaacagcgacctggtgagacacagaagagcccacaccggcgagaagccctaccactgcaacgagtgcggcgagaacttcagcagaatcagccacctggtgcagcaccagagaacccacaccggcgagaagccctacgagtgcaacgcctgcggcaagagcttcagcagaagcagccacctgatcacccaccagaagatccacaccggcgagaagccctacgagtgcaacgagtgctggagaagcttcggcgagagaagcgacctgatcaagcaccagagaacccacaccggcgagaagccctacgagtgcgtgcagtgcggcaagggcttcacccagagcagcaacctgatcacccaccagagagtgcacaccggcgagaagccctacgagtgcaccgagtgcgagaagagcttcagcagaagcagcgccctgatcaagcacaagagagtgcacaccgactag

SEQ ID NO: 106051 - DNA, 1413 bp, Artificial Sequence; identical to SEQ ID NO: 106050
  Description of Artificial Sequence: Synthetic coding sequence

SEQ ID NO: 106052 - DNA, 909 bp, Artificial Sequence
  Description of Artificial Sequence: Synthetic coding sequence
atggccgccaccctgctgatggccggcagccaggcccccgtgaccttcgaggacatggccatgtacctgaccagagaggagtggagacccctggacgccgcccagagagacctgtacagagacgtgatgcaggagaactacggcaacgtggtgagcctggacttcgagatcagaagcgagaacgaggtgaaccccaagcaggagatcagcgaggacgtgcagttcggcaccaccagcgagagacccgccgagaacgccgaggagaaccccgagagcgaggagggcttcgagagcggcgacagaagcgagagacagtggggcgacctgaccgccgaggagtgggtgagctaccccctgcagcccgtgaccgacctgctggtgcacaaggaggtgcacaccggcatcagataccacatctgcagccactgcggcaaggccttcagccagatcagcgacctgaacagacaccagaagacccacaccggcgacagaccctacaagtgctacgagtgcggcaagggcttcagcagaagcagccacctgatccagcaccagagaacccacaccggcgagagaccctacgactgcaacgagtgcggcaagagcttcggcagaagcagccacctgatccagcaccagaccatccacaccggcgagaagccccacaagtgcaacgagtgcggcaagagcttctgcagactgagccacctgatccagcaccagagaacccacagcggcgagaagccctacgagtgcgaggagtgcggcaagagcttcagcagaagcagccacctggcccagcaccagagaacccacaccggcgagaagccctacgagtgcaccgagtgcgagaagagcttcagcagaagcagcgccctgatcaagcacaagagagtgcacaccgactag

SEQ ID NO: 106053 - DNA, 1848 bp, Artificial Sequence
  Description of Artificial Sequence: Synthetic coding sequence
atggacagcgtggccttcgaggacgtggccgtgaacttcacccacgaggagtgggccctgctgggccccagccagaagaacctgtacagagacgtgatgagagagaccatcagaaacctgaactgcatcggcatgaagtgggagaaccagaacatcgacgaccagcaccagaacctgagaagaaaccccagatgcgacgtggtggagagattcggcaagagcaaggacggcagccagtgcggcgagaccctgagccagatcagaaacagcatcgtgaacaagaacacccccgccagagtggacgcctgcggcagcagcgtgaacggcgaggtgatcatgggccacagcagcctgaactgctacatcagagtggacaccggccacaagcacagagagtgccacgagtacgccgagaagagctacacccacaagcagtgcggcaagggcctgagctacagacacagcttccagacctgcgagagaccccacaccggcaagaagccctacgactgcaaggagtgcggcaagaccttcagcagccccggcaacctgagaagacacatggtggtgaagggcggcgacggcccctacaagtgcgagctgtgcggcaaggccttcttctggcccagcctgctgagaatgcacgagagaacccacaccggcgagaagccctacgagtgcaagcagtgcagcaaggccttccccgtgtacagcagctacctgagacacgagaagatccacaccggcgagaagccctacgagtgcaagcagtgcagcaaggccttccccgactacagcagctacctgagacacgagagaacccacaccggcgagaagccctacaagtgcaagcagtgcggcaaggccttcagcgtgagcggcagcctgagagtgcacgagagaatccacaccggcgagaagccctacacctgcaagcagtgcggcaaggccttctgccacctgggcagcttccagagacacatgatcatgcacagcggcgacggcccccacaagtgcaagatctgcggcaagggcttcgacttccccggcagcgccagaatccacgagggcacccacaccctggagaagccctacgagtgcaagcagtgcggcaagctgctgagccacagaagcagcttcagaagacacatgatggcccacaccggcgacggcccccacaagtgcaccgtgtgcggcaaggccttcgacagccccagcgtgttccagagacacgagagaacccacaccggcgagaagccctacgagtgcaagcagtgcggcaaggccttcagaaccagcagcagcctgagaaagcacgagaccacccacaccggcgagcagccctacaagtgcaagtgcggcaaggccttcagcgacctgttcagcttccagagccacgagaccacccacagcgaggaggagccctacgagtgcaaggagtgcggcaaggccttcagcagcttcaagtacttctgcagacacgagagaacccacagcgaggagaagagctacgagtgccagatctgcggcaaggccttcagcagattcagctacctgaagacccacgagagaacccacaccgccgagaagccctacgagtgcaagcagtgcagaaaggccttcttctggcccagcttcctgctgagacacgagagaacccacaccggcgagagaccctacgagtgcaagcactgcggcaaggccttcagcagaagcagcttctgcagagagcacgagagaacccacaccggcgagaagccctacgagtgcaaggagtgcggcaaggccttcagcagcctgagcagcttcaacagacacaagagaacccactggaaggacatcctgtag

SEQ ID NO: 106054 - DNA, 1992 bp, Artificial Sequence
  Description of Artificial Sequence: Synthetic coding sequence
atggccctgtgctacggcaccttctggggctaccccaagatgctggaggccgccaacctgatggagggcctggtggacatcggcccctgggtgaccctgcccagaggccagcccgaggtgctggagtggggcctgcccaaggaccaggacagcgtggccttcgaggacgtggccgtgaacttcacccacgaggagtgggccctgctgggccccagccagaagaacctgtacagagacgtgatgagagagaccatcagaaacctgaactgcatcggcatgaagtgggagaaccagaacatcgacgaccagcaccagaacctgagaagaaaccccagatgcgacgtggtggagagattcggcaagagcaaggacggcagccagtgcggcgagaccctgagccagatcagaaacagcatcgtgaacaagaacacccccgccagagtggacgcctgcggcagcagcgtgaacggcgaggtgatcatgggccacagcagcctgaactgctacatcagagtggacaccggccacaagcacagagagtgccacgagtacgccgagaagagctacacccacaagcagtgcggcaagggcctgagctacagacacagcttccagacctgcgagagaccccacaccggcaagaagccctacgactgcaaggagtgcggcaagaccttcagcagccccggcaacctgagaagacacatggtggtgaagggcggcgacggcccctacaagtgcgagctgtgcggcaaggccttcttctggcccagcctgctgagaatgcacgagagaacccacaccggcgagaagccctacgagtgcaagcagtgcagcaaggccttccccgtgtacagcagctacctgagacacgagaagatccacaccggcgagaagccctacgagtgcaagcagtgcagcaaggccttccccgactacagcagctacctgagacacgagagaacccacaccggcgagaagccctacaagtgcaagcagtgcggcaaggccttcagcgtgagcggcagcctgagagtgcacgagagaatccacaccggcgagaagccctacacctgcaagcagtgcggcaaggccttctgccacctgggcagcttccagagacacatgatcatgcacagcggcgacggcccccacaagtgcaagatctgcggcaagggcttcgacttccccggcagcgccagaatccacgagggcacccacaccctggagaagccctacgagtgcaagcagtgcggcaagctgctgagccacagaagcagcttcagaagacacatgatggcccacaccggcgacggcccccacaagtgcaccgtgtgcggcaaggccttcgacagccccagcgtgttccagagacacgagagaacccacaccggcgagaagccctacgagtgcaagcagtgcggcaaggccttcagaaccagcagcagcctgagaaagcacgagaccacccacaccggcgagcagccctacaagtgcaagtgcggcaaggccttcagcgacctgttcagcttccagagccacgagaccacccacagcgaggaggagccctacgagtgcaaggagtgcggcaaggccttcagcagcttcaagtacttctgcagacacgagagaacccacagcgaggagaagagctacgagtgccagatctgcggcaaggccttcagcagattcagctacctgaagacccacgagagaacccacaccgccgagaagccctacgagtgcaagcagtgcagaaaggccttcttctggcccagcttcctgctgagacacgagagaacccacaccggcgagagaccctacgagtgcaagcactgcggcaaggccttcagcagaagcagcttctgcagagagcacgagagaacccacaccggcgagaagccctacgagtgcaaggagtgcggcaaggccttcagcagcctgagcagcttcaacagacacaagagaacccactggaaggacatcctgtag

SEQ ID NO: 106055 - DNA, 1914 bp, Artificial Sequence
  Description of Artificial Sequence: Synthetic coding sequence
atggccctgtgctacggcaccttctggggctaccccaagatgctggaggccgccaacctgatggagggcctggtggacatcggcccctgggtgaccctgcccagaggccagcccgaggtgctggagtggggcctgcccaaggaccaggacagcgtggccttcgaggacgtggccgtgaacttcacccacgaggagtgggccctgctgggccccagccagaagaacctgtacagagacgtgatgagagagaccatcagaaacctgaactgcatcggcatgaagtgggagaaccagaacatcgacgaccagcaccagaacctgagaagaaaccccagatgcgacgtggtggagagattcggcaagagcaaggacggcagccagtgcggcgagaccctgagccagatcagaaacagcatcgtgaacaagaacacccccgccagagtggacgcctgcggcagcagcgtgaacggcgaggtgatcatgggccacagcagcctgaactgctacatcagagtggacaccggccacaagcacagagagtgccacgagtacgccgagaagagctacacccacaagcagtgcggcaagggcctgagctacagacacagcttccagacctgcgagagaccccacaccggcaagaagccctacgactgcaaggagtgcggcaagaccttcagcagccccggcaacctgagaagacacatggtggtgaagggcggcgacggcccctacaagtgcgagctgtgcggcaaggccttcttctggcccagcctgctgagaatgcacgagagaacccacaccggcgagaagccctacgagtgcaagcagtgcagcaaggccttccccgtgtacagcagctacctgagacacgagaagatccacaccggcgagaagccctacgagtgcaagcagtgcagcaaggccttccccgactacagcagctacctgagacacgagagaacccacaccggcgagaagccctacaagtgcaagcagtgcggcaaggccttcagcgtgagcggcagcctgagagtgcacgagagaatccacaccggcgagaagccctacacctgcaagcagtgcggcaaggccttctgccacctgggcagcttccagagacacatgatcatgcacagcggcgacggcccccacaagtgcaagatctgcggcaagggcttcgacttccccggcagcgccagaatccacgagggcacccacaccctggagaagccctacgagtgcaagcagtgcggcaagctgctgagccacagaagcagcttcagaagacacatgatggcccacaccggcgacggcccccacaagtgcaccgtgtgcggcaaggccttcgacagccccagcgtgttccagagacacgagagaacccacaccggcgagaagccctacgagtgcaagcagtgcggcaaggccttcagaaccagcagcagcctgagaaagcacgagaccacccacaccggcgagcagccctacaagtgcaagtgcggcaaggccttcagcgacctgttcagcttccagagccacgagaccacccacagcgaggaggagccctacgagtgcaaggagtgcggcaaggccttcagcagcttcaagtacttctgcagacacgagagaacccacagcgaggagaagagctacgagtgccagatctgcggcaaggccttcagcagattcagctacctgaagacccacgagagaacccacaccgccgagaagccctacgagtgcaagcagtgcagaaaggccttcttctggcccagcttcctgctgagacacgagagaacccacaccggcgagagaccctacgagtgcaagcactgcggcaaggccttcagcagaagcagcttctgcagagagcacgagagaacccacaccggcgagaagccctacgagtag

SEQ ID NO: 106056 - DNA, 1770 bp, Artificial Sequence
  Description of Artificial Sequence: Synthetic coding sequence
atggacagcgtggccttcgaggacgtggccgtgaacttcacccacgaggagtgggccctgctgggccccagccagaagaacctgtacagagacgtgatgagagagaccatcagaaacctgaactgcatcggcatgaagtgggagaaccagaacatcgacgaccagcaccagaacctgagaagaaaccccagatgcgacgtggtggagagattcggcaagagcaaggacggcagccagtgcggcgagaccctgagccagatcagaaacagcatcgtgaacaagaacacccccgccagagtggacgcctgcggcagcagcgtgaacggcgaggtgatcatgggccacagcagcctgaactgctacatcagagtggacaccggccacaagcacagagagtgccacgagtacgccgagaagagctacacccacaagcagtgcggcaagggcctgagctacagacacagcttccagacctgcgagagaccccacaccggcaagaagccctacgactgcaaggagtgcggcaagaccttcagcagccccggcaacctgagaagacacatggtggtgaagggcggcgacggcccctacaagtgcgagctgtgcggcaaggccttcttctggcccagcctgctgagaatgcacgagagaacccacaccggcgagaagccctacgagtgcaagcagtgcagcaaggccttccccgtgtacagcagctacctgagacacgagaagatccacaccggcgagaagccctacgagtgcaagcagtgcagcaaggccttccccgactacagcagctacctgagacacgagagaacccacaccggcgagaagccctacaagtgcaagcagtgcggcaaggccttcagcgtgagcggcagcctgagagtgcacgagagaatccacaccggcgagaagccctacacctgcaagcagtgcggcaaggccttctgccacctgggcagcttccagagacacatgatcatgcacagcggcgacggcccccacaagtgcaagatctgcggcaagggcttcgacttccccggcagcgccagaatccacgagggcacccacaccctggagaagccctacgagtgcaagcagtgcggcaagctgctgagccacagaagcagcttcagaagacacatgatggcccacaccggcgacggcccccacaagtgcaccgtgtgcggcaaggccttcgacagccccagcgtgttccagagacacgagagaacccacaccggcgagaagccctacgagtgcaagcagtgcggcaaggccttcagaaccagcagcagcctgagaaagcacgagaccacccacaccggcgagcagccctacaagtgcaagtgcggcaaggccttcagcgacctgttcagcttccagagccacgagaccacccacagcgaggaggagccctacgagtgcaaggagtgcggcaaggccttcagcagcttcaagtacttctgcagacacgagagaacccacagcgaggagaagagctacgagtgccagatctgcggcaaggccttcagcagattcagctacctgaagacccacgagagaacccacaccgccgagaagccctacgagtgcaagcagtgcagaaaggccttcttctggcccagcttcctgctgagacacgagagaacccacaccggcgagagaccctacgagtgcaagcactgcggcaaggccttcagcagaagcagcttctgcagagagcacgagagaacccacaccggcgagaagccctacgagtag

SEQ ID NO: 106057 - DNA, 1623 bp, Artificial Sequence
  Description of Artificial Sequence: Synthetic coding sequence
atgggcatcgtggagaaggccagcagcagcagcgacagcgtgaccttcgaggacgtggccgtgaacttcacccaggaggagtggaccctgctggaccccagccagaagaagctgtacagagacgtgatgtgggagaccttcagaaacctggccaccatcggcaccaagcagaaggagtggaacatcgaggagcagtacaagaaccagggcagaaacctgagaaaccacatggtggagagactgtgcgagagcaaggagggcagccacggcggcgagggcttcagccagatcgccaacctgagcctgaacaagaagacccccagcggcggcaagctgtgggagagcagcgtgtgcggcaaggtgctgagccaccacagcagcctgaacagacacatcagaagctacaccagacacaagctgtacaagtgccaggagtacggcgagaagccctacaagtgcaagaagtgcggcaagcccttcagctacctgcagagcttcaagaagcacaagagaacccacagcgccggcatcgtgtacaagtgcaaggcctgcggcaaggccttcagctgccagagaagcttccagatccacggcagaacccacaccggcgacaagcccttcaagtgcaaggagtgcggcaaggccttcagataccaccagagcgcccagaagcacgagaaggcccacaccggcgagaagccctacaagtgcaaggagtgcggcaagcccttcatctacagacacagcgccagagcccacgagagaaaccacaccgtgcagaagagatacgagtgcaagcagtgcggcaagacctacatcagcagcgtgggcttccaggcccacgagagaacccacaccggcgagaagccctacgagtgcaagaagtgcggcaaggtgttcgtgtaccacaacagcgcccagagacacgagaagacccacaccggcgagaagccctacaagtgcaaggagtgcggcaaggccttcagctaccactgcaccgcccagaagcacgagagaaaccacaccgcccagaagcactacgagtgcaagctgtgcggcaagacctacctgagccccctgggcttccaggcccacgagagcacccacaccggcgacaagcccttcgagtgcaagaagtgcggcaaggccttcagatactactacagcgcccagagacacgagagaacccacaccggcgagaagccctacaagtgcaaggagtgcggcaaggccttctactgctgcagcagcgccagaagacacgagagaatgcacaccgccaagaagcagtacgagtgcaagaagtgcggcaagacctacatcaccctggccggcttccagatccacgagagaacccacaccggcgagaagccctacgagtgcaagcagtgcggcaaggccttcagcagcagcagctacatccacatccacgagagaatccacaccggcgagaagccctacgagtgcaaggagtgcggcaagcccttcagcttcctgaccggcttcagagtgcacatgagaatgcacaccggcgagaagccctacaagtgcaaggactgcggcaacgccttcatctggagagccagcctgcagtaccacgtgaagaaggtgcacgccgagtag

SEQ ID NO: 106058 - DNA, 1848 bp, Artificial Sequence; identical to SEQ ID NO: 106053
  Description of Artificial Sequence: Synthetic coding sequence

SEQ ID NO: 106059 - DNA, 984 bp, Artificial Sequence
  Description of Artificial Sequence: Synthetic coding sequence
atggaggtggccgtgcccgtgaagcaggaggccgagggcctggccctggacagcccctggcacagattcagaagattccacctgggcgacgcccccggccccagagaggccctgggcctgctgagagccctgtgcagagactggctgagacccgaggtgcacaccaaggagcagatgctggagctgctggtgctggagcagttcctgagcgccctgcccgccgacacccaggcctgggtgtgcagcagacagccccagagcggcgaggaggccgtggccctgctggaggagctgtggggccccgccgccagccccgacggcagcagcgccaccagagtgccccaggacgtgacccagggccccggcgccaccggcggcaaggaggacagcggcatgatccccctggccggcaccgcccccggcgccgagggccccgcccccggcgacagccaggccgtgagaccctacaagcaggagcccagcagcccccccctggcccccggcctgcccgccttcctggccgcccccggcaccaccagctgccccgagtgcggcaagaccagcctgaagcccgcccacctgctgagacacagacagagccacagcggcgagaagccccacgcctgccccgagtgcggcaaggccttcagaagaaaggagcacctgagaagacacagagacacccaccccggcagccccggcagccccggccccgccctgagacccctgcccgccagagagaagccccacgcctgctgcgagtgcggcaagaccttctactggagagagcacctggtgagacacagaaagacccacagcggcgccagacccttcgcctgctgggagtgcggcaagggcttcggcagaagagagcacgtgctgagacaccagagaatccacggcagagccgccgccagcgcccagggcgccgtggcccccggccccgacggcggcggccccttccccccctggcccctgggctag

SEQ ID NO: 106060 - DNA, 1557 bp, Artificial Sequence
  Description of Artificial Sequence: Synthetic coding sequence
atggccgtggccctgggctgcgccatccaggccagcctgaaccagggcagcgtgttccaggagtacgacaccgactgcgaggtgttcagacagagattcagacagttccagtacagagaggccgccggcccccacgaggccttcaacaagctgtgggagctgtgctgccagtggctgaagcccaagatgagaagcaaggagcagatcctggagctgctggtgctggagcagttcctgaccatcctgcccaccgagatcgagacctgggtgagagagcactgccccgagaacagagagagagtggtgagcctgatcgaggacctgcagagagagctggagatccccgagcagcaggtggacatgcacgacatgctgctggaggagctggcccccgtgggcaccgcccacatcccccccaccatgcacctggagagccccgccctgcaggtgatgggccccgcccaggaggcccccgtggccgaggcctggatcccccaggccggcccccccgagctgaactacggcgccaccggcgagtgccagaacttcctggaccccggctaccccctgcccaagctggacatgaacttcagcctggagaacagagaggagccctgggtgaaggagctgcaggacagcaaggagatgaagcagctgctggacagcaagatcggcttcgagatcggcatcgagaacgaggaggacaccagcaagcagaagaagatggagaccatgtaccccttcatcgtgaccctggagggcaacgccctgcagggccccatcctgcagaaggactacgtgcagctggagaaccagtgggagaccccccccgaggacctgcagaccgacctggccaagctggtggaccagcagaaccccaccctgggcgagacccccgagaacagcaacctggaggagcccctgaaccccaagccccacaagaagaagagccccggcgagaagccccacagatgcccccagtgcggcaagtgcttcgccagaaagagccagctgaccggccaccagagaatccacagcggcgaggagccccacaagtgccccgagtgcggcaagagattcctgagaagcagcgacctgtacagacaccagagactgcacaccggcgagagaccctacgagtgcaccgtgtgcaagaagagattcaccagaagaagccacctgatcggccaccagagaacccacagcgaggaggagacctacaagtgcctggagtgcggcaagagcttctgccacggcagcagcctgaagagacacctgaagacccacaccggcgagaagccccacagatgccacaactgcggcaagagcttcagcagactgaccgccctgaccctgcaccagagaacccacaccgaggagagacccttcaagtgcaactactgcggcaagagcttcagacagagacccagcctggtgatccacctgagaatccacaccggcgagaagccctacaagtgcacccactgcagcaagagcttcagacagagagccggcctgatcatgcaccaggtgacccacttcagaggcctgatctag

SEQ ID NO: 106061 - DNA, 384 bp, Artificial Sequence
  Description of Artificial Sequence: Synthetic coding sequence
atggccgtggccctgggctgcgccatccaggccagcctgaaccagggcagcgtgttccaggagtacgacaccgactgcgaggtgttcagacagagattcagacagttccagtacagagaggccgccggcccccacgaggccttcaacaagctgtgggagctgtgctgccagtggctgaagcccaagatgagaagcaaggagcagatcctggagctgctggtgctggagcagttcctgaccatcctgcccaccgagatcgagacctgggtgagagagcactgccccgagaacagagagagagtggtgagcctgatcgaggacctgcagagagagctggagatccccgagcagcagaccttcgccgccgagtacagccactactag

SEQ ID NO: 106062 - DNA, 495 bp, Artificial Sequence
  Description of Artificial Sequence: Synthetic coding sequence
atggccgtggccctgggctgcgccatccaggccagcctgaaccagggcagcgtgttccaggagtacgacaccgactgcgaggtgttcagacagagattcagacagttccagtacagagaggccgccggcccccacgaggccttcaacaagctgtgggagctgtgctgccagtggctgaagcccaagatgagaagcaaggagcagatcctggagctgctggtgctggagcagttcctgaccatcctgcccaccgagatcgagacctgggtgagagagcactgccccgagaacagagagagagtggtgagcctgatcgaggacctgcagagagagctggagatccccgagcagcaggtgagaaaggagtgcggcatcttcgtgatcggccccaaggaggtggccgaggccgccggcaccagaccccacatctgcctgtacgtgatcccccagccccaggacttcagcagagtgctgttcctgttcctgttctgctag

SEQ ID NO: 106063 - DNA, 2049 bp, Artificial Sequence
  Description of Artificial Sequence: Synthetic coding sequence
atgaccaagagcaaggaggccgtgaccttcaaggacgtggccgtggtgttcagcgaggaggagctgcagctgctggacctggcccagagaaagctgtacagagacgtgatgctggagaacttcagaaacgtggtgagcgtgggccaccagagcacccccgacggcctgccccagctggagagagaggagaagctgtggatgatgaagatggccacccagagagacaacagcagcggcgccaagaacctgaaggagatggagaccctgcaggaggtgggcctgagatacctgccccacgaggagctgttctgcagccagatctggcagcagatcaccagagagctgatcaagtaccaggacagcgtggtgaacatccagagaaccggctgccagctggagaagagagacgacctgcactacaaggacgagggcttcagcaaccagagcagccacctgcaggtgcacagagtgcacaccggcgagaagccctacaagggcgagcactgcgtgaagagcttcagctggagcagccacctgcagatcaaccagagagcccacgccggcgagaagccctacaagtgcgagaagtgcgacaacgccttcagaagattcagcagcctgcaggcccaccagagagtgcacagcagagccaagagctacaccaacgacgccagctacagaagcttcagccagagaagccacctgccccaccaccagagagtgcccaccggcgagaacccctacaagtacgaggagtgcggcagaaacgtgggcaagagcagccactgccaggcccccctgatcgtgcacaccggcgagaagccctacaagtgcgaggagtgcggcgtgggcttcagccagagaagctacctgcaggtgcacctgaaggtgcacaccggcaagaagccctacaagtgcgaggagtgcggcaagagcttcagctggagaagcagactgcaggcccacgagagaatccacaccggcgagaagccctacaagtgcaacgcctgcggcaagagcttcagctacagcagccacctgaacatccactgcagaatccacaccggcgagaagccctacaagtgcgaggagtgcggcaagggcttcagcgtgggcagccacctgcaggcccaccagatcagccacaccggcgagaagccctacaagtgcgaggagtgcggcaagggcttctgcagagccagcaacctgctggaccaccagagaggccacaccggcgagaagccctaccagtgcgacgcctgcggcaagggcttcagcagaagcagcgacttcaacatccacttcagagtgcacaccggcgagaagccctacaagtgcgaggagtgcggcaagggcttcagccaggccagcaacctgctggcccaccagagaggccacaccggcgagaagccctacaagtgcggcacctgcggcaagggcttcagcagaagcagcgacctgaacgtgcactgcagaatccacaccggcgagaagccctacaagtgcgagagatgcggcaaggccttcagccagttcagcagcctgcaggtgcaccagagagtgcacaccggcgagaagccctaccagtgcgccgagtgcggcaagggcttcagcgtgggcagccagctgcaggcccaccagagatgccacaccggcgagaagccctaccagtgcgaggagtgcggcaagggcttctgcagagccagcaacttcctggcccacagaggcgtgcacaccggcgagaagccctacagatgcgacgtgtgcggcaagagattcagacagagaagctacctgcaggcccaccagagagtgcacaccggcgagagaccctacaagtgcgaggagtgcggcaaggtgttcagctggagcagctacctgcaggcccaccagagagtgcacaccggcgagaagccctacaagtgcgaggagtgcggcaagggcttcagctggagcagcagcctgatcatccaccagagagtgcacgccgacgacgagggcgacaaggacttccccagcagcgaggacagccacagaaagaccagatag

SEQ ID NO: 106064 - DNA, 1617 bp, Artificial Sequence
  Description of Artificial Sequence: Synthetic coding sequence
atgaccaagagcaaggaggccgtgaccttcaaggacgtggccgtggtgttcagcgaggaggagctgcagctgctggacctggcccagagaaagctgtacagagacgtgatgctggagaacttcagaaacgtggtgagcgtgggccaccagagcacccccgacggcctgccccagctggagagagaggagaagctgtggatgatgaagatggccacccagagagacaacagcagcggcgccaagaacctgaaggagatggagaccctgcaggaggtgggcctgagatacctgccccacgaggagctgttctgcagccagatctggcagcagatcaccagagagctgatcaagtaccaggacagcgtggtgaacatccagagaaccggctgccagctggagaagagagacgacctgcactacaaggacgagggcttcagcaaccagagcagccacctgcaggtgcacagagtgcacaccggcgagaagccctacaagggcgagcactgcgtgaagagcttcagctggagcagccacctgcagatcaaccagagagcccacgccggcgagaagccctacaagtgcgagaagtgcgacaacgccttcagaagattcagcagcctgcaggcccaccagagagtgcacagcagagccaagagctacaccaacgacgccagctacagaagcttcagccagagaagccacctgccccaccaccagagagtgcccaccggcgagaacccctacaagtacgaggagtgcggcagaaacgtgggcaagagcagccactgccaggcccccctgatcgtgcacaccggcgagaagccctacaagtgcgaggagtgcggcgtgggcttcagccagagaagctacctgcaggtgcacctgaaggtgcacaccggcaagaagccctacaagtgcgaggagtgcggcaagagcttcagctggagaagcagactgcaggcccacgagagaatccacaccggcgagaagccctacaagtgcaacgcctgcggcaagagcttcagctacagcagccacctgaacatccactgcagaatccacaccggcgagaagccctacaagtgcgaggagtgcggcaagggcttcagcgtgggcagccacctgcaggcccaccagatcagccacaccggcgagaagccctacaagtgcgaggagtgcggcaagggcttctgcagagccagcaacctgctggaccaccagagaggccacaccggcgagaagccctaccagtgcgacgcctgcggcaagggcttcagcagaagcagcgacttcaacatccacttcagagtgcacaccggcaagaaccccatcaacgtgagaagcgtggccagagccagcgccagaccccagatcttctggcccatcaaggaggccaccctggagagaaaccccaccaacgtggtgcacgtgggcagagccagcgtgggcgcccagatcctgatgtacaccgtggagagcacccaggagagaaaccccatcaacgccagaggcgtggtgagacccagcgtgagcagccccgccttcagatgcatcagagagttcaccctggagagaaaccacatcagcgtgcagagcgtgggcagagccagcgtgtag

SEQ ID NO: 106065 - DNA, 1689 bp, Artificial Sequence
  Description of Artificial Sequence: Synthetic coding sequence
atggccgccgcctggatggcccccgcccaggagagcgtgaccttcgaggacgtggccgtgaccttcacccaggaggagtggggccagctggacgtgacccagagagccctgtacgtggaggtgatgctggagacctgcggcctgctggtggccctgggcgacagcaccaagcccgagaccgtggagcccatccccagccacctggccctgcccgaggaggtgagcctgcaggagcagctggcccagggcgtgcccagatacagctacctgggccaggccatggaccaggacggccccagcgagatgcaggagtacttcctgagacccggcaccgacccccagagcgagaagctgcacggcaagatgagcctggagcacgagggcctggccaccgccgacggcatctgcagcatgatgatccagaaccaggtgagccccgaggacgccctgtacggcttcgacagctacggccccgtgaccgacagcctgatccacgagggcgagaacagctacaagttcgaggagatgttcaacgagaactgcttcctggtgcagcacgagcagatcctgcccagagtgaagccctacgactgccccgagtgcggcaaggccttcggcaagagcaagcacctgctgcagcaccacatcatccacaccggcgagaagccctacaagtgcctggagtgcggcaaggacttcaacagaagaagccacctgaccagacaccagagaacccacaacggcgacaagcccttcgtgtgcagcgagtgcggcagaaccttcaacagaggcagccacctgaccagacaccagagagtgcacagcggcgagaagcccttcgtgtgcaacgagtgcggcaaggccttcacctacagaagcaacttcgtgctgcacaacaagagccacaacgagaagaagcccttcgcctgcagcgagtgcggcaagggcttctacgagagcaccgccctgatccagcacttcatcatccacaccggcgagagacccttcaagtgcctggagtgcggcaaggccttcaactgcagaagccacctgaagcagcacgagagaatccacaccggcgagaagcccttcgtgtgcagccagtgcggcaaggccttcacccactacagcacctacgtgctgcacgagagagcccacaccggcgagaagcccttcgagtgcaaggagtgcggcaaggccttcagcatcagaaaggacctgatcagacacttcaacatccacaccggcgagaagccctacgagtgcctgcagtgcggcaaggccttcaccagaatgagcggcctgaccagacaccagtggatccacaccggcgagaagccctacgtgtgcatccagtgcggcaaggccttctgcagaaccaccaacctgatcagacacttcagcatccacaccggcgagaagccctacgagtgcgtggagtgcggcaaggccttcaacagaagaagccccctgaccagacaccagagaatccacaccgccgagaagagccacgagcccatccagagcggcaacgtgagctgcgagagcaccgacctgatccagcacagcatcatccacaccgagagcagccccgtgagcgccgtgaacatggagacccccagcatcgccgcccacagcagcagcctggacatcaacggcttcatcgtggaggagaccctgcccctgtag

SEQ ID NO: 106066 - DNA, 1566 bp, Artificial Sequence
  Description of Artificial Sequence: Synthetic coding sequence
atgctggagacctgcggcctgctggtggccctgggcgacagcaccaagcccgagaccgtggagcccatccccagccacctggccctgcccgaggaggtgagcctgcaggagcagctggcccagggcgtgcccagatacagctacctgggccaggccatggaccaggacggccccagcgagatgcaggagtacttcctgagacccggcaccgacccccagagcgagaagctgcacggcaagatgagcctggagcacgagggcctggccaccgccgacggcatctgcagcatgatgatccagaaccaggtgagccccgaggacgccctgtacggcttcgacagctacggccccgtgaccgacagcctgatccacgagggcgagaacagctacaagttcgaggagatgttcaacgagaactgcttcctggtgcagcacgagcagatcctgcccagagtgaagccctacgactgccccgagtgcggcaaggccttcggcaagagcaagcacctgctgcagcaccacatcatccacaccggcgagaagccctacaagtgcctggagtgcggcaaggacttcaacagaagaagccacctgaccagacaccagagaacccacaacggcgacaagcccttcgtgtgcagcgagtgcggcagaaccttcaacagaggcagccacctgaccagacaccagagagtgcacagcggcgagaagcccttcgtgtgcaacgagtgcggcaaggccttcacctacagaagcaacttcgtgctgcacaacaagagccacaacgagaagaagcccttcgcctgcagcgagtgcggcaagggcttctacgagagcaccgccctgatccagcacttcatcatccacaccggcgagagacccttcaagtgcctggagtgcggcaaggccttcaactgcagaagccacctgaagcagcacgagagaatccacaccggcgagaagcccttcgtgtgcagccagtgcggcaaggccttcacccactacagcacctacgtgctgcacgagagagcccacaccggcgagaagcccttcgagtgcaaggagtgcggcaaggccttcagcatcagaaaggacctgatcagacacttcaacatccacaccggcgagaagccctacgagtgcctgcagtgcggcaaggccttcaccagaatgagcggcctgaccagacaccagtggatccacaccggcgagaagccctacgtgtgcatccagtgcggcaaggccttctgcagaaccaccaacctgatcagacacttcagcatccacaccggcgagaagccctacgagtgcgtggagtgcggcaaggccttcaacagaagaagccccctgaccagacaccagagaatccacaccgccgagaagagccacgagcccatccagagcggcaacgtgagctgcgagagcaccgacctgatccagcacagcatcatccacaccgagagcagccccgtgagcgccgtgaacatggagacccccagcatcgccgcccacagcagcagcctggacatcaacggcttcatcgtggaggagaccctgcccctgtag

SEQ ID NO: 106067 - DNA, 1623 bp, Artificial Sequence
  Description of Artificial Sequence: Synthetic coding sequence
atggcccacgagctggtgatgttcagagacgtggccatcgacgtgagccaggaggagtgggagtgcctgaaccccgcccagagaaacctgtacaaggaggtgatgctggagaactacagcaacctggtgagcctgggcctgagcgtgagcaagcccgccgtgatcagcagcctggagcagggcaaggagccctggatggtggtgagagaggagaccggcagatggtgccccgacctggccagcagagacgagccccagaagctgagccccaagagagacatctacgagaccgagctgagccagtgggtgaacatggaggagttcaagagccacagccccgagagaagcatcttcagcgccatctgggagggcaactgccacttcgagcagcaccagggccaggaggagggctacttcagacagctgatgatcaaccacgagaacatgcccatcttcagccagcacaccctgctgacccaggagttctacgacagagagaagatcagcgagtgcaagaagtgcagaaagatcttcagctaccacctgttcttcagccaccacaagagaacccacagcaaggagctgagcgagtgcaaggagtgcaccgagatcgtgaacaccccctgcctgttcaagcagcagaccatccagaacggcgacaagtgcaacgagtgcaaggagtgctggaaggccttcgtgcactgcagccagctgaagcacctgagaatccacaacggcgagaagagatacgagtgcaacgagtgcggcaaggccttcaactacggcagcgagctgaccctgcaccagagaatccacaccggcgagaagccctacgagtgcaaggagtgcggcaaggccttcagacagagaagccagctgacccagcaccagagactgcacaccggcgagaagccctacgagtgcaagcagtgcggcaaggccttcatcagaggcttccagctgaccgagcacctgagactgcacaccggcgagaagccctacgagtgcaaggagtgcggcaagaccttcagacacagaagccacctgaccatccaccagagaatccacaccggcgagaagccctacgagtgcagagagtgcggcaaggccttcagctaccacagcagcttcagccaccaccagaagatccacagcggcaagaagccctacgagtgccacgagtgcggcaaggccttctgcgacggcctgcagctgaccctgcaccagagaatccacaccggcgagaagccctacgagtgcaaggagtgcggcaagaccttcagacagtgcagccacctgaagagacaccagagaatccacaccggcgagaagccccacgagtgcatgatctgcggcaaggccttcagactgcacagccacctgatccagcaccagagaatccacaccggcgagaagccctacgagtgcaaggagtgcggcaaggccttcagctaccacagcagcttcagccaccaccagagaatccacagcggcaagaagccctaccagtgcggcaaggccttcaaccacagactgcagctgaacctgcaccagaccctgcacaccggcgagaagcccgtgagattccccctgctgcccccccaccccagcctggccagctag

SEQ ID NO: 106068 - DNA, 741 bp, Artificial Sequence
  Description of Artificial Sequence: Synthetic coding sequence
atggtggtgagagaggagaccggcagatggtgccccggcacctggaagacctggggcttccacaacaacttcctggacaacaacgaggccaccgacatcaacgccgacctggccagcagagacgagccccagaagctgagccccaagagagacatctacgagaccgagctgagccagtgggtgaacatggaggagttcaagagccacagccccgagagaagcatcttcagcgccatctgggagggcaactgccacttcgagcagcaccagggccaggaggagggctacttcagacagctgatgatcaaccacgagaacatgcccatcttcagccagcacaccctgctgacccaggagttctacgacagagagaagatcagcgagtgcaagaagtgcagaaagatcttcagctaccacctgttcttcagccaccacaagtgcagccacctgaagagacaccagagaatccacaccggcgagaagccccacgagtgcatgatctgcggcaaggccttcagactgcacagccacctgatccagcaccagagaatccacaccggcgagaagccctacgagtgcaaggagtgcggcaaggccttcagctaccacagcagcttcagccaccaccagagaatccacagcggcaagaagccctaccagtgcggcaaggccttcaaccacagactgcagctgaacctgcaccagaccctgcacaccggcgagaagcccgtgagattctag

SEQ ID NO: 106069 - DNA, 1692 bp, Artificial Sequence
  Description of Artificial Sequence: Synthetic coding sequence
atggcccacgagctggtgatgttcagagacgtggccatcgacgtgagccaggaggagtgggagtgcctgaaccccgcccagagaaacctgtacaaggaggtgatgctggagaactacagcaacctggtgagcctgggcctgagcgtgagcaagcccgccgtgatcagcagcctggagcagggcaaggagccctggatggtggtgagagaggagaccggcagatggtgccccggcacctggaagacctggggcttccacaacaacttcctggacaacaacgaggccaccgacatcaacgccgacctggccagcagagacgagccccagaagctgagccccaagagagacatctacgagaccgagctgagccagtgggtgaacatggaggagttcaagagccacagccccgagagaagcatcttcagcgccatctgggagggcaactgccacttcgagcagcaccagggccaggaggagggctacttcagacagctgatgatcaaccacgagaacatgcccatcttcagccagcacaccctgctgacccaggagttctacgacagagagaagatcagcgagtgcaagaagtgcagaaagatcttcagctaccacctgttcttcagccaccacaagagaacccacagcaaggagctgagcgagtgcaaggagtgcaccgagatcgtgaacaccccctgcctgttcaagcagcagaccatccagaacggcgacaagtgcaacgagtgcaaggagtgctggaaggccttcgtgcactgcagccagctgaagcacctgagaatccacaacggcgagaagagatacgagtgcaacgagtgcggcaaggccttcaactacggcagcgagctgaccctgcaccagagaatccacaccggcgagaagccctacgagtgcaaggagtgcggcaaggccttcagacagagaagccagctgacccagcaccagagactgcacaccggcgagaagccctacgagtgcaagcagtgcggcaaggccttcatcagaggcttccagctgaccgagcacctgagactgcacaccggcgagaagccctacgagtgcaaggagtgcggcaagaccttcagacacagaagccacctgaccatccaccagagaatccacaccggcgagaagccctacgagtgcagagagtgcggcaaggccttcagctaccacagcagcttcagccaccaccagaagatccacagcggcaagaagccctacgagtgccacgagtgcggcaaggccttctgcgacggcctgcagctgaccctgcaccagagaatccacaccggcgagaagccctacgagtgcaaggagtgcggcaagaccttcagacagtgcagccacctgaagagacaccagagaatccacaccggcgagaagccccacgagtgcatgatctgcggcaaggccttcagactgcacagccacctgatccagcaccagagaatccacaccggcgagaagccctacgagtgcaaggagtgcggcaaggccttcagctaccacagcagcttcagccaccaccagagaatccacagcggcaagaagccctaccagtgcggcaaggccttcaaccacagactgcagctgaacctgcaccagaccctgcacaccggcgagaagcccgtgagattccccctgctgcccccccaccccagcctggccagctag

SEQ ID NO: 106070 - DNA, 777 bp, Artificial Sequence
  Description of Artificial Sequence: Synthetic coding sequence
gagaagagatacgagtgcaacgagtgcggcaaggccttcaactacggcagcgagctgaccctgcaccagagaatccacaccggcgagaagccctacgagtgcaaggagtgcggcaaggccttcagacagagaagccagctgacccagcaccagagactgcacaccggcgagaagccctacgagtgcaagcagtgcggcaaggccttcatcagaggcttccagctgaccgagcacctgagactgcacaccggcgagaagccctacgagtgcaaggagtgcggcaagaccttcagacacagaagccacctgaccatccaccagagaatccacaccggcgagaagccctacgagtgcagagagtgcggcaaggccttcagctaccacagcagcttcagccaccaccagaagatccacagcggcaagaagccctacgagtgccacgagtgcggcaaggccttctgcgacggcctgcagctgaccctgcaccagagaatccacaccggcgagaagccctacgagtgcaaggagtgcggcaagaccttcagacagtgcagccacctgaagagacaccagagaatccacaccggcgagaagccccacgagtgcatgatctgcggcaaggccttcagactgcacagccacctgatccagcaccagagaatccacaccggcgagaagccctacgagtgcaaggagtgcggcaaggccttcagctaccacagcagcttcagccaccaccagagaatccacagcgacgccaccaccgccatcagctag

SEQ ID NO: 106071 - DNA, 1311 bp, Artificial Sequence
  Description of Artificial Sequence: Synthetic coding sequence
atggaggagttcaagagccacagccccgagagaagcatcttcagcgccatctgggagggcaactgccacttcgagcagcaccagggccaggaggagggctacttcagacagctgatgatcaaccacgagaacatgcccatcttcagccagcacaccctgctgacccaggagttctacgacagagagaagatcagcgagtgcaagaagtgcagaaagatcttcagctaccacctgttcttcagccaccacaagagaacccacagcaaggagctgagcgagtgcaaggagtgcaccgagatcgtgaacaccccctgcctgttcaagcagcagaccatccagaacggcgacaagtgcaacgagtgcaaggagtgctggaaggccttcgtgcactgcagccagctgaagcacctgagaatccacaacggcgagaagagatacgagtgcaacgagtgcggcaaggccttcaactacggcagcgagctgaccctgcaccagagaatccacaccggcgagaagccctacgagtgcaaggagtgcggcaaggccttcagacagagaagccagctgacccagcaccagagactgcacaccggcgagaagccctacgagtgcaagcagtgcggcaaggccttcatcagaggcttccagctgaccgagcacctgagactgcacaccggcgagaagccctacgagtgcaaggagtgcggcaagaccttcagacacagaagccacctgaccatccaccagagaatccacaccggcgagaagccctacgagtgcagagagtgcggcaaggccttcagctaccacagcagcttcagccaccaccagaagatccacagcggcaagaagccctacgagtgccacgagtgcggcaaggccttctgcgacggcctgcagctgaccctgcaccagagaatccacaccggcgagaagccctacgagtgcaaggagtgcggcaagaccttcagacagtgcagccacctgaagagacaccagagaatccacaccggcgagaagccccacgagtgcatgatctgcggcaaggccttcagactgcacagccacctgatccagcaccagagaatccacaccggcgagaagccctacgagtgcaaggagtgcggcaaggccttcagctaccacagcagcttcagccaccaccagagaatccacagcggcaagaagccctaccagtgcggcaaggccttcaaccacagactgcagctgaacctgcaccagaccctgcacaccggcgagaagcccgtgagattccccctgctgcccccccaccccagcctggccagctag

SEQ ID NO: 106072 - DNA, 1692 bp, Artificial Sequence; identical to SEQ ID NO: 106069
  Description of Artificial Sequence: Synthetic coding sequence

SEQ ID NO: 106073 - DNA, 1788 bp, Artificial Sequence
  Description of Artificial Sequence: Synthetic coding sequence
atgagagagaccctggaggccctgagcagcctgggcttcagcgtgggccagcccgagatggccccccagagcgagcccagagagggcagccacaacgcccaggagcagatgagcagcagcagagaggagagagccctgggcgtgtgcagcggccacgaggcccccacccccgaggagggcgcccacaccgagcaggccgaggccccctgcagaggccaggcctgcagcgcccagaaggcccagcccgtgggcacctgccccggcgaggagtggatgatcagaaaggtgaaggtggaggacgaggaccaggaggccgaggaggaggtggagtggccccagcacctgagcctgctgcccagccccttccccgcccccgacctgggccacctggccgccgcctacaagctggagcccggcgcccccggcgccctgagcggcctggccctgagcggctggggccccatgcccgagaagccctacggctgcggcgagtgcgagagaagattcagagaccagctgaccctgagactgcaccagagactgcacagaggcgagggcccctgcgcctgccccgactgcggcagaagcttcacccagagagcccacatgctgctgcaccagagaagccacagaggcgagagacccttcccctgcagcgagtgcgacaagagattcagcaagaaggcccacctgaccagacacctgagaacccacaccggcgagagaccctacccctgcgccgagtgcggcaagagattcagccagaagatccacctgggcagccaccagaagacccacaccggcgagagacccttcccctgcaccgagtgcgagaagagattcagaaagaagacccacctgatcagacaccagagaatccacaccggcgagagaccctaccagtgcgcccagtgcgccagaagcttcacccacaagcagcacctggtgagacaccagagagtgcaccagaccgccggccccgccagacccagccccgacagcagcgccagcccccacagcaccgcccccagccccacccccagcttccccggccccaagcccttcgcctgcagcgactgcggcctgagcttcggctggaagaagaacctggccacccaccagtgcctgcacagaagcgagggcagacccttcggctgcgacgagtgcgccctgggcgccaccgtggacgcccccgccgccaagcccctggccagcgcccccggcggccccggctgcggccccggcagcgaccccgtggtgccccagagagcccccagcggcgagagaagcttcttctgccccgactgcggcagaggcttcagccacggccagcacctggccagacaccccagagtgcacaccggcgagagacccttcgcctgcacccagtgcgacagaagattcggcagcagacccaacctggtggcccacagcagagcccacagcggcgccagacccttcgcctgcgcccagtgcggcagaagattcagcagaaagagccacctgggcagacaccaggccgtgcacaccggcagcagaccccacgcctgcgccgtgtgcgccagaagcttcagcagcaagaccaacctggtgagacaccaggccatccacaccggcagcagacccttcagctgcccccagtgcggcaagagcttcagcagaaagacccacctggtgagacaccagctgatccacggcgaggccgcccacgccgcccccgacgccgccctggccgcccccgcctggagcgccccccccgaggtggcccccccccccctgttcttctag

SEQ ID NO: 106074 - DNA, 11778 bp, Artificial Sequence
  Description of Artificial Sequence: Synthetic coding sequence
atgcccggcgagagacccagaggcgcccccccccccaccatgaccggcgacctgcagcccagacaggtggccagcagccccggccaccccagccagccccccctggaggacaacacccccgccaccagaaccaccaagggcgccagagaggccggcggccaggcccaggccatggagctgcccgaggcccagcccagacaggccagagacggcgagctgaagccccccagcctgagaggccaggcccccagcagcacccccggcaagagaggcagcccccagaccccccccggcagaagccccctgcaggcccccagcagactggccggcagagccgagggcagccccccccagagatacatcctgggcatcgccagcagcagaaccaagcccaccctggacgagacccccgagaacccccagctggaggccgcccagctgcccgaggtggacaccccccagggccccggcaccggcgcccccctgagacccggcctgcccagaaccgaggcccagcccgccgccgaggagctgggcttccacagatgcttccaggagccccccagcagcttcaccagcaccaactacaccagccccagcgccacccccagaccccccgcccccggccccccccagagcagaggcaccagccccctgcagcccggcagctaccccgagtaccaggccagcggcgccgacagctggccccccgccgccgagaacagcttccccggcgccaacttcggcgtgccccccgccgagcccgagcccatccccaagggcagcagacccggcggcagccccagaggcgtgagcttccagttccccttccccgccctgcacggcgccagcaccaagcccttccccgccgacgtggccggccacgccttcaccaacggccccctggtgttcgccttccaccagccccagggcgcctggcccgaggaggccgtgggcaccggccccgcctaccccctgcccacccagcccgcccccagccccctgccctgctaccagggccagcccggcggcctgaacagacacagcgacctgagcggcgccctgagcagccccggcgccgcccacagcgcccccagacccttcagcgacagcctgcacaagagcctgaccaagatcctgcccgagagaccccccagcgcccaggacggcctgggcagcaccagaggcccccccagcagcctgccccagagacacttccccggccaggcctacagagccagcggcgtggacaccagccccggcccccccgacaccgagctggccgcccccggccccccccccgccagactgccccagctgtgggaccccaccgccgccccctaccccaccccccccggcggccccctggccgccaccagaagcatgttcttcaacggccagcccagccccggccagagactgtgcctgccccagagcgcccccctgccctggccccaggtgctgcccaccgccagacccagcccccacggcatggagatgctgagcagactgcccttccccgccggcggccccgagtggcagggcggcagccagggcgccctgggcaccgccggcaagacccccggccccagagagaagctgcccgccgtgagaagcagccagggcggcagccccgccctgttcacctacaacggcatgaccgaccccggcgcccagcccctgttcttcggcgtggcccagccccaggtgagcccccacggcacccccagcctgcccccccccagagtggtgggcgccagccccagcgagagccccctgcccagccccgccaccaacaccgccggcagcacctgcagcagcctgagccccatgagcagcagccccgccaaccccagcagcgaggagagccagctgcccggccccctgggccccagcgccttcttccacccccccacccacccccaggagaccggcagccccttccccagccccgagcccccccacagcctgcccacccactaccagcccgagcccgccaaggccttccccttccccgccgacggcctgggcgccgagggcgccttccagtgcctggaggagacccccttcccccacgagggccccgaggtgggcagaggcggcctgcagggcttccccagagccccccccccctaccccacccaccacttcagcctgagcagcgccagcctggaccagctggacgtgctgctgacctgcagacagtgcgacagaaactacagcagcctggccgccttcctggcccacagacagttctgcggcctgctgctggccagagccaaggacggccaccagagaagccccggcccccccggcctgcccagcccccccgccgcccccagagtgcccgccgacgcccacgccggcctgctgagccacgccaagaccttcctgctggccggcgacgcccaggccgagggcaaggacgaccccctgagaaccggcttcctgcccagcctggccgccacccccttccccctgcccgccagcgacctggacatggaggacgacgccaagctggacagcctgatcaccgaggccctgaacggcatggagtaccagagcgacaaccccgagatcgacagcagcttcatcgacgtgttcgccgacgaggagcccagcggccccagaggccccagcagcggccaccccctgaagagcaaggccggcgtgacccccgagagcaaggcccccccccccctgcccgccgccacccccgacccccagacccccagacccggcgacagaggctgccccgccagaggcagacccaagaccagaagcctgggcctggcccccaccgaggccgacgcccccagccagggcagacagcagagaagaggcaagcagctgaagctgttcagaaaggacctggacagcggcggcgccgccgagggcagcggcagcggcggcggcggcagagccagcggcctgagacccagaagaaacgacggcctgggcgagagacccccccccagacccagaagacccagaacccaggcccccggcagcagagccgaccccgcccccagagtgcccagagccgccgccctgcccgaggagaccagaagcagcagaagaagaagactgccccccagaaaggaccccagaaagagaaaggccagaggcggcgcctggggcaaggagctgatcctgaagatcgtgcagcagaagaacagactgagagagtacgacttcgccagcgagagcgaggaggacgagcagcccccccccagaggccccggcttcagaggcagaagaggcagaggcgagaagagaaaggaggtggagctgacccagggccccagagaggacgagccccagaagcccagaaaggccgccagacaggaggccggcggcgacggcgcccccgccaaccccgaggagcccggcggcagcagacccggccccggcagaagcccccaggccagaggccccagcagaagcctggagaccggcgccgccgccagagagggcggccccaagtgcgccgacagacccagcgtggcccccaaggaccccctgcaggtgcccaccaacaccgagaccagcgaggagaccagacccagcctggacttcccccaggaggccaaggagcccgagaccgccgaggagagcgcccccgacagcaccgagttcaccgaggccctgagaagcccccccgccgcctgcgccggcgagatgggcgccagccccggcctgctgatccccgagcagcccccccccagcagacacgacaccggcacccccaagcccagcggcagcctggccaacaccgccccccacggcagcagccccacccccggcgtgggcagcctgctgggcggccccggcggcacccaggcccccgtgagccacaacagcaaggacccccccgccagacagcccggcgagttcctggcccccgtggccaaccccagcagcaccgcctgccccaagcccagcgtgctgagcagcaagatcagcagcttcggctgcgaccccgccggcttcaacagagaccccctgggcgtgcccgtggccaagaagggcccccagccctacagcagcccccacagcgagctgttcctgggccccaaggacctggccggctgcttcctggaggagctgcaccccaagcccagcgccagagacgccccccccgccagcagcagctgcctgtgccaggacggcgaggacgccggcagcctggagccccagctgcccagaagcccccccggcaccgccgagaccgagcccggcagagccgccagcccccccaccctggagagcagcagcctgttccccgacctgcccgtggacagattcgacccccccctgtacggcagcctgagcgccaacagagacagcggcctgcccttcgcctgcgccgaccccccccagaagaccgtgcccagcgaccccccctaccccagcttcctgctgctggaggaggtgagccccatgctgcccagccacttccccgacctgagcggcggcaaggtgctgagcaagacctgcccccccgagagaaccgtggtgcccggcgccgcccccagcctgcccggcaagggcagcggctgcagcgtggccctgatgagccacctgagcgaggacgagctggagatccagaagctggtgaccgagctggagagccagctgcagagaagcaaggacaccagaggcgcccccagagagctggccgaggccgagagcgtgggcagagtggagctgggcaccggcaccgagccccccagccagagaagaacctgccaggccaccgtgccccacgaggacaccttcagcgccgccgacctgaccagagtgggcgagagcaccgcccacagagagggcgccgagagcgccgtggccaccgtggaggccgtgcagggcagacccggcggcacctggccctgccccgccagcttccaccccggccacgccgccctgctgccctgcgcccaggaggacctggtgagcggcgcccccttcagccccagaggcgccaacttccacttccagcccgtgcagaaggccggcgccagcaagaccggcctgtgccaggccgagggcgacagcagacccccccaggacgtgtgcctgcccgagcccagcaagcagcccggcccccagctggacgccggcagcctggccaagtgcagccccgaccaggagctgagcttccccaagaacaaggaggccgccagcagccaggagagcgaggacagcctgagactgctgccctgcgagcagagaggcggcttcctgcccgagcccggcaccgccgaccagccccacagaggcgcccccgcccccgaggccttcggcagccccgccgtgcacctggcccccgacctggccttccagggcgacggcgccccccccctggacgccacctggcccttcggcgccagccccagccacgccgcccagggccacagcgccggcagagccggcggccacctgcaccccaccgccggcagacccggcttcgagggcaacgagttcgcccccgccggcgccagcagcctgaccgcccccagaggcagagaggcctggctggtgcccgtgcccagccccgcctgcgtgagcaacacccaccccagcagaagaagccaggaccccgccctgagcccccccatcagacagctgcagctgcccggccccggcgtggccaagagcaaggacggcatcctgggcctgcaggagctgacccccgccgcccagagcccccccagagtgaaccccagcggcctggagggcggcaccgtggagggcggcaaggtggcctgcggccccgcccagggcagccccggcggcgtgcaggtgaccaccctgcccgccgtggccggccaccagctgggcctggaggccgacggccactggggcctgctgggccaggccgagaagacccagggccagggcaccgccaaccagctgcagcccgagaacggcgtgagccccggcggcaccgacaaccacgccagcgtgaacgccagccccaagaccgccctgaccggccccaccgagggcgccgtgctgctggagaagtgcaagggcagcagagccgccatgagcctgcaggaggaggccgagcccacccccagcccccccagccccaacagagagagcctggccctggccctgaccgccgcccacagcagaagcggcagcgagggcagaacccccgagagagccagcagccccggcctgaacaagcccctgctggccaccggcgacagccccgcccccagcgtgggcgacctggccgcctgcgcccccagccccaccagcgccgcccacatgccctgcagcctgggccccctgcccagagaggaccccctgaccagccccagcagagcccagggcggcctgggcggccagctgcccgccagccccagctgcagagacccccccggcccccagcagctgctggcctgcagccccgcctgggcccccctggaggaggccgacggcgtgcaggccaccaccgacaccggcgccgaggacagccccgtggccccccccagcctgaccaccagcccctgcgaccccaaggaggccctggccggctgcctgctgcagggcgagggcagccccctggaggaccccagcagctggccccccggcagcgtgagcgccgtgacctgcacccacagcggcgacacccccaaggacagcaccctgagaatccccgaggacagcagaaaggagaagctgtgggagagccccggcagagccaccagcccccccctggccggcgccgtgagccccagcgtggccgtgagagccaccggcctgagcagcacccccaccggcgacgaggcccaggccggcagaggcctgcccggccccgacccccagagcagaggcgcccccccccacaccaaccccgacagaatgcccagaggccacagcagctacagccccagcaacaccgccagactgggccacagagagggccaggccgtgaccgccgtgcccaccgagccccccaccctgcagggcgccggccccgacagccccgcctgcctggagggcgagatgggcaccagcagcaaggagcccgaggaccccggcacccccgagaccggcagaagcggcgccaccaagatgcccagagtgacctgccccagcaccggcctgggcctgggcagaaccaccgcccccagcagcaccgccagcgacttccagagcgacagcccccagagccacagaaacgccagccaccagaccccccagggcgaccccctgggcccccaggacctgaagcagagaagcagaggctacaagaagaagcccgccagcaccgagaacggccagtggaagggccaggccccccacggccccgtgacctgcgaggtgtgcgccgccagcttcagaagcggccccggcctgagcagacacaaggccagaaagcacagaccccaccccggcgcccccgccgagcccagccccgccgccctgcccgcccagcagcccctggagcccctggcccagaagtgccagccccccagaaagaagagccacagagtgagcggcaaggagagacccaaccacagcagaggcgaccccagccacgtgacccagcccccccccgcccagggcagcaaggaggtgctgagagcccccggcagcccccacagccagcagctgcacccccccagccccaccgagcacgaggtggacgtgaagacccccgccagcaagcccagacccgaccaggccagagaggacgagctgcaccccaagcaggccgagaagagagagggcagaagatggagaagagagcccaccgtggacagccccagccacagcgagggcaagagcaacaagaagagaggcaagctgagaggcagaagactgagagaggagagcatcctgcccgtgagcgccgacgtgatcagcgacggcagaggcagcagacccagccccgccatggccagctacgccgccagccccagccactgcctgagcgtggagggcggccccgaggccgacggcgagcagccccccagactggccaccctgggccccggcgtgatggagggcgccgccgagaccgaccaggaggccctgtgcgccggcgagaccggcgcccagaagccccccggcgacagaatgctgtgccccggcagaatggacggcgccgccctgggcgagcagcccaccggccagaagggcgccagcgccagaggcttctggggccccagagagaccaaggccctgggcgtgtgcaaggagagcggcagcgagcccgccgaggacagcagcagagcccacagcagaagcgaggagggcgtgtgggaggagaacaccccccccctgggccccctgggcttccccgagaccagcagcagccccgccgacagcaccaccagcagctgcctgcagggcctgcccgacaaccccgacacccagggcggcgtgcagggccccgagggccccacccccgacgccagcggcagcagcgccaaggacccccccagcctgttcgacgacgaggtgagcttcagccagctgttcccccccggcggcagactgaccagaaagagaaacccccacgtgtacggcaagagatgcgagaagcccgtgctgcccctgcccacccagcccagcttcgaggagggcggcgaccccaccctgggccccgccagactgcccaccgacctgagcgacagcagcagcctgtgcctgtgccacgaggacccctgggaggacgaggaccccgccggcctgcccgagagcttcctgctggacggcttcctgaacagcagagtgcccggcatcgacccctgggcccccggcctgagcctgtgggccctggagcccagcagagaggccggcgccgagaagctgcccagccactgccccgaggacgacagacccgaggccatccccgagctgcacatggtgcccgccgcctggagaggcctggagatgcccgcccccgccgacgacagcagcagcagcctgggcgacgtgagccccgagccccccagcctggagagagagagatgcgacggcggcctgcccggcaacacccacctgctgcccctgagagccaccgacttcgaggtgctgagcaccaagttcgagatgcaggacctgtgcttcctgggccccttcgaggaccccgtgggcctgcccggccccagcttcctggacttcgagggcaccgccagcagccagggcccccagagcagaagaaccgaggaggccgccggcgccggcagagcccagggcagaggcagacccgccaagggcagaagagccagctacaagtgcaaggtgtgcttccagagattcagaagcctgggcgagctggacctgcacaagctggcccacacccccgcccccccccccacctgctacatgtgcgtggagagaagattcggcagcagagagctgctgagaggccacctgcaggagagacacgcccagagcaaggccggcccctgggcctgcggcatgtgcctgaaggaggtggccgacgtgtggatgtacaacgagcacctgagagagcacgccgtgagattcgccagaagaggccaggccagaagaagcctgggcgacctgcccggcggcctggagggcagcagcgccgtggcccacctgctgaacagcatcaccgagcccgcccccaagcaccacagaggcaagagaagcgccggcaaggccgccggcagccccggcgacccctggggccaggagggcgaggccaagaaggacagccccggcgagagagccaagcccagagccagaagcacccccagcaaccccgacggcgccgccacccccgacagcgccagcgccaccgccctggccgacgccggcagccccggcccccccagaaccacccccagccccagccccgacccctgggccggcggcgagcccctgctgcaggccacccccgtgcacgaggcctgcaaggaccccagcagagactgccaccactgcggcaagagattccccaagcccttcaagctgcagagacacctggccgtgcacagcccccagagagtgtacctgtgccccagatgccccagagtgtaccccgagcacggcgagctgctggcccacctgggcggcgcccacggcctgctggagagacccgagctgcagcacacccccctgtacgcctgcgagctgtgcgccaccgtgatgagaatcatcaagaagagcttcgcctgcagcagctgcaactacaccttcgccaagaaggagcagttcgacagacacatgaacaagcacctgagaggcggcagacagcccttcgccttcagaggcgtgagaagacccggcgcccccggccagaaggccagagccctggagggcaccctgcccagcaagagaagaagagtggccatgcccggcagcgcccccggccccggcgaggacagacccccccccagaggcagcagccccatcctgagcgagggcagcctgcccgccctgctgcacctgtgcagcgaggtggcccccagcaccaccaagggctggcccgagaccctggagagacccgtggaccccgtgacccaccccatcagaggctgcgagctgcccagcaaccaccaggagtgccccccccccagcctgagccccttccccgccgccctggccgacggcagaggcgactgcgccctggacggcgccctggagagacccgagaacgaggccagccccggcagccccggccccctgctgcagcaggccctgcccctgggcgccagcctgcccagacccggcgccagaggccaggacgccgagggcaagagagcccccctggtgttcagcggcaagagaagagcccccggcgccagaggcagatgcgcccccgaccacttccaggaggaccacctgctgcagaaggagaaggaggtgagcagcagccacatggtgagcgagggcggccccagaggcaccttccacaagggcagcgccaccaagcccgccggctgccagagcagcagcaaggacagaagcgccgccagcacccccagcaaggccctgaagttccccgtgcaccccagaaaggccgtgggcagcctggcccccggcgagctggccagaggcaccgagaacggcatgaagcccgccacccccaaggccaagcccggccccagcagccagggcagcggcagccccagacccggcaccaagaccggcggcggcagccagccccagcccgccagcggccagctgcagagcgagaccgccaccacccccgccaagcccagcttccccagcagaagccccgcccccgagagactgcccgccagagcccaggccaagagctgcaccaagggccccagagaggccggcgagcagggcccccacggcagcctgggccccaaggagaagggcgagagcagcaccaagagaaagaagggccaggtgcccggccccgccagaagcgagagcgtgggcagcttcggcagagcccccagcgcccccgacaagccccccagaacccccagaaagcaggccacccccagcagagtgctgcccaccaagcccaagcccaacagccagaacaagcccagacccccccccagcgagcagagaaaggccgagcccggccacacccagagaaaggacagactgggcaaggccttcccccagggcagacccctgctgagaccccccaagagaggcaccgccgtgcacggcgccgagcccgccgagccccacacccacagaaccgccgaggcccagagcgacctgctgagccagctgttcggccagagactgaccggcttcaagatccccctgaagaaggacgccagcgagtag

SEQ ID NO: 106075 - DNA, 1479 bp, Artificial Sequence
  Description of Artificial Sequence: Synthetic coding sequence
atgctgtgcgacgagaaggcccagaagagaagaaagagaaaggccaaggagagcggcatggccctgccccagggccacctgaccttcagagacgtggccatcgagttcagccaggccgagtggaagtgcctggaccccgcccagagagccctgtacaaggacgtgatgctggagaactacagaaacctggtgagcctgggcagcagctacgccctgggcagcaacgccgaggacaagcccatcaagaagcagctgggcgtgagcttccacctgcacctgagcgagctggagctgttccccgacgagagagtgatcaacggctgcaaccaggtggagaacttcatcaaccacagcagcagcgtgagctgcctgcaggagatgagcagcagcgtgaagacccccatcttcaacagaaacgacttcgacgacagcagcttcctgccccaggagcagaaggtgcacctgagagagaagccctacgagtgcaacgagcacagcaaggtgttcagagtgagcagcagcctgaccaagcaccaggtgatccacaccgtggagaagccctacaagtgcaacagctgcggcaaggtgttcagcagaaacagccacctggccgagcactgcagaatccacaccggcgagaagccctacaagtgcaacgtgtgcggcaaggtgttcagctacaacagcaacttcgccagacaccagagaatccacaccagagagaagccctacgagtgcaacgagtgcggcaaggtgttcagcaacaacagctacctggccagacaccagagaatccacgccgaggagaagccctacaagtgcaacgagtgcggcaagggcttcagccacaagagcagcctggccaaccactggagaatctacaccggcgagaagccctacaagtgcgacgagtgcggcaaggccttctacagaatcgccctgctggtgagacaccagaagatccacaccggcgagaagccctacaagtgcaacgagtgcggcaaggtgttcatccagaacagccacctggcccagcactggagaatccacaccggcgagaagccctacaagtgcaacgagtgcggcaaggtgttcaaccagctgagcaacctggccagacacagaagaatccacaccggcgagaagccctacaagtgcaacgagtgcggcaaggccttcagcgagtacagcggcctgagcgcccacctggtgatccacaccggcgagaagccctacaagtgcagcgagtgcggcaaggccttcagacacaagctgagcctgaccaaccaccagagaatccacaccggcgagagaccctacaagtgcaacgagtgcggcaaggtgttcaacagaatcgcccacctggccagacacagaaagatccacaccggcgagaagccctacaagtgcaacgagtgcggcaaggccttcagcagaatcagctacctggcccagcactggaccatccacatgggctag

SEQ ID NO: 106076 - DNA, 1377 bp, Artificial Sequence
  Description of Artificial Sequence: Synthetic coding sequence
atgctggagcagagaagagagccctggagcggcgagagcgaggtgaagatcgccaagaacagcgacggcagagagtgcatcaagggcgtgaacaccggcagcagctacgccctgggcagcaacgccgaggacaagcccatcaagaagcagctgggcgtgagcttccacctgcacctgagcgagctggagctgttccccgacgagagagtgatcaacggctgcaaccaggtggagaacttcatcaaccacagcagcagcgtgagctgcctgcaggagatgagcagcagcgtgaagacccccatcttcaacagaaacgacttcgacgacagcagcttcctgccccaggagcagaaggtgcacctgagagagaagccctacgagtgcaacgagcacagcaaggtgttcagagtgagcagcagcctgaccaagcaccaggtgatccacaccgtggagaagccctacaagtgcaacagctgcggcaaggtgttcagcagaaacagccacctggccgagcactgcagaatccacaccggcgagaagccctacaagtgcaacgtgtgcggcaaggtgttcagctacaacagcaacttcgccagacaccagagaatccacaccagagagaagccctacgagtgcaacgagtgcggcaaggtgttcagcaacaacagctacctggccagacaccagagaatccacgccgaggagaagccctacaagtgcaacgagtgcggcaagggcttcagccacaagagcagcctggccaaccactggagaatctacaccggcgagaagccctacaagtgcgacgagtgcggcaaggccttctacagaatcgccctgctggtgagacaccagaagatccacaccggcgagaagccctacaagtgcaacgagtgcggcaaggtgttcatccagaacagccacctggcccagcactggagaatccacaccggcgagaagccctacaagtgcaacgagtgcggcaaggtgttcaaccagctgagcaacctggccagacacagaagaatccacaccggcgagaagccctacaagtgcaacgagtgcggcaaggccttcagcgagtacagcggcctgagcgcccacctggtgatccacaccggcgagaagccctacaagtgcagcgagtgcggcaaggccttcagacacaagctgagcctgaccaaccaccagagaatccacaccggcgagagaccctacaagtgcaacgagtgcggcaaggtgttcaacagaatcgcccacctggccagacacagaaagatccacaccggcgagaagccctacaagtgcaacgagtgcggcaaggccttcagcagaatcagctacctggcccagcactggaccatccacatgggctag

SEQ ID NO: 106077 - DNA, 537 bp, Artificial Sequence
  Description of Artificial Sequence: Synthetic coding sequence
ttcccccagaccagaaagagaatcgcctggagcgagggccacgccgccgccagactgaccagcaaggagagctgctgcgagaaggcccagaagagaagaaagagaaaggccaaggagagcggcatggccctgccccagggccacctgaccttcagagacgtggccatcgagttcagccaggccgagtggaagtgcctggaccccgcccagagagccctgtacaaggacgtgatgctggagaactacagaaacctggtgagcctgggcatcagcctgcccgacctgaacatcaacagcatgctggagcagagaagagagccctggagcggcgagagcgaggtgaagatcgccaagaacagcgacggcagagagtgcatcaagggcgtgaacaccggcagcagctacgccctgggcagcaacgccgaggacaagcccatcaagaagcagctgggcgtgagcttccacctgcacctgagcgagctggagctgttccccgacgagagagtgatcaacggctgcaaccaggtggagaactag

SEQ ID NO: 106078 - DNA, 1608 bp, Artificial Sequence
  Description of Artificial Sequence: Synthetic coding sequence
atgctgtgcgacgagaaggcccagaagagaagaaagagaaaggccaaggagagcggcatggccctgccccagggccacctgaccttcagagacgtggccatcgagttcagccaggccgagtggaagtgcctggaccccgcccagagagccctgtacaaggacgtgatgctggagaactacagaaacctggtgagcctgggcatcagcctgcccgacctgaacatcaacagcatgctggagcagagaagagagccctggagcggcgagagcgaggtgaagatcgccaagaacagcgacggcagagagtgcatcaagggcgtgaacaccggcagcagctacgccctgggcagcaacgccgaggacaagcccatcaagaagcagctgggcgtgagcttccacctgcacctgagcgagctggagctgttccccgacgagagagtgatcaacggctgcaaccaggtggagaacttcatcaaccacagcagcagcgtgagctgcctgcaggagatgagcagcagcgtgaagacccccatcttcaacagaaacgacttcgacgacagcagcttcctgccccaggagcagaaggtgcacctgagagagaagccctacgagtgcaacgagcacagcaaggtgttcagagtgagcagcagcctgaccaagcaccaggtgatccacaccgtggagaagccctacaagtgcaacagctgcggcaaggtgttcagcagaaacagccacctggccgagcactgcagaatccacaccggcgagaagccctacaagtgcaacgtgtgcggcaaggtgttcagctacaacagcaacttcgccagacaccagagaatccacaccagagagaagccctacgagtgcaacgagtgcggcaaggtgttcagcaacaacagctacctggccagacaccagagaatccacgccgaggagaagccctacaagtgcaacgagtgcggcaagggcttcagccacaagagcagcctggccaaccactggagaatctacaccggcgagaagccctacaagtgcgacgagtgcggcaaggccttctacagaatcgccctgctggtgagacaccagaagatccacaccggcgagaagccctacaagtgcaacgagtgcggcaaggtgttcatccagaacagccacctggcccagcactggagaatccacaccggcgagaagccctacaagtgcaacgagtgcggcaaggtgttcaaccagctgagcaacctggccagacacagaagaatccacaccggcgagaagccctacaagtgcaacgagtgcggcaaggccttcagcgagtacagcggcctgagcgcccacctggtgatccacaccggcgagaagccctacaagtgcagcgagtgcggcaaggccttcagacacaagctgagcctgaccaaccaccagagaatccacaccggcgagagaccctacaagtgcaacgagtgcggcaaggtgttcaacagaatcgcccacctggccagacacagaaagatccacaccggcgagaagccctacaagtgcaacgagtgcggcaaggccttcagcagaatcagctacctggcccagcactggaccatccacatgggctag

SEQ ID NO: 106079 - DNA, 1608 bp, Artificial Sequence; identical to SEQ ID NO: 106078
  Description of Artificial Sequence: Synthetic coding sequence

SEQ ID NO: 106080 - DNA, 1764 bp, Artificial Sequence
  Description of Artificial Sequence: Synthetic coding sequence
atgcccaccgccctgtgccccagagtgctggcccccaaggagagcgaggagcccagaaagatgagaagcccccccggcgagaaccccagcccccagggcgagctgcccagccccgagagcagcagaagactgttcagaagattcagataccaggaggccgccggccccagagaggccctgcagagactgtgggacctgtgcggcggctggctgagacccgagagacacaccaaggagcagatcctggagctgctggtgctggagcagttcctggccatcctgcccagagagatccagagctgggtgagagcccaggagcccgagagcggcgagcaggccgtggccgccgtggaggccctggagagagagcccggcagaccctggcagtggctgaagcactgcgaggaccccgtggtgatcgacgacggcgacagccccctggaccaggagcaggagcagctgcccgtggagccccacagcgacctggccaagaaccaggacgcccagcccatcaccctggcccagtgcctgggcctgcccagcagaccccccagccagctgagcggcgaccccgtgctgcaggacgccttcctgctgcaggaggagaacgtgagagacacccagcaggtgaccaccctgcagctgccccccagcagagtgagccccttcaaggacatgatcctgtgcttcagcgaggaggactggagcctgctggaccccgcccagaccggcttctacggcgagttcatcatcggcgaggactacggcgtgagcatgccccccaacgacctggccgcccagcccgacctgagccagggcgaggagaacgagcccagagtgcccgagctgcaggacctgcagggcaaggaggtgccccaggtgagctacctggacagccccagcctgcagcccttccaggtggaggagagaagaaagagagaggagctgcaggtgcccgagttccaggcctgcccccagaccgtggtgccccagaacacctaccccgccggcggcaaccccagaagcctggagaacagcctggacgaggaggtgaccatcgagatcgtgctgagcagcagcggcgacgaggacagccagcacggcccctactgcaccgaggagctgggcagccccaccgagaagcagagaagcctgcccgccagccacagaagcagcaccgaggccggcggcgaggtgcagaccagcaagaagagctacgtgtgccccaactgcggcaagatcttcagatggagagtgaacttcatcagacacctgagaagcagaagagagcaggagaagccccacgagtgcagcgtgtgcggcgagctgttcagcgacagcgaggacctggacggccacctggagagccacgaggcccagaagccctacagatgcggcgcctgcggcaagagcttcagactgaacagccacctgctgagccacagaagaatccacctgcagcccgacagactgcagcccgtggagaagagagagcaggccgccagcgaggacgccgacaagggccccaaggagcccctggagaacggcaaggccaagctgagcttccagtgctgcgagtgcggcaaggccttccagagacacgaccacctggccagacacagaagccacttccacctgaaggacaaggccagacccttccagtgcagatactgcgtgaagagcttcacccagaactacgacctgctgagacacgagagactgcacatgaagagaagaagcaagcaggccctgaacagctactag

SEQ ID NO: 106081 - DNA, 1872 bp, Artificial Sequence
  Description of Artificial Sequence: Synthetic coding sequence
atgcccaccgccctgtgccccagagtgctggcccccaaggagagcgaggagcccagaaagatgagaagcccccccggcgagaaccccagcccccagggcgagctgcccagccccgagagcagcagaagactgttcagaagattcagataccaggaggccgccggccccagagaggccctgcagagactgtgggacctgtgcggcggctggctgagacccgagagacacaccaaggagcagatcctggagctgctggtgctggagcagttcctggccatcctgcccagagagatccagagctgggtgagagcccaggagcccgagagcggcgagcaggccgtggccgccgtggaggccctggagagagagcccggcagaccctggcagtggctgaagcactgcgaggaccccgtggtgatcgacgacggcgacagccccctggaccaggagcaggagcagctgcccgtggagccccacagcgacctggccaagaaccaggacgcccagcccatcaccctggcccagtgcctgggcctgcccagcagaccccccagccagctgagcggcgaccccgtgctgcaggacgccttcctgctgcaggaggagaacgtgagagacacccagcaggtgaccaccctgcagctgccccccagaatcttccagttcaacaaccacagaagcaacggctacatcctggagatgctgggcagcggcggcaagaaggcccagatcatcagcgtgctgagccagatctacgtgagcagagtgagccccttcaaggacatgatcctgtgcttcagcgaggaggactggagcctgctggaccccgcccagaccggcttctacggcgagttcatcatcggcgaggactacggcgtgagcatgccccccaacgacctggccgcccagcccgacctgagccagggcgaggagaacgagcccagagtgcccgagctgcaggacctgcagggcaaggaggtgccccaggtgagctacctggacagccccagcctgcagcccttccaggtggaggagagaagaaagagagaggagctgcaggtgcccgagttccaggcctgcccccagaccgtggtgccccagaacacctaccccgccggcggcaaccccagaagcctggagaacagcctggacgaggaggtgaccatcgagatcgtgctgagcagcagcggcgacgaggacagccagcacggcccctactgcaccgaggagctgggcagccccaccgagaagcagagaagcctgcccgccagccacagaagcagcaccgaggccggcggcgaggtgcagaccagcaagaagagctacgtgtgccccaactgcggcaagatcttcagatggagagtgaacttcatcagacacctgagaagcagaagagagcaggagaagccccacgagtgcagcgtgtgcggcgagctgttcagcgacagcgaggacctggacggccacctggagagccacgaggcccagaagccctacagatgcggcgcctgcggcaagagcttcagactgaacagccacctgctgagccacagaagaatccacctgcagcccgacagactgcagcccgtggagaagagagagcaggccgccagcgaggacgccgacaagggccccaaggagcccctggagaacggcaaggccaagctgagcttccagtgctgcgagtgcggcaaggccttccagagacacgaccacctggccagacacagaagccacttccacctgaaggacaaggccagacccttccagtgcagatactgcgtgaagagcttcacccagaactacgacctgctgagacacgagagactgcacatgaagagaagaagcaagcaggccctgaacagctactag

SEQ ID NO: 106082 - DNA, 1830 bp, Artificial Sequence
  Description of Artificial Sequence: Synthetic coding sequence
atgagcaccgcccccagcctgagcgccctgagaagcagcaagcacagcggcggcggcggcggcggcggcggcggcggcggcgccgaccccgcctggaccagcgccctgagcggcaacagcagcggccccggccccggcagcagccccgccggcagcaccaagcccttcgtgcacgccgtgccccccagcgaccccctgagacaggccaacagactgcccatcaaggtgctgaagatgctgaccgccagaaccggccacatcctgcaccccgagtacctgcagcccctgcccagcacccccgtgagccccatcgagctggacgccaagaagagccccctggccctgctggcccagacctgcagccagatcggcaagcccgaccccagccccagcagcaagctgagcagcgtggccagcaacggcggcggcgccggcggcgccggcggcggcgccgccggcgacaaggacaccaagagcggccccctgaagctgagcgacatcggcgtggaggacaagagcagcttcaagccctacagcaagcccggcagcgacaagaaggagcccggcggcggcggcggcggcggcggcggcggcggcggcggcggcggcggcgtgagcagcgagaagagcggcttcagagtgcccagcgccacctgccagcccttcacccccagaaccggcagccccagcagcagcgccagcgccgagggcggccccaccggcctggcccacggcagaatcagctgcggcggcggcatcaacgtggacgtgaaccagcaccccgacggcggccccggcggcaaggccctgggcagcgactgcggcggcagcagcggcagcagcagcggcagcggccccagcgcccccaccagcagcagcgtgctgggcagcggcctggtggcccccgtgagcccctacaagcccggccagaccgtgttccccctgccccccgccggcatgacctaccccggcagcctggccggcgcctacgccggctaccccccccagttcctgccccacggcgtggccctggaccccaccaagcccggcagcctggtgggcgcccagctggccgccgccgccgccggcagcctgggctgcagcaagcccgccggcagcagccccctggccggcgccagcccccccagcgtgatgaccgccagcctgtgcagagacccctactgcctgagctaccactgcgccagccacctggccggcgccgccgccgccagcgccagctgcgcccacgaccccgccgccgccgccgccgccctgaagagcggctaccccctggtgtaccccacccaccccctgcacggcgtgcacagcagcctgaccgccgccgccgccgccggcgccaccccccccagcctggccggccaccccctgtacccctacggcttcatgctgcccaacgaccccctgccccacatctgcaactgggtgagcgccaacggcccctgcgacaagagattcgccaccagcgaggagctgctgagccacctgagaacccacaccgccttccccggcaccgacaagctgctgagcggctaccccagcagcagcagcctggccagcgccgccgccgccgccatggcctgccacatgcacatccccaccagcggcgcccccggcagccccggcaccctggccctgagaagcccccaccacgccctgggcctgagcagcagataccacccctacagcaagagccccctgcccacccccggcgcccccgtgcccgtgcccgccgccaccggcccctactacagcccctacgccctgtacggccagagactgaccaccgccagcgccctgggctaccagtag

SEQ ID NO: 106083 - DNA, 1941 bp, Artificial Sequence
  Description of Artificial Sequence: Synthetic coding sequence
atgagcaccgcccccagcctgagcgccctgagaagcagcaagcacagcggcggcggcggcggcggcggcggcggcggcggcgccgaccccgcctggaccagcgccctgagcggcaacagcagcggccccggccccggcagcagccccgccggcagcaccaagcccttcgtgcacgccgtgccccccagcgaccccctgagacaggccaacagactgcccatcaaggtgctgaagatgctgaccgccagaaccggccacatcctgcaccccgagtacctgcagcccctgcccagcacccccgtgagccccatcgagctggacgccaagaagagccccctggccctgctggcccagacctgcagccagatcggcaagcccgaccccagccccagcagcaagctgagcagcgtggccagcaacggcggcggcgccggcggcgccggcggcggcgccgccggcgacaaggacaccaagagcggccccctgaagctgagcgacatcggcgtggaggacaagagcagcttcaagccctacagcaagcccggcagcgacaagaaggagcccggcggcggcggcggcggcggcggcggcggcggcggcggcggcggcggcgtgagcagcgagaagagcggcttcagagtgcccagcgccacctgccagcccttcacccccagaaccggcagccccagcagcagcgccagcgcctgcagccccggcggcatgctgagcagcgccggcggcgcccccgagggcaaggacgacaagaaggacaccgacgtgggcggcggcggcaagggcaccggcggcgccagcgccgagggcggccccaccggcctggcccacggcagaatcagctgcggcggcggcatcaacgtggacgtgaaccagcaccccgacggcggccccggcggcaaggccctgggcagcgactgcggcggcagcagcggcagcagcagcggcagcggccccagcgcccccaccagcagcagcgtgctgggcagcggcctggtggcccccgtgagcccctacaagcccggccagaccgtgttccccctgccccccgccggcatgacctaccccggcagcctggccggcgcctacgccggctaccccccccagttcctgccccacggcgtggccctggaccccaccaagcccggcagcctggtgggcgcccagctggccgccgccgccgccggcagcctgggctgcagcaagcccgccggcagcagccccctggccggcgccagcccccccagcgtgatgaccgccagcctgtgcagagacccctactgcctgagctaccactgcgccagccacctggccggcgccgccgccgccagcgccagctgcgcccacgaccccgccgccgccgccgccgccctgaagagcggctaccccctggtgtaccccacccaccccctgcacggcgtgcacagcagcctgaccgccgccgccgccgccggcgccaccccccccagcctggccggccaccccctgtacccctacggcttcatgctgcccaacgaccccctgccccacatctgcaactgggtgagcgccaacggcccctgcgacaagagattcgccaccagcgaggagctgctgagccacctgagaacccacaccgccttccccggcaccgacaagctgctgagcggctaccccagcagcagcagcctggccagcgccgccgccgccgccatggcctgccacatgcacatccccaccagcggcgcccccggcagccccggcaccctggccctgagaagcccccaccacgccctgggcctgagcagcagataccacccctacagcaagagccccctgcccacccccggcgcccccgtgcccgtgcccgccgccaccggcccctactacagcccctacgccctgtacggccagagactgaccaccgccagcgccctgggctaccagtag

SEQ ID NO: 106084 - DNA, 1941 bp, Artificial Sequence; identical to SEQ ID NO: 106083
  Description of Artificial Sequence: Synthetic coding sequence

SEQ ID NO: 106085 - DNA, 1626 bp, Artificial Sequence
  Description of Artificial Sequence: Synthetic coding sequence
atgcccagaagaaagcagagccacccccagcccgtgaagtgcgagggcgtgaaggtggacaccgaggacagcctggacgagggccccggcgccctggtgctggagagcgacctgctgctgggccaggacctggagttcgaggaggaggaggaggaggaggagggcgacggcaacagcgaccagctgatgggcttcgagagagacagcgagggcgacagcctgggcgccagacccggcctgccctacggcctgagcgacgacgagagcggcggcggcagagccctgagcgccgagagcgaggtggaggagcccgccagaggccccggcgaggccagaggcgagagacccggccccgcctgccagctgtgcggcggccccaccggcgagggcccctgctgcggcgccggcggccccggcggcggccccctgctgccccccagactgctgtacagctgcagactgtgcaccttcgtgagccactacagcagccacctgaagagacacatgcagacccacagcggcgagaagcccttcagatgcggcagatgcccctacgccagcgcccagctggtgaacctgaccagacacaccagaacccacaccggcgagaagccctacagatgcccccactgccccttcgcctgcagcagcctgggcaacctgagaagacaccagagaacccacgccggcccccccacccccccctgccccacctgcggcttcagatgctgcacccccagacccgccagaccccccagccccaccgagcaggagggcgccgtgcccagaagacccgaggacgccctgctgctgcccgacctgagcctgcacgtgccccccggcggcgccagcttcctgcccgactgcggccagctgagaggcgagggcgagggcctgtgcggcaccggcagcgagcccctgcccgagctgctgttcccctggacctgcagaggctgcggccaggagctggaggagggcgagggcagcagactgggcgccgccatgtgcggcagatgcatgagaggcgaggccggcggcggcgccagcggcggcccccagggccccagcgacaagggcttcgcctgcagcctgtgccccttcgccacccactaccccaaccacctggccagacacatgaagacccacagcggcgagaagcccttcagatgcgccagatgcccctacgccagcgcccacctggacaacctgaagagacaccagagagtgcacaccggcgagaagccctacaagtgccccctgtgcccctacgcctgcggcaacctggccaacctgaagagacacggcagaatccacagcggcgacaagcccttcagatgcagcctgtgcaactacagctgcaaccagagcatgaacctgaagagacacatgctgagacacaccggcgagaagcccttcagatgcgccacctgcgcctacaccaccggccactgggacaactacaagagacaccagaaggtgcacggccacggcggcgccggcggccccggcctgagcgccagcgagggctgggcccccccccacagcccccccagcgtgctgagcagcagaggcccccccgccctgggcaccgccggcagcagagccgtgcacaccgacagcagctag

SEQ ID NO: 106086 - DNA, 1440 bp, Artificial Sequence
  Description of Artificial Sequence: Synthetic coding sequence
atgggcttcgagagagacagcgagggcgacagcctgggcgccagacccggcctgccctacggcctgagcgacgacgagagcggcggcggcagagccctgagcgccgagagcgaggtggaggagcccgccagaggccccggcgaggccagaggcgagagacccggccccgcctgccagctgtgcggcggccccaccggcgagggcccctgctgcggcgccggcggccccggcggcggccccctgctgccccccagactgctgtacagctgcagactgtgcaccttcgtgagccactacagcagccacctgaagagacacatgcagacccacagcggcgagaagcccttcagatgcggcagatgcccctacgccagcgcccagctggtgaacctgaccagacacaccagaacccacaccggcgagaagccctacagatgcccccactgccccttcgcctgcagcagcctgggcaacctgagaagacaccagagaacccacgccggcccccccacccccccctgccccacctgcggcttcagatgctgcacccccagacccgccagaccccccagccccaccgagcaggagggcgccgtgcccagaagacccgaggacgccctgctgctgcccgacctgagcctgcacgtgccccccggcggcgccagcttcctgcccgactgcggccagctgagaggcgagggcgagggcctgtgcggcaccggcagcgagcccctgcccgagctgctgttcccctggacctgcagaggctgcggccaggagctggaggagggcgagggcagcagactgggcgccgccatgtgcggcagatgcatgagaggcgaggccggcggcggcgccagcggcggcccccagggccccagcgacaagggcttcgcctgcagcctgtgccccttcgccacccactaccccaaccacctggccagacacatgaagacccacagcggcgagaagcccttcagatgcgccagatgcccctacgccagcgcccacctggacaacctgaagagacaccagagagtgcacaccggcgagaagccctacaagtgccccctgtgcccctacgcctgcggcaacctggccaacctgaagagacacggcagaatccacagcggcgacaagcccttcagatgcagcctgtgcaactacagctgcaaccagagcatgaacctgaagagacacatgctgagacacaccggcgagaagcccttcagatgcgccacctgcgcctacaccaccggccactgggacaactacaagagacaccagaaggtgcacggccacggcggcgccggcggccccggcctgagcgccagcgagggctgggcccccccccacagcccccccagcgtgctgagcagcagaggcccccccgccctgggcaccgccggcagcagagccgtgcacaccgacagcagctag

SEQ ID NO: 106087 - DNA, 3936 bp, Artificial Sequence
  Description of Artificial Sequence: Synthetic coding sequence
atgagcagaagaaagcaggccaagcccagaagcctgaaggaccccaactgcaagctggaggacaagaccgaggacggcgaggccctggactgcaagaagagacccgaggacggcgaggagctggaggacgaggccgtgcacagctgcgacagctgcctgcaggtgttcgagagcctgagcgacatcaccgagcacaagatcaaccagtgccagctgaccgacggcgtggacgtggaggacgaccccacctgcagctggcccgccagcagccccagcagcaaggaccagaccagccccagccacggcgagggctgcgacttcggcgaggaggagggcggccccggcctgccctacccctgccagttctgcgacaagagcttcagcagactgagctacctgaagcaccacgagcagagccacagcgacaagctgcccttcaagtgcacctactgcagcagactgttcaagcacaagagaagcagagacagacacatcaagctgcacaccggcgacaagaagtaccactgcagcgagtgcgacgccgccttcagcagaagcgaccacctgaagatccacctgaagacccacaccagcaacaagccctacaagtgcgccatctgcagaagaggcttcctgagcagcagcagcctgcacggccacatgcaggtgcacgagagaaacaaggacggcagccagagcggcagcagaatggaggactggaagatgaaggacacccagaagtgcagccagtgcgaggagggcttcgacttccccgaggacctgcagaagcacatcgccgagtgccaccccgagtgcagccccaacgaggacagagccgccctgcagtgcgtgtactgccacgagctgttcgtggaggagaccagcctgatgaaccacatggagcaggtgcacagcggcgagaagaagaacagctgcagcatctgcagcgagagcttccacaccgtggaggagctgtacagccacatggacagccaccagcagcccgagagctgcaaccacagcaacagccccagcctggtgaccgtgggctacaccagcgtgagcagcaccacccccgacagcaacctgagcgtggacagcagcaccatggtggaggccgccccccccatccccaagagcagaggcagaaagagagccgcccagcagacccccgacatgaccggccccagcagcaagcaggccaaggtgacctacagctgcatctactgcaacaagcagctgttcagcagcctggccgtgctgcagatccacctgaagaccatgcacctggacaagcccgagcaggcccacatctgccagtactgcctggaggtgctgcccagcctgtacaacctgaacgagcacctgaagcaggtgcacgaggcccaggaccccggcctgatcgtgagcgccatgcccgccatcgtgtaccagtgcaacttctgcagcgaggtggtgaacgacctgaacaccctgcaggagcacatcagatgcagccacggcttcgccaaccccgccgccaaggacagcaacgccttcttctgcccccactgctacatgggcttcctgaccgacagcagcctggaggagcacatcagacaggtgcactgcgacctgagcggcagcagattcggcagccccgtgctgggcacccccaaggagcccgtggtggaggtgtacagctgcagctactgcaccaacagccccatcttcaacagcgtgctgaagctgaacaagcacatcaaggagaaccacaagaacatccccctggccctgaactacatccacaacggcaagaagagcagagccctgagccccctgagccccgtggccatcgagcagaccagcctgaagatgatgcaggccgtgggcggcgcccccgccagacccaccggcgagtacatctgcaaccagtgcggcgccaagtacaccagcctggacagcttccagacccacctgaagacccacctggacaccgtgctgcccaagctgacctgcccccagtgcaacaaggagttccccaaccaggagagcctgctgaagcacgtgaccatccacttcatgatcaccagcacctactacatctgcgagagctgcgacaagcagttcaccagcgtggacgacctgcagaagcacctgctggacatgcacaccttcgtgttcttcagatgcaccctgtgccaggaggtgttcgacagcaaggtgagcatccagctgcacctggccgtgaagcacagcaacgagaagaaggtgtacagatgcaccagctgcaactgggacttcagaaacgagaccgacctgcagctgcacgtgaagcacaaccacctggagaaccagggcaaggtgcacaagtgcatcttctgcggcgagagcttcggcaccgaggtggagctgcagtgccacatcaccacccacagcaagaagtacaactgcaagttctgcagcaaggccttccacgccatcatcctgctggagaagcacctgagagagaagcactgcgtgttcgagaccaagacccccaactgcggcaccaacggcgccagcgagcaggtgcagaaggaggaggtggagctgcagaccctgctgaccaacagccaggagagccacaacagccacgacggcagcgaggaggacgtggacaccagcgagcccatgtacggctgcgacatctgcggcgccgcctacaccatggagaccctgctgcagaaccaccagctgagagaccacaacatcagacccggcgagagcgccatcgtgaagaagaaggccgagctgatcaagggcaactacaagtgcaacgtgtgcagcagaaccttcttcagcgagaacggcctgagagagcacatgcagacccacctgggccccgtgaagcactacatgtgccccatctgcggcgagagattccccagcctgctgaccctgaccgagcacaaggtgacccacagcaagagcctggacaccggcaactgcagaatctgcaagatgcccctgcagagcgaggaggagttcctggagcactgccagatgcaccccgacctgagaaacagcctgaccggcttcagatgcgtggtgtgcatgcagaccgtgaccagcaccctggagctgaagatccacggcaccttccacatgcagaagaccggcaacggcagcgccgtgcagaccaccggcagaggccagcacgtgcagaagctgtacaagtgcgccagctgcctgaaggagttcagaagcaagcaggacctggtgaagctggacatcaacggcctgccctacggcctgtgcgccggctgcgtgaacctgagcaagagcgccagccccggcatcaacgtgccccccggcaccaacagacccggcctgggccagaacgagaacctgagcgccatcgagggcaagggcaaggtgggcggcctgaagaccagatgcagcagctgcaacgtgaagttcgagagcgagagcgagctgcagaaccacatccagaccatccacagagagctggtgcccgacagcaacagcacccagctgaagaccccccaggtgagccccatgcccagaatcagccccagccagagcgacgagaagaagacctaccagtgcatcaagtgccagatggtgttctacaacgagtgggacatccaggtgcacgtggccaaccacatgatcgacgagggcctgaaccacgagtgcaagctgtgcagccagaccttcgacagccccgccaagctgcagtgccacctgatcgagcacagcttcgagggcatgggcggcaccttcaagtgccccgtgtgcttcaccgtgttcgtgcaggccaacaagctgcagcagcacatcttcagcgcccacggccaggaggacaagatctacgactgcacccagtgcccccagaagttcttcttccagaccgagctgcagaaccacaccatgacccagcacagcagctag

SEQ ID NO: 106088 - DNA, 3936 bp, Artificial Sequence
  Description of Artificial Sequence: Synthetic coding sequence
atcagcagagcccagaaggcccagaccagaagactgaacgaccccaactgcaagctggaggacaagaccgaggacggcgaggccctggactgcaagaagagacccgaggacggcgaggagctggaggacgaggccgtgcacagctgcgacagctgcctgcaggtgttcgagagcctgagcgacatcaccgagcacaagatcaaccagtgccagctgaccgacggcgtggacgtggaggacgaccccacctgcagctggcccgccagcagccccagcagcaaggaccagaccagccccagccacggcgagggctgcgacttcggcgaggaggagggcggccccggcctgccctacccctgccagttctgcgacaagagcttcagcagactgagctacctgaagcaccacgagcagagccacagcgacaagctgcccttcaagtgcacctactgcagcagactgttcaagcacaagagaagcagagacagacacatcaagctgcacaccggcgacaagaagtaccactgcagcgagtgcgacgccgccttcagcagaagcgaccacctgaagatccacctgaagacccacaccagcaacaagccctacaagtgcgccatctgcagaagaggcttcctgagcagcagcagcctgcacggccacatgcaggtgcacgagagaaacaaggacggcagccagagcggcagcagaatggaggactggaagatgaaggacacccagaagtgcagccagtgcgaggagggcttcgacttccccgaggacctgcagaagcacatcgccgagtgccaccccgagtgcagccccaacgaggacagagccgccctgcagtgcgtgtactgccacgagctgttcgtggaggagaccagcctgatgaaccacatggagcaggtgcacagcggcgagaagaagaacagctgcagcatctgcagcgagagcttccacaccgtggaggagctgtacagccacatggacagccaccagcagcccgagagctgcaaccacagcaacagccccagcctggtgaccgtgggctacaccagcgtgagcagcaccacccccgacagcaacctgagcgtggacagcagcaccatggtggaggccgccccccccatccccaagagcagaggcagaaagagagccgcccagcagacccccgacatgaccggccccagcagcaagcaggccaaggtgacctacagctgcatctactgcaacaagcagctgttcagcagcctggccgtgctgcagatccacctgaagaccatgcacctggacaagcccgagcaggcccacatctgccagtactgcctggaggtgctgcccagcctgtacaacctgaacgagcacctgaagcaggtgcacgaggcccaggaccccggcctgatcgtgagcgccatgcccgccatcgtgtaccagtgcaacttctgcagcgaggtggtgaacgacctgaacaccctgcaggagcacatcagatgcagccacggcttcgccaaccccgccgccaaggacagcaacgccttcttctgcccccactgctacatgggcttcctgaccgacagcagcctggaggagcacatcagacaggtgcactgcgacctgagcggcagcagattcggcagccccgtgctgggcacccccaaggagcccgtggtggaggtgtacagctgcagctactgcaccaacagccccatcttcaacagcgtgctgaagctgaacaagcacatcaaggagaaccacaagaacatccccctggccctgaactacatccacaacggcaagaagagcagagccctgagccccctgagccccgtggccatcgagcagaccagcctgaagatgatgcaggccgtgggcggcgcccccgccagacccaccggcgagtacatctgcaaccagtgcggcgccaagtacaccagcctggacagcttccagacccacctgaagacccacctggacaccgtgctgcccaagctgacctgcccccagtgcaacaaggagttccccaaccaggagagcctgctgaagcacgtgaccatccacttcatgatcaccagcacctactacatctgcgagagctgcgacaagcagttcaccagcgtggacgacctgcagaagcacctgctggacatgcacaccttcgtgttcttcagatgcaccctgtgccaggaggtgttcgacagcaaggtgagcatccagctgcacctggccgtgaagcacagcaacgagaagaaggtgtacagatgcaccagctgcaactgggacttcagaaacgagaccgacctgcagctgcacgtgaagcacaaccacctggagaaccagggcaaggtgcacaagtgcatcttctgcggcgagagcttcggcaccgaggtggagctgcagtgccacatcaccacccacagcaagaagtacaactgcaagttctgcagcaaggccttccacgccatcatcctgctggagaagcacctgagagagaagcactgcgtgttcgagaccaagacccccaactgcggcaccaacggcgccagcgagcaggtgcagaaggaggaggtggagctgcagaccctgctgaccaacagccaggagagccacaacagccacgacggcagcgaggaggacgtggacaccagcgagcccatgtacggctgcgacatctgcggcgccgcctacaccatggagaccctgctgcagaaccaccagctgagagaccacaacatcagacccggcgagagcgccatcgtgaagaagaaggccgagctgatcaagggcaactacaagtgcaacgtgtgcagcagaaccttcttcagcgagaacggcctgagagagcacatgcagacccacctgggccccgtgaagcactacatgtgccccatctgcggcgagagattccccagcctgctgaccctgaccgagcacaaggtgacccacagcaagagcctggacaccggcaactgcagaatctgcaagatgcccctgcagagcgaggaggagttcctggagcactgccagatgcaccccgacctgagaaacagcctgaccggcttcagatgcgtggtgtgcatgcagaccgtgaccagcaccctggagctgaagatccacggcaccttccacatgcagaagaccggcaacggcagcgccgtgcagaccaccggcagaggccagcacgtgcagaagctgtacaagtgcgccagctgcctgaaggagttcagaagcaagcaggacctggtgaagctggacatcaacggcctgccctacggcctgtgcgccggctgcgtgaacctgagcaagagcgccagccccggcatcaacgtgccccccggcaccaacagacccggcctgggccagaacgagaacctgagcgccatcgagggcaagggcaaggtgggcggcctgaagaccagatgcagcagctgcaacgtgaagttcgagagcgagagcgagctgcagaaccacatccagaccatccacagagagctggtgcccgacagcaacagcacccagctgaagaccccccaggtgagccccatgcccagaatcagccccagccagagcgacgagaagaagacctaccagtgcatcaagtgccagatggtgttctacaacgagtgggacatccaggtgcacgtggccaaccacatgatcgacgagggcctgaaccacgagtgcaagctgtgcagccagaccttcgacagccccgccaagctgcagtgccacctgatcgagcacagcttcgagggcatgggcggcaccttcaagtgccccgtgtgcttcaccgtgttcgtgcaggccaacaagctgcagcagcacatcttcagcgcccacggccaggaggacaagatctacgactgcacccagtgcccccagaagttcttcttccagaccgagctgcaggtgcacaccgccacccccagacagagctag

SEQ ID NO: 106089 - DNA, 4038 bp, Artificial Sequence
  Description of Artificial Sequence: Synthetic coding sequence
ttcctgagcgactacgtgcagagcgagagcctgagagtgagaggccccctgtggagccaccccgacggcttcggcggcctggccagcatcttccactactacgtggactacagaagcgacagcgccgtgcaggacctggccgaccccaactgcaagctggaggacaagaccgaggacggcgaggccctggactgcaagaagagacccgaggacggcgaggagctggaggacgaggccgtgcacagctgcgacagctgcctgcaggtgttcgagagcctgagcgacatcaccgagcacaagatcaaccagtgccagctgaccgacggcgtggacgtggaggacgaccccacctgcagctggcccgccagcagccccagcagcaaggaccagaccagccccagccacggcgagggctgcgacttcggcgaggaggagggcggccccggcctgccctacccctgccagttctgcgacaagagcttcagcagactgagctacctgaagcaccacgagcagagccacagcgacaagctgcccttcaagtgcacctactgcagcagactgttcaagcacaagagaagcagagacagacacatcaagctgcacaccggcgacaagaagtaccactgcagcgagtgcgacgccgccttcagcagaagcgaccacctgaagatccacctgaagacccacaccagcaacaagccctacaagtgcgccatctgcagaagaggcttcctgagcagcagcagcctgcacggccacatgcaggtgcacgagagaaacaaggacggcagccagagcggcagcagaatggaggactggaagatgaaggacacccagaagtgcagccagtgcgaggagggcttcgacttccccgaggacctgcagaagcacatcgccgagtgccaccccgagtgcagccccaacgaggacagagccgccctgcagtgcgtgtactgccacgagctgttcgtggaggagaccagcctgatgaaccacatggagcaggtgcacagcggcgagaagaagaacagctgcagcatctgcagcgagagcttccacaccgtggaggagctgtacagccacatggacagccaccagcagcccgagagctgcaaccacagcaacagccccagcctggtgaccgtgggctacaccagcgtgagcagcaccacccccgacagcaacctgagcgtggacagcagcaccatggtggaggccgccccccccatccccaagagcagaggcagaaagagagccgcccagcagacccccgacatgaccggccccagcagcaagcaggccaaggtgacctacagctgcatctactgcaacaagcagctgttcagcagcctggccgtgctgcagatccacctgaagaccatgcacctggacaagcccgagcaggcccacatctgccagtactgcctggaggtgctgcccagcctgtacaacctgaacgagcacctgaagcaggtgcacgaggcccaggaccccggcctgatcgtgagcgccatgcccgccatcgtgtaccagtgcaacttctgcagcgaggtggtgaacgacctgaacaccctgcaggagcacatcagatgcagccacggcttcgccaaccccgccgccaaggacagcaacgccttcttctgcccccactgctacatgggcttcctgaccgacagcagcctggaggagcacatcagacaggtgcactgcgacctgagcggcagcagattcggcagccccgtgctgggcacccccaaggagcccgtggtggaggtgtacagctgcagctactgcaccaacagccccatcttcaacagcgtgctgaagctgaacaagcacatcaaggagaaccacaagaacatccccctggccctgaactacatccacaacggcaagaagagcagagccctgagccccctgagccccgtggccatcgagcagaccagcctgaagatgatgcaggccgtgggcggcgcccccgccagacccaccggcgagtacatctgcaaccagtgcggcgccaagtacaccagcctggacagcttccagacccacctgaagacccacctggacaccgtgctgcccaagctgacctgcccccagtgcaacaaggagttccccaaccaggagagcctgctgaagcacgtgaccatccacttcatgatcaccagcacctactacatctgcgagagctgcgacaagcagttcaccagcgtggacgacctgcagaagcacctgctggacatgcacaccttcgtgttcttcagatgcaccctgtgccaggaggtgttcgacagcaaggtgagcatccagctgcacctggccgtgaagcacagcaacgagaagaaggtgtacagatgcaccagctgcaactgggacttcagaaacgagaccgacctgcagctgcacgtgaagcacaaccacctggagaaccagggcaaggtgcacaagtgcatcttctgcggcgagagcttcggcaccgaggtggagctgcagtgccacatcaccacccacagcaagaagtacaactgcaagttctgcagcaaggccttccacgccatcatcctgctggagaagcacctgagagagaagcactgcgtgttcgagaccaagacccccaactgcggcaccaacggcgccagcgagcaggtgcagaaggaggaggtggagctgcagaccctgctgaccaacagccaggagagccacaacagccacgacggcagcgaggaggacgtggacaccagcgagcccatgtacggctgcgacatctgcggcgccgcctacaccatggagaccctgctgcagaaccaccagctgagagaccacaacatcagacccggcgagagcgccatcgtgaagaagaaggccgagctgatcaagggcaactacaagtgcaacgtgtgcagcagaaccttcttcagcgagaacggcctgagagagcacatgcagacccacctgggccccgtgaagcactacatgtgccccatctgcggcgagagattccccagcctgctgaccctgaccgagcacaaggtgacccacagcaagagcctggacaccggcaactgcagaatctgcaagatgcccctgcagagcgaggaggagttcctggagcactgccagatgcaccccgacctgagaaacagcctgaccggcttcagatgcgtggtgtgcatgcagaccgtgaccagcaccctggagctgaagatccacggcaccttccacatgcagaagaccggcaacggcagcgccgtgcagaccaccggcagaggccagcacgtgcagaagctgtacaagtgcgccagctgcctgaaggagttcagaagcaagcaggacctggtgaagctggacatcaacggcctgccctacggcctgtgcgccggctgcgtgaacctgagcaagagcgccagccccggcatcaacgtgccccccggcaccaacagacccggcctgggccagaacgagaacctgagcgccatcgagggcaagggcaaggtgggcggcctgaagaccagatgcagcagctgcaacgtgaagttcgagagcgagagcgagctgcagaaccacatccagaccatccacagagagctggtgcccgacagcaacagcacccagctgaagaccccccaggtgagccccatgcccagaatcagccccagccagagcgacgagaagaagacctaccagtgcatcaagtgccagatggtgttctacaacgagtgggacatccaggtgcacgtggccaaccacatgatcgacgagggcctgaaccacgagtgcaagctgtgcagccagaccttcgacagccccgccaagctgcagtgccacctgatcgagcacagcttcgagggcatgggcggcaccttcaagtgccccgtgtgcttcaccgtgttcgtgcaggccaacaagctgcagcagcacatcttcagcgcccacggccaggaggacaagatctacgactgcacccagtgcccccagaagttcttcttccagaccgagctgcaggtgcacaccgccacccccagacagagctag

SEQ ID NO: 106090 - DNA, 2013 bp, Artificial Sequence
  Description of Artificial Sequence: Synthetic coding sequence
atggccgaggtggtggccgaggtggccgagatgcccacccagatgagccccggcgccgtggagatgagcacccccatgagcgccgagatgatggagatgagcaccgaggtgaccgagatgacccccggcgaggccctggccagcagcctgttcttccagcaccaccagttcatgtgcagcgagtgcggcagcctgtacaacaccctggaggaggtgctgagccaccaggagcagcacatgctggccgtgagcgaggaggaggccctgaccacccagaacgtgggcctggagcccgagctggtgcccggcgccgagggccccttccagtgcggcgagtgcagccagctgatcctgagccccggcgagctgctggcccaccaggacgcccacctgagagagagcgccaaccagatccagtaccagtgctgggactgccaggagctgttccccagccccgagctgtgggtggcccacagaaaggcccagcacctgagcgccaccgtggccgagccccccgtgcccccccccctgcccccccccacccccctgcccccccccagcccccccagcgaggtgaagatggagccctacgagtgccccgagtgcagcaccctgtgcgccacccccgaggagttcctggagcaccagggcacccacttcgacagcctggagaaggaggagagaaacggcctggaggaggaggaggaggacgacgaggaggacgaggaggacgacgaggagatggaggacgaggaggccatggccgaggtgggcgacgacgccgtgggcggcgacgagagcaccgccggctgggcccagggctgcggcgactgcccccagcaccagcccagcgccggcgccagaagacagcacagaagaaccgcccacagccccgccagcgccacccaccccttccactgcagccagtgccagagaagcttcagcagcgccaacagactgcaggcccacggcagagcccacgtgggcggcacccacgagtgcaccacctgcagcaaggtgttcaagaaggccgccagcctggagcagcacctgagactgcacagaggcgaggccagatacctgtgcgtggactgcggcagaggcttcggcaccgagctgaccctggtggcccacagaagagcccacaccgccaaccccctgcacagatgcagatgcggcaagaccttcagcaacatgaccaagttcctgtaccacagaagaacccacgccggcaagagcggcgccccccccaccggcgccaccgccccccccgcccccgccgagcccaccccccccccccccccccccgccccccccgcccagctgccctgcccccagtgcagcaagagcttcgccagcgccagcagactgagcagacacagaagagccgtgcacggcccccccgagagaagacacagatgcggcgtgtgcggcaagggcttcaagaagctgatccacgtgagaaaccacctgagaacccacaccggcgagagacccttccagtgccacagctgcggcaagaccttcgccagcctggccaacctgagcagacaccagctgacccacaccggcgccagaccctaccagtgcctggactgcggcaagagattcacccagagcagcaacctgcagcagcacagaagactgcacctgagacccgtggccttcgccagagcccccagactgcccatcaccggcctgtacaacaagagcccctactactgcggcacctgcggcagatggttcagagccatggccggcctgagactgcaccagagagtgcacgccagagccagaaccctgaccctgcagccccccagaagccccagccccgcccccccccccccccccgagccccagcagaccatcatgtgcaccgagctgggcgagaccatcgccatcatcgagaccagccagcccctggccctggaggacaccctgcagctgtgccaggccgccctgggcgccagcgaggccggcggcctgctgcagctggacaccgccttcgtgtag

SEQ ID NO: 106091 - DNA, 1581 bp, Artificial Sequence
  Description of Artificial Sequence: Synthetic coding sequence
atggccgaggtggtggccgaggtggccgagatgcccacccagatgagccccggcgccgtggagatgagcacccccatgagcgccgagatgatggagatgagcaccgaggtgaccgagatgacccccagcccccccagcgaggtgaagatggagccctacgagtgccccgagtgcagcaccctgtgcgccacccccgaggagttcctggagcaccagggcacccacttcgacagcctggagaaggaggagagaaacggcctggaggaggaggaggaggacgacgaggaggacgaggaggacgacgaggagatggaggacgaggaggccatggccgaggtgggcgacgacgccgtgggcggcgacgagagcaccgccggctgggcccagggctgcggcgactgcccccagcaccagcccagcgccggcgccagaagacagcacagaagaaccgcccacagccccgccagcgccacccaccccttccactgcagccagtgccagagaagcttcagcagcgccaacagactgcaggcccacggcagagcccacgtgggcggcacccacgagtgcaccacctgcagcaaggtgttcaagaaggccgccagcctggagcagcacctgagactgcacagaggcgaggccagatacctgtgcgtggactgcggcagaggcttcggcaccgagctgaccctggtggcccacagaagagcccacaccgccaaccccctgcacagatgcagatgcggcaagaccttcagcaacatgaccaagttcctgtaccacagaagaacccacgccggcaagagcggcgccccccccaccggcgccaccgccccccccgcccccgccgagcccaccccccccccccccccccccgccccccccgcccagctgccctgcccccagtgcagcaagagcttcgccagcgccagcagactgagcagacacagaagagccgtgcacggcccccccgagagaagacacagatgcggcgtgtgcggcaagggcttcaagaagctgatccacgtgagaaaccacctgagaacccacaccggcgagagacccttccagtgccacagctgcggcaagaccttcgccagcctggccaacctgagcagacaccagctgacccacaccggcgccagaccctaccagtgcctggactgcggcaagagattcacccagagcagcaacctgcagcagcacagaagactgcacctgagacccgtggccttcgccagagcccccagactgcccatcaccggcctgtacaacaagagcccctactactgcggcacctgcggcagatggttcagagccatggccggcctgagactgcaccagagagtgcacgccagagccagaaccctgaccctgcagccccccagaagccccagccccgcccccccccccccccccgagccccagcagaccatcatgtgcaccgagctgggcgagaccatcgccatcatcgagaccagccagcccctggccctggaggacaccctgcagctgtgccaggccgccctgggcgccagcgaggccggcggcctgctgcagctggacaccgccttcgtgtag

SEQ ID NO: 106092 - DNA, 1983 bp, Artificial Sequence
  Description of Artificial Sequence: Synthetic coding sequence
atggcccacgccctggtgaccttcagagacgtggccatcgacttcagccagaaggagtgggagtgcctggacaccacccagagaaagctgtacagagacgtgatgctggagaactacaacaacctggtgagcctgggctacagcggcagcaagcccgacgtgatcaccctgctggagcagggcaaggagccctgcgtggtggccagagacgtgaccggcagacagtgccccggcctgctgagcagacacaagaccaagaagctgagcagcgagaaggacatccacgagatcagcctgagcaaggagagcatcatcgagaagagcaagaccctgagactgaagggcagcatcttcagaaacgagtggcagaacaagagcgagttcgagggccagcagggcctgaaggagagaagcatcagccagaagaagatcgtgagcaagaagatgagcaccgacagaaagagacccagcttcaccctgaaccagagaatccacaacagcgagaagagctgcgacagccacctggtgcagcacggcaagatcgacagcgacgtgaagcacgactgcaaggagtgcggcagcaccttcaacaacgtgtaccagctgaccctgcaccagaagatccacaccggcgagaagagctgcaagtgcgagaagtgcggcaaggtgttcagccacagctaccagctgaccctgcaccagagattccacaccggcgagaagccctacgagtgccaggagtgcggcaagaccttcaccctgtacccccagctgaacagacaccagaagatccacaccggcaagaagccctacatgtgcaagaagtgcgacaagggcttcttcagcagactggagctgacccagcacaagagaatccacaccggcaagaagagctacgagtgcaaggagtgcggcaaggtgttccagctgatcttctacttcaaggagcacgagagaatccacaccggcaagaagccctacgagtgcaaggagtgcggcaaggccttcagcgtgtgcggccagctgaccagacaccagaagatccacaccggcgtgaagccctacgagtgcaaggagtgcggcaagaccttcagactgagcttctacctgaccgagcacagaagaacccacgccggcaagaagccctacgagtgcaaggagtgcggcaagagcttcaacgtgagaggccagctgaacagacacaagaccatccacaccggcatcaagcccttcgcctgcaaggtgtgcgagaaggccttcagctacagcggcgacctgagagtgcacagcagaatccacaccggcgagaagccctacgagtgcaaggagtgcggcaaggccttcatgctgagaagcgtgctgaccgagcaccagagactgcacaccggcgtgaagccctacgagtgcaaggagtgcggcaagaccttcagagtgagaagccagatcagcctgcacaagaagatccacaccgacgtgaagccctacaagtgcgtgagatgcggcaagaccttcagattcggcttctacctgaccgagcaccagagaatccacaccggcgagaagccctacaagtgcaaggagtgcggcaaggccttcatcagaagaggcaacctgaaggagcacctgaagatccacagcggcctgaagccctacgactgcaaggagtgcggcaagagcttcagcagaagaggccagttcaccgagcaccagaagatccacaccggcgtgaagccctacaagtgcaaggagtgcggcaaggccttcagcagaagcgtggacctgagaatccaccagagaatccacaccggcgagaagccctacgagtgcaagcagtgcggcaaggccttcagactgaacagccacctgaccgagcaccagagaatccacaccggcgagaagccctacgagtgcaaggtgtgcagaaaggccttcagacagtacagccacctgtaccagcaccagaagacccacaacgtgatctag

SEQ ID NO: 106093 - DNA, 1887 bp, Artificial Sequence
  Description of Artificial Sequence: Synthetic coding sequence
atggcccacgccctggtgaccttcagagacgtggccatcgacttcagccagaaggagtgggagtgcctggacaccacccagagaaagctgtacagagacgtgatgctggagaactacaacaacctggtgagcctgggcctgctgagcagacacaagaccaagaagctgagcagcgagaaggacatccacgagatcagcctgagcaaggagagcatcatcgagaagagcaagaccctgagactgaagggcagcatcttcagaaacgagtggcagaacaagagcgagttcgagggccagcagggcctgaaggagagaagcatcagccagaagaagatcgtgagcaagaagatgagcaccgacagaaagagacccagcttcaccctgaaccagagaatccacaacagcgagaagagctgcgacagccacctggtgcagcacggcaagatcgacagcgacgtgaagcacgactgcaaggagtgcggcagcaccttcaacaacgtgtaccagctgaccctgcaccagaagatccacaccggcgagaagagctgcaagtgcgagaagtgcggcaaggtgttcagccacagctaccagctgaccctgcaccagagattccacaccggcgagaagccctacgagtgccaggagtgcggcaagaccttcaccctgtacccccagctgaacagacaccagaagatccacaccggcaagaagccctacatgtgcaagaagtgcgacaagggcttcttcagcagactggagctgacccagcacaagagaatccacaccggcaagaagagctacgagtgcaaggagtgcggcaaggtgttccagctgatcttctacttcaaggagcacgagagaatccacaccggcaagaagccctacgagtgcaaggagtgcggcaaggccttcagcgtgtgcggccagctgaccagacaccagaagatccacaccggcgtgaagccctacgagtgcaaggagtgcggcaagaccttcagactgagcttctacctgaccgagcacagaagaacccacgccggcaagaagccctacgagtgcaaggagtgcggcaagagcttcaacgtgagaggccagctgaacagacacaagaccatccacaccggcatcaagcccttcgcctgcaaggtgtgcgagaaggccttcagctacagcggcgacctgagagtgcacagcagaatccacaccggcgagaagccctacgagtgcaaggagtgcggcaaggccttcatgctgagaagcgtgctgaccgagcaccagagactgcacaccggcgtgaagccctacgagtgcaaggagtgcggcaagaccttcagagtgagaagccagatcagcctgcacaagaagatccacaccgacgtgaagccctacaagtgcgtgagatgcggcaagaccttcagattcggcttctacctgaccgagcaccagagaatccacaccggcgagaagccctacaagtgcaaggagtgcggcaaggccttcatcagaagaggcaacctgaaggagcacctgaagatccacagcggcctgaagccctacgactgcaaggagtgcggcaagagcttcagcagaagaggccagttcaccgagcaccagaagatccacaccggcgtgaagccctacaagtgcaaggagtgcggcaaggccttcagcagaagcgtggacctgagaatccaccagagaatccacaccggcgagaagccctacgagtgcaagcagtgcggcaaggccttcagactgaacagccacctgaccgagcaccagagaatccacaccggcgagaagccctacgagtgcaaggtgtgcagaaaggccttcagacagtacagccacctgtaccagcaccagaagacccacaacgtgatctag

SEQ ID NO: 106094 - DNA, 1887 bp, Artificial Sequence; identical to SEQ ID NO: 106093
  Description of Artificial Sequence: Synthetic coding sequence

SEQ ID NO: 106095 - DNA, 1983 bp, Artificial Sequence; identical to SEQ ID NO: 106092
  Description of Artificial Sequence: Synthetic coding sequence

SEQ ID NO: 106096 - DNA, 1500 bp, Artificial Sequence
  Description of Artificial Sequence: Synthetic coding sequence
atggcccagggcctggtgaccttcagagacgtggccatcgagttcagcctggaggagtggaagtgcctggagcccgcccagagagacctgtacagagaggtgaccctggagaacttcggccacctggccagcctgggcctgagcatcagcaagcccgacgtggtgagcctgctggagcagggcaaggagccctggatgatcgccaacgacgtgaccggcccctggtgccccgacctggagagcagatgcgagaagttcctgcagaaggacatcttcgagatcggcgccttcaactgggagatcatggagagcctgaagtgcagcgacctggagggcagcgacttcagagccgactgggagtgcgagggccagttcgagagacaggtgaacgaggagtgctacttcaagcaggtgaacgtgacctacggccacatgcccgtgttccagcaccacaccagccacaccgtgagacagagcagagagaccggcgagaagctgatggagtgccacgagtgcggcaaggccttcagcagaggcagccacctgatccagcaccagaagatccacaccggcgagaagcccttcggctgcaaggagtgcggcaaggccttcagcagagccagccacctggtgcagcaccagagaatccacaccggcgagaagccctacgactgcaaggactgcggcaaggccttcggcagaaccagcgagctgatcctgcaccagagactgcacaccggcgtgaagccctacgagtgcaaggagtgcggcaagaccttcagacagcacagccagctgatcctgcaccagagaacccacaccggcgagaagccctacgtgtgcaaggactgcggcaaggccttcatcagaggcagccagctgaccgtgcacagaagaatccacaccggcgccagaccctacgagtgcaaggagtgcggcaaggccttcagacagcacagccagctgaccgtgcaccagagaatccacaccggcgagaagccctacgagtgcaaggagtgcggcaagggcttcatccacagcagcgaggtgaccagacaccagagaatccacagcggcgagaagccctacgagtgcaaggagtgcggcaaggccttcagacagcacgcccagctgaccagacaccagagagtgcacaccggcgacagaccctacgagtgcaaggactgcggcaaggccttcagcagaagcagctacctgatccagcaccagagaatccacaccggcgacaagccctacgagtgcaaggagtgcggcaaggccttcatcagagtgagccagctgacccaccaccagagaatccacacctgcgagaagccctacgagtgcagagagtgcggcatggccttcatcagaagcagccagctgaccgagcaccagagaatccaccccggcatcaagccctacgagtgcagagagtgcggccaggccttcatcctgggcagccagctgatcgagcactacagaatccacaccggctag

SEQ ID NO: 106097 - DNA, 1620 bp, Artificial Sequence
  Description of Artificial Sequence: Synthetic coding sequence
atgagaagaggcccctgggagagatggagcctggccagccacagactggacgccggcctgtgcacctgccccagagaggagagcagagagatcagagccggccagatcgtgctgaaggccatggcccagggcctggtgaccttcagagacgtggccatcgagttcagcctggaggagtggaagtgcctggagcccgcccagagagacctgtacagagaggtgaccctggagaacttcggccacctggccagcctgggcctgagcatcagcaagcccgacgtggtgagcctgctggagcagggcaaggagccctggatgatcgccaacgacgtgaccggcccctggtgccccgacctggagagcagatgcgagaagttcctgcagaaggacatcttcgagatcggcgccttcaactgggagatcatggagagcctgaagtgcagcgacctggagggcagcgacttcagagccgactgggagtgcgagggccagttcgagagacaggtgaacgaggagtgctacttcaagcaggtgaacgtgacctacggccacatgcccgtgttccagcaccacaccagccacaccgtgagacagagcagagagaccggcgagaagctgatggagtgccacgagtgcggcaaggccttcagcagaggcagccacctgatccagcaccagaagatccacaccggcgagaagcccttcggctgcaaggagtgcggcaaggccttcagcagagccagccacctggtgcagcaccagagaatccacaccggcgagaagccctacgactgcaaggactgcggcaaggccttcggcagaaccagcgagctgatcctgcaccagagactgcacaccggcgtgaagccctacgagtgcaaggagtgcggcaagaccttcagacagcacagccagctgatcctgcaccagagaacccacaccggcgagaagccctacgtgtgcaaggactgcggcaaggccttcatcagaggcagccagctgaccgtgcacagaagaatccacaccggcgccagaccctacgagtgcaaggagtgcggcaaggccttcagacagcacagccagctgaccgtgcaccagagaatccacaccggcgagaagccctacgagtgcaaggagtgcggcaagggcttcatccacagcagcgaggtgaccagacaccagagaatccacagcggcgagaagccctacgagtgcaaggagtgcggcaaggccttcagacagcacgcccagctgaccagacaccagagagtgcacaccggcgacagaccctacgagtgcaaggactgcggcaaggccttcagcagaagcagctacctgatccagcaccagagaatccacaccggcgacaagccctacgagtgcaaggagtgcggcaaggccttcatcagagtgagccagctgacccaccaccagagaatccacacctgcgagaagccctacgagtgcagagagtgcggcatggccttcatcagaagcagccagctgaccgagcaccagagaatccaccccggcatcaagccctacgagtgcagagagtgcggccaggccttcatcctgggcagccagctgatcgagcactacagaatccacaccggctag

SEQ ID NO: 106098 - DNA, 1500 bp, Artificial Sequence; identical to SEQ ID NO: 106096
  Description of Artificial Sequence: Synthetic coding sequence

SEQ ID NO: 106099 - DNA, 2061 bp, Artificial Sequence
  Description of Artificial Sequence: Synthetic coding sequence
atgaccgagagccagggcaccgtgaccttcaaggacgtggccatcgacttcacccaggaggagtggaagagactggaccccgcccagagaaagctgtacagaaacgtgatgctggagaactacaacaacctgatcaccgtgggctaccccttcaccaagcccgacgtgatcttcaagctggagcaggaggaggagccctgggtgatggaggaggaggtgctgagaagacactggcagggcgagatctggggcgtggacgagcaccagaagaaccaggacagactgctgagacaggtggaggtgaagttccagaagaccctgaccgaggagaagggcaacgagtgccagaagaagttcgccaacgtgttccccctgaacagcgacttcttccccagcagacacaacctgtacgagtacgacctgttcggcaagtgcctggagcacaacttcgactgccacaacaacgtgaagtgcctgatgagaaaggagcactgcgagtacaacgagcccgtgaagagctacggcaacagcagcagccacttcgtgatcacccccttcaagtgcaaccactgcggcaagggcttcaaccagaccctggacctgatcagacacctgagaatccacaccggcgagaagccctacgagtgcagcaactgcagaaaggccttcagccacaaggagaagctgatcaagcactacaagatccacagcagagagcagagctacaagtgcaacgagtgcggcaaggccttcatcaagatgagcaacctgatcagacaccagagaatccacaccggcgagaagccctacgcctgcaaggagtgcgagaagagcttcagccagaagagcaacctgatcgaccacgagaagatccacaccggcgagaagccctacgagtgcaacgagtgcggcaaggccttcagccagaagcagagcctgatcgcccaccagaaggtgcacaccggcgagaagccctacgcctgcaacgagtgcggcaaggccttccccagaatcgccagcctggccctgcacatgagaagccacaccggcgagaagccctacaagtgcgacaagtgcggcaaggccttcagccagttcagcatgctgatcatccacgtgagaatccacaccggcgagaagccctacgagtgcaacgagtgcggcaaggccttcagccagagcagcgccctgaccgtgcacatgagaagccacaccggcgagaagccctacgagtgcaaggagtgcagaaaggccttcagccacaagaagaacttcatcacccaccagaagatccacaccagagagaagccctacgagtgcaacgagtgcggcaaggccttcatccagatgagcaacctggtgagacaccagagaatccacaccggcgagaagccctacatctgcaaggagtgcggcaaggccttcagccagaagagcaacctgatcgcccacgagaagatccacagcggcgagaagccctacgagtgcaacgagtgcggcaaggccttcagccagaagcagaacttcatcacccaccagaaggtgcacaccggcgagaagccctacgactgcaacgagtgcggcaaggccttcagccagatcgccagcctgaccctgcacctgagaagccacaccggcgagaagccctacgagtgcgacaagtgcggcaaggccttcagccagtgcagcctgctgaacctgcacatgagaagccacaccggcgagaagccctacgtgtgcaacgagtgcggcaaggccttcagccagagaaccagcctgatcgtgcacatgagaggccacaccggcgagaagccctacgagtgcaacaagtgcggcaaggccttcagccagagcagcagcctgaccatccacatcagaggccacaccggcgagaagcccttcgactgcagcaagtgcggcaaggccttcagccagatcagcagcctgaccctgcacatgagaaagcacaccggcgagaagccctaccactgcatcgagtgcggcaaggccttcagccagaagagccacctggtgagacaccagagaatccacacccactag

SEQ ID NO: 106100 - DNA, 1029 bp, Artificial Sequence
  Description of Artificial Sequence: Synthetic coding sequence
atgagaagccacaccggcgagaagccctacaagtgcgacaagtgcggcaaggccttcagccagttcagcatgctgatcatccacgtgagaatccacaccggcgagaagccctacgagtgcaacgagtgcggcaaggccttcagccagagcagcgccctgaccgtgcacatgagaagccacaccggcgagaagccctacgagtgcaaggagtgcagaaaggccttcagccacaagaagaacttcatcacccaccagaagatccacaccagagagaagccctacgagtgcaacgagtgcggcaaggccttcatccagatgagcaacctggtgagacaccagagaatccacaccggcgagaagccctacatctgcaaggagtgcggcaaggccttcagccagaagagcaacctgatcgcccacgagaagatccacagcggcgagaagccctacgagtgcaacgagtgcggcaaggccttcagccagaagcagaacttcatcacccaccagaaggtgcacaccggcgagaagccctacgactgcaacgagtgcggcaaggccttcagccagatcgccagcctgaccctgcacctgagaagccacaccggcgagaagccctacgagtgcgacaagtgcggcaaggccttcagccagtgcagcctgctgaacctgcacatgagaagccacaccggcgagaagccctacgtgtgcaacgagtgcggcaaggccttcagccagagaaccagcctgatcgtgcacatgagaggccacaccggcgagaagccctacgagtgcaacaagtgcggcaaggccttcagccagagcagcagcctgaccatccacatcagaggccacaccggcgagaagcccttcgactgcagcaagtgcggcaaggccttcagccagatcagcagcctgaccctgcacatgagaaagcacaccggcgagaagccctaccactgcatcgagtgcggcaaggccttcagccagaagagccacctggtgagacaccagagaatccacacccactag

SEQ ID NO: 106101 - DNA, 1584 bp, Artificial Sequence
  Description of Artificial Sequence: Synthetic coding sequence
atgagaaaggagcactgcgagtacaacgagcccgtgaagagctacggcaacagcagcagccacttcgtgatcacccccttcaagtgcaaccactgcggcaagggcttcaaccagaccctggacctgatcagacacctgagaatccacaccggcgagaagccctacgagtgcagcaactgcagaaaggccttcagccacaaggagaagctgatcaagcactacaagatccacagcagagagcagagctacaagtgcaacgagtgcggcaaggccttcatcaagatgagcaacctgatcagacaccagagaatccacaccggcgagaagccctacgcctgcaaggagtgcgagaagagcttcagccagaagagcaacctgatcgaccacgagaagatccacaccggcgagaagccctacgagtgcaacgagtgcggcaaggccttcagccagaagcagagcctgatcgcccaccagaaggtgcacaccggcgagaagccctacgcctgcaacgagtgcggcaaggccttccccagaatcgccagcctggccctgcacatgagaagccacaccggcgagaagccctacaagtgcgacaagtgcggcaaggccttcagccagttcagcatgctgatcatccacgtgagaatccacaccggcgagaagccctacgagtgcaacgagtgcggcaaggccttcagccagagcagcgccctgaccgtgcacatgagaagccacaccggcgagaagccctacgagtgcaaggagtgcagaaaggccttcagccacaagaagaacttcatcacccaccagaagatccacaccagagagaagccctacgagtgcaacgagtgcggcaaggccttcatccagatgagcaacctggtgagacaccagagaatccacaccggcgagaagccctacatctgcaaggagtgcggcaaggccttcagccagaagagcaacctgatcgcccacgagaagatccacagcggcgagaagccctacgagtgcaacgagtgcggcaaggccttcagccagaagcagaacttcatcacccaccagaaggtgcacaccggcgagaagccctacgactgcaacgagtgcggcaaggccttcagccagatcgccagcctgaccctgcacctgagaagccacaccggcgagaagccctacgagtgcgacaagtgcggcaaggccttcagccagtgcagcctgctgaacctgcacatgagaagccacaccggcgagaagccctacgtgtgcaacgagtgcggcaaggccttcagccagagaaccagcctgatcgtgcacatgagaggccacaccggcgagaagccctacgagtgcaacaagtgcggcaaggccttcagccagagcagcagcctgaccatccacatcagaggccacaccggcgagaagcccttcgactgcagcaagtgcggcaaggccttcagccagatcagcagcctgaccctgcacatgagaaagcacaccggcgagaagccctaccactgcatcgagtgcggcaaggccttcagccagaagagccacctggtgagacaccagagaatccacacccactag

SEQ ID NO: 106102 - DNA, 1551 bp, Artificial Sequence
  Description of Artificial Sequence: Synthetic coding sequence
atgttcgagcagctgaagcccatcgagcccagagactgctggagagaggccagagtgaagaagaagcccgtgaccttcgaggacgtggccgtgaacttcacccaggaggagtgggactgcctggacgccagccagagagtgctgtaccaggacgtgatgagcgagaccttcaagaacctgaccagcgtggccagaatcttcctgcacaagcccgagctgatcaccaagctggagcaggaggaggagcagtggagagagttcgtgcacctgcccaacaccgagggcctgagcgagggcaagaagaaggagctgagagagcagcaccccagcctgagagacgagggcaccagcgacgacaaggtgttcctggcctgcagaggcgccggccagtgccccctgagcgcccccgccggcaccatggacagaaccagagtgctgcaggccagccaggccggcccccccttcttctgctacacctgcggcaagtgcttcagcagaagaagctacctgtacagccaccagttcgtgcacaaccccaagctgaccaacagctgcagccagtgcggcaagctgttcagaagccccaagagcctgagctaccacagaagaatgcacctgggcgagagacccttctgctgcaccctgtgcgacaagacctactgcgacgccagcggcctgagcagacacagaagagtgcacctgggctacagaccccacagctgcagcgtgtgcggcaagagcttcagagaccagagcgagctgaagagacaccagaagatccaccagaaccaggagcccgtggacggcaaccaggagtgcaccctgagaatccccggcacccaggccgagttccagacccccatcgccagaagccagagaagcatccagggcctgctggacgtgaaccacgcccccgtggccagaagccaggagcccatcttcagaaccgagggccccatggcccagaaccaggccagcgtgctgaagaaccaggcccccgtgaccagaacccaggcccccatcaccggcaccctgtgccaggacgccagaagcaacagccaccccgtgaagcccagcagactgaacgtgttctgctgcccccactgcagcctgaccttcagcaagaagagctacctgagcagacaccagaaggcccacctgaccgagccccccaactactgcttccactgcagcaagagcttcagcagcttcagcagactggtgagacaccagcagacccactggaagcagaagagctacctgtgccccatctgcgacctgagcttcggcgagaaggagggcctgatggaccactggagaggctacaagggcaaggacctgtgccagagcagccaccacaagtgcagagtgatcctgggccagtggctgggcttcagccacgacgtgcccaccatggccggcgaggagtggaagcacggcggcgaccagagcccccccagaatccacacccccagaagaagaggcctgagagagaaggcctgcaagggcgacaagaccaaggaggccgtgagcatcctgaagcacaagtag

SEQ ID NO: 106103 - DNA, 1551 bp, Artificial Sequence; identical to SEQ ID NO: 106102
  Description of Artificial Sequence: Synthetic coding sequence

SEQ ID NO: 106104 - DNA, 1551 bp, Artificial Sequence; identical to SEQ ID NO: 106102
  Description of Artificial Sequence: Synthetic coding sequence

SEQ ID NO: 106105 - DNA, 1551 bp, Artificial Sequence; identical to SEQ ID NO: 106102
  Description of Artificial Sequence: Synthetic coding sequence

SEQ ID NO: 106106 - DNA, 636 bp, Artificial Sequence
  Description of Artificial Sequence: Synthetic coding sequence
tgagccagaagccaggagcccatcttcagaaccgagggccccatggcccagaaccaggccagcgtgctgaagaaccaggcccccgtgaccagaacccaggcccccatcaccggcaccctgtgccaggacgccagaagcaacagccaccccgtgaagcccagcagactgaacgtgttctgctgcccccactgcagcctgaccttcagcaagaagagctacctgagcagacaccagaaggcccacctgaccgagccccccaactactgcttccactgcagcaagagcttcagcagcttcagcagactggtgagacaccagcagacccactggaagcagaagagctacctgtgccccatctgcgacctgagcttcggcgagaaggagggcctgatggaccactggagaggctacaagggcaaggacctgtgccagagcagccaccacaagtgcagagtgatcctgggccagtggctgggcttcagccacgacgtgcccaccatggccggcgaggagtggaagcacggcggcgaccagagcccccccagaatccacacccccagaagaagaggcctgagagagaaggcctgcaagggcgacaagaccaaggaggccgtgagcatcctgaagcacaagtag

SEQ ID NO: 106107 - DNA, 1551 bp, Artificial Sequence; identical to SEQ ID NO: 106102
  Description of Artificial Sequence: Synthetic coding sequence

SEQ ID NO: 106108 - DNA, 1551 bp, Artificial Sequence; identical to SEQ ID NO: 106102
  Description of Artificial Sequence: Synthetic coding sequence

SEQ ID NO: 106109 - DNA, 1551 bp, Artificial Sequence; identical to SEQ ID NO: 106102
  Description of Artificial Sequence: Synthetic coding sequence

SEQ ID NO: 106110 - DNA, 1551 bp, Artificial Sequence; identical to SEQ ID NO: 106102
  Description of Artificial Sequence: Synthetic coding sequence

SEQ ID NO: 106111 - DNA, 1611 bp, Artificial Sequence
  Description of Artificial Sequence: Synthetic coding sequence
atgttcgagcagctgaagcccatcgagcccgtgcagaagaccctgccctgggtgggcgaggtggccgccaccctgcaggaggccatgaagagagactgctggagagaggccagagtgaagaagaagcccgtgaccttcgaggacgtggccgtgaacttcacccaggaggagtgggactgcctggacgccagccagagagtgctgtaccaggacgtgatgagcgagaccttcaagaacctgaccagcgtggccagaatcttcctgcacaagcccgagctgatcaccaagctggagcaggaggaggagcagtggagagagttcgtgcacctgcccaacaccgagggcctgagcgagggcaagaagaaggagctgagagagcagcaccccagcctgagagacgagggcaccagcgacgacaaggtgttcctggcctgcagaggcgccggccagtgccccctgagcgcccccgccggcaccatggacagaaccagagtgctgcaggccagccaggccggcccccccttcttctgctacacctgcggcaagtgcttcagcagaagaagctacctgtacagccaccagttcgtgcacaaccccaagctgaccaacagctgcagccagtgcggcaagctgttcagaagccccaagagcctgagctaccacagaagaatgcacctgggcgagagacccttctgctgcaccctgtgcgacaagacctactgcgacgccagcggcctgagcagacacagaagagtgcacctgggctacagaccccacagctgcagcgtgtgcggcaagagcttcagagaccagagcgagctgaagagacaccagaagatccaccagaaccaggagcccgtggacggcaaccaggagtgcaccctgagaatccccggcacccaggccgagttccagacccccatcgccagaagccagagaagcatccagggcctgctggacgtgaaccacgcccccgtggccagaagccaggagcccatcttcagaaccgagggccccatggcccagaaccaggccagcgtgctgaagaaccaggcccccgtgaccagaacccaggcccccatcaccggcaccctgtgccaggacgccagaagcaacagccaccccgtgaagcccagcagactgaacgtgttctgctgcccccactgcagcctgaccttcagcaagaagagctacctgagcagacaccagaaggcccacctgaccgagccccccaactactgcttccactgcagcaagagcttcagcagcttcagcagactggtgagacaccagcagacccactggaagcagaagagctacctgtgccccatctgcgacctgagcttcggcgagaaggagggcctgatggaccactggagaggctacaagggcaaggacctgtgccagagcagccaccacaagtgcagagtgatcctgggccagtggctgggcttcagccacgacgtgcccaccatggccggcgaggagtggaagcacggcggcgaccagagcccccccagaatccacacccccagaagaagaggcctgagagagaaggcctgcaagggcgacaagaccaaggaggccgtgagcatcctgaagcacaagtag

SEQ ID NO: 106112 - DNA, 1551 bp, Artificial Sequence; identical to SEQ ID NO: 106102
  Description of Artificial Sequence: Synthetic coding sequence

SEQ ID NO: 106113 - DNA, 1356 bp, Artificial Sequence
  Description of Artificial Sequence: Synthetic coding sequence
gccggcggcagccccgagagcctgctgttcttccagaagcccgtgaccttcgaggacgtggccgtgaacttcacccaggaggagtgggactgcctggacgccagccagagagtgctgtaccaggacgtgatgagcgagaccttcaagaacctgaccagcgtggccagaatcttcctgcacaagcccgagctgatcaccaagctggagcaggaggaggagcagtggagagagaccagagtgctgcaggccagccaggccggcccccccttcttctgctacacctgcggcaagtgcttcagcagaagaagctacctgtacagccaccagttcgtgcacaaccccaagctgaccaacagctgcagccagtgcggcaagctgttcagaagccccaagagcctgagctaccacagaagaatgcacctgggcgagagacccttctgctgcaccctgtgcgacaagacctactgcgacgccagcggcctgagcagacacagaagagtgcacctgggctacagaccccacagctgcagcgtgtgcggcaagagcttcagagaccagagcgagctgaagagacaccagaagatccaccagaaccaggagcccgtggacggcaaccaggagtgcaccctgagaatccccggcacccaggccgagttccagacccccatcgccagaagccagagaagcatccagggcctgctggacgtgaaccacgcccccgtggccagaagccaggagcccatcttcagaaccgagggccccatggcccagaaccaggccagcgtgctgaagaaccaggcccccgtgaccagaacccaggcccccatcaccggcaccctgtgccaggacgccagaagcaacagccaccccgtgaagcccagcagactgaacgtgttctgctgcccccactgcagcctgaccttcagcaagaagagctacctgagcagacaccagaaggcccacctgaccgagccccccaactactgcttccactgcagcaagagcttcagcagcttcagcagactggtgagacaccagcagacccactggaagcagaagagctacctgtgccccatctgcgacctgagcttcggcgagaaggagggcctgatggaccactggagaggctacaagggcaaggacctgtgccagagcagccaccacaagtgcagagtgatcctgggccagtggctgggcttcagccacgacgtgcccaccatggccggcgaggagtggaagcacggcggcgaccagagcccccccagaatccacacccccagaagaagaggcctgagagagaaggcctgcaagggcgacaagaccaaggaggccgtgagcatcctgaagcacaagtag

SEQ ID NO: 106114 - DNA, 1551 bp, Artificial Sequence; identical to SEQ ID NO: 106102
  Description of Artificial Sequence: Synthetic coding sequence

SEQ ID NO: 106115 - DNA, 1611 bp, Artificial Sequence; identical to SEQ ID NO: 106111
  Description of Artificial Sequence: Synthetic coding sequence

SEQ ID NO: 106116 - DNA, 1611 bp, Artificial Sequence; identical to SEQ ID NO: 106111
  Description of Artificial Sequence: Synthetic coding sequence

SEQ ID NO: 106117 - DNA, 1611 bp, Artificial Sequence; identical to SEQ ID NO: 106111
  Description of Artificial Sequence: Synthetic coding sequence

SEQ ID NO: 106118 - DNA, 1611 bp, Artificial Sequence; identical to SEQ ID NO: 106111
  Description of Artificial Sequence: Synthetic coding sequence

SEQ ID NO: 106119 - DNA, 1551 bp, Artificial Sequence; identical to SEQ ID NO: 106102
  Description of Artificial Sequence: Synthetic coding sequence

SEQ ID NO: 106120 - DNA, 1551 bp, Artificial Sequence; identical to SEQ ID NO: 106102
  Description of Artificial Sequence: Synthetic coding sequence

SEQ ID NO: 106121 - DNA, 1611 bp, Artificial Sequence; identical to SEQ ID NO: 106111
  Description of Artificial Sequence: Synthetic coding sequence

SEQ ID NO: 106122 - DNA, 1551 bp, Artificial Sequence; identical to SEQ ID NO: 106102
  Description of Artificial Sequence: Synthetic coding sequence

SEQ ID NO: 106123 - DNA, 1551 bp, Artificial Sequence; identical to SEQ ID NO: 106102
  Description of Artificial Sequence: Synthetic coding sequence

SEQ ID NO: 106124 - DNA, 1611 bp, Artificial Sequence; identical to SEQ ID NO: 106111
  Description of Artificial Sequence: Synthetic coding sequence

SEQ ID NO: 106125 - DNA, 1725 bp, Artificial Sequence
  Description of Artificial Sequence: Synthetic coding sequence
atggccgccgccgtgcccagaagacccacccagggcaccgtgaccttcgaggacgtggccgtgaacttcagccaggaggagtggtgcctgctgagcgaggcccagagatgcctgtacagagacgtgatgctggagaacctggccctgatcagcagcctgggctgctggtgcggcagcaaggacgaggaggccccctgcaagcagagaatcagcgtgcagagagagagccagagcagaacccccagagccggcgtgagccccaagaaggcccacccctgcgagatgtgcggcctgatcctggaggacgtgttccacttcgccgaccaccaggagacccaccacaagcagaagctgaacagaagcggcgcctgcggcaagaacctggacgacaccgcctacctgcaccagcaccagaagcagcacatcggcgagaagttctacagaaagagcgtgagagaggccagcttcgtgaagaagagaaagctgagagtgagccaggagcccttcgtgttcagagagttcggcaaggacgtgctgcccagcagcggcctgtgccaggaggaggccgccgtggagaagaccgacagcgagaccatgcacggcccccccttccaggagggcaagaccaactacagctgcggcaagagaaccaaggccttcagcaccaagcacagcgtgatcccccaccagaagctgttcaccagagacggctgctacgtgtgcagcgactgcggcaagagcttcagcagatacgtgagcttcagcaaccaccagagagaccacaccgccaagggcccctacgactgcggcgagtgcggcaagagctacagcagaaagagcagcctgatccagcaccagagagtgcacaccggccagaccgcctacccctgcgaggagtgcggcaagagcttcagccagaagggcagcctgatcagccaccagctggtgcacaccggcgagggcccctacgagtgcagagagtgcggcaagagcttcggccagaagggcaacctgatccagcaccagcagggccacaccggcgagagagcctaccactgcggcgagtgcggcaagagcttcagacagaagttctgcttcatcaaccaccagagagtgcacaccggcgagagaccctacaagtgcggcgagtgcggcaagagcttcggccagaagggcaacctggtgcaccaccagagaggccacaccggcgagagaccctacgagtgcaaggagtgcggcaagagcttcagatacagaagccacctgaccgagcaccagagactgcacaccggcgagagaccctacaactgcagagagtgcggcaagctgttcaacagaaagtaccacctgctggtgcacgagagagtgcacaccggcgagagaccctacgcctgcgaggtgtgcggcaagctgttcggcaacaagcacagcgtgaccatccaccagagaatccacaccggcgagagaccctacgagtgcagcgagtgcggcaagagcttcctgagcagcagcgccctgcacgtgcacaagagagtgcacagcggccagaagccctacaagtgcagcgagtgcggcaagagcttcagcgagtgcagcagcctgatcaagcacagaagaatccacaccggcgagagaccctacgagtgcaccaagtgcggcaagaccttccagagaagcagcaccctgctgcaccaccagagcagccacagaagaaaggccctgtag

SEQ ID NO: 106126 - DNA, 3804 bp, Artificial Sequence
  Description of Artificial Sequence: Synthetic coding sequence
atgggcgacatgaagacccccgacttcgacgacctgctggccgccttcgacatccccgaccccaccagcctggacgccaaggaggccatccagacccccagcgaggagaacgagagccccctgaagccccccggcatctgcatggacgagagcgtgagcctgagccacagcggcagcgcccccgacgtgcccgccgtgagcgtgatcgtgaagaacaccagcagacaggagagcttcgaggccgagaaggaccacatcacccccagcctgctgcacaacggcttcagaggcagcgacctgccccccgacccccacaactgcggcaagttcgacagcaccttcatgaacggcgacagcgccagaagcttccccggcaagctggagccccccaagagcgagcccctgcccaccttcaaccagttcagccccatcagcagccccgagcccgaggaccccatcaaggacaacggcttcggcatcaagcccaagcacagcgacagctacttccccccccccctgggctgcggcgccgtgggcggccccgtgctggaggccctggccaagttccccgtgcccgagctgcacatgttcgaccacttctgcaagaaggagcccaagcccgagcccctgcccctgggcagccagcaggagcacgagcagagcggccagaacaccgtggagccccacaaggaccccgacgccaccagattcttcggcgaggccctggagttcaacagccaccccagcaacagcatcggcgagagcaagggcctggccagagagctgggcacctgcagcagcgtgccccccagacagagactgaagcccgcccacagcaagctgagcagctgcgtggccgccctggtggccctgcaggccaagagagtggccagcgtgaccaaggaggaccagcccggccacaccaaggacctgagcggccccaccaaggagagcagcaagggcagccccaagatgcccaagagccccaagagccccagaagccccctggaggccaccagaaagagcatcaagcccagcgacagccccagaagcatctgcagcgacagcagcagcaagggcagccccagcgtggccgccagcagcccccccgccatccccaaggtgagaatcaagaccatcaagaccagcagcggcgagatcaagagaaccgtgaccagaatcctgcccgaccccgacgaccccagcaagagccccgtgggcagccccctgggcagcgccatcgccgaggcccccagcgagatgcccggcgacgaggtgcccgtggaggagcacttccccgaggccggcaccaacagcggcagcccccagggcgccagaaagggcgacgagagcatgaccaaggccagcgacagcagcagccccagctgcagcagcggccccagagtgcccaagggcgccgcccccggcagccagaccggcaagaagcagcagagcaccgccctgcaggccagcaccctggcccccgccaacctgctgcccaaggccgtgcacctggccaacctgaacctggtgccccacagcgtggccgccagcgtgaccgccaagagcagcgtgcagagaagaagccagccccagctgacccagatgagcgtgcccctggtgcaccaggtgaagaaggccgcccccctgatcgtggaggtgttcaacaaggtgctgcacagcagcaaccccgtgcccctgtacgcccccaacctgagcccccccgccgacagcagaatccacgtgcccgccagcggctactgctgcctggagtgcggcgacgccttcgccctggagaagagcctgagccagcactacggcagaagaagcgtgcacatcgaggtgctgtgcaccctgtgcagcaagaccctgctgttcttcaacaagtgcagcctgctgagacacgccagagaccacaagagcaagggcctggtgatgcagtgcagccagctgctggtgaagcccatcagcgccgaccagatgttcgtgagcgcccccgtgaacagcaccgcccccgccgcccccgcccccagcagcagccccaagcacggcctgaccagcggcagcgccagcccccccccccccgccctgcccctgtaccccgaccccgtgagactgatcagatacagcatcaagtgcctggagtgccacaagcagatgagagactacatggtgctggccgcccacttccagagaaccaccgaggagaccgagggcctgacctgccaggtgtgccagatgctgctgcccaaccagtgcagcttctgcgcccaccagagaatccacgcccacaagagcccctactgctgccccgagtgcggcgtgctgtgcagaagcgcctacttccagacccacgtgaaggagaactgcctgcactacgccagaaaggtgggctacagatgcatccactgcggcgtggtgcacctgaccctggccctgctgaagagccacatccaggagagacactgccaggtgttccacaagtgcgccttctgccccatggccttcaagaccgccagcagcaccgccgaccacagcgccacccagcaccccacccagccccacagacccagccagctgatctacaagtgcagctgcgagatggtgttcaacaagaagagacacatccagcagcacttctaccagaacgtgagcaagacccaggtgggcgtgttcaagtgccccgagtgccccctgctgttcgtgcagaagcccgagctgatgcagcacgtgaagagcacccacggcgtgcccagaaacgtggacgagctgagcagcctgcagagcagcgccgacaccagcagcagcagacccggcagcagagtgcccaccgagccccccgccaccagcgtggccgccagaagcagcagcctgcccagcggcagatggggcagacccgaggcccacagaagagtggaggccagacccagactgagaaacaccggctggacctgccaggagtgccaggagtgggtgcccgacagagagagctacgtgagccacatgaagaagagccacggcagaaccctgaagagatacccctgcagacagtgcgagcagagcttccacacccccaacagcctgagaaagcacatcagaaacaaccacgacaccgtgaagaagttctacacctgcggctactgcaccgaggacagccccagcttccccagacccagcctgctggagagccacatcagcctgatgcacggcatcagaaaccccgacctgagccagaccagcaaggtgaagccccccggcggccacagcccccaggtgaaccacctgaagagacccgtgagcggcgtgggcgacgcccccggcaccagcaacggcgccaccgtgagcagcaccaagagacacaagagcctgttccagtgcgccaagtgcagcttcgccaccgacagcggcctggagttccagagccacatcccccagcaccaggtggacagcagcaccgcccagtgcctgctgtgcggcctgtgctacaccagcgccagcagcctgagcagacacctgttcatcgtgcacaaggtgagagaccaggaggaggaggaggaggaggaggccgccgccgccgagatggccgtggaggtggccgagcccgaggagggcagcggcgaggaggtgcccatggagaccagagagaacggcctggaggagtgcgccggcgagcccctgagcgccgaccccgaggccagaagactgctgggccccgcccccgaggacgacggcggccacaacgaccacagccagccccaggccagccaggaccaggacagccacaccctgagcccccaggtgtag

SEQ ID NO: 106127 - DNA, 3804 bp, Artificial Sequence; identical to SEQ ID NO: 106126
  Description of Artificial Sequence: Synthetic coding sequence

SEQ ID NO: 106128 - DNA, 2379 bp, Artificial Sequence
  Description of Artificial Sequence: Synthetic coding sequence
atggccgccatcaacccctgggccagctggggcgccctgaccgaccagagctggggcatgaccgccgtggacccctgggccagctgggccctgtgcccccagtaccccgcctggcacgtggagggcagcctggaggagggcagaagagccaccggcctgcccgccgcccaggtgcaggagcccgtgaccttcaaggacgtggccgtggacttcacccaggaggagtggggccagctggacctggtgcagagaaccctgtacagagacgtgatgctggagacctacggccacctgctgagcgtgggcaaccagatcgccaagcccgaggtgatcagcctgctggagcagggcgaggagccctggagcgtggagcaggcctgcccccagagaacctgccccgagtgggtgagaaacctggagagcaaggccctgatccccgcccagagcatcttcgaggaggagcagagccacggcatgaagctggagagatacatctgggacgacccctggttcagcagactggaggtgctgggctgcaaggaccagctggagatgtaccacatgaaccagagcaccgccatgagacagatggtgttcatgcagaagcaggtgctgagccagagaagcagcgagttctgcggcctgggcgccgagttcagccagaacctgaacttcgtgcccagccagagagtgagccagatcgagcacttctacaagcccgacacccacgcccagagctggagatgcgacagcgccatcatgtacgccgacaaggtgacctgcgagaacaacgactacgacaagaccgtgtaccagagcatccagcccatctaccccgccagaatccagaccggcgacaacctgttcaagtgcaccgacgccgtgaagagcttcaaccacatcatccacttcggcgaccacaagggcatccacaccggcgagaagctgtacgagtacaaggagtgccaccagatcttcaaccagagccccagcttcaacgagcaccccagactgcacgtgggcgagaaccagtacaactacaaggagtacgagaacatcttctacttcagcagcttcatggagcaccagaagatcggcaccgtggagaaggcctacaagtacaacgagtgggagaaggtgttcggctacgacagcttcctgacccagcacaccagcacctacaccgccgagaagccctacgactacaacgagtgcggcaccagcttcatctggagcagctacctgatccagcacaagaagacccacaccggcgagaagccctacgagtgcgacaagtgcggcaaggtgttcagaaacagaagcgccctgaccaagcacgagagaacccacaccggcatcaagccctacgagtgcaacaagtgcggcaaggccttcagctggaacagccacctgatcgtgcacaagagaatccacaccggcgagaagccctacgtgtgcaacgagtgcggcaagagcttcaactggaacagccacctgatcggccaccagagaacccacaccggcgagaagcccttcgagtgcaccgagtgcggcaagagcttcagctggagcagccacctgatcgcccacatgagaatgcacaccggcgagaagcccttcaagtgcgacgagtgcgagaaggccttcagagactacagcgccctgagcaagcacgagagaacccacagcggcgccaagccctacaagtgcaccgagtgcggcaagagcttcagctggagcagccacctgatcgcccaccagagaacccacaccggcgagaagccctacaactgccaggagtgcggcaaggccttcagagagagaagcgccctgaccaagcacgagatcatccacagcggcatcaagccctacgagtgcaacaagtgcggcaagagctgcagccagatggcccacctggtgagacaccagagaacccacaccggcgagaagccctacgagtgcaacaagtgcggcaagagcttcagccagagctgccacctggtggcccacagaagaatccacaccggcgagaagccctacaagtgcaaccagtgcgagagaagcttcaactgcagcagccacctgatcgcccacagaagaacccacaccggcgagaagccctacagatgcaacgagtgcggcaaggccttcaacgagagcagcagcctgatcgtgcacctgagaaaccacaccggcgagaagccctacaagtgcaaccactgcgagaaggccttctgcaagaacagcagcctgatcatccaccagagaatgcacagcggcgagaagagattcatctgcagcgagtgcggcaaggccttcagcggccacagcgccctgctgcagcaccagagaaaccacagcgaggagaagctgaactag

SEQ ID NO: 106129 - DNA, 2109 bp, Artificial Sequence
  Description of Artificial Sequence: Synthetic coding sequence
atgctggagacctacggccacctgctgagcgtgggcaaccagatcgccaagcccgaggtgatcagcctgctggagcagggcgaggagccctggagcgtggagcaggcctgcccccagagaacctgccccgagtgggtgagaaacctggagagcaaggccctgatccccgcccagagcatcttcgaggaggagcagagccacggcatgaagctggagagatacatctgggacgacccctggttcagcagactggaggtgctgggctgcaaggaccagctggagatgtaccacatgaaccagagcaccgccatgagacagatggtgttcatgcagaagcaggtgctgagccagagaagcagcgagttctgcggcctgggcgccgagttcagccagaacctgaacttcgtgcccagccagagagtgagccagatcgagcacttctacaagcccgacacccacgcccagagctggagatgcgacagcgccatcatgtacgccgacaaggtgacctgcgagaacaacgactacgacaagaccgtgtaccagagcatccagcccatctaccccgccagaatccagaccggcgacaacctgttcaagtgcaccgacgccgtgaagagcttcaaccacatcatccacttcggcgaccacaagggcatccacaccggcgagaagctgtacgagtacaaggagtgccaccagatcttcaaccagagccccagcttcaacgagcaccccagactgcacgtgggcgagaaccagtacaactacaaggagtacgagaacatcttctacttcagcagcttcatggagcaccagaagatcggcaccgtggagaaggcctacaagtacaacgagtgggagaaggtgttcggctacgacagcttcctgacccagcacaccagcacctacaccgccgagaagccctacgactacaacgagtgcggcaccagcttcatctggagcagctacctgatccagcacaagaagacccacaccggcgagaagccctacgagtgcgacaagtgcggcaaggtgttcagaaacagaagcgccctgaccaagcacgagagaacccacaccggcatcaagccctacgagtgcaacaagtgcggcaaggccttcagctggaacagccacctgatcgtgcacaagagaatccacaccggcgagaagccctacgtgtgcaacgagtgcggcaagagcttcaactggaacagccacctgatcggccaccagagaacccacaccggcgagaagcccttcgagtgcaccgagtgcggcaagagcttcagctggagcagccacctgatcgcccacatgagaatgcacaccggcgagaagcccttcaagtgcgacgagtgcgagaaggccttcagagactacagcgccctgagcaagcacgagagaacccacagcggcgccaagccctacaagtgcaccgagtgcggcaagagcttcagctggagcagccacctgatcgcccaccagagaacccacaccggcgagaagccctacaactgccaggagtgcggcaaggccttcagagagagaagcgccctgaccaagcacgagatcatccacagcggcatcaagccctacgagtgcaacaagtgcggcaagagctgcagccagatggcccacctggtgagacaccagagaacccacaccggcgagaagccctacgagtgcaacaagtgcggcaagagcttcagccagagctgccacctggtggcccacagaagaatccacaccggcgagaagccctacaagtgcaaccagtgcgagagaagcttcaactgcagcagccacctgatcgcccacagaagaacccacaccggcgagaagccctacagatgcaacgagtgcggcaaggccttcaacgagagcagcagcctgatcgtgcacctgagaaaccacaccggcgagaagccctacaagtgcaaccactgcgagaaggccttctgcaagaacagcagcctgatcatccaccagagaatgcacagcggcgagaagagattcatctgcagcgagtgcggcaaggccttcagcggccacagcgccctgctgcagcaccagagaaaccacagcgaggagaagctgaactag

SEQ ID NO: 106130 - DNA, 1527 bp, Artificial Sequence
  Description of Artificial Sequence: Synthetic coding sequence
atggccgccatcaacccctgggccagctggggcgccctgaccgaccagagctggggcatgaccgccgtggacccctgggccagctgggccctgtgcccccagtaccccgcctggcacgtggagggcagcctggaggagggcagaagagccaccggcctgcccgccgcccaggtgcaggagcccgtgaccttcaaggacgtggccgtggacttcacccaggaggagtggggccagctggacctggtgcagagaaccctgtacagagacgtgatgctggagacctacggccacctgctgagcgtgggcaaccagatcgccaagcccgaggtgatcagcctgctggagcagggcgaggagccctggagcgtggagcaggcctgcccccagagaacctgccccgagtgggtgagaaacctggagagcaaggccctgatccccgcccagagcatcttcgaggaggagcagagccacggcatgaagctggagagatacatctgggacgacccctggttcagcagactggaggtgctgggctgcaaggaccagctggagatgtaccacatgaaccagagcaccgccatgagacagatggtgttcatgcagaagcaggtgctgagccagagaagcagcgagttctgcggcctgggcgccgagttcagccagaacctgaacttcgtgcccagccagagagtgagccagatcgagcacttctacaagcccgacacccacgcccagagctggagatgcgacagcgccatcatgtacgccgacaaggtgacctgcgagaacaacgactacgacaagaccgtgtaccagagcatccagcccatctaccccgccagaatccagaccggcgacaacctgttcaagtgcaccgacgccgtgaagagcttcaaccacatcatccacttcggcgaccacaagggcatccacaccggcgagaagctgtacgagtacaaggagtgccaccagatcttcaaccagagccccagcttcaacgagcaccccagactgcacgtgggcgagaaccagtacaactacaaggagtacgagaacatcttctacttcagcagcttcatggagcaccagaagatcggcaccgtggagaaggcctacaagtacaacgagtgggagaaggtgttcggctacgacagcttcctgacccagcacaccagcacctacaccgccgagaagccctacgactacaacgagtgcggcaccagcttcatctggagcagctacctgatccagcacaagaagacccacaccggcgagaagccctacgagtgcgacaagtgcggcaaggtgttcagaaacagaagcgccctgaccaagcacgagagaacccacaccggcatcaagccctacgagtgcaacaagtgcggcaaggccttcagctggaacagccacctgatcgtgcacaagagaatccacaccggcgagaagccctacgtgtgcaacgagtgcggcaagagcttcaactggaacagccacctgatcggccaccagagaacccacaccggctag

SEQ ID NO: 106131 - DNA, 2523 bp, Artificial Sequence
  Description of Artificial Sequence: Synthetic coding sequence
atgaaggaggacaagagcagcatcagagaggccatcagcaaggccaagagcaccgccaacatcaagaccgagcaggagggcgaggccagcgagaagagcctgcacctgagcccccagcacatcacccaccagaccatgcccatcggccagagaggcagcgagcagggcaagagagtggagaacatcaacggcaccagctaccccagcctgcagcagaagaccaacgccgtgaagaagctgcacaagtgcgacgagtgcggcaagagcttcaagtacaacagcagactggtgcagcacaagatcatgcacaccggcgagaagagatacgagtgcgacgactgcggcggcaccttcagaagcagcagcagcctgagagtgcacaagagaatccacaccggcgagaagccctacaagtgcgaggagtgcggcaaggcctacatgagctacagcagcctgatcaaccacaagagcacccacagcggcgagaagaactgcaagtgcgacgagtgcggcaagagcttcaactacagcagcgtgctggaccagcacaagagaatccacaccggcgagaagccctacgagtgcggcgagtgcggcaaggccttcagaaacagcagcggcctgagagtgcacaagagaatccacaccggcgagaagccctacgagtgcgacatctgcggcaagaccttcagcaacagcagcggcctgagagtgcacaagagaatccacaccggcgagaagccctacgagtgcgacgagtgcggcaaggccttcatcacctgcagaaccctgctgaaccacaagagcatccacttcggcgacaagccctacaagtgcgacgagtgcgagaagagcttcaactacagcagcctgctgatccagcacaaggtgatccacaccggcgagaagccctacgagtgcgacgagtgcggcaaggccttcagaaacagcagcggcctgatcgtgcacaagagaatccacaccggcgagaagccctacaagtgcgacgtgtgcggcaaggccttcagctacagcagcggcctggccgtgcacaagagcatccaccccggcaagaaggcccacgagtgcaaggagtgcggcaagagcttcagctacaacagcctgctgctgcagcacagaaccatccacaccggcgagagaccctacgtgtgcgacgtgtgcggcaagaccttcagaaacaacgccggcctgaaggtgcacagaagactgcacaccggcgagaagccctacaagtgcgacgtgtgcggcaaggcctacatcagcagaagcagcctgaagaaccacaagggcatccacctgggcgagaagccctacaagtgcagctactgcgagaagagcttcaactacagcagcgccctggagcagcacaagagaatccacaccagagagaagcccttcggctgcgacgagtgcggcaaggccttcagaaacaacagcggcctgaaggtgcacaagagaatccacaccggcgagagaccctacaagtgcgaggagtgcggcaaggcctacatcagcctgagcagcctgatcaaccacaagagcgtgcaccccggcgagaagcccttcaagtgcgacgagtgcgagaaggccttcatcacctacagaaccctgaccaaccacaagaaggtgcacctgggcgagaagccctacaagtgcgacgtgtgcgagaagagcttcaactacaccagcctgctgagccagcacagaagagtgcacaccagagagaagccctacgagtgcgacagatgcgagaaggtgttcagaaacaacagcagcctgaaggtgcacaagagaatccacaccggcgagagaccctacgagtgcgacgtgtgcggcaaggcctacatcagccacagcagcctgatcaaccacaagagcacccaccccggcagaaccccccacacctgcgacgagtgcggcaaggccttcttcagcagcagaaccctgatcagccacaagagagtgcacctgggcgagaagcccttcaagtgcgtggagtgcggcaagagcttcagctacagcagcctgctgagccagcacaagagaatccacaccggcgagaagccctacgtgtgcgacagatgcggcaaggccttcagaaacagcagcggcctgaccgtgcacaagagaatccacaccggcgagaagccctacgagtgcgacgagtgcggcaaggcctacatcagccacagcagcctgatcaaccacaagagcgtgcaccagggcaagcagccctacaactgcgagtgcggcaagagcttcaactacagaagcgtgctggaccagcacaagagaatccacaccggcaagaagccctacagatgcaacgagtgcggcaaggccttcaacatcagaagcaacctgaccaagcacaagagaacccacaccggcgaggagagcctgaacgtgatctacgtgggcagctacagcggcaccagccagaagagaacctacgagggcggcaacgccctggacggcggcagaatgagaatgcccctgtag

SEQ ID NO: 106132 - DNA, 1497 bp, Artificial Sequence
  Description of Artificial Sequence: Synthetic coding sequence
atgagctacagcagcctgatcaaccacaagagcacccacagcggcgagaagaactgcaagtgcgacgagtgcggcaagagcttcaactacagcagcgtgctggaccagcacaagagaatccacaccggcgagaagccctacgagtgcggcgagtgcggcaaggccttcagaaacagcagcggcctgagagtgcacaagagaatccacaccggcgagaagccctacgagtgcgacatctgcggcaagaccttcagcaacagcagcggcctgagagtgcacaagagaatccacaccggcgagaagccctacgagtgcgacgagtgcggcaaggccttcatcacctgcagaaccctgctgaaccacaagagcatccacttcggcgacaagccctacaagtgcgacgagtgcggcaaggccttcagaaacaacagcggcctgaaggtgcacaagagaatccacaccggcgagagaccctacaagtgcgaggagtgcggcaaggcctacatcagcctgagcagcctgatcaaccacaagagcgtgcaccccggcgagaagcccttcaagtgcgacgagtgcgagaaggccttcatcacctacagaaccctgaccaaccacaagaaggtgcacctgggcgagaagccctacaagtgcgacgtgtgcgagaagagcttcaactacaccagcctgctgagccagcacagaagagtgcacaccagagagaagccctacgagtgcgacagatgcgagaaggtgttcagaaacaacagcagcctgaaggtgcacaagagaatccacaccggcgagagaccctacgagtgcgacgtgtgcggcaaggcctacatcagccacagcagcctgatcaaccacaagagcacccaccccggcagaaccccccacacctgcgacgagtgcggcaaggccttcttcagcagcagaaccctgatcagccacaagagagtgcacctgggcgagaagcccttcaagtgcgtggagtgcggcaagagcttcagctacagcagcctgctgagccagcacaagagaatccacaccggcgagaagccctacgtgtgcgacagatgcggcaaggccttcagaaacagcagcggcctgaccgtgcacaagagaatccacaccggcgagaagccctacgagtgcgacgagtgcggcaaggcctacatcagccacagcagcctgatcaaccacaagagcgtgcaccagggcaagcagccctacaactgcgagtgcggcaagagcttcaactacagaagcgtgctggaccagcacaagagaatccacaccggcaagaagccctacagatgcaacgagtgcggcaaggccttcaacatcagaagcaacctgaccaagcacaagagaacccacaccggcgaggagagcctgaacgtgatctacgtgggcagctacagcggcaccagccagaagagaacctacgagggcggcaacgccctggacggcggcagaatgagaatgcccctgtag

SEQ ID NO: 106133 - DNA, 2703 bp, Artificial Sequence
  Description of Artificial Sequence: Synthetic coding sequence
atgagccacctgaagaccagcaccgaggacgaggagcccaccgaggagtacgagaacgtgggcaacgccgccagcaagtggcccaaggtggaggaccccatgcccgagagcaaggtgggcgacacctgcgtgtgggacagcaaggtggagaaccagcagaagaagcccgtggagaacagaatgaaggaggacaagagcagcatcagagaggccatcagcaaggccaagagcaccgccaacatcaagaccgagcaggagggcgaggccagcgagaagagcctgcacctgagcccccagcacatcacccaccagaccatgcccatcggccagagaggcagcgagcagggcaagagagtggagaacatcaacggcaccagctaccccagcctgcagcagaagaccaacgccgtgaagaagctgcacaagtgcgacgagtgcggcaagagcttcaagtacaacagcagactggtgcagcacaagatcatgcacaccggcgagaagagatacgagtgcgacgactgcggcggcaccttcagaagcagcagcagcctgagagtgcacaagagaatccacaccggcgagaagccctacaagtgcgaggagtgcggcaaggcctacatgagctacagcagcctgatcaaccacaagagcacccacagcggcgagaagaactgcaagtgcgacgagtgcggcaagagcttcaactacagcagcgtgctggaccagcacaagagaatccacaccggcgagaagccctacgagtgcggcgagtgcggcaaggccttcagaaacagcagcggcctgagagtgcacaagagaatccacaccggcgagaagccctacgagtgcgacatctgcggcaagaccttcagcaacagcagcggcctgagagtgcacaagagaatccacaccggcgagaagccctacgagtgcgacgagtgcggcaaggccttcatcacctgcagaaccctgctgaaccacaagagcatccacttcggcgacaagccctacaagtgcgacgagtgcgagaagagcttcaactacagcagcctgctgatccagcacaaggtgatccacaccggcgagaagccctacgagtgcgacgagtgcggcaaggccttcagaaacagcagcggcctgatcgtgcacaagagaatccacaccggcgagaagccctacaagtgcgacgtgtgcggcaaggccttcagctacagcagcggcctggccgtgcacaagagcatccaccccggcaagaaggcccacgagtgcaaggagtgcggcaagagcttcagctacaacagcctgctgctgcagcacagaaccatccacaccggcgagagaccctacgtgtgcgacgtgtgcggcaagaccttcagaaacaacgccggcctgaaggtgcacagaagactgcacaccggcgagaagccctacaagtgcgacgtgtgcggcaaggcctacatcagcagaagcagcctgaagaaccacaagggcatccacctgggcgagaagccctacaagtgcagctactgcgagaagagcttcaactacagcagcgccctggagcagcacaagagaatccacaccagagagaagcccttcggctgcgacgagtgcggcaaggccttcagaaacaacagcggcctgaaggtgcacaagagaatccacaccggcgagagaccctacaagtgcgaggagtgcggcaaggcctacatcagcctgagcagcctgatcaaccacaagagcgtgcaccccggcgagaagcccttcaagtgcgacgagtgcgagaaggccttcatcacctacagaaccctgaccaaccacaagaaggtgcacctgggcgagaagccctacaagtgcgacgtgtgcgagaagagcttcaactacaccagcctgctgagccagcacagaagagtgcacaccagagagaagccctacgagtgcgacagatgcgagaaggtgttcagaaacaacagcagcctgaaggtgcacaagagaatccacaccggcgagagaccctacgagtgcgacgtgtgcggcaaggcctacatcagccacagcagcctgatcaaccacaagagcacccaccccggcagaaccccccacacctgcgacgagtgcggcaaggccttcttcagcagcagaaccctgatcagccacaagagagtgcacctgggcgagaagcccttcaagtgcgtggagtgcggcaagagcttcagctacagcagcctgctgagccagcacaagagaatccacaccggcgagaagccctacgtgtgcgacagatgcggcaaggccttcagaaacagcagcggcctgaccgtgcacaagagaatccacaccggcgagaagccctacgagtgcgacgagtgcggcaaggcctacatcagccacagcagcctgatcaaccacaagagcgtgcaccagggcaagcagccctacaactgcgagtgcggcaagagcttcaactacagaagcgtgctggaccagcacaagagaatccacaccggcaagaagccctacagatgcaacgagtgcggcaaggccttcaacatcagaagcaacctgaccaagcacaagagaacccacaccggcgaggagagcctgaacgtgatctacgtgggcagctacagcggcaccagccagaagagaacctacgagggcggcaacgccctggacggcggcagaatgagaatgcccctgtag

SEQ ID NO: 106134 - DNA, 483 bp, Artificial Sequence
  Description of Artificial Sequence: Synthetic coding sequence
atgcccgagagcaaggtgggcgacacctgcgtgtgggacagcaaggtggagaaccagcagaagaagcccgtggagaacagaatgaaggaggacaagagcagcatcagagaggccatcagcaaggccaagagcaccgccaacatcaagaccgagcaggagggcgaggccagcgagaagagcctgcacctgagcccccagcacatcacccaccagaccatgcccatcggccagagaggcagcgagcagggcaagagagtggagaacatcaacggcaccagctaccccagcctgcagcagaagaccaacgccgtgaagaagctgcacaagtgcgacgagtgcggcaagagcttcaagtacaacagcagactggtgcagcacaagatcatgcacaccggcgagaagagatacgagtgcgacgactgcggcggcaccttcagaagcagcagcagcctgagagtgcacaagagaatccacaccggctag

SEQ ID NO: 106135 - DNA, 315 bp, Artificial Sequence
  Description of Artificial Sequence: Synthetic coding sequence
atgcccgagagcaaggtgggcgacacctgcgtgtgggacagcaaggtggagaaccagcagaagaagcccgtggagaacagaatgaaggaggacaagagcagcatcagagaggccatcagcaaggccaagagcaccgccaacatcaagaccgagcaggagggcgaggccagcgagaagagcctgcacctgagcccccagcacatcacccaccagaccatgcccatcggccagagaggcagcgagcagggcaagagagtggagaacatcaacggcaccagctaccccagcctgcagcagaagaccaacgccgtgtag

SEQ ID NO: 106136 - DNA, 237 bp, Artificial Sequence
  Description of Artificial Sequence: Synthetic coding sequence
atgcccgagagcaaggtgggcgacacctgcgtgtgggacagcaaggtggagaaccagcagaagaagcccgtggagaacagaatgaaggaggacaagagcagcatcagagaggccatcagcaaggccaagagcaccgccaacatcaagaccgagcaggagggcgaggccagcgagaagagcctgcacctgagcccccagcacatcacccaccagaccatgcccatcggccagagatag

SEQ ID NO: 106137 - DNA, 2604 bp, Artificial Sequence
  Description of Artificial Sequence: Synthetic coding sequence
atgcccgagagcaaggtgggcgacacctgcgtgtgggacagcaaggtggagaaccagcagaagaagcccgtggagaacagaatgaaggaggacaagagcagcatcagagaggccatcagcaaggccaagagcaccgccaacatcaagaccgagcaggagggcgaggccagcgagaagagcctgcacctgagcccccagcacatcacccaccagaccatgcccatcggccagagaggcagcgagcagggcaagagagtggagaacatcaacggcaccagctaccccagcctgcagcagaagaccaacgccgtgaagaagctgcacaagtgcgacgagtgcggcaagagcttcaagtacaacagcagactggtgcagcacaagatcatgcacaccggcgagaagagatacgagtgcgacgactgcggcggcaccttcagaagcagcagcagcctgagagtgcacaagagaatccacaccggcgagaagccctacaagtgcgaggagtgcggcaaggcctacatgagctacagcagcctgatcaaccacaagagcacccacagcggcgagaagaactgcaagtgcgacgagtgcggcaagagcttcaactacagcagcgtgctggaccagcacaagagaatccacaccggcgagaagccctacgagtgcggcgagtgcggcaaggccttcagaaacagcagcggcctgagagtgcacaagagaatccacaccggcgagaagccctacgagtgcgacatctgcggcaagaccttcagcaacagcagcggcctgagagtgcacaagagaatccacaccggcgagaagccctacgagtgcgacgagtgcggcaaggccttcatcacctgcagaaccctgctgaaccacaagagcatccacttcggcgacaagccctacaagtgcgacgagtgcgagaagagcttcaactacagcagcctgctgatccagcacaaggtgatccacaccggcgagaagccctacgagtgcgacgagtgcggcaaggccttcagaaacagcagcggcctgatcgtgcacaagagaatccacaccggcgagaagccctacaagtgcgacgtgtgcggcaaggccttcagctacagcagcggcctggccgtgcacaagagcatccaccccggcaagaaggcccacgagtgcaaggagtgcggcaagagcttcagctacaacagcctgctgctgcagcacagaaccatccacaccggcgagagaccctacgtgtgcgacgtgtgcggcaagaccttcagaaacaacgccggcctgaaggtgcacagaagactgcacaccggcgagaagccctacaagtgcgacgtgtgcggcaaggcctacatcagcagaagcagcctgaagaaccacaagggcatccacctgggcgagaagccctacaagtgcagctactgcgagaagagcttcaactacagcagcgccctggagcagcacaagagaatccacaccagagagaagcccttcggctgcgacgagtgcggcaaggccttcagaaacaacagcggcctgaaggtgcacaagagaatccacaccggcgagagaccctacaagtgcgaggagtgcggcaaggcctacatcagcctgagcagcctgatcaaccacaagagcgtgcaccccggcgagaagcccttcaagtgcgacgagtgcgagaaggccttcatcacctacagaaccctgaccaaccacaagaaggtgcacctgggcgagaagccctacaagtgcgacgtgtgcgagaagagcttcaactacaccagcctgctgagccagcacagaagagtgcacaccagagagaagccctacgagtgcgacagatgcgagaaggtgttcagaaacaacagcagcctgaaggtgcacaagagaatccacaccggcgagagaccctacgagtgcgacgtgtgcggcaaggcctacatcagccacagcagcctgatcaaccacaagagcacccaccccggcagaaccccccacacctgcgacgagtgcggcaaggccttcttcagcagcagaaccctgatcagccacaagagagtgcacctgggcgagaagcccttcaagtgcgtggagtgcggcaagagcttcagctacagcagcctgctgagccagcacaagagaatccacaccggcgagaagccctacgtgtgcgacagatgcggcaaggccttcagaaacagcagcggcctgaccgtgcacaagagaatccacaccggcgagaagccctacgagtgcgacgagtgcggcaaggcctacatcagccacagcagcctgatcaaccacaagagcgtgcaccagggcaagcagccctacaactgcgagtgcggcaagagcttcaactacagaagcgtgctggaccagcacaagagaatccacaccggcaagaagccctacagatgcaacgagtgcggcaaggccttcaacatcagaagcaacctgaccaagcacaagagaacccacaccggcgaggagagcctgaacgtgatctacgtgggcagctacagcggcaccagccagaagagaacctacgagggcggcaacgccctggacggcggcagaatgagaatgcccctgtag

SEQ ID NO: 106138 - DNA, 1386 bp, Artificial Sequence
  Description of Artificial Sequence: Synthetic coding sequence
atggacagcgtggccttcgaggacgtggccgtgaacttcaccctggaggagtgggccctgctggaccccagccagaagaacctgtacagagacgtgatgagagagaccttcagaaacctggccagcgtgggcaagcagtgggaggaccagaacatcgaggaccccttcaagatccccagaagaaacatcagccacatccccgagagactgtgcgagagcaaggagggcggccagggcgaggagaccttcagccagatccccgacggcatcctgaacaagaagacccccggcgtgaagccctgcgagagcagcgtgtgcggcgaggtgggcatgggccccagcagcctgaacagacacatcagagaccacaccggcagagagcccaacgagtaccaggagtacggcaagaagagctacaccagaaaccagtgcggcagagccctgagctaccacagaagcttccccgtgagagagagaacccaccccggcggcaagccctacgactgcaaggagtgcggcgagaccttcatcagcctggtgagcatcagaagacacatgctgacccacagaggcggcgtgccctacaagtgcaaggtgtgcggcaaggccttcgactaccccagcctgttcagaatccacgagagaagccacaccggcgagaagccctacgagtgcaagcagtgcggcaaggccttcagctgcagcagctacatcagaatccacgagagaacccacaccggcgacaagccctacgagtgcaagcagtgcggcaaggccttcagctgcagcaagtacatcagaatccacgagagaacccacaccggcgagaagccctacgagtgcaagcagtgcggcaaggccttcagatgcgccagcagcgtgagaagccacgagagaacccacaccggcgagaagctgttcgagtgcaaggagtgcggcaaggccctgacctgcctggccagcgtgagaagacacatgatcaagcacaccggcaacggcccctacaagtgcaaggtgtgcggcaaggccttcgacttccccagcagcttcagaatccacgagagaacccacaccggcgagaagccctacgactgcaagcagtgcggcaaggccttcagctgcagcagcagcttcagaaagcacgagagaatccacaccggcgagaagccctacaagtgcaccaagtgcggcaaggccttcagcagaagcagctacttcagaatccacgagagaacccacaccggcgagaagccctacgagtgcaagcagtgcggcaaggccttcagcagaagcacctacttcagagtgcacgagaagatccacaccggcgagaagccctacgagaaccccaaccccaacgccagcgtggtgcccgtgctgagctag

SEQ ID NO: 106139 - DNA, 3168 bp, Artificial Sequence
  Description of Artificial Sequence: Synthetic coding sequence
atggtgggcagccacgccgacatggcccccgccagcaccgccgagggcgccggcgagaagcccggccccgccgcccccgcccccgccgcccagtacgagtgcggcgagtgcggcaagagcttcagatggagcagcagactgctgcaccaccagagaacccacaccggcgagagaccctacaagtgccccgactgccccaaggccttcaagggcagcagcgccctgctgtaccaccagagaggccacaccggcgagagaccctaccagtgccccgactgccccaaggccttcaagagaagcagcctgctgcagatccacagaagcgtgcacaccggcctgagagccttcatctgcggccagtgcggcctggccttcaagtggagcagccactaccagtaccacctgagacagcacaccggcgagagaccctacccctgccccgactgccccaaggccttcaagaacagcagcagcctgagaagacacagacacgtgcacaccggcgagagaccctacacctgcggcgtgtgcggcaagagcttcacccagagcaccaacctgagacagcaccagagagtgcacaccggcgagagacccttcagatgccccctgtgccccaagaccttcacccacagcagcaacctgctgctgcaccagagaacccacggcgccgcccccgcccccggcaccgccagcgccgccccccccccccagagcagagagcccggcaaggtgttcgtgtgcgacgcctacctgcagagacacctgcagccccacagcccccccgccccccccgcccccccccccccccccccccccgtggtgcccgagctgttcctggccgccgccgagaccaccgtggagctggtgtacagatgcgacggctgcgagcagggcttcagcagcgaggagctgctgctggagcaccagccctgccccggccccgacgccgccccccagccccaggaggcccccgccgaggcccccaaggccgaccagccccccagccccctgccccagccccccccccccgccgccgcccccgcccccggcttcgcctgcctgccctgcggcaagagcttcagaaccgtggccggcctgagcagacaccagcacagccacggcgccgccggcggccaggccttcagatgcggcagctgcgacggcagcttcccccagctggccagcctgctggcccaccagcagtgccacgtggaggaggccgccgccggcagaccccccccccaggccgaggccgccgaggtgacctgcccccaggagcccctggcccccgccgcccccgtgcccccccccccccccagcgcccccgccagcgccgagagaccctacaagtgcgccgagtgcggcaagagcttcaagggcagcagcggcctgagataccacctgagagaccacaccggcgagagaccctaccagtgcggcgagtgcggcaaggccttcaagagaagcagcctgctggccatccaccagagagtgcacaccggcctgagagccttcacctgcggccagtgcggcctgaccttcaagtggagcagccactaccagtaccacctgagactgcacagcggcgagagaccctacgcctgcggcgagtgcggcaaggccttcagaaacaccagctgcctgagaagacacagacacgtgcacaccggcgagagaccccacgcctgcggcgtgtgcggcaagagcttcgcccagaccagcaacctgagacagcaccagagagtgcacaccggcgagagacccttcagatgccccctgtgccccaagaccttcacccacagcagcaacctgctgctgcaccagagaacccacagcgccgagagacccttcacctgccccatctgcggcagaggcttcgtgatggccgcctacctgcagagacacctgagaacccacgcccccgccaacaccccccccagcaccaccgcccccgccgccggcccccagccccccgcccccctggccgccgccagagccccccccgccacccaggacgtgcacgtgctgccccacctgcaggccaccctgagcctggaggtggccggcggcaccgcccaggcccccagcctgggccccgccgcccccaacagccagaccttcctgctggtgcagaccgcccagggcctgcagctgatccccagcagcgtgcagccccccacccccccccccccccccgccccccccaagctgatcctgctgcccagcagcagcgccggcgccggcggcggcagagccagacagggccccagagccgtgggcaaggccggccagggcgccggcgtggtgtggctgcccggccccggcggcctgggcgtgcagggcgccgccagcgccggcgccagcggcaccggccagagcctgatcgtgctgcagaacgtgggcggcggcgaggccggcccccaggagatgagcggcgtgcagctgcagcccctgagacccgcccccgaggtgaccaccgtgcagctgcagcccgcccaggaggtgaccaccgtgcagctgcagcccgcccaggaggtgaccaccgtgcagctgcagcccgcccaggaggtgaccaccgtgcagctgcagcccgtggccggccagctgagcaacagcagcggcggcgccgtggccaccgaggcccccaacctgctggtggtgcagagcggcgccgccgaggagctgctgaccggccccggccccggcgaggccggcgacggcgaggccagcaccggcgtggtgcaggacgtgctgttcgagaccctgcagaccgacgagggcctgcagagcgtgctggtgctgagcggcgccgacggcgagcagaccagactgtgcgtgcaggaggtggagaccctgccccccggcctgaccgagccccccgccaccggcccccccggccagaagctgctgatcatcagaagcgcccccgccaccgagctgctggacagcagcaacaccggcggcggcaccgccaccctgcagctgctggcccccccccccagcggccccgccagcggccccgccggcctgcccggcgcccccgccagccagatggtgcaggtggtgcccgccggcgccggccccggcgtgatgaccccccagggcctgcccagcatccagatcgtgcagaccctgcccgccgtgcagctggtgcacaccttctag

SEQ ID NO: 106140 - DNA, 1602 bp, Artificial Sequence
  Description of Artificial Sequence: Synthetic coding sequence
atggacagataccagggcaaccaggacagagtgctgagacaggtgaccgtgatcagcagagagaccctgaccgacgagatgggcagcaagtacagcgccttcggcaagatgttcaacagatgcaccgacctggcccccctgagccagaagttccacaagttcgacagctgcgagaacagcctgaagagcaacagcgacctgctgaactacaacagaagctacgccagaaagaaccccaccaagagattcagatgcggcagaccccccaagtacaacgccagctgcagcgtgcccgagaaggagggcttcatccacaccggcatggagccctacggcgacagccagtgcgagaaggtgctgagccacaagcaggcccacgtgcagtacaagaagttccaggccagagagaagcccaacgtgtgcagcatgtgcggcaaggccttcatcaagaagagccagctgatcatccaccagagaatccacaccggcgagaagccctacgtgtgcggcgactgcagaaaggccttcagcgagaagagccacctgatcgtgcaccagagaatccacaccggcgagaagccctacgagtgcaccaagtacggcagagccttcagcagaaagagccccttcaccgtgcaccagagagtgcacaccggcgagaagccctacgagtgcttcgagtgccccaaggccttcagccagaagagccacctgatcatccaccagagagtgcacaccagagagaagcccttcgagtgcagcgagtgcagaaaggccttctgcgagatgagccacctgttcatccaccagatcacccacaccggcaagaagccctacgagtgcaccgagtgcggcaagaccttccccagaaagacccagctgatcatccaccagagaacccacaccggcgagaagccctacaagtgcggcgagtgcggcaagaccttctgccagcagagccacctgatcggccaccagagaatccacaccggcgagaagccctacgtgtgcaccgactgcggcaaggccttcagccagaagagccacctgaccggccaccagagactgcacaccggcgagaagccctacatgtgcaccgagtgcggcaagagcttcagccagaagagccccctgatcatccaccagagaatccacaccggcgagaagccctaccagtgcggcgagtgcggcaagaccttcagccagaagagcctgctgatcatccacctgagagtgcacaccggcgagaagccctacgagtgcaccgagtgcggcagagccttcagcctgaagagccacctgatcctgcaccagagaggccacaccggcgagaagccctacgagtgcagcgagtgcggcaaggccttctgcggcaagagccccctgatcatccaccagaagacccaccccagagagaagacccccgagtgcgccgagagcggcatgaccttcttctggaagagccagatgatcacctaccagagaagacacaccggcgagaagcccagcagatgcagcgactgcggcaaggccttctgccagcacgtgtacttcaccggccaccagaacccctacagaaaggacaccctgtacatctgctag

SEQ ID NO: 106141 - DNA, 1974 bp, Artificial Sequence
  Description of Artificial Sequence: Synthetic coding sequence
atgatcgagagccaggagcccgtgaccttcgaggacgtggccgtggacttcacccaggaggagtggcagcagctgaaccccgcccagaagaccctgcacagagacgtgatgctggagacctacaaccacctggtgagcgtgggctgcagcggcatcaagcccgacgtgatcttcaagctggagcacggcaaggacccctggatcatcgagagcgagctgagcagatggatctaccccgacagagtgaagggcctggagagcagccagcagatcatcagcggcgagctgctgttccagagagagatcctggagagagcccccaaggacaacagcctgtacagcgtgctgaagatctggcacatcgacaaccagatggacagataccagggcaaccaggacagagtgctgagacaggtgaccgtgatcagcagagagaccctgaccgacgagatgggcagcaagtacagcgccttcggcaagatgttcaacagatgcaccgacctggcccccctgagccagaagttccacaagttcgacagctgcgagaacagcctgaagagcaacagcgacctgctgaactacaacagaagctacgccagaaagaaccccaccaagagattcagatgcggcagaccccccaagtacaacgccagctgcagcgtgcccgagaaggagggcttcatccacaccggcatggagccctacggcgacagccagtgcgagaaggtgctgagccacaagcaggcccacgtgcagtacaagaagttccaggccagagagaagcccaacgtgtgcagcatgtgcggcaaggccttcatcaagaagagccagctgatcatccaccagagaatccacaccggcgagaagccctacgtgtgcggcgactgcagaaaggccttcagcgagaagagccacctgatcgtgcaccagagaatccacaccggcgagaagccctacgagtgcaccaagtacggcagagccttcagcagaaagagccccttcaccgtgcaccagagagtgcacaccggcgagaagccctacgagtgcttcgagtgccccaaggccttcagccagaagagccacctgatcatccaccagagagtgcacaccagagagaagcccttcgagtgcagcgagtgcagaaaggccttctgcgagatgagccacctgttcatccaccagatcacccacaccggcaagaagccctacgagtgcaccgagtgcggcaagaccttccccagaaagacccagctgatcatccaccagagaacccacaccggcgagaagccctacaagtgcggcgagtgcggcaagaccttctgccagcagagccacctgatcggccaccagagaatccacaccggcgagaagccctacgtgtgcaccgactgcggcaaggccttcagccagaagagccacctgaccggccaccagagactgcacaccggcgagaagccctacatgtgcaccgagtgcggcaagagcttcagccagaagagccccctgatcatccaccagagaatccacaccggcgagaagccctaccagtgcggcgagtgcggcaagaccttcagccagaagagcctgctgatcatccacctgagagtgcacaccggcgagaagccctacgagtgcaccgagtgcggcagagccttcagcctgaagagccacctgatcctgcaccagagaggccacaccggcgagaagccctacgagtgcagcgagtgcggcaaggccttctgcggcaagagccccctgatcatccaccagaagacccaccccagagagaagacccccgagtgcgccgagagcggcatgaccttcttctggaagagccagatgatcacctaccagagaagacacaccggcgagaagcccagcagatgcagcgactgcggcaaggccttctgccagcacgtgtacttcaccggccaccagaacccctacagaaaggacaccctgtacatctgctag

SEQ ID NO: 106142 - DNA, 645 bp, Artificial Sequence
  Description of Artificial Sequence: Synthetic coding sequence
atgatcgagagccaggagcccgtgaccttcgaggacgtggccgtggacttcacccaggaggagtggcagcagctgaaccccgcccagaagaccctgcacagagacgtgatgctggagacctacaaccacctggtgagcgtgggctgcagcggcatcaagcccgacgtgatcttcaagctggagcacggcaaggacccctggatcatcgagagcgagctgagcagatggatctaccccgacagagtgaagggcctggagagcagccagcagatcatcagcggcgagctgctgttccagagagagatcctggagagagcccccaaggacaacagcctgtacagcgtgctgaagatctggcacatcgacaaccagatggacagataccagggcaaccaggacagagtgctgagacaggtgaccgtgatcagcagagagaccctgaccgacgagatgggcagcaagtacagcgccttcggcaagatgttcaacagatgcaccgacctggcccccctgagccagaagttccacaagttcgacagctgcgagaacagcctgaagagcaacagcgacctgctgaactacaacagaagctacgccagaaagaaccccaccaagagattcagatgcggcagaccccccaagtag

SEQ ID NO: 106143 - DNA, 1932 bp, Artificial Sequence
  Description of Artificial Sequence: Synthetic coding sequence
atgatcgagagccaggaggagtggcagcagctgaaccccgcccagaagaccctgcacagagacgtgatgctggagacctacaaccacctggtgagcgtgggctgcagcggcatcaagcccgacgtgatcttcaagctggagcacggcaaggacccctggatcatcgagagcgagctgagcagatggatctaccccgacagagtgaagggcctggagagcagccagcagatcatcagcggcgagctgctgttccagagagagatcctggagagagcccccaaggacaacagcctgtacagcgtgctgaagatctggcacatcgacaaccagatggacagataccagggcaaccaggacagagtgctgagacaggtgaccgtgatcagcagagagaccctgaccgacgagatgggcagcaagtacagcgccttcggcaagatgttcaacagatgcaccgacctggcccccctgagccagaagttccacaagttcgacagctgcgagaacagcctgaagagcaacagcgacctgctgaactacaacagaagctacgccagaaagaaccccaccaagagattcagatgcggcagaccccccaagtacaacgccagctgcagcgtgcccgagaaggagggcttcatccacaccggcatggagccctacggcgacagccagtgcgagaaggtgctgagccacaagcaggcccacgtgcagtacaagaagttccaggccagagagaagcccaacgtgtgcagcatgtgcggcaaggccttcatcaagaagagccagctgatcatccaccagagaatccacaccggcgagaagccctacgtgtgcggcgactgcagaaaggccttcagcgagaagagccacctgatcgtgcaccagagaatccacaccggcgagaagccctacgagtgcaccaagtacggcagagccttcagcagaaagagccccttcaccgtgcaccagagagtgcacaccggcgagaagccctacgagtgcttcgagtgccccaaggccttcagccagaagagccacctgatcatccaccagagagtgcacaccagagagaagcccttcgagtgcagcgagtgcagaaaggccttctgcgagatgagccacctgttcatccaccagatcacccacaccggcaagaagccctacgagtgcaccgagtgcggcaagaccttccccagaaagacccagctgatcatccaccagagaacccacaccggcgagaagccctacaagtgcggcgagtgcggcaagaccttctgccagcagagccacctgatcggccaccagagaatccacaccggcgagaagccctacgtgtgcaccgactgcggcaaggccttcagccagaagagccacctgaccggccaccagagactgcacaccggcgagaagccctacatgtgcaccgagtgcggcaagagcttcagccagaagagccccctgatcatccaccagagaatccacaccggcgagaagccctaccagtgcggcgagtgcggcaagaccttcagccagaagagcctgctgatcatccacctgagagtgcacaccggcgagaagccctacgagtgcaccgagtgcggcagagccttcagcctgaagagccacctgatcctgcaccagagaggccacaccggcgagaagccctacgagtgcagcgagtgcggcaaggccttctgcggcaagagccccctgatcatccaccagaagacccaccccagagagaagacccccgagtgcgccgagagcggcatgaccttcttctggaagagccagatgatcacctaccagagaagacacaccggcgagaagcccagcagatgcagcgactgcggcaaggccttctgccagcacgtgtacttcaccggccaccagaacccctacagaaaggacaccctgtacatctgctag

SEQ ID NO: 106144 - DNA, 5937 bp, Artificial Sequence
  Description of Artificial Sequence: Synthetic coding sequence
atgagcagacccagattcaaccccagaggcgacttccccctgcagagacccagagcccccaaccccagcggcatgagaccccccggccccttcatgagacccggcagcatgggcctgcccagattctaccccgccggcagagccagaggcatcccccacagattcgccggccacgagagctaccagaacatgggcccccagagaatgaacgtgcaggtgacccagcacagaaccgaccccagactgaccaaggagaagctggacttccacgaggcccagcagaagaagggcaagccccacggcagcagatgggacgacgagccccacatcagcgccagcgtggccgtgaagcagagcagcgtgacccaggtgaccgagcagagccccaaggtgcagagcagatacaccaaggagagcgccagcagcatcctggccagcttcggcctgagcaacgaggacctggaggagctgagcagataccccgacgagcagctgacccccgagaacatgcccctgatcctgagagacatcagaatgagaaagatgggcagaagactgcccaacctgcccagccagagcagaaacaaggagaccctgggcagcgaggccgtgagcagcaacgtgatcgactacggccacgccagcaagtacggctacaccgaggaccccctggaggtgagaatctacgaccccgagatccccaccgacgaggtggagaacgagttccagagccagcagaacatcagcgccagcgtgcccaaccccaacgtgatctgcaacagcatgttccccgtggaggacgtgttcagacagatggacttccccggcgagagcagcaacaacagaagcttcttcagcgtggagagcggcaccaagatgagcggcctgcacatcagcggcggccagagcgtgctggagcccatcaagagcgtgaaccagagcatcaaccagaccgtgagccagaccatgagccagagcctgatcccccccagcatgaaccagcagcccttcagcagcgagctgatcagcagcgtgagccagcaggagagaatcccccacgagcccgtgatcaacagcagcaacgtgcacgtgggcagcagaggcagcaagaagaactaccagagccaggccgacatccccatcagaagccccttcggcatcgtgaaggccagctggctgcccaagttcagccacgccgacgcccagaagatgaagagactgcccacccccagcatgatgaacgactactacgccgccagccccagaatcttcccccacctgtgcagcctgtgcaacgtggagtgcagccacctgaaggactggatccagcaccagaacaccagcacccacatcgagagctgcagacagctgagacagcagtaccccgactggaaccccgagatcctgcccagcagaagaaacgagggcaacagaaaggagaacgagacccccagaagaagaagccacagccccagccccagaagaagcagaagaagcagcagcagccacagattcagaagaagcagaagccccatgcactacatgtacagacccagaagcagaagccccagaatctgccacagattcatcagcagatacagaagcagaagcagaagcagaagcccctacagaatcagaaaccccttcagaggcagccccaagtgcttcagaagcgtgagccccgagagaatgagcagaagaagcgtgagaagcagcgacagaaagaaggccctggaggacgtggtgcagagaagcggccacggcaccgagttcaacaagcagaagcacctggaggccgccgacaagggccacagccccgcccagaagcccaagaccagcagcggcaccaagcccagcgtgaagcccaccagcgccaccaagagcgacagcaacctgggcggccacagcatcagatgcaagagcaagaacctggaggacgacaccctgagcgagtgcaagcaggtgagcgacaaggccgtgagcctgcagagaaagctgagaaaggagcagagcctgcactacggcagcgtgctgctgatcaccgagctgcccgaggacggctgcaccgaggaggacgtgagaaagctgttccagcccttcggcaaggtgaacgacgtgctgatcgtgccctacagaaaggaggcctacctggagatggagttcaaggaggccatcaccgccatcatgaagtacatcgagaccacccccctgaccatcaagggcaagagcgtgaagatctgcgtgcccggcaagaagaaggcccagaacaaggaggtgaagaagaagaccctggagagcaagaaggtgagcgccagcaccctgaagagagacgccgacgccagcaaggccgtggagatcgtgaccagcaccagcgccgccaagaccggccaggccaaggccagcgtggccaaggtgaacaagagcaccggcaagagcgccagcagcgtgaagagcgtggtgaccgtggccgtgaagggcaacaaggccagcatcaagaccgccaagagcggcggcaagaagagcctggaggccaagaagaccggcaacgtgaagaacaaggacagcaacaagcccgtgaccatccccgagaacagcgagatcaagaccagcatcgaggtgaaggccaccgagaactgcgccaaggaggccatcagcgacgccgccctggaggccaccgagaacgagcccctgaacaaggagaccgaggagatgtgcgtgatgctggtgagcaacctgcccaacaagggctacagcgtggaggaggtgtacgacctggccaagcccttcggcggcctgaaggacatcctgatcctgagcagccacaagaaggcctacatcgagatcaacagaaaggccgccgagagcatggtgaagttctacacctgcttccccgtgctgatggacggcaaccagctgagcatcagcatggcccccgagaacatgaacatcaaggacgaggaggccatcttcatcaccctggtgaaggagaacgaccccgaggccaacatcgacaccatctacgacagattcgtgcacctggacaacctgcccgaggacggcctgcagtgcgtgctgtgcgtgggcctgcagttcggcaaggtggaccaccacgtgttcatcagcaacagaaacaaggccatcctgcagctggacagccccgagagcgcccagagcatgtacagcttcctgaagcagaacccccagaacatcggcgaccacatgctgacctgcagcctgagccccaagatcgacctgcccgaggtgcagatcgagcacgaccccgagctggagaaggagagccccggcctgaagaacagccccatcgacgagagcgaggtgcagaccgccaccgacagccccagcgtgaagcccaacgagctggaggaggagagcacccccagcatccagaccgagaccctggtgcagcaggaggagccctgcgaggaggaggccgagaaggccacctgcgacagcgacttcgccgtggagaccctggagctggagacccagggcgaggaggtgaaggaggagatccccctggtggccagcgccagcgtgagcatcgagcagttcaccgagaacgccgaggagtgcgccctgaaccagcagatgttcaacagcgacctggagaagaagggcgccgagatcatcaaccccaagaccgccctgctgcccagcgacagcgtgttcgccgaggagagaaacctgaagggcatcctggaggagagccccagcgaggccgaggacttcatcagcggcatcacccagaccatggtggaggccgtggccgaggtggagaagaacgagaccgtgagcgagatcctgcccagcacctgcatcgtgaccctggtgcccggcatccccaccggcgacgagaagaccgtggacaagaagaacatcagcgagaagaagggcaacatggacgagaaggaggagaaggagttcaacaccaaggagaccagaatggacctgcagatcggcaccgagaaggccgagaagaacgagggcagaatggacgccgagaaggtggagaagatggccgccatgaaggagaagcccgccgagaacaccctgttcaaggcctaccccaacaagggcgtgggccaggccaacaagcccgacgagaccagcaagaccagcatcctggccgtgagcgacgtgagcagcagcaagcccagcatcaaggccgtgatcgtgagcagccccaaggccaaggccaccgtgagcaagaccgagaaccagaagagcttccccaagagcgtgcccagagaccagatcaacgccgagaagaagctgagcgccaaggagttcggcctgctgaagcccaccagcgccagaagcggcctggccgagagcagcagcaagttcaagcccacccagagcagcctgaccagaggcggcagcggcagaatcagcgccctgcagggcaagctgagcaagctggactacagagacatcaccaagcagagccaggagaccgaggccagacccagcatcatgaagagagacgacagcaacaacaagaccctggccgagcagaacaccaagaaccccaagagcaccaccggcagaagcagcaagagcaaggaggagcccctgttccccttcaacctggacgagttcgtgaccgtggacgaggtgatcgaggaggtgaaccccagccaggccaagcagaaccccctgaagggcaagagaaaggagaccctgaagaacgtgcccttcagcgagctgaacctgaagaagaagaagggcaagaccagcacccccagaggcgtggagggcgagctgagcttcgtgaccctggacgagatcggcgaggaggaggacgccgccgcccacctggcccaggccctggtgaccgtggacgaggtgatcgacgaggaggagctgaacatggaggagatggtgaagaacagcaacagcctgttcaccctggacgagctgatcgaccaggacgactgcatcagccacagcgagcccaaggacgtgaccgtgctgagcgtggccgaggagcaggacctgctgaagcaggagagactggtgaccgtggacgagatcggcgaggtggaggagctgcccctgaacgagagcgccgacatcaccttcgccaccctgaacaccaagggcaacgagggcgacaccgtgagagacagcatcggcttcatcagcagccaggtgcccgaggaccccagcaccctggtgaccgtggacgagatccaggacgacagcagcgacctgcacctggtgaccctggacgaggtgaccgaggaggacgaggacagcctggccgacttcaacaacctgaaggaggagctgaacttcgtgaccgtggacgaggtgggcgaggaggaggacggcgacaacgacctgaaggtggagctggcccagagcaagaacgaccaccccaccgacaagaagggcaacagaaagaagagagccgtggacaccaagaagaccaagctggagagcctgagccaggtgggccccgtgaacgagaacgtgatggaggaggacctgaagaccatgatcgagagacacctgaccgccaagacccccaccaagagagtgagaatcggcaagaccctgcccagcgagaaggccgtggtgaccgagcccgccaagggcgaggaggccttccagatgagcgaggtggacgaggagagcggcctgaaggacagcgagcccgagagaaagagaaagaagaccgaggacagcagcagcggcaagagcgtggccagcgacgtgcccgaggagctggacttcctggtgcccaaggccggcttcttctgccccatctgcagcctgttctacagcggcgagaaggccatgaccaaccactgcaagagcaccagacacaagcagaacaccgagaagttcatggccaagcagagaaaggagaaggagcagaacgaggccgaggagagaagcagcagatag

SEQ ID NO: 106145 - DNA, 3420 bp, Artificial Sequence
  Description of Artificial Sequence: Synthetic coding sequence
atgagcagacccagattcaaccccagaggcgacttccccctgcagagacccagagcccccaaccccagcggcatgagaccccccggccccttcatgagacccggcagcatgggcctgcccagattctaccccgccggcagagccagaggcatcccccacagattcgccggccacgagagctaccagaacatgggcccccagagaatgaacgtgcaggtgacccagcacagaaccgaccccagactgaccaaggagaagctggacttccacgaggcccagcagaagaagggcaagccccacggcagcagatgggacgacgagccccacatcagcgccagcgtggccgtgaagcagagcagcgtgacccaggtgaccgagcagagccccaaggtgcagagcagatacaccaaggagagcgccagcagcatcctggccagcttcggcctgagcaacgaggacctggaggagctgagcagataccccgacgagcagctgacccccgagaacatgcccctgatcctgagagacatcagaatgagaaagatgggcagaagactgcccaacctgcccagccagagcagaaacaaggagaccctgggcagcgaggccgtgagcagcaacgtgatcgactacggccacgccagcaagtacggctacaccgaggaccccctggaggtgagaatctacgaccccgagatccccaccgacgaggtggagaacgagttccagagccagcagaacatcagcgccagcgtgcccaaccccaacgtgatctgcaacagcatgttccccgtggaggacgtgttcagacagatggacttccccggcgagagcagcaacaacagaagcttcttcagcgtggagagcggcaccaagatgagcggcctgcacatcagcggcggccagagcgtgctggagcccatcaagagcgtgaaccagagcatcaaccagaccgtgagccagaccatgagccagagcctgatcccccccagcatgaaccagcagcccttcagcagcgagctgatcagcagcgtgagccagcaggagagaatcccccacgagcccgtgatcaacagcagcaacgtgcacgtgggcagcagaggcagcaagaagaactaccagagccaggccgacatccccatcagaagccccttcggcatcgtgaaggccagctggctgcccaagttcagccacgccgacgcccagaagatgaagagactgcccacccccagcatgatgaacgactactacgccgccagccccagaatcttcccccacctgtgcagcctgtgcaacgtggagtgcagccacctgaaggactggatccagcaccagaacaccagcacccacatcgagagctgcagacagctgagacagcagtaccccgactggaaccccgagatcctgcccagcagaagaaacgagggcaacagaaaggagaacgagacccccagaagaagaagccacagccccagccccagaagaagcagaagaagcagcagcagccacagattcagaagaagcagaagccccatgcactacatgtacagacccagaagcagaagccccagaatctgccacagattcatcagcagatacagaagcagaagcagaagcagaagcccctacagaatcagaaaccccttcagaggcagccccaagtgcttcagaagcgtgagccccgagagaatgagcagaagaagcgtgagaagcagcgacagaaagaaggccctggaggacgtggtgcagagaagcggccacggcaccgagttcaacaagcagaagcacctggaggccgccgacaagggccacagccccgcccagaagcccaagaccagcagcggcaccaagcccagcgtgaagcccaccagcgccaccaagagcgacagcaacctgggcggccacagcatcagatgcaagagcaagaacctggaggacgacaccctgagcgagtgcaagcaggtgagcgacaaggccgtgagcctgcagagaaagctgagaaaggagcagagcctgcactacggcagcgtgctgctgatcaccgagctgcccgaggacggctgcaccgaggaggacgtgagaaagctgttccagcccttcggcaaggtgaacgacgtgctgatcgtgccctacagaaaggaggcctacctggagatggagttcaaggaggccatcaccgccatcatgaagtacatcgagaccacccccctgaccatcaagggcaagagcgtgaagatctgcgtgcccggcaagaagaaggcccagaacaaggaggtgaagaagaagaccctggagagcaagaaggtgagcgccagcaccctgaagagagacgccgacgccagcaaggccgtggagatcgtgaccagcaccagcgccgccaagaccggccaggccaaggccagcgtggccaaggtgaacaagagcaccggcaagagcgccagcagcgtgaagagcgtggtgaccgtggccgtgaagggcaacaaggccagcatcaagaccgccaagagcggcggcaagaagagcctggaggccaagaagaccggcaacgtgaagaacaaggacagcaacaagcccgtgaccatccccgagaacagcgagatcaagaccagcatcgaggtgaaggccaccgagaactgcgccaaggaggccatcagcgacgccgccctggaggccaccgagaacgagcccctgaacaaggagaccgaggagatgtgcgtgatgctggtgagcaacctgcccaacaagggctacagcgtggaggaggtgtacgacctggccaagcccttcggcggcctgaaggacatcctgatcctgagcagccacaagaaggcctacatcgagatcaacagaaaggccgccgagagcatggtgaagttctacacctgcttccccgtgctgatggacggcaaccagctgagcatcagcatggcccccgagaacatgaacatcaaggacgaggaggccatcttcatcaccctggtgaaggagaacgaccccgaggccaacatcgacaccatctacgacagattcgtgcacctggacaacctgcccgaggacggcctgcagtgcgtgctgtgcgtgggcctgcagttcggcaaggtggaccaccacgtgttcatcagcaacagaaacaaggccatcctgcagctggacagccccgagagcgcccagagcatgtacagcttcctgaagcagaacccccagaacatcggcgaccacatgctgacctgcagcctgagccccaagatcgacctgcccgaggtgcagatcgagcacgaccccgagctggagaaggagagactgtggctgagcaagaccctgagaatcctgaaggccctgctggtggaggtgcccaacctgaagagaagccactacttccacctgatctggatgaacctgctgctgtggatgagactgtag

SEQ ID NO: 106146 - DNA, 2445 bp, Artificial Sequence
  Description of Artificial Sequence: Synthetic coding sequence
atgagcagacccagattcaaccccagaggcgacttccccctgcagagacccagagcccccaaccccagcggcatgagaccccccggccccttcatgagacccggcagcatgggcctgcccagattctaccccgccggcagagccagaggcatcccccacagattcgccggccacgagagctaccagaacatgggcccccagagaatgaacgtgcaggtgacccagcacagaaccgaccccagactgaccaaggagaagctggacttccacgaggcccagcagaagaagggcaagccccacggcagcagatgggacgacgagccccacatcagcgccagcgtggccgtgaagcagagcagcgtgacccaggtgaccgagcagagccccaaggtgcagagcagatacaccaaggagagcgccagcagcatcctggccagcttcggcctgagcaacgaggacctggaggagctgagcagataccccgacgagcagctgacccccgagaacatgcccctgatcctgagagacatcagaatgagaaagatgggcagaagactgcccaacctgcccagccagagcagaaacaaggagaccctgggcagcgaggccgtgagcagcaacgtgatcgactacggccacgccagcaagtacggctacaccgaggaccccctggaggtgagaatctacgaccccgagatccccaccgacgaggtggagaacgagttccagagccagcagaacatcagcgccagcgtgcccaaccccaacgtgatctgcaacagcatgttccccgtggaggacgtgttcagacagatggacttccccggcgagagcagcaacaacagaagcttcttcagcgtggagagcggcaccaagatgagcggcctgcacatcagcggcggccagagcgtgctggagcccatcaagagcgtgaaccagagcatcaaccagaccgtgagccagaccatgagccagagcctgatcccccccagcatgaaccagcagcccttcagcagcgagctgatcagcagcgtgagccagcaggagagaatcccccacgagcccgtgatcaacagcagcaacgtgcacgtgggcagcagaggcagcaagaagaactaccagagccaggccgacatccccatcagaagccccttcggcatcgtgaaggccagctggctgcccaagttcagccacgccgacgcccagaagatgaagagactgcccacccccagcatgatgaacgactactacgccgccagccccagaatcttcccccacctgtgcagcctgtgcaacgtggagtgcagccacctgaaggactggatccagcaccagaacaccagcacccacatcgagagctgcagacagctgagacagcagtaccccgactggaaccccgagatcctgcccagcagaagaaacgagggcaacagaaaggagaacgagacccccagaagaagaagccacagccccagccccagaagaagcagaagaagcagcagcagccacagattcagaagaagcagaagccccatgcactacatgtacagacccagaagcagaagccccagaatctgccacagattcatcagcagatacagaagcagaagcagaagcagaagcccctacagaatcagaaaccccttcagaggcagccccaagtgcttcagaagcgtgagccccgagagaatgagcagaagaagcgtgagaagcagcgacagaaagaaggccctggaggacgtggtgcagagaagcggccacggcaccgagttcaacaagcagaagcacctggaggccgccgacaagggccacagccccgcccagaagcccaagaccagcagcggcaccaagcccagcgtgaagcccaccagcgccaccaagagcgacagcaacctgggcggccacagcatcagatgcaagagcaagaacctggaggacgacaccctgagcgagtgcaagcaggtgagcgacaaggccgtgagcctgcagagaaagctgagaaaggagcagagcctgcactacggcagcgtgctgctgatcaccgagctgcccgaggacggctgcaccgaggaggacgtgagaaagctgttccagcccttcggcaaggtgaacgacgtgctgatcgtgccctacagaaaggaggcctacctggagatggagttcaaggaggccatcaccgccatcatgaagtacatcgagaccacccccctgaccatcaagggcaagagcgtgaagatctgcgtgcccggcaagaagaaggcccagaacaaggaggtgaagaagaagaccctggagagcaagaaggtgagcgccagcaccctgaagagagacgccgacgccagcaaggccgtggagatcgtgaccagcaccagcgccggcctgctgcccaccggcggcggcaacaactacccccagatcgtgctggcccccggcctgtgccactag

SEQ ID NO: 106147 - DNA, 2643 bp, Artificial Sequence
  Description of Artificial Sequence: Synthetic coding sequence
atgcccagagacggcgtgcccgccggcaacaccacccccgccgccgcccaggccgccgcccagagccccgacagcgccaccgccggcgccccccaggtgctggacagcctgaagagataccccgactggaaccccgagatcctgcccagcagaagaaacgagggcaacagaaaggagaacgagacccccagaagaagaagccacagccccagccccagaagaagcagaagaagcagcagcagccacagattcagaagaagcagaagccccatgcactacatgtacagacccagaagcagaagccccagaatctgccacagattcatcagcagatacagaagcagaagcagaagcagaagcccctacagaatcagaaaccccttcagaggcagccccaagtgcttcagaagcgtgagccccgagagaatgagcagaagaagcgtgagaagcagcgacagaaagaaggccctggaggacgtggtgcagagaagcggccacggcaccgagttcaacaagcagaagcacctggaggccgccgacaagggccacagccccgcccagaagcccaagaccagcagcggcaccaagcccagcgtgaagcccaccagcgccaccaagagcgacagcaacctgggcggccacagcatcagatgcaagagcaagaacctggaggacgacaccctgagcgagtgcaagcaggtgagcgacaaggccgtgagcctgcagagaaagctgagaaaggagcagagcctgcactacggcagcgtgctgctgatcaccgagctgcccgaggacggctgcaccgaggaggacgtgagaaagctgttccagcccttcggcaaggtgaacgacgtgctgatcgtgccctacagaaaggaggcctacctggagatggagttcaaggaggccatcaccgccatcatgaagtacatcgagaccacccccctgaccatcaagggcaagagcgtgaagatctgcgtgcccggcaagaagaaggcccagaacaaggaggtgaagaagaagaccctggagagcaagaaggtgagcgccagcaccctgaagagagacgccgacgccagcaaggccgtggagatcgtgaccagcaccagcgccgccaagaccggccaggccaaggccagcgtggccaaggtgaacaagagcaccggcaagagcgccagcagcgtgaagagcgtggtgaccgtggccgtgaagggcaacaaggccagcatcaagaccgccaagagcggcggcaagaagagcctggaggccaagaagaccggcaacgtgaagaacaaggacagcaacaagcccgtgaccatccccgagaacagcgagatcaagaccagcatcgaggtgaaggccaccgagaactgcgccaaggaggccatcagcgacgccgccctggaggccaccgagaacgagcccctgaacaaggagaccgaggagatgtgcgtgatgctggtgagcaacctgcccaacaagggctacagcgtggaggaggtgtacgacctggccaagcccttcggcggcctgaaggacatcctgatcctgagcagccacaagaaggcctacatcgagatcaacagaaaggccgccgagagcatggtgaagttctacacctgcttccccgtgctgatggacggcaaccagctgagcatcagcatggcccccgagaacatgaacatcaaggacgaggaggccatcttcatcaccctggtgaaggagaacgaccccgaggccaacatcgacaccatctacgacagattcgtgcacctggacaacctgcccgaggacggcctgcagtgcgtgctgtgcgtgggcctgcagttcggcaaggtggaccaccacgtgttcatcagcaacagaaacaaggccatcctgcagctggacagccccgagagcgcccagagcatgtacagcttcctgaagcagaacccccagaacatcggcgaccacatgctgacctgcagcctgagccccaagatcgacctgcccgaggtgcagatcgagcacgaccccgagctggagaaggagagccccggcctgaagaacagccccatcgacgagagcgaggtgcagaccgccaccgacagccccagcgtgaagcccaacgagctggaggaggagagcacccccagcatccagaccgagaccctggtgcagcaggaggagccctgcgaggaggaggccgagaaggccacctgcgacagcgacttcgccgtggagaccctggagctggagacccagggcgaggaggtgaaggaggagatccccctggtggccagcgccagcgtgagcatcgagcagttcaccgagaacgccgaggagtgcgccctgaaccagcagatgttcaacagcgacctggagaagaagggcgccgagatcatcaaccccaagaccgccctgctgcccagcgacagcgtgttcgccgaggagagaaacctgaagggcatcctggaggagagccccagcgaggccgaggacttcatcagcggcatcacccagaccatggtggaggccgtggccgaggtggagaagaacgagaccgtgagcgagatcctgcccagcacctgcatcgtgaccctggtgcccggcatccccaccggcgacgagaagaccgtggacaagaagaacatcagctag

SEQ ID NO: 106148 - DNA, 2757 bp, Artificial Sequence
  Description of Artificial Sequence: Synthetic coding sequence
atggacagcccccccctgaaggccctgaacagcaacagcatctacttcctgctgctgttccactgcatgctgatcagcgaggtgcagatcgagcacgaccccgagctggagaaggagagccccggcctgaagaacagccccatcgacgagagcgaggtgcagaccgccaccgacagccccagcgtgaagcccaacgagctggaggaggagagcacccccagcatccagaccgagaccctggtgcagcaggaggagccctgcgaggaggaggccgagaaggccacctgcgacagcgacttcgccgtggagaccctggagctggagacccagggcgaggaggtgaaggaggagatccccctggtggccagcgccagcgtgagcatcgagcagttcaccgagaacgccgaggagtgcgccctgaaccagcagatgttcaacagcgacctggagaagaagggcgccgagatcatcaaccccaagaccgccctgctgcccagcgacagcgtgttcgccgaggagagaaacctgaagggcatcctggaggagagccccagcgaggccgaggacttcatcagcggcatcacccagaccatggtggaggccgtggccgaggtggagaagaacgagaccgtgagcgagatcctgcccagcacctgcatcgtgaccctggtgcccggcatccccaccggcgacgagaagaccgtggacaagaagaacatcagcgagaagaagggcaacatggacgagaaggaggagaaggagttcaacaccaaggagaccagaatggacctgcagatcggcaccgagaaggccgagaagaacgagggcagaatggacgccgagaaggtggagaagatggccgccatgaaggagaagcccgccgagaacaccctgttcaaggcctaccccaacaagggcgtgggccaggccaacaagcccgacgagaccagcaagaccagcatcctggccgtgagcgacgtgagcagcagcaagcccagcatcaaggccgtgatcgtgagcagccccaaggccaaggccaccgtgagcaagaccgagaaccagaagagcttccccaagagcgtgcccagagaccagatcaacgccgagaagaagctgagcgccaaggagttcggcctgctgaagcccaccagcgccagaagcggcctggccgagagcagcagcaagttcaagcccacccagagcagcctgaccagaggcggcagcggcagaatcagcgccctgcagggcaagctgagcaagctggactacagagacatcaccaagcagagccaggagaccgaggccagacccagcatcatgaagagagacgacagcaacaacaagaccctggccgagcagaacaccaagaaccccaagagcaccaccggcagaagcagcaagagcaaggaggagcccctgttccccttcaacctggacgagttcgtgaccgtggacgaggtgatcgaggaggtgaaccccagccaggccaagcagaaccccctgaagggcaagagaaaggagaccctgaagaacgtgcccttcagcgagctgaacctgaagaagaagaagggcaagaccagcacccccagaggcgtggagggcgagctgagcttcgtgaccctggacgagatcggcgaggaggaggacgccgccgcccacctggcccaggccctggtgaccgtggacgaggtgatcgacgaggaggagctgaacatggaggagatggtgaagaacagcaacagcctgttcaccctggacgagctgatcgaccaggacgactgcatcagccacagcgagcccaaggacgtgaccgtgctgagcgtggccgaggagcaggacctgctgaagcaggagagactggtgaccgtggacgagatcggcgaggtggaggagctgcccctgaacgagagcgccgacatcaccttcgccaccctgaacaccaagggcaacgagggcgacaccgtgagagacagcatcggcttcatcagcagccaggtgcccgaggaccccagcaccctggtgaccgtggacgagatccaggacgacagcagcgacctgcacctggtgaccctggacgaggtgaccgaggaggacgaggacagcctggccgacttcaacaacctgaaggaggagctgaacttcgtgaccgtggacgaggtgggcgaggaggaggacggcgacaacgacctgaaggtggagctggcccagagcaagaacgaccaccccaccgacaagaagggcaacagaaagaagagagccgtggacaccaagaagaccaagctggagagcctgagccaggtgggccccgtgaacgagaacgtgatggaggaggacctgaagaccatgatcgagagacacctgaccgccaagacccccaccaagagagtgagaatcggcaagaccctgcccagcgagaaggccgtggtgaccgagcccgccaagggcgaggaggccttccagatgagcgaggtggacgaggagagcggcctgaaggacagcgagcccgagagaaagagaaagaagaccgaggacagcagcagcggcaagagcgtggccagcgacgtgcccgaggagctggacttcctggtgcccaaggccggcttcttctgccccatctgcagcctgttctacagcggcgagaaggccatgaccaaccactgcaagagcaccagacacaagcagaacaccgagaagttcatggccaagcagagaaaggagaaggagcagaacgaggccgaggagagaagcagcagatag

SEQ ID NO: 106149 - DNA, 5937 bp, Artificial Sequence; identical to SEQ ID NO: 106144
  Description of Artificial Sequence: Synthetic coding sequence

SEQ ID NO: 106150 - DNA, 90 bp, Artificial Sequence
  Description of Artificial Sequence: Synthetic coding sequence
atgagcagacccagattcaaccccagaggcgacttccccctgcagagacccagagcccccaaccccagcggcatgagaccccccggctag

SEQ ID NO: 106151 - DNA, 594 bp, Artificial Sequence
  Description of Artificial Sequence: Synthetic coding sequence
atgagcagacccagattcaaccccagaggcgacttccccctgcagagacccagagcccccaaccccagcggcatgagaccccccggccccttcatgagacccggcagcatgggcctgcccagattctaccccgccggcagagccagaggcatcccccacagattcgccggccacgagagctaccagaacatgggcccccagagaatgaacgtgcaggtgacccagcacagaaccgaccccagactgaccaaggagaagctggacttccacgaggcccagcagaagaagggcaagccccacggcagcagatgggacgacgagccccacatcagcgccagcgtggccgtgaagcagagcagcgtgacccaggtgaccgagcagagccccaaggtgcagagcagatacaccaaggagagcgccagcagcatcctggccagcttcggcctgagcaacgaggacctggaggagctgagcagataccccgacgagcagctgacccccgagaacatgcccctgatcctgagagacatcagaatgagaaagatgggcagaagactgcccaacctgcccagccagagcagaaacaaggagtag

SEQ ID NO: 106152 - DNA, 111 bp, Artificial Sequence
  Description of Artificial Sequence: Synthetic coding sequence
atgagcagacccagattcaaccccagaggcgacttccccctgcagagacccagagcccccaaccccagcggcatgagaccccccggccccttcatgagacccggcagctag

SEQ ID NO: 106153 - DNA, 189 bp, Artificial Sequence
  Description of Artificial Sequence: Synthetic coding sequence
atgagcagacccagattcaaccccagaggcgacttccccctgcagagacccagagcccccaaccccagcggcatgagaccccccggccccttcatgagacccggcagcatgggcctgcccagattctaccccgccggcagagccagaggcatcccccacagattcgccggccacgagagctaccagtag

SEQ ID NO: 106154 - DNA, 189 bp, Artificial Sequence; identical to SEQ ID NO: 106153
  Description of Artificial Sequence: Synthetic coding sequence

SEQ ID NO: 106155 - DNA, 1758 bp, Artificial Sequence
  Description of Artificial Sequence: Synthetic coding sequence
atggacagcccccccctgaaggccctgaacagcaacagcatctacttcctgctgctgttccactgcatgctgatcagcgaggtgcagatcgagcacgaccccgagctggagaaggagagccccggcctgaagaacagccccatcgacgagagcgaggtgcagaccgccaccgacagccccagcgtgaagcccaacgagctggaggaggagagcacccccagcatccagaccgagaccctggtgcagcaggaggagccctgcgaggaggaggccgagaaggccacctgcgacagcgacttcgccgtggagaccctggagctggagacccagggcgaggaggtgaaggaggagatccccctggtggccagcgccagcgtgagcatcgagcagttcaccgagaacgccgaggagtgcgccctgaaccagcagatgttcaacagcgacctggagaagaagggcgccgagatcatcaaccccaagaccgccctgctgcccagcgacagcgtgttcgccgaggagagaaacctgaagggcatcctggaggagagccccagcgaggccgaggacttcatcagcggcatcacccagaccatggtggaggccgtggccgaggtggagaagaacgagaccgtgagcgagatcctgcccagcacctgcatcgtgaccctggtgcccggcatccccaccggcgacgagaagaccgtggacaagaagaacatcagcgagaagaagggcaacatggacgagaaggaggagaaggagttcaacaccaaggagaccagaatggacctgcagatcggcaccgagaaggccgagaagaacgagggcagaatggacgccgagaaggtggagaagatggccgccatgaaggagaagcccgccgagaacaccctgttcaaggcctaccccaacaagggcgtgggccaggccaacaagcccgacgagaccagcaagaccagcatcctggccgtgagcgacgtgagcagcagcaagcccagcatcaaggccgtgatcgtgagcagccccaaggccaaggccaccgtgagcaagaccgagaaccagaagagcttccccaagagcgtgcccagagaccagatcaacgccgagaagaagctgagcgccaaggagttcggcctgctgaagcccaccagcgccagaagcggcctggccgagagcagcagcaagttcaagcccacccagagcagcctgaccagaggcggcagcggcagaatcagcgccctgcagggcaagctgagcaagctggactacagagacatcaccaagcagagccaggagaccgaggccagacccagcatcatgaagagagacgacagcaacaacaagaccctggccgagcagaacaccaagaaccccaagagcaccaccggcagaagcagcaagagcaaggaggagcccctgttccccttcaacctggacgagttcgtgaccgtggacgaggtgatcgaggaggtgaaccccagccaggccaagcagaaccccctgaagggcaagagaaaggagaccctgaagaacgtgcccttcagcgagctgaacctgaagaagaagaagggcaagaccagcacccccagaggcgtggagggcgagctgagcttcgtgaccctggacgagatcggcgaggaggaggacgccgccgcccacctggcccaggccctggtgaccgtggacgaggtgatcgacgaggaggagctgaacatggaggagatggtgaagttcaagttcaccttctacatcagatag

SEQ ID NO: 106156 - DNA, 3075 bp, Artificial Sequence
  Description of Artificial Sequence: Synthetic coding sequence
atgcccagagacggcgtgcccgccggcaacaccacccccgccgccgcccaggccgccgcccagagccccgacagcgccaccgccggcgccccccaggtgctggacagcctgaagagattcgtgctgttcctggagaacttcgcccccctggtgaacagcctgaacctgggcatcgccaaccccctgctgctgggccccagccccctgcacttcgcccagatcaagacccagctggccctgcagcagctgaacgccgtggccagccacggcagcacccccccctacaccctgctgaaccaggccttcctgaagatcgccatgagcagacccagattcaaccccagaggcgacttccccctgcagagacccagagcccccaaccccagcggcatgagaccccccggccccttcatgagacccggcagcatgggcctgcccagattctaccccgccggcagagccagaggcatcccccacagattcgccggccacgagagctaccagaacatgggcccccagagaatgaacgtgcaggtgacccagcacagaaccgaccccagactgaccaaggagaagctggacttccacgaggcccagcagaagaagggcaagccccacggcagcagatgggacgacgagccccacatcagcgccagcgtggccgtgaagcagagcagcgtgacccaggtgaccgagcagagccccaaggtgcagagcagatacaccaaggagagcgccagcagcatcctggccagcttcggcctgagcaacgaggacctggaggagctgagcagataccccgacgagcagctgacccccgagaacatgcccctgatcctgagagacatcagaatgagaaagatgggcagaagactgcccaacctgcccagccagagcagaaacaaggagaccctgggcagcgaggccgtgagcagcaacgtgatcgactacggccacgccagcaagtacggctacaccgaggaccccctggaggtgagaatctacgaccccgagatccccaccgacgaggtggagaacgagttccagagccagcagaacatcagcgccagcgtgcccaaccccaacgtgatctgcaacagcatgttccccgtggaggacgtgttcagacagatggacttccccggcgagagcagcaacaacagaagcttcttcagcgtggagagcggcaccaagatgagcggcctgcacatcagcggcggccagagcgtgctggagcccatcaagagcgtgaaccagagcatcaaccagaccgtgagccagaccatgagccagagcctgatcccccccagcatgaaccagcagcccttcagcagcgagctgatcagcagcgtgagccagcaggagagaatcccccacgagcccgtgatcaacagcagcaacgtgcacgtgggcagcagaggcagcaagaagaactaccagagccaggccgacatccccatcagaagccccttcggcatcgtgaaggccagctggctgcccaagttcagccacgccgacgcccagaagatgaagagactgcccacccccagcatgatgaacgactactacgccgccagccccagaatcttcccccacctgtgcagcctgtgcaacgtggagtgcagccacctgaaggactggatccagcaccagaacaccagcacccacatcgagagctgcagacagctgagacagcagtaccccgactggaaccccgagatcctgcccagcagaagaaacgagggcaacagaaaggagaacgagacccccagaagaagaagccacagccccagccccagaagaagcagaagaagcagcagcagccacagattcagaagaagcagaagccccatgcactacatgtacagacccagaagcagaagccccagaatctgccacagattcatcagcagatacagaagcagaagcagaagcagaagcccctacagaatcagaaaccccttcagaggcagccccaagtgcttcagaagcgtgagccccgagagaatgagcagaagaagcgtgagaagcagcgacagaaagaaggccctggaggacgtggtgcagagaagcggccacggcaccgagttcaacaagcagaagcacctggaggccgccgacaagggccacagccccgcccagaagcccaagaccagcagcggcaccaagcccagcgtgaagcccaccagcgccaccaagagcgacagcaacctgggcggccacagcatcagatgcaagagcaagaacctggaggacgacaccctgagcgagtgcaagcaggtgagcgacaaggccgtgagcctgcagagaaagctgagaaaggagcagagcctgcactacggcagcgtgctgctgatcaccgagctgcccgaggacggctgcaccgaggaggacgtgagaaagctgttccagcccttcggcaaggtgaacgacgtgctgatcgtgccctacagaaaggaggcctacctggagatggagttcaaggaggccatcaccgccatcatgaagtacatcgagaccacccccctgaccatcaagggcaagagcgtgaagatctgcgtgcccggcaagaagaaggcccagaacaaggaggtgaagaagaagaccctggagagcaagaaggtgagcgccagcaccctgaagagagacgccgacgccagcaaggccgtggagatcgtgaccagcaccagcgccgagagcgtggaccagacccagcagctggtgcccctggtgagaaacaccgccagagaccacgacggcacccccgagaacgagggcgaggagaccgtgcagagcgccctgttcggcttccagtacgacgccagcgaccacaccatggcctggctgggccccaacaccgtgcccgaggtgaaggagatgatcctgcaggacccccagctgcagaccacccagctgccccagaccacccaggcccccgacatcacctggggcatgctgaagaagaccacctacaaggccgagcagatcctgctgcagacccagaagcccttcacccccgacaacctgttcctggccctgctgagcggcgacgccaagcccgagtacgagcagtag

SEQ ID NO: 106157 - DNA, 1317 bp, Artificial Sequence
  Description of Artificial Sequence: Synthetic coding sequence
atgcaggccgaggacagaagccagttcggcagcgccgccgagatgctgagcgagcagaccgccgccctgggcaccggctgggagagcatgaacgtgcagctggacggcgccgagccccaggtggagagaggcagccaggaggagagaccctggagaaccgtgcccggccccctggagcacctgtgctgcgacctggaggaggagccccagagcctgcaggagaaggcccagagcgccccctgggtgcccgccatcccccaggagggcaacaccggcgactgggagatggccgccgccctgctggccgccggcagccagggcctggtgaccatcaaggacgtgagcctgtgcttcagccaggaggagtggagaagcctggaccccagccagaccgacttctacggcgagtacgtgatgcaggagaactgcggcatcgtggtgagcctgagattccccatccccaagctggacatgctgagccagctggagggcggcgaggagcagtgggtgcccgacccccaggacctggaggagagagacatcctgagagtgacctacaccggcgacggcagcgagcacgagggcgacacccccgagctggaggccgagccccccagaatgctgagcagcgtgagcgaggacaccgtgctgtggaaccccgagcacgacgagagctgggacagcatgcccagcagcagcagaggcatgctgctgggcccccccttcctgcaggaggacagcttcagcaacctgctgtgcagcaccgagatggacagcctgctgagaccccacacctgcccccagtgcggcaagcagttcgtgtggggcagccacctggccagacaccagcagacccacaccggcgagagaccctacagctgcctgaagtgcgagaagaccttcggcagaagacaccacctgatcagacaccagaagacccacctgcacgacaagaccagcagatgcagcgagtgcggcaagaacttcagatgcaacagccacctggccagccaccagagagtgcacgccgagggcaagagctgcaagggccaggaggtgggcgagagccccggcaccagaaagagacagagagccccccccgtgcccaagtgccacgtgtgcaccgagtgcggcaagagcttcggcagaagacaccacctggtgagacactggctgacccacaccggcgagaagcccttccagtgccccagatgcgagaagagcttcggcagaaagcaccacctggacagacacctgctgacccaccagggccagagccccagaaacagctgggacagaggcaccagcgtgttctag

SEQ ID NO: 106158 - DNA, 1248 bp, Artificial Sequence
  Description of Artificial Sequence: Synthetic coding sequence
atgctgagcgagcagaccgccgccctgggcaccggctgggagagcatgaacgtgcagctggacggcgccgagccccaggtggagagaggcagccaggaggagagaccctggagaaccgtgcccggccccctggagcacctgtgctgcgacctggaggaggagccccagagcctgcaggagaaggcccagagcgccccctgggtgcccgccatcccccaggagggcaacaccggcgactgggagatggccgccgccctgctggccgccggcagccaggtgagcagcgccagcctgggcgtgagctgcggccccatcaccgccgccttcgtgctgctgagccaccagcccatcgacgagctggcccacatgatcatcaacggcttccccatccccaagctggacatgctgagccagctggagggcggcgaggagcagtgggtgcccgacccccaggacctggaggagagagacatcctgagagtgacctacaccggcgacggcagcgagcacgagggcgacacccccgagctggaggccgagccccccagaatgctgagcagcgtgagcgaggacaccgtgctgtggaaccccgagcacgacgagagctgggacagcatgcccagcagcagcagaggcatgctgctgggcccccccttcctgcaggaggacagcttcagcaacctgctgtgcagcaccgagatggacagcctgctgagaccccacacctgcccccagtgcggcaagcagttcgtgtggggcagccacctggccagacaccagcagacccacaccggcgagagaccctacagctgcctgaagtgcgagaagaccttcggcagaagacaccacctgatcagacaccagaagacccacctgcacgacaagaccagcagatgcagcgagtgcggcaagaacttcagatgcaacagccacctggccagccaccagagagtgcacgccgagggcaagagctgcaagggccaggaggtgggcgagagccccggcaccagaaagagacagagagccccccccgtgcccaagtgccacgtgtgcaccgagtgcggcaagagcttcggcagaagacaccacctggtgagacactggctgacccacaccggcgagaagcccttccagtgccccagatgcgagaagagcttcggcagaaagcaccacctggacagacacctgctgacccaccagggccagagccccagaaacagctgggacagaggcaccagcgtgttctag

SEQ ID NO: 106159 - DNA, 1317 bp, Artificial Sequence; identical to SEQ ID NO: 106157
  Description of Artificial Sequence: Synthetic coding sequence

SEQ ID NO: 106160 - DNA, 1275 bp, Artificial Sequence
  Description of Artificial Sequence: Synthetic coding sequence
atgctgagcgagcagaccgccgccctgggcaccggctgggagagcatgaacgtgcagctggacggcgccgagccccaggtggagagaggcagccaggaggagagaccctggagaaccgtgcccggccccctggagcacctgtgctgcgacctggaggaggagccccagagcctgcaggagaaggcccagagcgccccctgggtgcccgccatcccccaggagggcaacaccggcgactgggagatggccgccgccctgctggccgccggcagccagggcctggtgaccatcaaggacgtgagcctgtgcttcagccaggaggagtggagaagcctggaccccagccagaccgacttctacggcgagtacgtgatgcaggagaactgcggcatcgtggtgagcctgagattccccatccccaagctggacatgctgagccagctggagggcggcgaggagcagtgggtgcccgacccccaggacctggaggagagagacatcctgagagtgacctacaccggcgacggcagcgagcacgagggcgacacccccgagctggaggccgagccccccagaatgctgagcagcgtgagcgaggacaccgtgctgtggaaccccgagcacgacgagagctgggacagcatgcccagcagcagcagaggcatgctgctgggcccccccttcctgcaggaggacagcttcagcaacctgctgtgcagcaccgagatggacagcctgctgagaccccacacctgcccccagtgcggcaagcagttcgtgtggggcagccacctggccagacaccagcagacccacaccggcgagagaccctacagctgcctgaagtgcgagaagaccttcggcagaagacaccacctgatcagacaccagaagacccacctgcacgacaagaccagcagatgcagcgagtgcggcaagaacttcagatgcaacagccacctggccagccaccagagagtgcacgccgagggcaagagctgcaagggccaggaggtgggcgagagccccggcaccagaaagagacagagagccccccccgtgcccaagtgccacgtgtgcaccgagtgcggcaagagcttcggcagaagacaccacctggtgagacactggctgacccacaccggcgagaagcccttccagtgccccagatgcgagaagagcttcggcagaaagcaccacctggacagacacctgctgacccaccagggccagagccccagaaacagctgggacagaggcaccagcgtgttctag

SEQ ID NO: 106161 - DNA, 411 bp, Artificial Sequence
  Description of Artificial Sequence: Synthetic coding sequence
atgcaggccgaggacagaagccagttcggcagcgccgccgagatgctgagcgagcagaccgccgccctgggcaccggctgggagagcatgaacgtgcagctggacggcgccgagccccaggtggagagaggcagccaggaggagagaccctggagaaccgtgcccggccccctggagcacctgtgctgcgacctggaggaggagccccagagcctgcaggagaaggcccagagcgccccctgggtgcccgccatcccccaggagggcaacaccggcgactgggagatggccgccgccctgctggccgccggcagccagggcctggtgaccatcaaggacgtgagcctgtgcttcagccaggaggagtggagaagcctggaccccagccagaccgacttctacggcgagtag

SEQ ID NO: 106162 - DNA, 324 bp, Artificial Sequence
  Description of Artificial Sequence: Synthetic coding sequence
atgctgagcgagcagaccgccgccctgggcaccggctgggagagcatgaacgtgcagctggacggcgccgagccccaggtggagagaggcagccaggaggagagaccctggagaaccgtgcccggccccctggagcacctgtgctgcgacctggaggaggagccccagagcctgcaggagaaggcccagagcgccccctgggtgcccgccatcccccaggagggcaacaccggcgactgggagatggccgccgccctgctggccgccggcagccagggcctggtgaccatcaaggacgtgagcctgtgcttcagccaggagtag

SEQ ID NO: 106163 - DNA, 234 bp, Artificial Sequence
  Description of Artificial Sequence: Synthetic coding sequence
atgctgagcgagcagaccgccgccctgggcaccggctgggagagcatgaacgtgcagctggacggcgccgagccccaggtggagagaggcagccaggaggagagaccctggagaaccgtgcccggccccctggagcacctgtgctgcgacctggaggaggagccccagagcctgcaggagaaggcccagagcgccccctgggtgcccgccatcccccaggagggcaacacctag

SEQ ID NO: 106164 - DNA, 3984 bp, Artificial Sequence
  Description of Artificial Sequence: Synthetic coding sequence
atgagaagcttcctgcagcaggacgtgaacaagaccaagagcagactgaacgtgctgaacggcctggccaacaacatggacgacctgaagatcaacaccgacatcaccggcgccaaggaggagctgctggacgacaacaacttcatcagcgacaaggagagcggcgtgcacaagcccaaggactgccagaccagcttccagaagaacaacaccctgaccctgcccgaggagctgagcaaggacaagagcgagaacgccctgagcggcggccagagcagcctgttcatccacgccggcgcccccaccgtgagcagcgagaacttcatcctgcccaagggcgccgccgtgaacggccccgtgagccacagcagcctgaccaagaccagcaacatgaacaagggcagcgtgagcctgaccaccggccagcccgtggaccagcccaccaccgagagctgcagcaccctgaaggtggccgccgacctgcagctgagcaccccccagaaggccagccagcaccaggtgctgttcctgctgagcgacgtggcccacgccaagaaccccacccacagcaacaagaagctgcccaccagcgccagcgtgggctgcgacatccagaacagcgtgggcagcaacatcaagagcgacggcaccctgatcaaccaggtggaggtgggcgaggacggcgaggacctgctggtgaaggacgactgcgtgaacaccgtgaccggcatcagcagcggcaccgacggcttcagaagcgagaacgacaccaactgggacccccagaaggagttcatccagttcctgatgaccaacgaggagaccgtggacaaggcccccccccacagcaagatcggcctggagaagaagagaaagagaaagatggacgtgagcaagatcaccagatacaccgaggactgcttcagcgacagcaactgcgtgcccaacaagagcaagatgcaggaggtggacttcctggagcagaacgaggagctgcaggccgtggacagccagaagtacgccctgagcaaggtgaagcccgagagcaccgacgaggacctggagagcgtggacgccttccagcacctgatctacaaccccgacaagtgcggcgaggagagcagccccgtgcacaccagcaccttcctgagcaacaccctgaagaagaagtgcgaggagagcgacagcgagagccccgccaccttcagcaccgaggagcccagcttctacccctgcaccaagtgcaacgtgaacttcagagagaagaagcacctgcacagacacatgatgtaccacctggacggcaacagccacttcagacacctgaacgtgcccagaccctacgcctgcagagagtgcggcagaaccttcagagacagaaacagcctgctgaagcacatgatcatccaccaggagagaagacagaagctgatggaggagatcagagagctgaaggagctgcaggacgagggcagaagcgccagactgcagtgcccccagtgcgtgttcggcaccaactgccccaagaccttcgtgcagcacgccaagacccacgagaaggacaagagatactactgctgcgaggagtgcaacttcatggccgtgaccgagaacgagctggagtgccacagaggcatcgcccacggcgccgtggtgaagtgccccatggtgaccagcgacatcgcccagagaaagacccagaagaagaccttcatgaaggacagcgtggtgggcagcagcaagaagagcgccacctacatctgcaagatgtgccccttcaccaccagcgccaagagcgtgctgaagaagcacaccgagtacctgcacagcagcagctgcgtggacagcttcggcagccccctgggcctggacaagagaaagaacgacatcctggaggagcccgtggacagcgacagcaccaagaccctgaccaagcagcagagcaccaccttccccaagaacagcgccctgaagcaggacgtgaagagaaccttcggcagcaccagccagagcagcagcttcagcaagatccacaagagaccccacagaatccagaaggccagaaagagcatcgcccagagcggcgtgaacatgtgcaaccagaacagcagcccccacaagaacgtgaccatcaagagcagcgtggaccagaagcccaagtacttccaccaggccgccaaggagaagagcaacgccaaggccaacagccactacctgtacagacacaagtacgagaactacagaatgatcaagaagagcggcgagagctaccccgtgcacttcaagaaggaggaggccagcagcctgaacagcctgcacctgttcagcagcagcagcaacagccacaacaacttcatcagcgacccccacaagcccgacgccaagagacccgagagcttcaaggaccacagaagagtggccgtgaagagagtgatcaaggagagcaagaaggagagcagcgtgggcggcgaggacctggacagctaccccgacttcctgcacaagatgaccgtggtggtgctgcagaagctgaacagcgccgagaagaaggacagctacgagaccgaggacgagagcagctgggacaacgtggagctgggcgactacaccacccaggccatcgaggacgagacctacagcgacatcaaccaggagcacgtgaacctgttccccctgttcaagagcaaggtggagggccaggagcccggcgagaacgccaccctgagctacgaccagaacgacggcttctacttcgagtactacgaggacaccggcagcaacaacttcctgcacgagatccacgacccccagcacctggagaccgccgacgccagcctgagcaagcacagcagcgtgttccactggaccgacctgagcctggagaagaagagctgcccctactgccccgccaccttcgagaccggcgtgggcctgagcaaccacgtgagaggccacctgcacagagccggcctgagctacgaggccagacacgtggtgagccccgagcagatcgccaccagcgacaagatgcagcacttcaagagaaccggcaccggcacccccgtgaagagagtgagaaaggccatcgagaagagcgagaccaccagcgagcacacctgccagctgtgcggcggctggttcgacaccaagatcggcctgagcaaccacgtgagaggccacctgaagagactgggcaagaccaagtgggacgcccacaagagccccatctgcgtgctgaacgagatgatgcagaacgaggagaagtacgagaagatcctgaaggccctgaacagcagaagaatcatccccagacccttcgtggcccagaagctggccagcagcgacgacttcatcagccagaacgtgatccccctggaggcctacagaaacggcctgaagaccgaggccctgagcgtgagcgccagcgaggaggagggcctgaacttcctgaacgagtacgacgagaccaagcccgagctgcccagcggcaagaagaaccagagcctgaccctgatcgagctgctgaagaacaagagaatgggcgaggagagaaacagcgccatcagcccccagaagatccacaaccagaccgccagaaagagattcgtgcagaagtgcgtgctgcccctgaacgaggacagccccctgatgtaccagccccagaagatggacctgaccatgcacagcgccctggactgcaagcagaagaagagcagaagcagaagcggcagcaagaagaagatgctgaccctgccccacggcgccgacgaggtgtacatcctgagatgcagattctgcggcctggtgttcagaggccccctgagcgtgcaggaggactggatcaagcacctgcagagacacatcgtgaacgccaacctgcccagaaccggcgccggcatggtggaggtgaccagcctgctgaagaagcccgccagcatcaccgagaccagcttcagcctgctgatggccgaggccgccagctag

SEQ ID NO: 106165 - DNA, 318 bp, Artificial Sequence
  Description of Artificial Sequence: Synthetic coding sequence
atgctgatcagacagaacctggccctggactgcaagcagaagaagagcagaagcagaagcggcagcaagaagaagatgctgaccctgccccacggcgccgacgaggtgtacatcctgagatgcagattctgcggcctggtgttcagaggccccctgagcgtgcaggaggactggatcaagcacctgcagagacacatcgtgaacgccaacctgcccagaaccggcgccggcatggtggaggtgaccagcctgctgaagaagcccgccagcatcaccgagaccagcttcagcctgctgatggccgaggccgccagctag

SEQ ID NO: 106166 - DNA, 318 bp, Artificial Sequence; identical to SEQ ID NO: 106165
  Description of Artificial Sequence: Synthetic coding sequence

SEQ ID NO: 106167 - DNA, 3984 bp, Artificial Sequence; identical to SEQ ID NO: 106164
  Description of Artificial Sequence: Synthetic coding sequence

SEQ ID NO: 106168 - DNA, 1953 bp, Artificial Sequence
  Description of Artificial Sequence: Synthetic coding sequence
atgatgtaccacctggacggcaacagccacttcagacacctgaacgtgcccagaccctacgcctgcagagagtgcggcagaaccttcagagacagaaacagcctgctgaagcacatgatcatccaccaggagagaagacagaagctgatggaggagatcagagagctgaaggagctgcaggacgagggcagaagcgccagactgcagtgcccccagtgcgtgttcggcaccaactgccccaagaccttcgtgcagcacgccaagacccacgagaaggacaagagatactactgctgcgaggagtgcaacttcatggccgtgaccgagaacgagctggagtgccacagaggcatcgcccacggcgccgtggtgaagtgccccatggtgaccagcgacatcgcccagagaaagacccagaagaagaccttcatgaaggacagcgtggtgggcagcagcaagaagagcgccacctacatctgcaagatgtgccccttcaccaccagcgccaagagcgtgctgaagaagcacaccgagtacctgcacagcagcagctgcgtggacagcttcggcagccccctgggcctggacaagagaaagaacgacatcctggaggagcccgtggacagcgacagcaccaagaccctgaccaagcagcagagcaccaccttccccaagaacagcgccctgaagcaggacgtgaagagaaccttcggcagcaccagccagagcagcagcttcagcaagatccacaagagaccccacagaatccagaaggccagaaagagcatcgcccagagcggcgtgaacatgtgcaaccagaacagcagcccccacaagaacgtgaccatcaagagcagcgtggaccagaagcccaagtacttccaccaggccgccaaggagaagagcaacgccaaggccaacagccactacctgtacagacacaagtacgagaactacagaatgatcaagaagagcggcgagagctaccccgtgcacttcaagaaggaggaggccagcagcctgaacagcctgcacctgttcagcagcagcagcaacagccacaacaacttcatcagcgacccccacaagcccgacgccaagagacccgagagcttcaaggaccacagaagagtggccgtgaagagagtgatcaaggagagcaagaaggagagcagcgtgggcggcgaggacctggacagctaccccgacttcctgcacaagatgaccgtggtggtgctgcagaagctgaacagcgccgagaagaaggacagctacgagaccgaggacgagagcagctgggacaacgtggagctgggcgactacaccacccaggccatcgaggacgagacctacagcgacatcaaccaggagcacgtgaacctgttccccctgttcaagagcaaggtggagggccaggagcccggcgagaacgccaccctgagctacgaccagaacgacggcttctacttcgagtactacgaggacaccggcagcaacaacttcctgcacgagatccacgacccccagcacctggagaccgccgacgccagcctgagcaagcacagcagcgtgttccactggaccgacctgagcctggagaagaagagctgcccctactgccccgccaccttcgagaccggcgtgggcctgagcaaccacgtgagaggccacctgcacagagccggcctgagctacgaggccagacacgtggtgagccccgagcagatcgccaccagcgacaagatgcagcacttcaagagaaccggcaccggcacccccgtgaagagagtgagaaaggccatcgagaagagcgagaccaccagcgagcacacctgccagctgtgcggcggctggttcgacaccaagatcggcctgagcaaccacgtgagaggccacctgaagagactgggcaagaccaagtgggacgcccacaagagccccatctgcgtgtag

SEQ ID NO: 106169 - DNA, 924 bp, Artificial Sequence
  Description of Artificial Sequence: Synthetic coding sequence
atgagaagcttcctgcagcaggacgtgaacaagaccaagagcagactgaacgtgctgaacggcctggccaacaacatggacgacctgaagatcaacaccgacatcaccggcgccaaggaggagctgctggacgacaacaacttcatcagcgacaaggagagcggcgtgcacaagcccaaggactgccagaccagcttccagaagaacaacaccctgaccctgcccgaggagctgagcaaggacaagagcgagaacgccctgagcggcggccagagcagcctgttcatccacgccggcgcccccaccgtgagcagcgagaacttcatcctgcccaagggcgccgccgtgaacggccccgtgagccacagcagcctgaccaagaccagcaacatgaacaagggcagcgtgagcctgaccaccggccagcccgtggaccagcccaccaccgagagctgcagcaccctgaaggtggccgccgacctgcagctgagcaccccccagaaggccagccagcaccaggtgctgttcctgctgagcgacgtggcccacgccaagaaccccacccacagcaacaagaagctgcccaccagcgccagcgtgggctgcgacatccagaacagcgtgggcagcaacatcaagagcgacggcaccctgatcaaccaggtggaggtgggcgaggacggcgaggacctgctggtgaaggacgactgcgtgaacaccgtgaccggcatcagcagcggcaccgacggcttcagaagcgagaacgacaccaactgggacccccagaaggagttcatccagttcctgatgaccaacgaggagaccgtggacaaggcccccccccacagcaagatcggcctggagaagaagaaggccaagaacggctgcaagcaggacaacagcctgtacagaggcctgctgtag

SEQ ID NO: 106170 - DNA, 1518 bp, Artificial Sequence
  Description of Artificial Sequence: Synthetic coding sequence
atgaccaaggcccaggagagcctgaccctggaggacgtggccgtggacttcacctgggaggagtggcagttcctgagccccgcccagaaggacctgtacagagacgtgatgctggagaactacagcaacctggtgagcgtgggctaccaggccggcaagcccgacgccctgaccaagctggagcagggcgagcccctgtggaccctggaggacgagatccacagccccgcccaccccgagatcgagaaggccgacgaccacctgcagcagcccctgcagaaccagaagatcctgaagagaaccggccagagatacgagcacggcagaaccctgaagagctacctgggcctgaccaaccagagcagaagatacaacagaaaggagcccgccgagttcaacggcgacggcgccttcctgcacgacaaccacgagcagatgcccaccgagatcgagttccccgagagcagaaagcccatcagcaccaagagccagttcctgaagcaccagcagacccacaacatcgagaaggcccacgagtgcaccgactgcggcaaggccttcctgaagaagagccagctgaccgagcacaagagaatccacaccggcaagaagccccacgtgtgcagcctgtgcggcaaggccttctacaagaagtacagactgaccgagcacgagagagcccacagaggcgagaagccccacggctgcagcctgtgcggcaaggccttctacaagagatacagactgaccgagcacgagagagcccacaagggcgagaagccctacggctgcagcgagtgcggcaaggccttccccagaaagagcgagctgaccgagcaccagagaatccacaccggcatcaagccccaccagtgcagcgagtgcggcagagccttcagcagaaagagcctgctggtggtgcaccagagaacccacaccggcgagaagccccacacctgcagcgagtgcggcaagggcttcatccagaagggcaacctgaacatccaccagagaacccacaccggcgagaagccctacggctgcatcgactgcggcaaggccttcagccagaagagctgcctggtggcccaccagagataccacaccggcaagacccccttcgtgtgccccgagtgcggccagccctgcagccagaagagcggcctgatcagacaccagaagatccacagcggcgagaagccctacaagtgcagcgactgcggcaaggccttcctgaccaagaccatgctgatcgtgcaccacagaacccacaccggcgagagaccctacggctgcgacgagtgcgagaaggcctacttctacatgagctgcctggtgaagcacaagagaatccacagcagagagaagagaggcgacagcgtgaaggtggagaaccccagcaccgccagccacagcctgagccccagcgagcacgtgcagggcaagagccccgtgaacatggtgaccgtggccatggtggccggccagtgcgagttcgcccacatcctgcacagctag

SEQ ID NO: 106171 - DNA, 1833 bp, Artificial Sequence
  Description of Artificial Sequence: Synthetic coding sequence
atgcccagcgccagaggcaagagcaagagcaaggcccccatcaccttcggcgacctggccatctacttcagccaggaggagtgggagtggctgagccccatccagaaggacctgtacgaggacgtgatgctggagaactacagaaacctggtgagcctgggcctgagcttcagaagacccaacgtgatcaccctgctggagaagggcaaggccccctggatggtggagcccgtgagaagaagaagagcccccgacagcggcagcaagtgcgagaccaagaagctgccccccaaccagtgcaacaagagcggccagagcatctgccagaagctggtgagcgcccagcagaaggcccccaccagaaagagcggctgcaacaagaacagcgtgctggtgaagcccaagaagggccacagcggcaagaagcccctgaagtgcaacgactgcggcaagaccttcagcagaagcttcagcctgaagctgcaccagaacatccacaccggcgagaagcccttcgagtgcagcaactgcagaaaggccttcagacagatcagcagcatcctgctgcaccagagaatccacagcggcaagaagagccacgagtgcaacaagtgcggcgagagcttcaaccagagaaccaccctgatcctgcacatgagaatccacgacggcaaggagatcctggactgcggcaaggccctgagccagtgccagagcttcaacatccaccagaagatccacgtggtgggcaacgtgtgccagtgcagaaagtgcggcaaggccttcaaccagatgagcagcctgctgctgcacaagaagatccacaacggcaagaagacccacaagtacaacaagtgcggcagaggcttcaagaagaagagcgtgttcgtggtgcacaagagaatccacgccggcgagaagatccccgagaacgccaaggccctgagccagagcctgcagcagagaagccaccacctggagaaccccttcaagtgcagaaagtgcggcaagctgttcaacagaatcagccccctgatgctgcaccagagaatccacaccagcgagaagccctacaagtgcgacaagtgcgacaagttcttcagaagactgagcaccctgatcctgcacctgagaatccacaacggcgagaagctgtacagatgcaacaagtgcgagaaggtgtgcaacagacacagcagcctgatccagcaccagaaggtgcacaccaagaagaagaagctgttcgagtgcaaggagtgcggcaagatgttcagcggcaccgccaacctgaagatccaccagaacatccacagcgaggagaagcccttcaagtgcaacaagtgcagcaaggtgttcggcagacagagcttcctgatcgagcaccagagaatccacaccggcgagaagccctaccagtgcgaggagtgcggcaaggccttcagccacagaatcagcctgaccagacacaagagaatccacaccgaggacagaccctacgagtgcgaccagtgcggcaaggccttcagccagagcgcccacctggcccagcacgagagaatccacaccggcgagaagccctacacctgcaagacctgcggcaaggccttcagccagagaaccagcctgatcctgcacgagagaagccacaccggcgagaagccctacgagtgcaacgagtgcggcaaggccttcagcagcggcagcgacctgatcagacaccagagaagccacagcagcgagaagccctacgagtgcagcaagtgcggcaaggcctacagcagaagcagcagcctgatcagacaccagaacacccacagcgaggagaaggcctag

SEQ ID NO: 106172 - DNA, 2217 bp, Artificial Sequence
  Description of Artificial Sequence: Synthetic coding sequence
atgagaaccctggtgaacgccctgagcggcggcggccaggagatcaagcccgagggcaagtgcgcccacaacggcatgtgcttcagatgcgaggaggtggcccccgacacctgcgaggcctacccctaccccggcctggtggtgagcgtggccggcaaggagggccccaaccccgaccacaagagaggcttcctggacctggcccaggagggcatccaggccctgccctaccagctgagcgcccacctgagcgtgtggaccctgaagggcgaggagagaatgcccagcgccagaggcaagagcaagagcaaggcccccatcaccttcggcgacctggccatctacttcagccaggaggagtgggagtggctgagccccatccagaaggacctgtacgaggacgtgatgctggagaactacagaaacctggtgagcctgggcctgagcttcagaagacccaacgtgatcaccctgctggagaagggcaaggccccctggatggtggagcccgtgagaagaagaagagcccccgagctggtgaccgtggccctgttcagcagcttcggcgaggtgatgttcagcagaatggtgctgatgctgatggacgtgtgccagtacctggtgatcgacgagctggacagcggcagcaagtgcgagaccaagaagctgccccccaaccagtgcaacaagagcggccagagcatctgccagaagctggtgagcgcccagcagaaggcccccaccagaaagagcggctgcaacaagaacagcgtgctggtgaagcccaagaagggccacagcggcaagaagcccctgaagtgcaacgactgcggcaagaccttcagcagaagcttcagcctgaagctgcaccagaacatccacaccggcgagaagcccttcgagtgcagcaactgcagaaaggccttcagacagatcagcagcatcctgctgcaccagagaatccacagcggcaagaagagccacgagtgcaacaagtgcggcgagagcttcaaccagagaaccaccctgatcctgcacatgagaatccacgacggcaaggagatcctggactgcggcaaggccctgagccagtgccagagcttcaacatccaccagaagatccacgtggtgggcaacgtgtgccagtgcagaaagtgcggcaaggccttcaaccagatgagcagcctgctgctgcacaagaagatccacaacggcaagaagacccacaagtacaacaagtgcggcagaggcttcaagaagaagagcgtgttcgtggtgcacaagagaatccacgccggcgagaagatccccgagaacgccaaggccctgagccagagcctgcagcagagaagccaccacctggagaaccccttcaagtgcagaaagtgcggcaagctgttcaacagaatcagccccctgatgctgcaccagagaatccacaccagcgagaagccctacaagtgcgacaagtgcgacaagttcttcagaagactgagcaccctgatcctgcacctgagaatccacaacggcgagaagctgtacagatgcaacaagtgcgagaaggtgtgcaacagacacagcagcctgatccagcaccagaaggtgcacaccaagaagaagaagctgttcgagtgcaaggagtgcggcaagatgttcagcggcaccgccaacctgaagatccaccagaacatccacagcgaggagaagcccttcaagtgcaacaagtgcagcaaggtgttcggcagacagagcttcctgatcgagcaccagagaatccacaccggcgagaagccctaccagtgcgaggagtgcggcaaggccttcagccacagaatcagcctgaccagacacaagagaatccacaccgaggacagaccctacgagtgcgaccagtgcggcaaggccttcagccagagcgcccacctggcccagcacgagagaatccacaccggcgagaagccctacacctgcaagacctgcggcaaggccttcagccagagaaccagcctgatcctgcacgagagaagccacaccggcgagaagccctacgagtgcaacgagtgcggcaaggccttcagcagcggcagcgacctgatcagacaccagagaagccacagcagcgagaagccctacgagtgcagcaagtgcggcaaggcctacagcagaagcagcagcctgatcagacaccagaacacccacagcgaggagaaggcctag

SEQ ID NO: 106173 - DNA, 975 bp, Artificial Sequence
  Description of Artificial Sequence: Synthetic coding sequence
aagaacagcgtgctggtgaagcccaagaagggccacagcggcaagaagcccctgaagtgcaacgactgcggcaagaccttcagcagaagcttcagcctgaagctgcaccagaacatccacaccggcgagaagcccttcgagtgcagcaactgcagaaaggccttcagacagatcagcagcatcctgctgcaccagagaatccacagcggcaagaagagccacgagtgcaacaagtgcggcgagagcttcaaccagagaaccaccctgatcctgcacatgagaatccacgacggcaagaaccccttcaagtgcagaaagtgcggcaagctgttcaacagaatcagccccctgatgctgcaccagagaatccacaccagcgagaagccctacaagtgcgaggagtgcggcaagatgttcagcggcaccgccaacctgaagatccaccagaacatccacagcgaggagaagcccttcaagtgcaacaagtgcagcaaggtgttcggcagacagagcttcctgatcgagcaccagagaatccacaccggcgagaagccctaccagtgcgaggagtgcggcaaggccttcagccacagaatcagcctgaccagacacaagagaatccacaccgaggacagaccctacgagtgcgaccagtgcggcaaggccttcagccagagcgcccacctggcccagcacgagagaatccacaccggcgagaagccctacacctgcaagacctgcggcaaggccttcagccagagaaccagcctgatcctgcacgagagaagccacaccggcgagaagccctacgagtgcaacgagtgcggcaaggccttcagcagcggcagcgacctgatcagacaccagagaagccacagcagcgagaagccctacgagtgcagcaagtgcggcaaggcctacagcagaagcagcagcctgatcagacaccagaacacccacagcgaggagaagtag

SEQ ID NO: 106174 - DNA, 1179 bp, Artificial Sequence
  Description of Artificial Sequence: Synthetic coding sequence
atgagaatccacgacggcaaggagatcctggactgcggcaaggccctgagccagtgccagagcttcaacatccaccagaagatccacgtggtgggcaacgtgtgccagtgcagaaagtgcggcaaggccttcaaccagatgagcagcctgctgctgcacaagaagatccacaacggcaagaagacccacaagtacaacaagtgcggcagaggcttcaagaagaagagcgtgttcgtggtgcacaagagaatccacgccggcgagaagatccccgagaacgccaaggccctgagccagagcctgcagcagagaagccaccacctggagaaccccttcaagtgcagaaagtgcggcaagctgttcaacagaatcagccccctgatgctgcaccagagaatccacaccagcgagaagccctacaagtgcgacaagtgcgacaagttcttcagaagactgagcaccctgatcctgcacctgagaatccacaacggcgagaagctgtacagatgcaacaagtgcgagaaggtgtgcaacagacacagcagcctgatccagcaccagaaggtgcacaccaagaagaagaagctgttcgagtgcaaggagtgcggcaagatgttcagcggcaccgccaacctgaagatccaccagaacatccacagcgaggagaagcccttcaagtgcaacaagtgcagcaaggtgttcggcagacagagcttcctgatcgagcaccagagaatccacaccggcgagaagccctaccagtgcgaggagtgcggcaaggccttcagccacagaatcagcctgaccagacacaagagaatccacaccgaggacagaccctacgagtgcgaccagtgcggcaaggccttcagccagagcgcccacctggcccagcacgagagaatccacaccggcgagaagccctacacctgcaagacctgcggcaaggccttcagccagagaaccagcctgatcctgcacgagagaagccacaccggcgagaagccctacgagtgcaacgagtgcggcaaggccttcagcagcggcagcgacctgatcagacaccagagaagccacagcagcgagaagccctacgagtgcagcaagtgcggcaaggcctacagcagaagcagcagcctgatcagacaccagaacacccacagcgaggagaaggcctag

SEQ ID NO: 106175 - DNA, 1833 bp, Artificial Sequence; identical to SEQ ID NO: 106171
  Description of Artificial Sequence: Synthetic coding sequence

SEQ ID NO: 106176 - DNA, 1728 bp, Artificial Sequence
  Description of Artificial Sequence: Synthetic coding sequence
atggccatgagccaggagagcctgaccttcaaggacgtgttcgtggacttcaccctggaggagtggcagcagctggacagcgcccagaagaacctgtacagagacgtgatgctggagaactacagccacctggtgagcgtgggccacctggtgggcaagcccgacgtgatcttcagactgggccccggcgacgagagctggatggccgacggcggcacccccgtgagaacctgcgccgtgtgggaggtggacgagcagatcgaccactacaaggagagccaggacaagttcctgtggcaggccgccttcatcggcaaggagaccctgaaggacgagagcggccaggagtgcaagatctgcagaaagatcatctacctgaacaccgacttcgtgagcgtgaagcagagactgcccaagtactacagctgggagagatgcagcaagcaccacctgaacttcctgggccagaacagaagctacgtgagaaagaaggacgacggctgcaaggcctactggaaggtgtgcctgcactacaacctgcacaaggcccagcccgccgagagattcttcgaccccaaccagagaggcaaggccctgcaccagaagcaggccctgagaaagagccagagaagccagaccggcgagaagctgtacaagtgcaccgagtgcggcaaggtgttcatccagaaggccaacctggtggtgcaccagagaacccacaccggcgagaagccctacgagtgctgcgagtgcgccaaggccttcagccagaagagcaccctgatcgcccaccagagaacccacaccggcgagaagccctacgagtgcagcgagtgcggcaagaccttcatccagaagagcaccctgatcaagcaccagagaacccacaccggcgagaagcccttcgtgtgcgacaagtgccccaaggccttcaagagcagctaccacctgatcagacacgagaagacccacatcagacaggccttctacaagggcatcaagtgcaccaccagcagcctgatctaccagagaatccacaccagcgagaagccccagtgcagcgagcacggcaaggccagcgacgagaagcccagccccaccaagcactggagaacccacaccaaggagaacatctacgagtgcagcaagtgcggcaagagcttcagaggcaagagccacctgagcgtgcaccagagaatccacaccggcgagaagccctacgagtgcagcatctgcggcaagaccttcagcggcaagagccacctgagcgtgcaccacagaacccacaccggcgagaagccctacgagtgcagaagatgcggcaaggccttcggcgagaagagcaccctgatcgtgcaccagagaatgcacaccggcgagaagccctacaagtgcaacgagtgcggcaaggccttcagcgagaagagccccctgatcaagcaccagagaatccacaccggcgagagaccctacgagtgcaccgactgcaagaaggccttcagcagaaagagcaccctgatcaagcaccagagaatccacaccggcgagaagccctacaagtgcagcgagtgcggcaaggccttcagcgtgaagagcaccctgatcgtgcaccacagaacccacaccggcgagaagccctacgagtgcagagactgcggcaaggccttcagcggcaagagcaccctgatcaagcaccagagaagccacaccggcgacaagaacctgtag

SEQ ID NO: 106177 - DNA, 1746 bp, Artificial Sequence
  Description of Artificial Sequence: Synthetic coding sequence
atggccatgagccaggagagcctgaccttcaaggacgtgttcgtggacttcaccctggaggagtggcagcagctggacagcgcccagaagaacctgtacagagacgtgatgctggagaactacagccacctggtgagcgtgggccacctggtgggcaagcccgacgtgatcttcagactgggccccggcgacgagagctggatggccgacggcggcacccccgtgagaacctgcgccggcgaggacagacccgaggtgtgggaggtggacgagcagatcgaccactacaaggagagccaggacaagttcctgtggcaggccgccttcatcggcaaggagaccctgaaggacgagagcggccaggagtgcaagatctgcagaaagatcatctacctgaacaccgacttcgtgagcgtgaagcagagactgcccaagtactacagctgggagagatgcagcaagcaccacctgaacttcctgggccagaacagaagctacgtgagaaagaaggacgacggctgcaaggcctactggaaggtgtgcctgcactacaacctgcacaaggcccagcccgccgagagattcttcgaccccaaccagagaggcaaggccctgcaccagaagcaggccctgagaaagagccagagaagccagaccggcgagaagctgtacaagtgcaccgagtgcggcaaggtgttcatccagaaggccaacctggtggtgcaccagagaacccacaccggcgagaagccctacgagtgctgcgagtgcgccaaggccttcagccagaagagcaccctgatcgcccaccagagaacccacaccggcgagaagccctacgagtgcagcgagtgcggcaagaccttcatccagaagagcaccctgatcaagcaccagagaacccacaccggcgagaagcccttcgtgtgcgacaagtgccccaaggccttcaagagcagctaccacctgatcagacacgagaagacccacatcagacaggccttctacaagggcatcaagtgcaccaccagcagcctgatctaccagagaatccacaccagcgagaagccccagtgcagcgagcacggcaaggccagcgacgagaagcccagccccaccaagcactggagaacccacaccaaggagaacatctacgagtgcagcaagtgcggcaagagcttcagaggcaagagccacctgagcgtgcaccagagaatccacaccggcgagaagccctacgagtgcagcatctgcggcaagaccttcagcggcaagagccacctgagcgtgcaccacagaacccacaccggcgagaagccctacgagtgcagaagatgcggcaaggccttcggcgagaagagcaccctgatcgtgcaccagagaatgcacaccggcgagaagccctacaagtgcaacgagtgcggcaaggccttcagcgagaagagccccctgatcaagcaccagagaatccacaccggcgagagaccctacgagtgcaccgactgcaagaaggccttcagcagaaagagcaccctgatcaagcaccagagaatccacaccggcgagaagccctacaagtgcagcgagtgcggcaaggccttcagcgtgaagagcaccctgatcgtgcaccacagaacccacaccggcgagaagccctacgagtgcagagactgcggcaaggccttcagcggcaagagcaccctgatcaagcaccagagaagccacaccggcgacaagaacctgtag

SEQ ID NO: 106178 - DNA, 3714 bp, Artificial Sequence
  Description of Artificial Sequence: Synthetic coding sequence
atgggcgacatgaagacccccgacttcgacgacctgctggccgccttcgacatccccgacatcgacgccaacgaggccatccacagcggccccgaggagaacgagggccccggcggccccggcaagcccgagcccggcgtgggcagcgagagcgaggacaccgccgccgccagcgccggcgacggccccggcgtgcccgcccaggccagcgaccacggcctgcccccccccgacatcagcgtggtgagcgtgatcgtgaagaacaccgtgtgccccgagcagagcgaggccctggccggcggcagcgccggcgacggcgcccaggccgccggcgtgaccaaggagggccccgtgggcccccacagaatgcagaacggcttcggcagccccgagcccagcctgcccggcaccccccacagccccgccccccccagcggcggcacctggaaggagaagggcatggagggcaagacccccctggacctgttcgcccacttcggccccgagcccggcgaccacagcgaccccctgccccccagcgcccccagccccaccagagagggcgccctgacccccccccccttccccagcagcttcgagctggcccaggagaacggccccggcatgcagccccccgtgagcagcccccccctgggcgccctgaagcaggagagctgcagcccccaccacccccaggtgctggcccagcagggcagcggcagcagccccaaggccaccgacatccccgccagcgccagccccccccccgtggccggcgtgcccttcttcaagcagagccccggccaccagagccccctggccagccccaaggtgcccgtgtgccagcccctgaaggaggaggacgacgacgagggccccgtggacaagagcagccccggcagcccccagagccccagcagcggcgccgaggccgccgacgaggacagcaacgacagccccgccagcagcagcagcagacccctgaaggtgagaatcaagaccatcaagaccagctgcggcaacatcaccagaaccgtgacccaggtgcccagcgaccccgacccccccgcccccctggccgagggcgccttcctggccgaggccagcctgctgaagctgagccccgccacccccaccagcgagggccccaaggtggtgagcgtgcagctgggcgacggcaccagactgaagggcaccgtgctgcccgtggccaccatccagaacgccagcaccgccatgctgatggccgccagcgtggccagaaaggccgtggtgctgcccggcggcaccgccaccagccccaagatgatcgccaagaacgtgctgggcctggtgccccaggccctgcccaaggccgacggcagagccggcctgggcaccggcggccagaaggtgaacggcgccagcgtggtgatggtgcagcccagcaagaccgccaccggccccagcaccggcggcggcaccgtgatcagcagaacccagagcagcctggtggaggccttcaacaagatcctgaacagcaagaacctgctgcccgcctacagacccaacctgagcccccccgccgaggccggcctggccctgccccccaccggctacagatgcctggagtgcggcgacgccttcagcctggagaagagcctggccagacactacgacagaagaagcatgagaatcgaggtgacctgcaaccactgcgccagaagactggtgttcttcaacaagtgcagcctgctgctgcacgccagagagcacaaggacaagggcctggtgatgcagtgcagccacctggtgatgagacccgtggccctggaccagatggtgggccagcccgacatcacccccctgctgcccgtggccgtgccccccgtgagcggccccctggccctgcccgccctgggcaagggcgagggcgccatcaccagcagcgccatcaccaccgtggccgccgaggcccccgtgctgcccctgagcaccgagccccccgccgcccccgccaccagcgcctacacctgcttcagatgcctggagtgcaaggagcagtgcagagacaaggccggcatggccgcccacttccagcagctgggcccccccgcccccggcgccaccagcaacgtgtgccccacctgccccatgatgctgcccaacagatgcagcttcagcgcccaccagagaatgcacaagaacagacccccccacgtgtgccccgagtgcggcggcaacttcctgcaggccaacttccagacccacctgagagaggcctgcctgcacgtgagcagaagagtgggctacagatgccccagctgcagcgtggtgttcggcggcgtgaacagcatcaagagccacatccagaccagccactgcgaggtgttccacaagtgccccatctgccccatggccttcaagagcggccccagcgcccacgcccacctgtacagccagcaccccagcttccagacccagcaggccaagctgatctacaagtgcgccatgtgcgacaccgtgttcacccacaagcccctgctgagcagccacttcgaccagcacctgctgccccagagagtgagcgtgttcaagtgccccagctgccccctgctgttcgcccagaagagaaccatgctggagcacctgaagaacacccaccagagcggcagactggaggagaccgccggcaagggcgccggcggcgccctgctgacccccaagaccgagcccgaggagctggccgtgagccagggcggcgccgcccccgccaccgaggagagcagcagcagcagcgaggaggaggaggtgcccagcagccccgagccccccagacccgccaagagacccagaagagagctgggcagcaagggcctgaagggcggcggcggcggccccggcggctggacctgcggcctgtgccacagctggttccccgagagagacgagtacgtggcccacatgaagaaggagcacggcaagagcgtgaagaagttcccctgcagactgtgcgagagaagcttctgcagcgcccccagcctgagaagacacgtgagagtgaaccacgagggcatcaagagagtgtacccctgcagatactgcaccgagggcaagagaaccttcagcagcagactgatcctggagaagcacgtgcaggtgagacacggcctgcagctgggcgcccagagccccggcagaggcaccaccctggccagaggcagcagcgccagagcccagggccccggcagaaagagaagacagagcagcgacagctgcagcgaggagcccgacagcaccaccccccccgccaagagccccagaggcggccccggcagcggcggccacggccccctgagatacagaagcagcagcagcaccgagcagagcctgatgatgggcctgagagtggaggacggcgcccagcagtgcctggactgcggcctgtgcttcgccagccccggcagcctgagcagacacagattcatcagccacaagaagagaagaggcgtgggcaaggccagcgccctgggcctgggcgacggcgaggaggaggccccccccagcagaagcgaccccgacggcggcgacagccccctgcccgccagcggcggccccctgacctgcaaggtgtgcggcaagagctgcgacagccccctgaacctgaagacccacttcagaacccacggcatggccttcatcagagccagacagggcgccgtgggcgacaactag

SEQ ID NO: 106179 - DNA, 3714 bp, Artificial Sequence; identical to SEQ ID NO: 106178
  Description of Artificial Sequence: Synthetic coding sequence

SEQ ID NO: 106180 - DNA, 3312 bp, Artificial Sequence
  Description of Artificial Sequence: Synthetic coding sequence
atgggcgacatgaagacccccgacttcgacgacctgctggccgccttcgacatccccgacatcgacgccaacgaggccatccacagcggccccgaggagaacgagggccccggcggccccggcaagcccgagcccggcgtgggcagcgagagcgaggacaccgccgccgccagcgccggcgacggccccggcgtgcccgcccaggccagcgaccacggcctgcccccccccgacatcagcgtggtgagcgtgatcgtgaagaacaccgtgtgccccgagcagagcgaggccctggccggcggcagcgccggcgacggcgcccaggccgccggcgtgaccaaggagggccccgtgggcccccacagaatgcagaacggcttcggcagccccgagcccagcctgcccggcaccccccacagccccgccccccccagcggcggcacctggaaggagaagggcatggagggcaagacccccctggacctgttcgcccacttcggccccgagcccggcgaccacagcgaccccctgccccccagcgcccccagccccaccagagagggcgccctgacccccccccccttccccagcagcttcgagctggcccaggagaacggccccggcatgcagccccccgtgagcagcccccccctgggcgccctgaagcaggagagctgcagcccccaccacccccaggtgctggcccagcagggcagcggcagcagccccaaggccaccgacatccccgccagcgccagccccccccccgtggccggcgtgcccttcttcaagcagagccccggccaccagagccccctggccagccccaaggtgcccgtgtgccagcccctgaaggaggaggacgacgacgagggccccgtggacaagagcagccccggcagcccccagagccccagcagcggcgccgaggccgccgacgaggacagcaacgacagccccgccagcagcagcagcagacccctgaaggtgagaatcaagaccatcaagaccagctgcggcaacatcaccagaaccgtgacccaggtgcccagcgaccccgacccccccgcccccctggccgagggcgccttcctggccgaggccagcctgctgaagctgagccccgccacccccaccagcgagggccccaaggtggtgagcgtgcagctgggcgacggcaccagactgaagggcaccgtgctgcccgtggccaccatccagaacgccagcaccgccatgctgatggccgccagcgtggccagaaaggccgtggtgctgcccggcggcaccgccaccagccccaagatgatcgccaagaacgtgctgggcctggtgccccaggccctgcccaaggccgacggcagagccggcctgggcaccggcggccagaaggtgaacggcgccagcgtggtgatggtgcagcccagcaagaccgccaccggccccagcaccggcggcggcaccgtgatcagcagaacccagagcagcctggtggaggccttcaacaagatcctgaacagcaagaacctgctgcccgcctacagacccaacctgagcccccccgccgaggccggcctggccctgccccccaccggctacagatgcctggagtgcggcgacgccttcagcctggagaagagcctggccagacactacgacagaagaagcatgagaatcgaggtgacctgcaaccactgcgccagaagactggtgttcttcaacaagtgcagcctgctgctgcacgccagagagcacaaggacaagggcctggtgatgcagtgcagccacctggtgatgagacccgtggccctggaccagatggtgggccagcccgacatcacccccctgctgcccgtggccgtgccccccgtgagcggccccctggccctgcccgccctgggcaagggcgagggcgccatcaccagcagcgccatcaccaccgtggccgccgaggcccccgtgctgcccctgagcaccgagccccccgccgcccccgccaccagcgcctacacctgcttcagatgcctggagtgcaaggagcagtgcagagacaaggccggcatggccgcccacttccagcagctgggcccccccgcccccggcgccaccagcaacgtgtgccccacctgccccatgatgctgcccaacagatgcagcttcagcgcccaccagagaatgcacaagaacagacccccccacgtgtgccccgagtgcggcggcaacttcctgcaggccaacttccagacccacctgagagaggcctgcctgcacgtgagcagaagagtgggctacagatgccccagctgcagcgtggtgttcggcggcgtgaacagcatcaagagccacatccagaccagccactgcgaggtgttccacaagtgccccatctgccccatggccttcaagagcggccccagcgcccacgcccacctgtacagccagcaccccagcttccagacccagcaggccaagctgatctacaagtgcgccatgtgcgacaccgtgttcacccacaagcccctgctgagcagccacttcgaccagcacctgctgccccagagagtgagcgtgttcaagtgccccagctgccccctgctgttcgcccagaagagaaccatgctggagcacctgaagaacacccaccagagcggcagactggaggagaccgccggcaagggcgccggcggcgccctgctgacccccaagaccgagcccgaggagctggccgtgagccagggcggcgccgcccccgccaccgaggagagcagcagcagcagcgaggaggaggaggtgcccagcagccccgagccccccagacccgccaagagacccagaagagagctgggcagcaagggcctgaagggcggcggcggcggccccggcggctggacctgcggcctgtgccacagctggttccccgagagagacgagtacgtggcccacatgaagaaggagcacggcaagagcgtgaagaagttcccctgcagactgtgcgagagaagcttctgcagcgcccccagcctgagaagacacgtgagagtgaaccacgagggcatcaagagagtgtacccctgcagaagcaagggccccggcctgagagccgtgcccctgctgcccagctgccccctgcccttccaggtgctgcacagaggcaagacccacctgcagcagccccccgaccccagagagacctgccccggccccgccagactggccgcctggggccccgtgccctggcccggcgaccacctgggcagcggcttccagtgccagagccccggcgccagaagcgagaccccccccgtgttctag

SEQ ID NO: 106181 - DNA, 2121 bp, Artificial Sequence
  Description of Artificial Sequence: Synthetic coding sequence
tgaaccgtgctgcccgtggccaccatccagaacgccagcaccgccatgctgatggccgccagcgtggccagaaaggccgtggtgctgcccggcggcaccgccaccagccccaagatgatcgccaagaacgtgctgggcctggtgccccaggccctgcccaaggccgacggcagagccggcctgggcaccggcggccagaaggtgaacggcgccagcgtggtgatggtgcagcccagcaagaccgccaccggccccagcaccggcggcggcaccgtgatcagcagaacccagagcagcctggtggaggccttcaacaagatcctgaacagcaagaacctgctgcccgcctacagacccaacctgagcccccccgccgaggccggcctggccctgccccccaccggctacagatgcctggagtgcggcgacgccttcagcctggagaagagcctggccagacactacgacagaagaagcatgagaatcgaggtgacctgcaaccactgcgccagaagactggtgttcttcaacaagtgcagcctgctgctgcacgccagagagcacaaggacaagggcctggtgatgcagtgcagccacctggtgatgagacccgtggccctggaccagatggtgggccagcccgacatcacccccctgctgcccgtggccgtgccccccgtgagcggccccctggccctgcccgccctgggcaagggcgagggcgccatcaccagcagcgccatcaccaccgtggccgccgaggcccccgtgctgcccctgagcaccgagccccccgccgcccccgccaccagcgcctacacctgcttcagatgcctggagtgcaaggagcagtgcagagacaaggccggcatggccgcccacttccagcagctgggcccccccgcccccggcgccaccagcaacgtgtgccccacctgccccatgatgctgcccaacagatgcagcttcagcgcccaccagagaatgcacaagaacagacccccccacgtgtgccccgagtgcggcggcaacttcctgcaggccaacttccagacccacctgagagaggcctgcctgcacgtgagcagaagagtgggctacagatgccccagctgcagcgtggtgttcggcggcgtgaacagcatcaagagccacatccagaccagccactgcgaggtgttccacaagtgccccatctgccccatggccttcaagagcggccccagcgcccacgcccacctgtacagccagcaccccagcttccagacccagcaggccaagctgatctacaagtgcgccatgtgcgacaccgtgttcacccacaagcccctgctgagcagccacttcgaccagcacctgctgccccagagagtgagcgtgttcaagtgccccagctgccccctgctgttcgcccagaagagaaccatgctggagcacctgaagaacacccaccagagcggcagactggaggagaccgccggcaagggcgccggcggcgccctgctgacccccaagaccgagcccgaggagctggccgtgagccagggcggcgccgcccccgccaccgaggagagcagcagcagcagcgaggaggaggaggtgcccagcagccccgagccccccagacccgccaagagacccagaagagagctgggcagcaagggcctgaagggcggcggcggcggccccggcggctggacctgcggcctgtgccacagctggttccccgagagagacgagtacgtggcccacatgaagaaggagcacggcaagagcgtgaagaagttcccctgcagactgtgcgagagaagcttctgcagcgcccccagcctgagaagacacgtgagagtgaaccacgagggcatcaagagagtgtacccctgcagaagcaagggccccggcctgagagccgtgcccctgctgcccagctgccccctgcccttccaggtgctgcacagaggcaagacccacctgcagcagccccccgaccccagagagacctgccccggccccgccagactggccgcctggggccccgtgccctggcccggcgaccacctgggcagcggcttccagtgccagagccccggcgccagaagcgagaccccccccgtgttctag

SEQ ID NO: 106182 - DNA, 450 bp, Artificial Sequence
  Description of Artificial Sequence: Synthetic coding sequence
atgccctgctgcagccacagaagatgcagagaggaccccggcaccagcgagagccaggagatggaggagtgggccctgctggacatcagccagagaaagctgtacaaggaggtgatgctggagaccttcagaaacctgaccagcgtgggcaagagctggaaggaccagaacatcgagtacgagtaccagaaccccagaagaaacttcagaagcctgatcgagaagaaggtgaacgagatcaaggacgacagccactgcggcgagaccttcacccaggtgcccgacgacagactgaacttccaggagaagaaggccagccccgagatcaagagctgcgacagcttcgtgtgcggcgaggtgggcctgggcaacagcagcttcaacatgaacatcagaggcgacatcggccacaaggcctacgagtaccaggagtacggccccaagccctag

SEQ ID NO: 106183 - DNA, 1701 bp, Artificial Sequence
  Description of Artificial Sequence: Synthetic coding sequence
atgccctgctgcagccacagaagatgcagagaggaccccggcaccagcgagagccaggagatggaccccgtggccttcgacgacgtggccgtgaacttcacccaggaggagtgggccctgctggacatcagccagagaaagctgtacaaggaggtgatgctggagaccttcagaaacctgaccagcgtgggcaagagctggaaggaccagaacatcgagtacgagtaccagaaccccagaagaaacttcagaagcctgatcgagaagaaggtgaacgagatcaaggacgacagccactgcggcgagaccttcacccaggtgcccgacgacagactgaacttccaggagaagaaggccagccccgagatcaagagctgcgacagcttcgtgtgcggcgaggtgggcctgggcaacagcagcttcaacatgaacatcagaggcgacatcggccacaaggcctacgagtaccaggagtacggccccaagccctgcaagtgccagcagcccaagaaggccttcagataccaccccagcttcagaaccccccagagagaccacaccggcgagaagccctacgcctgcaaggagtgcggcaagaccttcatcagccacagcagcatccagagacacgtggtgatgcacagcggcgacggcccctacaagtgcaagttctgcggcaaggccttccactgcctgagcctgtacctgatccacgagagaatccacaccggcgagaagccctacgagtgcaagcagtgcggcaagagcttcagctacagcgccaccctgagaatccacgagagaacccacaccggcgagaagccctacgagtgccagcagtgcggcaaggccttccacagccccagatgctacagaagacacgagagaatccacaccggcgagaaggcctaccagtgcaaggagtgcggcaaggccttcacctgcccccagtacgtgagaatccacgagagaacccacagcagaaagaagccctacgagtgcacccagtgcggcaaggccctgagcagcctgaccagcttccagacccacatcagaatgcacagcggcgagagaccctacgagtgcaagatctgcggcaagggcttctgcagcgccaacagcttccagagacacgagaagacccacagcggcgagaagccctacaagtgcaagcagtgcggcaaggccttcatccacagcagcagcctgagataccacgagagaatccacaccggcgagaagccctacgagtgcaagcagtgcggcaaggccttcagaagcagcagccacctgcagctgcacggcagaacccacaccggcgagaagccctacgagtgccaggagtgcggcaaggccttcagaagcatgaagaacctgcagagccacgagagaacccagacccacgtgagaatccacagcggcgagagaccctacaagtgcaagctgtgcggcaagggcttctactgccccaagagcctgcagagacacgagaagacccacaccggcgagaagctgtacgagtgcaagcagtgcggcgaggccttcagcagcagcagcagcttcagataccacgagagaacccacaccggcgagaagccctacaagtgcaagcagtgcggcaaggccttcagagccgccagcgtgctgagaatgcacggcagaacccaccccgaggacaagccctacgagtgcaagcagtag

SEQ ID NO: 106184 - DNA, 2061 bp, Artificial Sequence
  Description of Artificial Sequence: Synthetic coding sequence
atggaggtggtgaccttcggcgacgtggccgtgcacttcagcagagaggagtggcagtgcctggaccccggccagagagccctgtacagagaggtgatgctggagaaccacagcagcgtggccggcctggccggcttcctggtgttcaagcccgagctgatcagcagactggagcagggcgaggagccctgggtgctggacctgcagggcgccgagggcaccgaggcccccagaaccagcaagaccgacagcaccatcagaaccgagaacgagcaggcctgcgaggacatggacatcctgaagagcgagagctacggcaccgtggtgagaatcagcccccaggacttcccccagaaccccggcttcggcgacgtgagcgacagcgaggtgtggctggacagccacctgggcagccccggcctgaaggtgaccggcttcaccttccagaacaactgcctgaacgaggagaccgtggtgcccaagaccttcaccaaggacgccccccagggctgcaaggagctgggcagcagcggcctggactgccagcccctggagagccagggcgagagcgccgagggcatgagccagagatgcgaggagtgcggcaagggcatcagagccaccagcgacatcgccctgcactgggagatcaacacccagaagatcagcagatgccaggagtgccagaagaagctgagcgactgcctgcagggcaagcacaccaacaactgccacggcgagaagccctacgagtgcgccgagtgcggcaaggtgttcagactgtgcagccagctgaaccagcaccagagaatccacaccggcgagaagcccttcaagtgcaccgagtgcggcaaggccttcagactgagcagcaagctgatccagcaccagagaatccacaccggcgagaagccctacagatgcgaggagtgcggcaaggccttcggccagagcagcagcctgatccaccaccagagaatccacaccggcgagagaccctacggctgcagagagtgcggcaaggccttcagccagcagagccagctggtgagacaccagagaacccacaccggcgagagaccctacccctgcaaggagtgcggcaaggccttcagccagagcagcaccctggcccagcaccagagaatgcacaccggcgagaaggcccagatcctgaaggccagcgacagccccagcctggtggcccaccagagaatccacgccgtggagaagcccttcaagtgcgacgagtgcggcaaggccttcagatggatcagcagactgagccagcaccagctgatccacaccggcgagaagccctacaagtgcaacaagtgcaccaaggccttcggctgcagcagcagactgatcagacaccagagaacccacaccggcgagaagcccttcaagtgcgacgagtgcggcaagggcttcgtgcagggcagccacctgatccagcaccagagaatccacaccggcgagaagccctacgtgtgcaacgactgcggcaaggccttcagccagagcagcagcctgatctaccaccagagaatccacaagggcgagaagccctacgagtgcctgcagtgcggcaaggccttcagcatgagcacccagctgaccatccaccagagagtgcacaccggcgagagaccctacaagtgcaacgagtgcggcaaggccttcagccagaacagcaccctgttccagcaccagatcatccacgccggcgtgaagccctacgagtgcagcgagtgcggcaaggccttcagcagaagcagctacctgatcgagcaccagagaatccacaccagagcccagtggttctacgagtacggcaacgccctggagggcagcaccttcgtgagcagaaagaaggtgaacaccatcaagaagctgcaccagtgcgaggactgcgagaagatcttcagatggagaagccacctgatcatccaccagagaatccacaccggcgagaagccctacaagtgcaacgactgcggcaaggccttcaacagaagcagcagactgacccagcaccagaagatccacatgggctag

SEQ ID NO: 106185 - DNA, 2094 bp, Artificial Sequence
  Description of Artificial Sequence: Synthetic coding sequence
atgggcttcctgggctgctggtgcgtgagcttccaggaggtggtgaccttcggcgacgtggccgtgcacttcagcagagaggagtggcagtgcctggaccccggccagagagccctgtacagagaggtgatgctggagaaccacagcagcgtggccggcctggccggcttcctggtgttcaagcccgagctgatcagcagactggagcagggcgaggagccctgggtgctggacctgcagggcgccgagggcaccgaggcccccagaaccagcaagaccgacagcaccatcagaaccgagaacgagcaggcctgcgaggacatggacatcctgaagagcgagagctacggcaccgtggtgagaatcagcccccaggacttcccccagaaccccggcttcggcgacgtgagcgacagcgaggtgtggctggacagccacctgggcagccccggcctgaaggtgaccggcttcaccttccagaacaactgcctgaacgaggagaccgtggtgcccaagaccttcaccaaggacgccccccagggctgcaaggagctgggcagcagcggcctggactgccagcccctggagagccagggcgagagcgccgagggcatgagccagagatgcgaggagtgcggcaagggcatcagagccaccagcgacatcgccctgcactgggagatcaacacccagaagatcagcagatgccaggagtgccagaagaagctgagcgactgcctgcagggcaagcacaccaacaactgccacggcgagaagccctacgagtgcgccgagtgcggcaaggtgttcagactgtgcagccagctgaaccagcaccagagaatccacaccggcgagaagcccttcaagtgcaccgagtgcggcaaggccttcagactgagcagcaagctgatccagcaccagagaatccacaccggcgagaagccctacagatgcgaggagtgcggcaaggccttcggccagagcagcagcctgatccaccaccagagaatccacaccggcgagagaccctacggctgcagagagtgcggcaaggccttcagccagcagagccagctggtgagacaccagagaacccacaccggcgagagaccctacccctgcaaggagtgcggcaaggccttcagccagagcagcaccctggcccagcaccagagaatgcacaccggcgagaaggcccagatcctgaaggccagcgacagccccagcctggtggcccaccagagaatccacgccgtggagaagcccttcaagtgcgacgagtgcggcaaggccttcagatggatcagcagactgagccagcaccagctgatccacaccggcgagaagccctacaagtgcaacaagtgcaccaaggccttcggctgcagcagcagactgatcagacaccagagaacccacaccggcgagaagcccttcaagtgcgacgagtgcggcaagggcttcgtgcagggcagccacctgatccagcaccagagaatccacaccggcgagaagccctacgtgtgcaacgactgcggcaaggccttcagccagagcagcagcctgatctaccaccagagaatccacaagggcgagaagccctacgagtgcctgcagtgcggcaaggccttcagcatgagcacccagctgaccatccaccagagagtgcacaccggcgagagaccctacaagtgcaacgagtgcggcaaggccttcagccagaacagcaccctgttccagcaccagatcatccacgccggcgtgaagccctacgagtgcagcgagtgcggcaaggccttcagcagaagcagctacctgatcgagcaccagagaatccacaccagagcccagtggttctacgagtacggcaacgccctggagggcagcaccttcgtgagcagaaagaaggtgaacaccatcaagaagctgcaccagtgcgaggactgcgagaagatcttcagatggagaagccacctgatcatccaccagagaatccacaccggcgagaagccctacaagtgcaacgactgcggcaaggccttcaacagaagcagcagactgacccagcaccagaagatccacatgggctag

SEQ ID NO: 106186 - DNA, 447 bp, Artificial Sequence
  Description of Artificial Sequence: Synthetic coding sequence
atggaggtggtgaccttcggcgacgtggccgtgcacttcagcagagaggagtggcagtgcctggaccccggccagagagccctgtacagagaggtgatgctggagaaccacagcagcgtggccggcctggccggcttcctggtgttcaagcccgagctgatcagcagactggagcagggcgaggagccctgggtgctggacctgcagggcgccgagggcaccgaggcccccagaaccagcaagaccggcttcctgggcagacccaccatgggccaggagcccagacacccccacgccccccccgccacccccgtgcccggcctgcccaagcactgcagccagagactgaccctgcccccccccggcctgagcagcagccccctgggccacttcctggtgcacgaccaggacagaagaagaggcaccagcgccatctggatggtgtag

SEQ ID NO: 106187 - DNA, 2061 bp, Artificial Sequence; identical to SEQ ID NO: 106184
  Description of Artificial Sequence: Synthetic coding sequence

SEQ ID NO: 106188 - DNA, 1773 bp, Artificial Sequence
  Description of Artificial Sequence: Synthetic coding sequence
atggacatcctgaagagcgagagctacggcaccgtggtgagaatcagcccccaggacttcccccagaaccccggcttcggcgacgtgagcgacagcgaggtgtggctggacagccacctgggcagccccggcctgaaggtgaccggcttcaccttccagaacaactgcctgaacgaggagaccgtggtgcccaagaccttcaccaaggacgccccccagggctgcaaggagctgggcagcagcggcctggactgccagcccctggagagccagggcgagagcgccgagggcatgagccagagatgcgaggagtgcggcaagggcatcagagccaccagcgacatcgccctgcactgggagatcaacacccagaagatcagcagatgccaggagtgccagaagaagctgagcgactgcctgcagggcaagcacaccaacaactgccacggcgagaagccctacgagtgcgccgagtgcggcaaggtgttcagactgtgcagccagctgaaccagcaccagagaatccacaccggcgagaagcccttcaagtgcaccgagtgcggcaaggccttcagactgagcagcaagctgatccagcaccagagaatccacaccggcgagaagccctacagatgcgaggagtgcggcaaggccttcggccagagcagcagcctgatccaccaccagagaatccacaccggcgagagaccctacggctgcagagagtgcggcaaggccttcagccagcagagccagctggtgagacaccagagaacccacaccggcgagagaccctacccctgcaaggagtgcggcaaggccttcagccagagcagcaccctggcccagcaccagagaatgcacaccggcgagaaggcccagatcctgaaggccagcgacagccccagcctggtggcccaccagagaatccacgccgtggagaagcccttcaagtgcgacgagtgcggcaaggccttcagatggatcagcagactgagccagcaccagctgatccacaccggcgagaagccctacaagtgcaacaagtgcaccaaggccttcggctgcagcagcagactgatcagacaccagagaacccacaccggcgagaagcccttcaagtgcgacgagtgcggcaagggcttcgtgcagggcagccacctgatccagcaccagagaatccacaccggcgagaagccctacgtgtgcaacgactgcggcaaggccttcagccagagcagcagcctgatctaccaccagagaatccacaagggcgagaagccctacgagtgcctgcagtgcggcaaggccttcagcatgagcacccagctgaccatccaccagagagtgcacaccggcgagagaccctacaagtgcaacgagtgcggcaaggccttcagccagaacagcaccctgttccagcaccagatcatccacgccggcgtgaagccctacgagtgcagcgagtgcggcaaggccttcagcagaagcagctacctgatcgagcaccagagaatccacaccagagcccagtggttctacgagtacggcaacgccctggagggcagcaccttcgtgagcagaaagaaggtgaacaccatcaagaagctgcaccagtgcgaggactgcgagaagatcttcagatggagaagccacctgatcatccaccagagaatccacaccggcgagaagccctacaagtgcaacgactgcggcaaggccttcaacagaagcagcagactgacccagcaccagaagatccacatgggctag

SEQ ID NO: 106189 - DNA, 1470 bp, Artificial Sequence
  Description of Artificial Sequence: Synthetic coding sequence
atgaaggagctggaccccaagaacgacatcagcgaggacaagctgagcgtggtgggcgaggccaccggcggccccaccagaaacggcgccagaggccccggcagcgagggcgtgtgggagcccggcagctggcccgagagacccagaggcgacgccggcgccgagtgggagcccctgggcatcccccagggcaacaagctgctgggcggcagcgtgcccgcctgccacgagctgaaggccttcgccaaccagggctgcgtgctggtgccccccagactggacgaccccaccgagaagggcgcctgcccccccgtgagaagaggcaagaacttcagcagcaccagcgacctgagcaagccccccatgccctgcgaggagaagaagacctacgactgcagcgagtgcggcaaggccttcagcagaagcagcagcctgatcaagcaccagagaatccacaccggcgagaagcccttcgagtgcgacacctgcggcaagcacttcatcgagagaagcagcctgaccatccaccagagagtgcacaccggcgagaagccctacgcctgcggcgactgcggcaaggccttcagccagagaatgaacctgaccgtgcaccagagaacccacaccggcgagaagccctacgtgtgcgacgtgtgcggcaaggccttcagaaagaccagcagcctgacccagcacgagagaatccacaccggcgagaagccctacgcctgcggcgactgcggcaaggccttcagccagaacatgcacctgatcgtgcaccagagaacccacaccggcgagaagccctacgtgtgccccgagtgcggcagagccttcagccagaacatgcacctgaccgagcaccagagaacccacaccggcgagaagccctacgcctgcaaggagtgcggcaaggccttcaacaagagcagcagcctgaccctgcaccagagaaaccacaccggcgagaagccctacgtgtgcggcgagtgcggcaaggccttcagccagagcagctacctgatccagcaccagagattccacatcggcgtgaagcccttcgagtgcagcgagtgcggcaaggccttcagcaagaacagcagcctgacccagcaccagagaatccacaccggcgagaagccctacgagtgctacatctgcaagaagcacttcaccggcagaagcagcctgatcgtgcaccagatcgtgcacaccggcgagaagccctacgtgtgcggcgagtgcggcaaggccttcagccagagcgcctacctgatcgagcaccagagaatccacaccggcgagaagccctacagatgcggccagtgcggcaagagcttcatcaagaacagcagcctgaccgtgcaccagagaatccacaccggcgagaagccctacagatgcggcgagtgcggcaagaccttcagcagaaacaccaacctgaccagacacctgagaatccacacctag

SEQ ID NO: 106190 - DNA, 2286 bp, Artificial Sequence
  Description of Artificial Sequence: Synthetic coding sequence
atggacagcggcggcggcagcctgggcctgcacacccccgacagcagaatggcccacaccatgatcatgcaggacttcgtggccggcatggccggcaccgcccacatcgacggcgaccacatcgtggtgagcgtgcccgaggccgtgctggtgagcgacgtggtgaccgacgacggcatcaccctggaccacggcctggccgccgaggtggtgcacggccccgacatcatcaccgagaccgacgtggtgaccgagggcgtgatcgtgcccgaggccgtgctggaggccgacgtggccatcgaggaggacctggaggaggacgacggcgaccacatcctgaccagcgagctgatcaccgagaccgtgagagtgcccgagcaggtgttcgtggccgacctggtgaccggccccaacggccacctggagcacgtggtgcaggactgcgtgagcggcgtggacagccccaccatggtgagcgaggaggtgctggtgaccaacagcgacaccgagaccgtgatccaggccgccggcggcgtgcccggcagcaccgtgaccatcaagaccgaggacgacgacgacgacgacgtgaagagcaccagcgaggactacctgatgatcagcctggacgacgtgggcgagaagctggagcacatgggcaacacccccctgaagatcggcagcgacggcagccaggaggacgccaaggaggacggcttcggcagcgaggtgatcaaggtgtacatcttcaaggccgaggccgaggacgacgtggagatcggcggcaccgagatcgtgaccgagagcgagtacaccagcggccacagcgtggccggcgtgctggaccagagcagaatgcagagagagaagatggtgtacatggccgtgaaggacagcagccaggaggaggacgacatcagagacgagagaagagtgagcagaagatacgaggactgccaggccagcggcaacaccctggacagcgccctggagagcagaagcagcaccgccgcccagtacctgcagatctgcgacggcatcaacaccaacaaggtgctgaagcagaaggccaagaagagaagaagaggcgagaccagacagtggcagaccgccgtgatcatcggccccgacggccagcccctgaccgtgtacccctgccacatctgcaccaagaagttcaagagcagaggcttcctgaagagacacatgaagaaccaccccgaccacctgatgagaaagaagtaccagtgcaccgactgcgacttcaccaccaacaagaaggtgagcttccacaaccacctggagagccacaagctgatcaacaaggtggacaagacccacgagttcaccgagtacaccagaagatacagagaggccagccccctgagcagcaacaagctgatcctgagagacaaggagcccaagatgcacaagtgcaagtactgcgactacgagaccgccgagcagggcctgctgaacagacacctgctggccgtgcacagcaagaacttcccccacgtgtgcgtggagtgcggcaagggcttcagacaccccagcgagctgaagaagcacatgagaacccacaccggcgagaagccctaccagtgccagtactgcatcttcagatgcgccgaccagagcaacctgaagacccacatcaagagcaagcacggcaacaacctgccctacaagtgcgagcactgcccccaggccttcggcgacgagagagagctgcagagacacctggacctgttccagggccacaagacccaccagtgcccccactgcgaccacaagagcaccaacagcagcgacctgaagagacacatcatcagcgtgcacaccaaggacttcccccacaagtgcgaggtgtgcgacaagggcttccacagacccagcgagctgaagaagcacagcgacatccacaagggcagaaagatccaccagtgcagacactgcgacttcaagaccagcgaccccttcatcctgagcggccacatcctgagcgtgcacaccaaggaccagcccctgaagtgcaagagatgcaagagaggcttcagacagcagaacgagctgaagaagcacatgaagacccacaccggcagaaagatctaccagtgcgagtactgcgagtacagcaccaccgacgccagcggcttcaagagacacgtgatcagcatccacaccaaggactacccccacagatgcgagttctgcaagaagggcttcagaagacccagcgagaagaaccagcacatcatgagacaccacaaggaggccctgatgtag

SEQ ID NO: 106191 - DNA, 2286 bp, Artificial Sequence; identical to SEQ ID NO: 106190
  Description of Artificial Sequence: Synthetic coding sequence

SEQ ID NO: 106192 - DNA, 2310 bp, Artificial Sequence
  Description of Artificial Sequence: Synthetic coding sequence
atgcaggacttcgtggccggcatggccggcaccgcccacatcgacggcgaccacatcgtggtgagcgtgcccgaggccgtgctggtgagcgacgtggtgaccgacgacggcatcaccctggaccacggcctggccgccgaggtggtgcacggccccgacatcatcaccgagaccgacgtggtgaccgagggcgtgatcgtgcccgaggccgtgctggaggccgacgtggccatcgaggaggacctggaggaggacgacggcgaccacatcctgaccagcgagctgatcaccgagaccgtgagagtgcccgagcaggtgttcgtggccgacctggtgaccggccccaacggccacctggagcacgtggtgcaggactgcgtgagcggcgtggacagccccaccatggtgagcgaggaggtgctggtgaccaacagcgacaccgagaccgtgatccaggccgccggcggcgtgcccggcagcaccgtgaccatcaagaccgaggacgacgacgacgacgacgtgaagagcaccagcgaggactacctgatgatcagcctggacgacgtgggcgagaagctggagcacatgggcaacacccccctgaagatcggcagcgacggcagccaggaggacgccaaggaggacggcttcggcagcgaggtgatcaaggtgtacatcttcaaggccgaggccgaggacgacgtggagatcggcggcaccgagatcgtgaccgagagcgagtacaccagcggccacagcgtggccggcgtgctggaccagagcagaatgcagagagagaagatggtgtacatggccgtgaaggacagcagccaggaggaggacgacatcagctgcgccgagatcgccgacgaggtgtacatggaggtgatcgtgggcgaggaggagggcaccagcctgcccgagatccagctggaggacagcgacgtgaacaagaccgtggtgcccgtggtgtgggccgccgcctacggcaacaccctggacagcgccctggagagcagaagcagcaccgccgcccagtacctgcagatctgcgacggcatcaacaccaacaaggtgctgaagcagaaggccaagaagagaagaagaggcgagaccagacagtggcagaccgccgtgatcatcggccccgacggccagcccctgaccgtgtacccctgccacatctgcaccaagaagttcaagagcagaggcttcctgaagagacacatgaagaaccaccccgaccacctgatgagaaagaagtaccagtgcaccgactgcgacttcaccaccaacaagaaggtgagcttccacaaccacctggagagccacaagctgatcaacaaggtggacaagacccacgagttcaccgagtacaccagaagatacagagaggccagccccctgagcagcaacaagctgatcctgagagacaaggagcccaagatgcacaagtgcaagtactgcgactacgagaccgccgagcagggcctgctgaacagacacctgctggccgtgcacagcaagaacttcccccacgtgtgcgtggagtgcggcaagggcttcagacaccccagcgagctgaagaagcacatgagaacccacaccggcgagaagccctaccagtgccagtactgcatcttcagatgcgccgaccagagcaacctgaagacccacatcaagagcaagcacggcaacaacctgccctacaagtgcgagcactgcccccaggccttcggcgacgagagagagctgcagagacacctggacctgttccagggccacaagacccaccagtgcccccactgcgaccacaagagcaccaacagcagcgacctgaagagacacatcatcagcgtgcacaccaaggacttcccccacaagtgcgaggtgtgcgacaagggcttccacagacccagcgagctgaagaagcacagcgacatccacaagggcagaaagatccaccagtgcagacactgcgacttcaagaccagcgaccccttcatcctgagcggccacatcctgagcgtgcacaccaaggaccagcccctgaagtgcaagagatgcaagagaggcttcagacagcagaacgagctgaagaagcacatgaagacccacaccggcagaaagatctaccagtgcgagtactgcgagtacagcaccaccgacgccagcggcttcaagagacacgtgatcagcatccacaccaaggactacccccacagatgcgagttctgcaagaagggcttcagaagacccagcgagaagaaccagcacatcatgagacaccacaaggaggccctgatgtag

SEQ ID NO: 106193 - DNA, 1812 bp, Artificial Sequence
  Description of Artificial Sequence: Synthetic coding sequence
atgatcagcctggacgacgtgggcgagaagctggagcacatgggcaacacccccctgaagatcggcagcgacggcagccaggaggacgccaaggaggacggcttcggcagcgaggtgatcaaggtgtacatcttcaaggccgaggccgaggacgacgtggagatcggcggcaccgagatcgtgaccgagagcgagtacaccagcggccacagcgtggccggcgtgctggaccagagcagaatgcagagagagaagatggtgtacatggccgtgaaggacagcagccaggaggaggacgacatcagctgcgccgagatcgccgacgaggtgtacatggaggtgatcgtgggcgaggaggagggcaccagcctgcccgagatccagctggaggacagcgacgtgaacaagaccgtggtgcccgtggtgtgggccgccgcctacggcgacgagagaagagtgagcagaagatacgaggactgccaggccagcggcaacaccctggacagcgccctggagagcagaagcagcaccgccgcccagtacctgcagatctgcgacggcatcaacaccaacaaggtgctgaagcagaaggccaagaagagaagaagaggcgagaccagacagtggcagaccgccgtgatcatcggccccgacggccagcccctgaccgtgtacccctgccacatctgcaccaagaagttcaagagcagaggcttcctgaagagacacatgaagaaccaccccgaccacctgatgagaaagaagtaccagtgcaccgactgcgacttcaccaccaacaagaaggtgagcttccacaaccacctggagagccacaagctgatcaacaaggtggacaagacccacgagttcaccgagtacaccagaagatacagagaggccagccccctgagcagcaacaagctgatcctgagagacaaggagcccaagatgcacaagtgcaagtactgcgactacgagaccgccgagcagggcctgctgaacagacacctgctggccgtgcacagcaagaacttcccccacgtgtgcgtggagtgcggcaagggcttcagacaccccagcgagctgaagaagcacatgagaacccacaccggcgagaagccctaccagtgccagtactgcatcttcagatgcgccgaccagagcaacctgaagacccacatcaagagcaagcacggcaacaacctgccctacaagtgcgagcactgcccccaggccttcggcgacgagagagagctgcagagacacctggacctgttccagggccacaagacccaccagtgcccccactgcgaccacaagagcaccaacagcagcgacctgaagagacacatcatcagcgtgcacaccaaggacttcccccacaagtgcgaggtgtgcgacaagggcttccacagacccagcgagctgaagaagcacagcgacatccacaagggcagaaagatccaccagtgcagacactgcgacttcaagaccagcgaccccttcatcctgagcggccacatcctgagcgtgcacaccaaggaccagcccctgaagtgcaagagatgcaagagaggcttcagacagcagaacgagctgaagaagcacatgaagacccacaccggcagaaagatctaccagtgcgagtactgcgagtacagcaccaccgacgccagcggcttcaagagacacgtgatcagcatccacaccaaggactacccccacagatgcgagttctgcaagaagggcttcagaagacccagcgagaagaaccagcacatcatgagacaccacaaggaggccctgatgtag

SEQ ID NO: 106194 - DNA, 1611 bp, Artificial Sequence
  Description of Artificial Sequence: Synthetic coding sequence
atgggccccctgcagttcagagacgtggccatcgagttcagcctggaggagtggcactgcctggacaccgcccagagaaacctgtacagaaacgtgatgctggagaactacagaaacctggtgttcctgggcatcgtggtgagcaagcccgacctgatcacctgcctggagcagggcaagaagcccctgaccatgaagaagcacgagatggtggccaaccccagcgtgacctgcagccacttcgccagagacctgtggcccgagcagagcatcaaggacagcttccagaaggtgaccctgagaagatacgagaactacggccacgacaacctgcagttcaagaagggctgcgagagcgtggacgagtgcaaggtgcacaagagaggctacaacggcctgaaccagtacctgaccaccacccagagcaagatcttccagtgcgacaagtacgtgaaggtgatccacaagttcagcaacagcaacagacacaagatcagacacaccggcaagaagcccttcaagtgcatcgagtgcggcaaggccttcaaccagagcagcaccctgaccacccacaagaagatccacaccggcgagaagcccttcaagtgcgaggagtgcggcaaggccttcaactggagcagccacctgaccacccacaagagaatccacaccggcgagaagagatacaagtgcgaggactgcggcaaggccttcagcagattcagctacctgaccgcccacaagatcatccacagcggcgagaagccctacaagtgcgaggagtgcggcaaggccttcaagagaagcagcaacctgaccacccacaagatcatccacaccggcgagaagccctacaagtgcgaggagtgcggcaaggccttcaagagaagcagcatcctgaccgcccacaagatcatccacagcggcgagaagccctacaagtgcgaggagtgcggcaaggccttcaagcaccccagcgtgctgaccacccacaagagaatccacaccggcgagaagccctacaagtgcgaggagtgcggcagagccttcaagtacttcagcagcctgaccacccacaagatcatccacagcggcgagaagccctacaagtgcgaggagtgcggcaaggccttcaactggagcagccacctgaccacccacaagagaatccacaccggcgagaagccctacaagtgcgaggagtgcggcgaggccttcaagtacagcagcagcctgaccacccacaagatcatccacaccggccagcagcccttcaagtgcgaggagtgcggcaaggccttcaagtgcttcagcatcctgaccacccacaagagaatccacaccggcgagaagccctacaagtgcgaggagtgcggcaaggccttcaacagcagcagccacctgaccgcccacaagagaatccacaccggcgagaagccctacaagtgcgagagatgcggcaaggccttcaagagaagcttcatcctgaccagacacaagagaatccacaccggcgagaagccctacaagtgcgaggagtgcggcaagggcttcaagtgccccagcaccctgaccacccacaaggtgatccacaccggcgagaagctgtag

SEQ ID NO: 106195 - DNA, 1935 bp, Artificial Sequence
  Description of Artificial Sequence: Synthetic coding sequence
atggagatccccgcccccgagcccgagaagaccgccctgagcagccaggaccccgccctgagcctgaaggagaacctggaggacatcagcggctggggcctgcccgaggccagaagcaaggagagcgtgagcttcaaggacgtggccgtggacttcacccaggaggagtggggccagctggacagcccccagagagccctgtacagagacgtgatgctggagaactaccagaacctgctggccctgggcccccccctgcacaagcccgacgtgatcagccacctggagagaggcgaggagccctggagcatgcagagagaggtgcccagaggcccctgccccgagtgggagctgaaggccgtgcccagccagcagcagggcatctgcaaggaggagcccgcccaggagcccatcatggagagacccctgggcggcgcccaggcctggggcagacaggccggcgccctgcagagaagccaggccgccccctgggcccccgcccccgccatggtgtgggacgtgcccgtggaggagttccccctgagatgccccctgttcgcccagcagagagtgcccgagggcggccccctgctggacaccagaaagaacgtgcaggccaccgagggcagaaccaaggcccccgccagactgtgcgccggcgagaacgccagcacccccagcgagcccgagaagttcccccaggtgagaagacagagaggcgccggcgccggcgagggcgagttcgtgtgcggcgagtgcggcaaggccttcagacagagcagcagcctgaccctgcacagaagatggcacagcagagagaaggcctacaagtgcgacgagtgcggcaaggccttcacctggagcaccaacctgctggagcacagaagaatccacaccggcgagaagcccttcttctgcggcgagtgcggcaaggccttcagctgccacagcagcctgaacgtgcaccagagaatccacaccggcgagagaccctacaagtgcagcgcctgcgagaaggccttcagctgcagcagcctgctgagcatgcacctgagagtgcacaccggcgagaagccctacagatgcggcgagtgcggcaaggccttcaaccagagaacccacctgaccagacaccacagaatccacaccggcgagaagccctaccagtgcggcagctgcggcaaggccttcacctgccacagcagcctgaccgtgcacgagaagatccacagcggcgacaagcccttcaagtgcagcgactgcgagaaggccttcaacagcagaagcagactgaccctgcaccagagaacccacaccggcgagaagcccttcaagtgcgccgactgcggcaagggcttcagctgccacgcctacctgctggtgcacagaagaatccacagcggcgagaagcccttcaagtgcaacgagtgcggcaaggccttcagcagccacgcctacctgatcgtgcacagaagaatccacaccggcgagaagcccttcgactgcagccagtgctggaaggccttcagctgccacagcagcctgatcgtgcaccagagaatccacaccggcgagaagccctacaagtgcagcgagtgcggcagagccttcagccagaaccactgcctgatcaagcaccagaagatccacagcggcgagaagagcttcaagtgcgagaagtgcggcgagatgttcaactggagcagccacctgaccgagcaccagagactgcacagcgagggcaagcccctggccatccagttcaacaagcacctgctgagcacctactacgtgcccggcagcctgctgggcgccggcgacgccggcctgagagacgtggaccccatcgacgccctggacgtggccaagctgctgtgcgtggtgccccccagagccggcagaaacttcagcctgggcagcaagcccagaaactag

SEQ ID NO: 106196 - DNA, 1935 bp, Artificial Sequence; identical to SEQ ID NO: 106195
  Description of Artificial Sequence: Synthetic coding sequence

SEQ ID NO: 106197 - DNA, 1839 bp, Artificial Sequence
  Description of Artificial Sequence: Synthetic coding sequence
atggagatccccgcccccgagcccgagaagaccgccctgagcagccaggaccccgccctgagcctgaaggagaacctggaggacatcagcggctggggcctgcccgaggccagaagcaaggagagcgtgagcttcaaggacgtggccgtggacttcacccaggaggagtggggccagctggacagcccccagagagccctgtacagagacgtgatgctggagaactaccagaacctgctggccctggagtgggagctgaaggccgtgcccagccagcagcagggcatctgcaaggaggagcccgcccaggagcccatcatggagagacccctgggcggcgcccaggcctggggcagacaggccggcgccctgcagagaagccaggccgccccctgggcccccgcccccgccatggtgtgggacgtgcccgtggaggagttccccctgagatgccccctgttcgcccagcagagagtgcccgagggcggccccctgctggacaccagaaagaacgtgcaggccaccgagggcagaaccaaggcccccgccagactgtgcgccggcgagaacgccagcacccccagcgagcccgagaagttcccccaggtgagaagacagagaggcgccggcgccggcgagggcgagttcgtgtgcggcgagtgcggcaaggccttcagacagagcagcagcctgaccctgcacagaagatggcacagcagagagaaggcctacaagtgcgacgagtgcggcaaggccttcacctggagcaccaacctgctggagcacagaagaatccacaccggcgagaagcccttcttctgcggcgagtgcggcaaggccttcagctgccacagcagcctgaacgtgcaccagagaatccacaccggcgagagaccctacaagtgcagcgcctgcgagaaggccttcagctgcagcagcctgctgagcatgcacctgagagtgcacaccggcgagaagccctacagatgcggcgagtgcggcaaggccttcaaccagagaacccacctgaccagacaccacagaatccacaccggcgagaagccctaccagtgcggcagctgcggcaaggccttcacctgccacagcagcctgaccgtgcacgagaagatccacagcggcgacaagcccttcaagtgcagcgactgcgagaaggccttcaacagcagaagcagactgaccctgcaccagagaacccacaccggcgagaagcccttcaagtgcgccgactgcggcaagggcttcagctgccacgcctacctgctggtgcacagaagaatccacagcggcgagaagcccttcaagtgcaacgagtgcggcaaggccttcagcagccacgcctacctgatcgtgcacagaagaatccacaccggcgagaagcccttcgactgcagccagtgctggaaggccttcagctgccacagcagcctgatcgtgcaccagagaatccacaccggcgagaagccctacaagtgcagcgagtgcggcagagccttcagccagaaccactgcctgatcaagcaccagaagatccacagcggcgagaagagcttcaagtgcgagaagtgcggcgagatgttcaactggagcagccacctgaccgagcaccagagactgcacagcgagggcaagcccctggccatccagttcaacaagcacctgctgagcacctactacgtgcccggcagcctgctgggcgccggcgacgccggcctgagagacgtggaccccatcgacgccctggacgtggccaagctgctgtgcgtggtgccccccagagccggcagaaacttcagcctgggcagcaagcccagaaactag

SEQ ID NO: 106198 - DNA, 210 bp, Artificial Sequence
  Description of Artificial Sequence: Synthetic coding sequence
atggagatccccgcccccgagcccgagaagaccgccctgagcagccaggaccccgccctgagcctgaaggagaacctggaggacatcagcggctggggcctgcccgaggccagaagcaagagcctggccctggtgacccaggccggcgtgcagtggagaaacctgggcagcctgcagcccccccccctgggcttcaagcagttcagctag

SEQ ID NO: 106199 - DNA, 1935 bp, Artificial Sequence
  Description of Artificial Sequence: Synthetic coding sequence
atggccgaggccgtggccgcccccatcagcccctggaccatggccgccaccatccaggccatggagagaaagatcgagagccaggccgccagactgctgagcctggagggcagaaccggcatggccgagaagaagctggccgactgcgagaagaccgccgtggagttcggcaaccagctggagggcaagtgggccgtgctgggcaccctgctgcaggagtacggcctgctgcagagaagactggagaacgtggagaacctgctgagaaacagaaacttctggatcctgagactgccccccggcagcaagggcgagagccccaaggagtggggcaagctggaggactggcagaaggagctgtacaagcacgtgatgagaggcaactacgagaccctggtgagcctggactacgccatcagcaagcccgaggtgctgagccagatcgagcagggcaaggagccctgcaactggagaagacccggccccaagatccccgacgtgcccgtggaccccagccccggcagcggcccccccgtgcccgcccccgacctgctgatgcagatcaagcaggagggcgagctgcagctgcaggagcagcaggccctgggcgtggaggcctgggccgccggccagcccgacatcggcgaggagccctggggcctgagccagctggacagcggcgccggcgacatcagcaccgacgccaccagcggcgtgcacagcaacttcagcaccaccatcccccccaccagctggcagaccgacctgcccccccaccaccccagcagcgcctgcagcgacggcaccctgaagctgaacaccgccgccagcaccgaggacgtgaagatcgtgatcaagaccgaggtgcaggaggaggaggtggtggccacccccgtgcaccccaccgacctggaggcccacggcaccctgttcggccccggccaggccaccagattcttccccagccccgcccaggagggcgcctgggagagccagggcagcagcttccccagccaggaccccgtgctgggcctgagagagcccgccagacccgagagagacatgggcgagctgagccccgccgtggcccaggaggagaccccccccggcgactggctgttcggcggcgtgagatggggctggaacttcagatgcaagccccccgtgggcctgaaccccagaaccggccccgagggcctgccctacagcagccccgacaacggcgaggccatcctggaccccagccaggcccccagacccttcaacgagccctgcaagtaccccggcagaaccaagggcttcggccacaagcccggcctgaagaagcaccccgccgccccccccggcggcagacccttcacctgcgccacctgcggcaagagcttccagctgcaggtgagcctgagcgcccaccagagaagctgcggcgcccccgacggcagcggccccggcaccggcggcggcggcagcggcagcggcggcggcggcggcggcagcggcggcggcagcgccagagacggcagcgccctgagatgcggcgagtgcggcagatgcttcaccagacccgcccacctgatcagacacagaatgctgcacaccggcgagagacccttcccctgcaccgagtgcgagaagagattcaccgagagaagcaagctgatcgaccactacagaacccacaccggcgtgagacccttcacctgcaccgtgtgcggcaagagcttcatcagaaaggaccacctgagaaagcaccagagaaaccacgccgccggcgccaagacccccgccagaggccagcccctgcccaccccccccgccccccccgaccccttcaagagccccgccagcaagggccccctggccagcaccgacctggtgaccgactggacctgcggcctgagcgtgctgggccccaccgacggcggcgacatgtag

SEQ ID NO: 106200 - DNA, 1938 bp, Artificial Sequence
  Description of Artificial Sequence: Synthetic coding sequence
atggccgaggccgtggccgcccccatcagcccctggaccatggccgccaccatccaggccatggagagaaagatcgagagccaggccgccagactgctgagcctggagggcagaaccggcatggccgagaagaagctggccgactgcgagaagaccgccgtggagttcggcaaccagctggagggcaagtgggccgtgctgggcaccctgctgcaggagtacggcctgctgcagagaagactggagaacgtggagaacctgctgagaaacagaaacttctggatcctgagactgccccccggcagcaagggcgagagccccaaggagtggggcaagctggaggactggcagaaggagctgtacaagcacgtgatgagaggcaactacgagaccctggtgagcctggactacgccatcagcaagcccgaggtgctgagccagatcgagcagggcaaggagccctgcaactggagaagacccggccccaagatccccgacgtgcccgtggaccccagccccggcagcggcccccccgtgcccgcccccgacctgctgatgcagatcaagcaggagggcgagctgcagctgcaggagcagcaggccctgggcgtggaggcctgggccgccggccagcccgacatcggcgaggagccctggggcctgagccagctggacagcggcgccggcgacatcagcaccgacgccaccagcggcgtgcacagcaacttcagcaccaccatcccccccaccagctggcagaccgacctgcccccccaccaccccagcagcgcctgcagcgacggcaccctgaagctgaacaccgccgccagcaccgaggccgacgtgaagatcgtgatcaagaccgaggtgcaggaggaggaggtggtggccacccccgtgcaccccaccgacctggaggcccacggcaccctgttcggccccggccaggccaccagattcttccccagccccgcccaggagggcgcctgggagagccagggcagcagcttccccagccaggaccccgtgctgggcctgagagagcccgccagacccgagagagacatgggcgagctgagccccgccgtggcccaggaggagaccccccccggcgactggctgttcggcggcgtgagatggggctggaacttcagatgcaagccccccgtgggcctgaaccccagaaccggccccgagggcctgccctacagcagccccgacaacggcgaggccatcctggaccccagccaggcccccagacccttcaacgagccctgcaagtaccccggcagaaccaagggcttcggccacaagcccggcctgaagaagcaccccgccgccccccccggcggcagacccttcacctgcgccacctgcggcaagagcttccagctgcaggtgagcctgagcgcccaccagagaagctgcggcgcccccgacggcagcggccccggcaccggcggcggcggcagcggcagcggcggcggcggcggcggcagcggcggcggcagcgccagagacggcagcgccctgagatgcggcgagtgcggcagatgcttcaccagacccgcccacctgatcagacacagaatgctgcacaccggcgagagacccttcccctgcaccgagtgcgagaagagattcaccgagagaagcaagctgatcgaccactacagaacccacaccggcgtgagacccttcacctgcaccgtgtgcggcaagagcttcatcagaaaggaccacctgagaaagcaccagagaaaccacgccgccggcgccaagacccccgccagaggccagcccctgcccaccccccccgccccccccgaccccttcaagagccccgccagcaagggccccctggccagcaccgacctggtgaccgactggacctgcggcctgagcgtgctgggccccaccgacggcggcgacatgtag

SEQ ID NO: 106201 - DNA, 2172 bp, Artificial Sequence
  Description of Artificial Sequence: Synthetic coding sequence
atgagcctgctgaaggagagaaagcccaagaagccccactacatccccagaccccccggcaagcccttcaagtacaagtgcttccagtgccccttcacctgcaacgagaagagccacctgttcaaccacatgaagtacggcctgtgcaagaacagcatcaccctggtgagcgagcaggacagagtgcccaagtgccccaagagcaacagcctggaccccaagcagaccaaccagcccgacgccaccgccaagcccgccagcagcaagagcgtggccaacggcctgagcgccttcgacagcaagctgcagcacagcagcgccagagaggacatcaaggagaacctggagctgcaggccagaggcacccacagatgcctgggccagaagcccgccctgcacagagccagcccctgcaagagccccgcccccgaggccgccctgggcgcccagcccgccctggagggcgccgccagacccagcgccttcgtgcccgtgggcgagcacagactgaagggccccgacaacgccgaggcccccgagaccctggccctgcacaaccccaccgccaaggccgtgagcttccacaccaagagcgccttccacacccccggctacccctggaaggccggcagccccttcctgccccccgagttcccccacaagatcagcagcaccaagggcctgggcgccatcagcccctacatgcaccccaccatccccgagtaccccccccacttctacaccgagcacggcctggccaccatctacagcccctacctgctggccggcagcagccccgagtgcgacgcccccctgctgagcgtgtacggcacccaggaccccagacacttcctgccccaccccggccccatccccaagcacctggcccccagccccgccacctacgaccactacagattcttccagcagtaccccagcaacctgcccatcccctacggcttctacagacccgagagcgccttcagcagctacggcctgagactgccccccgtgaccggcctgaccagagaccagagcagccacctgctggaggaggccaccctggtgtaccccgccagcagccccagcagactgaaccccagcgaccccaacagaaagcacgtggagttcgagagccccatccccgaggccaaggacagcagcaaggccggccagagagacaccgagggcagcaagatgagccccagagccggcagcgccgccaccggcagccccggcagacccagccccaccgacttcatgcagaccagccagacctgcgagggcctgtacgacctgagcaacaaggccgccagcagcgccctgggcagactgtacccccccgagcagagcctgaccgccttcagacccgtgaagaagagcaccgagtgcctgcccgcccaggccgccgagaccaccgccgagagccccgtgagcctgaacgtggtgaacggcgacccccccgcccccaccggcagcgccagcctggtgagcgaggccgcccccagcagccccgacgacagcagcggcatgggccccctgaacctgagcaagaagagcgagatcaacctggccgccacccacgagcccacctaccagggcagcccccaggccgagaccgccagcttcagcgagctgcaggacctgcccctgaacctgagcgtgaaggacccctgcaacacccaggcccccagacccgccttccccggcagacccagagccgccgagcccgccgccgccgtgccccagaagaccggcaccgagggcagcgaggacggccccagccaccccgagaccaagcccggcagcctggacggcgacggcgccccccccaccggccccggcgaggaggcccccgacgcctgcgccgtggacagcagcgaggagcagaagcagaccgccgccgtggccctgtgccagctggccgcctacagccccagaaacatcagagtgggcgacggcgacgccgccgcccccgagcccgcctgcagacaggacacccccaccctgagcagcatggagagccaggaggcccagtgcgacctgagacccaagggccagaagagaaccagcctgagagacgccggcaagagccagcagggcgccaagaaggccaagctgcaggacaccgccagagtgttcaccctgagaagaagagccagagtgagctag

SEQ ID NO: 106202 - DNA, 951 bp, Artificial Sequence
  Description of Artificial Sequence: Synthetic coding sequence
atgagccccagagccggcagcgccgccaccggcagccccggcagacccagccccaccgacttcatgcagaccagccagacctgcgagggcctgtacgacctgagcaacaaggccgccagcagcgccctgggcagactgtacccccccgagcagagcctgaccgccttcagacccgtgaagaagagcaccgagtgcctgcccgcccaggccgccgagaccaccgccgagagccccgtgagcctgaacgtggtgaacggcgacccccccgcccccaccggcagcgccagcctggtgagcgaggccgcccccagcagccccgacgacagcagcggcaagagcgagatcaacctggccgccacccacgagcccacctaccagggcagcccccaggccgagaccgccagcttcagcgagctgcaggacctgcccctgaacctgagcgtgaaggacccctgcaacacccaggcccccagacccgccttccccggcagacccagagccgccgagcccgccgccgccgtgccccagaagaccggcaccgagggcagcgaggacggccccagccaccccgagaccaagcccggcagcctggacggcgacggcgccccccccaccggccccggcgaggaggcccccgacgcctgcgccgtggacagcagcgaggagcagaagcagaccgccgccgtggccctgtgccagctggccgcctacagccccagaaacatcagagtgggcgacggcgacgccgccgcccccgagcccgcctgcagacaggacacccccaccctgagcagcatggagagccaggaggcccagtgcgacctgagacccaagggccagaagagaaccagcctgagagacgccggcaagagccagcagggcgccaagaaggccaagctgcaggacaccgccagagtgttcaccctgagaagaagagccagagtgagctag

SEQ ID NO: 106203 - DNA, 891 bp, Artificial Sequence
  Description of Artificial Sequence: Synthetic coding sequence
atgtacttcagccaggaggagtgggagctgctggaccccacccagaaggccctgtacaacgacgtgatgcaggagaactacgagaccgtgatcagcctggccctgttcgtgctgcccaagcccaaggtgatcagctgcctggagcagggcgaggagccctgggtgcaggtgagccccgagttcaaggacagcgccggcaagagccccaccggcctgaagctgaagaacgacaccgagaaccaccagcccgtgagcctgagcgacctggagatccaggccagcgccggcgtgatcagcaagaaggccaaggtgaaggtgccccagaagaccgccggcaaggagaaccacttcgacatgcacagagtgggcaagtggcaccaggacttccccgtgaagaagagaaagaagctgagcacctggaagcaggagctgctgaagctgatggacagacacaagaaggactgcgccagagagaagcccttcaagtgccaggagtgcggcaagaccttcagagtgagcagcgacctgatcaagcaccagagaatccacaccgaggagaagccctacaagtgccagcagtgcgacaagagattcagatggagcagcgacctgaacaagcacctgaccacccaccagggcatcaagccctacaagtgcagctggtgcggcaagagcttcagccagaacaccaacctgcacacccaccagagaacccacaccggcgagaagcccttcacctgccacgagtgcggcaagaagttcagccagaacagccacctgatcaagcacagaagaacccacaccggcgagcagccctacacctgcagcatctgcagaagaaacttcagcagaagaagcagcctgctgagacaccagaagctgcacctgtag

SEQ ID NO: 106204 - DNA, 891 bp, Artificial Sequence; identical to SEQ ID NO: 106203
  Description of Artificial Sequence: Synthetic coding sequence

SEQ ID NO: 106205 - DNA, 1248 bp, Artificial Sequence
  Description of Artificial Sequence: Synthetic coding sequence
atggccatgagagagctgaacgccgacagctgcagcagcccccagatgggcgccatgtgggagaccagcggcagcgtgaaggagaacagcagccagagcaagaagtacagcaccaagatcgagaacctgggccccgagagcgcctgcagacacttctggagcttcagataccacgaggccaccggccccctggagaccatcagccagctgcagaagctgtgccaccagtggctgagacccgagatccacagcaaggagcagatcctggagatgctggtgctggagcagttcctgagcatcctgcccaaggagacccagaactgggtgcagaagcaccacccccagaacgtgaagcaggccctggtgctggtggagttcctgcagagagagcccgacggcaccaagaacgagagcctgctgaccttcgaggacgtggccgtgtacttcagcgaggaggagtggcagctgctgaaccccctggagaagaccctgtacaacgacgtgatgcaggacatctacgagaccgtgatcagcctgggcctgaagctgaagaacgacaccggcaacgaccaccccatcagcgtgagcaccagcgagatccagaccagcggctgcgaggtgagcaagaagaccagaatgaagatcgcccagaagaccatgggcagagagaaccccggcgacacccacagcgtgcagaagtggcacagagccttccccagaaagaagagaaagaagcccgccacctgcaagcaggagctgcccaagctgatggacctgcacggcaagggccccaccggcgagaagcccttcaagtgccaggagtgcggcaagagcttcagagtgagcagcgacctgatcaagcaccacagaatccacaccggcgagaagccctacaagtgccagcagtgcgacagaagattcagatggagcagcgacctgaacaagcacttcatgacccaccagggcatcaagccctacagatgcagctggtgcggcaagagcttcagccacaacaccaacctgcacacccaccagagaatccacaccggcgagaagcccttcaagtgcgacgagtgcggcaagagattcatccagaacagccacctgatcaagcaccagagaacccacaccggcgagcagccctacacctgcagcctgtgcaagagaaacttcagcagaagaagcagcctgctgagacaccagaagctgcacagaagaagagaggcctgcctggtgagccccaactag

SEQ ID NO: 106206 - DNA, 1533 bp, Artificial Sequence
  Description of Artificial Sequence: Synthetic coding sequence
atggccatgagagagctgaacgccgacagctgcagcagcccccagatgggcgccatgtgggagaccagcggcagcgtgaaggagaacagcagccagagcaagaagtacagcaccaagatcgagaacctgggccccgagagcgcctgcagacacttctggagcttcagataccacgaggccaccggccccctggagaccatcagccagctgcagaagctgtgccaccagtggctgagacccgagatccacagcaaggagcagatcctggagatgctggtgctggagcagttcctgagcatcctgcccaaggagacccagaactgggtgcagaagcaccacccccagaacgtgaagcaggccctggtgctggtggagttcctgcagagagagcccgacggcaccaagaacgaggtgaccgcccacgagctgggcaaggaggccgtgctgctgggcggcaccgccgtggcccccggcttcaagtggaagcccgccgagccccagcccatgggcgtgttccagaaggagtactggaacacctacagagtgctgcaggagcagctgggctggaacacccacaaggagacccagcccgtgtacgagagagccgtgcacgaccagcagatgctggccctgagcgagcagaagagaatcaagcactggaagatggccagcaagctgatcctgcccgagagcctgagcctgctgaccttcgaggacgtggccgtgtacttcagcgaggaggagtggcagctgctgaaccccctggagaagaccctgtacaacgacgtgatgcaggacatctacgagaccgtgatcagcctgggcctgaagctgaagaacgacaccggcaacgaccaccccatcagcgtgagcaccagcgagatccagaccagcggctgcgaggtgagcaagaagaccagaatgaagatcgcccagaagaccatgggcagagagaaccccggcgacacccacagcgtgcagaagtggcacagagccttccccagaaagaagagaaagaagcccgccacctgcaagcaggagctgcccaagctgatggacctgcacggcaagggccccaccggcgagaagcccttcaagtgccaggagtgcggcaagagcttcagagtgagcagcgacctgatcaagcaccacagaatccacaccggcgagaagccctacaagtgccagcagtgcgacagaagattcagatggagcagcgacctgaacaagcacttcatgacccaccagggcatcaagccctacagatgcagctggtgcggcaagagcttcagccacaacaccaacctgcacacccaccagagaatccacaccggcgagaagcccttcaagtgcgacgagtgcggcaagagattcatccagaacagccacctgatcaagcaccagagaacccacaccggcgagcagccctacacctgcagcctgtgcaagagaaacttcagcagaagaagcagcctgctgagacaccagaagctgcacagaagaagagaggcctgcctggtgagccccaactag

SEQ ID NO: 106207 - DNA, 1548 bp, Artificial Sequence
  Description of Artificial Sequence: Synthetic coding sequence
atggagagcctgggcctgcacaccgtgaccctgagcgacggcaccaccgcctacgtgcagcaggccgtgaagggcgagaagctgctggagggccaggtgatccagctggaggacggcaccaccgcctacatccaccaggtgaccgtgcagaaggaggccctgagcttcgaggacggccagcccgtgcagctggaggacggcagcatggcctacatccacagaacccccagagagggctacgaccccagcaccctggaggccgtgcagctggaggacggcagcaccgcctacatccaccaccccgtggccgtgcccagcgagagcaccatcctggccgtgcagaccgaggtgggcctggaggacctggccgccgaggacgacgagggcttcagcgccgacgccgtggtggccctggagcagtacgccagcaaggtgctgcacgacagccagatccccagaaacggcaagggccagcaggtgggcgacagagccttcagatgcggctacaagggctgcggcagactgtacaccaccgcccaccacctgaaggtgcacgagagagcccacaccggcgacagaccctacagatgcgacttccccagctgcggcaaggccttcgccaccggctacggcctgaagagccacgtgagaacccacaccggcgagaagccctacaagtgccccgaggagctgtgcagcaaggccttcaagaccagcggcgacctgcagaagcacgtgagaacccacaccggcgagagacccttccagtgccccttcgagggctgcggcagaagcttcaccaccagcaacatcagaaaggtgcacgtgagaacccacaccggcgagagaccctacacctgccccgagccccactgcggcagaggcttcaccagcgccaccaactacaagaaccacgtgagaatccacaccggcgagaagccctacgtgtgcaccgtgcccggctgcggcaagagattcaccgagtacagcagcctgtacaagcaccacgtggtgcacacccactgcaagccctacacctgcagcacctgcggcaagacctacagacagaccagcaccctggccatgcacaagagaagcgcccacggcgagctggaggccaccgaggagagcgagcaggccctgtacgagcagcagcagctggaggccgccagcgccgccgaggagagccccccccccaagagacccagaatcgcctacctgagcgaggtgaaggaggagagagacgacatccccgcccaggtggccatggtgaccgaggaggacggcgccccccaggtggccctgatcacccaggacggcgcccagcaggtgaccatcatcaccagcggcgccgtggtggccgaggacagcagcgtggccagcctgagacaccagcaggtggccctgctggccaccgccaacggcacccacatcgccgtgcagctggaggagcagcagaccctggaggaggccatcaacgtggccaccgccgccatgcagcagggcgccgtgaccctggagaccaccgtgagcgagagcggctgctag

SEQ ID NO: 106208 - DNA, 1713 bp, Artificial Sequence
  Description of Artificial Sequence: Synthetic coding sequence
atggagagcctgggcctgcacaccgtgaccctgagcgacggcaccaccgcctacgtgcagcaggccgtgaagggcgagaagctgctggagggccaggtgatccagctggaggacggcaccaccgcctacatccaccaggtgaccgtgcagaaggaggccctgagcttcgaggacggccagcccgtgcagctggaggacggcagcatggcctacatccacagaacccccagagagggctacgaccccagcaccctggaggccgtgcagctggaggacggcagcaccgcctacatccaccaccccgtggccgtgcccagcgagagcaccatcctggccgtgcagaccgaggtgggcctggaggacctggccgccgaggacgacgagggcttcagcgccgacgccgtggtggccctggagcagtacgccagcaaggtgctgcacgacagccagatccccagaaacggcaagggccagcaggtgggcgacagagccttcagatgcggctacaagggctgcggcagactgtacaccaccgcccaccacctgaaggtgcacgagagagcccacaccggcgacagaccctacagatgcgacttccccagctgcggcaaggccttcgccaccggctacggcctgaagagccacgtgagaacccacaccggcgagaagccctacaagtgccccgaggagctgtgcagcaaggccttcaagaccagcggcgacctgcagaagcacgtgagaacccacaccggcgagagacccttccagtgccccttcgagggctgcggcagaagcttcaccaccagcaacatcagaaaggtgcacgtgagaacccacaccggcgagagaccctacacctgccccgagccccactgcggcagaggcttcaccagcgccaccaactacaagaaccacgtgagaatccacaccggcgagaagccctacgtgtgcaccgtgcccggctgcggcaagagattcaccgagtacagcagcctgtacaagcaccacgtggtgcacacccactgcaagccctacacctgcagcacctgcggcaagacctacagacagaccagcaccctggccatgcacaagagaagcgcccacggcgagctggaggccaccgaggagagcgagcaggccctgtacgagcagcagcagctggaggccgccagcgccgccgaggagagccccccccccaagagacccagaatcgcctacctgagcgaggtgaaggaggagagagacgacatccccgcccaggtggccatggtgaccgaggaggacggcgccccccaggtggccctgatcacccaggacggcgcccagcaggtgagcctgagccccgaggacctgcaggccctgggcagcgccatcagcatggtgacccagcacggcagcaccaccctgaccatccccagccccgacgccgacctggccaccagcggcacccacaccgtgaccatggtgagcgccgacggcacccagacccagcccgtgaccatcatcaccagcggcgccgtggtggccgaggacagcagcgtggccagcctgagacaccagcaggtggccctgctggccaccgccaacggcacccacatcgccgtgcagctggaggagcagcagaccctggaggaggccatcaacgtggccaccgccgccatgcagcagggcgccgtgaccctggagaccaccgtgagcgagagcggctgctag

SEQ ID NO: 106209 - DNA, 1287 bp, Artificial Sequence
  Description of Artificial Sequence: Synthetic coding sequence
atggagagcctgggcctgcacaccgtgaccctgagcgacggcaccaccgcctacgtgcagcaggccgtgaagggcgagaagctgctggagggccaggtgatccagctggaggacggcaccaccgcctacatccaccaggtgaccgtgcagaaggaggccctgagcttcgaggacggccagcccgtgcagctggaggacggcagcatggcctacatccacagaacccccagagagggctacgaccccagcaccctggaggccgtgcagctggaggacggcagcaccgcctacatccaccaccccgtggccgtgcccagcgagagcaccatcctggccgtgcagaccgaggtgggcctggaggacctggccgccgaggacgacgagggcttcagcgccgacgccgtggtggccctggagcagtacgccagcaaggtgctgcacgacagccagatccccagaaacggcaagggccagcaggtgggcgacagagccttcagatgcggctacaagggctgcggcagactgtacaccaccgcccaccacctgaaggtgcacgagagagcccacaccggcgacagaccctacagatgcgacttccccagctgcggcaaggccttcgccaccggctacggcctgaagagccacgtgagaacccacaccggcgagaagccctacaagtgccccgaggagctgtgcagcaaggccttcaagaccagcggcgacctgcagaagcacgtgagaacccacaccggcgagagacccttccagtgccccttcgagggctgcggcagaagcttcaccaccagcaacatcagaaaggtgcacgtgagaacccacaccggcgagagaccctacacctgccccgagccccactgcggcagaggcttcaccagcgccaccaactacaagaaccacgtgagaatccacaccggcgagaagccctacgtgtgcaccgtgcccggctgcggcaagagattcaccgagtacagcagcctgtacaagcaccacgtggtgcacacccactgcaagccctacacctgcagcacctgcggcaagacctacagacagaccagcaccctggccatgcacaagagaagcggccactgcggccacgccgccagaggctgcgaccccggcgacaacagcgtgggcgagtggctgctgagccccagaggcctgggccccaccccctgctggagaaagtgccacctgcacggccacagctgcccccagggccccagactgtggctgacccacagaagatggccccacagaagcctgggctag

SEQ ID NO: 106210 - DNA, 1635 bp, Artificial Sequence
  Description of Artificial Sequence: Synthetic coding sequence
atggagagcctgggcctgcacaccgtgaccctgagcgacggcaccaccgcctacgtgcagcaggccgtgaagggcgagaagctgctggagggccaggtgatccagctggaggacggcaccaccgcctacatccaccaggtgaccgtgcagaaggagggctacgaccccagcaccctggaggccgtgcagctggaggacggcagcaccgcctacatccaccaccccgtggccgtgcccagcgagagcaccatcctggccgtgcagaccgaggtgggcctggaggacctggccgccgaggacgacgagggcttcagcgccgacgccgtggtggccctggagcagtacgccagcaaggtgctgcacgacagccagatccccagaaacggcaagggccagcaggtgggcgacagagccttcagatgcggctacaagggctgcggcagactgtacaccaccgcccaccacctgaaggtgcacgagagagcccacaccggcgacagaccctacagatgcgacttccccagctgcggcaaggccttcgccaccggctacggcctgaagagccacgtgagaacccacaccggcgagaagccctacaagtgccccgaggagctgtgcagcaaggccttcaagaccagcggcgacctgcagaagcacgtgagaacccacaccggcgagagacccttccagtgccccttcgagggctgcggcagaagcttcaccaccagcaacatcagaaaggtgcacgtgagaacccacaccggcgagagaccctacacctgccccgagccccactgcggcagaggcttcaccagcgccaccaactacaagaaccacgtgagaatccacaccggcgagaagccctacgtgtgcaccgtgcccggctgcggcaagagattcaccgagtacagcagcctgtacaagcaccacgtggtgcacacccactgcaagccctacacctgcagcacctgcggcaagacctacagacagaccagcaccctggccatgcacaagagaagcgcccacggcgagctggaggccaccgaggagagcgagcaggccctgtacgagcagcagcagctggaggccgccagcgccgccgaggagagccccccccccaagagacccagaatcgcctacctgagcgaggtgaaggaggagagagacgacatccccgcccaggtggccatggtgaccgaggaggacggcgccccccaggtggccctgatcacccaggacggcgcccagcaggtgagcctgagccccgaggacctgcaggccctgggcagcgccatcagcatggtgacccagcacggcagcaccaccctgaccatccccagccccgacgccgacctggccaccagcggcacccacaccgtgaccatggtgagcgccgacggcacccagacccagcccgtgaccatcatcaccagcggcgccgtggtggccgaggacagcagcgtggccagcctgagacaccagcaggtggccctgctggccaccgccaacggcacccacatcgccgtgcagctggaggagcagcagaccctggaggaggccatcaacgtggccaccgccgccatgcagcagggcgccgtgaccctggagaccaccgtgagcgagagcggctgctag

SEQ ID NO: 106211 - DNA, 1209 bp, Artificial Sequence
  Description of Artificial Sequence: Synthetic coding sequence
atggagagcctgggcctgcacaccgtgaccctgagcgacggcaccaccgcctacgtgcagcaggccgtgaagggcgagaagctgctggagggccaggtgatccagctggaggacggcaccaccgcctacatccaccaggtgaccgtgcagaaggaggccctgagcttcgaggacggccagcccgtgcagctggaggacggcagcatggcctacatccacagaacccccagagagggctacgaccccagcaccctggaggccgtgcagctggaggacggcagcaccgcctacatccaccaccccgtggccgtgcccagcgagagcaccatcctggccgtgcagaccgaggtgggcctggaggacctggccgccgaggacgacgagggcttcagcgccgacgccgtggtggccctggagcagtacgccagcaaggtgctgcacgacagccagatccccagaaacggcaagggccagcaggtgggcgacagagccttcagatgcggctacaagggctgcggcagactgtacaccaccgcccaccacctgaaggtgcacgagagagcccacaccggcgacagaccctacagatgcgacttccccagctgcggcaaggccttcgccaccggctacggcctgaagagccacgtgagaacccacaccggcgagaagccctacaagtgccccgaggagctgtgcagcaaggccttcaagaccagcggcgacctgcagaagcacgtgagaacccacaccggcgagagacccttccagtgccccttcgagggctgcggcagaagcttcaccaccagcaacatcagaaaggtgcacgtgagaacccacaccggcgagagaccctacacctgccccgagccccactgcggcagaggcttcaccagcgccaccaactacaagaaccacgtgagaatccacaccggcgagaagccctacgtgtgcaccgtgcccggctgcggcaagagattcaccgagtacagcagcctgtacaagcaccacgtggtgcacacccaccactgcggccacgccgccagaggctgcgaccccggcgacaacagcgtgggcgagtggctgctgagccccagaggcctgggccccaccccctgctggagaaagtgccacctgcacggccacagctgcccccagggccccagactgtggctgacccacagaagatggccccacagaagcctgggctag

SEQ ID NO: 106212 - DNA, 1023 bp, Artificial Sequence
  Description of Artificial Sequence: Synthetic coding sequence
atggagagcctgggcctgcacaccgtgaccctgagcgacggcaccaccgcctacgtgcagcaggccgtgaagggcgagaagctgctggagggccaggtgatccagctggaggacggcaccaccgcctacatccaccaggtgaccgtgcagaaggaggccctgagcttcgaggacggccagcccgtgcagctggaggacggcagcatggcctacatccacagaacccccagagagggctacgaccccagcaccctggaggccgtgcagctggaggacggcagcaccgcctacatccaccaccccgtggccgtgcccagcgagagcaccatcctggccgtgcagaccgaggtgggcctggaggacctggccgccgaggacgacgagggcttcagcgccgacgccgtggtggccctggagcagtacgccagcaaggtgctgcacgacagccagatccccagaaacggcaagggccagcaggtgggcgacagagccttcagatgcggctacaagggctgcggcagactgtacaccaccgcccaccacctgaaggtgcacgagagagcccacaccggcgacagaccctacagatgcgacttccccagctgcggcaaggccttcgccaccggctacggcctgaagagccacgtgagaacccacaccggcgagaagccctacaagtgccccgaggagctgtgcagcaaggccttcaagaccagcggcgacctgcagaagcacgtgagaacccacaccggcgagagacccttccagtgccccttcgagggctgcggcagaagcttcaccaccagcaacatcagaaaggtgcacgtgagaacccacaccggcgagagaccctacacctgccccgagccccactgcggcagaggcttcaccagcgccaccaactacaagaaccacgtgagaatccacaccggcgagaagccctacgtgtgcaccgtgcccggctgcggcaagagattcaccgagtacagcagcctgtacaagcaccacgtggtgcacacctag

SEQ ID NO: 106213 - DNA, 1638 bp, Artificial Sequence
  Description of Artificial Sequence: Synthetic coding sequence
atggactgcgtgatcttcgaggaggtggccgtgaacttcacccccgaggagtgggccctgctggaccacgcccagagaagcctgtacagagacgtgatgctggagacctgcagaaacctggccagcctggactgctacatctacgtgagaaccagcggcagcagcagccagagagacgtgttcggcaacggcatcagcaacgacgaggagatcgtgaagttcaccggcagcgacagctggagcatcttcggcgagaactggagattcgacaacaccggcgaccagcaccagatcccccagagacacctgagaagccagctgggcagactgtgcgagagcaacgagggccaccagtgcggcgagaccctgagccagaccgccaacctgctggtgcacaagagctaccccaccgaggccaagcccagcgagtgcaccaagtgcggcaaggccttcgagaacagacagagaagccacaccggccagagaccctgcaaggagtgcggccaggcctgcagctgcctgagctgccagagcccccccatgaagacccagaccgtggagaagccctgcaactgccaggacagcagaaccgccagcgtgacctacgtgaagagcctgagcagcaagaagagctacgagtgccagaagtgcggcaaggccttcatctgccccagcagcttcagaggccacgtgaacagccaccacggccagaagacccacgcctgcaaggtgtgcggcaagaccttcatgtactacagctacctgaccagacacgtgagaacccacaccggcgagaagccctacgagtgcaaggagtgcggcaaggccttcagctgccccagctacttcagagagcacgtgagaacccacaccggcgagaagccctacgagtgcaagcactgcggcaagagcttcagctgctacagcagcttcagagaccacgtgagaacccacaccggcgagaagccctgccagtgcaagcactgcggcaaggccttcacctgctacagcagcctgagagagcacggcagaacccacagcggcgagaagccctacgagtgcaaggagtgcggcaaggccttcagataccccagcagcctgagagcccacatgagaatgcacaccggcgagaagccctacgtgtgcaagcagtgcggcaaggccttcggctgccccacctacttcagaagacacgtgaagacccacagcggcgtgaagccctaccagtgcaaggagtgcggcaaggcctacagcttcagcagcagcctgagaatccacgtgagaacccacaccggcgagaagcccttcgagtgcaagcactgcggcaaggccttcagctgccacagcagcctgagagagcacgtgagaacccacagcggcgagaagccctacgagtgcaaccagtgcggcaaggccttcagccacgcccagtacttccagaagcacgtgagaagccacagcggcgtgaagccctacgagtgcaccgagtgcggcaaggcctacagctgcagcagcagcctgagagtgcacgtgagaacccacaccggcgagagaccctacgagtgcaagcagtgcggcaagaccttcagatacctggccagcctgcaggcccacgtgagaacccacgccggcgcctag

SEQ ID NO: 106214 - DNA, 1308 bp, Artificial Sequence
  Description of Artificial Sequence: Synthetic coding sequence
agactgtgcgagagcaacgagggccaccagtgcggcgagaccctgagccagaccgccaacctgctggtgcacaagagctaccccaccgaggccaagcccagcgagtgcaccaagtgcggcaagaccttcatgtactacagctacctgaccagacacgtgagaacccacaccggcgagaagccctacgagtgcaaggagtgcggcaaggccttcagctgccccagctacttcagagagcacgtgagaacccacaccggcgagaagccctacgagtgcaagcactgcggcaagagcttcagctgctacagcagcttcagagaccacgtgagaacccacaccggcgagaagccctgccagtgcaagcactgcggcaaggccttcacctgctacagcagcctgagagagcacggcagaacccacagcggcgagaagccctacgagtgcaaggagtgcggcaaggccttcagataccccagcagcctgagagcccacatgagaatgcacaccggcgagaagccctacgtgtgcaagcagtgcggcaaggccttcggctgccccacctacttcagaagacacgtgaagacccacagcggcgtgaagccctaccagtgcaaggagtgcggcaaggcctacagcttcagcagcagcctgagaatccacgtgagaacccacaccggcgagaagcccttcgagtgcaagcactgcggcaaggccttcagctgccacagcagcctgagagagcacgtgagaacccacagcggcgagaagccctacgagtgcaaccagtgcggcaaggccttcagccacgcccagtacttccagaagcacgtgagaagccacagcggcgtgaagccctacgagtgcaccgagtgcggcaaggcctacagctgcagcagcagcctgagagtgcacgtgagaacccacaccggcgagagaccctacgagtgcaagcagtgcggcaagaccttcagctggcccagcgacctgagagtgcacatgagaacccacagcggcgagaagagatgcggctgcaagcagtgcggcaagagcttcagcagccccagcagcttcaagggccacatcagaacccacaccggcgagaagctgtacacctgcagagagtgcggcaaggtgttcagcagccccagctacttcagaacccaggtgagaatccacatcggcgagaagccctacgtgtgcgagcagagaggcaaggtgttcagctggagcagcagcttcagaggccacctgagaacccacagcagagagaagccctacgagtgcaaggagtgcaccaaggccttctag

SEQ ID NO: 106215 - DNA, 1497 bp, Artificial Sequence
  Description of Artificial Sequence: Synthetic coding sequence
atgctggaggagggcgtgctgcccagccccggccccgccctgccccaggaggagaacaccggcgaggagggcatggccgccggcctgctgaccgccggccccagaggcagcaccttcttcagcagcgtgaccgtggccttcgcccaggagagatggagatgcctggtgagcacccccagagacagattcaaggagggcatccccggcaagagcagaagcctggtgctgctgggcctgcccgtgagccagcccggcatgaacagccagctggagcagagagagggcgcctggatgctggagggcgaggacctgagaagccccagccccggctggaagatcatcagcggcagcccccccgagcaggccctgagcgaggccagcttccaggacccctgcgtggagatgccccccggcgacagcgaccacggcaccagcgacctggagaagagcttcaacctgagacccgtgctgagcccccagcagagagtgcccgtggaggccagacccagaaagtgcgagacccacaccgagagcttcaagaacagcgagatcctgaagccccacagagccaagccctacgcctgcaacgagtgcggcaaggccttcagctactgcagcagcctgagccagcaccagaagagccacaccggcgagaagccctacgagtgcagcgagtgcggcaaggccttcagccagagcagcagcctgatccagcaccagagaatccacaccggcgagaagccctacaagtgcagcgagtgcggcagagccttcagccagaacgccaacctgaccaagcaccagagaacccacaccggcgagaagccctacagatgcagcgagtgcgagaaggccttcagcgactgcagcgccctggtgcagcaccagagaatccacaccggcgagaagccctacgagtgcagcgactgcggcaaggccttcagacacagcgccaacctgaccaaccaccagagaacccacaccggcgagaagccctacaagtgcagcgagtgcggcaaggccttcagctactgcgccgccttcatccagcaccagagaatccacaccggcgagaagccctacagatgcgccgcctgcggcaaggccttcagccagagcgccaacctgaccaaccaccagagaacccacaccggcgagaagccctacaagtgcagcgagtgcggcaaggccttcagccagagcaccaacctgatcatccaccagaagacccacaccggcgagaagccctacaagtgcaacgagtgcggcaagttcttcagcgagagcagcgccctgatcagacaccacatcatccacaccggcgagaagccctacgagtgcaacgagtgcggcaaggccttcaaccagagcagcagcctgagccagcaccagagaatccacaccggcgtgaagccctacgagtgcagcgagtgcggcaaggccttcagatgcagcagcgccttcgtgagacaccagagactgcacgccggcgagtag

SEQ ID NO: 106216 - DNA, 1425 bp, Artificial Sequence
  Description of Artificial Sequence: Synthetic coding sequence
atggccgccggcctgctgaccgccggccccagaggcagcaccttcttcagcagcgtgaccgtggccttcgcccaggagagatggagatgcctggtgagcacccccagagacagattcaaggagggcatccccggcaagagcagaagcctggtgctgctgggcctgcccgtgagccagcccggcatgaacagccagctggagcagagagagggcgcctggatgctggagggcgaggacctgagaagccccagccccggctggaagatcatcagcggcagcccccccgagcaggccctgagcgaggccagcttccaggacccctgcgtggagatgccccccggcgacagcgaccacggcaccagcgacctggagaagagcttcaacctgagacccgtgctgagcccccagcagagagtgcccgtggaggccagacccagaaagtgcgagacccacaccgagagcttcaagaacagcgagatcctgaagccccacagagccaagccctacgcctgcaacgagtgcggcaaggccttcagctactgcagcagcctgagccagcaccagaagagccacaccggcgagaagccctacgagtgcagcgagtgcggcaaggccttcagccagagcagcagcctgatccagcaccagagaatccacaccggcgagaagccctacaagtgcagcgagtgcggcagagccttcagccagaacgccaacctgaccaagcaccagagaacccacaccggcgagaagccctacagatgcagcgagtgcgagaaggccttcagcgactgcagcgccctggtgcagcaccagagaatccacaccggcgagaagccctacgagtgcagcgactgcggcaaggccttcagacacagcgccaacctgaccaaccaccagagaacccacaccggcgagaagccctacaagtgcagcgagtgcggcaaggccttcagctactgcgccgccttcatccagcaccagagaatccacaccggcgagaagccctacagatgcgccgcctgcggcaaggccttcagccagagcgccaacctgaccaaccaccagagaacccacaccggcgagaagccctacaagtgcagcgagtgcggcaaggccttcagccagagcaccaacctgatcatccaccagaagacccacaccggcgagaagccctacaagtgcaacgagtgcggcaagttcttcagcgagagcagcgccctgatcagacaccacatcatccacaccggcgagaagccctacgagtgcaacgagtgcggcaaggccttcaaccagagcagcagcctgagccagcaccagagaatccacaccggcgtgaagccctacgagtgcagcgagtgcggcaaggccttcagatgcagcagcgccttcgtgagacaccagagactgcacgccggcgagtag

SEQ ID NO: 106217 - DNA, 1728 bp, Artificial Sequence
  Description of Artificial Sequence: Synthetic coding sequence
atggaccccgaggacgagggcgtggccggcgtgatgagcgtgggcccccccgccgccagactgcaggagcccgtgaccttcagagacgtggccgtggacttcacccaggaggagtggggccagctggaccccacccagagaatcctgtacagagacgtgatgctggagaccttcggccacctgctgagcatcggccccgagctgcccaagcccgaggtgatcagccagctggagcagggcaccgagctgtgggtggccgagagaggcaccacccagggctgccaccccgcctgggagcccagaagcgagagccaggccagcagaaaggaggagggcctgcccgaggaggagcccagccacgtgaccggcagagagggcttccccaccgacgccccctaccccaccaccctgggcaaggacagagagtgccagagccagagcctggccctgaaggagcagaacaacctgaagcagctggagttcggcctgaaggaggcccccgtgcaggaccagggctacaagaccctgagactgagagagaactgcgtgctgagcagcagccccaaccccttccccgagatcagcagaggcgagtacctgtacacctacgacagccagatcaccgacagcgagcacaacagcagcctggtgagccagcagaccggcagccccggcaagcagcccggcgagaacagcgactgccacagagacagcagccaggccatccccatcaccgagctgaccaagagccaggtgcaggacaagccctacaagtgcaccgactgcggcaagagcttcaaccacaacgcccacctgaccgtgcacaagagaatccacaccggcgagagaccctacatgtgcaaggagtgcggcaaggccttcagccagaacagcagcctggtgcagcacgagagaatccacaccggcgacaagccctacaagtgcgccgagtgcggcaagagcttctgccacagcacccacctgaccgtgcacagaagaatccacaccggcgagaagccctacgagtgccaggactgcggcagagccttcaaccagaacagcagcctgggcagacacaagagaacccacaccggcgagaagccctacacctgcagcgtgtgcggcaagagcttcagcagaaccacctgcctgttcctgcacctgagaacccacaccgaggagagaccctacgagtgcaaccactgcggcaagggcttcagacacagcagcagcctggcccagcaccagagaaagcacgccggcgagaagcccttcgagtgcagacagagactgatcttcgagcagacccccgccctgaccaagcacgagtggaccgaggccctgggctgcgacccccccctgagccaggacgagagaacccacagaagcgacagacccttcaagtgcaaccagtgcggcaagtgcttcatccagagcagccacctgatcagacaccagatcacccacaccagagaggagcagccccacggcagaagcagaagaagagagcagagcagcagcagaaacagccacctggtgcagcaccagcaccccaacagcagaaagagcagcgccggcggcgccaaggccggccagcccgagagcagagccctggccctgttcgacatccagaagatcatgcaggagaagaaccccgtgcacgtgatcggcgtggaggagcccagcgtgggcgccagcatgctgttcgacatcagagagagcacctag

SEQ ID NO: 106218 - DNA, 519 bp, Artificial Sequence
  Description of Artificial Sequence: Synthetic coding sequence
atggaccccgaggacgagggcgtggccggcgtgatgagcgtgggcccccccgccgccagactgcaggtgaccatcaccaccatcaccaccgccgccggcagcggccaggccagccccgcccagaccgaccccttcaccagcagaagagacgagagcggcaccgccgtgaacgccctggacacctggggcaacagcgacgccggcagaggcgtggtgaccgtgctggccggccagagaggcggcagagacagcaaccaggcccccggccccagaatgagaatgctgcacgccgccctgagcagccccgcccccagaagcccctgccccggcgcctgggcccagcccctgggcggcaacgacggcagccccagaaccgagtgcgacgagagcgaccaccagggcagacccctgagagactgcggcagaaccgccgtgcagggcggccagtgcctgcagggccacctggccatcagagcccccctgagcagacagagcggctgcggcctgtgcagcccctag

SEQ ID NO: 106219 - DNA, 873 bp, Artificial Sequence
  Description of Artificial Sequence: Synthetic coding sequence
atgtgcaaggagtgcggcaaggccttcagccagaacagcagcctggtgcagcacgagagaatccacaccggcgacaagccctacaagtgcgccgagtgcggcaagagcttctgccacagcacccacctgaccgtgcacagaagaatccacaccggcgagaagccctacgagtgccaggactgcggcagagccttcaaccagaacagcagcctgggcagacacaagagaacccacaccggcgagaagccctacacctgcagcgtgtgcggcaagagcttcagcagaaccacctgcctgttcctgcacctgagaacccacaccgaggagagaccctacgagtgcaaccactgcggcaagggcttcagacacagcagcagcctggcccagcaccagagaaagcacgccggcgagaagcccttcgagtgcagacagagactgatcttcgagcagacccccgccctgaccaagcacgagtggaccgaggccctgggctgcgacccccccctgagccaggacgagagaacccacagaagcgacagacccttcaagtgcaaccagtgcggcaagtgcttcatccagagcagccacctgatcagacaccagatcacccacaccagagaggagcagccccacggcagaagcagaagaagagagcagagcagcagcagaaacagccacctggtgcagcaccagcaccccaacagcagaaagagcagcgccggcggcgccaaggccggccagcccgagagcagagccctggccctgttcgacatccagaagatcatgcaggagaagaaccccgtgcacgtgatcggcgtggaggagcccagcgtgggcgccagcatgctgttcgacatcagagagagcacctag

SEQ ID NO: 106220 - DNA, 822 bp, Artificial Sequence
  Description of Artificial Sequence: Synthetic coding sequence
atgagccccaagagagacggcctgggcaccggcgacggcctgcacagccaggtgctgcaggagcaggtgagcaccggcgacaacctgcacgagtgcgacagccagggccccagcaaggacaccctggtgagagagggcaagacctacaagtgcaaggagtgcggcagcgtgttcaacaagaacagcctgctggtgagacaccagcagatccacaccggcgtgaagccctacgagtgccaggagtgcggcaaggccttccccgagaaggtggacttcgtgagacccatgagaatccacaccggcgagaagccctgcaagtgcgtggagtgcggcaaggtgttcaacagaagaagccacctgctgtgctacagacagatccacaccggcgagaagccctacgagtgcagcgagtgcggcaagaccttcagctaccacagcgtgttcatccagcacagagtgacccacaccggcgagaagctgttcggctgcaaggagtgcggcaagaccttctactacaacagcagcctgaccagacacatgaagatccacaccggcgagaagccctgcaagtgcagcgagtgcggcaagaccttcacctacagaagcgtgttcttcagacacagcatgacccacaccgccggcaagccctacgagtgcaaggagtgcggcaagggcttctactacagctacagcctgaccagacacaccagaagccacaccggcgagaagccctacgagtgcctggagcacagaaaggacttcggctaccacagcgccttcgcccagcagagcaagatccacagcggcggcaagaacctgtag

SEQ ID NO: 106221 - DNA, 822 bp, Artificial Sequence; identical to SEQ ID NO: 106220
  Description of Artificial Sequence: Synthetic coding sequence

SEQ ID NO: 106222 - DNA, 3630 bp, Artificial Sequence
  Description of Artificial Sequence: Synthetic coding sequence
atggagtgctactacatcgtgatcagcagcacccacctgagcaacggccacttcagaaacatcaagggcgtgttcagaggccccctgagcaagaacggcaacaagaccctggactacgccgagaaggagaacaccatcgccaaggccctggaggacctgaaggccaacttctactgcgagctgtgcgacaagcagtactacaagcaccaggagttcgacaaccacatcaacagctacgaccacgcccacaagcagagactgaaggagctgaagcagagagagttcgccagaaacgtggccagcaagagcagaaaggacgagagaaagcaggagaaggccctgcagagactgcacaagctggccgagctgagaaaggagaccgtgtgcgcccccggcagcggccccatgttcaagagcaccaccgtgaccgtgagagagaactgcaacgagatcagccagagagtggtggtggacagcgtgaacaaccagcaggacttcaagtacaccctgatccacagcgaggagaacaccaaggacgccaccaccgtggccgaggaccccgagagcgccaacaactacaccgccaagaacaaccaggtgggcgaccaggcccagggcatccacagacacaagatcggcttcagcttcgccttccccaagaaggccagcgtgaagctggagagcagcgccgccgccttcagcgagtacagcgacgacgccagcgtgggcaagggcttcagcagaaagagcagattcgtgcccagcgcctgccacctgcagcagagcagccccaccgacgtgctgctgagcagcgaggagaagaccaacagcttccacccccccgaggccatgtgcagagacaaggagaccgtgcagacccaggagatcaaggaggtgagcagcgagaaggacgccctgctgctgcccagcttctgcaagttccagctgcagctgagcagcgacgccgacaactgccagaacagcgtgcccctggccgaccagatccccctggagagcgtggtgatcaacgaggacatccccgtgagcggcaacagcttcgagctgctgggcaacaagagcaccgtgctggacatgagcaacgactgcatcagcgtgcaggccaccaccgaggagaacgtgaagcacaacgaggccagcaccaccgaggtggagaacaagaacggccccgagaccctggcccccagcaacaccgaggaggtgaacatcaccatccacaagaagaccaacttctgcaagagacagtgcgagcccttcgtgcccgtgctgaacaagcacagaagcaccgtgctgcagtggcccagcgagatgctggtgtacaccaccaccaagcccagcatcagctacagctgcaaccccctgtgcttcgacttcaagagcaccaaggtgaacaacaacctggacaagaacaagcccgacctgaaggacctgtgcagccagcagaagcaggaggacatctgcatgggccccctgagcgactacaaggacgtgagcaccgagggcctgaccgactacgagatcggcagcagcaagaacaagtgcagccaggtgacccccctgctggccgacgacatcctgagcagcagctgcgacagcggcaagaacgagaacaccggccagagatacaagaacatcagctgcaagatcagagagaccgagaagtacaacttcaccaagagccagatcaagcaggacaccctggacgagaagtacaacaagatcagactgaaggagacccacgagtactggttccacaagagcagaagaaagaagaagagaaagaagctgtgccagcaccaccacatggagaagaccaaggagagcgagaccagatgcaagatggaggccgagaacagctacaccgagaacgccggcaagtacctgctggagcccatcagcgagaagcagtacctggccgccgagcagctgctggacagccaccagctgctggacaagagacccaagagcgagagcatcagcctgagcgacaacgaggagatgtgcaagacctggaacaccgagtacaacacctacgacaccatcagcagcaagaaccactgcaagaagaacaccatcctgctgaacggccagagcaacgccaccatgatccacagcggcaagcacaacctgacctacagcagaacctactgctgctggaagaccaagatgagcagctgcagccaggaccacagaagcctggtgctgcagaacgacatgaagcacatgagccagaaccaggccgtgaagagaggctacaacagcgtgatgaacgagagcgagagattctacagaaagagaagacagcacagccacagctacagcagcgacgagagcctgaacagacagaaccacctgcccgaggagttcctgagaccccccagcaccagcgtggccccctgcaagcccaagaagaagagaagaagaaagagaggcagattccaccccggcttcgagaccctggagctgaaggagaacaccgactaccccgtgaaggacaacagcagcctgaaccccctggacagactgatcagcgaggacaagaaggagaagatgaagccccaggaggtggccaagatcgagagaaacagcgagcagaccaaccagctgagaaacaagctgagcttccaccccaacaacctgctgcccagcgagaccaacggcgagaccgagcacctggagatggagaccaccagcggcgagctgagcgacgtgagcaacgaccccaccaccagcgtgtgcgtggccagcgcccccaccaaggaggccatcgacaacaccctgctggagcacaaggagagaagcgagaacatcaacctgaacgagaagcagatccccttccaggtgcccaacatcgagagaaacttcagacagagccagcccaagagctacctgtgccactacgagctggccgaggccctgccccagggcaagatgaacgagacccccaccgagtggctgagatacaacagcggcatcctgaacacccagccccccctgcccttcaaggaggcccacgtgagcggccacaccttcgtgaccgccgagcagatcctggcccccctggccctgcccgagcaggccctgctgatccccctggagaaccacgacaagttcaagaacgtgccctgcgaggtgtaccagcacatcctgcagcccaacatgctggccaacaaggtgaagttcaccttcccccccgccgccctgcccccccccagcacccccctgcagcccctgcccctgcagcagagcctgtgcagcaccagcgtgaccaccatccaccacaccgtgctgcagcagcacgccgccgccgccgccgccgccgccgccgccgccgccgccggcaccttcaaggtgctgcagccccaccagcagttcctgagccagatccccgccctgaccagaaccagcctgccccagctgagcgtgggccccgtgggccccagactgtgccccggcaaccagcccaccttcgtggcccccccccagatgcccatcatccccgccagcgtgctgcaccccagccacctggccttccccagcctgccccacgccctgttccccagcctgctgagcccccaccccaccgtgatccccctgcagcccctgttctag

SEQ ID NO: 106223 - DNA, 210 bp, Artificial Sequence
  Description of Artificial Sequence: Synthetic coding sequence
atgcccgccaacgaggacgccccccagcccggcgagcacggcagcgcctgcgaggtgagcgtgagcttcgaggacgtgaccgtggacttcagcagagaggagtggcagcagctggacagcacccagagaagactgtaccaggacgtgatgctggagaactacagccacctgctgagcgtgggcaaggacaaccaccccgtgaagctgtag

SEQ ID NO: 106224 - DNA, 1986 bp, Artificial Sequence
  Description of Artificial Sequence: Synthetic coding sequence
atgcccgccaacgaggacgccccccagcccggcgagcacggcagcgcctgcgaggtgagcgtgagcttcgaggacgtgaccgtggacttcagcagagaggagtggcagcagctggacagcacccagagaagactgtaccaggacgtgatgctggagaactacagccacctgctgagcgtgggcttcgaggtgcccaagcccgaggtgatcttcaagctggagcagggcgagggcccctggaccctggagggcgaggccccccaccagagctgcagcgacggcaagttcggcatcaagcccagccagagaagaatcagcggcaagagcaccttccacagcgagatggagggcgaggacaccagagacgacagcctgtacagcatcctggaggagctgtggcaggacgccgagcagatcaagagatgccaggagaagcacaacaagctgctgagcagaaccaccttcctgaacaagaagatcctgaacaccgagtgggactacgagtacaaggacttcggcaagttcgtgcaccccagccccaacctgatcctgagccagaagagaccccacaagagagacagcttcggcaagagcttcaagcacaacctggacctgcacatccacaacaagagcaacgccgccaagaacctggacaagaccatcggccacggccaggtgttcacccagaacagcagctacagccaccacgagaacacccacaccggcgtgaagttctgcgagagaaaccagtgcggcaaggtgctgagcctgaagcacagcctgagccagaacgtgaagttccccatcggcgagaaggccaacacctgcaccgagttcggcaagatcttcacccagagaagccacttcttcgccccccagaagatccacaccgtggagaagccccacgagctgagcaagtgcgtgaacgtgttcacccagaagcccctgctgagcatctacctgagagtgcacagagacgagaagctgtacatctgcaccaagtgcggcaaggccttcatccagaacagcgagctgatcatgcacgagaagacccacaccagagagaagccctacaagtgcaacgagtgcggcaagagcttcttccaggtgagcagcctgctgagacaccagaccacccacaccggcgagaagctgttcgagtgcagcgagtgcggcaagggcttcagcctgaacagcgccctgaacatccaccagaagatccacaccggcgagagacaccacaagtgcagcgagtgcggcaaggccttcacccagaagagcaccctgagaatgcaccagagaatccacaccggcgagagaagctacatctgcacccagtgcggccaggccttcatccagaaggcccacctgatcgcccaccagagaatccacaccggcgagaagccctacgagtgcagcgactgcggcaagagcttccccagcaagagccagctgcagatgcacaagagaatccacaccggcgagaagccctacatctgcaccgagtgcggcaaggccttcaccaacagaagcaacctgaacacccaccagaagagccacaccggcgagaagagctacatctgcgccgagtgcggcaaggccttcaccgacagaagcaacttcaacaagcaccagaccatccacaccggcgagaagccctacgtgtgcgccgactgcggcagagccttcatccagaagagcgagctgatcacccaccagagaatccacaccaccgagaagccctacaagtgccccgactgcgagaagagcttcagcaagaagccccacctgaaggtgcaccagagaatccacaccggcgagaagccctacatctgcgccgagtgcggcaaggccttcaccgacagaagcaacttcaacaagcaccagaccatccacaccggcgacaagccctacaagtgcagcgactgcggcaagggcttcacccagaagagcgtgctgagcatgcacagaaacatccacacctag

SEQ ID NO: 106225 - DNA, 312 bp, Artificial Sequence
  Description of Artificial Sequence: Synthetic coding sequence
atgcccgccaacgaggacgccccccagcccggcgagcacggcagcgcctgcgaggtgagcgtgagcttcgaggacgtgaccgtggacttcagcagagaggagtggcagcagctggacagcacccagagaagactgtaccaggacgtgatgctggagaactacagccacctgctgagcgtgggcttcgaggtgcccaagcccgaggtgatcttcaagctggagcagggcgagggcccctggaccctggagggcgaggccccccaccagagctgcagcggcatcagcacctacttcgtgaccagcaccgtgtag

SEQ ID NO: 106226 - DNA, 1986 bp, Artificial Sequence; identical to SEQ ID NO: 106224
  Description of Artificial Sequence: Synthetic coding sequence

SEQ ID NO: 106227 - DNA, 369 bp, Artificial Sequence
  Description of Artificial Sequence: Synthetic coding sequence
atgcccgccaacgaggacgccccccagcccggcgagcacggcagcgcctgcgaggtgagcgtgagcttcgaggacgtgaccgtggacttcagcagagaggagtggcagcagctggacagcacccagagaagactgtaccaggacgtgatgctggagaactacagccacctgctgagcgtgggcttcgaggtgcccaagcccgaggtgatcttcaagctggagcagggcgagggcccctggaccctggagggcgaggccccccaccagagctgcagcgacggcaagttcggcatcaagcccagccagagaagaatcagcggcaagagcaccttccacagcgagatggagggcgaggacaccctgtgctag

SEQ ID NO: 106228 - DNA, 1551 bp, Artificial Sequence
  Description of Artificial Sequence: Synthetic coding sequence
atgcacggcagaaaggacgacgcccagaagcagcccgtgaagaaccagctgggcctgaacccccagagccacctgcccgagctgcagctgttccaggccgagggcaagatctacaagtacgaccacatggagaagagcgtgaacagcagcagcctggtgagccccccccagagaatcagcagcaccgtgaagacccacatcagccacacctacgagtgcaacttcgtggacagcctgttcacccagaaggagaaggccaacatcggcaccgagcactacaagtgcagcgagagaggcaaggccttccaccagggcctgcacttcaccatccaccagatcatccacaccaaggagacccagttcaagtgcgacatctgcggcaagatcttcaacaagaagagcaacctggccagccaccagagaatccacaccggcgagaagccctacaagtgcaacgagtgcggcaaggtgttccacaacatgagccacctggcccagcacagaagaatccacaccggcgagaagccctacaagtgcaacgagtgcggcaaggtgttcaaccagatcagccacctggcccagcaccagagaatccacaccggcgagaagccctacaagtgcaacgagtgcggcaaggtgttccaccagatcagccacctggcccagcacagaaccatccacaccggcgagaagccctacgagtgcaacaagtgcggcaaggtgttcagcagaaacagctacctggtgcagcacctgatcatccacaccggcgagaagccctacagatgcaacgtgtgcggcaaggtgttccaccacatcagccacctggcccagcaccagagaatccacaccggcgagaagccctacaagtgcaacgagtgcggcaaggtgttcagccacaagagcagcctggtgaaccactggagaatccacaccggcgagaagccctacaagtgcaacgagtgcggcaaggtgttcagccacaagagcagcctggtgaaccactggagaatccacaccggcgagaagccctacaagtgcaacgagtgcggcaaggtgttcagcagaaacagctacctggcccagcacctgatcatccacgccggcgagaagccctacaagtgcgacgagtgcgacaaggccttcagccagaacagccacctggtgcagcaccacagaatccacaccggcgagaagccctacaagtgcgacgagtgcggcaaggtgttcagccagaacagctacctggcctaccactggagaatccacaccggcgagaaggcctacaagtgcaacgagtgcggcaaggtgttcggcctgaacagcagcctggcccaccacagaaagatccacaccggcgagaagcccttcaagtgcaacgagtgcggcaaggccttcagcatgagaagcagcctgaccaaccaccacgccatccacaccggcgagaagcacttcaagtgcaacgagtgcggcaagctgttcagagacaacagctacctggtgagacaccagagattccacgccggcaagaagagcaacacctgcaactag

SEQ ID NO: 106229 - DNA, 1467 bp, Artificial Sequence
  Description of Artificial Sequence: Synthetic coding sequence
atgcacggcagaaaggacgacgcccagaagcagcccgtgaagaaccagctgggcctgaacccccagagccacctgcccgagctgcagctgttccaggccgagggcaagatctacaagtacgaccacatggagaagagcgtgaacagcagcagcctggtgagccccccccagagaatcagcagcaccgtgaagacccacatcagccacacctacgagtgcaacttcgtggacagcctgttcacccagaaggagaaggccaacatcggcaccgagcactacaagtgcagcgagagaggcaaggccttccaccagggcctgcacttcaccatccaccagatcatccacaccaaggagacccagttcaagtgcgacatctgcggcaagatcttcaacaagaagagcaacctggccagccaccagagaatccacaccggcgagaagccctacaagtgcaacgagtgcggcaaggtgttccacaacatgagccacctggcccagcacagaagaatccacaccggcgagaagccctacaagtgcaacgagtgcggcaaggtgttcaaccagatcagccacctggcccagcaccagagaatccacaccggcgagaagccctacaagtgcaacgagtgcggcaaggtgttccaccagatcagccacctggcccagcacagaaccatccacaccggcgagaagccctacgagtgcaacaagtgcggcaaggtgttcagcagaaacagctacctggtgcagcacctgatcatccacaccggcgagaagccctacagatgcaacgtgtgcggcaaggtgttcagccacaagagcagcctggtgaaccactggagaatccacaccggcgagaagccctacaagtgcaacgagtgcggcaaggtgttcagccacaagagcagcctggtgaaccactggagaatccacaccggcgagaagccctacaagtgcaacgagtgcggcaaggtgttcagcagaaacagctacctggcccagcacctgatcatccacgccggcgagaagccctacaagtgcgacgagtgcgacaaggccttcagccagaacagccacctggtgcagcaccacagaatccacaccggcgagaagccctacaagtgcgacgagtgcggcaaggtgttcagccagaacagctacctggcctaccactggagaatccacaccggcgagaaggcctacaagtgcaacgagtgcggcaaggtgttcggcctgaacagcagcctggcccaccacagaaagatccacaccggcgagaagcccttcaagtgcaacgagtgcggcaaggccttcagcatgagaagcagcctgaccaaccaccacgccatccacaccggcgagaagcacttcaagtgcaacgagtgcggcaagctgttcagagacaacagctacctggtgagacaccagagattccacgccggcaagaagagcaacacctgcaactag

SEQ ID NO: 106230 - DNA, 1467 bp, Artificial Sequence; identical to SEQ ID NO: 106229
  Description of Artificial Sequence: Synthetic coding sequence

SEQ ID NO: 106231 - DNA, 1551 bp, Artificial Sequence; identical to SEQ ID NO: 106228
  Description of Artificial Sequence: Synthetic coding sequence

SEQ ID NO: 106232 - DNA, 1551 bp, Artificial Sequence; identical to SEQ ID NO: 106228
  Description of Artificial Sequence: Synthetic coding sequence

SEQ ID NO: 106233 - DNA, 1551 bp, Artificial Sequence; identical to SEQ ID NO: 106228
  Description of Artificial Sequence: Synthetic coding sequence

SEQ ID NO: 106234 - DNA, 1551 bp, Artificial Sequence; identical to SEQ ID NO: 106228
  Description of Artificial Sequence: Synthetic coding sequence

SEQ ID NO: 106235 - DNA, 5034 bp, Artificial Sequence
  Description of Artificial Sequence: Synthetic coding sequence
atggaggtgcccgagcccacctgccccgccccccccgccagagaccagcccgcccccacccccggcccccccggcgcccccggcggccaggccagcccccacctgaccctgggccccgtgctgctgccccccgagcagggcctggccccccccaccgtgttcctgaaggccctgcccatccccctgtaccacaccgtgccccccggcggcctgcagcccagagcccccctggtgaccggcagcctggacggcggcaacgtgcccttcatcctgagccccgtgctgcagcccgagggccccggccccacccaggtgggcaagcccgccgcccccaccctgaccgtgaacatcgtgggcaccctgcccgtgctgagccccggcctgggccccaccctgggcagccccggcaaggtgagaaacgccggcaagtacctgtgcccccactgcggcagagactgcctgaagcccagcgtgctggagaagcacatcagaagccacaccggcgagagacccttcccctgcgccacctgcggcatcgccttcaagacccagagcaacctgtacaagcacagaagaacccagacccacctgaacaacagcagactgagcagcgagagcgagggcgccggcggcggcctgctggaggagggcgacaaggccggcgagccccccagacccgagggcagaggcgagagcagatgccagggcatgcacgagggcgccagcgagagacccctgagccccggcgcccacgtgcccctgctggccaagaacctggacgtgagaaccgaggccgccccctgccccggcagcgccttcgccgacagagaggccccctgggacagcgcccccatggccagccccggcctgcccgccgccagcacccagccctggagaaagctgcccgagcagaagagccccaccgccggcaagccctgcgccctgcagagacagcaggccaccgccgccgagaagccctgggacgccaaggcccccgagggcagactgagaaagtgcgagagcaccgacagcggctacctgagcagaagcgacagcgccgagcagccccacgccccctgcagccccctgcacagcctgagcgagcacagcgccgagagcgagggcgagggcggccccggccccggccccggcgtggccggcgccgagcccggcgccagagaggccggcctggagctggagaagaagagactggaggagagaatcgcccagctgatcagccacaaccaggccgtggtggacgacgcccagctggacaacgtgagacccagaaagaccggcctgagcaagcagggcagcatcgacctgcccaccccctacacctacaaggacagcttccacttcgacatcagagccctggagcccggcagaagaagagcccccggccccgtgagaagcacctggaccccccccgacaagagcagacccctgttcttccacagcgtgcccacccagctgagcaccaccgtggagtgcgtgcccgtgaccagaagcaacagcctgcccttcgtggagggcagcagaacctggctggagcccagagagcccagagacccctggagcagaacccagaagcccctgagccccagacccggccccgccagactgggctgcagaagcggcctgagcagcaccgacgtgcccagcggccaccccagagccctggtgagacaggccgccgtggaggacctgcccggcacccccatcggcgacgccctggtgcccgccgaggacaccgacgccaagagaaccgccgccagagaggccatggccggcaagggcagagccggcggcagaaagtgcggccagagaagactgaagatgttcagccaggagaagtggcaggtgtacggcgacgagaccttcaagagaatctaccagaagatgaaggccagcccccacggcggcaagaaggccagagaggtgggcatgggcagcggcgccgagctgggcttccccctgcagaaggaggccgccggcagcagcggcaccgtgcccacccaggacagaagaacccccgtgcacgaggacatcagcgccggcgccacccccgagccctggggcaacccccccgccctggaggccagcctggtgaccgagcccaccaagcacggcgagaccgtggccagaagaggcgacagcgacagacccagagtggaggaggccgtgagcagccccgccctgggcggcagagacagcccctgcagcggcagcagaagccccctggtgagccccaacggcagactggagctgggctggcagatgccccccgcccccggccccctgaagggcggcgacgtggaggcccccagacccgtgtggcccgaccccaagctggagggcggcgccagaggcgtgggcgacgtgcaggagacctgcctgtgggcccagaccgtgctgagatggcccagcagaggcagcggcgaggacaagctgcccagcgagagaaagaagctgaaggtggaggacctgcacagctggaagcagcccgagcccgtgagcgccgagacccccggcggccccacccagcccgccagcctgagcagccagaagcaggacgccgaccccggcgaggtgcccggcggcagcaaggagagcgccagacaggtgggcgagcccctggagagcagcggcgccagcctggccgccgccagcgtggccctgaagagagtgggccccagagacaaggccacccccctgcaccccgccgcccccgcccccgccgagcaccccagcctggccacccccccccaggcccccagagtgctgagcgccctggccgacaacgccttcagccccaagtacctgctgagactgccccaggccgagacccccctgcccctgcccatcccctggggccccagacacagccaggacagcctgtgcagcagcggctggcccgaggagagagccagcttcgtgggcagcggcctgggcacccccctgagccccagccccgccagcggccccagccccggcgaggccgacagcatcctggaggaccccagctgcagcagaccccaggacggcagaaagggcgcccagctgggcggcgacaagggcgacagaatggccaccagcagacccgccgccagagagctgcccatcagcgcccccggcgcccccagagaggccaccagcagcccccccacccccacctgcgaggcccacctggtgcaggacatggagggcgacagccacagaatccacagactgtgcatgggcagcaccctggccagagccagactgagcggcgacgtgctgaacccctgggtgcccaactgggagctgggcgagccccccggcaacgcccccgaggaccccagcagcggccccctggtgggccccgacccctgcagccccctgcagcccggcagcttcctgaccgccctgaccagaccccagggcgtgccccccggctggcccgagctggccctgagcagccacagcggcaccagcagaagccacagcaccagaagcccccacagcacccagaaccccttccccagcctgaaggccgagcccagactgacctggtgctgcctgagcagaagcgtgcccctgcccgccgagcagaaggccaaggccgccagcgtgtacctggccgtgcacttccccggcagcagcctgagagacgagggccccaacggcccccccggcagcaacggcggctggacctggaccagccccggcgagggcggccccgcccagatgagcaagttcagctaccccaccgtgcccggcgtgatgccccagcaccaggtgagcgagcccgagtggaagaagggcctgccctggagagccaagatgagcagaggcaacagcaagcagagaaagctgaagatcaaccccaagagatacaagggcaacttcctgcagagctgcgtgcagctgagagccagcagactgagaacccccacctgggtgagaagaagaagcagacacccccccgccctggagggcctgaagccctgcagaacccccggccagaccagcagcgagatcgccggcctgaacctgcaggaggagcccagctgcgccaccagcgagagccccccctgctgcggcaaggaggagaagaaggagggcgactgcagacagaccctgggcaccctgagcctgggcaccagcagcagaatcgtgagagagatggacaagagaaccgtgaaggacatcagccccagcgccggcgagcacggcgactgcaccacccacagcaccgccgccaccagcggcctgagcctgcagagcgacacctgcctggccgtggtgaacgacgtgcccctgccccccggcaagggcctggacctgggcctgctggagacccagctgctggccagccaggacagcgtgagcaccgaccccaagccctacatcttcagcgacgcccagagacccagcagcttcggcagcaagggcaccttcccccaccacgacatcgccaccagcgtggccgccgtgtgcatcagcctgcccgtgagaaccgaccacatcgcccaggagatccacagcgccgagagcagagaccacagccagaccgccggcagaaccctgaccagcagcagccccgacagcaaggtgaccgaggagggcagagcccagaccctgctgcccggcagacccagcagcggccagagaatcagcgacagcgtgcccctggagagcaccgagaagacccacctggagatccccgccagcggccccagcagcgccagcagccaccacaaggagggcagacacaagaccttcttccccagcagaggccagtacggctgcggcgagatgaccgtgccctgccccagcctgggcagcgacggcagaaagagacaggtgagcggcctgatcaccagaaaggacagcgtggtgcccagcaagcccgagcagcccatcgagatccccgaggcccccagcaagagcctgaagaagagaagcctggagggcatgagaaagcagaccagagtggagttcagcgacaccagcagcgacgacgaggacagactggtgatcgagatctag

SEQ ID NO: 106236 - DNA, 264 bp, Artificial Sequence
  Description of Artificial Sequence: Synthetic coding sequence
atgggccccctgaccttcagagacgtggccatcgagttcagcctgaaggagtggcagtgcctggacaccgcccagagaaacctgtacagaaacgtgatgctggagaactacagaaacctggtgttcctgggcatcaccgtgagcaagcccgacctgatcacctgcctggagcagggcaaggaggcctggagcatgaagagacacgagatcatggtggccaagcccaccgagagctacagcgtgacccagagcggcatgcagtag

SEQ ID NO: 106237 - DNA, 1788 bp, Artificial Sequence
  Description of Artificial Sequence: Synthetic coding sequence
atgggccccctgaccttcagagacgtggccatcgagttcagcctgaaggagtggcagtgcctggacaccgcccagagaaacctgtacagaaacgtgatgctggagaactacagaaacctggtgttcctgggcatcaccgtgagcaagcccgacctgatcacctgcctggagcagggcaaggaggcctggagcatgaagagacacgagatcatggtggccaagcccaccgtgatgtgcagccacttcgcccaggacctgtggcccgagcagaacatcaaggacagcttccagaaggtgaccctgaagagatacggcaagtgcagacacgagaacctgcccctgagaaagggctgcgagagcatggacgagtgcaagatgcacaagggcggctgcaacggcctgaaccagtgcctgaccgccacccagagcaagatcttccagtgcgacaagtacgtgaaggtggcccacaagttcagcaacagcaacagacacgagatcagacacaccaagaagaagcccttcaagtgcaccaagtgcggcaagagcttcggcatgatcagctgcctgaccgagcacagcagaatccacaccagagtgaacttctacaagtgcgaggagtgcggcaaggccttcaactggagcagcaccctgaccaagcacaagagaatccacaccggcgagaagccctacaagtgcgaggagtgcggcaaggccttcaaccagagcagcaacctgatcaagcacaagaagatccacaccggcgagaagccctacaagtgcgaggagtgcggcaagaccttcaacagattcagcaccctgaccacccacaagatcatccacaccggcgagaagccctacaagtgcaaggagtgcggcaaggccttcaacagaagcagcaccctgaccacccacagaaagatccacaccggcgagaagccctacaagtgcgaggagtgcggcaaggccttcaagcagagcagcaacctgaccacccacaagatcatccacaccggcgagaagccctacaagtgcaagaagtgcggcaaggccttcaaccagagcgcccacctgaccacccacgaggtgatccacaccggcgagaagccctacaagtgcgagaagtgcggcaaggccttcaaccacttcagccacctgaccacccacaagatcatccacaccggcgagaagccctacaagtgcaaggagtgcggcaaggccttcaagcacagcagcaccctgaccaagcacaagatcatccacaccggcgagaagccctacaagtgcaaggagtgcgagaaggccttcaaccagagcagcaagctgaccgagcacaagaagatccacaccggcgagaagccctacgagtgcgagaagtgcggcaaggccttcaaccagagcagcaacctgaccagacacaagaagagccacaccgaggagaagccctacaagtgcgaggagtgcggcaagggcttcaagtggcccagcaccctgaccatccacaagatcatccacaccggcgagaagccctacaagtgcgaggagtgcggcaaggccttcaaccagagcagcaagctgaccaagcacaagaagatccacaccggcgagaagccctacacctgcgaggagtgcggcaaggccttcaaccagagcagcaacctgaccaagcacaagagaatccacaccggcgagaagccctacaagtgcgaggagtgcgacaaggccttcaagtggagcagcgtgctgaccaagcacaagatcatccacaccggcgagaagctgcagatctag

SEQ ID NO: 106238 - DNA, 1689 bp, Artificial Sequence
  Description of Artificial Sequence: Synthetic coding sequence
atgggccccctgaccttcagagacgtggccatcgagttcagcctgaaggagtggcagtgcctggacaccgcccagagaaacctgtacagaaacgtgatgctggagaactacagaaacctggtgttcctggtgatgtgcagccacttcgcccaggacctgtggcccgagcagaacatcaaggacagcttccagaaggtgaccctgaagagatacggcaagtgcagacacgagaacctgcccctgagaaagggctgcgagagcatggacgagtgcaagatgcacaagggcggctgcaacggcctgaaccagtgcctgaccgccacccagagcaagatcttccagtgcgacaagtacgtgaaggtggcccacaagttcagcaacagcaacagacacgagatcagacacaccaagaagaagcccttcaagtgcaccaagtgcggcaagagcttcggcatgatcagctgcctgaccgagcacagcagaatccacaccagagtgaacttctacaagtgcgaggagtgcggcaaggccttcaactggagcagcaccctgaccaagcacaagagaatccacaccggcgagaagccctacaagtgcgaggagtgcggcaaggccttcaaccagagcagcaacctgatcaagcacaagaagatccacaccggcgagaagccctacaagtgcgaggagtgcggcaagaccttcaacagattcagcaccctgaccacccacaagatcatccacaccggcgagaagccctacaagtgcaaggagtgcggcaaggccttcaacagaagcagcaccctgaccacccacagaaagatccacaccggcgagaagccctacaagtgcgaggagtgcggcaaggccttcaagcagagcagcaacctgaccacccacaagatcatccacaccggcgagaagccctacaagtgcaagaagtgcggcaaggccttcaaccagagcgcccacctgaccacccacgaggtgatccacaccggcgagaagccctacaagtgcgagaagtgcggcaaggccttcaaccacttcagccacctgaccacccacaagatcatccacaccggcgagaagccctacaagtgcaaggagtgcggcaaggccttcaagcacagcagcaccctgaccaagcacaagatcatccacaccggcgagaagccctacaagtgcaaggagtgcgagaaggccttcaaccagagcagcaagctgaccgagcacaagaagatccacaccggcgagaagccctacgagtgcgagaagtgcggcaaggccttcaaccagagcagcaacctgaccagacacaagaagagccacaccgaggagaagccctacaagtgcgaggagtgcggcaagggcttcaagtggcccagcaccctgaccatccacaagatcatccacaccggcgagaagccctacaagtgcgaggagtgcggcaaggccttcaaccagagcagcaagctgaccaagcacaagaagatccacaccggcgagaagccctacacctgcgaggagtgcggcaaggccttcaaccagagcagcaacctgaccaagcacaagagaatccacaccggcgagaagccctacaagtgcgaggagtgcgacaaggccttcaagtggagcagcgtgctgaccaagcacaagatcatccacaccggcgagaagctgcagatctag

SEQ ID NO: 106239 - DNA, 1413 bp, Artificial Sequence
  Description of Artificial Sequence: Synthetic coding sequence
atgcacaagggcggctgcaacggcctgaaccagtgcctgaccgccacccagagcaagatcttccagtgcgacaagtacgtgaaggtggcccacaagttcagcaacagcaacagacacgagatcagacacaccaagaagaagcccttcaagtgcaccaagtgcggcaagagcttcggcatgatcagctgcctgaccgagcacagcagaatccacaccagagtgaacttctacaagtgcgaggagtgcggcaaggccttcaactggagcagcaccctgaccaagcacaagagaatccacaccggcgagaagccctacaagtgcgaggagtgcggcaaggccttcaaccagagcagcaacctgatcaagcacaagaagatccacaccggcgagaagccctacaagtgcgaggagtgcggcaagaccttcaacagattcagcaccctgaccacccacaagatcatccacaccggcgagaagccctacaagtgcaaggagtgcggcaaggccttcaacagaagcagcaccctgaccacccacagaaagatccacaccggcgagaagccctacaagtgcgaggagtgcggcaaggccttcaagcagagcagcaacctgaccacccacaagatcatccacaccggcgagaagccctacaagtgcaagaagtgcggcaaggccttcaaccagagcgcccacctgaccacccacgaggtgatccacaccggcgagaagccctacaagtgcgagaagtgcggcaaggccttcaaccacttcagccacctgaccacccacaagatcatccacaccggcgagaagccctacaagtgcaaggagtgcggcaaggccttcaagcacagcagcaccctgaccaagcacaagatcatccacaccggcgagaagccctacaagtgcaaggagtgcgagaaggccttcaaccagagcagcaagctgaccgagcacaagaagatccacaccggcgagaagccctacgagtgcgagaagtgcggcaaggccttcaaccagagcagcaacctgaccagacacaagaagagccacaccgaggagaagccctacaagtgcgaggagtgcggcaagggcttcaagtggcccagcaccctgaccatccacaagatcatccacaccggcgagaagccctacaagtgcgaggagtgcggcaaggccttcaaccagagcagcaagctgaccaagcacaagaagatccacaccggcgagaagccctacacctgcgaggagtgcggcaaggccttcaaccagagcagcaacctgaccaagcacaagagaatccacaccggcgagaagccctacaagtgcgaggagtgcgacaaggccttcaagtggagcagcgtgctgaccaagcacaagatcatccacaccggcgagaagctgcagatctag

SEQ ID NO: 106240 - DNA, 1806 bp, Artificial Sequence
  Description of Artificial Sequence: Synthetic coding sequence
atgggccccctggagttcagagacgtggccatcgagttcagcctggaggagtggcactgcctggacaccgcccagcagaacctgtacagagacgtgatgctggagaactacagacacctggtgttcctgggcatcgtggtgaccaagcccgacctgatcacctgcctggagcagggcaagaagcccttcaccgtgaagagacacgagatgatcgccaagagccccgtgatgtgcttccacttcgcccaggacctgtgccccgagcagagcctgaaggacagcttccagaaggtgatcgtgaccagatacgagaagagagagtacggcaacctggagctgaagaagggctgcgagagcgtggacgagggcaaggtgcacaagagaggctacaacggcctgaaccagtgcctgaccgccacccagagcaaggtgttccagtgcgacacctacgtgaaggtgagccacatcttcagcaacagcaacagacacaagatcagagacaccggcaagaagcccttcaagtgcatcgagtgcggcaaggccttcaaccagagcagcaccctggccacccacaagaagatccacaccggcgagatcacctgcaagtgcgaggagtgcggcaaggccttcaacagaagcagccacctgaccagccacaagagaatccacaccggcgagaagagatacaagtgcgaggactgcggcaaggagctgaagtacagcagcaccctgaccgcccacaagagaatccacaccggcgagaagagatacaagtgcgaggactgcggcaaggagctgaagtacagcagcaccctgaccgcccacaagagaatccacaccggcgagaagccctacaagtgcgacaagtgcggcagagccttcatcagcagcagcatcctgtacgtgcacaagatcagccacaccgaggagaagccctacaagtgcgaggagtgcggcaaggccttcaagctgagcagcatcctgagcacccacaagagaatccacaccggcgagaagccctacaagtgcgaggagtgcggcaaggccttcagaagaagcctggtgctgagaacccacaagagaatccacaccggcgagaagccctacaagtgcgacaagtgcggcaaggccttcatcagcagcagcctgctgtacaagcacaagatcagccacagcgagaagaagccctacaagtgcgaggagtgcggcaaggccttcaagagaagcagcaccctgaccatccacaagatcagccacaccgaggagaagccctacaagtgccaggagtgcgacaaggtgttcaagagaagcagcgccctgagcacccacaagatcatccacagcggcgagaagccctacaagtgcgaggagtgcggcaaggccttcaagagaagcagcaacctgaccacccacaagatcagccacaccgaggagaagctgtacaagtgccaggagtgcgacaaggccttcaagtacagcagcgccctgagcacccacaagatcatccacagcggcgagaacccctacaagtgcgaggagtgcggcaaggccttcaagagaagcagcgtgctgagcaagcacaagatcatccacaccggcgccaagccctacaagtgcgaggagtgcggcaaggccttcaagagaagcagccagctgaccagccacaagatcagccacaccggcgagaagccctacaagtgcgaggagtgcggcaaggccttcaacctgagcagcgacctgaacacccacaagagaatccacatcggccagaaggcctacatcgtgaagaacatggccaacctgtag

SEQ ID NO: 106241 - DNA, 369 bp, Artificial Sequence
  Description of Artificial Sequence: Synthetic coding sequence
atgagaaagcacatcaaggagagagagctgagcctgatggagcagatcaaggagttcatcctggagagaaacaccatgaacgtgcccaccgtgggcaagcccttcagcggcagacacagcctgctgagcatcagagagttcaccctgggcagaagccccatgaacgtgatgaacgtgggcgagcccagcgagaagaagcccacctgcatgatcatcagagagttcatcctggagaagaaccccatcctggtgagaaacgtgggcaagaccagcgccgaggtgcagctgctgctgaacaccagagagttcatcctggagatcaacagcagaaacagagagatcaaggagttcgccgagtgcttcagctag

SEQ ID NO: 106242 - DNA, 1911 bp, Artificial Sequence
  Description of Artificial Sequence: Synthetic coding sequence
atggcccccagaccccccaccgccgccccccaggagagcgtgaccttcaaggacgtgagcgtggacttcacccaggaggagtggtaccacgtggaccccgcccagagaagcctgtacagagacgtgatgctggagaactacagccacctggtgagcctgggctaccaggtgagcaagcccgaggtgatcttcaagctggagcagggcgaggagccctggatcagcgagggcgagatccagagacccttctaccccgactggaagaccagacccgaggtgaagagcagccacctgcagcaggacgtgagcgaggtgagccactgcacccacgacctgctgcacgccaccctggaggacagctgggacgtgagcagccagctggacagacagcaggagaactggaagagacacctgggcagcgaggccagcacccagaagaagatcatcaccccccaggagaacttcgagcagaacaagttcggcgagaacagcagactgaacaccaacctggtgacccagctgaacatccccgccagaatcagacccagcgagtgcgagaccctgggcagcaacctgggccacaacgccgacctgctgaacgagaacaacatcctggccaagaagaagccctacaagtgcgacaagtgcagaaaggccttcatccacagaagcagcctgaccaagcacgagaagacccacaagggcgagggcgccttccccaacggcaccgaccagggcatctaccccggcaagaagcaccacgagtgcaccgactgcggcaagaccttcctgtggaagacccagctgaccgagcaccagagaatccacaccggcgagaagcccttcgagtgcaacgtgtgcggcaaggccttcagacacagcagcagcctgggccagcacgagaacgcccacaccggcgagaagccctaccagtgcagcctgtgcggcaaggccttccagagaagcagcagcctggtgcagcaccagagaatccacaccggcgagaagccctacagatgcaacctgtgcggcagaagcttcagacacggcaccagcctgacccagcacgaggtgacccacagcggcgagaagcccttccagtgcaaggagtgcggcaaggccttcagcagatgcagcagcctggtgcagcacgagagaacccacaccggcgagaagcccttcgagtgcagcatctgcggcagagccttcggccagagccccagcctgtacaagcacatgagaatccacaagagaggcaagccctaccagagcagcaactacagcatcgacttcaagcacagcaccagcctgacccaggacgagagcaccctgaccgaggtgaagagctaccactgcaacgactgcggcgaggacttcagccacatcaccgacttcaccgaccaccagagaatccacaccgccgagaacccctacgactgcgagcaggccttcagccagcaggccatcagccaccccggcgagaagccctaccagtgcaacgtgtgcggcaaggccttcaagagaagcaccagcttcatcgagcaccacagaatccacaccggcgagaagccctacgagtgcaacgagtgcggcgaggccttcagcagaagaagcagcctgacccagcacgagagaacccacaccggcgagaagccctacgagtgcatcgactgcggcaaggccttcagccagagcagcagcctgatccagcacgagagaacccacaccggcgagaagccctacgagtgcaacgagtgcggcagagccttcagaaagaagaccaacctgcacgaccaccagagaatccacaccggcgagaagccctacagctgcaaggagtgcggcaagaacttcagcagaagcagcgccctgaccaagcaccagagaatccacaccagaaacaagctgtag

SEQ ID NO: 106243 - DNA, 3576 bp, Artificial Sequence
  Description of Artificial Sequence: Synthetic coding sequence
atgcccggcacccccggcagcctggagatgggcctgctgaccttcagagacgtggccatcgagttcagccccgaggagtggcagtgcctggacaccgcccagcagaacctgtacagaaacgtgatgctggagaactacagaaacctggccttcctgggcatcgccctgagcaagcccgacctgatcacctacctggagcagggcaaggagccctggaacatgaagcagcacgagatggtggacgagcccaccggcatctgcccccacttcccccaggacttctggcccgagcagagcatggaggacagcttccagaaggtgctgctgagaaagtacgagaagtgcggccacgagaacctgcagctgagaaagggctgcaagagcgtggacgagtgcaaggtgcacaaggagggctacaacaagctgaaccagtgcctgaccaccgcccagagcaaggtgttccagtgcggcaagtacctgaaggtgttctacaagttcctgaacagcaacagacacaccatcagacacaccggcaagaagtgcttcaagtgcaagaagtgcgtgaagagcttctgcatcagactgcacaagacccagcacaagtgcgtgtacatcaccgagaagagctgcaagtgcaaggagtgcgagaagaccttccactggagcagcaccctgaccaaccacaaggagatccacaccgaggacaagccctacaagtgcgaggagtgcggcaaggccttcaagcagctgagcaccctgaccacccacaagatcatctgcgccaaggagaagatctacaagtgcgaggagtgcggcaaggccttcctgtggagcagcaccctgaccagacacaagagaatccacaccggcgagaagccctacaagtgcgaggagtgcggcaaggccttcagccacagcagcaccctggccaagcacaagagaatccacaccggcgagaagccctacaagtgcgaggagtgcggcaaggccttcagcagaagcagcaccctggccaagcacaagagaatccacaccggcgagaagccctacaagtgcaaggagtgcggcaaggccttcagcaacagcagcaccctggccaaccacaagatcacccacaccgaggagaagccctacaagtgcaaggagtgcgacaaggccttcaagagactgagcaccctgaccaagcacaagatcatccacgccggcgagaagctgtacaagtgcgaggagtgcggcaaggccttcaacagaagcagcaacctgaccatccacaagttcatccacaccggcgagaagccctacaagtgcgaggagtgcggcaaggccttcaactggagcagcagcctgaccaagcacaagagattccacaccagagagaagcccttcaagtgcaaggagtgcggcaaggccttcatctggagcagcaccctgaccagacacaagagaatccacaccggcgagaagccctacaagtgcgaggagtgcggcaaggccttcagacagagcagcaccctgaccaagcacaagatcatccacaccggcgagaagccctacaagttcgaggagtgcggcaaggccttcagacagagcctgaccctgaacaagcacaagatcatccacagcagagagaagccctacaagtgcaaggagtgcggcaaggccttcaagcagttcagcaccctgaccacccacaagatcatccacgccggcaagaagctgtacaagtgcgaggagtgcggcaaggccttcaaccacagcagcagcctgagcacccacaagatcatccacaccggcgagaagagctacaagtgcgaggagtgcggcaaggccttcctgtggagcagcaccctgagaagacacaagagaatccacaccggcgagaagccctacaagtgcgaggagtgcggcaaggccttcagccacagcagcgccctggccaagcacaagagaatccacaccggcgagaagccctacaagtgcaaggagtgcggcaaggccttcagcaacagcagcaccctggccaaccacaagatcacccacaccgaggagaagccctacaagtgcaaggagtgcgacaagaccttcaagagactgagcaccctgaccaagcacaagatcatccacgccggcgagaagctgtacaagtgcgaggagtgcggcaaggccttcaacagaagcagcaacctgaccatccacaagttcatccacaccggcgagaagccctacaagtgcgaggagtgcggcaaggccttcaactggagcagcagcctgaccaagcacaagagaatccacaccagagagaagcccttcaagtgcaaggagtgcggcaaggccttcatctggagcagcaccctgaccagacacaagagaatccacaccggcgagaagccctacaagtgcgaggagtgcggcaaggccttcagcagaagcagcaccctgaccaagcacaagaccatccacaccggcgagaagccctacaagtgcaaggagtgcggcaaggccttcaagcacagcagcgccctggccaagcacaagatcatccacgccggcgagaagctgtacaagtgcgaggagtgcggcaaggccttcaaccagagcagcaacctgaccacccacaagatcatccacaccaaggagaagcccagcaagagcgaggagtgcgacaaggccttcatctggagcagcaccctgaccgagcacaagagaatccacaccagagagaagacctacaagtgcgaggagtgcggcaaggccttcagccagcccagccacctgaccacccacaagagaatgcacaccggcgagaagccctacaagtgcgaggagtgcggcaaggccttcagccagagcagcaccctgaccacccacaagatcatccacaccggcgagaagccctacaagtgcgaggagtgcggcaaggccttcagaaagagcagcaccctgaccgagcacaagatcatccacaccggcgagaagccctacaagtgcgaggagtgcggcaaggccttcagccagagcagcaccctgaccagacacaccagaatgcacaccggcgagaagccctacaagtgcgaggagtgcggcaaggccttcaacagaagcagcaagctgaccacccacaagatcatccacaccggcgagaagccctacaagtgcgaggagtgcggcaaggccttcatcagcagcagcaccctgaacggccacaagagaatccacaccagagagaagccctacaagtgcgaggagtgcggcaaggccttcagccagagcagcaccctgaccagacacaagagactgcacaccggcgagaagccctacaagtgcggcgagtgcggcaaggccttcaaggagagcagcgccctgaccaagcacaagatcatccacaccggcgagaagccctacaagtgcgagaagtgcggcaaggccttcaaccagagcagcatcctgaccaaccacaagaagatccacaccatcacccccgtgatccccctgctgtgggaggccgaggccggcggcagcagaggccaggagatggagaccatcctggccaacaccgtgaagcccctgctgtactag

SEQ ID NO: 106244 - DNA, 3480 bp, Artificial Sequence
  Description of Artificial Sequence: Synthetic coding sequence
atgcccggcacccccggcagcctggagatgggcctgctgaccttcagagacgtggccatcgagttcagccccgaggagtggcagtgcctggacaccgcccagcagaacctgtacagaaacgtgatgctggagaactacagaaacctggccttcctgggcatctgcccccacttcccccaggacttctggcccgagcagagcatggaggacagcttccagaaggtgctgctgagaaagtacgagaagtgcggccacgagaacctgcagctgagaaagggctgcaagagcgtggacgagtgcaaggtgcacaaggagggctacaacaagctgaaccagtgcctgaccaccgcccagagcaaggtgttccagtgcggcaagtacctgaaggtgttctacaagttcctgaacagcaacagacacaccatcagacacaccggcaagaagtgcttcaagtgcaagaagtgcgtgaagagcttctgcatcagactgcacaagacccagcacaagtgcgtgtacatcaccgagaagagctgcaagtgcaaggagtgcgagaagaccttccactggagcagcaccctgaccaaccacaaggagatccacaccgaggacaagccctacaagtgcgaggagtgcggcaaggccttcaagcagctgagcaccctgaccacccacaagatcatctgcgccaaggagaagatctacaagtgcgaggagtgcggcaaggccttcctgtggagcagcaccctgaccagacacaagagaatccacaccggcgagaagccctacaagtgcgaggagtgcggcaaggccttcagccacagcagcaccctggccaagcacaagagaatccacaccggcgagaagccctacaagtgcgaggagtgcggcaaggccttcagcagaagcagcaccctggccaagcacaagagaatccacaccggcgagaagccctacaagtgcaaggagtgcggcaaggccttcagcaacagcagcaccctggccaaccacaagatcacccacaccgaggagaagccctacaagtgcaaggagtgcgacaaggccttcaagagactgagcaccctgaccaagcacaagatcatccacgccggcgagaagctgtacaagtgcgaggagtgcggcaaggccttcaacagaagcagcaacctgaccatccacaagttcatccacaccggcgagaagccctacaagtgcgaggagtgcggcaaggccttcaactggagcagcagcctgaccaagcacaagagattccacaccagagagaagcccttcaagtgcaaggagtgcggcaaggccttcatctggagcagcaccctgaccagacacaagagaatccacaccggcgagaagccctacaagtgcgaggagtgcggcaaggccttcagacagagcagcaccctgaccaagcacaagatcatccacaccggcgagaagccctacaagttcgaggagtgcggcaaggccttcagacagagcctgaccctgaacaagcacaagatcatccacagcagagagaagccctacaagtgcaaggagtgcggcaaggccttcaagcagttcagcaccctgaccacccacaagatcatccacgccggcaagaagctgtacaagtgcgaggagtgcggcaaggccttcaaccacagcagcagcctgagcacccacaagatcatccacaccggcgagaagagctacaagtgcgaggagtgcggcaaggccttcctgtggagcagcaccctgagaagacacaagagaatccacaccggcgagaagccctacaagtgcgaggagtgcggcaaggccttcagccacagcagcgccctggccaagcacaagagaatccacaccggcgagaagccctacaagtgcaaggagtgcggcaaggccttcagcaacagcagcaccctggccaaccacaagatcacccacaccgaggagaagccctacaagtgcaaggagtgcgacaagaccttcaagagactgagcaccctgaccaagcacaagatcatccacgccggcgagaagctgtacaagtgcgaggagtgcggcaaggccttcaacagaagcagcaacctgaccatccacaagttcatccacaccggcgagaagccctacaagtgcgaggagtgcggcaaggccttcaactggagcagcagcctgaccaagcacaagagaatccacaccagagagaagcccttcaagtgcaaggagtgcggcaaggccttcatctggagcagcaccctgaccagacacaagagaatccacaccggcgagaagccctacaagtgcgaggagtgcggcaaggccttcagcagaagcagcaccctgaccaagcacaagaccatccacaccggcgagaagccctacaagtgcaaggagtgcggcaaggccttcaagcacagcagcgccctggccaagcacaagatcatccacgccggcgagaagctgtacaagtgcgaggagtgcggcaaggccttcaaccagagcagcaacctgaccacccacaagatcatccacaccaaggagaagcccagcaagagcgaggagtgcgacaaggccttcatctggagcagcaccctgaccgagcacaagagaatccacaccagagagaagacctacaagtgcgaggagtgcggcaaggccttcagccagcccagccacctgaccacccacaagagaatgcacaccggcgagaagccctacaagtgcgaggagtgcggcaaggccttcagccagagcagcaccctgaccacccacaagatcatccacaccggcgagaagccctacaagtgcgaggagtgcggcaaggccttcagaaagagcagcaccctgaccgagcacaagatcatccacaccggcgagaagccctacaagtgcgaggagtgcggcaaggccttcagccagagcagcaccctgaccagacacaccagaatgcacaccggcgagaagccctacaagtgcgaggagtgcggcaaggccttcaacagaagcagcaagctgaccacccacaagatcatccacaccggcgagaagccctacaagtgcgaggagtgcggcaaggccttcatcagcagcagcaccctgaacggccacaagagaatccacaccagagagaagccctacaagtgcgaggagtgcggcaaggccttcagccagagcagcaccctgaccagacacaagagactgcacaccggcgagaagccctacaagtgcggcgagtgcggcaaggccttcaaggagagcagcgccctgaccaagcacaagatcatccacaccggcgagaagccctacaagtgcgagaagtgcggcaaggccttcaaccagagcagcatcctgaccaaccacaagaagatccacaccatcacccccgtgatccccctgctgtgggaggccgaggccggcggcagcagaggccaggagatggagaccatcctggccaacaccgtgaagcccctgctgtactag

SEQ ID NO: 106245 - DNA, 1761 bp, Artificial Sequence
  Description of Artificial Sequence: Synthetic coding sequence
atgggccccctgaccttcagagacgtgaagatcgagttcagcctggaggagtggcagtgcctggacaccgcccagagaaacctgtacagagacgtgatgctggagaactacagaaacctggtgttcctgggcatcgccgtgagcaagcccgacctgatcacctggctggagcagggcaaggagccctggaacctgaagagacacgagatggtggacaagacccccgtgatgtgcagccacttcgcccaggacgtgtggcccgagcacagcatcaaggacagcttccagaaggtgatcctgagaacctacggcaagtacggccacgagaacctgcagctgagaaaggaccacaagagcgtggacgcctgcaaggtgtacaagggcggctacaacggcctgaaccagtgcctgaccaccaccgacagcaagatcttccagtgcgacaagtacgtgaaggtgttccacaagttccccaacgtgaacagaaacaagatcagacacaccggcaagaagcccttcaagtgcaagaacagaggcaagagcttctgcatgctgagccagctgacccagcacaagaagatccacaccagagagtacagctacaagtgcgaggagtgcggcaaggccttcaactggagcagcaccctgaccaagcacaagatcatccacaccggcgagaagccctacaagtgcgaggagtgcggcaaggccttcaacagaagcagcaacctgaccaagcacaagatcatccacaccggcgagaagccctacaagtgcgaggagtgcggcaaggccttcaacagaagcagcaccctgaccaagcacaagagaatccacaccgaggagaagccctacaagtgcgaggagtgcggcaaggccttcaaccagttcagcatcctgaacaagcacaagagaatccacatggaggacaagccctacaagtgcgaggagtgcggcaaggccttcagagtgttcagcatcctgaagaagcacaagatcatccacaccggcgagaagccctacaagtgcgaggagtgcggcaaggccttcaaccagttcagcaacctgaccaagcacaagatcatccacaccggcgagaagccctacaagtgcgacgagtgcggcaaggccttcaaccagagcagcaccctgaccaagcacaagagaatccacaccggcgagaagccctacaagtgcgaggagtgcggcaaggccttcaagcagagcagcaccctgaccgagcacaagatcatccacaccggcgagaagccctacaagtgcgagaagtgcggcaaggccttcagctggagcagcgccttcaccaagcacaagagaaaccacatggaggacaagccctacaagtgcgaggagtgcggcaaggccttcagcgtgttcagcaccctgaccaagcacaagatcatccacaccagagagaagccctacaagtgcgaggagtgcggcaaggccttcaaccagagcagcatcttcaccaagcacaagatcatccacaccgagggcaagagctacaagtgcgagaagtgcggcaacgccttcaaccagagcagcaacctgaccgccagaaagatcatctacaccggcgagaagccctacaagtacgaggagtgcgacaaggccttcaacaagttcagcaccctgatcacccaccagatcatctacaccggcgagaagccctgcaagcacgagtgcggcagagccttcaacaagagcagcaactacaccaaggagaagctgcagacctag

SEQ ID NO: 106246 - DNA, 1665 bp, Artificial Sequence
  Description of Artificial Sequence: Synthetic coding sequence
atgggccccctgaccttcagagacgtgaagatcgagttcagcctggaggagtggcagtgcctggacaccgcccagagaaacctgtacagagacgtgatgctggagaactacagaaacctggtgttcctggtgatgtgcagccacttcgcccaggacgtgtggcccgagcacagcatcaaggacagcttccagaaggtgatcctgagaacctacggcaagtacggccacgagaacctgcagctgagaaaggaccacaagagcgtggacgcctgcaaggtgtacaagggcggctacaacggcctgaaccagtgcctgaccaccaccgacagcaagatcttccagtgcgacaagtacgtgaaggtgttccacaagttccccaacgtgaacagaaacaagatcagacacaccggcaagaagcccttcaagtgcaagaacagaggcaagagcttctgcatgctgagccagctgacccagcacaagaagatccacaccagagagtacagctacaagtgcgaggagtgcggcaaggccttcaactggagcagcaccctgaccaagcacaagatcatccacaccggcgagaagccctacaagtgcgaggagtgcggcaaggccttcaacagaagcagcaacctgaccaagcacaagatcatccacaccggcgagaagccctacaagtgcgaggagtgcggcaaggccttcaacagaagcagcaccctgaccaagcacaagagaatccacaccgaggagaagccctacaagtgcgaggagtgcggcaaggccttcaaccagttcagcatcctgaacaagcacaagagaatccacatggaggacaagccctacaagtgcgaggagtgcggcaaggccttcagagtgttcagcatcctgaagaagcacaagatcatccacaccggcgagaagccctacaagtgcgaggagtgcggcaaggccttcaaccagttcagcaacctgaccaagcacaagatcatccacaccggcgagaagccctacaagtgcgacgagtgcggcaaggccttcaaccagagcagcaccctgaccaagcacaagagaatccacaccggcgagaagccctacaagtgcgaggagtgcggcaaggccttcaagcagagcagcaccctgaccgagcacaagatcatccacaccggcgagaagccctacaagtgcgagaagtgcggcaaggccttcagctggagcagcgccttcaccaagcacaagagaaaccacatggaggacaagccctacaagtgcgaggagtgcggcaaggccttcagcgtgttcagcaccctgaccaagcacaagatcatccacaccagagagaagccctacaagtgcgaggagtgcggcaaggccttcaaccagagcagcatcttcaccaagcacaagatcatccacaccgagggcaagagctacaagtgcgagaagtgcggcaacgccttcaaccagagcagcaacctgaccgccagaaagatcatctacaccggcgagaagccctacaagtacgaggagtgcgacaaggccttcaacaagttcagcaccctgatcacccaccagatcatctacaccggcgagaagccctgcaagcacgagtgcggcagagccttcaacaagagcagcaactacaccaaggagaagctgcagacctag

SEQ ID NO: 106247 - DNA, 1554 bp, Artificial Sequence
  Description of Artificial Sequence: Synthetic coding sequence
atggtggacaagacccccgtgatgtgcagccacttcgcccaggacgtgtggcccgagcacagcatcaaggacagcttccagaaggtgatcctgagaacctacggcaagtacggccacgagaacctgcagctgagaaaggaccacaagagcgtggacgcctgcaaggtgtacaagggcggctacaacggcctgaaccagtgcctgaccaccaccgacagcaagatcttccagtgcgacaagtacgtgaaggtgttccacaagttccccaacgtgaacagaaacaagatcagacacaccggcaagaagcccttcaagtgcaagaacagaggcaagagcttctgcatgctgagccagctgacccagcacaagaagatccacaccagagagtacagctacaagtgcgaggagtgcggcaaggccttcaactggagcagcaccctgaccaagcacaagatcatccacaccggcgagaagccctacaagtgcgaggagtgcggcaaggccttcaacagaagcagcaacctgaccaagcacaagatcatccacaccggcgagaagccctacaagtgcgaggagtgcggcaaggccttcaacagaagcagcaccctgaccaagcacaagagaatccacaccgaggagaagccctacaagtgcgaggagtgcggcaaggccttcaaccagttcagcatcctgaacaagcacaagagaatccacatggaggacaagccctacaagtgcgaggagtgcggcaaggccttcagagtgttcagcatcctgaagaagcacaagatcatccacaccggcgagaagccctacaagtgcgaggagtgcggcaaggccttcaaccagttcagcaacctgaccaagcacaagatcatccacaccggcgagaagccctacaagtgcgacgagtgcggcaaggccttcaaccagagcagcaccctgaccaagcacaagagaatccacaccggcgagaagccctacaagtgcgaggagtgcggcaaggccttcaagcagagcagcaccctgaccgagcacaagatcatccacaccggcgagaagccctacaagtgcgagaagtgcggcaaggccttcagctggagcagcgccttcaccaagcacaagagaaaccacatggaggacaagccctacaagtgcgaggagtgcggcaaggccttcagcgtgttcagcaccctgaccaagcacaagatcatccacaccagagagaagccctacaagtgcgaggagtgcggcaaggccttcaaccagagcagcatcttcaccaagcacaagatcatccacaccgagggcaagagctacaagtgcgagaagtgcggcaacgccttcaaccagagcagcaacctgaccgccagaaagatcatctacaccggcgagaagccctacaagtacgaggagtgcgacaaggccttcaacaagttcagcaccctgatcacccaccagatcatctacaccggcgagaagccctgcaagcacgagtgcggcagagccttcaacaagagcagcaactacaccaaggagaagctgcagacctag

SEQ ID NO: 106248 - DNA, 1863 bp, Artificial Sequence
  Description of Artificial Sequence: Synthetic coding sequence
atgggccccctgcagttcagagacgtggccatcgagttcagcctggaggagtggcactgcctggacaccgcccagagaaacctgtacagaaacgtgatgctggagaactacagcaacctggtgttcctgggcatcgtggtgagcaagcccgacctgatcgcccacctggagcagggcaagaagcccctgaccatgaagagacacgagatggtggccaaccccagcgtgatctgcagccacttcgcccaggacctgtggcccgagcagaacatcaaggacagcttccagaaggtgatcctgagaagatacgagaagagaggccacggcaacctgcagctgatcaagagatgcgagagcgtggacgagtgcaaggtgcacaccggcggctacaacggcctgaaccagtgcagcaccaccacccagagcaaggtgttccagtgcgacaagtacggcaaggtgttccacaagttcagcaacagcaacagacacaacatcagacacaccgagaagaagcccttcaagtgcatcgagtgcggcaaggccttcaaccagttcagcaccctgatcacccacaagaagatccacaccggcgagaagccctacatctgcgaggagtgcggcaaggccttcaagtacagcagcgccctgaacacccacaagagaatccacaccggcgagaagccctacaagtgcgacaagtgcgacaaggccttcatcgccagcagcaccctgagcaagcacgagatcatccacaccggcaagaagccctacaagtgcgaggagtgcggcaaggccttcaaccagagcagcaccctgaccaagcacaagaagatccacaccggcgagaagccctacaagtgcgaggagtgcggcaaggccttcaaccagagcagcaccctgaccaagcacaagaagatccacaccggcgagaagccctacgtgtgcgaggagtgcggcaaggccttcaagtacagcagaatcctgaccacccacaagagaatccacaccggcgagaagccctacaagtgcaacaagtgcggcaaggccttcatcgccagcagcaccctgagcagacacgagttcatccacatgggcaagaagcactacaagtgcgaggagtgcggcaaggccttcatctggagcagcgtgctgaccagacacaagagagtgcacaccggcgagaagccctacaagtgcgaggagtgcggcaaggccttcaagtacagcagcaccctgagcagccacaagagaagccacaccggcgagaagccctacaagtgcgaggagtgcggcaaggccttcgtggccagcagcaccctgagcaagcacgagatcatccacaccggcaagaagccctacaagtgcgaggagtgcggcaaggccttcaaccagagcagcagcctgaccaagcacaagaagatccacaccggcgagaagccctacaagtgcgaggagtgcggcaaggccttcaaccagagcagcagcctgaccaagcacaagaagatccacaccggcgagaagccctacaagtgcgaggagtgcggcaaggccttcaaccagagcagcaccctgatcaagcacaagaagatccacaccagagagaagccctacaagtgcgaggagtgcggcaaggccttccacctgagcacccacctgaccacccacaagatcctgcacaccggcgagaagccctacagatgcagagagtgcggcaaggccttcaaccacagcgccaccctgagcagccacaagaagatccacagcggcgagaagccctacgagtgcgacaagtgcggcaaggccttcatcagccccagcagcctgagcagacacgagatcatccacaccggcgagaagccctag

SEQ ID NO: 106249 - DNA, 1779 bp, Artificial Sequence
  Description of Artificial Sequence: Synthetic coding sequence
atgggccccctgcagttcagagacgtggccatcgagttcagcctggaggagtggcactgcctggacaccgcccagagaaacctgtacagaaacgtgatgctggagaactacagcaacctggtgttcctgggcatcgtggtgagcaagcccgacctgatcgcccacctggagcagggcaagaagcccctgaccatgaagagacacgagatggtggccaaccccagcgtgatctgcagccacttcgcccaggacctgtggcccgagcagaacatcaaggacagcttccagaaggtgatcctgagaagatacgagaagagaggccacggcaacctgcagctgatcaagagatgcgagagcgtggacgagtgcaaggtgcacaccggcggctacaacggcctgaaccagtgcagcaccaccacccagagcaaggtgttccagtgcgacaagtacggcaaggtgttccacaagttcagcaacagcaacagacacaacatcagacacaccgagaagaagcccttcaagtgcatcgagtgcggcaaggccttcaaccagttcagcaccctgatcacccacaagaagatccacaccggcgagaagccctacatctgcgaggagtgcggcaaggccttcaagtacagcagcgccctgaacacccacaagagaatccacaccggcgagaagccctacaagtgcgacaagtgcgacaaggccttcatcgccagcagcaccctgagcaagcacgagatcatccacaccggcaagaagccctacaagtgcgaggagtgcggcaaggccttcaaccagagcagcaccctgaccaagcacaagaagatccacaccggcgagaagccctacaagtgcgaggagtgcggcaaggccttcaaccagagcagcaccctgaccaagcacaagaagatccacaccggcgagaagccctacgtgtgcgaggagtgcggcaaggccttcaagtacagcagaatcctgaccacccacaagagaatccacaccggcgagaagccctacaagtgcaacaagtgcggcaaggccttcatcgccagcagcaccctgagcagacacgagttcatccacatgggcaagaagcactacaagtgcgaggagtgcggcaaggccttcatctggagcagcgtgctgaccagacacaagagagtgcacaccggcgagaagccctacaagtgcgaggagtgcggcaaggccttcgtggccagcagcaccctgagcaagcacgagatcatccacaccggcaagaagccctacaagtgcgaggagtgcggcaaggccttcaaccagagcagcagcctgaccaagcacaagaagatccacaccggcgagaagccctacaagtgcgaggagtgcggcaaggccttcaaccagagcagcagcctgaccaagcacaagaagatccacaccggcgagaagccctacaagtgcgaggagtgcggcaaggccttcaaccagagcagcaccctgatcaagcacaagaagatccacaccagagagaagccctacaagtgcgaggagtgcggcaaggccttccacctgagcacccacctgaccacccacaagatcctgcacaccggcgagaagccctacagatgcagagagtgcggcaaggccttcaaccacagcgccaccctgagcagccacaagaagatccacagcggcgagaagccctacgagtgcgacaagtgcggcaaggccttcatcagccccagcagcctgagcagacacgagatcatccacaccggcgagaagccctag

SEQ ID NO: 106250 - DNA, 183 bp, Artificial Sequence
  Description of Artificial Sequence: Synthetic coding sequence
atggtggccaaccccagcgtgatctgcagccacttcgcccaggacctgtggcccgagcagaacatcaaggacagcttccagaaggtgatcctgagaagatacgagaagagaggccacggcaacctgcagctgatcaagagatgcgagagcacccccagcgagaaggagaagaagaagaagtag

SEQ ID NO: 106251 - DNA, 1719 bp, Artificial Sequence
  Description of Artificial Sequence: Synthetic coding sequence
atgcccggccccctgggcagcctggagatgggcgtgctgaccttcagagacgtggccctggagttcagcctggaggagtggcagtgcctggacaccgcccagcagaacctgtacagaaacgtgatgctggagaactacagaaacctggtgttcgtgggcatcgccgccagcaagcccgacctgatcacctgcctggagcagggcaaggagccctggaacgtgaagagacacgagatggtgaccgagccccccgtggtgtacagctacttcgcccaggacctgtggcccaagcagggcaagaagaactacttccagaaggtgatcctgagaacctacaagaagtgcggcagagagaacctgcagctgagaaagtactgcaagagcatggacgagtgcaaggtgcacaaggagtgctacaacggcctgaaccagtgcctgaccaccacccagaacaagatcttccagtacgacaagtacgtgaaggtgttccacaagttcagcaacagcaacagacacaagatcggccacaccggcaagaagagcttcaagtgcaaggagtgcgagaagagcttctgcatgctgagccacctggcccagcacaagagaatccacagcggcgagaagccctacaagtgcaaggagtgcggcaaggcctacaacgaggccagcaacctgagcacccacaagagaatccacaccggcaagaagccctacaagtgcgaggagtgcggcaaggccttcaacagactgagccacctgaccacccacaagatcatccacaccggcaagaagccctacaagtgcgaggagtgcggcaaggccttcaaccagagcgccaacctgaccacccacaagagaatccacaccggcgagaagccctacaagtgcgaggagtgcggcagagccttcagccagagcagcaccctgaccgcccacaagatcatccacgccggcgagaagccctacaagtgcgaggagtgcggcaaggccttcagccagagcagcaccctgaccacccacaagatcatccacaccggcgagaagttctacaagtgcgaggagtgcggcaaggccttcagcagactgagccacctgaccacccacaagagaatccacagcggcgagaagccctacaagtgcgaggagtgcggcaaggccttcaagcagagcagcaccctgaccacccacaagagaatccacgccggcgagaagttctacaagtgcgaggtgtgcagcaaggccttcagcagattcagccacctgaccacccacaagagaatccacaccggcgagaagccctacaagtgcgaggagtgcggcaaggccttcaacctgagcagccagctgaccacccacaagatcatccacaccggcgagaagccctacaagtgcgaggagtgcggcaaggccttcaaccagagcagcaccctgagcaagcacaaggtgatccacaccggcgagaagccctacaagtgcgaggagtgcggcaaggccttcaaccagagcagccacctgaccacccacaagatgatccacaccggcgagaagccctacaagtgcgaggagtgcggcaaggccttcaacaacagcagcatcctgaacagacacaagatgatccacaccggcgagaagctgtacaagcccgagagctgcaacaacgcctgcgacaacatcgccaagatcagcaagtacaagagaaactgcgccggcgagaagtag

SEQ ID NO: 106252 - DNA, 3114 bp, Artificial Sequence
  Description of Artificial Sequence: Synthetic coding sequence
atgagcttctggagcgagaagtgcaccagactgatcctgtacgacctgaagatcgccctgaagaacggcagcctgaccttctgggacgtgaccatcgagttcgccctggaggagtggcagtgcctggacatggcccagcagaacctgtacagaaacgtgatgctggagaactacagaaacctggtgttcctgggcatcgccgtgagcaagctggacctgatcacctgcctgaagcagggcaaggagccctggaacatgaagagacacgagatggtgaccaagccccccgtgatcagcagccacttcacccaggacttctggcccgaccagagcatcaaggacagcttccaggagatcatcctgagaacctacgccagatgcggccacaagaacctgagactgagaaaggactgcgagagcgtgaacgagggcaagatgcacgaggaggcctacaacaagctgaaccagtgctggaccaccacccagggcaagatcttccagtgcaacaagtacgtgaaggtgttccacaagtacagcaacagcaacagatacaagatcatccacaccggcaagaagccctacaagtgcgaggagtgcggcaaggccttcaagcagagcagccacctgaccagacacaaggccatccacaccggcgagaagccctacaagtgcgaggagtgcggcaaggccttcaaccacttcagcgccctgagaaagcaccagatcatccacaccggcaagaagccctacaagtgcgaggagtgcggcaaggccttcagccagagcagcaccctgagaaagcacgagatcatccacaccgaggagaagccctacaagtacgaggagtgcggcaaggccttcagcaacctgagcgccctgagaaagcacgagatcatccacaccggccagaagccctacaagtgcgaggagtgcggcaaggccttcaagtggagcagcaagctgaccgtgcacaaggtgatccacaccgccgagaagccctgcaagtgcgaggagtgcggcaaggccttcaagagattcagcgccctgagaaagcacaagatcatccacaccggcaagcagccctacaagtgcgaggagtgcagcaaggccttcagcaacttcagcgccctgagaaagcacgagatcatccacaccggcgagaagccctacaagtgcgaggagtgcggcaaggccttcaagtggagcagcaagctgaccgtgcacaaggtgatccacatggaggagaagccctgcaagtgcgaggagtgcggcaaggccttcaagcacttcagcgccctgagaaagcacaagatcatccacaccggcaagaagccctacaagtgcgaggagtgcggcaaggccttcaacaacagcagcaccctgatgaagcacaagatcatccacaccggcaagaagccctacaagtgcgaggagtgcggcaaggccttcaagcagagcagccacctgaccagacacaaggccatccacaccggcgagaagccctacaagtgcgaggagtgcggcaaggccttcaaccacttcagcgccctgagaaagcaccagatcatccacaccggcaagaagccctacaagtgcgaggagtgcggcaaggccttcagccagagcagcaccctgagaaagcacgagatcatccacaccggcgagaagccctacaagtgcgaggagtgcggcaaggccttcaagtggagcagccacctgaccagacacaaggtgatccacaccgaggagaagccctacaagtgcgaggagtgcggcaaggccttcaaccacttcagcgccctgagaaagcacaagatcatccacaccggcaagaagccctacaagtgcgaggagtgcggcaaggccttcagccagagcagcaccctgagaaagcacgagatcatccacaccggcgagaagccctacaagtgcgaggagtgcggcaaggccttcaagtggagcagcaagctgaccgtgcacaaggtgatccacaccgccgagaagccctgcaagtgcgaggagtgcggcaaggccttcaagcacttcagcgccctgagaaagcacaagatcatccacaccggcaagaagccctacaagtgcgaggagtgcggcaaggccttcaacaacagcagcaccctgagaaagcacgagatcatccacaccggcgagaagagctacaagtgcgaggagtgcgccctgagaaagcacgagatcatccacaccggcaagaagccctacaagtgcgaggagtgcggcaaggccttcaacaacagcagcaccctgagaaagcacaagatcatctacaccggcaagaagccctacaagtgcgaggagtgcggcaaggccttcaagcagagcagccacctgaccagacacaaggccgtgcacaccggcgagaagccctacaagtgcggcgagtgcggcaaggccttcaacaacagcagcaccctgaagaagcacaagctgatccacaccagagagaagagctacaagtgcgaggagtgcggcaaggccttcagcaacttcagcgccctgagaaagcacaagatcatccacaccggcgagaagccctacaagtgcgaggagtgcgagtgcggcaaggccttcaacaacagcagcaccctgatgaagcacaagatcatccacaccggcgagaagccctacaagtgcgaggagtgcggcaagggcttcaacaacttcagcaccctgatgaagcacaagatcatccacaccggcgagaagccctacaagtgcgaggagtgcggcaaggccttcaagcagagcagccacctgaccaagcacaagagcatccacaccggcgagaagccctacaagtgcgaggagagaggcaaggccttcagccacttcagcagactgaccaagcacagaatcatccacaccggcaagaagccctacaagtgcgaggagtgcggcgagaagccctacaagtgcgaggagtgcggcaaggccttcaaccagagcagccacctgacccagcacaagaccatccacaccggcggcaagacctacaagtgcgaggagtgcggcaaggccttcaaccacctgagcgccctgaccaagcacaagatcatccacaccggcgagaagccctag

SEQ ID NO: 106253 - DNA, 3021 bp, Artificial Sequence
  Description of Artificial Sequence: Synthetic coding sequence
atgagcagaagaaagcagagcaaccccagacagatcaagagaagcctgggcgacatggaggccagagaggaggtgcagctggtgggcgccagccacatggagcagaaggccaccgcccccgaggcccccagcccccccagcgccgacgtgaacagccccccccccctgcccccccccaccagccccggcggccccaaggagctggagggccaggagcccgagcccagacccaccgaggaggagcccggcagcccctggagcggccccgacgagctggagcccgtggtgcaggacggccagagaagaatcagagccagactgagcctggccaccggcctgagctggggccccttccacggcagcgtgcagaccagagccagcagccccagacaggccgagcccagccccgccctgaccctgctgctggtggacgaggcctgctggctgagaaccctgccccaggccctgaccgaggccgaggccaacaccgagatccacagaaaggacgacgccctgtggtgcagagtgaccaagcccgtgcccgccggcggcctgctgagcgtgctgctgaccgccgagccccacagcacccccggccaccccgtgaagaaggagcccgccgagcccacctgccccgcccccgcccacgacctgcagctgctgccccagcaggccggcatggccagcatcctggccaccgccgtgatcaacaaggacgtgttcccctgcaaggactgcggcatctggtacagaagcgagagaaacctgcaggcccacctgctgtactactgcgccagcagacagggcaccggcagccccgccgccgccgccaccgacgagaagcccaaggagacctaccccaacgagagagtgtgccccttcccccagtgcagaaagagctgccccagcgccagcagcctggagatccacatgagaagccacagcggcgagagacccttcgtgtgcctgatctgcctgagcgccttcaccaccaaggccaactgcgagagacacctgaaggtgcacaccgacaccctgagcggcgtgtgccacagctgcggcttcatcagcaccaccagagacatcctgtacagccacctggtgaccaaccacatggtgtgccagcccggcagcaagggcgagatctacagccccggcgccggccaccccgccaccaagctgccccccgacagcctgggcagcttccagcagcagcacaccgccctgcagggccccctggccagcgccgacctgggcctggcccccacccccagccccggcctggacagaaaggccctggccgaggccaccaacggcgaggccagagccgagcccctggcccagaacggcggcagcagcgagccccccgccgcccccagaagcatcaaggtggaggccgtggaggagcccgaggccgcccccatcctgggccccggcgagcccggcccccaggcccccagcagaacccccagccccagaagccccgcccccgccagagtgaaggccgagctgagcagccccacccccggcagcagccccgtgcccggcgagctgggcctggccggcgccctgttcctgccccagtacgtgttcggccccgacgccgccccccccgccagcgagatcctggccaagatgagcgagctggtgcacagcagactgcagcagggcgccggcgccggcgccggcggcgcccagaccggcctgttccccggcgcccccaagggcgccacctgcttcgagtgcgagatcaccttcagcaacgtgaacaactactacgtgcacaagagactgtactgcagcggcagaagagcccccgaggacgcccccgccgccagaagacccaaggccccccccggccccgccagagccccccccggccagcccgccgagcccgacgcccccagaagcagccccggccccggcgccagagaggagggcgccggcggcgccgccacccccgaggacggcgccggcggcagaggcagcgagggcagccagagccccggcagcagcgtggacgacgccgaggacgaccccagcagaaccctgtgcgaggcctgcaacatcagattcagcagacacgagacctacaccgtgcacaagagatactactgcgccagcagacacgaccccccccccagaagacccgccgccccccccggcccccccggccccgccgccccccccgcccccagccccgccgcccccgtgagaaccagaagaagaagaaagctgtacgagctgcacgccgccggcgccccccccccccccccccccggccacgcccccgcccccgagagccccagacccggcagcggcagcggcagcggccccggcctggcccccgccagaagccccggccccgccgccgacggccccatcgacctgagcaagaagcccagaagacccctgcccggcgcccccgcccccgccctggccgactaccacgagtgcaccgcctgcagagtgagcttccacagcctggaggcctacctggcccacaagaagtacagctgccccgccgcccccccccccggcgccctgggcctgcccgccgccgcctgcccctactgcccccccaacggccccgtgagaggcgacctgctggagcacttcagactggcccacggcctgctgctgggcgcccccctggccggccccggcgtggaggccagaacccccgccgacagaggccccagccccgcccccgcccccgccgccagcccccagcccggcagcagaggccccagagacggcctgggccccgagccccaggagcccccccccggccccccccccagccccgccgccgcccccgaggccgtgccccccccccccgccccccccagctacagcgacaagggcgtgcagacccccagcaagggcacccccgcccccctgcccaacggcaaccacagatactgcagactgtgcaacatcaagttcagcagcctgagcaccttcatcgcccacaagaagtactactgcagcagccacgccgccgagcacgtgaagtag

SEQ ID NO: 106254 - DNA, 2649 bp, Artificial Sequence
  Description of Artificial Sequence: Synthetic coding sequence
atgtactactgcagcggcagacagagagaggccgcccccgtgagcgaggagaacgaggacagcgcccaccagatcagcagcctgtgccccttcccccagtgcaccaagagcttcagcaacgccagagccctggagatgcacctgaacagccacagcggcgtgaagatggaggagttcctgccccccggcgccagcctgaagtgcaccgtgtgcagctacaccgccgacagcgtgatcaacttccaccagcacctgttcagccacctgacccaggccgccttcagatgcaaccactgccacttcggcttccagacccagagagagctgctgcagcaccaggagctgcacgtgcccagcggcaagctgcccagagagagcgacatggagcacagccccagcgccaccgaggacagcctgcagcccgccaccgacctgctgaccagaagcgagctgccccagagccagaaggccatgcagaccaaggacgccagcagcgacaccgagctggacaagtgcgagaagaagacccagctgttcctgaccaaccagagacccgagatccagcccaccaccaacaagcagagcttcagctacaccaagatcaagagcgagcccagcagccccagactggccagcagccccgtgcagcccaacatcggccccagcttccccgtgggccccttcctgagccagttcagcttcccccaggacatcaccatggtgccccaggccagcgagatcctggccaagatgagcgagctggtgcacagaagactgagacacggcagcagcagctacccccccgtgatctacagccccctgatgcccaagggcgccacctgcttcgagtgcaacatcaccttcaacaacctggacaactacctggtgcacaagaagcactactgcagcagcagatggcagcagatggccaagagccccgagttccccagcgtgagcgagaagatgcccgaggccctgagccccaacaccggccagaccagcatcaacctgctgaaccccgccgcccacagcgccgaccccgagaaccccctgctgcagaccagctgcatcaacagcagcaccgtgctggacctgatcggccccaacggcaagggccacgacaaggacttcagcacccagaccaagaagctgagcaccagcagcaacaacgacgacaagatcaacggcaagcccgtggacgtgaagaaccccagcgtgcccctggtggacggcgagagcgaccccaacaagaccacctgcgaggcctgcaacatcaccttcagcagacacgagacctacatggtgcacaagcagtactactgcgccaccagacacgacccccccctgaagagaagcgccagcaacaaggtgcccgccatgcagagaaccatgagaaccagaaagagaagaaagatgtacgagatgtgcctgcccgagcaggagcagagaccccccctggtgcagcagagattcctggacgtggccaacctgaacaacccctgcaccagcacccaggagcccaccgagggcctgggcgagtgctaccaccccagatgcgacatcttccccggcatcgtgagcaagcacctggagaccagcctgaccatcaacaagtgcgtgcccgtgagcaagtgcgacaccacccacagcagcgtgagctgcctggagatggacgtgcccatcgacctgagcaagaagtgcctgagccagagcgagagaaccaccaccagccccaagagactgctggactaccacgagtgcaccgtgtgcaagatcagcttcaacaaggtggagaactacctggcccacaagcagaacttctgccccgtgaccgcccaccagagaaacgacctgggccagctggacggcaaggtgttccccaaccccgagagcgagagaaacagccccgacgtgagctacgagagaagcatcatcaagtgcgagaagaacggcaacctgaagcagcccagccccaacggcaacctgttcagcagccacctggccaccctgcagggcctgaaggtgttcagcgaggccgcccagctgatcgccaccaaggaggagaacagacacctgttcctgccccagtgcctgtaccccggcgccatcaagaaggccaagggcgccgaccagctgagcccctactacggcatcaagcccagcgactacatcagcggcagcctggtgatccacaacaccgacatcgagcagagcagaaacgccgagaacgagagccccaagggccaggccagcagcaacggctgcgccgccctgaagaaggacagcctgcccctgctgcccaagaacagaggcatggtgatcgtgaacggcggcctgaagcaggacgagagacccgccgccaacccccagcaggagaacatcagccagaacccccagcacgaggacgaccacaagagccccagctggatcagcgagaaccccctggccgccaacgagaacgtgagccccggcatccccagcgccgaggagcagctgagcagcatcgccaagggcgtgaacggcagcagccaggcccccaccagcggcaagtactgcagactgtgcgacatccagttcaacaacctgagcaacttcatcacccacaagaagttctactgcagcagccacgccgccgagcacgtgaagtag

SEQ ID NO: 106255 - DNA, 3456 bp, Artificial Sequence
  Description of Artificial Sequence: Synthetic coding sequence
atgagcagaagaaagcagagcaagcccagacagatcaagagacccctggaggacgccatcgaggacgaggaggaggagtgccccagcgaggagaccgacatcatcagcaagggcgacttccccctggaggagagcttcagcaccgagttcggccccgagaacctgagctgcgaggaggtggagtacttctgcaacaagggcgacgacgagggcatccaggagaccgccgagagcgacggcgacacccagagcgagaagcccggccagcccggcgtggagaccgacgactgggacggccccggcgagctggaggtgttccagaaggacggcgagagaaagatccagagcagacagcagctgcccgtgggcaccacctggggccccttccccggcaagatggacctgaacaacaacagcctgaagaccaaggcccaggtgcccatggtgctgaccgccggccccaagtggctgctggacgtgacctggcagggcgtggaggacaacaagaacaactgcatcgtgtacagcaagggcggccagctgtggtgcaccaccaccaaggccatcagcgagggcgaggagctgatcgccttcgtggtggacttcgacagcagactgcaggccgccagccagatgaccctgaccgagggcatgtaccccgccagactgctggacagcatccagctgctgccccagcaggccgccatggccagcatcctgcccaccgccatcgtgaacaaggacatcttcccctgcaagagctgcggcatctggtacagaagcgagagaaacctgcaggcccacctgatgtactactgcagcggcagacagagagaggccgcccccgtgagcgaggagaacgaggacagcgcccaccagatcagcagcctgtgccccttcccccagtgcaccaagagcttcagcaacgccagagccctggagatgcacctgaacagccacagcggcgtgaagatggaggagttcctgccccccggcgccagcctgaagtgcaccgtgtgcagctacaccgccgacagcgtgatcaacttccaccagcacctgttcagccacctgacccaggccgccttcagatgcaaccactgccacttcggcttccagacccagagagagctgctgcagcaccaggagctgcacgtgcccagcggcaagctgcccagagagagcgacatggagcacagccccagcgccaccgaggacagcctgcagcccgccaccgacctgctgaccagaagcgagctgccccagagccagaaggccatgcagaccaaggacgccagcagcgacaccgagctggacaagtgcgagaagaagacccagctgttcctgaccaaccagagacccgagatccagcccaccaccaacaagcagagcttcagctacaccaagatcaagagcgagcccagcagccccagactggccagcagccccgtgcagcccaacatcggccccagcttccccgtgggccccttcctgagccagttcagcttcccccaggacatcaccatggtgccccaggccagcgagatcctggccaagatgagcgagctggtgcacagaagactgagacacggcagcagcagctacccccccgtgatctacagccccctgatgcccaagggcgccacctgcttcgagtgcaacatcaccttcaacaacctggacaactacctggtgcacaagaagcactactgcagcagcagatggcagcagatggccaagagccccgagttccccagcgtgagcgagaagatgcccgaggccctgagccccaacaccggccagaccagcatcaacctgctgaaccccgccgcccacagcgccgaccccgagaaccccctgctgcagaccagctgcatcaacagcagcaccgtgctggacctgatcggccccaacggcaagggccacgacaaggacttcagcacccagaccaagaagctgagcaccagcagcaacaacgacgacaagatcaacggcaagcccgtggacgtgaagaaccccagcgtgcccctggtggacggcgagagcgaccccaacaagaccacctgcgaggcctgcaacatcaccttcagcagacacgagacctacatggtgcacaagcagtactactgcgccaccagacacgacccccccctgaagagaagcgccagcaacaaggtgcccgccatgcagagaaccatgagaaccagaaagagaagaaagatgtacgagatgtgcctgcccgagcaggagcagagaccccccctggtgcagcagagattcctggacgtggccaacctgaacaacccctgcaccagcacccaggagcccaccgagggcctgggcgagtgctaccaccccagatgcgacatcttccccggcatcgtgagcaagcacctggagaccagcctgaccatcaacaagtgcgtgcccgtgagcaagtgcgacaccacccacagcagcgtgagctgcctggagatggacgtgcccatcgacctgagcaagaagtgcctgagccagagcgagagaaccaccaccagccccaagagactgctggactaccacgagtgcaccgtgtgcaagatcagcttcaacaaggtggagaactacctggcccacaagcagaacttctgccccgtgaccgcccaccagagaaacgacctgggccagctggacggcaaggtgttccccaaccccgagagcgagagaaacagccccgacgtgagctacgagagaagcatcatcaagtgcgagaagaacggcaacctgaagcagcccagccccaacggcaacctgttcagcagccacctggccaccctgcagggcctgaaggtgttcagcgaggccgcccagctgatcgccaccaaggaggagaacagacacctgttcctgccccagtgcctgtaccccggcgccatcaagaaggccaagggcgccgaccagctgagcccctactacggcatcaagcccagcgactacatcagcggcagcctggtgatccacaacaccgacatcgagcagagcagaaacgccgagaacgagagccccaagggccaggccagcagcaacggctgcgccgccctgaagaaggacagcctgcccctgctgcccaagaacagaggcatggtgatcgtgaacggcggcctgaagcaggacgagagacccgccgccaacccccagcaggagaacatcagccagaacccccagcacgaggacgaccacaagagccccagctggatcagcgagaaccccctggccgccaacgagaacgtgagccccggcatccccagcgccgaggagcagctgagcagcatcgccaagggcgtgaacggcagcagccaggcccccaccagcggcaagtactgcagactgtgcgacatccagttcaacaacctgagcaacttcatcacccacaagaagttctactgcagcagccacgccgccgagcacgtgaagtag

SEQ ID NO: 106256 - DNA, 3060 bp, Artificial Sequence
  Description of Artificial Sequence: Synthetic coding sequence
atggacctgaacaacaacagcctgaagaccaaggcccaggtgcccatggtgctgaccgccggccccaagtggctgctggacgtgacctggcagggcgtggaggacaacaagaacaactgcatcgtgtacagcaagggcggccagctgtggtgcaccaccaccaaggccatcagcgagggcgaggagctgatcgccttcgtggtggacttcgacagcagactgcaggccgccagccagatgaccctgaccgagggcatgtaccccgccagactgctggacagcatccagctgctgccccagcaggccgccatggccagcatcctgcccaccgccatcgtgaacaaggacatcttcccctgcaagagctgcggcatctggtacagaagcgagagaaacctgcaggcccacctgatgtactactgcagcggcagacagagagaggccgcccccgtgagcgaggagaacgaggacagcgcccaccagatcagcagcctgtgccccttcccccagtgcaccaagagcttcagcaacgccagagccctggagatgcacctgaacagccacagcggcgtgaagatggaggagttcctgccccccggcgccagcctgaagtgcaccgtgtgcagctacaccgccgacagcgtgatcaacttccaccagcacctgttcagccacctgacccaggccgccttcagatgcaaccactgccacttcggcttccagacccagagagagctgctgcagcaccaggagctgcacgtgcccagcggcaagctgcccagagagagcgacatggagcacagccccagcgccaccgaggacagcctgcagcccgccaccgacctgctgaccagaagcgagctgccccagagccagaaggccatgcagaccaaggacgccagcagcgacaccgagctggacaagtgcgagaagaagacccagctgttcctgaccaaccagagacccgagatccagcccaccaccaacaagcagagcttcagctacaccaagatcaagagcgagcccagcagccccagactggccagcagccccgtgcagcccaacatcggccccagcttccccgtgggccccttcctgagccagttcagcttcccccaggacatcaccatggtgccccaggccagcgagatcctggccaagatgagcgagctggtgcacagaagactgagacacggcagcagcagctacccccccgtgatctacagccccctgatgcccaagggcgccacctgcttcgagtgcaacatcaccttcaacaacctggacaactacctggtgcacaagaagcactactgcagcagcagatggcagcagatggccaagagccccgagttccccagcgtgagcgagaagatgcccgaggccctgagccccaacaccggccagaccagcatcaacctgctgaaccccgccgcccacagcgccgaccccgagaaccccctgctgcagaccagctgcatcaacagcagcaccgtgctggacctgatcggccccaacggcaagggccacgacaaggacttcagcacccagaccaagaagctgagcaccagcagcaacaacgacgacaagatcaacggcaagcccgtggacgtgaagaaccccagcgtgcccctggtggacggcgagagcgaccccaacaagaccacctgcgaggcctgcaacatcaccttcagcagacacgagacctacatggtgcacaagcagtactactgcgccaccagacacgacccccccctgaagagaagcgccagcaacaaggtgcccgccatgcagagaaccatgagaaccagaaagagaagaaagatgtacgagatgtgcctgcccgagcaggagcagagaccccccctggtgcagcagagattcctggacgtggccaacctgaacaacccctgcaccagcacccaggagcccaccgagggcctgggcgagtgctaccaccccagatgcgacatcttccccggcatcgtgagcaagcacctggagaccagcctgaccatcaacaagtgcgtgcccgtgagcaagtgcgacaccacccacagcagcgtgagctgcctggagatggacgtgcccatcgacctgagcaagaagtgcctgagccagagcgagagaaccaccaccagccccaagagactgctggactaccacgagtgcaccgtgtgcaagatcagcttcaacaaggtggagaactacctggcccacaagcagaacttctgccccgtgaccgcccaccagagaaacgacctgggccagctggacggcaaggtgttccccaaccccgagagcgagagaaacagccccgacgtgagctacgagagaagcatcatcaagtgcgagaagaacggcaacctgaagcagcccagccccaacggcaacctgttcagcagccacctggccaccctgcagggcctgaaggtgttcagcgaggccgcccagctgatcgccaccaaggaggagaacagacacctgttcctgccccagtgcctgtaccccggcgccatcaagaaggccaagggcgccgaccagctgagcccctactacggcatcaagcccagcgactacatcagcggcagcctggtgatccacaacaccgacatcgagcagagcagaaacgccgagaacgagagccccaagggccaggccagcagcaacggctgcgccgccctgaagaaggacagcctgcccctgctgcccaagaacagaggcatggtgatcgtgaacggcggcctgaagcaggacgagagacccgccgccaacccccagcaggagaacatcagccagaacccccagcacgaggacgaccacaagagccccagctggatcagcgagaaccccctggccgccaacgagaacgtgagccccggcatccccagcgccgaggagcagctgagcagcatcgccaagggcgtgaacggcagcagccaggcccccaccagcggcaagtactgcagactgtgcgacatccagttcaacaacctgagcaacttcatcacccacaagaagttctactgcagcagccacgccgccgagcacgtgaagtag

SEQ ID NO: 106257 - DNA, 3060 bp, Artificial Sequence; identical to SEQ ID NO: 106256
  Description of Artificial Sequence: Synthetic coding sequence

SEQ ID NO: 106258 - DNA, 2418 bp, Artificial Sequence
  Description of Artificial Sequence: Synthetic coding sequence
atggacgaggacggcctggagctgcagcaggagcccaacagcttcttcgacgccaccggcgccgacggcacccacatggacggcgaccagatcgtggtggaggtgcaggagaccgtgttcgtgagcgacgtggtggacagcgacatcaccgtgcacaacttcgtgcccgacgaccccgacagcgtggtgatccaggacgtgatcgaggacgtggtgatcgaggacgtgcagtgccccgacatcatggaggaggccgacgtgagcgagaccgtgatcatccccgagcaggtgctggacagcgacgtgaccgaggaggtgagcctggcccactgcaccgtgcccgacgacgtgctggccagcgacatcaccagcgccagcatgagcatgcccgagcacgtgctgaccggcgacagcatccacgtgagcgacgtgggccacgtgggccacgtgggccacgtggagcacgtggtgcacgacagcgtggtggaggccgagatcgtgaccgaccccctgaccaccgacgtggtgagcgaggaggtgctggtggccgactgcgccagcgaggccgtgatcgacgccaacggcatccccgtggaccagcaggacgacgacaagggcaactgcgaggactacctgatgatcagcctggacgacgccggcaagatcgagcacgacggcagcagcggcatgaccatggacaccgagagcgagatcgacccctgcaaggtggacggcacctgccccgaggtgatcaaggtgtacatcttcaaggccgaccccggcgaggacgacctgggcggcaccgtggacatcgtggagagcgagcccgagaacgaccacggcgtggagctgctggaccagaacagcagcatcagagtgcccagagagaagatggtgtacatgaccgtgaacgacagccagcccgaggacgaggacctgaacgtggccgagatcgccgacgaggtgtacatggaggtgatcgtgggcgaggaggacgccgccgccgccgccgccgccgccgccgtgcacgagcagcagatggacgacaacgagatcaagaccttcatgcccatcgcctgggccgccgcctacggcaacaacagcgacggcatcgagaacagaaacggcaccgccagcgccctgctgcacatcgacgagagcgccggcctgggcagactggccaagcagaagcccaagaagagaagaagacccgacagcagacagtaccagaccgccatcatcatcggccccgacggccaccccctgaccgtgtacccctgcatgatctgcggcaagaagttcaagagcagaggcttcctgaagagacacatgaagaaccaccccgagcacctggccaagaagaagtacagatgcaccgactgcgactacaccaccaacaagaagatcagcctgcacaaccacctggagagccacaagctgaccagcaaggccgagaaggccatcgagtgcgacgagtgcggcaagcacttcagccacgccggcgccctgttcacccacaagatggtgcacaaggagaagggcgccaacaagatgcacaagtgcaagttctgcgagtacgagaccgccgagcagggcctgctgaacagacacctgctggccgtgcacagcaagaacttcccccacatctgcgtggagtgcggcaagggcttcagacaccccagcgagctgaagaagcacatgagaatccacaccggcgagaagccctaccagtgccagtactgcgagtacagaagcgccgacagcagcaacctgaagacccacgtgaagaccaagcacagcaaggagatgcccttcaagtgcgacatctgcctgctgaccttcagcgacaccaaggaggtgcagcagcacgccctgatccaccaggagagcaagacccaccagtgcctgcactgcgaccacaagagcagcaacagcagcgacctgaagagacacatcatcagcgtgcacaccaaggactacccccacaagtgcgacatgtgcgacaagggcttccacagacccagcgagctgaagaagcacgtggccgcccacaagggcaagaagatgcaccagtgcagacactgcgacttcaagatcgccgaccccttcgtgctgagcagacacatcctgagcgtgcacaccaaggacctgcccttcagatgcaagagatgcagaaagggcttcagacagcagagcgagctgaagaagcacatgaagacccacagcggcagaaaggtgtaccagtgcgagtactgcgagtacagcaccaccgacgccagcggcttcaagagacacgtgatcagcatccacaccaaggactacccccacagatgcgagtactgcaagaagggcttcagaagacccagcgagaagaaccagcacatcatgagacaccacaaggaggtgggcctgccctag

SEQ ID NO: 106259 - DNA, 2268 bp, Artificial Sequence
  Description of Artificial Sequence: Synthetic coding sequence
atggacgaggacggcctggagctgcagcaggagcccaacagcttcttcgacgccaccggcgccgacggcacccacatggacggcgaccagatcgtggtggaggtgcaggagaccgtgttcgtgagcgacgtggtggacagcgacatcaccgtgcacaacttcgtgcccgacgaccccgacagcgtggtgatccaggacgtgatcgaggacgtggtgatcgaggacgtgcagtgccccgacatcatggaggaggccgacgtgagcgagaccgtgatcatccccgagcaggtgctggacagcgacgtgaccgaggaggtgagcctggcccactgcaccgtgcccgacgacgtgctggccagcgacatcaccagcgccagcatgagcatgcccgagcacgtgctgaccggcgacagcatccacgtgagcgacgtgggccacgtgggccacgtgggccacgtggagcacgtggtgcacgacagcgtggtggaggccgagatcgtgaccgaccccctgaccaccgacgtggtgagcgaggaggtgctggtggccgactgcgccagcgaggccgtgatcgacgccaacggcatccccgtggaccagcaggacgacgacaagggcaactgcgaggactacctgatgatcagctgcggcaccgtggacatcgtggagagcgagcccgagaacgaccacggcgtggagctgctggaccagaacagcagcatcagagtgcccagagagaagatggtgtacatgaccgtgaacgacagccagcccgaggacgaggacctgaacgtggccgagatcgccgacgaggtgtacatggaggtgatcgtgggcgaggaggacgccgccgccgccgccgccgccgccgccgtgcacgagcagcagatggacgacaacgagatcaagaccttcatgcccatcgcctgggccgccgcctacggcaacaacagcgacggcatcgagaacagaaacggcaccgccagcgccctgctgcacatcgacgagagcgccggcctgggcagactggccaagcagaagcccaagaagagaagaagacccgacagcagacagtaccagaccgccatcatcatcggccccgacggccaccccctgaccgtgtacccctgcatgatctgcggcaagaagttcaagagcagaggcttcctgaagagacacatgaagaaccaccccgagcacctggccaagaagaagtacagatgcaccgactgcgactacaccaccaacaagaagatcagcctgcacaaccacctggagagccacaagctgaccagcaaggccgagaaggccatcgagtgcgacgagtgcggcaagcacttcagccacgccggcgccctgttcacccacaagatggtgcacaaggagaagggcgccaacaagatgcacaagtgcaagttctgcgagtacgagaccgccgagcagggcctgctgaacagacacctgctggccgtgcacagcaagaacttcccccacatctgcgtggagtgcggcaagggcttcagacaccccagcgagctgaagaagcacatgagaatccacaccggcgagaagccctaccagtgccagtactgcgagtacagaagcgccgacagcagcaacctgaagacccacgtgaagaccaagcacagcaaggagatgcccttcaagtgcgacatctgcctgctgaccttcagcgacaccaaggaggtgcagcagcacgccctgatccaccaggagagcaagacccaccagtgcctgcactgcgaccacaagagcagcaacagcagcgacctgaagagacacatcatcagcgtgcacaccaaggactacccccacaagtgcgacatgtgcgacaagggcttccacagacccagcgagctgaagaagcacgtggccgcccacaagggcaagaagatgcaccagtgcagacactgcgacttcaagatcgccgaccccttcgtgctgagcagacacatcctgagcgtgcacaccaaggacctgcccttcagatgcaagagatgcagaaagggcttcagacagcagagcgagctgaagaagcacatgaagacccacagcggcagaaaggtgtaccagtgcgagtactgcgagtacagcaccaccgacgccagcggcttcaagagacacgtgatcagcatccacaccaaggactacccccacagatgcgagtactgcaagaagggcttcagaagacccagcgagaagaaccagcacatcatgagacaccacaaggaggtgggcctgccctag

SEQ ID NO: 106260 - DNA, 2418 bp, Artificial Sequence; identical to SEQ ID NO: 106258
  Description of Artificial Sequence: Synthetic coding sequence

SEQ ID NO: 106261 - DNA, 2418 bp, Artificial Sequence; identical to SEQ ID NO: 106258
  Description of Artificial Sequence: Synthetic coding sequence

SEQ ID NO: 106262 - DNA, 99 bp, Artificial Sequence
  Description of Artificial Sequence: Synthetic coding sequence
atggacgaggacggcctggagctgcagcaggagcccaacagcttcttcgacgccaccggcgccgacggcacccacatggacggcgaccagatcgtgtag

SEQ ID NO: 106263 - DNA, 408 bp, Artificial Sequence
  Description of Artificial Sequence: Synthetic coding sequence
atggacgaggacggcctggagctgcagcaggagcccaacagcttcttcgacgccaccggcgccgacggcacccacatggacggcgaccagatcgtggtggaggtgcaggagaccgtgttcgtgagcgacgtggtggacagcgacatcaccgtgcacaacttcgtgcccgacgaccccgacagcgtggtgatccaggacgtgatcgaggacgtggtgatcgaggacgtgcagtgccccgacatcatggaggaggccgacgtgagcgagaccgtgatcatccccgagcaggtgctggacagcgacgtgaccgaggaggtgagcctggcccactgcaccgtgcccgacgacgtgctggccagcgacatcaccagcgccagcatgagcatgcccgagcacgtgctgacctag

SEQ ID NO: 106264 - DNA, 1584 bp, Artificial Sequence
  Description of Artificial Sequence: Synthetic coding sequence
atggacaccgagagcgagatcgacccctgcaaggtggacggcacctgccccgaggtgatcaaggtgtacatcttcaaggccgaccccggcgaggacgacctgggcggcaccgtggacatcgtggagagcgagcccgagaacgaccacggcgtggagctgctggaccagaacagcagcatcagagtgcccagagagaagatggtgtacatgaccgtgaacgacagccagcccgaggacgaggacctgaacgtggccgagatcgccgacgaggtgtacatggaggtgatcgtgggcgaggaggacgccgccgccgccgccgccgccgccgccgtgcacgagcagcagatggacgacaacgagatcaagaccttcatgcccatcgcctgggccgccgcctacgccatcatcatcggccccgacggccaccccctgaccgtgtacccctgcatgatctgcggcaagaagttcaagagcagaggcttcctgaagagacacatgaagaaccaccccgagcacctggccaagaagaagtacagatgcaccgactgcgactacaccaccaacaagaagatcagcctgcacaaccacctggagagccacaagctgaccagcaaggccgagaaggccatcgagtgcgacgagtgcggcaagcacttcagccacgccggcgccctgttcacccacaagatggtgcacaaggagaagggcgccaacaagatgcacaagtgcaagttctgcgagtacgagaccgccgagcagggcctgctgaacagacacctgctggccgtgcacagcaagaacttcccccacatctgcgtggagtgcggcaagggcttcagacaccccagcgagctgaagaagcacatgagaatccacaccggcgagaagccctaccagtgccagtactgcgagtacagaagcgccgacagcagcaacctgaagacccacgtgaagaccaagcacagcaaggagatgcccttcaagtgcgacatctgcctgctgaccttcagcgacaccaaggaggtgcagcagcacgccctgatccaccaggagagcaagacccaccagtgcctgcactgcgaccacaagagcagcaacagcagcgacctgaagagacacatcatcagcgtgcacaccaaggactacccccacaagtgcgacatgtgcgacaagggcttccacagacccagcgagctgaagaagcacgtggccgcccacaagggcaagaagatgcaccagtgcagacactgcgacttcaagatcgccgaccccttcgtgctgagcagacacatcctgagcgtgcacaccaaggacctgcccttcagatgcaagagatgcagaaagggcttcagacagcagagcgagctgaagaagcacatgaagacccacagcggcagaaaggtgtaccagtgcgagtactgcgagtacagcaccaccgacgccagcggcttcaagagacacgtgatcagcatccacaccaaggactacccccacagatgcgagtactgcaagaagggcttcagaagacccagcgagaagaaccagcacatcatgagacaccacaaggaggtgggcctgccctag

SEQ ID NO: 106265 - DNA, 789 bp, Artificial Sequence
  Description of Artificial Sequence: Synthetic coding sequence
atggacgaggacggcctggagctgcagcaggagcccaacagcttcttcgacgccaccggcgccgacggcacccacatggacggcgaccagatcgtggtggaggtgcaggagaccgtgttcgtgagcgacgtggtggacagcgacatcaccgtgcacaacttcgtgcccgacgaccccgacagcgtggtgatccaggacgtgatcgaggacgtggtgatcgaggacgtgcagtgccccgacatcatggaggaggccgacgtgagcgagaccgtgatcatccccgagcaggtgctggacagcgacgtgaccgaggaggtgagcctggcccactgcaccgtgcccgacgacgtgctggccagcgacatcaccagcgccagcatgagcatgcccgagcacgtgctgaccggcgacagcatccacgtgagcgacgtgggccacgtgggccacgtgggccacgtggagcacgtggtgcacgacagcgtggtggaggccgagatcgtgaccgaccccctgaccaccgacgtggtgagcgaggaggtgctggtggccgactgcgccagcgaggccgtgatcgacgccaacggcatccccgtggaccagcaggacgacgacaagggcaactgcgaggactacctgatgatcagctgcaacaacagcgacggcatcgagaacagaaacggcaccgccagcgccctgctgcacatcgacgagagcgccggcctgggcagactggccaagcagaagcccaagaagagaagaagacccgacagcagacagtaccagacctag

SEQ ID NO: 106266 - DNA, 1731 bp, Artificial Sequence
  Description of Artificial Sequence: Synthetic coding sequence
atgaccatggacaccgagagcgagatcgacccctgcaaggtggacggcacctgccccgaggtgatcaaggtgtacatcttcaaggccgaccccggcgaggacgacctgggcggcaccgtggacatcgtggagagcgagcccgagaacgaccacggcgtggagctgctggaccagaacagcagcatcagagtgcccagagagaagatggtgtacatgaccgtgaacgacagccagcccgaggacgaggacctgaacgtggccgagatcgccgacgaggtgtacatggaggtgatcgtgggcgaggaggacgccgccgccgccgccgccgccgccgccgtgcacgagcagcagatggacgacaacgagatcaagaccttcatgcccatcgcctgggccgccgcctacggcaacaacagcgacggcatcgagaacagaaacggcaccgccagcgccctgctgcacatcgacgagagcgccggcctgggcagactggccaagcagaagcccaagaagagaagaagacccgacagcagacagtaccagaccgccatcatcatcggccccgacggccaccccctgaccgtgtacccctgcatgatctgcggcaagaagttcaagagcagaggcttcctgaagagacacatgaagaaccaccccgagcacctggccaagaagaagtacagatgcaccgactgcgactacaccaccaacaagaagatcagcctgcacaaccacctggagagccacaagctgaccagcaaggccgagaaggccatcgagtgcgacgagtgcggcaagcacttcagccacgccggcgccctgttcacccacaagatggtgcacaaggagaagggcgccaacaagatgcacaagtgcaagttctgcgagtacgagaccgccgagcagggcctgctgaacagacacctgctggccgtgcacagcaagaacttcccccacatctgcgtggagtgcggcaagggcttcagacaccccagcgagctgaagaagcacatgagaatccacaccggcgagaagccctaccagtgccagtactgcgagtacagaagcgccgacagcagcaacctgaagacccacgtgaagaccaagcacagcaaggagatgcccttcaagtgcgacatctgcctgctgaccttcagcgacaccaaggaggtgcagcagcacgccctgatccaccaggagagcaagacccaccagtgcctgcactgcgaccacaagagcagcaacagcagcgacctgaagagacacatcatcagcgtgcacaccaaggactacccccacaagtgcgacatgtgcgacaagggcttccacagacccagcgagctgaagaagcacgtggccgcccacaagggcaagaagatgcaccagtgcagacactgcgacttcaagatcgccgaccccttcgtgctgagcagacacatcctgagcgtgcacaccaaggacctgcccttcagatgcaagagatgcagaaagggcttcagacagcagagcgagctgaagaagcacatgaagacccacagcggcagaaaggtgtaccagtgcgagtactgcgagtacagcaccaccgacgccagcggcttcaagagacacgtgatcagcatccacaccaaggactacccccacagatgcgagtactgcaagaagggcttcagaagacccagcgagaagaaccagcacatcatgagacaccacaaggaggtgggcctgccctag

SEQ ID NO: 106267 - DNA, 2535 bp, Artificial Sequence
  Description of Artificial Sequence: Synthetic coding sequence
atggacgaggacggcctggagctgcagcaggagcccaacagcttcttcgacgccaccgacagagtgagcttctgccaccccggctggagcaccgtggcccccagcggcagcaccgccaccagcgccagccaggcccaggtgatctgcagcgccagcagagtgaccggcgccaccggcgccgacggcacccacatggacggcgaccagatcgtggtggaggtgcaggagaccgtgttcgtgagcgacgtggtggacagcgacatcaccgtgcacaacttcgtgcccgacgaccccgacagcgtggtgatccaggacgtgatcgaggacgtggtgatcgaggacgtgcagtgccccgacatcatggaggaggccgacgtgagcgagaccgtgatcatccccgagcaggtgctggacagcgacgtgaccgaggaggtgagcctggcccactgcaccgtgcccgacgacgtgctggccagcgacatcaccagcgccagcatgagcatgcccgagcacgtgctgaccggcgacagcatccacgtgagcgacgtgggccacgtgggccacgtgggccacgtggagcacgtggtgcacgacagcgtggtggaggccgagatcgtgaccgaccccctgaccaccgacgtggtgagcgaggaggtgctggtggccgactgcgccagcgaggccgtgatcgacgccaacggcatccccgtggaccagcaggacgacgacaagggcaactgcgaggactacctgatgatcagcctggacgacgccggcaagatcgagcacgacggcagcagcggcatgaccatggacaccgagagcgagatcgacccctgcaaggtggacggcacctgccccgaggtgatcaaggtgtacatcttcaaggccgaccccggcgaggacgacctgggcggcaccgtggacatcgtggagagcgagcccgagaacgaccacggcgtggagctgctggaccagaacagcagcatcagagtgcccagagagaagatggtgtacatgaccgtgaacgacagccagcccgaggacgaggacctgaacgtggccgagatcgccgacgaggtgtacatggaggtgatcgtgggcgaggaggacgccgccgccgccgccgccgccgccgccgtgcacgagcagcagatggacgacaacgagatcaagaccttcatgcccatcgcctgggccgccgcctacggcaacaacagcgacggcatcgagaacagaaacggcaccgccagcgccctgctgcacatcgacgagagcgccggcctgggcagactggccaagcagaagcccaagaagagaagaagacccgacagcagacagtaccagaccgccatcatcatcggccccgacggccaccccctgaccgtgtacccctgcatgatctgcggcaagaagttcaagagcagaggcttcctgaagagacacatgaagaaccaccccgagcacctggccaagaagaagtacagatgcaccgactgcgactacaccaccaacaagaagatcagcctgcacaaccacctggagagccacaagctgaccagcaaggccgagaaggccatcgagtgcgacgagtgcggcaagcacttcagccacgccggcgccctgttcacccacaagatggtgcacaaggagaagggcgccaacaagatgcacaagtgcaagttctgcgagtacgagaccgccgagcagggcctgctgaacagacacctgctggccgtgcacagcaagaacttcccccacatctgcgtggagtgcggcaagggcttcagacaccccagcgagctgaagaagcacatgagaatccacaccggcgagaagccctaccagtgccagtactgcgagtacagaagcgccgacagcagcaacctgaagacccacgtgaagaccaagcacagcaaggagatgcccttcaagtgcgacatctgcctgctgaccttcagcgacaccaaggaggtgcagcagcacgccctgatccaccaggagagcaagacccaccagtgcctgcactgcgaccacaagagcagcaacagcagcgacctgaagagacacatcatcagcgtgcacaccaaggactacccccacaagtgcgacatgtgcgacaagggcttccacagacccagcgagctgaagaagcacgtggccgcccacaagggcaagaagatgcaccagtgcagacactgcgacttcaagatcgccgaccccttcgtgctgagcagacacatcctgagcgtgcacaccaaggacctgcccttcagatgcaagagatgcagaaagggcttcagacagcagagcgagctgaagaagcacatgaagacccacagcggcagaaaggtgtaccagtgcgagtactgcgagtacagcaccaccgacgccagcggcttcaagagacacgtgatcagcatccacaccaaggactacccccacagatgcgagtactgcaagaagggcttcagaagacccagcgagaagaaccagcacatcatgagacaccacaaggaggtgggcctgccctag

SEQ ID NO: 106268 - DNA, 522 bp, Artificial Sequence
  Description of Artificial Sequence: Synthetic coding sequence
ggcggctgcagccagtacctgctgctgttcgtggacgacgccggcaagatcgagcacgacggcagcagcggcatgaccatggacaccgagagcgagatcgacccctgcaaggtggacggcacctgccccgaggtgatcaaggtgtacatcttcaaggccgaccccggcgaggacgacctgggcggcaccgtggacatcgtggagagcgagcccgagaacgaccacggcgtggagctgctggaccagaacagcagcatcagagtgcccagagagaagatggtgtacatgaccgtgaacgacagccagcccgaggacgaggacctgaacgtggccgagatcgccgacgaggtgtacatggaggtgatcgtgggcgaggaggacgccgccgccgccgccgccgccgccgccgtgcacgagcagcagatggacgacaacgagatcaagaccttcatgcccatcgcctgggccgccgcctacggcaacaacagcgacggcatcgagaacagaaacggcaccgcctag

SEQ ID NO: 106269 - DNA, 2406 bp, Artificial Sequence
  Description of Artificial Sequence: Synthetic coding sequence
atggacgaggacgagttcgagctgcagccccaggagcccaacagcttcttcgacggcatcggcgccgacgccacccacatggacggcgaccagatcgtggtggagatccaggaggccgtgttcgtgagcaacatcgtggacagcgacatcaccgtgcacaacttcgtgcccgacgaccccgacagcgtggtgatccaggacgtggtggaggacgtggtgatcgaggaggacgtgcagtgcagcgacatcctggaggaggccgacgtgagcgagaacgtgatcatccccgagcaggtgctggacagcgacgtgaccgaggaggtgagcctgccccactgcaccgtgcccgacgacgtgctggccagcgacatcaccagcaccagcatgagcatgcccgagcacgtgctgaccagcgagagcatgcacgtgtgcgacatcggccacgtggagcacatggtgcacgacagcgtggtggaggccgagatcatcaccgaccccctgaccagcgacatcgtgagcgaggaggtgctggtggccgactgcgcccccgaggccgtgatcgacgccagcggcatcagcgtggaccagcaggacaacgacaaggccagctgcgaggactacctgatgatcagcctggacgacgccggcaagatcgagcacgacggcagcaccggcgtgaccatcgacgccgagagcgagatggacccctgcaaggtggacagcacctgccccgaggtgatcaaggtgtacatcttcaaggccgaccccggcgaggacgacctgggcggcaccgtggacatcgtggagagcgagcccgagaacgaccacggcgtggagctgctggaccagaacagcagcatcagagtgcccagagagaagatggtgtacatgaccgtgaacgacagccagcaggaggacgaggacctgaacgtggccgagatcgccgacgaggtgtacatggaggtgatcgtgggcgaggaggacgccgccgtggccgccgccgccgccgccgtgcacgagcagcagatcgacgaggacgagatgaagaccttcgtgcccatcgcctgggccgccgcctacggcaacaacagcgacggcatcgagaacagaaacggcaccgccagcgccctgctgcacatcgacgagagcgccggcctgggcagactggccaagcagaagcccaagaagaagagaagacccgacagcagacagtaccagaccgccatcatcatcggccccgacggccaccccctgaccgtgtacccctgcatgatctgcggcaagaagttcaagagcagaggcttcctgaagagacacatgaagaaccaccccgagcacctggccaagaagaagtaccactgcaccgactgcgactacaccaccaacaagaagatcagcctgcacaaccacctggagagccacaagctgaccagcaaggccgagaaggccatcgagtgcgacgagtgcggcaagcacttcagccacgccggcgccctgttcacccacaagatggtgcacaaggagaagggcgccaacaagatgcacaagtgcaagttctgcgagtacgagaccgccgagcagggcctgctgaacagacacctgctggccgtgcacagcaagaacttcccccacatctgcgtggagtgcggcaagggcttcagacaccccagcgagctgagaaagcacatgagaatccacaccggcgagaagccctaccagtgccagtactgcgagtacagaagcgccgacagcagcaacctgaagacccacatcaagaccaagcacagcaaggagatgcccttcaagtgcgacatctgcctgctgaccttcagcgacaccaaggaggtgcagcagcacaccctggtgcaccaggagagcaagacccaccagtgcctgcactgcgaccacaagagcagcaacagcagcgacctgaagagacacgtgatcagcgtgcacaccaaggactacccccacaagtgcgagatgtgcgagaagggcttccacagacccagcgagctgaagaagcacgtggccgtgcacaagggcaagaagatgcaccagtgcagacactgcgacttcaagatcgccgaccccttcgtgctgagcagacacatcctgagcgtgcacaccaaggacctgcccttcagatgcaagagatgcagaaagggcttcagacagcagaacgagctgaagaagcacatgaagacccacagcggcagaaaggtgtaccagtgcgagtactgcgagtacagcaccaccgacgccagcggcttcaagagacacgtgatcagcatccacaccaaggactacccccacagatgcgagtactgcaagaagggcttcagaagacccagcgagaagaaccagcacatcatgagacaccacaaggaggtgggcctgccctag

SEQ ID NO: 106270 - DNA, 2406 bp, Artificial Sequence; identical to SEQ ID NO: 106269
  Description of Artificial Sequence: Synthetic coding sequence

SEQ ID NO: 106271 - DNA, 1833 bp, Artificial Sequence
  Description of Artificial Sequence: Synthetic coding sequence
atggacgaggacgagttcgagctgcagccccaggagcccaacagcttcttcgacggcatcgtggacgacgccggcaagatcgagcacgacggcagcaccggcgtgaccatcgacgccgagagcgagatggacccctgcaaggtggacagcacctgccccgaggtgatcaaggtgtacatcttcaaggccgaccccggcgaggacgacctgggcggcaccgtggacatcgtggagagcgagcccgagaacgaccacggcgtggagctgctggaccagaacagcagcatcagagtgcccagagagaagatggtgtacatgaccgtgaacgacagccagcaggaggacgaggacctgaacgtggccgagatcgccgacgaggtgtacatggaggtgatcgtgggcgaggaggacgccgccgtggccgccgccgccgccgccgtgcacgagcagcagatcgacgaggacgagatgaagaccttcgtgcccatcgcctgggccgccgcctacggcaacaacagcgacggcatcgagaacagaaacggcaccgccagcgccctgctgcacatcgacgagagcgccggcctgggcagactggccaagcagaagcccaagaagaagagaagacccgacagcagacagtaccagaccgccatcatcatcggccccgacggccaccccctgaccgtgtacccctgcatgatctgcggcaagaagttcaagagcagaggcttcctgaagagacacatgaagaaccaccccgagcacctggccaagaagaagtaccactgcaccgactgcgactacaccaccaacaagaagatcagcctgcacaaccacctggagagccacaagctgaccagcaaggccgagaaggccatcgagtgcgacgagtgcggcaagcacttcagccacgccggcgccctgttcacccacaagatggtgcacaaggagaagggcgccaacaagatgcacaagtgcaagttctgcgagtacgagaccgccgagcagggcctgctgaacagacacctgctggccgtgcacagcaagaacttcccccacatctgcgtggagtgcggcaagggcttcagacaccccagcgagctgagaaagcacatgagaatccacaccggcgagaagccctaccagtgccagtactgcgagtacagaagcgccgacagcagcaacctgaagacccacatcaagaccaagcacagcaaggagatgcccttcaagtgcgacatctgcctgctgaccttcagcgacaccaaggaggtgcagcagcacaccctggtgcaccaggagagcaagacccaccagtgcctgcactgcgaccacaagagcagcaacagcagcgacctgaagagacacgtgatcagcgtgcacaccaaggactacccccacaagtgcgagatgtgcgagaagggcttccacagacccagcgagctgaagaagcacgtggccgtgcacaagggcaagaagatgcaccagtgcagacactgcgacttcaagatcgccgaccccttcgtgctgagcagacacatcctgagcgtgcacaccaaggacctgcccttcagatgcaagagatgcagaaagggcttcagacagcagaacgagctgaagaagcacatgaagacccacagcggcagaaaggtgtaccagtgcgagtactgcgagtacagcaccaccgacgccagcggcttcaagagacacgtgatcagcatccacaccaaggactacccccacagatgcgagtactgcaagaagggcttcagaagacccagcgagaagaaccagcacatcatgagacaccacaaggaggtgggcctgccctag

SEQ ID NO: 106272 - DNA, 276 bp, Artificial Sequence
  Description of Artificial Sequence: Synthetic coding sequence
atggacgaggacgagttcgagctgcagccccaggagcccaacagcttcttcgacggcatcggcgccgacgccacccacatggacggcgaccagatcgtggtggagatccaggaggccgtgttcgtgagcaacatcgtggacagcgacatcaccgtgcacaacttcgtgcccgacgaccccgacagcgtggtgatccaggacgtggtggaggacgtggtgatcgaggaggacgtgcagtgcagcgacatcctggaggaggccgacgtgagcgagtag

SEQ ID NO: 106273 - DNA, 2175 bp, Artificial Sequence
  Description of Artificial Sequence: Synthetic coding sequence
atggacggcgaccagatcgtggtggagatccaggaggccgtgttcgtgagcaacatcgtggacagcgacatcaccgtgcacaacttcgtgcccgacgaccccgacagcgtggtgatccaggacgtggtggaggacgtggtgatcgaggaggacgtgcagtgcagcgacatcctggaggaggccgacgtgagcgagaacgtgatcatccccgagcaggtgctggacagcgacgtgaccgaggaggtgagcctgccccactgcaccgtgcccgacgacgtgctggccagcgacatcaccagcaccagcatgagcatgcccgagcacgtgctgaccagcgagagcatgcacgtgtgcgacatcggccacgtggagcacatggtgcacgacagcgtggtggaggccgagatcatcaccgaccccctgaccagcgacatcgtgagcgaggaggtgctggtggccgactgcgcccccgaggccgtgatcgacgccagcggcatcagcgtggaccagcaggacaacgacaaggccagctgcgaggactacctgatgatcagcctggacgacgccggcaagatcgagcacgacggcagcaccggcgtgaccatcgacgccgagagcgagatggacccctgcaaggtggacagcacctgccccgaggtgatcaaggtgtacatcttcaaggccgaccccggcgaggacgacctgggcggcaccgtggacatcgtggagagcgagcccgagaacgaccacggcgtggagctgctggaccagaacagcagcatcagagtgcccagagagaagatggtgtacatgaccgtgaacgacagccagcaggaggacgaggacctgagcaacaacagcgacggcatcgagaacagaaacggcaccgccagcgccctgctgcacatcgacgagagcgccggcctgggcagactggccaagcagaagcccaagaagaagagaagacccgacagcagacagtaccagaccgccatcatcatcggccccgacggccaccccctgaccgtgtacccctgcatgatctgcggcaagaagttcaagagcagaggcttcctgaagagacacatgaagaaccaccccgagcacctggccaagaagaagtaccactgcaccgactgcgactacaccaccaacaagaagatcagcctgcacaaccacctggagagccacaagctgaccagcaaggccgagaaggccatcgagtgcgacgagtgcggcaagcacttcagccacgccggcgccctgttcacccacaagatggtgcacaaggagaagggcgccaacaagatgcacaagtgcaagttctgcgagtacgagaccgccgagcagggcctgctgaacagacacctgctggccgtgcacagcaagaacttcccccacatctgcgtggagtgcggcaagggcttcagacaccccagcgagctgagaaagcacatgagaatccacaccggcgagaagccctaccagtgccagtactgcgagtacagaagcgccgacagcagcaacctgaagacccacatcaagaccaagcacagcaaggagatgcccttcaagtgcgacatctgcctgctgaccttcagcgacaccaaggaggtgcagcagcacaccctggtgcaccaggagagcaagacccaccagtgcctgcactgcgaccacaagagcagcaacagcagcgacctgaagagacacgtgatcagcgtgcacaccaaggactacccccacaagtgcgagatgtgcgagaagggcttccacagacccagcgagctgaagaagcacgtggccgtgcacaagggcaagaagatgcaccagtgcagacactgcgacttcaagatcgccgaccccttcgtgctgagcagacacatcctgagcgtgcacaccaaggacctgcccttcagatgcaagagatgcagaaagggcttcagacagcagaacgagctgaagaagcacatgaagacccacagcggcagaaaggtgtaccagtgcgagtactgcgagtacagcaccaccgacgccagcggcttcaagagacacgtgatcagcatccacaccaaggactacccccacagatgcgagtactgcaagaagggcttcagaagacccagcgagaagaaccagcacatcatgagacaccacaaggaggtgggcctgccctag

SEQ ID NO: 106274 - DNA, 1617 bp, Artificial Sequence
  Description of Artificial Sequence: Synthetic coding sequence
atggccagagagctgagcgagagcaccgccctggacgcccagagcaccgaggaccagatggagctgctggtgatcaaggtggaggaggaggaggccggcttccccagcagccccgacctgggcagcgagggcagcagagagagattcagaggcttcagataccccgaggccgccggccccagagaggccctgagcagactgagagagctgtgcagacagtggctgcagcccgagatgcacagcaaggagcagatcctggagctgctggtgctggagcagttcctgaccatcctgcccggcaacctgcagagctgggtgagagagcagcaccccgagagcggcgaggaggtggtggtgctgctggagtacctggagagacagctggacgagcccgccccccaggtgagcggcgtggaccagggccaggagctgctgtgctgcaagatggccctgctgacccccgcccccggcagccagagcagccagttccagctgatgaaggccctgctgaagcacgagagcgtgggcagccagcccctgcaggacagagtgctgcaggtgcccgtgctggcccacggcggctgctgcagagaggacaaggtggtggccagcagactgacccccgagagccagggcctgctgaaggtggaggacgtggccctgaccctgacccccgagtggacccagcaggacagcagccagggcaacctgtgcagagacgagaagcaggagaaccacggcagcctggtgagcctgggcgacgagaagcagaccaagagcagagacctgccccccgccgaggagctgcccgagaaggagcacggcaagatcagctgccacctgagagaggacatcgcccagatccccacctgcgccgaggccggcgagcaggagggcagactgcagagaaagcagaagaacgccaccggcggcagaagacacatctgccacgagtgcggcaagagcttcgcccagagcagcggcctgagcaagcacagaagaatccacaccggcgagaagccctacgagtgcgaggagtgcggcaaggccttcatcggcagcagcgccctggtgatccaccagagagtgcacaccggcgagaagccctacgagtgcgaggagtgcggcaaggccttcagccacagcagcgacctgatcaagcaccagagaacccacaccggcgagaagccctacgagtgcgacgactgcggcaagaccttcagccagagctgcagcctgctggagcaccacagaatccacaccggcgagaagccctaccagtgcagcatgtgcggcaaggccttcagaagaagcagccacctgctgagacaccagagaatccacaccggcgacaagaacgtgcaggagcccgagcagggcgaggcctggaagagcagaatggagagccagctggagaacgtggagacccccatgagctacaagtgcaacgagtgcgagagaagcttcacccagaacaccggcctgatcgagcaccagaagatccacaccggcgagaagccctaccagtgcaacgcctgcggcaagggcttcaccagaatcagctacctggtgcagcaccagagaagccacgtgggcaagaacatcctgagccagtag

SEQ ID NO: 106275 - DNA, 1173 bp, Artificial Sequence
  Description of Artificial Sequence: Synthetic coding sequence
atggccctgctgacccccgcccccggcagccagagcagccagttccagctgatgaaggccctgctgaagcacgagagcgtgggcagccagcccctgcaggacagagtgctgcaggtgcccgtgctggcccacggcggctgctgcagagaggacaaggtggtggccagcagactgacccccgagagccagggcctgctgaaggtggaggacgtggccctgaccctgacccccgagtggacccagcaggacagcagccagggcaacctgtgcagagacgagaagcaggagaaccacggcagcctggtgagcctgggcgacgagaagcagaccaagagcagagacctgccccccgccgaggagctgcccgagaaggagcacggcaagatcagctgccacctgagagaggacatcgcccagatccccacctgcgccgaggccggcgagcaggagggcagactgcagagaaagcagaagaacgccaccggcggcagaagacacatctgccacgagtgcggcaagagcttcgcccagagcagcggcctgagcaagcacagaagaatccacaccggcgagaagccctacgagtgcgaggagtgcggcaaggccttcatcggcagcagcgccctggtgatccaccagagagtgcacaccggcgagaagccctacgagtgcgaggagtgcggcaaggccttcagccacagcagcgacctgatcaagcaccagagaacccacaccggcgagaagccctacgagtgcgacgactgcggcaagaccttcagccagagctgcagcctgctggagcaccacagaatccacaccggcgagaagccctaccagtgcagcatgtgcggcaaggccttcagaagaagcagccacctgctgagacaccagagaatccacaccggcgacaagaacgtgcaggagcccgagcagggcgaggcctggaagagcagaatggagagccagctggagaacgtggagacccccatgagctacaagtgcaacgagtgcgagagaagcttcacccagaacaccggcctgatcgagcaccagaagatccacaccggcgagaagccctaccagtgcaacgcctgcggcaagggcttcaccagaatcagctacctggtgcagcaccagagaagccacgtgggcaagaacatcctgagccagtag

SEQ ID NO: 106276 - DNA, 1617 bp, Artificial Sequence; identical to SEQ ID NO: 106274
  Description of Artificial Sequence: Synthetic coding sequence

SEQ ID NO: 106277 - DNA, 537 bp, Artificial Sequence
  Description of Artificial Sequence: Synthetic coding sequence
atggccagagagctgagcgagagcaccgccctggacgcccagagcaccgaggaccagatggagctgctggtgatcaaggtggaggaggaggaggccggcttccccagcagccccgacctgggcagcgagggcagcagagagagattcagaggcttcagataccccgaggccgccggccccagagaggccctgagcagactgagagagctgtgcagacagtggctgcagcccgagatgcacagcaaggagcagatcctggagctgctggtgctggagcagttcctgaccatcctgcccggcaacctgcagagctgggtgagagagcagcaccccgagagcggcgaggaggtggtggtgctgctggagtacctggagagacagctggacgagcccgccccccaggtggagagaaccggcctggtgagcgagagatgcggcctgttcccccccgagatccccgaccagagcgagggccacagcttcaacatccaggagttcttcatcagcttcctgtacagagagcccccctggcagtag

SEQ ID NO: 106278 - DNA, 993 bp, Artificial Sequence
  Description of Artificial Sequence: Synthetic coding sequence
agacagagattcagaggcttcagataccccgaggccgccggccccagagaggccctgagcagactgagagagctgtgcggccagtggctgcagcccgagatgcacagcaaggagcagatcctggagctgctggtgctggagcagttcctgaccatcctgcccggcaacctgcagagctgggtgagagagcagcaccccgagagcggcgaggaggtggtggtgctgctggagtacctggagagacagctggacgagcccgccccccaggtggagagaaccggcctggtgagcgagagatgcgccagaggcatccccctgagaagcagaagcagcagcagcctgttcgtgctggccttcctgccctggcagggcatcacccacagctgcagacccttcgtggtgagcggcggcgagatccagaccaagagcagagacctgccccccgtgaagaagctgcccgagaaggagcacggcaagatctgccacctgagagaggacatcgcccagatccccacccacgccgaggccggcgagcaggagggcagactgcagagaaagcagaagaacgccatcggcagcagaagacactactgccacgagtgcggcaagagcttcgcccagagcagcggcctgaccaagcacagaagaatccacaccggcgagaagccctacgagtgcgaggactgcggcaagaccttcatcggcagcagcgccctggtgatccaccagagagtgcacaccggcgagaagccctacgagtgcgaggagtgcggcaaggtgttcagccacagcagcaacctgatcaagcaccagagaacccacaccggcgagaagccctacgagtgcgacgactgcggcaagaccttcagccagagctgcagcctgctggagcaccacaagatccacaccggcgagaagccctaccagtgcaacatgtgcggcaaggccttcagaagaaacagccacctgctgagacaccagagaatccactag

SEQ ID NO: 106279 - DNA, 1638 bp, Artificial Sequence
  Description of Artificial Sequence: Synthetic coding sequence
atggccagagagcccagaaagaacgccgccctggacgcccagagcgccgaggaccagaccggcctgctgaccgtgaaggtggagaaggaggaggccagcgccctgaccgccgaggtgagagccccctgcagccccgccagaggccccgagagaagcagacagagattcagaggcttcagataccccgaggccgccggccccagagaggccctgagcagactgagagagctgtgcggccagtggctgcagcccgagatgcacagcaaggagcagatcctggagctgctggtgctggagcagttcctgaccatcctgcccggcaacctgcagagctgggtgagagagcagcaccccgagagcggcgaggaggtggtggtgctgctggagtacctggagagacagctggacgagcccgccccccaggtgcccgtgggcgaccagggccaggagctgctgtgctgcaagatggccctgctgacccagacccagggcagccagagcagccagtgccagcccatgaaggccctgttcaagcacgagagcctgggcagccagcccctgcacgacagagtgctgcaggtgcccggcctggcccagggcggctgctgcagagaggacgccatggtggccagcagactgacccccggcagccagggcctgctgaagatggaggacgtggccctgaccctgacccccggctggacccagctggacagcagccaggtgaacctgtacagagacgagaagcaggagaaccacagcagcctggtgagcctgggcggcgagatccagaccaagagcagagacctgccccccgtgaagaagctgcccgagaaggagcacggcaagatctgccacctgagagaggacatcgcccagatccccacccacgccgaggccggcgagcaggagggcagactgcagagaaagcagaagaacgccatcggcagcagaagacactactgccacgagtgcggcaagagcttcgcccagagcagcggcctgaccaagcacagaagaatccacaccggcgagaagccctacgagtgcgaggactgcggcaagaccttcatcggcagcagcgccctggtgatccaccagagagtgcacaccggcgagaagccctacgagtgcgaggagtgcggcaaggtgttcagccacagcagcaacctgatcaagcaccagagaacccacaccggcgagaagccctacgagtgcgacgactgcggcaagaccttcagccagagctgcagcctgctggagcaccacaagatccacaccggcgagaagccctaccagtgcaacatgtgcggcaaggccttcagaagaaacagccacctgctgagacaccagagaatccacggcgacaagaacgtgcagaaccccgagcacggcgagagctgggagagccagggcagaaccgagagccagtgggagaacaccgaggcccccgtgagctacaagtgcaacgagtgcgagagaagcttcaccagaaacagaagcctgatcgagcaccagaagatccacaccggcgagaagccctaccagtgcgacacctgcggcaagggcttcaccagaaccagctacctggtgcagcaccagagaagccacgtgggcaagaagaccctgagccagtag

SEQ ID NO: 106280 - DNA, 1173 bp, Artificial Sequence
  Description of Artificial Sequence: Synthetic coding sequence
atggccctgctgacccagacccagggcagccagagcagccagtgccagcccatgaaggccctgttcaagcacgagagcctgggcagccagcccctgcacgacagagtgctgcaggtgcccggcctggcccagggcggctgctgcagagaggacgccatggtggccagcagactgacccccggcagccagggcctgctgaagatggaggacgtggccctgaccctgacccccggctggacccagctggacagcagccaggtgaacctgtacagagacgagaagcaggagaaccacagcagcctggtgagcctgggcggcgagatccagaccaagagcagagacctgccccccgtgaagaagctgcccgagaaggagcacggcaagatctgccacctgagagaggacatcgcccagatccccacccacgccgaggccggcgagcaggagggcagactgcagagaaagcagaagaacgccatcggcagcagaagacactactgccacgagtgcggcaagagcttcgcccagagcagcggcctgaccaagcacagaagaatccacaccggcgagaagccctacgagtgcgaggactgcggcaagaccttcatcggcagcagcgccctggtgatccaccagagagtgcacaccggcgagaagccctacgagtgcgaggagtgcggcaaggtgttcagccacagcagcaacctgatcaagcaccagagaacccacaccggcgagaagccctacgagtgcgacgactgcggcaagaccttcagccagagctgcagcctgctggagcaccacaagatccacaccggcgagaagccctaccagtgcaacatgtgcggcaaggccttcagaagaaacagccacctgctgagacaccagagaatccacggcgacaagaacgtgcagaaccccgagcacggcgagagctgggagagccagggcagaaccgagagccagtgggagaacaccgaggcccccgtgagctacaagtgcaacgagtgcgagagaagcttcaccagaaacagaagcctgatcgagcaccagaagatccacaccggcgagaagccctaccagtgcgacacctgcggcaagggcttcaccagaaccagctacctggtgcagcaccagagaagccacgtgggcaagaagaccctgagccagtag

SEQ ID NO: 106281 - DNA, 501 bp, Artificial Sequence
  Description of Artificial Sequence: Synthetic coding sequence
cccacccacgccgaggccggcgagcaggagggcagactgcagagaaagcagaagaacgccatcggcagcagaagacactactgccacgagtgcggcaagagcttcgcccagagcagcggcctgaccaagcacagaagaatccacaccggcgagaagccctacgagtgcgaggactgcggcaagaccttcatcggcagcagcgccctggtgatccaccagagagtgcacaccggcgagaagccctacgagtgcgaggagtgcggcaaggtgttcagccacagcagcaacctgatcaagcaccagagaacccacaccggcgagaagccctacgagtgcgacgactgcggcaagaccttcagccagagctgcagcctgctggagcaccacaagatccacaccggcgagaagccctaccagtgcaacatgtgcggcaaggccttcagaagaaacagccacctgctgagacaccagagaatccacgtggtgaccgagatcgtgtag

SEQ ID NO: 106282 - DNA, 438 bp, Artificial Sequence
  Description of Artificial Sequence: Synthetic coding sequence
atggagttccccgacctgggcaagcactgcagcgagaagacctgcaagcagctggacttcctgcccgtgaagtgcgacgcctgcaagcaggacttctgcaaggaccacttcccctacgccgcccacaagtgccccttcgccttccagaaggacgtgcacgtgcccgtgtgccccctgtgcaacacccccatccccgtgaagaagggccagatccccgacgtggtggtgggcgaccacatcgacagagactgcgacagccaccccggcaagaagaaggagaagatcttcacctacagatgcagcaaggagggctgcaagaagaaggagatgctgcagatggtgtgcgcccagtgccacggcaacttctgcatccagcacagacaccccctggaccacagctgcagacacggcagcagacccaccatcaaggccggctag

SEQ ID NO: 106283 - DNA, 543 bp, Artificial Sequence
  Description of Artificial Sequence: Synthetic coding sequence
atggagttccccgacctgggcaagcactgcagcgagaagacctgcaagcagctggacttcctgcccgtgaagtgcgacgcctgcaagcaggacttctgcaaggaccacttcccctacgccgcccacaagtgccccttcgccttccagaaggacgtgcacgtgcccgtgtgccccctgtgcaacacccccatccccgtgaagaagggccagatccccgacgtggtggtgggcgaccacatcgacagagactgcgacagccaccccggcaagaagaaggagaagatcttcacctacagatgcagcaaggagggctgcaagaagaaggagatgctgcagatggtgtgcgcccagtgccacggcaacttctgcatccagcacagacaccccctggaccacagctgcagacacggcagcagacccaccatcaaggccggctgcagccccatgaccgtgagcgagagcagacccctgggcgacttcctgaccctggcccccggcggcctggcccagagactgggctactggttcaccagactgatgtag

SEQ ID NO: 106284 - DNA, 774 bp, Artificial Sequence
  Description of Artificial Sequence: Synthetic coding sequence
atggagttccccgacctgggcgcccactgcagcgagcccagctgccagagactggacttcctgcccctgaagtgcgacgcctgcagcggcatcttctgcgccgaccacgtggcctacgcccagcaccactgcggcagcgcctaccagaaggacatccaggtgcccgtgtgccccctgtgcaacgtgcccgtgcccgtggccagaggcgagccccccgacagagccgtgggcgagcacatcgacagagactgcagaagcgaccccgcccagcagaagagaaagatcttcaccaacaagtgcgagagagccggctgcagacagagagagatgatgaagctgacctgcgagagatgcagcagaaacttctgcatcaagcacagacaccccctggaccacgactgcagcggcgagggccaccccaccagcagagccggcctggccgccatcagcagagcccaggccgtggccagcaccagcaccgtgcccagccccagccagaccatgcccagctgcaccagccccagcagagccaccaccagaagccccagctggaccgccccccccgtgatcgccctgcagaacggcctgagcgaggacgaggccctgcagagagccctggagatgagcctggccgagaccaagccccaggtgcccagctgccaggaggaggaggacctggccctggcccaggccctgagcgccagcgaggccgagtaccagagacagcaggcccagagcagaagcagcaagcccagcaactgcagcctgtgctag

SEQ ID NO: 106285 - DNA, 531 bp, Artificial Sequence
  Description of Artificial Sequence: Synthetic coding sequence
atggagttccccgacctgggcgcccactgcagcgagcccagctgccagagactggacttcctgcccctgaagtgcgacgcctgcagcggcatcttctgcgccgaccacgtggcctacgcccagcaccactgcggcagcgcctaccagaaggacatccaggtgcccgtgtgccccctgtgcaacgtgcccgtgcccgtggccagaggcgagccccccgacagagccgtgggcgagcacatcgacagagactgcagaagcgaccccgcccagcagaagagaaagatcttcaccaacaagtgcgagagagccggctgcagacagagagagatgatgaagctgacctgcgagagatgcagcagaaacttctgcatcaagcacagacaccccctggaccacgactgcagcggcgagggccaccccaccagcagagccggcctggccgccatcagcagagcccaggccgtggccagcaccagcaccgtgcccagccccagccagaccatgcccagctgcaccagccccagcagatag

SEQ ID NO: 106286 - DNA, 774 bp, Artificial Sequence; identical to SEQ ID NO: 106284
  Description of Artificial Sequence: Synthetic coding sequence

SEQ ID NO: 106287 - DNA, 531 bp, Artificial Sequence; identical to SEQ ID NO: 106285
  Description of Artificial Sequence: Synthetic coding sequence

SEQ ID NO: 106288 - DNA, 153 bp, Artificial Sequence
  Description of Artificial Sequence: Synthetic coding sequence
atggagttccccgacctgggcgcccactgcagcgagcccagctgccagagactggacttcctgcccctgaagtgcgacgcctgcagcggcatcttctgcgccgaccacgtggcctacgcccagcaccactgcggcagcgcctaccagaagtag

SEQ ID NO: 106289 - DNA, 678 bp, Artificial Sequence
  Description of Artificial Sequence: Synthetic coding sequence
atggagttccccgacctgggcgcccactgcagcgagcccagctgccagagactggacttcctgcccctgaagtgcgacgcctgcagcggcatcttctgcgccgaccacgtggcctacgcccagcaccactgcggcagcgcctaccagaaggacatccaggtgcccgtgtgccccctgtgcaacgtgcccgtgcccgtggccagaggcgagccccccgacagagccgtgggcgagcacatcgacagagactgcagaagcgaccccgcccagcagaagagaaagatcttcaccaacaagtgcgagagagccggctgcagacagagagagatgatgaagctgacctgcgagagatgcagcagaaacttctgcatcaagcacagacaccccctggaccacgactgcagcggcgagggccaccccaccagcagagccggcctggccgccatcagcagagcccaggccgtggccagcaccagcaccgtgcccagccccagccagaccatgcccagctgcaccagccccagcagagccaccaccagaagccccagctggaccgccccccccgtgatcgccctgcagaacggcctggtgagctgggccgaggtgggctggaccgagaccaacacccagagagtgaagagcaaggacgccggcctgctgagccccttcgtggagtag

SEQ ID NO: 106290 - DNA, 684 bp, Artificial Sequence
  Description of Artificial Sequence: Synthetic coding sequence
atgggcgacgccggcagcgagagaagcaaggcccccagcctgccccccagatgcccctgcggcttctggggcagcagcaagaccatgaacctgtgcagcaagtgcttcgccgacttccagaagaagcagcccgacgacgacagcgcccccagcaccagcaacagccagagcgacctgttcagcgaggagaccaccagcgacaacaacaacaccagcatcaccacccccaccctgagccccagccagcagcccctgcccaccgagctgaacgtgaccagccccagcaaggaggagtgcggcccctgcaccgacaccgcccacgtgagcctgatcacccccaccaagagaagctgcggcaccgacagccagagcgagaacgaggccagccccgtgaagagacccagactgctggagaacaccgagagaagcgaggagaccagcagaagcaagcagaagagcagaagaagatgcttccagtgccagaccaagctggagctggtgcagcaggagctgggcagctgcagatgcggctacgtgttctgcatgctgcacagactgcccgagcagcacgactgcaccttcgaccacatgggcagaggcagagaggaggccatcatgaagatggtgaagctggacagaaaggtgggcagaagctgccagagaatcggcgagggctgcagctag

SEQ ID NO: 106291 - DNA, 642 bp, Artificial Sequence
  Description of Artificial Sequence: Synthetic coding sequence
atggcccaggagaccaaccagacccccggccccatgctgtgcagcaccggctgcggcttctacggcaaccccagaaccaacggcatgtgcagcgtgtgctacaaggagcacctgcagagacagcagaacagcggcagaatgagccccatgggcaccgccagcggcagcaacagccccaccagcgacagcgccagcgtgcagagagccgacaccagcctgaacaactgcgagggcgccgccggcagcaccagcgagaagagcagaaacgtgcccgtggccgccctgcccgtgacccagcagatgaccgagatgagcatcagcagagaggacaagatcaccacccccaagaccgaggtgagcgagcccgtggtgacccagcccagccccagcgtgagccagcccagcaccagccagagcgaggagaaggcccccgagctgcccaagcccaagaagaacagatgcttcatgtgcagaaagaaggtgggcctgaccggcttcgactgcagatgcggcaacctgttctgcggcctgcacagatacagcgacaagcacaactgcccctacgactacaaggccgaggccgccgccaagatcagaaaggagaaccccgtggtggtggccgagaagatccagagaatctag

SEQ ID NO: 106292 - DNA, 642 bp, Artificial Sequence; identical to SEQ ID NO: 106291
  Description of Artificial Sequence: Synthetic coding sequence

SEQ ID NO: 106293 - DNA, 636 bp, Artificial Sequence
  Description of Artificial Sequence: Synthetic coding sequence
atggccaagcccgagcaggccgccgacggcggcgtgagaggcagaggcgccagaccccccgcccaggaggcccagagaagaagaagacaccccgtggtggtggccagagacctggcccccggcgtgcccggcagcctgcacagcacccagaagaacatggcccaggagaccaaccagacccccggccccatgctgtgcagcaccggctgcggcttctacggcaaccccagaaccaacggcatgtgcagcgtgtgctacaaggagcacctgcagagacagcagaacagcggcagaatgagccccatgggcaccgccagcggcagcaacagccccaccagcgacagcgccagcgtgcagagagccgacaccagcctgaacaactgcgagggcgccgccggcagcaccagcgagaagagcagaaacgtgcccgtggccgccctgcccgtgacccagcagatgaccgagatgagcatcagcagagaggacaagatcaccacccccaagaccgaggtgagcgagcccgtggtgacccagcccagccccagcgtgagccagcccagcaccagccagagcgaggagaaggcccccgagctgcccaagcccaagaagaacagatgcttcatgtgcagaaagtag

SEQ ID NO: 106294 - DNA, 642 bp, Artificial Sequence; identical to SEQ ID NO: 106291
  Description of Artificial Sequence: Synthetic coding sequence

SEQ ID NO: 106295 - DNA, 642 bp, Artificial Sequence; identical to SEQ ID NO: 106291
  Description of Artificial Sequence: Synthetic coding sequence

SEQ ID NO: 106296 - DNA, 627 bp, Artificial Sequence
  Description of Artificial Sequence: Synthetic coding sequence
atggcccaggagaccaaccacagccaggtgcccatgctgtgcagcaccggctgcggcttctacggcaaccccagaaccaacggcatgtgcagcgtgtgctacaaggagcacctgcagagacagaacagcagcaacggcagaatcagcccccccgccaccagcgtgagcagcctgagcgagagcctgcccgtgcagtgcaccgacggcagcgtgcccgaggcccagagcgccctggacagcaccagcagcagcatgcagcccagccccgtgagcaaccagagcctgctgagcgagagcgtggccagcagccagctggacagcaccagcgtggacaaggccgtgcccgagaccgaggacgtgcaggccagcgtgagcgacaccgcccagcagcccagcgaggagcagagcaagagcctggagaagcccaagcagaagaagaacagatgcttcatgtgcagaaagaaggtgggcctgaccggcttcgagtgcagatgcggcaacgtgtactgcggcgtgcacagatacagcgacgtgcacaactgcagctacaactacaaggccgacgccgccgagaagatcagaaaggagaaccccgtggtggtgggcgagaagatccagaagatctag

SEQ ID NO: 106297 - DNA, 627 bp, Artificial Sequence; identical to SEQ ID NO: 106296
  Description of Artificial Sequence: Synthetic coding sequence

SEQ ID NO: 106298 - DNA, 591 bp, Artificial Sequence
  Description of Artificial Sequence: Synthetic coding sequence
atggcccaggagaccaaccacagccaggtgcccatgctgtgcagcaccggctgcggcttctacggcaaccccagaaccaacggcatgtgcagcgtgtgctacaaggagcacctgcagagacagaacagcagcaacggcagaatcagcccccccgtgcagtgcaccgacggcagcgtgcccgaggcccagagcgccctggacagcaccagcagcagcatgcagcccagccccgtgagcaaccagagcctgctgagcgagagcgtggccagcagccagctggacagcaccagcgtggacaaggccgtgcccgagaccgaggacgtgcaggccagcgtgagcgacaccgcccagcagcccagcgaggagcagagcaagagcctggagaagcccaagcagaagaagaacagatgcttcatgtgcagaaagaaggtgggcctgaccggcttcgagtgcagatgcggcaacgtgtactgcggcgtgcacagatacagcgacgtgcacaactgcagctacaactacaaggccgacgccgccgagaagatcagaaaggagaaccccgtggtggtgggcgagaagatccagaagatctag

SEQ ID NO: 106299 - DNA, 627 bp, Artificial Sequence; identical to SEQ ID NO: 106296
  Description of Artificial Sequence: Synthetic coding sequence

SEQ ID NO: 106300 - DNA, 627 bp, Artificial Sequence; identical to SEQ ID NO: 106296
  Description of Artificial Sequence: Synthetic coding sequence

SEQ ID NO: 106301 - DNA, 627 bp, Artificial Sequence; identical to SEQ ID NO: 106296
  Description of Artificial Sequence: Synthetic coding sequence

SEQ ID NO: 106302 - DNA, 2085 bp, Artificial Sequence
  Description of Artificial Sequence: Synthetic coding sequence
atggagaacaagagcctggagagcagccagaccgacctgaagctggtggcccaccccagagccaagagcaaggtgtggaagtacttcggcttcgacaccaacgccgagggctgcatcctgcagtggaagaagatctactgcagaatctgcatggcccagatcgcctacagcggcaacaccagcaacctgagctaccacctggagaagaaccaccccgaggagttctgcgagttcgtgaagagcaacaccgagcagatgagagaggccttcgccaccgccttcagcaagctgaagcccgagagcagccagcagcccggccaggacgccctggccgtgaaggccggccacggctacgacagcaagaagcagcaggagctgaccgccgccgtgctgggcctgatctgcgagggcctgtaccccgccagcatcgtggacgagcccaccttcaaggtgctgctgaagaccgccgaccccagatacgagctgcccagcagaaagtacatcagcaccaaggccatccccgagaagtacggcgccgtgagagaggtgatcctgaaggagctggccgaggccacctggtgcggcatcagcaccgacatgtggagaagcgagaaccagaacagagcctacgtgaccctggccgcccacttcctgggcctgggcgcccccaactgcctgagcatgggcagcagatgcctgaagaccttcgaggtgcccgaggagaacaccgccgagaccatcaccagagtgctgtacgaggtgttcatcgagtggggcatcagcgccaaggtgttcggcgccaccaccaactacggcaaggacatcgtgaaggcctgcagcctgctggacgtggccgtgcacatgccctgcctgggccacaccttcaacgccggcatccagcaggccttccagctgcccaagctgggcgccctgctgagcagatgcagaaagctggtggagtacttccagcagagcgccgtggccatgtacatgctgtacgagaagcagaagcagcagaacgtggcccactgcatgctggtgagcaacagagtgagctggtggggcagcaccctggccatgctgcagagactgaaggagcagcagttcgtgatcgccggcgtgctggtggaggacagcaacaaccaccacctgatgctggaggccagcgagtgggccaccatcgagggcctggtggagctgctgcagcccttcaagcaggtggccgagatgctgagcgccagcagataccccaccatcagcatggtgaagcccctgctgcacatgctgctgaacaccaccctgaacatcaaggagaccgacagcaaggagctgagcatggccaaggaggtgatcgccaaggagctgagcaagacctaccaggagacccccgagatcgacatgttcctgaacgtggccaccttcctggaccccagatacaagagactgcccttcctgagcgccttcgagagacagcaggtggagaacagagtggtggaggaggccaagggcctgctggacaaggtgaaggacggcggctacagacccgccgaggacaagatcttccccgtgcccgaggagccccccgtgaagaagctgatgagaaccagcacccccccccccgccagcgtgatcaacaacatgctggccgagatcttctgccagaccggcggcgtggaggaccaggaggagtggcacgcccaggtggtggaggagctgagcaacttcaagagccagaaggtgctgggcctgaacgaggaccccctgaagtggtggagcgacagactggccctgttccccctgctgcccaaggtgctgcagaagtactggtgcgtgaccgccaccagagtggcccccgagagactgttcggcagcgccgccaacgtggtgagcgccaagagaaacagactggcccccgcccacgtggacgagcaggtgttcctgtacgagaacgccagaagcggcgccgaggccgagcccgaggaccaggacgagggcgagtggggcctggaccaggagcaggtgttcagcctgggcgacggcgtgagcggcggcttcttcggcatcagagacagcagcttcctgtag

SEQ ID NO: 106303 - DNA, 2085 bp, Artificial Sequence; identical to SEQ ID NO: 106302
  Description of Artificial Sequence: Synthetic coding sequence

SEQ ID NO: 106304 - DNA, 2085 bp, Artificial Sequence; identical to SEQ ID NO: 106302
  Description of Artificial Sequence: Synthetic coding sequence

SEQ ID NO: 106305 - DNA, 819 bp, Artificial Sequence
  Description of Artificial Sequence: Synthetic coding sequence
atggagaacaagagcctggagagcagccagaccgacctgaagctggtggcccaccccagagccaagagcaaggtgtggaagtacttcggcttcgacaccaacgccgagggctgcatcctgcagtggaagaagatctactgcagaatctgcatggcccagatcgcctacagcggcaacaccagcaacctgagctaccacctggagaagaaccaccccgaggagttctgcgagttcgtgaagagcaacaccgagcagatgagagaggccttcgccaccgccttcagcaagctgaagcccgagagcagccagcagcccggccaggacgccctggccgtgaaggccggccacggctacgacagcaagaagcagcaggagctgaccgccgccgtgctgggcctgatctgcgagggcctgtaccccgccagcatcgtggacgagcccaccttcaaggtgctgctgaagaccgccgaccccagatacgagctgcccagcagaaagtacatcagcaccaaggccatccccgagaagtacggcgccgtgagagaggtgatcctgaaggagctggccgaggccacctggtgcggcatcagcaccgacatgtggagaagcgagaaccagaacagagcctacgtgaccctggccgcccacttcctgggcctgggcgcccccaactgcctgagcatgggcagcagatgcctgaagaccttcgaggtgcccgaggagaacaccgccgagaccatcaccagagtgctgtacgaggtgttcatcgagtggggcatcagcgccaaggtgttcggcgccaccaccaactacggctag

SEQ ID NO: 106306 - DNA, 3177 bp, Artificial Sequence
  Description of Artificial Sequence: Synthetic coding sequence
atgagaagaaagggcagatgccacagaggcagcgccgccagacaccccagcagcccctgcagcgtgaagcacagccccaccagagagaccctgacctacgcccaggcccagagaatggtggagatcgagatcgagggcagactgcacagaatcagcatcttcgaccccctggagatcatcctggaggacgacctgaccgcccaggagatgagcgagtgcaacagcaacaaggagaacagcgagagaccccccgtgtgcctgagaaccaagagacacaagaacaacagagtgaagaagaagaacgaggccctgcccagcgcccacggcacccccgccagcgccagcgccctgcccgagcccaaggtgagaatcgtggagtacagcccccccagcgcccccagaagaccccccgtgtactacaagttcatcgagaagagcgccgaggagctggacaacgaggtggagtacgacatggacgaggaggactacgcctggctggagatcgtgaacgagaagagaaagggcgactgcgtgcccgccgtgagccagagcatgttcgagttcctgatggacagattcgagaaggagagccactgcgagaaccagaagcagggcgagcagcagagcctgatcgacgaggacgccgtgtgctgcatctgcatggacggcgagtgccagaacagcaacgtgatcctgttctgcgacatgtgcaacctggccgtgcaccaggagtgctacggcgtgccctacatccccgagggccagtggctgtgcagacactgcctgcagagcagagccagacccgccgactgcgtgctgtgccccaacaagggcggcgccttcaagaagaccgacgacgacagatggggccacgtggtgtgcgccctgtggatccccgaggtgggcttcgccaacaccgtgttcatcgagcccatcgacggcgtgagaaacatcccccccgccagatggaagctgacctgctacctgtgcaagcagaagggcgtgggcgcctgcatccagtgccacaaggccaactgctacaccgccttccacgtgacctgcgcccagaaggccggcctgtacatgaagatggagcccgtgaaggagctgaccggcggcggcaccaccttcagcgtgagaaagaccgcctactgcgacgtgcacaccccccccggctgcaccagaagacccctgaacatctacggcgacgtggagatgaagaacggcgtgtgcagaaaggagagcagcgtgaagaccgtgagaagcaccagcaaggtgagaaagaaggccaagaaggccaagaaggccctggccgagccctgcgccgtgctgcccaccgtgtgcgccccctacatccccccccagagactgaacagaatcgccaaccaggtggccatccagagaaagaagcagttcgtggagagagcccacagctactggctgctgaagagactgagcagaaacggcgcccccctgctgagaagactgcagagcagcctgcagagccagagaagcagccagcagagagagaacgacgaggagatgaaggccgccaaggagaagctgaagtactggcagagactgagacacgacctggagagagccagactgctgatcgagctgctgagaaagagagagaagctgaagagagagcaggtgaaggtggagcaggtggccatggagctgagactgacccccctgaccgtgctgctgagaagcgtgctggaccagctgcaggacaaggaccccgccagaatcttcgcccagcccgtgagcctgaaggaggtgcccgactacctggaccacatcaagcaccccatggacttcgccaccatgagaaagagactggaggcccagggctacaagaacctgcacgagttcgaggaggacttcgacctgatcatcgacaactgcatgaagtacaacgccagagacaccgtgttctacagagccgccgtgagactgagagaccagggcggcgtggtgctgagacaggccagaagagaggtggacagcatcggcctggaggaggccagcggcatgcacctgcccgagagacccgccgccgcccccagaagacccttcagctgggaggacgtggacagactgctggaccccgccaacagagcccacctgggcctggaggagcagctgagagagctgctggacatgctggacctgacctgcgccatgaagagcagcggcagcagaagcaagagagccaagctgctgaagaaggagatcgccctgctgagaaacaagctgagccagcagcacagccagcccctgcccaccggccccggcctggagggcttcgaggaggacggcgccgccctgggccccgaggccggcgaggaggtgctgcccagactggagaccctgctgcagcccagaaagagaagcagaagcacctgcggcgacagcgaggtggaggaggagagccccggcaagagactggacgccggcctgaccaacggcttcggcggcgccagaagcgagcaggagcccggcggcggcctgggcagaaaggccacccccagaagaagatgcgccagcgagagcagcatcagcagcagcaacagccccctgtgcgacagcagcttcaacgcccccaagtgcggcagaggcaagcccgccctggtgagaagacacaccctggaggacagaagcgagctgatcagctgcatcgagaacggcaactacgccaaggccgccagaatcgccgccgaggtgggccagagcagcatgtggatcagcaccgacgccgccgccagcgtgctggagcccctgaaggtggtgtgggccaagtgcagcggctaccccagctaccccgccctgatcatcgaccccaagatgcccagagtgcccggccaccacaacggcgtgaccatccccgccccccccctggacgtgctgaagatcggcgagcacatgcagaccaagagcgacgagaagctgttcctggtgctgttcttcgacaacaagagaagctggcagtggctgcccaagagcaagatggtgcccctgggcatcgacgagaccatcgacaagctgaagatgatggagggcagaaacagcagcatcagaaaggccgtgagaatcgccttcgacagagccatgaaccacctgagcagagtgcacggcgagcccaccagcgacctgagcgacatcgactag

SEQ ID NO: 106307 - DNA, 2940 bp, Artificial Sequence
  Description of Artificial Sequence: Synthetic coding sequence
atgagcgtgtgcaccctgagcgtgcccgtgagcagcctgagccccggcagaagatgcaacaccttcagcgacagcggcatcctgggctgcgtgcccatcaacagcaacaccgacgaggaggacgtggtggaggagaagatggtggccgagggcgtgaacaaggaggccaagcagcccgccaagaagaagagaaagaagggcctgagaatcaagggcaagagaagaagaaagaagctgatcctggccaagaagttcagcaaggacctgggcagcggcagacccgtggccgacgcccccgccctgctggccagcaacgaccccgagcaggacgaggagagcctgttcgagagcaacatcgagaagcagatctacctgcccagcaccagagccaagaccagcatcgtgtggcacttcttccacgtggacccccagtacacctggagagccatctgcaacctgtgcgagaagagcgtgagcagaggcaagcccggcagccacctgggcaccagcaccctgcagagacacctgcaggccagacacagcccccactggaccagagccaacaagttcggcgtggccagcggcgaggaggacttcaccctggacgtgagcctgagccccagcagcggcagcaacggcagcttcgagtacatccccaccgaccccctggacgacaacagaatgggcaagaagcacgacaagagcgccagcgacgccctgagagccgagagaggcagattcctgatcaagagcaacatcgtgaagcacgccctgatccccggcaccagagccaagaccagcgccgtgtggaacttcttctacaccgacccccagcacatcagcagagccgtgtgcaacatctgcaagagaagcgtgagcagaggcagacccggcagccacctgggcaccagcaccctgcagagacacctgcaggccacccaccccatccactgggccgtggccaacaaggacagcggcgccgtggccaacggcctggacgaggccgagaccgagagaagcgacctgctgagcgacaccctgcacggcgagaagagcaccggcagccaggacctgaccgccgaggacctgagcgacagcgacagcgacgagcccatgctggaggtggagaacagaagcgagagccccatccccgtggccgagcagggcaccctgatgagagcccaggagagagagaccacctgctgcggcaaccccgtgagcagccacatcagccaggccatcatccagatgatcgtggaggacatgcacccctacaactacttcagcacccccgccttccagagattcatgcagatcgtggcccccgactacagactgcccagcgagacctacttcttcaccaaggccgtgccccagctgtacgactgcgtgagagagaagatcttcctgaccctggagaacgtgcagagccagaagatccacctgaccgtggacatctggacccacgaccccagcaccgactacttcatcgtgaccgtgcactgggtgagcctggagaccgccagcttcctgaacaacggcagaatccccgacttcagaaagtgggccgtgctgtgcgtgaccggcctggccaaggactgcctgatcaccaacatcctgcaggagctgaacgaccagatcggcctgtggctgagccccaacttcctgatccccagcttcatcgtgagcgacaacagcagcaacgtggtgcacgccatcaaggacggcggcttcacccacgtgccctgcttcctgcactgcctgaacatggtgatccaggacttcttctgcgagcacaagagcatcgagaacatgctggtggccgccagaaagacctgccaccacttcagccacagcgtgaaggccagacagatcctgcaggagttccagaacgaccaccagctgccctggaagaacctgaagcaggacgagaccggccactggatcagcaccttctacatgctgaagtggctgctggagcactgctacagcgtgcaccacagcctgggcagagccagcggcgtggtgctgaccagcctgcagtggaccctgatgacctacgtgtgcgacatcctgaagcccttcgaggaggccacccagaaggtgagcgtgaagaccgccggcctgaaccaggtgctgcccctgatccaccacctgctgctgagcctgcagaagctgagagaggacttccaggtgagaggcatcacccaggccctgaacctggtggacagcctgagcctgaagctggagaccgacaccctgctgagcgccatgctgaagagcaagccctgcatcctggccaccctgctggacccctgcttcaagaacagcctggaggacttcttcccccagggcgccgacctggagacctacaagcagttcctggccgaggaggtgtgcaactacatggagagcagccccgagatctgccagatccccaccagcgaggccagctgccccagcgtgaccgtgggcgccgacagcttcaccagcagcctgaaggagggcaccagcagcagcggcagcgtggacagcagcgccgtggacaacgtggccctgggcagcaagagcttcatgttccccagcgccgtggccgtggtggacgagtacttcaaggagaagtacagcgagttcagcggcggcgacgaccccctgatctactggcagagaaagatcagcatctggcccgccctgacccaggtggccatccagtacctgagctgccccatgtgcagctggcagagcgagtgcatcttcaccaagaacagccacttccaccccaagcagatcatgagcctggacttcgacaacatcgagcagctgatgttcctgaagatgaacctgaagaacgtgaactacgactacagcaccctggtgctgagctgggaccccgagcagaacgaggtggtgcagagcagcgagaaggagatcctgccctag

SEQ ID NO: 106308 - DNA, 4938 bp, Artificial Sequence
  Description of Artificial Sequence: Synthetic coding sequence
atggaggagagcaagaccctgaagagcgagaaccacgagcccaagaagaacgtgatctgcgaggagagcaaggccgtgcaggtgatcggcaaccagaccctgaaggccagaaacgacaagagcgtgaaggagatcgagaacagcagccccaacagaaacagcagcaagaagaacaagcagaacgacatctgcatcgagaagaccgaggtgaagagctgcaaggtgaacgccgccaacctgcccggccccaaggacctgggcctggtgctgagagaccagagccactgcaaggccaagaagttccccaacagccccgtgaaggccgagaaggccaccatcagccaggccaagagcgagaaggccaccagcctgcaggccaaggccgagaagagccccaagagccccaacagcgtgaaggccgagaaggccagcagctaccagatgaagagcgagaaggtgcccagcagccccgccgaggccgagaagggccccagcctgctgctgaaggacatgagacagaagaccgagctgcagcagatcggcaagaagatccccagcagcttcaccagcgtggacaaggtgaacatcgaggccgtgggcggcgagaagtgcgccctgcagaacagccccagaagccagaagcagcagacctgcaccgacaacaccggcgacagcgacgacagcgccagcggcatcgaggacgtgagcgacgacctgagcaagatgaagaacgacgagagcaacaaggagaacagcagcgagatggactacctggagaacgccaccgtgatcgacgagagcgccctgacccccgagcagagactgggcctgaagcaggccgaggagagactggagagagaccacatcttcagactggagaagagaagccccgagtacaccaactgcagatacctgtgcaagctgtgcctgatccacatcgagaacatccagggcgcccacaagcacatcaaggagaagagacacaagaagaacatcctggagaagcaggaggagagcgagctgagaagcctgcccccccccagccccgcccacctggccgccctgagcgtggccgtgatcgagctggccaaggagcacggcatcaccgacgacgacctgagagtgagacaggagatcgtggaggagatgagcaaggtgatcaccaccttcctgcccgagtgcagcctgagactgtacggcagcagcctgaccagattcgccctgaagagcagcgacgtgaacatcgacatcaagttcccccccaagatgaaccaccccgacctgctgatcaaggtgctgggcatcctgaagaagaacgtgctgtacgtggacgtggagagcgacttccacgccaaggtgcccgtggtggtgtgcagagacagaaagagcggcctgctgtgcagagtgagcgccggcaacgacatggcctgcctgaccaccgacctgctgaccgccctgggcaagatcgagcccgtgttcatccccctggtgctggccttcagatactgggccaagctgtgctacatcgacagccagaccgacggcggcatccccagctactgcttcgccctgatggtgatgttcttcctgcagcagagaaagccccccctgctgccctgcctgctgggcagctggatcgagggcttcgaccccaagagaatggacgacttccagctgaagggcatcgtggaggagaagttcgtgaagtgggagtgcaacagcagcagcgccaccgagaagaacagcatcgccgaggagaacaaggccaaggccgaccagcccaaggacgacaccaagaagaccgagaccgacaaccagagcaacgccatgaaggagaagcacggcaagagccccctggccctggagacccccaacagagtgagcctgggccagctgtggctggagctgctgaagttctacaccctggacttcgccctggaggagtacgtgatctgcgtgagaatccaggacatcctgaccagagagaacaagaactggcccaagagaagaatcgccatcgaggaccccttcagcgtgaagagaaacgtggccagaagcctgaacagccagctggtgtacgagtacgtggtggagagattcagagccgcctacagatacttcgcctgcccccagaccaagggcggcaacaagagcaccgtggacttcaagaagagagagaagggcaagatcagcaacaagaagcccgtgaagagcaacaacatggccaccaacggctgcatcctgctgggcgagaccaccgagaagatcaacgccgagagagagcagcccgtgcagtgcgacgagatggactgcaccagccagagatgcatcatcgacaacaacaacctgctggtgaacgagctggacttcgccgaccacggccaggacagcagcagcctgagcaccagcaagagcagcgagatcgagcccaagctggacaagaagcaggacgacctggcccccagcgagacctgcctgaagaaggagctgagccagtgcaactgcatcgacctgagcaagagccccgaccccgacaagagcaccggcaccgactgcagaagcaacctggagaccgagagcagccaccagagcgtgtgcaccgacaccagcgccaccagctgcaactgcaaggccaccgaggacgccagcgacctgaacgacgacgacaacctgcccacccaggagctgtactacgtgttcgacaagttcatcctgaccagcggcaagccccccaccatcgtgtgcagcatctgcaagaaggacggccacagcaagaacgactgccccgaggacttcagaaagatcgacctgaagcccctgccccccatgaccaacagattcagagagatcctggacctggtgtgcaagagatgcttcgacgagctgagccccccctgcagcgagcagcacaacagagagcagatcctgatcggcctggagaagttcatccagaaggagtacgacgagaaggccagactgtgcctgttcggcagcagcaagaacggcttcggcttcagagacagcgacctggacatctgcatgaccctggagggccacgagaacgccgagaagctgaactgcaaggagatcatcgagaacctggccaagatcctgaagagacaccccggcctgagaaacatcctgcccatcaccaccgccaaggtgcccatcgtgaagttcgagcacagaagaagcggcctggagggcgacatcagcctgtacaacaccctggcccagcacaacaccagaatgctggccacctacgccgccatcgaccccagagtgcagtacctgggctacaccatgaaggtgttcgccaagagatgcgacatcggcgacgccagcagaggcagcctgagcagctacgcctacatcctgatggtgctgtacttcctgcagcagagaaagccccccgtgatccccgtgctgcaggagatcttcgacggcaagcagatcccccagagaatggtggacggctggaacgccttcttcttcgacaagaccgaggagctgaagaagagactgcccagcctgggcaagaacaccgagagcctgggcgagctgtggctgggcctgctgagattctacaccgaggagttcgacttcaaggagtacgtgatcagcatcagacagaagaagctgctgaccaccttcgagaagcagtggaccagcaagtgcatcgccatcgaggaccccttcgacctgaaccacaacctgggcgccggcgtgagcagaaagatgaccaacttcatcatgaaggccttcatcaacggcagaaagctgttcggcacccccttctaccccctgatcggcagagaggccgagtacttcttcgacagcagagtgctgaccgacggcgagctggcccccaacgacagatgctgcagagtgtgcggcaagatcggccactacatgaaggactgccccaagagaaagagcagcctgctgttcagactgaagaagaaggacagcgaggaggagaaggagggcaacgaggaggagaaggacagcagagacgtgctggaccccagagacctgcacgacaccagagacttcagagaccccagagacctgagatgcttcatctgcggcgacgccggccacgtgagaagagagtgccccgaggtgaagctggccagacagagaaacagcagcgtggccgccgcccagctggtgagaaacctggtgaacgcccagcaggtggccggcagcgcccagcagcagggcgaccagagcatcagaaccagacagagcagcgagtgcagcgagagccccagctacagcccccagccccagcccttcccccagaacagcagccagagcgccgccatcacccagcccagcagccagcccggcagccagcccaagctgggccccccccagcagggcgcccagcccccccaccaggtgcagatgcccctgtacaacttcccccagagcccccccgcccagtacagccccatgcacaacatgggcctgctgcccatgcaccccctgcagatccccgcccccagctggcccatccacggccccgtgatccacagcgcccccggcagcgcccccagcaacatcggcctgaacgaccccagcatcatcttcgcccagcccgccgccagacccgtggccatccccaacaccagccacgacggccactggcccagaaccgtggcccccaacagcctggtgaacagcggcgccgtgggcaacagcgagcccggcttcagaggcctgaccccccccatcccctgggagcacgcccccagaccccacttccccctggtgcccgccagctggccctacggcctgcaccagaacttcatgcaccagggcaacgccagattccagcccaacaagcccttctacacccaggacagatgcgccaccagaagatgcagagagagatgcccccacccccccagaggcaacgtgagcgagtag

SEQ ID NO: 106309 - DNA, 4935 bp, Artificial Sequence
  Description of Artificial Sequence: Synthetic coding sequence
atggaggagagcaagaccctgaagagcgagaaccacgagcccaagaagaacgtgatctgcgaggagagcaaggccgtgcaggtgatcggcaaccagaccctgaaggccagaaacgacaagagcgtgaaggagatcgagaacagcagccccaacagaaacagcagcaagaagaacaagcagaacgacatctgcatcgagaagaccgaggtgaagagctgcaaggtgaacgccgccaacctgcccggccccaaggacctgggcctggtgctgagagaccagagccactgcaaggccaagaagttccccaacagccccgtgaaggccgagaaggccaccatcagccaggccaagagcgagaaggccaccagcctgcaggccaaggccgagaagagccccaagagccccaacagcgtgaaggccgagaaggccagcagctaccagatgaagagcgagaaggtgcccagcagccccgccgaggccgagaagggccccagcctgctgctgaaggacatgagacagaagaccgagctgcagcagatcggcaagaagatccccagcagcttcaccagcgtggacaaggtgaacatcgaggccgtgggcggcgagaagtgcgccctgcagaacagccccagaagccagaagcagcagacctgcaccgacaacaccggcgacagcgacgacagcgccagcggcatcgaggacgtgagcgacgacctgagcaagatgaagaacgacgagagcaacaaggagaacagcagcgagatggactacctggagaacgccaccgtgatcgacgagagcgccctgacccccgagcagagactgggcctgaagcaggccgaggagagactggagagagaccacatcttcagactggagaagagaagccccgagtacaccaactgcagatacctgtgcaagctgtgcctgatccacatcgagaacatccagggcgcccacaagcacatcaaggagaagagacacaagaagaacatcctggagaagcaggaggagagcgagctgagaagcctgcccccccccagccccgcccacctggccgccctgagcgtggccgtgatcgagctggccaaggagcacggcatcaccgacgacgacctgagagtgagacaggagatcgtggaggagatgagcaaggtgatcaccaccttcctgcccgagtgcagcctgagactgtacggcagcagcctgaccagattcgccctgaagagcagcgacgtgaacatcgacatcaagttcccccccaagatgaaccaccccgacctgctgatcaaggtgctgggcatcctgaagaagaacgtgctgtacgtggacgtggagagcgacttccacgccaaggtgcccgtggtggtgtgcagagacagaaagagcggcctgctgtgcagagtgagcgccggcaacgacatggcctgcctgaccaccgacctgctgaccgccctgggcaagatcgagcccgtgttcatccccctggtgctggccttcagatactgggccaagctgtgctacatcgacagccagaccgacggcggcatccccagctactgcttcgccctgatggtgatgttcttcctgcagcagagaaagccccccctgctgccctgcctgctgggcagctggatcgagggcttcgaccccaagagaatggacgacttccagctgaagggcatcgtggaggagaagttcgtgaagtgggagtgcaacagcagcagcgccaccgagaagaacagcatcgccgaggagaacaaggccaaggccgaccagcccaaggacgacaccaagaagaccgagaccgacaaccagagcaacgccatgaaggagaagcacggcaagagccccctggccctggagacccccaacagagtgagcctgggccagctgtggctggagctgctgaagttctacaccctggacttcgccctggaggagtacgtgatctgcgtgagaatccaggacatcctgaccagagagaacaagaactggcccaagagaagaatcgccatcgaggaccccttcagcgtgaagagaaacgtggccagaagcctgaacagccagctggtgtacgagtacgtggtggagagattcagagccgcctacagatacttcgcctgcccccagaccaagggcggcaacaagagcaccgtggacttcaagaagagagagaagggcaagatcagcaacaagaagcccgtgaagagcaacaacatggccaccaacggctgcatcctgctgggcgagaccaccgagaagatcaacgccgagagagagcagcccgtgcagtgcgacgagatggactgcaccagccagagatgcatcatcgacaacaacaacctgctggtgaacgagctggacttcgccgaccacggccaggacagcagcagcctgagcaccagcaagagcagcgagatcgagcccaagctggacaagaagcaggacgacctggcccccagcgagacctgcctgaagaaggagctgagccagtgcaactgcatcgacctgagcaagagccccgaccccgacaagagcaccggcaccgactgcagaagcaacctggagaccgagagcagccaccagagcgtgtgcaccgacaccagcgccaccagctgcaactgcaaggccaccgaggacgccagcgacctgaacgacgacgacaacctgcccacccaggagctgtactacgtgttcgacaagttcatcctgaccagcggcaagccccccaccatcgtgtgcagcatctgcaagaaggacggccacagcaagaacgactgccccgaggacttcagaaagatcgacctgaagcccctgccccccatgaccaacagattcagagagatcctggacctggtgtgcaagagatgcttcgacgagctgagccccccctgcagcgagcagcacaacagagagcagatcctgatcggcctggagaagttcatccagaaggagtacgacgagaaggccagactgtgcctgttcggcagcagcaagaacggcttcggcttcagagacagcgacctggacatctgcatgaccctggagggccacgagaacgccgagaagctgaactgcaaggagatcatcgagaacctggccaagatcctgaagagacaccccggcctgagaaacatcctgcccatcaccaccgccaaggtgcccatcgtgaagttcgagcacagaagaagcggcctggagggcgacatcagcctgtacaacaccctggcccagcacaacaccagaatgctggccacctacgccgccatcgaccccagagtgcagtacctgggctacaccatgaaggtgttcgccaagagatgcgacatcggcgacgccagcagaggcagcctgagcagctacgcctacatcctgatggtgctgtacttcctgcagcagagaaagccccccgtgatccccgtgctgcaggagatcttcgacggcaagcagatcccccagagaatggtggacggctggaacgccttcttcttcgacaagaccgaggagctgaagaagagactgcccagcctgggcaagaacaccgagagcctgggcgagctgtggctgggcctgctgagattctacaccgaggagttcgacttcaaggagtacgtgatcagcatcagacagaagaagctgctgaccaccttcgagaagcagtggaccagcaagtgcatcgccatcgaggaccccttcgacctgaaccacaacctgggcgccggcgtgagcagaaagatgaccaacttcatcatgaaggccttcatcaacggcagaaagctgttcggcacccccttctaccccctgatcggcagagaggccgagtacttcttcgacagcagagtgctgaccgacggcgagctggcccccaacgacagatgctgcagagtgtgcggcaagatcggccactacatgaaggactgccccaagagaaagagcctgctgttcagactgaagaagaaggacagcgaggaggagaaggagggcaacgaggaggagaaggacagcagagacgtgctggaccccagagacctgcacgacaccagagacttcagagaccccagagacctgagatgcttcatctgcggcgacgccggccacgtgagaagagagtgccccgaggtgaagctggccagacagagaaacagcagcgtggccgccgcccagctggtgagaaacctggtgaacgcccagcaggtggccggcagcgcccagcagcagggcgaccagagcatcagaaccagacagagcagcgagtgcagcgagagccccagctacagcccccagccccagcccttcccccagaacagcagccagagcgccgccatcacccagcccagcagccagcccggcagccagcccaagctgggccccccccagcagggcgcccagcccccccaccaggtgcagatgcccctgtacaacttcccccagagcccccccgcccagtacagccccatgcacaacatgggcctgctgcccatgcaccccctgcagatccccgcccccagctggcccatccacggccccgtgatccacagcgcccccggcagcgcccccagcaacatcggcctgaacgaccccagcatcatcttcgcccagcccgccgccagacccgtggccatccccaacaccagccacgacggccactggcccagaaccgtggcccccaacagcctggtgaacagcggcgccgtgggcaacagcgagcccggcttcagaggcctgaccccccccatcccctgggagcacgcccccagaccccacttccccctggtgcccgccagctggccctacggcctgcaccagaacttcatgcaccagggcaacgccagattccagcccaacaagcccttctacacccaggacagatgcgccaccagaagatgcagagagagatgcccccacccccccagaggcaacgtgagcgagtag

SEQ ID NO: 106310 - DNA, 264 bp, Artificial Sequence
  Description of Artificial Sequence: Synthetic coding sequence
atggaggagagcaagaccctgaagagcgagaaccacgagcccaagaagaacgtgatctgcgaggagagcaaggccgtgcaggtgatcggcaaccagaccctgaaggccagaaacgacaagagcgtgaaggagatcgagaacagcagccccaacagaaacagcagcaagaagaacaagcagaacgacatctgcatcgagaagaccgaggtgaagagctgcaaggtgaacgccgccaacctgcccggccccaaggacctgggctag

SEQ ID NO: 106311 - DNA, 234 bp, Artificial Sequence
  Description of Artificial Sequence: Synthetic coding sequence
atggaggagagcaagaccctgaagagcgagaaccacgagcccaagaagaacgtgatctgcgaggagagcaaggccgtgcaggtgatcggcaaccagaccctgaaggccagaaacgacaagagcgtgaaggagatcgagaacagcagccccaacagaaacagcagcaagaagaacaagcagaacgacatctgcatcgagaagaccgaggtgaagagctgcaaggtgaacgcctag

SEQ ID NO: 106312 - DNA, 1209 bp, Artificial Sequence
  Description of Artificial Sequence: Synthetic coding sequence
atggccagcatcatcgccagagtgggcaacagcagaagactgaacgcccccctgcccccctgggcccacagcatgctgagaagcctgggcagaagcctgggccccatcatggccagcatggccgacagaaacatgaagctgttcagcggcagagtggtgcccgcccagggcgaggagaccttcgagaactggctgacccaggtgaacggcgtgctgcccgactggaacatgagcgaggaggagaagctgaagagactgatgaagaccctgagaggccccgccagagaggtgatgagagtgctgcaggccaccaaccccaacctgagcgtggccgacttcctgagagccatgaagctggtgttcggcgagagcgagagcagcgtgaccgcccacggcaagttcttcaacaccctgcaggcccagggcgagaaggccagcctgtacgtgatcagactggaggtgcagctgcagaacgccatccaggccggcatcatcgccgagaaggacgccaacagaaccagactgcagcagctgctgctgggcggcgagctgagcagagacctgagactgagactgaaggacttcctgagaatgtacgccaacgagcaggagagactgcccaacttcctggagctgatcagaatggtgagagaggaggaggactgggacgacgccttcatcaagagaaagagacccaagagaagcgagagcatggtggagagagccgtgagccccgtggccttccagggcagcccccccatcgtgatcggcagcgccgactgcaacgtgatcgagatcgacgacaccctggacgacagcgacgaggacgtgatcctggtggagagccaggacccccccctgcccagctggggcgccccccccctgagagacagagccagaccccaggacgaggtgctggtgatcgacagcccccacaacagcagagcccagttccccagcaccagcggcggcagcggctacaagaacaacggccccggcgagatgagaagagccagaaagagaaagcacaccatcagatgcagctactgcggcgaggagggccacagcaaggagacctgcgacaacgagagcgacaaggcccaggtgttcgagaacctgatcatcaccctgcaggagctgacccacaccgagatggagagaagcagagtggcccccggcgagtacaacgacttcagcgagcccctgtag

SEQ ID NO: 106313 - DNA, 1542 bp, Artificial Sequence
  Description of Artificial Sequence: Synthetic coding sequence
atggccgccagcagaaacggcttcgaggccgtggaggccgagggcagcgccggctgcagaggcagcagcggcatggaggtggtgctgcccctggaccccgccgtgcccgcccccctgtgcccccacggccccaccctgctgttcgtgaaggtgacccagggcaaggaggagaccagaagattctacgcctgcagcgcctgcagagacagaaaggactgcaacttcttccagtgggaggacgagaagctgagcggcgccagactggccgccagagaggcccacaacagaagatgccagccccccctgagcagaacccagtgcgtggagagatacctgaagttcatcgagctgcccctgacccagagaaagttctgccagacctgccagcagctgctgctgcccgacgactggggccagcacagcgagcaccaggtgctgggcaacgtgagcatcacccagctgagaagacccagccagctgctgtaccccctggagaacaagaagaccaacgcccagtacctgttcgccgacagaagctgccagttcctggtggacctgctgagcgccctgggcttcagaagagtgctgtgcgtgggcacccccagactgcacgagctgatcaagctgaccgccagcggcgacaagaagagcaacatcaagagcctgctgctggacatcgacttcagatacagccagttctacatggaggacagcttctgccactacaacatgttcaaccaccacttcttcgacggcaagaccgccctggaggtgtgcagagccttcctgcaggaggacaagggcgagggcatcatcatggtgaccgacccccccttcggcggcctggtggagcccctggccatcaccttcaagaagctgatcgccatgtggaaggagggccagagccaggacgacagccacaaggagctgcccatcttctggatcttcccctacttcttcgagagcagaatctgccagttcttccccagcttccagatgctggactaccaggtggactacgacaaccacgccctgtacaagcacggcaagaccggcagaaagcagagccccgtgagaatcttcaccaacatcccccccaacaagatcatcctgcccaccgaggagggctacagattctgcagcccctgccagagatacgtgagcctggagaaccagcactgcgagctgtgcaacagctgcaccagcaaggacggcagaaagtggaaccactgcttcctgtgcaagaagtgcgtgaagcccagctggatccactgcagcatctgcaaccactgcgccgtgcccgaccacagctgcgagggccccaagcacggctgcttcatctgcggcgagctggaccacaagagaagcacctgccccaacatcgccaccagcaagagagccaacaaggccgtgagaaagcagaagcagagaaagagcaacaagatgaagatggagaccaccaagggccagagcatgaaccacaccagcgccaccagaagaaagaagagaagagagagagcccaccagtacctgggcagctag

SEQ ID NO: 106314 - DNA, 384 bp, Artificial Sequence
  Description of Artificial Sequence: Synthetic coding sequence
atggaggtggtgctgcccctggaccccgccgtgcccgcccccctgtgcccccacggccccaccctgctgttcgtgaaggtgacccagggcaaggaggagaccagaagattctacgcctgcagcgcctgcagagacagaaaggactgcaacttcttccagtgggaggacgagaagctgagcggcgccagactggccgccagagaggcccacaacagaagatgccagccccccctgagcagaacccagtgcggcagatacctgaagttcatcgagctgcccctgacccagagaaagttctgccagacctgccagcagctgctgctgcccgacgactggggccagcacagcgagcaccagttctgggtgtgcgtgatcaccagctag

SEQ ID NO: 106315 - DNA, 1479 bp, Artificial Sequence
  Description of Artificial Sequence: Synthetic coding sequence
atggtgatcctgctgctgcagcacggcgccgaccccaccctgatcgacggcgagggcttcagcagcatccacctggccgtgctgttccagcacatgcccatcatcgcctacctgatcagcaagggccagagcgtgaacatgaccgacgtgaacggccagacccccctgatgctgagcgcccacaaggtgatcggccccgagcccaccggcttcctgctgaagttcaaccccagcctgaacgtggtggacaagatccaccagaacacccccctgcactgggccgtggccgccggcaacgtgaacgccgtggacaagctgctggaggccggcagcagcctggacatccagaacgtgaagggcgagacccccctggacatggccctgcagaacaagaaccagctgatcatccacatgctgaagaccgaggccaagatgagagccaaccagaagttcagactgtggagatggctgcagaagtgcgagctgttcctgctgctgatgctgagcgtgatcaccatgtgggccatcggctacatcctggacttcaacagcgacagctggctgctgaagggctgcctgctggtgaccctgttcttcctgaccagcctgttccccagattcctggtgggctacaagaacctggtgtacctgcccaccgccttcctgctgagcagcgtgttctggatcttcatgacctggttcatcctgttcttccccgacctggccggcgcccccttctacttcagcttcatcttcagcatcgtggccttcctgtacttcttctacaagacctgggccaccgaccccggcttcaccaaggccagcgaggaggagaagaaggtgaacatcatcaccctggccgagaccggcagcctggacttcagaaccttctgcaccagctgcctgatcagaaagcccctgagaagcctgcactgccacgtgtgcaactgctgcgtggccagatacgaccagcactgcctgtggaccggcagatgcatcggcttcggcaaccaccactactacatcttcttcctgttcttcctgagcatggtgtgcggctggatcatctacggcagcttcatctacctgagcagccactgcgccaccaccttcaaggaggacggcctgtggacctacctgaaccagatcgtggcctgcagcccctgggtgctgtacatcctgatgctggccaccttccacttcagctggagcaccttcctgctgctgaaccagctgttccagatcgccttcctgggcctgaccagccacgagagaatcagcctgcagaagcagagcaagcacatgaagcagaccctgagcctgagaaagaccccctacaacctgggcttcatgcagaacctggccgacttcttccagtgcggctgcttcggcctggtgaagccctgcgtggtggactggaccagccagtacaccatggtgttccaccccgccagagagaaggtgctgagaagcgtgtag

SEQ ID NO: 106316 - DNA, 1869 bp, Artificial Sequence
  Description of Artificial Sequence: Synthetic coding sequence
atggagggccccggcctgggcagccagtgcagaaaccacagccacggcccccacccccccggcttcggcagatacggcatctgcgcccacgagaacaaggagctggccaacgccagagaggccctgcccctgatcgaggacagcagcaactgcgacatcgtgaaggccacccagtacggcatcttcgagagatgcaaggagctggtggaggccggctacgacgtgagacagcccgacaaggagaacgtgagcctgctgcactgggccgccatcaacaacagactggacctggtgaagttctacatcagcaagggcgccgtggtggaccagctgggcggcgacctgaacagcacccccctgcactgggccatcagacagggccacctgcccatggtgatcctgctgctgcagcacggcgccgaccccaccctgatcgacggcgagggcttcagcagcatccacctggccgtgctgttccagcacatgcccatcatcgcctacctgatcagcaagggccagagcgtgaacatgaccgacgtgaacggccagacccccctgatgctgagcgcccacaaggtgatcggccccgagcccaccggcttcctgctgaagttcaaccccagcctgaacgtggtggacaagatccaccagaacacccccctgcactgggccgtggccgccggcaacgtgaacgccgtggacaagctgctggaggccggcagcagcctggacatccagaacgtgaagggcgagacccccctggacatggccctgcagaacaagaaccagctgatcatccacatgctgaagaccgaggccaagatgagagccaaccagaagttcagactgtggagatggctgcagaagtgcgagctgttcctgctgctgatgctgagcgtgatcaccatgtgggccatcggctacatcctggacttcaacagcgacagctggctgctgaagggctgcctgctggtgaccctgttcttcctgaccagcctgttccccagattcctggtgggctacaagaacctggtgtacctgcccaccgccttcctgctgagcagcgtgttctggatcttcatgacctggttcatcctgttcttccccgacctggccggcgcccccttctacttcagcttcatcttcagcatcgtggccttcctgtacttcttctacaagacctgggccaccgaccccggcttcaccaaggccagcgaggaggagaagaaggtgaacatcatcaccctggccgagaccggcagcctggacttcagaaccttctgcaccagctgcctgatcagaaagcccctgagaagcctgcactgccacgtgtgcaactgctgcgtggccagatacgaccagcactgcctgtggaccggcagatgcatcggcttcggcaaccaccactactacatcttcttcctgttcttcctgagcatggtgtgcggctggatcatctacggcagcttcatctacctgagcagccactgcgccaccaccttcaaggaggacggcctgtggacctacctgaaccagatcgtggcctgcagcccctgggtgctgtacatcctgatgctggccaccttccacttcagctggagcaccttcctgctgctgaaccagctgttccagatcgccttcctgggcctgaccagccacgagagaatcagcctgcagaagcagagcaagcacatgaagcagaccctgagcctgagaaagaccccctacaacctgggcttcatgcagaacctggccgacttcttccagtgcggctgcttcggcctggtgaagccctgcgtggtggactggaccagccagtacaccatggtgttccaccccgccagagagaaggtgctgagaagcgtgtag

SEQ ID NO: 106317 - DNA, 564 bp, Artificial Sequence
  Description of Artificial Sequence: Synthetic coding sequence
atgagaagaggctggaagatggccctgagcggcggcctgagatgctgcagaagagtgctgagctgggtgcccgtgctggtgatcgtgctggtggtgctgtggagctactacgcctacgtgttcgagctgtgcctggtgaccgtgctgagccccgccgagaaggtgatctacctgatcctgtaccacgccatcttcgtgttcttcacctggacctactggaagagcatcttcaccctgccccagcagcccaaccagaagttccacctgagctacaccgacaaggagagatacgagaacgaggagagacccgaggtgcagaagcagatgctggtggacatggccaagaagctgcccgtgtacaccagaaccggcagcggcgccgtgagattctgcgacagatgccacctgatcaagcccgacagatgccaccactgcagcgtgtgcgccatgtgcgtgctgaagatggaccaccactgcccctggggcaactaccccgtgttcgccctgagcagcatgagcttcttcttcagcctgtggcccgcctgcttcctgagcgccctgtag

SEQ ID NO: 106318 - DNA, 1014 bp, Artificial Sequence
  Description of Artificial Sequence: Synthetic coding sequence
atgagaagaggctggaagatggccctgagcggcggcctgagatgctgcagaagagtgctgagctgggtgcccgtgctggtgatcgtgctggtggtgctgtggagctactacgcctacgtgttcgagctgtgcctggtgaccgtgctgagccccgccgagaaggtgatctacctgatcctgtaccacgccatcttcgtgttcttcacctggacctactggaagagcatcttcaccctgccccagcagcccaaccagaagttccacctgagctacaccgacaaggagagatacgagaacgaggagagacccgaggtgcagaagcagatgctggtggacatggccaagaagctgcccgtgtacaccagaaccggcagcggcgccgtgagattctgcgacagatgccacctgatcaagcccgacagatgccaccactgcagcgtgtgcgccatgtgcgtgctgaagatggaccaccactgcccctgggtgaacaactgcatcggcttcagcaactacaagttcttcctgcagttcctggcctacagcgtgctgtactgcctgtacatcgccaccaccgtgttcagctacttcatcaagtactggagaggcgagctgcccagcgtgagaagcaagttccacgtgctgttcctgctgttcgtggcctgcatgttcttcgtgagcctggtgatcctgttcggctaccactgctggctggtgagcagaaacaagaccaccctggaggccttctgcacccccgtgttcaccagcggccccgagaagaacggcttcaacctgggcttcatcaagaacatccagcaggtgttcggcgacaagaagaagttctggctgatccccatcggcagcagccccggcgacggccacagcttccccatgagaagcatgaacgagagccagaaccccctgctggccaacgaggagacctgggaggacaacgaggacgacaaccaggactaccccgagggcagcagcagcctggccgtggagaccgagacctag

SEQ ID NO: 106319 - DNA, 987 bp, Artificial Sequence
  Description of Artificial Sequence: Synthetic coding sequence
atgagaagaggctggaagatggccctgagcggcggcctgagatgctgcagaagagtgctgagctgggtgcccgtgctggtgatcgtgctggtggtgctgtggagctactacgcctacgtgttcgagctgtgcctggtgatctacctgatcctgtaccacgccatcttcgtgttcttcacctggacctactggaagagcatcttcaccctgccccagcagcccaaccagaagttccacctgagctacaccgacaaggagagatacgagaacgaggagagacccgaggtgcagaagcagatgctggtggacatggccaagaagctgcccgtgtacaccagaaccggcagcggcgccgtgagattctgcgacagatgccacctgatcaagcccgacagatgccaccactgcagcgtgtgcgccatgtgcgtgctgaagatggaccaccactgcccctgggtgaacaactgcatcggcttcagcaactacaagttcttcctgcagttcctggcctacagcgtgctgtactgcctgtacatcgccaccaccgtgttcagctacttcatcaagtactggagaggcgagctgcccagcgtgagaagcaagttccacgtgctgttcctgctgttcgtggcctgcatgttcttcgtgagcctggtgatcctgttcggctaccactgctggctggtgagcagaaacaagaccaccctggaggccttctgcacccccgtgttcaccagcggccccgagaagaacggcttcaacctgggcttcatcaagaacatccagcaggtgttcggcgacaagaagaagttctggctgatccccatcggcagcagccccggcgacggccacagcttccccatgagaagcatgaacgagagccagaaccccctgctggccaacgaggagacctgggaggacaacgaggacgacaaccaggactaccccgagggcagcagcagcctggccgtggagaccgagacctag

SEQ ID NO: 106320 - DNA, 2022 bp, Artificial Sequence
  Description of Artificial Sequence: Synthetic coding sequence
atgcccagaagccccggcaccagactgaagcccgccaagtacatccccgtggccaccgccgccgccctgctggtgggcagcagcaccctgttcttcgtgttcacctgcccctggctgaccagagccgtgagccccgccgtgcccgtgtacaacggcatcatcttcctgttcgtgctggccaacttcagcatggccaccttcatggaccccggcgtgttccccagagccgacgaggacgaggacaaggaggacgacttcagagcccccctgtacaagaacgtggacgtgagaggcatccaggtgagaatgaagtggtgcgccacctgccacttctacagaccccccagatgcagccactgcagcgtgtgcgacaactgcgtggaggtgaccggcaagttcagaggcggcgtgaaccccttcaccagaggctgctgcggcaacgtggagcacgtgctgtgcagccccctggcccccagatacgtggtggagccccccagactgcccctggccgtgagcctgaagccccccttcctgagacccgagctgctggacagagccgcccccctgaaggtgaagctgagcgacaacggcctgaaggccggcctgggcagaagcaagagcaagggcagcctggacagactggacgagaagcccctggacctgggcccccccctgccccccaagatcgaggccggcaccttcagcagcgacctgcagacccccagacccggcagcgccgagagcgccctgagcgtgcagagaaccagcccccccacccccgccatgtacaagttcagacccgccttccccaccggccccaaggtgcccttctgcggccccggcgagcaggtgcccggccccgacagcctgaccctgggcgacgacagcatcagaagcctggacttcgtgagcgagcccagcctggacctgcccgactacggccccggcggcctgcacgccgcctacccccccagcccccccctgagcgccagcgacgccttcagcggcgccctgagaagcctgagcctgaaggccagcagcagaagaggcggcgaccacgtggccctgcagcccctgagaagcgagggcggcccccccaccccccacagaagcatcttcgccccccacgccctgcccaacagaaacggcagcctgagctacgacagcctgctgaaccccggcagccccggcggccacgcctgccccgcccaccccgccgtgggcgtggccggctaccacagcccctacctgcaccccggcgccaccggcgacccccccagacccctgcccagaagcttcagccccgtgctgggccccagacccagagagcccagccccgtgagatacgacaacctgagcagaaccatcatggccagcatccaggagagaaaggacagagaggagagagagagactgctgagaagccaggccgacagcctgttcggcgacagcggcgtgtacgacgcccccagcagctacagcctgcagcaggccagcgtgctgagcgagggccccagaggccccgccctgagatacggcagcagagacgacctggtggccggccccggcttcggcggcgccagaaaccccgccctgcagaccagcctgagcagcctgagcagcagcgtgagcagagcccccagaaccagcagcagcagcctgcaggccgaccaggccagcagcaacgcccccggccccagacccagcagcggcagccacagaagccccgccagacagggcctgcccagcccccccggcaccccccacagccccagctacgccggccccaaggccgtggccttcatccacaccgacctgcccgagcccccccccagcctgaccgtgcagagagaccacccccagctgaagaccccccccagcaagctgaacggccagagccccggcctggccagactgggccccgccaccggcccccccggccccagcgccagccccaccagacacaccctggtgaagaaggtgagcggcgtgggcggcaccacctacgagatcagcgtgtag

SEQ ID NO: 106321 - DNA, 2298 bp, Artificial Sequence
  Description of Artificial Sequence: Synthetic coding sequence
atgcccagaagccccggcaccagactgaagcccgccaagtacatccccgtggccaccgccgccgccctgctggtgggcagcagcaccctgttcttcgtgttcacctgcccctggctgaccagagccgtgagccccgccgtgcccgtgtacaacggcatcatcttcctgttcgtgctggccaacttcagcatggccaccttcatggaccccggcgtgttccccagagccgacgaggacgaggacaaggaggacgacttcagagcccccctgtacaagaacgtggacgtgagaggcatccaggtgagaatgaagtggtgcgccacctgccacttctacagaccccccagatgcagccactgcagcgtgtgcgacaactgcgtggaggacttcgaccaccactgcccctgggtgaacaactgcatcggcagaagaaactacagatacttcttcctgttcctgctgagcctgagcgcccacatggtgggcgtggtggccttcggcctggtgtacgtgctgaaccacgccgagggcctgggcgccgcccacaccaccatcaccatggccgtgatgtgcgtggccggcctgttcttcatccccgtgatcggcctgaccggcttccacgtggtgctggtgaccagaggcagaaccaccaacgagcaggtgaccggcaagttcagaggcggcgtgaaccccttcaccagaggctgctgcggcaacgtggagcacgtgctgtgcagccccctggcccccagatacgtggtggagccccccagactgcccctggccgtgagcctgaagccccccttcctgagacccgagctgctggacagagccgcccccctgaaggtgaagctgagcgacaacggcctgaaggccggcctgggcagaagcaagagcaagggcagcctggacagactggacgagaagcccctggacctgggcccccccctgccccccaagatcgaggccggcaccttcagcagcgacctgcagacccccagacccggcagcgccgagagcgccctgagcgtgcagagaaccagcccccccacccccgccatgtacaagttcagacccgccttccccaccggccccaaggtgcccttctgcggccccggcgagcaggtgcccggccccgacagcctgaccctgggcgacgacagcatcagaagcctggacttcgtgagcgagcccagcctggacctgcccgactacggccccggcggcctgcacgccgcctacccccccagcccccccctgagcgccagcgacgccttcagcggcgccctgagaagcctgagcctgaaggccagcagcagaagaggcggcgaccacgtggccctgcagcccctgagaagcgagggcggcccccccaccccccacagaagcatcttcgccccccacgccctgcccaacagaaacggcagcctgagctacgacagcctgctgaaccccggcagccccggcggccacgcctgccccgcccaccccgccgtgggcgtggccggctaccacagcccctacctgcaccccggcgccaccggcgacccccccagacccctgcccagaagcttcagccccgtgctgggccccagacccagagagcccagccccgtgagatacgacaacctgagcagaaccatcatggccagcatccaggagagaaaggacagagaggagagagagagactgctgagaagccaggccgacagcctgttcggcgacagcggcgtgtacgacgcccccagcagctacagcctgcagcaggccagcgtgctgagcgagggccccagaggccccgccctgagatacggcagcagagacgacctggtggccggccccggcttcggcggcgccagaaaccccgccctgcagaccagcctgagcagcctgagcagcagcgtgagcagagcccccagaaccagcagcagcagcctgcaggccgaccaggccagcagcaacgcccccggccccagacccagcagcggcagccacagaagccccgccagacagggcctgcccagcccccccggcaccccccacagccccagctacgccggccccaaggccgtggccttcatccacaccgacctgcccgagcccccccccagcctgaccgtgcagagagaccacccccagctgaagaccccccccagcaagctgaacggccagagccccggcctggccagactgggccccgccaccggcccccccggccccagcgccagccccaccagacacaccctggtgaagaaggtgagcggcgtgggcggcaccacctacgagatcagcgtgtag

SEQ ID NO: 106322 - DNA, 2337 bp, Artificial Sequence
  Description of Artificial Sequence: Synthetic coding sequence
atgcccagaagccccggcaccagactgaagcccgccaagtacatccccgtggccaccgccgccgccctgctggtgggcagcagcaccctgttcttcgtgttcacctgcccctggctgaccagagccgtgagccccgccgtgcccgtgtacaacggcatcatcttcctgttcgtgctggccaacttcagcatggccaccttcatggaccccggcgtgttccccagagccgacgaggacgaggacaaggaggacgacttcagagcccccctgtacaagaacgtggacgtgagaggcatccaggtgagaatgaagtggtgcgccacctgccacttctacagaccccccagatgcagccactgcagcgtgtgcgacaactgcgtggaggacttcgaccaccactgcccctgggtgaacaactgcatcggcagaagaaactacagatacttcttcctgttcctgctgagcctgagcgcccacatggtgggcgtggtggccttcggcctggtgtacgtgctgaaccacgccgagggcctgggcgccgcccacaccaccatcaccatggccgtgatgtgcgtggccggcctgttcttcatccccgtgatcggcctgaccggcttccacgtggtgctggtgaccagaggcagaaccaccaacgagcaggtgaccggcaagttcagaggcggcgtgaaccccttcaccagaggctgctgcggcaacgtggagcacgtgctgtgcagccccctggcccccagatacgtggtggagccccccagactgcccctggccgtgagcctgaagccccccttcctgagacccgagctgctggacagagccgcccccctgaaggtgaagctgagcgacaacggcctgaaggccggcctgggcagaagcaagagcaagggcagcctggacagactggacgagaagcccctggacctgggcccccccctgccccccaagatcgaggccggcaccttcagcagcgacctgcagacccccagacccggcagcgccgagagcgccctgagcgtgcagagaaccagcccccccacccccgccatgtacaagttcagacccgccttccccaccggccccaaggtgcccttctgcggccccggcgagcaggtgcccggccccgacagcctgaccctgggcgacgacagcatcagaagcctggacttcgtgagcgagcccagcctggacctgcccgactacggccccggcggcctgcacgccgcctacccccccagcccccccctgagcgccagcgacgccttcagcggcgccctgagaagcctgagcctgaaggccagcagcagaagaggcggcgaccacgtggccctgcagcccctgagaagcgagggcggcccccccaccccccacagaagcatcttcgccccccacgccctgcccaacagaaacggcagcctgagctacgacagcctgctgaaccccggcagccccggcggccacgcctgccccgcccaccccgccgtgggcgtggccggctaccacagcccctacctgcaccccggcgccaccggcgacccccccagacccctgcccagaagcttcagccccgtgctgggccccagacccagagagcccagccccgtgagatacgacaacctgagcagaaccatcatggccagcatccaggagagaaaggacagagaggagagagagagactgctgagaagccaggccgacagcctgttcggcgacagcggcgtgtacgacgcccccagcagctacagcctgcagcaggccagcgtgctgagcgagggccccagaggccccgccctgagatacggcagcagagacgacctggtggccggccccggcttcggcggcgccagaaaccccgccctgcagaccagcctgagcagcctgagcagcagcgtgagcagagcccccagaaccagcagcagcagcctgcaggccgaccaggccagcagcaacgcccccggccccagacccagcagcggcagccacagaagccccgccagacagggcctgcccagcccccccggcaccccccacagccccagctacgccggccccaaggccgtggccttcatccacaccgacctgcccgagcccccccccagcctgaccgtgcagagaggcagaatcggcacctgcaccagaggctggggcagaagaggccagccctgggtgccccccggcctgcacctgtgccacctgggcagacccgaggacagaccccccctgagagccccctggagccaggccgccggcgccccccccagaggcgccatgtgcagactgcacctggccgccagcagcctgttccccagcctgagcggcccctag

SEQ ID NO: 106323 - DNA, 1095 bp, Artificial Sequence
  Description of Artificial Sequence: Synthetic coding sequence
atgagcgtgatggtggtgagaaagaaggtgaccagaaagtgggagaagctgcccggcagaaacaccttctgctgcgacggcagagtgatgatggccagacagaagggcatcttctacctgaccctgttcctgatcctgggcacctgcaccctgttcttcgccttcgagtgcagatacctggccgtgcagctgagccccgccatccccgtgttcgccgccatgctgttcctgttcagcatggccaccctgctgagaaccagcttcagcgaccccggcgtgatccccagagccctgcccgacgaggccgccttcatcgagatggagatcgaggccaccaacggcgccgtgccccagggccagagacccccccccagaatcaagaacttccagatcaacaaccagatcgtgaagctgaagtactgctacacctgcaagatcttcagaccccccagagccagccactgcagcatctgcgacaactgcgtggagagattcgaccaccactgcccctgggtgggcaactgcgtgggcaagagaaactacagatacttctacctgttcatcctgagcctgagcctgctgaccatctacgtgttcgccttcaacatcgtgtacgtggccctgaagagcctgaagatcggcttcctggagaccctgaaggagacccccggcaccgtgctggaggtgctgatctgcttcttcaccctgtggagcgtggtgggcctgaccggcttccacaccttcctggtggccctgaaccagaccaccaacgaggacatcaagggcagctggaccggcaagaacagagtgcagaacccctacagccacggcaacatcgtgaagaactgctgcgaggtgctgtgcggccccctgccccccagcgtgctggacagaagaggcatcctgcccctggaggagagcggcagcagaccccccagcacccaggagaccagcagcagcctgctgccccagagccccgcccccaccgagcacctgaacagcaacgagatgcccgaggacagcagcacccccgaggagatgcccccccccgagccccccgagcccccccaggaggccgccgaggccgagaagtag

SEQ ID NO: 106324 - DNA, 1095 bp, Artificial Sequence; identical to SEQ ID NO: 106323
  Description of Artificial Sequence: Synthetic coding sequence

SEQ ID NO: 106325 - DNA, 513 bp, Artificial Sequence
  Description of Artificial Sequence: Synthetic coding sequence
atgagcgtgatggtggtgagaaagaaggtgaccagaaagtgggagaagctgcccggcagaaacaccttctgctgcgacggcagagtgatgatggccagacagaagggcatcttctacctgaccctgttcctgatcctgggcacctgcaccctgttcttcgccttcgagtgcagatacctggccgtgcagctgagccccgccatccccgtgttcgccgccatgctgttcctgttcagcatggccaccctgctgagaaccagcttcagcgaccccggcgtgatccccagagccctgcccgacgaggccgccttcatcgagatggagatcgaggccaccaacggcgccgtgccccagggccagagacccccccccagaatcaagaacttccagatcaacaaccagatcgtgaagctgaagtactgctacacctgcaagatcttcagaccccccagagccagccactgcagcatctgcgacaactgcgtggagagattcgaccaccactgcccctag

SEQ ID NO: 106326 - DNA, 585 bp, Artificial Sequence
  Description of Artificial Sequence: Synthetic coding sequence
tgactgttcctgatcctgggcacctgcaccctgttcttcgccttcgagtgcagatacctggccgtgcagctgagccccgccatccccgtgttcgccgccatgctgttcctgttcagcatggccaccctgctgagaaccagcttcagcgaccccggcgtgatccccagagccctgcccgacgaggccgccttcatcgagatggagatcgaggccaccaacggcgccgtgccccagggccagagacccccccccagaatcaagaacttccagatcaacaaccagatcgtgaagctgaagtactgctacacctgcaagatcttcagaccccccagagccagccactgcagcatctgcgacaactgcgtggagagcctgaagatcggcttcctggagaccctgaaggagacccccggcaccgtgctggaggtgctgatctgcttcttcaccctgtggagcgtggtgggcctgaccggcttccacaccttcctggtggccctgaaccagaccaccaacgaggacatcaagggcagctggaccggcaagaacagagtgcagaacccctacagccacggcaacatcgtgtag

SEQ ID NO: 106327 - DNA, 897 bp, Artificial Sequence
  Description of Artificial Sequence: Synthetic coding sequence
atggagagaggcatcagcgacgtgaccgacagaaagctgaccatggaggaggaggaggccaagagaatcgccgagatgggcaagcccgtgctgggcgagcaccccaagctggaggtgatcatcgaggagagctacgagttcaagaccaccgtggacaagctgatcaagaagaccaacctggccctggtggtgggcacccacagctggagagaccagttcatggaggccatcaccgtgagcgccgccggcgacgaggacgaggacgagagcggcgaggagagactgcccagctgcttcgactacgtgatgcacttcctgaccgtgttctggaaggtgctgttcgcctgcgtgccccccaccgagtactgccacggctgggcctgcttcgccgtgagcatcctgatcatcggcatgctgaccgccatcatcggcgacctggccagccacttcggctgcaccatcggcctgaaggacagcgtgaccgccgtggtgttcgtggccttcggcaccagcgtgcccgacaccttcgccagcaaggccgccgccctgcaggacgtgtacgccgacgccagcatcggcaacgtgaccggcagcaacgccgtgaacgtgttcctgggcatcggcctggcctggagcgtggccgccatctactgggccctgcagggccaggagttccacgtgagcgccggcaccctggccttcagcgtgaccctgttcaccatcttcgccttcgtgtgcatcagcgtgctgctgtacagaagaagaccccacctgggcggcgagctgggcggccccagaggctgcaagctggccaccacctggctgttcgtgagcctgtggctgctgtacatcctgttcgccaccctggaggcctactgctacatcaagggcttctag

SEQ ID NO: 106328 - DNA, 705 bp, Artificial Sequence
  Description of Artificial Sequence: Synthetic coding sequence
atgagcagcgaggtgagcgccagaagagacgccaagaagctggtgagaagccccagcggcctgagaatggtgcccgagcacagagccttcggcagccccttcggcctggaggagccccagtgggtgcccgacaaggagtgcagaagatgcatgcagtgcgacgccaagttcgacttcctgaccagaaagcaccactgcagaagatgcggcaagtgcttctgcgacagatgctgcagccagaaggtgcccctgagaagaatgtgcttcgtggaccccgtgagacagtgcgccgagtgcgccctggtgagcctgaaggaggccgagttctacgacaagcagctgaaggtgctgctgagcggcgccaccttcctggtgaccttcggcaacagcgagaagcccgagaccatgacctgcagactgagcaacaaccagagatacctgttcctggacggcgacagccactacgagatcgagatcgtgcacatcagcaccgtgcagatcctgaccgagggcttcccccccggcggcggcaacgccagagccaccggcatgttcctgcagtacaccgtgcccggcaccgagggcgtgacccagctgaagctgaccgtggtggaggacgtgaccgtgggcagaagacaggccgtggcctggctggtggccatgcacaaggccgccaagctgctgtacgagagcagagaccagtag

SEQ ID NO: 106329 - DNA, 7620 bp, Artificial Sequence
  Description of Artificial Sequence: Synthetic coding sequence
atgaaccaccccttcggcaaggaggaggccgccagccagaagcagctgttcggcttcttctgcgagtgcctgagaagaggcgagtgggagctggcccaggcctgcgtgccccagctgcaggagggccagggcgacatccccaagagagtggaggacatcctgcaggccctggtggtgtgccccaacctgctgagatgcggccaggacatcaacccccagagagtggcctgggtgtggctgctggtgctggagaagtggctggccagagagaagaagctgctgcccgtggtgttcagaagaaagctggagttcctgctgctgagcgaggacctgcagggcgacatccccgagaacatcctggaggagctgtacgagaccctgacccagggcgccgtgggccacgtgcccgacggcaaccccagaagagagagctggacccccagactgagcagcgaggccgtgagcgtgctgtgggacctgctgagacagagcccccagcccgcccaggccctgctggagctgctgctggaggaggacgacggcaccggcctgtgccactggcccctgcagaacgccctggtggacctgatcagaaaggccctgagagccctgcagggccccgacagcgtgccccccggcgtggtggacgccatctacggcgccctgagaaccctgagatgccccgccgagcccctgggcgtggagctgcacctgctgtgcgaggagctgctggaggcctgcagaaccgagggcagccccctgagagaggagagactgctgagctgcctgctgcacaaggccagcagaggcctgctgagcctgtacggccacacctacgccgagaaggtgaccgagaagccccccagagccaccgccagcggcaaggtgagccccgaccacctggaccccgagagagccatgctggccctgttcagcaaccccaaccccgccgaggcctggaaggtggcctacttctactgcctgagcaacaacaagcacttcctggagcagatcctggtgaccgccctgaccctgctgaaggaggaggacttccccaacctgggctgcctgctggacagagagttcagacccctgagctgcctgctggtgctgctgggctggacccactgccagagcctggagagcgccaagagactgctgcagaccctgcacagaacccagggccccggctgcgacgagctgctgagagacgcctgcgacggcctgtgggcccacctggaggtgctggagtggtgcatccagcagagcagcaaccccatccccaagagagacctgctgtaccacctgcacggcggcgacagccacagcgtgctgtacaccctgcaccacctgaccaacctgcccgccctgagagaggaggacgtgctgaagctgctgcagaaggtgcccgccaaggacccccagcaggagcccgacgccgtggacgcccccgtgcccgagcacctgagccagtgccagaacctgaccctgtaccagggcttctgcgccatgaagtacgccatctacgccctgtgcgtgaacagccaccagcacagccagtgccaggactgcaaggacagcctgagcgaggacctggccagcgccaccgagcccgccaacgacagcctgagcagccccggcgccgccaacctgttcagcacctacctggccagatgccagcagtacctgtgcagcatccccgacagcctgtgcctggagctgctggagaacatcttcagcctgctgctgatcaccagcgccgacctgcaccccgagccccacctgcccgaggactacgccgaggacgacgacatcgagggcaagagccccagcggcctgagaagccccagcgagagcccccagcacatcgcccaccccgagagaaagagcgagagaggcagcctgggcgtgcccaagaccctggcctacaccatgcccagccacgtgaaggccgagcccaaggacagctaccccggcccccacagacacagcttcctggacctgaagcacttcaccagcggcatcagcggcttcctggccgacgagttcgccatcggcgccttcctgagactgctgcaggagcagctggacgagatcagcagcagaagcccccccgagaagcccaagcaggagagccagagctgcagcggcagcagagacggcctgcagagcagactgcacagactgagcaaggtggtgagcgaggcccagtggagacacaaggtggtgaccagcaaccacagaagcgaggagcagcccagcagaagataccagcccgccaccagacaccccagcctgagaagaggcagaagaaccagaagaagccaggccgacggcagagacagaggcagcaaccccagcctggagagcaccagcagcgagctgagcaccagcaccagcgagggcagcctgagcgccatgagcggcagaaacgagctgcacagcagactgcacccccacccccagagcagcctgatccccatgatgttcagcccccccgagagcctgctggccagctgcatcctgagaggcaacttcgccgaggcccaccaggtgctgttcaccttcaacctgaagagcagccccagcagcggcgagctgatgttcatggagagataccaggaggtgatccaggagctggcccaggtggagcacaagatcgagaaccagaacagcgacgccggcagcagcaccatcagaagaaccggcagcggcagaagcaccctgcaggccatcggcagcgccgccgccgccggcatggtgttctacagcatcagcgacgtgaccgacaagctgctgaacaccagcggcgaccccatccccatgctgcaggaggacttctggatcagcaccgccctggtggagcccaccgcccccctgagagaggtgctggaggacctgagcccccccgccatggccgccttcgacctggcctgcagccagtgccagctgtggaagacctgcaagcagctgctggagaccgccgagagaagactgaacagcagcctggagagaagaggcagaagaatcgaccacgtgctgctgaacgccgacggcatcagaggcttccccgtggtgctgcagcagatcagcaagagcctgaactacctgctgatgagcgccagccagaccaagagcgagagcgtggaggagaagggcggcggcccccccagatgcagcatcaccgagctgctgcagatgtgctggcccagcctgagcgaggactgcgtggccagccacaccaccctgagccagcagctggaccaggtgctgcagagcctgagagaggccctggagctgcccgagcccagaaccccccccctgagcagcctggtggagcaggccgcccagaaggcccccgaggccgaggcccaccccgtgcagatccagacccagctgctgcagaagaacctgggcaagcagacccccagcggcagcagacagatggactacctgggcaccttcttcagctactgcagcaccctggccgccgtgctgctgcagagcctgagcagcgagcccgaccacgtggaggtgaaggtgggcaaccccttcgtgctgctgcagcagagcagcagccagctggtgagccacctgctgttcgagagacaggtgccccccgagagactggccgccctgctggcccaggagaacctgagcctgagcgtgccccaggtgatcgtgagctgctgctgcgagcccctggccctgtgcagcagcagacagagccagcagaccagcagcctgctgaccagactgggcaccctggcccagctgcacgccagccactgcctggacgacctgcccctgagcacccccagcagccccagaaccaccgagaaccccaccctggagagaaagccctacagcagccccagagacagcagcctgcccgccctgaccagcagcgccctggccttcctgaagagcagaagcaagctgctggccaccgtggcctgcctgggcgccagccccagactgaaggtgagcaagcccagcctgagctggaaggagctgagaggcagaagagaggtgcccctggccgccgagcaggtggccagagagtgcgagagactgctggagcagttccccctgttcgaggccttcctgctggccgcctgggagcccctgagaggcagcctgcagcagggccagagcctggccgtgaacctgtgcggctgggccagcctgagcaccgtgctgctgggcctgcacagccccatcgccctggacgtgctgagcgaggccttcgaggagagcctggtggccagagactggagcagagccctgcagctgaccgaggtgtacggcagagacgtggacgacctgagcagcatcaaggacgccgtgctgagctgcgccgtggcctgcgacaaggagggctggcagtacctgttccccgtgaaggacgccagcctgagaagcagactggccctgcagttcgtggacagatggcccctggagagctgcctggagatcctggcctactgcatcagcgacaccgccgtgcaggagggcctgaagtgcgagctgcagagaaagctggccgagctgcaggtgtaccagaagatcctgggcctgcagagcccccccgtgtggtgcgactggcagaccctgagaagctgctgcgtggaggaccccagcaccgtgatgaacatgatcctggaggcccaggagtacgagctgtgcgaggagtggggctgcctgtaccccatccccagagagcacctgatcagcctgcaccagaagcacctgctgcacctgctggagagaagagaccacgacaaggccctgcagctgctgagaagaatccccgaccccaccatgtgcctggaggtgaccgagcagagcctggaccagcacaccagcctggccaccagccacttcctggccaactacctgaccacccacttctacggccagctgaccgccgtgagacacagagagatccaggccctgtacgtgggcagcaagatcctgctgaccctgcccgagcagcacagagccagctacagccacctgagcagcaaccccctgttcatgctggagcagctgctgatgaacatgaaggtggactgggccaccgtggccgtgcagaccctgcagcagctgctggtgggccaggagatcggcttcaccatggacgaggtggacagcctgctgagcagatacgccgagaaggccctggacttcccctacccccagagagagaagagaagcgacagcgtgatccacctgcaggagatcgtgcaccaggccgccgaccccgagaccctgcccagaagccccagcgccgagttcagccccgccgccccccccggcatcagcagcatccacagccccagcctgagagagagaagcttcccccccacccagcccagccaggagttcgtgccccccgccaccccccccgccagacaccagtgggtgcccgacgagaccgagagcatctgcatggtgtgctgcagagagcacttcaccatgttcaacagaagacaccactgcagaagatgcggcagactggtgtgcagcagctgcagcaccaagaagatggtggtggagggctgcagagagaaccccgccagagtgtgcgaccagtgctacagctactgcaacaaggacgtgcccgaggagcccagcgagaagcccgaggccctggacagcagcaagaacgagagccccccctacagcttcgtggtgagagtgcccaaggccgacgaggtggagtggatcctggacctgaaggaggaggagaacgagctggtgagaagcgagttctactacgagcaggcccccagcgccagcctgtgcatcgccatcctgaacctgcacagagacagcatcgcctgcggccaccagctgatcgagcactgctgcagactgagcaagggcctgaccaaccccgaggtggacgccggcctgctgaccgacatcatgaagcagctgctgttcagcgccaagatgatgttcgtgaaggccggccagagccaggacctggccctgtgcgacagctacatcagcaaggtggacgtgctgaacatcctggtggccgccgcctacagacacgtgcccagcctggaccagatcctgcagcccgccgccgtgaccagactgagaaaccagctgctggaggccgagtactaccagctgggcgtggaggtgagcaccaagaccggcctggacaccaccggcgcctggcacgcctggggcatggcctgcctgaaggccggcaacctgaccgccgccagagagaagttcagcagatgcctgaagccccccttcgacctgaaccagctgaaccacggcagcagactggtgcaggacgtggtggagtacctggagagcaccgtgagacccttcgtgagcctgcaggacgacgactacttcgccaccctgagagagctggaggccaccctgagaacccagagcctgagcctggccgtgatccccgagggcaagatcatgaacaacacctactaccaggagtgcctgttctacctgcacaactacagcaccaacctggccatcatcagcttctacgtgagacacagctgcctgagagaggccctgctgcacctgctgaacaaggagagcccccccgaggtgttcatcgagggcatcttccagcccagctacaagagcggcaagctgcacaccctggagaacctgctggagagcatcgaccccaccctggagagctggggcaagtacctgatcgccgcctgccagcacctgcagaagaagaactactaccacatcctgtacgagctgcagcagttcatgaaggaccaggtgagagccgccatgacctgcatcagattcttcagccacaaggccaagagctacaccgagctgggcgagaagctgagctggctgctgaaggccaaggaccacctgaagatctacctgcaggagaccagcagaagcagcggcagaaagaagaccaccttcttcagaaagaagatgaccgccgccgacgtgagcagacacatgaacaccctgcagctgcagatggaggtgaccagattcctgcacagatgcgagagcgccggcaccagccagatcaccaccctgcccctgcccaccctgttcggcaacaaccacatgaagatggacgtggcctgcaaggtgatgctgggcggcaagaacgtggaggacggcttcggcatcgccttcagagtgctgcaggacttccagctggacgccgccatgacctactgcagagccgccagacagctggtggagaaggagaagtacagcgagatccagcagctgctgaagtgcgtgagcgagagcggcatggccgccaagagcgacggcgacaccatcctgctgaactgcctggaggccttcaagagaatccccccccaggagctggagggcctgatccaggccatccacaacgacgacaacaaggtgagagcctacctgatctgctgcaagctgagaagcgcctacctgatcgccgtgaagcaggagcacagcagagccaccgccctggtgcagcaggtgcagcaggccgccaagagcagcggcgacgccgtggtgcaggacatctgcgcccagtggctgctgaccagccaccccagaggcgcccacggccccggcagcagaaagtag

SEQ ID NO: 106330 - DNA, 7557 bp, Artificial Sequence
  Description of Artificial Sequence: Synthetic coding sequence
atgaaccaccccttcggcaaggaggaggccgccagccagaagcagctgttcggcttcttctgcgagtgcctgagaagaggcgagtgggagctggcccaggcctgcgtgccccagctgcaggagggccagggcgacatccccaagagagtggaggacatcctgcaggccctggtggtgtgccccaacctgctgagatgcggccaggacatcaacccccagagagtggcctgggtgtggctgctggtgctggagaagtggctggccagagagaagaagctgctgcccgtggtgttcagaagaaagctggagttcctgctgctgagcgaggacctgcagggcgacatccccgagaacatcctggaggagctgtacgagaccctgacccagggcgccgtgggccacgtgcccgacggcaaccccagaagagagagctggacccccagactgagcagcgaggccgtgagcgtgctgtgggacctgctgagacagagcccccagcccgcccaggccctgctggagctgctgctggaggaggacgacggcaccggcctgtgccactggcccctgcagaacgccctggtggacctgatcagaaaggccctgagaaccctgagatgccccgccgagcccctgggcgtggagctgcacctgctgtgcgaggagctgctggaggcctgcagaaccgagggcagccccctgagagaggagagactgctgagctgcctgctgcacaaggccagcagaggcctgctgagcctgtacggccacacctacgccgagaaggtgaccgagaagccccccagagccaccgccagcggcaaggtgagccccgaccacctggaccccgagagagccatgctggccctgttcagcaaccccaaccccgccgaggcctggaaggtggcctacttctactgcctgagcaacaacaagcacttcctggagcagatcctggtgaccgccctgaccctgctgaaggaggaggacttccccaacctgggctgcctgctggacagagagttcagacccctgagctgcctgctggtgctgctgggctggacccactgccagagcctggagagcgccaagagactgctgcagaccctgcacagaacccagggccccggctgcgacgagctgctgagagacgcctgcgacggcctgtgggcccacctggaggtgctggagtggtgcatccagcagagcagcaaccccatccccaagagagacctgctgtaccacctgcacggcggcgacagccacagcgtgctgtacaccctgcaccacctgaccaacctgcccgccctgagagaggaggacgtgctgaagctgctgcagaaggtgcccgccaaggacccccagcaggagcccgacgccgtggacgcccccgtgcccgagcacctgagccagtgccagaacctgaccctgtaccagggcttctgcgccatgaagtacgccatctacgccctgtgcgtgaacagccaccagcacagccagtgccaggactgcaaggacagcctgagcgaggacctggccagcgccaccgagcccgccaacgacagcctgagcagccccggcgccgccaacctgttcagcacctacctggccagatgccagcagtacctgtgcagcatccccgacagcctgtgcctggagctgctggagaacatcttcagcctgctgctgatcaccagcgccgacctgcaccccgagccccacctgcccgaggactacgccgaggacgacgacatcgagggcaagagccccagcggcctgagaagccccagcgagagcccccagcacatcgcccaccccgagagaaagagcgagagaggcagcctgggcgtgcccaagaccctggcctacaccatgcccagccacgtgaaggccgagcccaaggacagctaccccggcccccacagacacagcttcctggacctgaagcacttcaccagcggcatcagcggcttcctggccgacgagttcgccatcggcgccttcctgagactgctgcaggagcagctggacgagatcagcagcagaagcccccccgagaagcccaagcaggagagccagagctgcagcggcagcagagacggcctgcagagcagactgcacagactgagcaaggtggtgagcgaggcccagtggagacacaaggtggtgaccagcaaccacagaagcgaggagcagcccagcagaagataccagcccgccaccagacaccccagcctgagaagaggcagaagaaccagaagaagccaggccgacggcagagacagaggcagcaaccccagcctggagagcaccagcagcgagctgagcaccagcaccagcgagggcagcctgagcgccatgagcggcagaaacgagctgcacagcagactgcacccccacccccagagcagcctgatccccatgatgttcagcccccccgagagcctgctggccagctgcatcctgagaggcaacttcgccgaggcccaccaggtgctgttcaccttcaacctgaagagcagccccagcagcggcgagctgatgttcatggagagataccaggaggtgatccaggagctggcccaggtggagcacaagatcgagaaccagaacagcgacgccggcagcagcaccatcagaagaaccggcagcggcagaagcaccctgcaggccatcggcagcgccgccgccgccggcatggtgttctacagcatcagcgacgtgaccgacaagctgctgaacaccagcggcgaccccatccccatgctgcaggaggacttctggatcagcaccgccctggtggagcccaccgcccccctgagagaggtgctggaggacctgagcccccccgccatggccgccttcgacctggcctgcagccagtgccagctgtggaagacctgcaagcagctgctggagaccgccgagagaagactgaacagcagcctggagagaagaggcagaagaatcgaccacgtgctgctgaacgccgacggcatcagaggcttccccgtggtgctgcagcagatcagcaagagcctgaactacctgctgatgagcgccagccagaccaagagcgagagcgtggaggagaagggcggcggcccccccagatgcagcatcaccgagctgctgcagatgtgctggcccagcctgagcgaggactgcgtggccagccacaccaccctgagccagcagctggaccaggtgctgcagagcctgagagaggccctggagctgcccgagcccagaaccccccccctgagcagcctggtggagcaggccgcccagaaggcccccgaggccgaggcccaccccgtgcagatccagacccagctgctgcagaagaacctgggcaagcagacccccagcggcagcagacagatggactacctgggcaccttcttcagctactgcagcaccctggccgccgtgctgctgcagagcctgagcagcgagcccgaccacgtggaggtgaaggtgggcaaccccttcgtgctgctgcagcagagcagcagccagctggtgagccacctgctgttcgagagacaggtgccccccgagagactggccgccctgctggcccaggagaacctgagcctgagcgtgccccaggtgatcgtgagctgctgctgcgagcccctggccctgtgcagcagcagacagagccagcagaccagcagcctgctgaccagactgggcaccctggcccagctgcacgccagccactgcctggacgacctgcccctgagcacccccagcagccccagaaccaccgagaaccccaccctggagagaaagccctacagcagccccagagacagcagcctgcccgccctgaccagcagcgccctggccttcctgaagagcagaagcaagctgctggccaccgtggcctgcctgggcgccagccccagactgaaggtgagcaagcccagcctgagctggaaggagctgagaggcagaagagaggtgcccctggccgccgagcaggtggccagagagtgcgagagactgctggagcagttccccctgttcgaggccttcctgctggccgcctgggagcccctgagaggcagcctgcagcagggccagagcctggccgtgaacctgtgcggctgggccagcctgagcaccgtgctgctgggcctgcacagccccatcgccctggacgtgctgagcgaggccttcgaggagagcctggtggccagagactggagcagagccctgcagctgaccgaggtgtacggcagagacgtggacgacctgagcagcatcaaggacgccgtgctgagctgcgccgtggcctgcgacaaggagggctggcagtacctgttccccgtgaaggacgccagcctgagaagcagactggccctgcagttcgtggacagatggcccctggagagctgcctggagatcctggcctactgcatcagcgacaccgccgtgcaggagggcctgaagtgcgagctgcagagaaagctggccgagctgcaggtgtaccagaagatcctgggcctgcagagcccccccgtgtggtgcgactggcagaccctgagaagctgctgcgtggaggaccccagcaccgtgatgaacatgatcctggaggcccaggagtacgagctgtgcgaggagtggggctgcctgtaccccatccccagagagcacctgatcagcctgcaccagaagcacctgctgcacctgctggagagaagagaccacgacaaggccctgcagctgctgagaagaatccccgaccccaccatgtgcctggaggtgaccgagcagagcctggaccagcacaccagcctggccaccagccacttcctggccaactacctgaccacccacttctacggccagctgaccgccgtgagacacagagagatccaggccctgtacgtgggcagcaagatcctgctgaccctgcccgagcagcacagagccagctacagccacctgagcagcaaccccctgttcatgctggagcagctgctgatgaacatgaaggtggactgggccaccgtggccgtgcagaccctgcagcagctgctggtgggccaggagatcggcttcaccatggacgaggtggacagcctgctgagcagatacgccgagaaggccctggacttcccctacccccagagagagaagagaagcgacagcgtgatccacctgcaggagatcgtgcaccaggccgccgaccccgagaccctgcccagaagccccagcgccgagttcagccccgccgccccccccggcatcagcagcatccacagccccagcctgagagagagaagcttcccccccacccagcccagccaggagttcgtgccccccgccaccccccccgccagacaccagtgggtgcccgacgagaccgagagcatctgcatggtgtgctgcagagagcacttcaccatgttcaacagaagacaccactgcagaagatgcggcagactggtgtgcagcagctgcagcaccaagaagatggtggtggagggctgcagagagaaccccgccagagtgtgcgaccagtgctacagctactgcaacaaggacgtgcccgaggagcccagcgagaagcccgaggccctggacagcagcaagaacgagagccccccctacagcttcgtggtgagagtgcccaaggccgacgaggtggagtggatcctggacctgaaggaggaggagaacgagctggtgagaagcgagttctactacgagcaggcccccagcgccagcctgtgcatcgccatcctgaacctgcacagagacagcatcgcctgcggccaccagctgatcgagcactgctgcagactgagcaagggcctgaccaaccccgaggtggacgccggcctgctgaccgacatcatgaagcagctgctgttcagcgccaagatgatgttcgtgaaggccggccagagccaggacctggccctgtgcgacagctacatcagcaaggtggacgtgctgaacatcctggtggccgccgcctacagacacgtgcccagcctggaccagatcctgcagcccgccgccgtgaccagactgagaaaccagctgctggaggccgagtactaccagctgggcgtggaggtgagcaccaagaccggcctggacaccaccggcgcctggcacgcctggggcatggcctgcctgaaggccggcaacctgaccgccgccagagagaagttcagcagatgcctgaagccccccttcgacctgaaccagctgaaccacggcagcagactggtgcaggacgtggtggagtacctggagagcaccgtgagacccttcgtgagcctgcaggacgacgactacttcgccaccctgagagagctggaggccaccctgagaacccagagcctgagcctggccgtgatccccgagggcaagatcatgaacaacacctactaccaggagtgcctgttctacctgcacaactacagcaccaacctggccatcatcagcttctacgtgagacacagctgcctgagagaggccctgctgcacctgctgaacaaggagagcccccccgaggtgttcatcgagggcatcttccagcccagctacaagagcggcaagctgcacaccctggagaacctgctggagagcatcgaccccaccctggagagctggggcaagtacctgatcgccgcctgccagcacctgcagaagaagaactactaccacatcctgtacgagctgcagcagttcatgaaggaccaggtgagagccgccatgacctgcatcagattcttcagccacaaggccaagagctacaccgagctgggcgagaagctgagctggctgctgaaggccaaggaccacctgaagatctacctgcaggagaccagcagaagcagcggcagaaagaagaccaccttcttcagaaagaagatgaccgccgccgacgtgagcagacacatgaacaccctgcagctgcagatggaggtgaccagattcctgcacagatgcgagagcgccggcaccagccagatcaccaccctgcccctgcccaccctgttcggcaacaaccacatgaagatggacgtggcctgcaaggtgatgctgggcggcaagaacgtggaggacggcttcggcatcgccttcagagtgctgcaggacttccagctggacgccgccatgacctactgcagagccgccagacagctggtggagaaggagaagtacagcgagatccagcagctgctgaagtgcgtgagcgagagcggcatggccgccaagagcgacggcgacaccatcctgctgaactgcctggaggccttcaagagaatccccccccaggagctggagggcctgatccaggccatccacaacgacgacaacaaggtgagagcctacctgatctgctgcaagctgagaagcgcctacctgatcgccgtgaagcaggagcacagcagagccaccgccctggtgcagcaggtgcagcaggccgccaagagcagcggcgacgccgtggtgcaggacatctgcgcccagtggctgctgaccagccaccccagaggcgcccacggccccggcagcagaaagtag

SEQ ID NO: 106331 - DNA, 1119 bp, Artificial Sequence
  Description of Artificial Sequence: Synthetic coding sequence
atgcagaccagcgagagagagggcagcggccccgagctgagccccagcgtgatgcccgaggcccccctggagagcccccccttccccaccaagagccccgccttcgacctgttcaacctggtgctgagctacaagagactggagatctacctggagcccctgaaggacgccggcgcctggtacagcgtgggcgccctgatgatcagcgtgcccgccctgctgggctacctgcaggaggtgtgcagagccagactgcccgacagcgagctgatgagaagaaagtaccacagcgtgagacaggaggacctgcagagaggcagactgagcagacccgaggccgtggccgaggtgaagagcttcctgatccagctggaggccttcctgagcagactgtgctgcacctgcgaggccgcctacagagtgctgcactgggagaaccccgtggtgagcagccagttctacggcgccctgctgggcaccgtgtgcatgctgtacctgctgcccctgtgctgggtgctgaccctgctgaacagcaccctgttcctgggcaacgtggagttcttcagagtggtgagcgagtacagagccagcctgcagcagagaatgaaccccaagcaggaggagcacgccttcgagagcccccccccccccgacgtgggcggcaaggacggcctgatggacagcacccccgccctgacccccaccgaggacctgacccccggcagcgtggaggaggccgaggaggccgagcccgacgaggagttcaaggacgccatcgaggaggacgacgagggcgccccctgccccgccgaggacgagctggccctgcaggacaacggcttcctgagcaagaacgaggtgctgagaagcaaggtgagcagactgaccgagagactgagaaagagataccccaccaacaacttcggcaactgcaccggctgcagcgccaccttcagcgtgctgaagaagagaagaagctgcagcaactgcggcaacagcttctgcagcagatgctgcagcttcaaggtgcccaagagcagcatgggcgccaccgcccccgaggcccagagagagaccgtgttcgtgtgcgccagctgcaaccagaccctgagcaagtag

SEQ ID NO: 106332 - DNA, 1251 bp, Artificial Sequence
  Description of Artificial Sequence: Synthetic coding sequence
atgcagaccagcgagagagagggcagcggccccgagctgagccccagcgtgatgcccgaggcccccctggagagcccccccttccccaccaagagccccgccttcgacctgttcaacctggtgctgagctacaagagactggagatctacctggagcccctgaaggacgccggcgacggcgtgagatacctgctgagatggcagatgcccctgtgcagcctgctgacctgcctgggcctgaacgtgctgttcctgaccctgaacgagggcgcctggtacagcgtgggcgccctgatgatcagcgtgcccgccctgctgggctacctgcaggaggtgtgcagagccagactgcccgacagcgagctgatgagaagaaagtaccacagcgtgagacaggaggacctgcagagaggcagactgagcagacccgaggccgtggccgaggtgaagagcttcctgatccagctggaggccttcctgagcagactgtgctgcacctgcgaggccgcctacagagtgctgcactgggagaaccccgtggtgagcagccagttctacggcgccctgctgggcaccgtgtgcatgctgtacctgctgcccctgtgctgggtgctgaccctgctgaacagcaccctgttcctgggcaacgtggagttcttcagagtggtgagcgagtacagagccagcctgcagcagagaatgaaccccaagcaggaggagcacgccttcgagagcccccccccccccgacgtgggcggcaaggacggcctgatggacagcacccccgccctgacccccaccgagagcctgagcagccaggacctgacccccggcagcgtggaggaggccgaggaggccgagcccgacgaggagttcaaggacgccatcgaggagacccacctggtggtgctggaggacgacgagggcgccccctgccccgccgaggacgagctggccctgcaggacaacggcttcctgagcaagaacgaggtgctgagaagcaaggtgagcagactgaccgagagactgagaaagagataccccaccaacaacttcggcaactgcaccggctgcagcgccaccttcagcgtgctgaagaagagaagaagctgcagcaactgcggcaacagcttctgcagcagatgctgcagcttcaaggtgcccaagagcagcatgggcgccaccgcccccgaggcccagagagagaccgtgttcgtgtgcgccagctgcaaccagaccctgagcaagtag

SEQ ID NO: 106333 - DNA, 957 bp, Artificial Sequence
  Description of Artificial Sequence: Synthetic coding sequence
atgcagaccagcgagagagagggcagcggccccgagctgagccccagcgtgatgcccgaggcccccctggagagcccccccttccccaccaagagccccgccttcgacctgttcaacctggtgctgagctacaagagactggagatctacctggagcccctgaaggacgccggcgacggcgtgagatacctgctgagcctgatccagctggaggccttcctgagcagactgtgctgcacctgcgaggccgcctacagagtgctgcactgggagaaccccgtggtgagcagccagttctacggcgccctgctgggcaccgtgtgcatgctgtacctgctgcccctgtgctgggtgctgaccctgctgaacagcaccctgttcctgggcaacgtggagttcttcagagtggtgagcgagtacagagccagcctgcagcagagaatgaaccccaagcaggaggagcacgccttcgagagcccccccccccccgacgtgggcggcaaggacggcctgatggacagcacccccgccctgacccccaccgaggacctgacccccggcagcgtggaggaggccgaggaggccgagcccgacgaggagttcaaggacgccatcgaggaggacgacgagggcgccccctgccccgccgaggacgagctggccctgcaggacaacggcttcctgagcaagaacgaggtgctgagaagcaaggtgagcagactgaccgagagactgagaaagagataccccaccaacaacttcggcaactgcaccggctgcagcgccaccttcagcgtgctgaagaagagaagaagctgcagcaactgcggcaacagcttctgcagcagatgctgcagcttcaaggtgcccaagagcagcatgggcgccaccgcccccgaggcccagagagagaccgtgttcgtgtgcgccagctgcaaccagaccctgagcaagtag

SEQ ID NO: 106334 - DNA, 1215 bp, Artificial Sequence
  Description of Artificial Sequence: Synthetic coding sequence
atgcagaccagcgagagagagggcagcggccccgagctgagccccagcgtgatgcccgaggcccccctggagagcccccccttccccaccaagagccccgccttcgacctgttcaacctggtgctgagctacaagagactggagatctacctggagcccctgaaggacgccggcgacggcgtgagatacctgctgagatggcagatgcccctgtgcagcctgctgacctgcctgggcctgaacgtgctgttcctgaccctgaacgagggcgcctggtacagcgtgggcgccctgatgatcagcgtgcccgccctgctgggctacctgcaggaggtgtgcagagccagactgcccgacagcgagctgatgagaagaaagtaccacagcgtgagacaggaggacctgcagagaggcagactgagcagacccgaggccgtggccgaggtgaagagcttcctgatccagctggaggccttcctgagcagactgtgctgcacctgcgaggccgcctacagagtgctgcactgggagaaccccgtggtgagcagccagttctacggcgccctgctgggcaccgtgtgcatgctgtacctgctgcccctgtgctgggtgctgaccctgctgaacagcaccctgttcctgggcaacgtggagttcttcagagtggtgagcgagtacagagccagcctgcagcagagaatgaaccccaagcaggaggagcacgccttcgagagcccccccccccccgacgtgggcggcaaggacggcctgatggacagcacccccgccctgacccccaccgaggacctgacccccggcagcgtggaggaggccgaggaggccgagcccgacgaggagttcaaggacgccatcgaggaggacgacgagggcgccccctgccccgccgaggacgagctggccctgcaggacaacggcttcctgagcaagaacgaggtgctgagaagcaaggtgagcagactgaccgagagactgagaaagagataccccaccaacaacttcggcaactgcaccggctgcagcgccaccttcagcgtgctgaagaagagaagaagctgcagcaactgcggcaacagcttctgcagcagatgctgcagcttcaaggtgcccaagagcagcatgggcgccaccgcccccgaggcccagagagagaccgtgttcgtgtgcgccagctgcaaccagaccctgagcaagtag

SEQ ID NO: 106335 - DNA, 936 bp, Artificial Sequence
  Description of Artificial Sequence: Synthetic coding sequence
atgatcagcgtgcccgccctgctgggctacctgcaggaggtgtgcagagccagactgcccgacagcgagctgatgagaagaaagtaccacagcgtgagacaggaggacctgcagagaggcagactgagcagacccgaggccgtggccgaggtgaagagcttcctgatccagctggaggccttcctgagcagactgtgctgcacctgcgaggccgcctacagagtgctgcactgggagaaccccgtggtgagcagccagttctacggcgccctgctgggcaccgtgtgcatgctgtacctgctgcccctgtgctgggtgctgaccctgctgaacagcaccctgttcctgggcaacgtggagttcttcagagtggtgagcgagtacagagccagcctgcagcagagaatgaaccccaagcaggaggagcacgccttcgagagcccccccccccccgacgtgggcggcaaggacggcctgatggacagcacccccgccctgacccccaccgagagcctgagcagccaggacctgacccccggcagcgtggaggaggccgaggaggccgagcccgacgaggagttcaaggacgccatcgaggaggacgacgagggcgccccctgccccgccgaggacgagctggccctgcaggacaacggcttcctgagcaagaacgaggtgctgagaagcaaggtgagcagactgaccgagagactgagaaagagataccccaccaacaacttcggcaactgcaccggctgcagcgccaccttcagcgtgctgaagaagagaagaagctgcagcaactgcggcaacagcttctgcagcagatgctgcagcttcaaggtgcccaagagcagcatgggcgccaccgcccccgaggcccagagagagaccgtgttcgtgtgcgccagctgcaaccagaccctgagcaagtag

SEQ ID NO: 106336 - DNA, 861 bp, Artificial Sequence
  Description of Artificial Sequence: Synthetic coding sequence
atgcagaccagcgagagagagggcagcggccccgagctgagccccagcgtgatgcccgaggcccccctggagagcccccccttccccaccaagagccccgccttcgacctgttcaacctggtgctgagctacaagagactggagatctacctggagcccctgaaggacgccggcgacggcgtgagatacctgctgagattctacggcgccctgctgggcaccgtgtgcatgctgtacctgctgcccctgtgctgggtgctgaccctgctgaacagcaccctgttcctgggcaacgtggagttcttcagagtggtgagcgagtacagagccagcctgcagcagagaatgaaccccaagcaggaggagcacgccttcgagagcccccccccccccgacgtgggcggcaaggacggcctgatggacagcacccccgccctgacccccaccgaggacctgacccccggcagcgtggaggaggccgaggaggccgagcccgacgaggagttcaaggacgccatcgaggaggacgacgagggcgccccctgccccgccgaggacgagctggccctgcaggacaacggcttcctgagcaagaacgaggtgctgagaagcaaggtgagcagactgaccgagagactgagaaagagataccccaccaacaacttcggcaactgcaccggctgcagcgccaccttcagcgtgctgaagaagagaagaagctgcagcaactgcggcaacagcttctgcagcagatgctgcagcttcaaggtgcccaagagcagcatgggcgccaccgcccccgaggcccagagagagaccgtgttcgtgtgcgccagctgcaaccagaccctgagcaagtag

SEQ ID NO: 106337 - DNA, 1236 bp, Artificial Sequence
  Description of Artificial Sequence: Synthetic coding sequence
atgcagaccagcgagagagagggcagcggccccgagctgagccccagcgtgatgcccgaggcccccctggagagcccccccttccccaccaagagccccgccttcgacctgttcaacctggtgctgagctacaagagactggagatctacctggagcccctgaaggacgccggcgacggcgtgagatacctgctgagatggcagatgcccctgtgcagcctgctgacctgcctgggcctgaacgtgctgttcctgaccctgaacgagggcgcctggtacagcgtgggcgccctgatgatcagcgtgcccgccctgctgggctacctgcaggaggtgtgcagagccagactgcccgacagcgagctgatgagaagaaagtaccacagcgtgagacaggaggacctgcagagaggcagactgagcagacccgaggccgtggccgaggtgaagagcttcctgatccagctggaggccttcctgagcagactgtgctgcacctgcgaggccgcctacagagtgctgcactgggagaaccccgtggtgagcagccagttctacggcgccctgctgggcaccgtgtgcatgctgtacctgctgcccctgtgctgggtgctgaccctgctgaacagcaccctgttcctgggcaacgtggagttcttcagagtggtgagcgagtacagagccagcctgcagcagagaatgaaccccaagcaggaggagcacgccttcgagagcccccccccccccgacgtgggcggcaaggacggcctgatggacagcacccccgccctgacccccaccgaggacctgacccccggcagcgtggaggaggccgaggaggccgagcccgacgaggagttcaaggacgccatcgaggagacccacctggtggtgctggaggacgacgagggcgccccctgccccgccgaggacgagctggccctgcaggacaacggcttcctgagcaagaacgaggtgctgagaagcaaggtgagcagactgaccgagagactgagaaagagataccccaccaacaacttcggcaactgcaccggctgcagcgccaccttcagcgtgctgaagaagagaagaagctgcagcaactgcggcaacagcttctgcagcagatgctgcagcttcaaggtgcccaagagcagcatgggcgccaccgcccccgaggcccagagagagaccgtgttcgtgtgcgccagctgcaaccagaccctgagcaagtag

SEQ ID NO: 106338 - DNA, 1185 bp, Artificial Sequence
  Description of Artificial Sequence: Synthetic coding sequence
ctggagagcccccccttccccaccaagagccccgccttcgacctgttcaacctggtgctgagctacaagagactggagatctacctggagcccctgaaggacgccggcgacggcgtgagatacctgctgagatggcagatgcccctgtgcagcctgctgacctgcctgggcctgaacgtgctgttcctgaccctgaacgagggcgcctggtacagcgtgggcgccctgatgatcagcgtgcccgccctgctgggctacctgcaggaggtgtgcagagccagactgcccgacagcgagctgatgagaagaaagtaccacagcgtgagacaggaggacctgcagagaggcagactgagcagacccgaggccgtggccgaggtgaagagcttcctgatccagctggaggccttcctgagcagactgtgctgcacctgcgaggccgcctacagagtgctgcactgggagaaccccgtggtgagcagccagttctacggcgccctgctgggcaccgtgtgcatgctgtacctgctgcccctgtgctgggtgctgaccctgctgaacagcaccctgttcctgggcaacgtggagttcttcagagtggtgagcgagtacagagccagcctgcagcagagaatgaaccccaagcaggaggagcacgccttcgagagcccccccccccccgacgtgggcggcaaggacggcctgatggacagcacccccgccctgacccccaccgagagcctgagcagccaggacctgacccccggcagcgtggaggaggccgaggaggccgagcccgacgaggagttcaaggacgccatcgaggagacccacctggtggtgctggaggacgacgagggcgccccctgccccgccgaggacgagctggccctgcaggacaacggcttcctgagcaagaacgaggtgctgagaagcaaggtgagcagactgaccgagagactgagaaagagataccccaccaacaacttcggcaactgcaccggctgcagcgccaccttcagcgtgctgaagaagagaagaagctgcagcaactgcggcaacagcttctgcagcagatgctgcagcttcaaggtgcccaagagcagcatgggcgccaccgcccccgaggcccagagagagaccgtgttcgtgtgcgccagctgcaaccagaccctgagcaagtag

SEQ ID NO: 106339 - DNA, 1047 bp, Artificial Sequence
  Description of Artificial Sequence: Synthetic coding sequence
atgcagaccagcgagagagagggcagcggccccgagctgagccccagcgtgatgcccgaggcccccctggagagcccccccttccccaccaagagccccgccttcgacctgttcaacctggtgctgagctacaagagactggagatctacctggagcccctgaaggacgccggcgacggcgtgagatacctgctgagatggcagatgcccctgtgcagcctgctgacctgcctgggcctgaacgtgctgttcctgaccctgaacgagggcgcctggtacagcgtgggcgccctgatgatcagcgtgcccgccctgctgggctacctgcaggaggtgtgcagagccagactgcccgacagcgagctgatgagaagaaagtaccacagcgtgagacaggaggacctgcagagaggcagactgagcagacccgaggccgtggccgaggtgaagagcttcctgatccagctggaggccttcctgagcagactgtgctgcacctgcgaggccgcctacagagtgctgcactgggagaaccccgtggtgagcagccagttctacggcgccctgctgggcaccgtgtgcatgctgtacctgctgcccctgtgctgggtgctgaccctgctgaacagcaccctgttcctgggcaacgtggagttcttcagagtggtgagcgagtacagagccagcctgcagcagagaatgaaccccaagcaggaggagcacgccttcgagagcccccccccccccgacgtgggcggcaaggacggcctgatggacagcacccccgccctgacccccaccgaggacctgacccccggcagcgtggaggaggccgaggaggccgagcccgacgaggagttcaaggacgccatcgaggaggacgacgagggcgccccctgccccgccgaggacgagctggccctgcaggacaacggcttcctgagcaagaacgaggtgctgagaagcaaggtgagcagactgaccgagagactgagaaagagataccccaccaacaacttcggcgtgaccggcgccggcagcagctag

SEQ ID NO: 106340 - DNA, 2664 bp, Artificial Sequence
  Description of Artificial Sequence: Synthetic coding sequence
atgatgaacagattcagaaagtggctgtacaagcccaagagaagcgacccccagctgctggccagattctactacgccgacgaggagctgaaccaggtggccgccgagctggacagcctggacggcagaaaggacccccagagatgcaccctgctggtgagccagttcagaagctgccaggacaacgtgctgaacatcatcaaccagatcatggacgagtgcatcccccaggacagagcccccagagacttctgcgtgaagttccccgaggagatcagacacgacaacctggccggccagctgtggttcggcgccgagtgcctggccgccggcagcatcatcatgaacagagagctggagagcatggccatgagacccctggccaaggagctgaccagaagcctggaggacgtgagaggcgccctgagagaccaggccctgagagacctgaacacctacaccgagaagatgagagaggccctgagacacttcgacgtgctgttcgccgagttcgagctgagctacgtgagcgccatggtgcccgtgaagagccccagagagtactacgtgcagcaggaggtgatcgtgctgttctgcgagaccgtggagagagccctggacttcggctacctgacccaggacatgatcgacgactacgagcccgccctgatgttcagcatccccagactggccatcgtgtgcggcctggtggtgtacgccgacggccccctgaacctggacagaaaggtggaggacatgagcgagctgttcagacccttccacaccctgctgagaaagatcagagacctgctgcagaccctgaccgaggaggagctgcacaccctggagagaaacctgtgcatcagccaggacgtggagttccccatcagagccgacgtgcagggccccgccgccctggcccccgccctgagcgcccccctgccccccgagggccccctgagcgccaaggccaaggaccccgacgccgagctggcctgcagcatgcagtacgacgaccaggagctggagcagctgagcagaatggtgcacagagccggcgacgagatgagcagcctgctgagcccccccatcgcctgccagagccccgcccacagacccggcgccgagggcagccccggcggcgaggccagccccggcagacccagactgagaagcggcagcgacgaggaggagagagtgttcttcatggacgacgtggagggcaccgccgaggccctggccagacccgagagccccgccggccccttcggctgggccggcagcacctgggccgacccccaggagaagggccagggcggccccggcggcgccgccggcatcagcctgcccgccagcgagaaggaggaggacctgagcaacaacaacctggaggccgagggcaccgacggcgccagcctggccggcaccagcagctgcagctgcctggacagcagactgcacctggacggctgggaggtgggcgccgacgacgccgagaccgccgagatgatcgcccacagaaccggcggcatgaagctgagcgccaccgtgatcttcaaccccaagagccccaccagcctggacagcgccgtggccacccaggaggccgccagcgagcccgtggccgagggcatggacggcggcccccacaagctgagcaccggcgccaccaactgcctgctgcacagctgcgtgtgctgcggcagctgcggcgacagcagagaggacgtggtggagagactgagagagaagtgcagccccggcggcgtgatcggcgccagctacgccgccggcctggccaaggccagcgacagagcccccgagagacaggaggaggcccccccccccagcgaggacgccagcaacggcagagagcccaaggcccccaccagcgacaagtgcctgccccacaccagcggcagccaggtggacaccgccagcggcctgcagggcgaggccggcgtggccggccagcaggagcccgaggccagagagctgcacgccggcagccccagcgcccacgaggccccccaggccctgagcggcagcagcagcagcaccgccggcagctgcagcagcgacaagatgggccccgaggccgcccccgccgccacccacgccgccccccaggccaccagagagaagatcagaagcagattccacggcagccacgacctgatccacagactgttcgtgtgcatcagcggcgtggccgaccagctgcagaccaactacgccagcgacctgagaagcatcctgaagaccctgttcgaggtgatggccaccaagcccgagaccgacgacaaggagaagctgagaaaggtgacccagaccctgagaagcgccgccctggaggactgcgccctgtgccaggagaccctgagcagcagcgagctggccgccaagaccagagacggcgacttcgaggacccccccgagtgggtgcccgacgaggcctgcggcttctgcaccgcctgcaaggcccccttcaccgtgatcagaagaaagcaccactgcagaagctgcggcaagatcttctgcagcagatgcagcagccacagcgcccccctgcccagatacggccaggtgaagcccgtgagagtgtgcacccactgctacatgttccacgtgacccccttctacagcgacaaggccggcctgtag

SEQ ID NO: 106341 - DNA, 2574 bp, Artificial Sequence
  Description of Artificial Sequence: Synthetic coding sequence
atgatgaacagattcagaaagtggctgtacaagcccaagagaagcgacccccagctgctggccagattctactacgccgacgaggagctgaaccaggtggccgccgagctggacagcctggacggcagaaaggacccccagagatgcaccctgctggtgagccagttcagaagctgccaggacaacgtgctgaacatcatcaaccagatcatggacgagtgcatcccccaggacagagcccccagagacttctgcgtgaagttccccgaggagatcagacacgacaacctggccggccagctgtggttcggcgccgagtgcctggccgccggcagcatcatcatgaacagagagctggagagcatggccatgagacccctggccaaggagctgaccagaagcctggaggacgtgagaggcgccctgagagaccaggccctgagagacctgaacacctacaccgagaagatgagagaggccctgagacacttcgacgtgctgttcgccgagttcgagctgagctacgtgagcgccatggtgcccgtgaagagccccagagagtactacgtgcagcaggaggtgatcgtgctgttctgcgagaccgtggagagcggcctggtggtgtacgccgacggccccctgaacctggacagaaaggtggaggacatgagcgagctgttcagacccttccacaccctgctgagaaagatcagagacctgctgcagaccctgaccgaggaggagctgcacaccctggagagaaacctgtgcatcagccaggacgtggagttccccatcagagccgacgtgcagggccccgccgccctggcccccgccctgagcgcccccctgccccccgagggccccctgagcgccaaggccaaggaccccgacgccgagctggcctgcagcatgcagtacgacgaccaggagctggagcagctgagcagaatggtgcacagagccggcgacgagatgagcagcctgctgagcccccccatcgcctgccagagccccgcccacagacccggcgccgagggcagccccggcggcgaggccagccccggcagacccagactgagaagcggcagcgacgaggaggagagagtgttcttcatggacgacgtggagggcaccgccgaggccctggccagacccgagagccccgccggccccttcggctgggccggcagcacctgggccgacccccaggagaagggccagggcggccccggcggcgccgccggcatcagcctgcccgccagcgagaaggaggaggacctgagcaacaacaacctggaggccgagggcaccgacggcgccagcctggccggcaccagcagctgcagctgcctggacagcagactgcacctggacggctgggaggtgggcgccgacgacgccgagaccgccgagatgatcgcccacagaaccggcggcatgaagctgagcgccaccgtgatcttcaaccccaagagccccaccagcctggacagcgccgtggccacccaggaggccgccagcgagcccgtggccgagggcatggacggcggcccccacaagctgagcaccggcgccaccaactgcctgctgcacagctgcgtgtgctgcggcagctgcggcgacagcagagaggacgtggtggagagactgagagagaagtgcagccccggcggcgtgatcggcgccagctacgccgccggcctggccaaggccagcgacagagcccccgagagacaggaggaggcccccccccccagcgaggacgccagcaacggcagagagcccaaggcccccaccagcgacaagtgcctgccccacaccagcggcagccaggtggacaccgccagcggcctgcagggcgaggccggcgtggccggccagcaggagcccgaggccagagagctgcacgccggcagccccagcgcccacgaggccccccaggccctgagcggcagcagcagcagcaccgccggcagctgcagcagcgacaagatgggccccgaggccgcccccgccgccacccacgccgccccccaggccaccagagagaagatcagaagcagattccacggcagccacgacctgatccacagactgttcgtgtgcatcagcggcgtggccgaccagctgcagaccaactacgccagcgacctgagaagcatcctgaagaccctgttcgaggtgatggccaccaagcccgagaccgacgacaaggagaagctgagaaaggtgacccagaccctgagaagcgccgccctggaggactgcgccctgtgccaggagaccctgagcagcagcgagctggccgccaagaccagagacggcgacttcgaggacccccccgagtgggtgcccgacgaggcctgcggcttctgcaccgcctgcaaggcccccttcaccgtgatcagaagaaagcaccactgcagaagctgcggcaagatcttctgcagcagatgcagcagccacagcgcccccctgcccagatacggccaggtgaagcccgtgagagtgtgcacccactgctacatgttccacgtgacccccttctacagcgacaaggccggcctgtag

SEQ ID NO: 106342 - DNA, 2454 bp, Artificial Sequence
  Description of Artificial Sequence: Synthetic coding sequence
atggacgagtgcatcccccaggacagagcccccagagacttctgcgtgaagttccccgaggagatcagacacgacaacctggccggccagctgtggttcggcgccgagtgcctggccgccggcagcatcatcatgaacagagagctggagagcatggccatgagacccctggccaaggagctgaccagaagcctggaggacgtgagaggcgccctgagagaccaggccctgagagacctgaacacctacaccgagaagatgagagaggccctgagacacttcgacgtgctgttcgccgagttcgagctgagctacgtgagcgccatggtgcccgtgaagagccccagagagtactacgtgcagcaggaggtgatcgtgctgttctgcgagaccgtggagagagccctggacttcggctacctgacccaggacatgatcgacgactacgagcccgccctgatgttcagcatccccagactggccatcgtgtgcggcctggtggtgtacgccgacggccccctgaacctggacagaaaggtggaggacatgagcgagctgttcagacccttccacaccctgctgagaaagatcagagacctgctgcagaccctgaccgaggaggagctgcacaccctggagagaaacctgtgcatcagccaggacgtggagttccccatcagagccgacgtgcagggccccgccgccctggcccccgccctgagcgcccccctgccccccgagggccccctgagcgccaaggccaaggaccccgacgccgagctggcctgcagcatgcagtacgacgaccaggagctggagcagctgagcagaatggtgcacagagccggcgacgagatgagcagcctgctgagcccccccatcgcctgccagagccccgcccacagacccggcgccgagggcagccccggcggcgaggccagccccggcagacccagactgagaagcggcagcgacgaggaggagagagtgttcttcatggacgacgtggagggcaccgccgaggccctggccagacccgagagccccgccggccccttcggctgggccggcagcacctgggccgacccccaggagaagggccagggcggccccggcggcgccgccggcatcagcctgcccgccagcgagaaggaggaggacctgagcaacaacaacctggaggccgagggcaccgacggcgccagcctggccggcaccagcagctgcagctgcctggacagcagactgcacctggacggctgggaggtgggcgccgacgacgccgagaccgccgagatgatcgcccacagaaccggcggcatgaagctgagcgccaccgtgatcttcaaccccaagagccccaccagcctggacagcgccgtggccacccaggaggccgccagcgagcccgtggccgagggcatggacggcggcccccacaagctgagcaccggcgccaccaactgcctgctgcacagctgcgtgtgctgcggcagctgcggcgacagcagagaggacgtggtggagagactgagagagaagtgcagccccggcggcgtgatcggcgccagctacgccgccggcctggccaaggccagcgacagagcccccgagagacaggaggaggcccccccccccagcgaggacgccagcaacggcagagagcccaaggcccccaccagcgacaagtgcctgccccacaccagcggcagccaggtggacaccgccagcggcctgcagggcgaggccggcgtggccggccagcaggagcccgaggccagagagctgcacgccggcagccccagcgcccacgaggccccccaggccctgagcggcagcagcagcagcaccgccggcagctgcagcagcgacaagatgggccccgaggccgcccccgccgccacccacgccgccccccaggccaccagagagaagatcagaagcagattccacggcagccacgacctgatccacagactgttcgtgtgcatcagcggcgtggccgaccagctgcagaccaactacgccagcgacctgagaagcatcctgaagaccctgttcgaggtgatggccaccaagcccgagaccgacgacaaggagaagctgagaaaggtgacccagaccctgagaagcgccgccctggaggactgcgccctgtgccaggagaccctgagcagcagcgagctggccgccaagaccagagacggcgacttcgaggacccccccgagtgggtgcccgacgaggcctgcggcttctgcaccgcctgcaaggcccccttcaccgtgatcagaagaaagcaccactgcagaagctgcggcaagatcttctgcagcagatgcagcagccacagcgcccccctgcccagatacggccaggtgaagcccgtgagagtgtgcacccactgctacatgttccacgtgacccccttctacagcgacaaggccggcctgtag

SEQ ID NO: 106343 - DNA, 1212 bp, Artificial Sequence
  Description of Artificial Sequence: Synthetic coding sequence
atggagcccgccggcccctgcggcttctgccccgccggcgaggtgcagcccgccagatacacctgccccagatgcaacgccccctactgcagcctgagatgctacagaacccacggcacctgcgccgagaacttctacagagaccaggtgctgggcgagctgagaggctgcagcgccccccccagcagactggccagcgccctgagaagactgagacagcagagagagaccgaggacgagcccggcgaggccggcctgagcagcggccccgcccccggcggcctgagcggcctgtgggagagactggcccccggcgagaaggccgccttcgagagactgctgagcagaggcgaggccggcagactgctgcccccctggagaccctggtggtggaacagaggcgccggcccccagctgctggaggagctggacaacgcccccggcagcgacgccgccgagctggagctggcccccgccagaaccccccccgacagcgtgaaggacgccagcgccgccgagcccgccgccgccgagagagtgctgggcgacgtgcccggcgcctgcacccccgtggtgcccaccagaatccccgccatcgtgagcctgagcagaggccccgtgagccccctggtgagattccagctgcccaacgtgctgttcgcctacgcccacaccctggccctgtaccacggcggcgacgacgccctgctgagcgacttctgcgccaccctgctgggcgtgagcggcgccctgggcgcccagcaggtgttcgccagcgccgaggaggccctgcaggccgccgcccacgtgctggaggccggcgagcacccccccggccccctgggcaccagaggcgccatgcacgaggtggccagaatcctgctgggcgagggccccaccaaccagaagggctacaccctggccgccctgggcgacctggcccagaccctgggcagagccagaaagcaggccgtggccagagaggagagagaccacctgtacagagccagaaagaagtgccagttcctgctggcctggaccaacgagaacgaggccgccctgacccccctggccctggactgcgccagagcccaccaggcccacgccgtggtggccgaggaggtggccgccctgaccggcgagctggagagactgtggggcggccccgtgccccccgcccccagaaccctgatcgaggagctgcccagctag

SEQ ID NO: 106344 - DNA, 1683 bp, Artificial Sequence
  Description of Artificial Sequence: Synthetic coding sequence
atggccggcccccagcccctggccctgcagctggagcagctgctgaaccccagacccagcgaggccgaccccgaggccgaccccgaggaggccaccgccgccagagtgatcgacagattcgacgagggcgaggacggcgagggcgacttcctggtggtgggcagcatcagaaagctggccagcgccagcctgctggacaccgacaagagatactgcggcaagaccaccagcagaaaggcctggaacgaggaccactgggagcagaccctgcccggcagcagcgacgaggagatcagcgacgaggagggcagcggcgacgaggacagcgagggcctgggcctggaggagtacgacgaggacgacctgggcgccgccgaggagcaggagtgcggcgaccacagagagagcaagaagagcagaagccacagcgccaagacccccggcttcagcgtgcagagcatcagcgacttcgagaagttcaccaagggcatggacgacctgggcagcagcgaggaggaggaggacgaggagagcggcatggaggagggcgacgacgccgaggacagccagggcgagagcgaggaggacagagccggcgacagaaacagcgaggacgacggcgtggtgatgaccttcagcagcgtgaaggtgagcgaggaggtggagaagggcagagccgtgaagaaccagatcgccctgtgggaccagctgctggagggcagaatcaagctgcagaaggccctgctgaccaccaaccagctgccccagcccgacgtgttccccctgttcaaggacaagggcggccccgagttcagcagcgccctgaagaacagccacaaggccctgaaggccctgctgagaagcctggtgggcctgcaggaggagctgctgttccagtaccccgacaccagatacctggtggacggcaccaagcccaacgccggcagcgaggagatcagcagcgaggacgacgagctggtggaggagaagaagcagcagagaagaagagtgcccgccaagagaaagctggagatggaggactaccccagcttcatggccaagagattcgccgacttcaccgtgtacagaaacagaaccctgcagaagtggcacgacaagaccaagctggccagcggcaagctgggcaagggcttcggcgccttcgagagaagcatcctgacccagatcgaccacatcctgatggacaaggagagactgctgagaagaacccagaccaagagaagcgtgtacagagtgctgggcaagcccgagcccgccgcccagcccgtgcccgagagcctgcccggcgagcccgagatcctgccccaggcccccgccaacgcccacctgaaggacctggacgaggagatcttcgacgacgacgacttctaccaccagctgctgagagagctgatcgagagaaagaccagcagcctggaccccaacgaccaggtggccatgggcagacagtggctggccatccagaagctgagaagcaagatccacaagaaggtggacagaaaggccagcaagggcagaaagctgagattccacgtgctgagcaagctgctgagcttcatggcccccatcgaccacaccaccatgaacgacgacgccagaaccgagctgtacagaagcctgttcggccagctgcacccccccgacgagggccacggcgactag

SEQ ID NO: 106345 - DNA, 4134 bp, Artificial Sequence
  Description of Artificial Sequence: Synthetic coding sequence
atggacaccagcagcgtgggcggcctggagctgaccgaccagacccccgtgctgctgggcagcaccgccatggccaccagcctgaccaacgtgggcaacagcttcagcggccccgccaaccccctggtgagcagaagcaacaagttccagaacagcagcgtggaggacgacgacgacgtggtgttcatcgagcccgtgcagccccccccccccagcgtgcccgtggtggccgaccagagaaccatcaccttcaccagcagcaagaacgaggagctgcagggcaacgacagcaagatcacccccagcagcaaggagctggccagccagaagggcagcgtgagcgagaccatcgtgatcgacgacgaggaggacatggagaccaaccagggccaggagaagaacagcagcaacttcatcgagagaagaccccccgagaccaagaacagaaccaacgacgtggacttcagcaccagcagcttcagcagaagcaaggtgaacgccggcatgggcaacagcggcatcaccaccgagcccgacagcgagatccagatcgccaacgtgaccaccctggagaccggcgtgagcagcgtgaacgacggccagctggagaacaccgacggcagagacatgaacctgatgatcacccacgtgaccagcctgcagaacaccaacctgggcgacgtgagcaacggcctgcagagcagcaacttcggcgtgaacatccagacctacacccccagcctgaccagccagaccaagaccggcgtgggccccttcaaccccggcagaatgaacgtggccggcgacgtgttccagaacggcgagagcgccacccaccacaaccccgacagctggatcagccagagcgccagcttccccagaaaccagaagcagcccggcgtggacagcctgagccccgtggccagcctgcccaagcagatcttccagcccagcgtgcagcagcagcccaccaagcccgtgaaggtgacctgcgccaactgcaagaagcccctgcagaagggccagaccgcctaccagagaaagggcagcgcccacctgttctgcagcaccacctgcctgagcagcttcagccacaagcccgcccccaagaagctgtgcgtgatgtgcaagaaggacatcaccaccatgaagggcaccatcgtggcccaggtggacagcagcgagagcttccaggagttctgcagcaccagctgcctgagcctgtacgaggacaagcagaaccccaccaagggcgccctgaacaagagcagatgcaccatctgcggcaagctgaccgagatcagacacgaggtgagcttcaagaacatgacccacaagctgtgcagcgaccactgcttcaacagatacagaatggccaacggcctgatcatgaactgctgcgagcagtgcggcgagtacctgcccagcaagggcgccggcaacaacgtgctggtgatcgacggccagcagaagagattctgctgccagagctgcgtgagcgagtacaagcaggtgggcagccaccccagcttcctgaaggaggtgagagaccacatgcaggacagcttcctgatgcagcccgagaagtacggcaagctgaccacctgcaccggctgcagaacccagtgcagattcttcgacatgacccagtgcatcggccccaacggctacatggagccctactgcagcaccgcctgcatgaacagccacaagaccaagtacgccaagagccagagcctgggcatcatctgccacttctgcaagagaaacagcctgccccagtaccaggccaccatgcccgacggcaagctgtacaacttctgcaacagcagctgcgtggccaagttccaggccctgagcatgcagagcagccccaacggccagttcgtggcccccagcgacatccagctgaagtgcaactactgcaagaacagcttctgcagcaagcccgagatcctggagtgggagaacaaggtgcaccagttctgcagcaagacctgcagcgacgactacaagaagctgcactgcatcgtgacctactgcgagtactgccaggaggagaagaccctgcacgagaccgtgaacttcagcggcgtgaagagacccttctgcagcgagggctgcaagctgctgtacaagcaggacttcgccagaagactgggcctgagatgcgtgacctgcaactactgcagccagctgtgcaagaagggcgccaccaaggagctggacggcgtggtgagagacttctgcagcgaggactgctgcaagaagttccaggactggtactacaaggccgccagatgcgactgctgcaagagccagggcaccctgaaggagagagtgcagtggagaggcgagatgaagcacttctgcgaccagcactgcctgctgagattctactgccagcagaacgagcccaacatgaccacccagaagggccccgagaacctgcactacgaccagggctgccagaccagcagaaccaagatgaccggcagcgcccccccccccagccccacccccaacaaggagatgaagaacaaggccgtgctgtgcaagcccctgaccatgaccaaggccacctactgcaagccccacatgcagaccaagagctgccagaccgacgacacctggagaaccgagtacgtgcccgtgcccatccccgtgcccgtgtacatccccgtgcccatgcacatgtacagccagaacatccccgtgcccaccaccgtgcccgtgcccgtgcccgtgcccgtgttcctgcccgcccccctggacagcagcgagaagatccccgccgccatcgaggagctgaagagcaaggtgagcagcgacgccctggacaccgagctgctgaccatgaccgacatgatgagcgaggacgagggcaagaccgagaccaccaacatcaacagcgtgatcatcgagaccgacatcatcggcagcgacctgctgaagaacagcgaccccgagacccagagcagcatgcccgacgtgccctacgagcccgacctggacatcgagatcgacttccccagagccgccgaggagctggacatggagaacgagttcctgctgccccccgtgttcggcgaggagtacgaggagcagcccagacccagaagcaagaagaagggcgccaagagaaaggccgtgagcggctaccagagccacgacgacagcagcgacaacagcgagtgcagcttccccttcaagtacacctacggcgtgaacgcctggaagcactgggtgaagaccagacagctggacgaggacctgctggtgctggacgagctgaagagcagcaagagcgtgaagctgaaggaggacctgctgagccacaccaccgccgagctgaactacggcctggcccacttcgtgaacgagatcagaagacccaacggcgagaactacgcccccgacagcatctactacctgtgcctgggcatccaggagtacctgtgcggcagcaacagaaaggacaacatcttcatcgaccccggctaccagaccttcgagcaggagctgaacaagatcctgagaagctggcagcccagcatcctgcccgacggcagcatcttcagcagagtggaggaggactacctgtggagaatcaagcagctgggcagccacagccccgtggccctgctgaacaccctgttctacttcaacaccaagtacttcggcctgaagaccgtggagcagcacctgagactgagcttcggcaccgtgttcagacactggaagaagaaccccctgaccatggagaacaaggcctgcctgagataccaggtgagcagcctgtgcggcaccgacaacgaggacaagatcaccaccggcaagagaaagcacgaggacgacgagcccgtgttcgagcagatcgagaacaccgccaaccccagcagatgccccgtgaagatgttcgagtgctacctgagcaagagcccccagaacctgaaccagagaatggacgtgttctacctgcagcccgagtgcagcagcagcaccgacagccccgtgtggtacaccagcaccagcctggacagaaacaccctggagaacatgctggtgagagtgctgctggtgaaggacatctacgacaaggacaactacgagctggacgaggacaccgactag

SEQ ID NO: 106346 - DNA, 4128 bp, Artificial Sequence
  Description of Artificial Sequence: Synthetic coding sequence
atggacaccagcagcgtgggcggcctggagctgaccgaccagacccccgtgctgctgggcagcaccgccatggccaccagcctgaccaacgtgggcaacagcttcagcggccccgccaaccccctggtgagcagaagcaacaagttccagaacagcagcgtggaggacgacgacgacgtggtgttcatcgagcccgtgcagccccccccccccagcgtgcccgtggtggccgaccagagaaccatcaccttcaccagcagcaagaacgaggagctgcagggcaacgacagcaagatcacccccagcagcaaggagctggccagccagaagggcagcgtgagcgagaccatcgtgatcgacgacgaggaggacatggagaccaaccagggccaggagaagaacagcagcaacttcatcgagagaagaccccccgagaccaagaacagaaccaacgacgtggacttcagcaccagcagcttcagcagaagcaaggtgaacgccggcatgggcaacagcggcatcaccaccgagcccgacagcgagatccagatcgccaacgtgaccaccctggagaccggcgtgagcagcgtgaacgacggccagctggagaacaccgacggcagagacatgaacctgatgatcacccacgtgaccagcctgcagaacaccaacctgggcgacgtgagcaacggcctgcagagcagcaacttcggcgtgaacatccagacctacacccccagcctgaccagccagaccaagaccggcgtgggccccttcaaccccggcagaatgaacgtggccggcgacgtgttccagaacggcgagagcgccacccaccacaaccccgacagctggatcagccagagcgccagcttccccagaaaccagaagcagcccggcgtggacagcctgagccccgtggccagcctgcccaagcagatcttccagcccagcgtgcagcagcagcccaccaagcccgtgaaggtgacctgcgccaactgcaagaagcccctgcagaagggccagaccgcctaccagagaaagggcagcgcccacctgttctgcagcaccacctgcctgagcagcttcagccacaagcccgcccccaagaagctgtgcgtgatgtgcaagaaggacatcaccaccatgaagggcaccatcgtggcccaggtggacagcagcgagagcttccaggagttctgcagcaccagctgcctgagcctgtacgaggacaagcagaaccccaccaagggcgccctgaacaagagcagatgcaccatctgcggcaagctgaccgagatcagacacgaggtgagcttcaagaacatgacccacaagctgtgcagcgaccactgcttcaacagatacagaatggccaacggcctgatcatgaactgctgcgagcagtgcggcgagtacctgcccagcaagggcgccggcaacaacgtgctggtgatcgacggccagcagaagagattctgctgccagagctgcgtgagcgagtacaagcaggtgggcagccaccccagcttcctgaaggaggtgagagaccacatgcaggacagcttcctgatgcagcccgagaagtacggcaagctgaccacctgcaccggctgcagaacccagtgcagattcttcgacatgacccagtgcatcggccccaacggctacatggagccctactgcagcaccgcctgcatgaacagccacaagaccaagtacgccaagagccagagcctgggcatcatctgccacttctgcaagagaaacagcctgccccagtaccaggccaccatgcccgacggcaagctgtacaacttctgcaacagcagctgcgtggccaagttccaggccctgagcatgcagagcagccccaacggccagttcgtggcccccagcgacatccagctgaagtgcaactactgcaagaacagcttctgcagcaagcccgagatcctggagtgggaggccagcctgcaccagttctgcagcaagacctgcagcgacgactacaagaagctgcactgcatcgtgacctactgcgagtactgccaggaggagaagaccctgcacgagaccgtgaacttcagcggcgtgaagagacccttctgcagcgagggctgcaagctgctgtacaagcaggacttcgccagaagactgggcctgagatgcgtgacctgcaactactgcagccagctgtgcaagaagggcgccaccaaggagctggacggcgtggtgagagacttctgcagcgaggactgctgcaagaagttccaggactggtactacaaggcctgcgactgctgcaagagccagggcaccctgaaggagagagtgcagtggagaggcgagatgaagcacttctgcgaccagcactgcctgctgagattctactgccagcagaacgagcccaacatgaccacccagaagggccccgagaacctgcactacgaccagggctgccagaccagcagaaccaagatgaccggcagcgcccccccccccagccccacccccaacaaggagatgaagaacaaggccgtgctgtgcaagcccctgaccatgaccaaggccacctactgcaagccccacatgcagaccaagagctgccagaccgacgacacctggagaaccgagtacgtgcccgtgcccatccccgtgcccgtgtacatccccgtgcccatgcacatgtacagccagaacatccccgtgcccaccaccgtgcccgtgcccgtgcccgtgcccgtgttcctgcccgcccccctggacagcagcgagaagatccccgccgccatcgaggagctgaagagcaaggtgagcagcgacgccctggacaccgagctgctgaccatgaccgacatgatgagcgaggacgagggcaagaccgagaccaccaacatcaacagcgtgatcatcgagaccgacatcatcggcagcgacctgctgaagaacagcgaccccgagacccagagcagcatgcccgacgtgccctacgagcccgacctggacatcgagatcgacttccccagagccgccgaggagctggacatggagaacgagttcctgctgccccccgtgttcggcgaggagtacgaggagcagcccagacccagaagcaagaagaagggcgccaagagaaaggccgtgagcggctaccagagccacgacgacagcagcgacaacagcgagtgcagcttccccttcaagtacacctacggcgtgaacgcctggaagcactgggtgaagaccagacagctggacgaggacctgctggtgctggacgagctgaagagcagcaagagcgtgaagctgaaggaggacctgctgagccacaccaccgccgagctgaactacggcctggcccacttcgtgaacgagatcagaagacccaacggcgagaactacgcccccgacagcatctactacctgtgcctgggcatccaggagtacctgtgcggcagcaacagaaaggacaacatcttcatcgaccccggctaccagaccttcgagcaggagctgaacaagatcctgagaagctggcagcccagcatcctgcccgacggcagcatcttcagcagagtggaggaggactacctgtggagaatcaagcagctgggcagccacagccccgtggccctgctgaacaccctgttctacttcaacaccaagtacttcggcctgaagaccgtggagcagcacctgagactgagcttcggcaccgtgttcagacactggaagaagaaccccctgaccatggagaacaaggcctgcctgagataccaggtgagcagcctgtgcggcaccgacaacgaggacaagatcaccaccggcaagagaaagcacgaggacgacgagcccgtgttcgagcagatcgagaacaccgccaaccccagcagatgccccgtgaagatgttcgagtgctacctgagcaagagcccccagaacctgaaccagagaatggacgtgttctacctgcagcccgagtgcagcagcagcaccgacagccccgtgtggtacaccagcaccagcctggacagaaacaccctggagaacatgctggtgagagtgctgctggtgaaggacatctacgacaaggacaactacgagctggacgaggacaccgactag

SEQ ID NO: 106347 - DNA, 4128 bp, Artificial Sequence; identical to SEQ ID NO: 106346
  Description of Artificial Sequence: Synthetic coding sequence

SEQ ID NO: 106348 - DNA, 1134 bp, Artificial Sequence
  Description of Artificial Sequence: Synthetic coding sequence
atgcaggacagcttcctgatgcagcccgagaagtacggcaagctgaccacctgcaccggctgcagaacccagtgcagattcttcgacatgacccagtgcatcggccccaacggctacatggagccctactgcagcaccgcctgcatgaacagccacaagaccaagtacgccaagagccagagcctgggcatcatctgccacttctgcaagagaaacagcctgccccagtaccaggccaccatgcccgacggcaagctgtacaacttctgcaacagcagctgcgtggccaagttccaggccctgagcatgcagagcagccccaacggccagttcgtggcccccagcgacatccagctgaagtgcaactactgcaagaacagcttctgcagcaagcccgagatcctggagtgggagaacaaggtgcaccagttctgcagcaagacctgcagcgacgactacaagaagctgcactgcatcgtgacctactgcgagtactgccaggaggagaagaccctgcacgagaccgtgaacttcagcggcgtgaagagacccttctgcagcgagggctgcaagctgctgtacaagcaggacttcgccagaagactgggcctgagatgcgtgacctgcaactactgcagccagctgtgcaagaagggcgccaccaaggagctggacggcgtggtgagagacttctgcagcgaggactgctgcaagaagttccaggactggtactacaaggccgccagatgcgactgctgcaagagccagggcaccctgaaggagagagtgcagtggagaggcgagatgaagcacttctgcgaccagcactgcctgctgagattctactgccagcagaacgagcccaacatgaccacccagaagggccccgagaacctgcactacgaccagggctgccagaccagcagaaccaagatgaccggcagcgcccccccccccagccccacccccaacaaggagatgaagaacaaggccgtgctgtgcaagcccctgaccatgaccaaggccacctactgcaagccccacatgcagaccaagagctgccagaccgacatcacctggagaatccagcacctgatcctgaaccactacgaccagagcctgatcaaggcctag

SEQ ID NO: 106349 - DNA, 4134 bp, Artificial Sequence; identical to SEQ ID NO: 106345
  Description of Artificial Sequence: Synthetic coding sequence

SEQ ID NO: 106350 - DNA, 4113 bp, Artificial Sequence
  Description of Artificial Sequence: Synthetic coding sequence
atggaccccagcgacttccccagccccttcgaccccctgaccctgcccgagaagcccctggccggcgacctgcccgtggacatggagttcggcgaggacctgctggagagccagaccgcccccaccagaggctgggccccccccggccccagccccagcagcggcgccctggacctgctggacacccccgccggcctggagaaggaccccggcgtgctggacggcgccaccgagctgctgggcctgggcggcctgctgtacaaggcccccagcccccccgaggtggaccacggccccgagggcaccctggcctgggacgccggcgaccagaccctggagcccggccccggcggccagacccccgaggtggtgccccccgaccccggcgccggcgccaacagctgcagccccgagggcctgctggagcccctggcccccgacagccccatcaccctgcagagcccccacatcgaggaggaggagaccaccagcatcgccaccgccagaagaggcagccccggccaggaggaggagctgccccagggccagccccagagccccaacgccccccccagccccagcgtgggcgagaccctgggcgacggcatcaacagcagccagaccaagcccggcggcagcagcccccccgcccaccccagcctgcccggcgacggcctgaccgccaaggccagcgagaagccccccgagagaaagagaagcgagagagtgagaagagccgagccccccaagcccgaggtggtggacagcaccgagagcatccccgtgagcgacgaggacagcgacgccatggtggacgaccccaacgacgaggacttcgtgcccttcagacccagaagaagccccagaatgagcctgagaagcagcgtgagccagagagccggcagaagcgccgtgggcaccaagatgacctgcgcccactgcagaacccccctgcagaagggccagaccgcctaccagagaaagggcctgccccagctgttctgcagcagcagctgcctgaccaccttcagcaagaagcccagcggcaagaagacctgcaccttctgcaagaaggagatctggaacaccaaggacagcgtggtggcccagaccggcagcggcggcagcttccacgagttctgcaccagcgtgtgcctgagcctgtacgaggcccagcagcagagacccatcccccagagcggcgaccccgccgacgccaccagatgcagcatctgccagaagaccggcgaggtgctgcacgaggtgagcaacggcagcgtggtgcacagactgtgcagcgacagctgcttcagcaagttcagagccaacaagggcctgaagaccaactgctgcgaccagtgcggcgcctacatctacaccaagaccggcagccccggccccgagctgctgttccacgagggccagcagaagagattctgcaacaccacctgcctgggcgcctacaagaagaagaacaccagagtgtacccctgcgtgtggtgcaagaccctgtgcaagaacttcgagatgctgagccacgtggacagaaacggcaagaccagcctgttctgcagcctgtgctgcaccaccagctacaaggtgaagcaggccggcctgaccggcccccccagaccctgcagcttctgcagaagaagcctgagcgacccctgctactacaacaaggtggacagaaccgtgtaccagttctgcagccccagctgctggaccaagttccagagaaccagccccgagggcggcatccacctgagctgccactactgccacagcctgttcagcggcaagcccgaggtgctggactggcaggaccaggtgttccagttctgctgcagagactgctgcgaggacttcaagagactgagaggcgtggtgagccagtgcgagcactgcagacaggagaagctgctgcacgagaagctgagattcagcggcgtggagaagagcttctgcagcgagggctgcgtgctgctgtacaagcaggacttcaccaagaagctgggcctgtgctgcatcacctgcacctactgcagccagacctgccagagaggcgtgaccgagcagctggacggcagcacctgggacttctgcagcgaggactgcaagagcaagtacctgctgtggtactgcaaggccgccagatgccacgcctgcaagagacagggcaagctgctggagaccatccactggagaggccagatcagacacttctgcaaccagcagtgcctgctgagattctacagccagcagaaccagcccaacctggacacccagagcggccccgagagcctgctgaacagccagagccccgagagcaagccccagacccccagccagaccaaggtggagaacagcaacaccgtgagaacccccgaggagaacggcaacctgggcaagatccccgtgaagaccagaagcgcccccaccgcccccacccccccccccccccccccccccgccacccccagaaagaacaaggccgccatgtgcaagcccctgatgcagaacagaggcgtgagctgcaaggtggagatgaagagcaagggcagccagaccgaggagtggaagccccaggtgatcgtgctgcccatccccgtgcccatcttcgtgcccgtgcccatgcacctgtactgccagaaggtgcccgtgcccttcagcatgcccatccccgtgcccgtgcccatgttcctgcccaccaccctggagagcaccgacaagatcgtggagaccatcgaggagctgaaggtgaagatccccagcaaccccctggaggccgacatcctggccatggccgagatgatcgccgaggccgaggagctggacaaggccagcagcgacctgtgcgacctggtgagcaaccagagcgccgagggcctgctggaggactgcgacctgttcggccccgccagagacgacgtgctggccatggccgtgaagatggccaacgtgctggacgagcccggccaggacctggaggccgacttccccaagaaccccctggacatcaaccccagcgtggacttcctgttcgactgcggcctggtgggccccgaggacgtgagcaccgagcaggacctgcccagaaccatgagaaagggccagaagagactggtgctgagcgagagctgcagcagagacagcatgagcagccagcccagctgcaccggcctgaactacagctacggcgtgaacgcctggaagtgctgggtgcagagcaagtacgccaacggcgagaccagcaagggcgacgagctgagattcggccccaagcccatgagaatcaaggaggacatcctggcctgcagcgccgccgagctgaactacggcctggcccagttcgtgagagagatcaccagacccaacggcgagagatacgagcccgacagcatctactacctgtgcctgggcatccagcagtacctgctggagaacaacagaatggtgaacatcttcaccgacctgtactacctgaccttcgtgcaggagctgaacaagagcctgagcacctggcagcccaccctgctgcccaacaacaccgtgttcagcagagtggaggaggagcacctgtgggagtgcaagcagctgggcgtgtacagccccttcgtgctgctgaacaccctgatgttcttcaacaccaagttcttcggcctgcagaccgccgaggagcacatgcagctgagcttcaccaacgtggtgagacagagcagaaagtgcaccacccccagaggcaccaccaaggtggtgagcatcagatactacgcccccgtgagacagagaaagggcagagacaccggccccggcaagagaaagagagaggacgaggcccccatcctggagcagagagagaacagaatgaaccccctgagatgccccgtgaagttctacgagttctacctgagcaagtgccccgagagcctgagaaccagaaacgacgtgttctacctgcagcccgagagaagctgcatcgccgagagccccctgtggtacagcgtgatccccatggacagaagcatgctggagagcatgctgaacagaatcctggccgtgagagagatctacgaggagctgggcagacccggcgaggaggacctggactag

SEQ ID NO: 106351 - DNA, 4113 bp, Artificial Sequence; identical to SEQ ID NO: 106350
  Description of Artificial Sequence: Synthetic coding sequence

SEQ ID NO: 106352 - DNA, 1050 bp, Artificial Sequence
  Description of Artificial Sequence: Synthetic coding sequence
atggaccccagcgacttccccagccccttcgaccccctgaccctgcccgagaagcccctggccggcgacctgcccgtggacatggagttcggcgaggacctgctggagagccagaccgcccccaccagaggctgggccccccccggccccagccccagcagcggcgccctggacctgctggacacccccgccggcctggagaaggaccccggcgtgctggacggcgccaccgagctgctgggcctgggcggcctgctgtacaaggcccccagcccccccgaggtggaccacggccccgagggcaccctggcctgggacgccggcgaccagaccctggagcccggccccggcggccagacccccgaggtggtgccccccgaccccggcgccggcgccaacagctgcagccccgagggcctgctggagcccctggcccccgacagccccatcaccctgcagagcccccacatcgaggaggaggagaccaccagcatcgccaccgccagaagaggcagccccggccaggaggaggagctgccccagggccagccccagagccccaacgccccccccagccccagcgtgggcgagaccctgggcgacggcatcaacagcagccagaccaagcccggcggcagcagcccccccgcccaccccagcctgcccggcgacggcctgaccgccaaggccagcgagaagccccccgagagagtgcagaagagaagcgagagagtgagaagagccgagccccccaagcccgaggtggtggacagcaccgagagcagaagaagcggcacccccagaaccagactgtggagaagactggtgctggaggcccccagcatgagcagcgcccaccccagcgtgagcccctgcatgagacccagcagcagcgccagaagccccagcctgggcatcccccccaccctgctggccgccgcctacgccagaagactggagagaagctgcaccagaagcgccatggccgcctggtacaccggcagcgccgccatcctggccagccccaacagcggccccaccagagactag

SEQ ID NO: 106353 - DNA, 1488 bp, Artificial Sequence
  Description of Artificial Sequence: Synthetic coding sequence
atggaccccagcgacttccccagccccttcgaccccctgaccctgcccgagaagcccctggccggcgacctgcccgtggacatggagttcggcgaggacctgctggagagccagaccgcccccaccagaggctgggccccccccggccccagccccagcagcggcgccctggacctgctggacacccccgccggcctggagaaggaccccggcgtgctggacggcgccaccgagctgctgggcctgggcggcctgctgtacaaggcccccagcccccccgaggtggaccacggccccgagggcaccctggcctgggacgccggcgaccagaccctggagcccggccccggcggccagacccccgaggtggtgccccccgaccccggcgccggcgccaacagctgcagccccgagggcctgctggagcccctggcccccgacagccccatcaccctgcagagcccccacatcgaggaggaggagaccaccagcatcgccaccgccagaagaggcagccccggccaggaggaggagctgccccagggccagccccagagccccaacgccccccccagccccagcgtgggcgagaccctgggcgacggcatcaacagcagccagaccaagcccggcggcagcagcccccccgcccaccccagcctgcccggcgacggcctgaccgccaaggccagcgagaagccccccgagagaaagagaagcgagagagtgagaagagccgagccccccaagcccgaggtggtggacagcaccgagagcatccccgtgagcgacgaggacagcgacgccatggtggacgaccccaacgacgaggacttcgtgcccttcagacccagaagaagccccagaatgagcctgagaagcagcgtgagccagagagccggcagaagcgccgtgggcaccaagatgacctgcgcccactgcagaacccccctgcagaagggccagaccgcctaccagagaaagggcctgccccagctgttctgcagcagcagctgcctgaccaccttcagcaagaagcccagcggcaagaagacctgcaccttctgcaagaaggagatctggaacaccaaggacagcgtggtggcccagaccggcagcggcggcagcttccacgagttctgcaccagcgtgtgcctgagcctgtacgaggcccagcagcagagacccatcccccagagcggcgaccccgccgacgccaccagatgcagcatctgccagaagaccggcgaggtgctgcacgaggtgagcaacggcagcgtggtgcacagactgtgcagcgacagctgcttcagcaagttcagagccaacaagggcctgaagaccaactgctgcgaccagtgcggcgcctacatctacaccaagaccggcagccccggccccgagctgctgttccacgagggccagcagaagagattctgcaacaccacctgcctgggcgcctacaagaaggtgggccccagagagtag

SEQ ID NO: 106354 - DNA, 1494 bp, Artificial Sequence
  Description of Artificial Sequence: Synthetic coding sequence
atggaccccagcgacttccccagccccttcgaccccctgaccctgcccgagaagcccctggccggcgacctgcccgtggacatggagttcggcgaggacctgctggagagccagaccgcccccaccagaggctgggccccccccggccccagccccagcagcggcgccctggacctgctggacacccccgccggcctggagaaggaccccggcgtgctggacggcgccaccgagctgctgggcctgggcggcctgctgtacaaggcccccagcccccccgaggtggaccacggccccgagggcaccctggcctgggacgccggcgaccagaccctggagcccggccccggcggccagacccccgaggtggtgccccccgaccccggcgccggcgccaacagctgcagccccgagggcctgctggagcccctggcccccgacagccccatcaccctgcagagcccccacatcgaggaggaggagaccaccagcatcgccaccgccagaagaggcagccccggccaggaggaggagctgccccagggccagccccagagccccaacgccccccccagccccagcgtgggcgagaccctgggcgacggcatcaacagcagccagaccaagcccggcggcagcagcccccccgcccaccccagcctgcccggcgacggcctgaccgccaaggccagcgagaagccccccgagagagtgcagaagagaagcgagagagtgagaagagccgagccccccaagcccgaggtggtggacagcaccgagagcatccccgtgagcgacgaggacagcgacgccatggtggacgaccccaacgacgaggacttcgtgcccttcagacccagaagaagccccagaatgagcctgagaagcagcgtgagccagagagccggcagaagcgccgtgggcaccaagatgacctgcgcccactgcagaacccccctgcagaagggccagaccgcctaccagagaaagggcctgccccagctgttctgcagcagcagctgcctgaccaccttcagcaagaagcccagcggcaagaagacctgcaccttctgcaagaaggagatctggaacaccaaggacagcgtggtggcccagaccggcagcggcggcagcttccacgagttctgcaccagcgtgtgcctgagcctgtacgaggcccagcagcagagacccatcccccagagcggcgaccccgccgacgccaccagatgcagcatctgccagaagaccggcgaggtgctgcacgaggtgagcaacggcagcgtggtgcacagactgtgcagcgacagctgcttcagcaagttcagagccaacaagggcctgaagaccaactgctgcgaccagtgcggcgcctacatctacaccaagaccggcagccccggccccgagctgctgttccacgagggccagcagaagagattctgcaacaccacctgcctgggcgcctacaagaaggtgggccccagagagtag

SEQ ID NO: 106355 - DNA, 3843 bp, Artificial Sequence
  Description of Artificial Sequence: Synthetic coding sequence
atggaccccagcgacttccccagccccttcgaccccctgaccctgcccgagaagcccctggccggcgacctgcccgtggacatggagttcggcgaggacctgctggagagccagaccgcccccaccagaggctgggccccccccggccccagccccagcagcggcgccctggacctgctggacacccccgccggcctggagaaggaccccggcgtgctggacggcgccaccgagctgctgggcctgggcggcctgctgtacaaggcccccagcccccccgaggtggaccacggccccgagggcaccctggcctgggacgccggcgaccagaccctggagcccggccccggcggccagacccccgaggtggtgccccccgaccccggcgccggcgccaacagctgcagccccgagggcctgctggagcccctggcccccgacagccccatcaccctgcagagcccccacatcgaggaggaggagaccaccagcatcgccaccgccagaagaggcagccccggccaggaggaggagctgccccagggccagccccagagccccaacgccccccccagccccagcgtgggcgagaccctgggcgacggcatcaacagcagccagaccaagcccggcggcagcagcccccccgcccaccccagcctgcccggcgacggcctgaccgccaaggccagcgagaagccccccgagagagtgcagaagagaagcgagagagtgagaagagccgagccccccaagcccgaggtggtggacagcaccgagagcatccccgtgagcgacgaggacagcgacgccatggtggacgaccccaacgacgaggacttcgtgcccttcagacccagaagaagccccagaatgagcctgagaagcagcgtgagccagagagccggcagaagcgccgtgggcaccaagatgacctgcgcccactgcagaacccccctgcagaagggccagaccgcctaccagagaaagggcctgccccagctgttctgcagcagcagctgcctgaccaccttcagcaagaagcccagcggcaagaagacctgcaccttctgcaagaaggagatctggaacaccaaggacagcgtggtggcccagaccggcagcggcggcagcttccacgagttctgcaccagcgtgtgcctgagcctgtacgaggcccagcagcagagacccatcccccagagcggcgaccccgccgacgccaccagatgcagcatctgccagaagaccggcgaggtgctgcacgaggtgagcaacggcagcgtggtgcacagactgtgcagcgacagctgcttcagcaagttcagagccaacaagggcctgaagaccaactgctgcgaccagtgcggcgcctacatctacaccaagaccggcagccccggccccgagctgctgttccacgagggccagcagaagagattctgcaacaccacctgcctgggcgcctacaagaagaagaacaccagagtgtacccctgcgtgtggtgcaagaccctgtgcaagaacttcgagatgctgagccacgtggacagaaacggcaagaccagcctgttctgcagcctgtgctgcaccaccagctacaaggtgaagcaggccggcctgaccggcccccccagaccctgcagcttctgcagaagaagcctgagcgacccctgctactacaacaaggtggacagaaccgtgtaccagttctgcagccccagctgctggaccaagttccagagaaccagccccgagggcggcatccacctgagctgccactactgccacagcctgttcagcggcaagcccgaggtgctggactggcaggaccaggtgttccagttctgctgcagagactgctgcgaggacttcaagagactgagaggcgtggtgagccagtgcgagcactgcagacaggagaagctgctgcacgagaagctgagattcagcggcgtggagaagagcttctgcagcgagggctgcgtgctgctgtacaagcaggacttcaccaagaagctgggcctgtgctgcatcacctgcacctactgcagccagacctgccagagaggcgtgaccgagcagctggacggcagcacctgggacttctgcagcgaggactgcaagagcaagtacctgctgtggtactgcaaggccgccagatgccacgcctgcaagagacagggcaagctgctggagaccatccactggagaggccagatcagacacttctgcaaccagcagtgcctgctgagattctacagccagcagaaccagcccaacctggacacccagagcggccccgagagcctgctgaacagccagagccccgagagcaagccccagacccccagccagaccaaggtggagaacagcaacaccgtgagaacccccgaggagaacggcaacctgggcaagatccccgtgaagaccagaagcgcccccaccgcccccacccccccccccccccccccccccgccacccccagaaagaacaaggccgccatgtgcaagcccctgatgcagaacagaggcgtgagctgcaaggtggagatgaagagcaagggcagccagaccgaggagtggaagccccaggtgatcgtgctgcccatccccgtgcccatcttcgtgcccgtgcccatgcacctgtactgccagaaggtgcccgtgcccttcagcatgcccatccccgtgcccgtgcccatgttcctgcccaccaccctggagagcaccgacaagatcgtggagaccatcgaggagctgaaggtgaagatccccagcaaccccctggaggccgacatcctggccatggccgagatgatcgccgaggccgaggagctggacaaggccagcagcgacctgtgcgacctggtgagcaaccagagcgccgagggcctgctggaggactgcgacctgttcggccccgccagagacgacgtgctggccatggccgtgaagatggccaacgtgctggacgagcccggccaggacctggaggccgacttccccaagaaccccctggacatcaaccccagcgtggacttcctgttcgactgcggcctggtgggccccgaggacgtgagcaccgagcaggacctgcccagaaccatgagaaagggccagaagagactggtgctgagcgagagctgcagcagagacagcatgagcagccagcccagctgcaccggcctgaactacagctacggcgtgaacgcctggaagtgctgggtgcagagcaagtacgccaacggcgagaccagcaaggccaagcccatgagaatcaaggaggacatcctggcctgcagcgccgccgagctgaactacggcctggcccagttcgtgagagagatcaccagacccaacggcgagagatacgagcccgacagcatctactacctgtgcctgggcatccagcagtacctgctggagaacaacagaatggtgaacatcttcaccgacctgtactacctgaccttcgtgcaggagctgaacaagagcctgagcacctggcagcccaccctgctgcccaacaacaccggccccggcaagagaaagagagaggacgaggcccccatcctggagcagagagagaacagaatgaaccccctgagatgccccgtgaagttctacgagttctacctgagcaagtgccccgagagcctgagaaccagaaacgacgtgttctacctgcagcccgagagaagctgcatcgccgagagccccctgtggtacagcgtgatccccatggacagaagcatgctggagagcatgctgaacagaatcctggccgtgagagagatctacgaggagctgggcagacccggcgaggaggacctggactag

SEQ ID NO: 106356 - DNA, 4119 bp, Artificial Sequence
  Description of Artificial Sequence: Synthetic coding sequence
atggaccccagcgacttccccagccccttcgaccccctgaccctgcccgagaagcccctggccggcgacctgcccgtggacatggagttcggcgaggacctgctggagagccagaccgcccccaccagaggctgggccccccccggccccagccccagcagcggcgccctggacctgctggacacccccgccggcctggagaaggaccccggcgtgctggacggcgccaccgagctgctgggcctgggcggcctgctgtacaaggcccccagcccccccgaggtggaccacggccccgagggcaccctggcctgggacgccggcgaccagaccctggagcccggccccggcggccagacccccgaggtggtgccccccgaccccggcgccggcgccaacagctgcagccccgagggcctgctggagcccctggcccccgacagccccatcaccctgcagagcccccacatcgaggaggaggagaccaccagcatcgccaccgccagaagaggcagccccggccaggaggaggagctgccccagggccagccccagagccccaacgccccccccagccccagcgtgggcgagaccctgggcgacggcatcaacagcagccagaccaagcccggcggcagcagcccccccgcccaccccagcctgcccggcgacggcctgaccgccaaggccagcgagaagccccccgagagagtgcagaagagaagcgagagagtgagaagagccgagccccccaagcccgaggtggtggacagcaccgagagcatccccgtgagcgacgaggacagcgacgccatggtggacgaccccaacgacgaggacttcgtgcccttcagacccagaagaagccccagaatgagcctgagaagcagcgtgagccagagagccggcagaagcgccgtgggcaccaagatgacctgcgcccactgcagaacccccctgcagaagggccagaccgcctaccagagaaagggcctgccccagctgttctgcagcagcagctgcctgaccaccttcagcaagaagcccagcggcaagaagacctgcaccttctgcaagaaggagatctggaacaccaaggacagcgtggtggcccagaccggcagcggcggcagcttccacgagttctgcaccagcgtgtgcctgagcctgtacgaggcccagcagcagagacccatcccccagagcggcgaccccgccgacgccaccagatgcagcatctgccagaagaccggcgaggtgctgcacgaggtgagcaacggcagcgtggtgcacagactgtgcagcgacagctgcttcagcaagttcagagccaacaagggcctgaagaccaactgctgcgaccagtgcggcgcctacatctacaccaagaccggcagccccggccccgagctgctgttccacgagggccagcagaagagattctgcaacaccacctgcctgggcgcctacaagaagaagaacaccagagtgtacccctgcgtgtggtgcaagaccctgtgcaagaacttcgagatgctgagccacgtggacagaaacggcaagaccagcctgttctgcagcctgtgctgcaccaccagctacaaggtgaagcaggccggcctgaccggcccccccagaccctgcagcttctgcagaagaagcctgagcgacccctgctactacaacaaggtggacagaaccgtgtaccagttctgcagccccagctgctggaccaagttccagagaaccagccccgagggcggcatccacctgagctgccactactgccacagcctgttcagcggcaagcccgaggtgctggactggcaggaccaggtgttccagttctgctgcagagactgctgcgaggacttcaagagactgagaggcgtggtgagccagtgcgagcactgcagacaggagaagctgctgcacgagaagctgagattcagcggcgtggagaagagcttctgcagcgagggctgcgtgctgctgtacaagcaggacttcaccaagaagctgggcctgtgctgcatcacctgcacctactgcagccagacctgccagagaggcgtgaccgagcagctggacggcagcacctgggacttctgcagcgaggactgcaagagcaagtacctgctgtggtactgcaaggccgccagatgccacgcctgcaagagacagggcaagctgctggagaccatccactggagaggccagatcagacacttctgcaaccagcagtgcctgctgagattctacagccagcagaaccagcccaacctggacacccagagcggccccgagagcctgctgaacagccagagccccgagagcaagccccagacccccagccagaccaaggtggagaacagcaacaccgtgagaacccccgaggagaacggcaacctgggcaagatccccgtgaagaccagaagcgcccccaccgcccccacccccccccccccccccccccccgccacccccagaaagaacaaggccgccatgtgcaagcccctgatgcagaacagaggcgtgagctgcaaggtggagatgaagagcaagggcagccagaccgaggagtggaagccccaggtgatcgtgctgcccatccccgtgcccatcttcgtgcccgtgcccatgcacctgtactgccagaaggtgcccgtgcccttcagcatgcccatccccgtgcccgtgcccatgttcctgcccaccaccctggagagcaccgacaagatcgtggagaccatcgaggagctgaaggtgaagatccccagcaaccccctggaggccgacatcctggccatggccgagatgatcgccgaggccgaggagctggacaaggccagcagcgacctgtgcgacctggtgagcaaccagagcgccgagggcctgctggaggactgcgacctgttcggccccgccagagacgacgtgctggccatggccgtgaagatggccaacgtgctggacgagcccggccaggacctggaggccgacttccccaagaaccccctggacatcaaccccagcgtggacttcctgttcgactgcggcctggtgggccccgaggacgtgagcaccgagcaggacctgcccagaaccatgagaaagggccagaagagactggtgctgagcgagagctgcagcagagacagcatgagcagccagcccagctgcaccggcctgaactacagctacggcgtgaacgcctggaagtgctgggtgcagagcaagtacgccaacggcgagaccagcaagggcgacgagctgagattcggccccaagcccatgagaatcaaggaggacatcctggcctgcagcgccgccgagctgaactacggcctggcccagttcgtgagagagatcaccagacccaacggcgagagatacgagcccgacagcatctactacctgtgcctgggcatccagcagtacctgctggagaacaacagaatggtgaacatcttcaccgacctgtactacctgaccttcgtgcaggagctgaacaagagcctgagcacctggcagcccaccctgctgcccaacaacaccgtgttcagcagagtggaggaggagcacctgtgggagtgcaagcagctgggcgtgtacagccccttcgtgctgctgaacaccctgatgttcttcaacaccaagttcttcggcctgcagaccgccgaggagcacatgcagctgagcttcaccaacgtggtgagacagagcagaaagtgcaccacccccagaggcaccaccaaggtggtgagcatcagatactacgcccccgtgagacagagaaagggcagagacaccggccccggcaagagaaagagagaggacgaggcccccatcctggagcagagagagaacagaatgaaccccctgagatgccccgtgaagttctacgagttctacctgagcaagtgccccgagagcctgagaaccagaaacgacgtgttctacctgcagcccgagagaagctgcatcgccgagagccccctgtggtacagcgtgatccccatggacagaagcatgctggagagcatgctgaacagaatcctggccgtgagagagatctacgaggagctgggcagacccggcgaggaggacctggactag

SEQ ID NO: 106357 - DNA, 4077 bp, Artificial Sequence
  Description of Artificial Sequence: Synthetic coding sequence
atggaccccagcgacttccccagccccttcgaccccctgaccctgcccgagaagcccctggccggcgacctgcccgtggacatggagttcggcgaggacctgctggagagccagaccgcccccaccagaggctgggccccccccggccccagccccagcagcggcgccctggacctgctggacacccccgccggcctggagaaggaccccggcgtgctggacggcgccaccgagctgctgggcctgggcggcctgctgtacaaggcccccagcccccccgaggtggaccacggccccgagggcaccctggcctgggacgccggcgaccagaccctggagcccggccccggcggccagacccccgaggtggtgccccccgaccccggcgccggcgccaacagctgcagccccgagggcctgctggagcccctggcccccgacagccccatcaccctgcagagcccccacatcgaggaggaggagaccaccagcatcgccaccgccagaagaggcagccccggccaggaggaggagctgccccagggccagccccagagccccaacgccccccccagccccagcgtgggcgagaccctgggcgacggcatcaacagcagccagaccaagcccggcggcagcagcccccccgcccaccccagcctgcccggcgacggcctgaccgccaaggccagcgagaagccccccgagagaaagagaagcgagagagtgagaagagccgagccccccaagcccgaggtggtggacagcaccgagagcatccccgtgagcgacgaggacagcgacgccatggtggacgaccccaacgacgaggacttcgtgcccttcagacccagaagaagccccagaatgagcctgagaagcagcgtgagccagagagccggcagaagcgccgtgggcaccaagatgacctgcgcccactgcagaacccccctgcagaagggccagaccgcctaccagagaaagggcctgccccagctgttctgcagcagcagctgcctgaccaccttcagcaagaagcccagcggcaagaagacctgcaccttctgcaagaaggagatctggaacaccaaggacagcgtggtggcccagaccggcagcggcggcagcttccacgagttctgcaccagcgtgtgcctgagcctgtacgaggcccagcagcagagacccatcccccagagcggcgaccccgccgacgccaccagatgcagcatctgccagaagaccggcgaggtgctgcacgaggtgagcaacggcagcgtggtgcacagactgtgcagcgacagctgcttcagcaagttcagagccaacaagggcctgaagaccaactgctgcgaccagtgcggcgcctacatctacaccaagaccggcagccccggccccgagctgctgttccacgagggccagcagaagagattctgcaacaccacctgcctgggcgcctacaagaagaagaacaccagagtgtacccctgcgtgtggtgcaagaccctgtgcaagaacttcgagatgctgagccacgtggacagaaacggcaagaccagcctgttctgcagcctgtgctgcaccaccagctacaaggtgaagcaggccggcctgaccggcccccccagaccctgcagcttctgcagaagaagcctgagcgacccctgctactacaacaaggtggacagaaccgtgtaccagttctgcagccccagctgctggaccaagttccagagaaccagccccgagggcggcatccacctgagctgccactactgccacagcctgttcagcggcaagcccgaggtgctggactggcaggaccaggtgttccagttctgctgcagagactgctgcgaggacttcaagagactgagaggcgtggtgagccagtgcgagcactgcagacaggagaagctgctgcacgagaagctgagattcagcggcgtggagaagagcttctgcagcgagggctgcgtgctgctgtacaagcaggacttcaccaagaagctgggcctgtgctgcatcacctgcacctactgcagccagacctgccagagaggcgtgaccgagcagctggacggcagcacctgggacttctgcagcgaggactgcaagagcaagtacctgctgtggtactgcaaggccgccagatgccacgcctgcaagagacagggcaagctgctggagaccatccactggagaggccagatcagacacttctgcaaccagcagtgcctgctgagattctacagccagcagaaccagcccaacctggacacccagagcggccccgagagcctgctgaacagccagagccccgagagcaagccccagacccccagccagaccaaggtggagaacagcaacaccatccccgtgaagaccagaagcgcccccaccgcccccacccccccccccccccccccccccgccacccccagaaagaacaaggccgccatgtgcaagcccctgatgcagaacagaggcgtgagctgcaaggtggagatgaagagcaagggcagccagaccgaggagtggaagccccaggtgatcgtgctgcccatccccgtgcccatcttcgtgcccgtgcccatgcacctgtactgccagaaggtgcccgtgcccttcagcatgcccatccccgtgcccgtgcccatgttcctgcccaccaccctggagagcaccgacaagatcgtggagaccatcgaggagctgaaggtgaagatccccagcaaccccctggaggccgacatcctggccatggccgagatgatcgccgaggccgaggagctggacaaggccagcagcgacctgtgcgacctggtgagcaaccagagcgccgagggcctgctggaggactgcgacctgttcggccccgccagagacgacgtgctggccatggccgtgaagatggccaacgtgctggacgagcccggccaggacctggaggccgacttccccaagaaccccctggacatcaaccccagcgtggacttcctgttcgactgcggcctggtgggccccgaggacgtgagcaccgagcaggacctgcccagaaccatgagaaagggccagaagagactggtgctgagcgagagctgcagcagagacagcatgagcagccagcccagctgcaccggcctgaactacagctacggcgtgaacgcctggaagtgctgggtgcagagcaagtacgccaacggcgagaccagcaagggcgacgagctgagattcggccccaagcccatgagaatcaaggaggacatcctggcctgcagcgccgccgagctgaactacggcctggcccagttcgtgagagagatcaccagacccaacggcgagagatacgagcccgacagcatctactacctgtgcctgggcatccagcagtacctgctggagaacaacagaatggtgaacatcttcaccgacctgtactacctgaccttcgtgcaggagctgaacaagagcctgagcacctggcagcccaccctgctgcccaacaacaccgtgttcagcagagtggaggaggagcacctgtgggagtgcaagcagctgggcgtgtacagccccttcgtgctgctgaacaccctgatgttcttcaacaccaagttcttcggcctgcagaccgccgaggagcacatgcagctgagcttcaccaacgtggtgagacagagcagaaagtgcaccacccccagaggcaccaccaaggtggtgagcatcagatactacgcccccgtgagacagagaaagggcagagacaccggccccggcaagagaaagagagaggacgaggcccccatcctggagcagagagagaacagaatgaaccccctgagatgccccgtgaagttctacgagttctacctgagcaagtgccccgagagcctgagaaccagaaacgacgtgttctacctgcagcccgagagaagctgcatcgccgagagccccctgtggtacagcgtgatccccatggacagaagcatgctggagagcatgctgaacagaatcctggccgtgagagagatctacgaggagctgggcagacccggcgaggaggacctggactag

SEQ ID NO: 106358 - DNA, 2112 bp, Artificial Sequence; identical to SEQ ID NO: 105642
  Description of Artificial Sequence: Synthetic coding sequence

SEQ ID NO: 106359 - DNA, 2229 bp, Artificial Sequence
  Description of Artificial Sequence: Synthetic coding sequence
atggagttcgtgagcggctacagagacgagttcctggacttcaccgccctgctgttcggctggttcagaaagttcgtggccgagagaggcgccgtgggcaccagcctggagggcagatgcagacagctggaggcccagatcagaagactgccccaggaccccgccctgtgggtgctgcacgtgctgcccaaccacagcgtgggcatcagcctgggccagggcgccgagcccggccccggccccggcctgggcaccgcctggctgctgggcgacaacccccccctgcacctgagagacctgagcccctacatcagcttcgtgagcctggaggacggcgaggagggcgaggaggaggaggaggaggacgaggaggaggagaagagagaggacggcggcgccggcagcaccgagaaggtggagcccgaggaggacagagagctggcccccaccagcagagagagcccccaggagaccaacccccccggcgagagcgaggaggccgccagagaggccggcggcggcaaggacggctgcagagaggacagagtggagaacgagaccagaccccagaagagaaagggccagagaagcgaggccgcccccctgcacgtgagctgcctgctgctggtgaccgacgagcacggcaccatcctgggcatcgacctgctggtggacggcgcccagggcaccgccagctggggcagcggcaccaaggacctggccccctgggcctacgccctgctgtgccacagcatggcctgccccatgggcagcggcgaccccagaaagcccagacagctgaccgtgggcgacgccagactgcacagagagctggagagcctggtgcccagactgggcgtgaagctggccaagacccccatgagaacctggggccccagacccggcttcaccttcgccagcctgagagccagaacctgccacgtgtgccacagacacagcttcgaggccaagctgaccccctgcccccagtgcagcgccgtgctgtactgcggcgaggcctgcctgagagccgactggcagagatgccccgacgacgtgagccacagattctggtgccccagactggccgccttcatggagagagccggcgagctggccaccctgcccttcacctacaccgccgaggtgaccagcgagaccttcaacaaggaggccttcctggccagcagaggcctgaccagaggctactggacccagctgagcatgctgatccccggccccggcttcagcagacaccccagaggcaacacccccagcctgagcctgctgagaggcggcgacccctaccagctgctgcagggcgacggcaccgccctgatgccccccgtgcccccccacccccccagaggcgtgttcggcagctggcaggactactacacctggagaggcctgagcctggacagccccatcgccgtgctgctgacctaccccctgaccgtgtactacgtgatcacccacctggtgccccagagcttccccgagctgaacatccagaacaagcagagcctgaagatccacgtggtggaggccggcaaggagttcgacctggtgatggtgttctgggagctgctggtgctgctgccccacgtggccctggagctgcagttcgtgggcgacggcctgccccccgagagcgacgagcagcacttcaccctgcagagagacagcctggaggtgagcgtgagacccggcagcggcatcagcgccagacccagcagcggcaccaaggagaagggcggcagaagagacctgcagatcaaggtgagcgccagaccctaccacctgttccagggccccaagcccgacctggtgatcggcttcaacagcggcttcgccctgaaggacacctggctgagaagcctgcccagactgcagagcctgagagtgcccgccttcttcaccgagagcagcgagtacagctgcgtgatggacggccagaccatggccgtggccaccggcggcggcaccagccccccccagcccaaccccttcagaagccccttcagactgagagccgccgacaactgcatgagctggtactgcaacgccttcatcttccacctggtgtacaagcccgcccagggcagcggcgccagacccgcccccggcccccccccccccagccccacccccagcgccccccccgcccccaccagaagaagaagaggcgagaagaagcccggcagaggcgccagaagaagaaagtag

SEQ ID NO: 106360 - DNA, 684 bp, Artificial Sequence
  Description of Artificial Sequence: Synthetic coding sequence
atgaccgacttcaagctgggcatcgtgagactgggcagagtggccggcaagaccaagtacaccctgatcgacgagcaggacatccccctggtggagagctacagcttcgaggccagaatggaggtggacgccgacggcaacggcgccaagatcttcgcctacgccttcgacaagaacagaggcagaggcagcggcagactgctgcacgagctgctgtgggagagacacagaggcggcgtggcccccggcttccaggtggtgcacctgaacgccgtgaccgtggacaacagactggacaacctgcagctggtgccctggggctggagacccaaggccgaggagaccagcagcaagcagagagagcagagcctgtactggctggccatccagcagctgcccaccgaccccatcgaggagcagttccccgtgctgaacgtgaccagatactacaacgccaacggcgacgtggtggaggaggaggagaacagctgcacctactacgagtgccactaccccccctgcaccgtgatcgagaagcagctgagagagttcaacatctgcggcagatgccaggtggccagatactgcggcagccagtgccagcagaaggactggcccgcccacaagaagcactgcagagagagaaagagacccttccagcacgagctggagcccgagagatag

SEQ ID NO: 106361 - DNA, 2127 bp, Artificial Sequence
  Description of Artificial Sequence: Synthetic coding sequence
atgagcgagagaggcatcaagtgggcctgcgagtactgcacctacgagaactggcccagcgccatcaagtgcaccatgtgcagagcccagagacccagcggcaccatcatcaccgaggaccccttcaagagcggcagcagcgacgtgggcagagactgggaccccagcagcaccgagggcggcagcagccccctgatctgccccgacagcagcgccagacccagagtgaagagcagctacagcatggagaacgccaacaagtggagctgccacatgtgcacctacctgaactggcccagagccatcagatgcacccagtgcctgagccagagaagaaccagaagccccaccgagagcccccagagcagcggcagcggcagcagacccgtggccttcagcgtggacccctgcgaggagtacaacgacagaaacaagctgaacaccagaacccagcactggacctgcagcgtgtgcacctacgagaactgggccaaggccaagagatgcgtggtgtgcgaccaccccagacccaacaacatcgaggccatcgagctggccgagaccgaggaggccagcagcatcatcaacgagcaggacagagccagatggagaggcagctgcagcagcggcaacagccagagaagaagcccccccgccaccaagagagacagcgaggtgaagatggacttccagagaatcgagctggccggcgccgtgggcagcaaggaggagctggaggtggacttcaagaagctgaagcagatcaagaacagaatgaagaagaccgactggctgttcctgaacgcctgcgtgggcgtggtggagggcgacctggccgccatcgaggcctacaagagcagcggcggcgacatcgccagacagctgaccgccgacgaggtgagactgctgaacagacccagcgccttcgacgtgggctacaccctggtgcacctggccatcagattccagagacaggacatgctggccatcctgctgaccgaggtgagccagcaggccgccaagtgcatccccgccatggtgtgccccgagctgaccgagcagatcagaagagagatcgccgccagcctgcaccagagaaagggcgacttcgcctgctacttcctgaccgacctggtgaccttcaccctgcccgccgacatcgaggacctgccccccaccgtgcaggagaagctgttcgacgaggtgctggacagagacgtgcagaaggagctggaggaggagagccccatcatcaactggagcctggagctggccaccagactggacagcagactgtacgccctgtggaacagaaccgccggcgactgcctgctggacagcgtgctgcaggccacctggggcatctacgacaaggacagcgtgctgagaaaggccctgcacgacagcctgcacgactgcagccactggttctacaccagatggaaggactgggagagctggtacagccagagcttcggcctgcacttcagcctgagagaggagcagtggcaggaggactgggccttcatcctgagcctggccagccagcccggcgccagcctggagcagacccacatcttcgtgctggcccacatcctgagaagacccatcatcgtgtacggcgtgaagtactacaagagcttcagaggcgagaccctgggctacaccagattccagggcgtgtacctgcccctgctgtgggagcagagcttctgctggaagagccccatcgccctgggctacaccagaggccacttcagcgccctggtggccatggagaacgacggctacggcaacagaggcgccggcgccaacctgaacaccgacgacgacgtgaccatcaccttcctgcccctggtggacagcgagagaaagctgctgcacgtgcacttcctgagcgcccaggagctgggcaacgaggagcagcaggagaagctgctgagagagtggctggactgctgcgtgaccgagggcggcgtgctggtggccatgcagaagagcagcagaagaagaaaccaccccctggtgacccagatggtggagaagtggctggacagatacagacagatcagaccctgcaccagcctgagcgacggcgaggaggacgaggacgacgaggacgagtag

SEQ ID NO: 106362 - DNA, 2400 bp, Artificial Sequence
  Description of Artificial Sequence: Synthetic coding sequence
atggagatccccaagctgctgcccgccagaggcaccctgcagggcggcggcggcggcggcatccccgccggcggcggcagagtgcacagaggccccgacagccccgccggccaggtgcccaccagaagactgctgctgcccagaggcccccaggacggcggccccggcagaagaagagaggaggccagcaccgccagcagaggccccggccccagcctgttcgcccccagaccccaccagcccagcggcggcggcgacgacttcttcctggtgctgctggaccccgtgggcggcgacgtggagaccgccggcagcggccaggccgccggccccgtgctgagagaggaggccaaggccggccccggcctgcagggcgacgagagcggcgccaaccccgccggctgcagcgcccagggcccccactgcctgagcgccgtgcccacccccgcccccatcagcgcccccggccccgccgccgccttcgccggcaccgtgaccatccacaaccaggacctgctgctgagattcgagaacggcgtgctgaccctggccaccccccccccccacgcctgggagcccggcgccgcccccgcccagcagcccagatgcctgatcgccccccaggccggcttcccccaggccgcccaccccggcgactgccccgagctgagaagcgacctgctgctggccgagcccgccgagcccgcccccgcccccgccccccaggaggaggccgagggcctggccgccgccctgggccccagaggcctgctgggcagcggccccggcgtggtgctgtacctgtgccccgaggccctgtgcggccagaccttcgccaagaagcaccagctgaagatgcacctgctgacccacagcagcagccagggccagagacccttcaagtgccccctgggcggctgcggctggaccttcaccaccagctacaagctgaagagacacctgcagagccacgacaagctgagacccttcggctgccccgccgagggctgcggcaagagcttcaccaccgtgtacaacctgaaggcccacatgaagggccacgagcaggagaacagcttcaagtgcgaggtgtgcgaggagagcttccccacccaggccaagctgggcgcccaccagagaagccacttcgagcccgagagaccctaccagtgcgccttcagcggctgcaagaagaccttcatcaccgtgagcgccctgttcagccacaacagagcccacttcagagagcaggagctgttcagctgcagcttccccggctgcagcaagcagtacgacaaggcctgcagactgaagatccacctgagaagccacaccggcgagagacccttcctgtgcgacttcgacggctgcggctggaacttcaccagcatgagcaagctgctgagacacaagagaaagcacgacgacgacagaagattcatgtgccccgtggagggctgcggcaagagcttcaccagagccgagcacctgaagggccacagcatcacccacctgggcaccaagcccttcgtgtgccccgtggccggctgctgcgccagattcagcgccagaagcagcctgtacatccacagcaagaagcacctgcaggacgtggacacctggaagagcagatgccccatcagcagctgcaacaagctgttcaccagcaagcacagcatgaagacccacatggtgaagagacacaaggtgggccaggacctgctggcccagctggaggccgccaacagcctgacccccagcagcgagctgaccagccagagacagaacgacctgagcgacgccgagatcgtgagcctgttcagcgacgtgcccgacagcaccagcgccgccctgctggacaccgccctggtgaacagcggcatcctgaccatcgacgtggccagcgtgagcagcaccctggccggccacctgcccgccaacaacaacaacagcgtgggccaggccgtggacccccccagcctgatggccaccagcgaccccccccagagcctggacaccagcctgttcttcggcaccgccgccaccggcttccagcagagcagcctgaacatggacgaggtgagcagcgtgagcgtgggccccctgggcagcctggacagcctggccatgaagaacagcagccccgagccccaggccctgacccccagcagcaagctgaccgtggacaccgacaccctgacccccagcagcaccctgtgcgagaacagcgtgagcgagctgctgacccccgccaaggccgagtggagcgtgcaccccaacagcgacttcttcggccaggagggcgagacccagttcggcttccccaacgccgccggcaaccacggcagccagaaggagagaaacctgatcaccgtgaccggcagcagcttcctggtgtag

SEQ ID NO: 106363 - DNA, 2412 bp, Artificial Sequence
  Description of Artificial Sequence: Synthetic coding sequence
atggagatccccaagctgctgcccgccagaggcaccctgcagggcggcggcggcggcggcatccccgccggcggcggcagagtgcacagaggccccgacagccccgccggccaggtgcccaccagaagactgctgctgctgagaggcccccaggacggcggccccggcagaagaagagaggaggccagcaccgccagcagaggccccggccccagcctgctggcccccagaaccgaccagcccagcggcggcggcggcggcggcggcgacgacttcttcctggtgctgctggaccccgtgggcggcgacgtggagaccgccggcagcggccaggccgccggccccgtgctgagagaggaggccgaggagggccccggcctgcagggcggcgagagcggcgccaaccccgccggccccaccgccctgggccccagatgcctgagcgccgtgcccacccccgcccccatcagcgcccccggccccgccgccgccttcgccggcaccgtgaccatccacaaccaggacctgctgctgagattcgagaacggcgtgctgaccctggccaccccccccccccacgcctgggagcccggcgccgcccccgcccagcagcccggctgcctgatcgccccccaggccggcttcccccacgccgcccaccccggcgactgccccgagctgccccccgacctgctgctggccgagcccgccgagcccgcccccgcccccgcccccgaggaggaggccgagggccccgccgccgccctgggccccagaggccccctgggcagcggccccggcgtggtgctgtacctgtgccccgaggcccagtgcggccagaccttcgccaagaagcaccagctgaaggtgcacctgctgacccacagcagcagccagggccagagacccttcaagtgccccctgggcggctgcggctggaccttcaccaccagctacaagctgaagagacacctgcagagccacgacaagctgagacccttcggctgccccgccgagggctgcggcaagagcttcaccaccgtgtacaacctgaaggcccacatgaagggccacgagcaggagaacagcttcaagtgcgaggtgtgcgaggagagcttccccacccaggccaagctgagcgcccaccagagaagccacttcgagcccgagagaccctaccagtgcgccttcagcggctgcaagaagaccttcatcaccgtgagcgccctgttcagccacaacagagcccacttcagagagcaggagctgttcagctgcagcttccccggctgcagcaagcagtacgacaaggcctgcagactgaagatccacctgagaagccacaccggcgagagacccttcctgtgcgacttcgacggctgcggctggaacttcaccagcatgagcaagctgctgagacacaagagaaagcacgacgacgacagaagattcatgtgccccgtggagggctgcggcaagagcttcaccagagccgagcacctgaagggccacagcatcacccacctgggcaccaagcccttcgtgtgccccgtggccggctgctgcgccagattcagcgccagaagcagcctgtacatccacagcaagaagcacctgcaggacgtggacacctggaagagcagatgccccatcagcagctgcaacaagctgttcaccagcaagcacagcatgaagacccacatggtgaagagacacaaggtgggccaggacctgctggcccagctggaggccgccaacagcctgacccccagcagcgagctgaccagccagagacagaacgacctgagcgacgccgagatcgtgagcctgttcagcgacgtgcccgacagcaccagcgccgccctgctggacaccgccctggtgaacagcggcatcctgaccatcgacgtggccagcgtgagcagcaccctggccggccacctgcccgccaacaacaacaacagcgtgggccaggccgtggacccccccagcctgatggccaccagcgaccccccccagagcctggacaccagcctgttcttcggcaccgccgccaccggcttccagcagagcagcctgaacatggacgaggtgagcagcgtgagcgtgggccccctgggcagcctggacagcctggccatgaagaacagcagccccgagccccaggccctgacccccagcagcaagctgaccgtggacaccgacgccctgacccccagcagcaccctgtgcgagaacagcgtgagcgagctgctgacccccaccaaggccgagtggaacgtgcaccccgacagcgacttcttcggccaggagggcgagacccagttcggcttccccaacgccgccggcaaccacggcagccagaaggagaccgacctgatcaccgtgaccggcagcagcttcctggtgtag

SEQ ID NO: 106364 - DNA, 2622 bp, Artificial Sequence
  Description of Artificial Sequence: Synthetic coding sequence
atggccagcagaagaaagagcaccaccccctgcatggtgctggccagcgagcaggaccccgacctggagctgatcagcgacctggacgagggcccccccgtgctgacccccgtggagaacaccagagccgagagcatcagcagcgacgaggaggtgcacgagagcgtggacagcgacaaccagcagaacaagaaggtggagggcggctacgagtgcaagtactgcaccttccagacccccgacctgaacatgttcaccttccacgtggacagcgagcaccccaacgtggtgctgaacagcagctacgtgtgcgtggagtgcaacttcctgaccaagagatacgacgccctgagcgagcacaacctgaagtaccaccccggcgaggagaacttcaagctgaccatggtgaagagaaacaaccagaccatcttcgagcagaccatcaacgacctgaccttcgacggcagcttcgtgaaggaggagaacgccgagcaggccgagagcaccgaggtgagcagcagcggcatcagcatcagcaagacccccatcatgaagatgatgaagaacaaggtggagaacaagagaatcgccgtgcaccacaacagcgtggaggacgtgcccgaggagaaggagaacgagatcaagcccgacagagaggagatcgtggagaaccccagcagcagcgccagcgagagcaacaccagcaccagcatcgtgaacagaatccaccccagcaccgccagcaccgtggtgacccccgccgccgtgctgcccggcctggcccaggtgatcaccgccgtgagcgcccagcagaacagcaacctgatccccaaggtgctgatccccgtgaacagcatccccacctacaacgccgccctggacaacaaccccctgctgctgaacacctacaacaagttcccctaccccaccatgagcgagatcaccgtgctgagcgcccaggccaagtacaccgaggagcagatcaagatctggttcagcgcccagagactgaagcacggcgtgagctggacccccgaggaggtggaggaggccagaagaaagcagttcaacggcaccgtgcacaccgtgccccagaccatcaccgtgatccccacccacatcagcaccggcagcaacggcctgcccagcatcctgcagacctgccagatcgtgggccagcccggcctggtgctgacccaggtggccggcaccaacaccctgcccgtgaccgcccccatcgccctgaccgtggccggcgtgcccagccagaacaacatccagaagagccaggtgcccgccgcccagcccaccgccgagaccaagcccgccaccgccgccgtgcccaccagccagagcgtgaagcacgagaccgccctggtgaaccccgacagcttcggcatcagagccaagaagaccaaggagcagctggccgagctgaaggtgagctacctgaagaaccagttcccccacgacagcgagatcatcagactgatgaagatcaccggcctgaccaagggcgagatcaagaagtggttcagcgacaccagatacaaccagagaaacagcaagagcaaccagtgcctgcacctgaacaacgacagcagcaccaccatcatcatcgacagcagcgacgagaccaccgagagccccaccgtgggcaccgcccagcccaagcagagctggaaccccttccccgacttcaccccccagaagttcaaggagaagaccgccgagcagctgagagtgctgcaggccagcttcctgaacagcagcgtgctgaccgacgaggagctgaacagactgagagcccagaccaagctgaccagaagagagatcgacgcctggttcaccgagaagaagaagagcaaggccctgaaggaggagaagatggagatcgacgagagcaacgccggcagcagcaaggaggaggccggcgagaccagccccgccgacgagagcggcgcccccaagagcggcagcaccggcaagatctgcaagaagacccccgagcagctgcacatgctgaagagcgccttcgtgagaacccagtggcccagccccgaggagtacgacaagctggccaaggagagcggcctggccagaaccgacatcgtgagctggttcggcgacaccagatacgcctggaagaacggcaacctgaagtggtactactactaccagagcgccaacagcagcagcatgaacggcctgagcagcctgagaaagagaggcagaggcagacccaagggcagaggcagaggcagacccagaggcagacccagaggcagcaagagaatcaacaactgggacagaggccccagcctgatcaagttcaagaccggcaccgccatcctgaaggactactacctgaagcacaagttcctgaacgagcaggacctggacgagctggtgaacaagagccacatgggctacgagcaggtgagagagtggttcgccgagagacagagaagaagcgagctgggcatcgagctgttcgaggagaacgaggaggaggacgaggtgatcgacgaccaggaggaggacgaggaggagaccgacgacagcgacacctgggagccccccagacacgtgaagagaaagctgagcaagagcgacgactag

SEQ ID NO: 106365 - DNA, 2622 bp, Artificial Sequence; identical to SEQ ID NO: 106364
  Description of Artificial Sequence: Synthetic coding sequence

SEQ ID NO: 106366 - DNA, 2622 bp, Artificial Sequence; identical to SEQ ID NO: 106364
  Description of Artificial Sequence: Synthetic coding sequence

SEQ ID NO: 106367 - DNA, 1497 bp, Artificial Sequence
  Description of Artificial Sequence: Synthetic coding sequence
atggccagcaagagaaagagcaccaccccctgcatgatccccgtgaagaccgtggtgctgcaggacgccagcatggaggcccagcccgccgagaccctgcccgagggcccccagcaggacctgccccccgaggccagcgccgccagcagcgaggccgcccagaaccccagcagcaccgacggcagcaccctggccaacggccacagaagcaccctggacggctacctgtacagctgcaagtactgcgacttcagaagccacgacatgacccagttcgtgggccacatgaacagcgagcacaccgacttcaacaaggaccccaccttcgtgtgcagcggctgcagcttcctggccaagacccccgagggcctgagcctgcacaacgccacctgccacagcggcgaggccagcttcgtgtggaacgtggccaagcccgacaaccacgtggtggtggagcagagcatccccgagagcaccagcacccccgacctggccggcgagcccagcgccgagggcgccgacggccaggccgagatcatcatcaccaagacccccatcatgaagatcatgaagggcaaggccgaggccaagaagatccacaccctgaaggagaacgtgcccagccagcccgtgggcgaggccctgcccaagctgagcaccggcgagatggaggtgagagagggcgaccacagcttcatcaacggcgccgtgcccgtgagccaggccagcgccagcagcgccaagaacccccacgccgccaacggccccctgatcggcaccgtgcccgtgctgcccgccggcatcgcccagttcctgagcctgcagcagcagccccccgtgcacgcccagcaccacgtgcaccagcccctgcccaccgccaaggccctgcccaaggtgatgatccccctgagcagcatccccacctacaacgccgccatggacagcaacagcttcctgaagaacagcttccacaagttcccctaccccaccaaggccgagctgtgctacctgaccgtggtgaccaagtaccccgaggagcagctgaagatctggttcaccgcccagagactgaagcagggcatcagctggagccccgaggagatcgaggacgccagaaagaagatgttcaacaccgtgatccagagcgtgccccagcccaccatcaccgtgctgaacacccccctggtggccagcgccggcaacgtgcagcacctgatccaggccgccctgcccggccacgtggtgggccagcccgagggcaccggcggcggcctgctggtgacccagcccctgatggccaacggcctgcaggccaccagcagccccctgcccctgaccgtgaccagcgtgcccaagcagcccggcgtggcccccatcaacaccgtgtgcagcaacaccaccagcgccgtgaaggtggtgaacgccgcccagagcctgctgaccgcctgccccagcatcaccagccaggccttcctggacgccagcatctacaagtag

SEQ ID NO: 106368 - DNA, 291 bp, Artificial Sequence
  Description of Artificial Sequence: Synthetic coding sequence
atggccagcaagagaaagagcaccaccccctgcatgatccccgtgaagaccgtggtgctgcaggacgccagcatggaggcccagcccgccgagaccctgcccgagggcccccagcaggacctgccccccgaggccagcgccgccagcagcgaggccgcccagaaccccagcagcaccgacggcagcaccctggccaacggccacagaagcaccctggacggctacctgtacagctgcaagtactgcgacttcagaagccacgacatgacccagttcgtgggccacatgtag

SEQ ID NO: 106369 - DNA, 2244 bp, Artificial Sequence
  Description of Artificial Sequence: Synthetic coding sequence
atggaggtgagagagggcgaccacagcttcatcaacggcgccgtgcccgtgagccaggccagcgccagcagcgccaagaacccccacgccgccaacggccccctgatcggcaccgtgcccgtgctgcccgccggcatcgcccagttcctgagcctgcagcagcagccccccgtgcacgcccagcaccacgtgcaccagcccctgcccaccgccaaggccctgcccaaggtgatgatccccctgagcagcatccccacctacaacgccgccatggacagcaacagcttcctgaagaacagcttccacaagttcccctaccccaccaaggccgagctgtgctacctgaccgtggtgaccaagtaccccgaggagcagctgaagatctggttcaccgcccagagactgaagcagggcatcagctggagccccgaggagatcgaggacgccagaaagaagatgttcaacaccgtgatccagagcgtgccccagcccaccatcaccgtgctgaacacccccctggtggccagcgccggcaacgtgcagcacctgatccaggccgccctgcccggccacgtggtgggccagcccgagggcaccggcggcggcctgctggtgacccagcccctgatggccaacggcctgcaggccaccagcagccccctgcccctgaccgtgaccagcgtgcccaagcagcccggcgtggcccccatcaacaccgtgtgcagcaacaccaccagcgccgtgaaggtggtgaacgccgcccagagcctgctgaccgcctgccccagcatcaccagccaggccttcctggacgccagcatctacaagaacaagaagagccacgagcagctgagcgccctgaagggcagcttctgcagaaaccagttccccggccagagcgaggtggagcacctgaccaaggtgaccggcctgagcaccagagaggtgagaaagtggttcagcgacagaagataccactgcagaaacctgaagggcagcagagccatgatccccggcgaccacagcagcatcatcatcgacagcgtgcccgaggtgagcttcagccccagcagcaaggtgcccgaggtgacctgcatccccaccaccgccaccctggccacccaccccagcgccaagagacagagctggcaccagacccccgacttcacccccaccaagtacaaggagagagcccccgagcagctgagagccctggagagcagcttcgcccagaaccccctgcccctggacgaggagctggacagactgagaagcgagaccaagatgaccagaagagagatcgacagctggttcagcgagagaagaaagaaggtgaacgccgaggagaccaagaaggccgaggagaacgccagccaggaggaggaggaggccgccgaggacgagggcggcgaggaggacctggccagcgagctgagagtgagcggcgagaacggcagcctggagatgcccagcagccacatcctggccgagagaaaggtgagccccatcaagatcaacctgaagaacctgagagtgaccgaggccaacggcagaaacgagatccccggcctgggcgcctgcgaccccgaggacgacgagagcaacaagctggccgagcagctgcccggcaaggtgagctgcaagaagaccgcccagcagagacacctgctgagacagctgttcgtgcagacccagtggcccagcaaccaggactacgacagcatcatggcccagaccggcctgcccagacccgaggtggtgagatggttcggcgacagcagatacgccctgaagaacggccagctgaagtggtacgaggactacaagagaggcaacttcccccccggcctgctggtgatcgcccccggcaacagagagctgctgcaggactactacatgacccacaagatgctgtacgaggaggacctgcagaacctgtgcgacaagacccagatgagcagccagcaggtgaagcagtggttcgccgagaagatgggcgaggagaccagagccgtggccgacaccggcagcgaggaccagggccccggcaccggcgagctgaccgccgtgcacaagggcatgggcgacacctacagcgaggtgagcgagaacagcgagagctgggagcccagagtgcccgaggccagcagcgagcccttcgacaccagcagcccccaggccggcagacagctgggcagctggagcctgagcagccagcccctgcccagcctgctgaccctgtag

SEQ ID NO: 106370 - DNA, 2871 bp, Artificial Sequence
  Description of Artificial Sequence: Synthetic coding sequence
atggccagcaagagaaagagcaccaccccctgcatgatccccgtgaagaccgtggtgctgcaggacgccagcatggaggcccagcccgccgagaccctgcccgagggcccccagcaggacctgccccccgaggccagcgccgccagcagcgaggccgcccagaaccccagcagcaccgacggcagcaccctggccaacggccacagaagcaccctggacggctacctgtacagctgcaagtactgcgacttcagaagccacgacatgacccagttcgtgggccacatgaacagcgagcacaccgacttcaacaaggaccccaccttcgtgtgcagcggctgcagcttcctggccaagacccccgagggcctgagcctgcacaacgccacctgccacagcggcgaggccagcttcgtgtggaacgtggccaagcccgacaaccacgtggtggtggagcagagcatccccgagagcaccagcacccccgacctggccggcgagcccagcgccgagggcgccgacggccaggccgagatcatcatcaccaagacccccatcatgaagatcatgaagggcaaggccgaggccaagaagatccacaccctgaaggagaacgtgcccagccagcccgtgggcgaggccctgcccaagctgagcaccggcgagatggaggtgagagagggcgaccacagcttcatcaacggcgccgtgcccgtgagccaggccagcgccagcagcgccaagaacccccacgccgccaacggccccctgatcggcaccgtgcccgtgctgcccgccggcatcgcccagttcctgagcctgcagcagcagccccccgtgcacgcccagcaccacgtgcaccagcccctgcccaccgccaaggccctgcccaaggtgatgatccccctgagcagcatccccacctacaacgccgccatggacagcaacagcttcctgaagaacagcttccacaagttcccctaccccaccaaggccgagctgtgctacctgaccgtggtgaccaagtaccccgaggagcagctgaagatctggttcaccgcccagagactgaagcagggcatcagctggagccccgaggagatcgaggacgccagaaagaagatgttcaacaccgtgatccagagcgtgccccagcccaccatcaccgtgctgaacacccccctggtggccagcgccggcaacgtgcagcacctgatccaggccgccctgcccggccacgtggtgggccagcccgagggcaccggcggcggcctgctggtgacccagcccctgatggccaacggcctgcaggccaccagcagccccctgcccctgaccgtgaccagcgtgcccaagcagcccggcgtggcccccatcaacaccgtgtgcagcaacaccaccagcgccgtgaaggtggtgaacgccgcccagagcctgctgaccgcctgccccagcatcaccagccaggccttcctggacgccagcatctacaagaacaagaagagccacgagcagctgagcgccctgaagggcagcttctgcagaaaccagttccccggccagagcgaggtggagcacctgaccaaggtgaccggcctgagcaccagagaggtgagaaagtggttcagcgacagaagataccactgcagaaacctgaagggcagcagagccatgatccccggcgaccacagcagcatcatcatcgacagcgtgcccgaggtgagcttcagccccagcagcaaggtgcccgaggtgacctgcatccccaccaccgccaccctggccacccaccccagcgccaagagacagagctggcaccagacccccgacttcacccccaccaagtacaaggagagagcccccgagcagctgagagccctggagagcagcttcgcccagaaccccctgcccctggacgaggagctggacagactgagaagcgagaccaagatgaccagaagagagatcgacagctggttcagcgagagaagaaagaaggtgaacgccgaggagaccaagaaggccgaggagaacgccagccaggaggaggaggaggccgccgaggacgagggcggcgaggaggacctggccagcgagctgagagtgagcggcgagaacggcagcctggagatgcccagcagccacatcctggccgagagaaaggtgagccccatcaagatcaacctgaagaacctgagagtgaccgaggccaacggcagaaacgagatccccggcctgggcgcctgcgaccccgaggacgacgagagcaacaagctggccgagcagctgcccggcaaggtgagctgcaagaagaccgcccagcagagacacctgctgagacagctgttcgtgcagacccagtggcccagcaaccaggactacgacagcatcatggcccagaccggcctgcccagacccgaggtggtgagatggttcggcgacagcagatacgccctgaagaacggccagctgaagtggtacgaggactacaagagaggcaacttcccccccggcctgctggtgatcgcccccggcaacagagagctgctgcaggactactacatgacccacaagatgctgtacgaggaggacctgcagaacctgtgcgacaagacccagatgagcagccagcaggtgaagcagtggttcgccgagaagatgggcgaggagaccagagccgtggccgacaccggcagcgaggaccagggccccggcaccggcgagctgaccgccgtgcacaagggcatgggcgacacctacagcgaggtgagcgagaacagcgagagctgggagcccagagtgcccgaggccagcagcgagcccttcgacaccagcagcccccaggccggcagacagctggagaccgactag

SEQ ID NO: 106371 - DNA, 141 bp, Artificial Sequence
  Description of Artificial Sequence: Synthetic coding sequence
atggccagcaagagaaagagcaccaccccctgcatgatccccgtgaagaccgtggtgctgcaggacgccagcatggaggcccagcccgccgagaccctgcccgagggcccccagcaggacctgccccccgaggccagctag

SEQ ID NO: 106372 - DNA, 1497 bp, Artificial Sequence; identical to SEQ ID NO: 106367
  Description of Artificial Sequence: Synthetic coding sequence

SEQ ID NO: 106373 - DNA, 147 bp, Artificial Sequence
  Description of Artificial Sequence: Synthetic coding sequence
atggccagcaagagaaagagcaccaccccctgcatgatccccgtgaagaccgtggtgctgcaggacgccagcatggaggcccagcccgccgagaccctgcccgagggcccccagcaggacctgccccccgaggccagcgccgcctag

SEQ ID NO: 106374 - DNA, 273 bp, Artificial Sequence
  Description of Artificial Sequence: Synthetic coding sequence
atggccagcaagagaaagagcaccaccccctgcatgatccccgtgaagaccgtggtgctgcaggacgccagcatggaggcccagcccgccgagaccctgcccgagggcccccagcaggacctgccccccgaggccagcgccgccagcagcgaggccgcccagaaccccagcagcaccgacggcagcaccctggccaacggccacagaagcaccctggacggctacctgtacagctgcaagtactgcgacttcagaagccacgacatgacctag

SEQ ID NO: 106375 - DNA, 357 bp, Artificial Sequence
  Description of Artificial Sequence: Synthetic coding sequence
atggccagcaagagaaagagcaccaccccctgcatgatccccgtgaagaccgtggtgctgcaggacgccagcatggaggcccagcccgccgagaccctgcccgagggcccccagcaggacctgccccccgaggccagcgccgccagcagcgaggccgcccagaaccccagcagcaccgacggcagcaccctggccaacggccacagaagcaccctggacggctacctgtacagctgcaagtactgcgacttcagaagccacgacatgacccagttcgtgggccacatgaacagcgagcacaccgacttcaacaaggaccccaccttcgtgtgcagcggctgcagcttcctggcctag

SEQ ID NO: 106376 - DNA, 2871 bp, Artificial Sequence; identical to SEQ ID NO: 106370
  Description of Artificial Sequence: Synthetic coding sequence

SEQ ID NO: 106377 - DNA, 2910 bp, Artificial Sequence
  Description of Artificial Sequence: Synthetic coding sequence
atggccagcaagagaaagagcaccaccccctgcatgatccccgtgaagaccgtggtgctgcaggacgccagcatggaggcccagcccgccgagaccctgcccgagggcccccagcaggacctgccccccgaggccagcgccgccagcagcgaggccgcccagaaccccagcagcaccgacggcagcaccctggccaacggccacagaagcaccctggacggctacctgtacagctgcaagtactgcgacttcagaagccacgacatgacccagttcgtgggccacatgaacagcgagcacaccgacttcaacaaggaccccaccttcgtgtgcagcggctgcagcttcctggccaagacccccgagggcctgagcctgcacaacgccacctgccacagcggcgaggccagcttcgtgtggaacgtggccaagcccgacaaccacgtggtggtggagcagagcatccccgagagcaccagcacccccgacctggccggcgagcccagcgccgagggcgccgacggccaggccgagatcatcatcaccaagacccccatcatgaagatcatgaagggcaaggccgaggccaagaagatccacaccctgaaggagaacgtgcccagccagcccgtgggcgaggccctgcccaagctgagcaccggcgagatggaggtgagagagggcgaccacagcttcatcaacggcgccgtgcccgtgagccaggccagcgccagcagcgccaagaacccccacgccgccaacggccccctgatcggcaccgtgcccgtgctgcccgccggcatcgcccagttcctgagcctgcagcagcagccccccgtgcacgcccagcaccacgtgcaccagcccctgcccaccgccaaggccctgcccaaggtgatgatccccctgagcagcatccccacctacaacgccgccatggacagcaacagcttcctgaagaacagcttccacaagttcccctaccccaccaaggccgagctgtgctacctgaccgtggtgaccaagtaccccgaggagcagctgaagatctggttcaccgcccagagactgaagcagggcatcagctggagccccgaggagatcgaggacgccagaaagaagatgttcaacaccgtgatccagagcgtgccccagcccaccatcaccgtgctgaacacccccctggtggccagcgccggcaacgtgcagcacctgatccaggccgccctgcccggccacgtggtgggccagcccgagggcaccggcggcggcctgctggtgacccagcccctgatggccaacggcctgcaggccaccagcagccccctgcccctgaccgtgaccagcgtgcccaagcagcccggcgtggcccccatcaacaccgtgtgcagcaacaccaccagcgccgtgaaggtggtgaacgccgcccagagcctgctgaccgcctgccccagcatcaccagccaggccttcctggacgccagcatctacaagaacaagaagagccacgagcagctgagcgccctgaagggcagcttctgcagaaaccagttccccggccagagcgaggtggagcacctgaccaaggtgaccggcctgagcaccagagaggtgagaaagtggttcagcgacagaagataccactgcagaaacctgaagggcagcagagccatgatccccggcgaccacagcagcatcatcatcgacagcgtgcccgaggtgagcttcagccccagcagcaaggtgcccgaggtgacctgcatccccaccaccgccaccctggccacccaccccagcgccaagagacagagctggcaccagacccccgacttcacccccaccaagtacaaggagagagcccccgagcagctgagagccctggagagcagcttcgcccagaaccccctgcccctggacgaggagctggacagactgagaagcgagaccaagatgaccagaagagagatcgacagctggttcagcgagagaagaaagaaggtgaacgccgaggagaccaagaaggccgaggagaacgccagccaggaggaggaggaggccgccgaggacgagggcggcgaggaggacctggccagcgagctgagagtgagcggcgagaacggcagcctggagatgcccagcagccacatcctggccgagagaaaggtgagccccatcaagatcaacctgaagaacctgagagtgaccgaggccaacggcagaaacgagatccccggcctgggcgcctgcgaccccgaggacgacgagagcaacaagctggccgagcagctgcccggcaaggtgagctgcaagaagaccgcccagcagagacacctgctgagacagctgttcgtgcagacccagtggcccagcaaccaggactacgacagcatcatggcccagaccggcctgcccagacccgaggtggtgagatggttcggcgacagcagatacgccctgaagaacggccagctgaagtggtacgaggactacaagagaggcaacttcccccccggcctgctggtgatcgcccccggcaacagagagctgctgcaggactactacatgacccacaagatgctgtacgaggaggacctgcagaacctgtgcgacaagacccagatgagcagccagcagaagcagaccgagttcgacctgatcaacgtgaaggactggcccgtgtgggagaccgcctgccacgtggaggagcccaaccccaccctgtgctgccacatgcccttcccctgccccgccgccggccacctgggcgagctgcccgagagcagccagaccgcccagagcctgcccctgcccagcgcctgccccccccccagcaagcagcaggccagatggggcagccaccagttcttcctgccccagtgcagaaccttccccctgcccagcaacggctag

SEQ ID NO: 106378 - DNA, 948 bp, Artificial Sequence
  Description of Artificial Sequence: Synthetic coding sequence
atggccagcaagagaaagagcaccaccccctgcatgatccccgtgaagaccgtggtgctgcaggacgccagcatggaggcccagcccgccgagaccctgcccgagggcccccagcaggacctgccccccgaggccagcgccgccagcagcgaggccgcccagaaccccagcagcaccgacggcagcaccctggccaacggccacagaagcaccctggacggctacctgtacagctgcaagtactgcgacttcagaagccacgacatgacccagttcgtgggccacatgaacagcgagcacaccgacttcaacaaggaccccaccttcgtgtgcagcggctgcagcttcctggccaagacccccgagggcctgagcctgcacaacgccacctgccacagcggcgaggccagcttcgtgtggaacgtggccaagcccgacaaccacgtggtggtggagcagagcatccccgagagcaccagcacccccgacctggccggcgagcccagcgccgagggcgccgacggccaggccgagatcatcatcaccaagacccccatcatgaagatcatgaagggcaaggccgaggccaagaagatccacaccctgaaggagaacgtgcccagccagcccgtgggcgaggccctgcccaagctgagcaccggcgagatggagaagcagaccgagttcgacctgatcaacgtgaaggactggcccgtgtgggagaccgcctgccacgtggaggagcccaaccccaccctgtgctgccacatgcccttcccctgccccgccgccggccacctgggcgagctgcccgagagcagccagaccgcccagagcctgcccctgcccagcgcctgccccccccccagcaagcagcaggccagatggggcagccaccagttcttcctgccccagtgcagaaccttccccctgcccagcaacggctag

SEQ ID NO: 106379 - DNA, 501 bp, Artificial Sequence
  Description of Artificial Sequence: Synthetic coding sequence
atggccagcaagagaaagagcaccaccccctgcatgatccccgtgaagaccgtggtgctgcaggacgccagcatggaggcccagcccgccgagaccctgcccgagggcccccagcaggacctgccccccgaggccagcgccgccagcagcgaggccgcccagaaccccagcagcaccgacggcagcaccctggccaacggccacagaagcaccctggacggctacctgtacagctgcaagtactgcgacttcagaagccacgacatgacccagttcgtgggccacatgaacagcgagcacaccgacttcaacaaggaccccaccttcgtgtgcagcggctgcagcttcctggccaagacccccgagggcctgagcctgcacaacgccacctgccacagcggcgaggccagcttcgtgtggaacgtggccaagcccgacaaccacgtggtggtggagcagagcatccccgagagcaccagcacccccgacctggccggctag

SEQ ID NO: 106380 - DNA, 2871 bp, Artificial Sequence; identical to SEQ ID NO: 106370
  Description of Artificial Sequence: Synthetic coding sequence

SEQ ID NO: 106381 - DNA, 2871 bp, Artificial Sequence; identical to SEQ ID NO: 106370
  Description of Artificial Sequence: Synthetic coding sequence

SEQ ID NO: 106382 - DNA, 501 bp, Artificial Sequence; identical to SEQ ID NO: 106379
  Description of Artificial Sequence: Synthetic coding sequence

SEQ ID NO: 106383 - DNA, 1428 bp, Artificial Sequence
  Description of Artificial Sequence: Synthetic coding sequence
atgggcatgtgggccagcctggacgccctgtgggagatgcccgccgagaagagaatcttcggcgccgtgctgctgttcagctggaccgtgtacctgtgggagaccttcctggcccagagacagagaagaatctacaagaccaccacccacgtgccccccgagctgggccagatcatggacagcgagaccttcgagaagagcagactgtaccagctggacaagagcaccttcagcttctggagcggcctgtacagcgagaccgagggcaccctgatcctgctgttcggcggcatcccctacctgtggagactgagcggcagattctgcggctacgccggcttcggccccgagtacgagatcacccagagcctggtgttcctgctgctggccaccctgttcagcgccctgaccggcctgccctggagcctgtacaacaccttcgtgatcgaggagaagcacggcttcaaccagcagaccctgggcttcttcatgaaggacgccatcaagaagttcgtggtgacccagtgcatcctgctgcccgtgagcagcctgctgctgtacatcatcaagatcggcggcgactacttcttcatctacgcctggctgttcaccctggtggtgagcctggtgctggtgaccatctacgccgactacatcgcccccctgttcgacaagttcacccccctgcccgagggcaagctgaaggaggagatcgaggtgatggccaagagcatcgacttccccctgaccaaggtgtacgtggtggagggcagcaagagaagcagccacagcaacgcctacttctacggcttcttcaagaacaagagaatcgtgctgttcgacaccctgctggaggagtacagcgtgctgaacaaggacatccaggaggacagcggcatggagcccagaaacgaggaggagggcaacagcgaggagatcaaggccaaggtgaagaacaagaagcagggctgcaagaacgaggaggtgctggccgtgctgggccacgagctgggccactggaagctgggccacaccgtgaagaacatcatcatcagccagatgaacagcttcctgtgcttcttcctgttcgccgtgctgatcggcagaaaggagctgttcgccgccttcggcttctacgacagccagcccaccctgatcggcctgctgatcatcttccagttcatcttcagcccctacaacgaggtgctgagcttctgcctgaccgtgctgagcagaagattcgagttccaggccgacgccttcgccaagaagctgggcaaggccaaggacctgtacagcgccctgatcaagctgaacaaggacaacctgggcttccccgtgagcgactggctgttcagcatgtggcactacagccacccccccctgctggagagactgcaggccctgaagaccatgaagcagcactag

SEQ ID NO: 106384 - DNA, 1017 bp, Artificial Sequence
  Description of Artificial Sequence: Synthetic coding sequence
atgatgagaacctgcgtgctgctgagcgccgtgctgtggtgcctgaccggcgtgcagtgccccagattcaccctgttcaacaagaagggcttcatctacggcaagaccggccagcccgacaagatctacgtggagctgcaccagaacagccccgtgctgatctgcatggacttcaagctgagcaagaaggagatcgtggaccccacctacctgtggatcggccccaacgagaagaccctgaccggcaacaacagaatcaacatcaccgagaccggccagctgatggtgaaggacttcctggagcccctgagcggcctgtacacctgcaccctgagctacaagaccgtgaaggccgagacccaggaggagaagaccgtgaagaagagatacgacttcatggtgttcgcctacagagagcccgactacagctaccagatggccgtgagattcaccaccagaagctgcatcggcagatacaacgacgtgttcttcagagtgctgaagaagatcctggacagcctgatcagcgacctgagctgccacgtgatcgagcccagctacaagtgccacagcgtggagatccccgagcacggcctgatccacgagctgttcatcgccttccaggtgaaccccttcgcccccggctggaagggcgcctgcaacggcagcgtggactgcgaggacaccaccaaccacaacatcctgcaggccagagacagaatcgaggacttcttcagaagccaggcctacatcttctaccacaacttcaacaagaccctgcccgccatgcacttcgtggaccacagcctgcaggtggtgagactggacagctgcagacccggcttcggcaagaacgagagactgcacagcaactgcgccagctgctgcgtggtgtgcagccccgccaccttcagccccgacgtgaacgtgacctgccagacctgcgtgagcgtgctgacctacggcgccaagagctgcccccagaccagcaacaagaaccagcagtacgaggactag

SEQ ID NO: 106385 - DNA, 951 bp, Artificial Sequence
  Description of Artificial Sequence: Synthetic coding sequence
atgatgagaacctgcgtgctgctgagcgccgtgctgtggtgcctgaccggcgacaagatctacgtggagctgcaccagaacagccccgtgctgatctgcatggacttcaagctgagcaagaaggagatcgtggaccccacctacctgtggatcggccccaacgagaagaccctgaccggcaacaacagaatcaacatcaccgagaccggccagctgatggtgaaggacttcctggagcccctgagcggcctgtacacctgcaccctgagctacaagaccgtgaaggccgagacccaggaggagaagaccgtgaagaagagatacgacttcatggtgttcgcctacagagagcccgactacagctaccagatggccgtgagattcaccaccagaagctgcatcggcagatacaacgacgtgttcttcagagtgctgaagaagatcctggacagcctgatcagcgacctgagctgccacgtgatcgagcccagctacaagtgccacagcgtggagatccccgagcacggcctgatccacgagctgttcatcgccttccaggtgaaccccttcgcccccggctggaagggcgcctgcaacggcagcgtggactgcgaggacaccaccaaccacaacatcctgcaggccagagacagaatcgaggacttcttcagaagccaggcctacatcttctaccacaacttcaacaagaccctgcccgccatgcacttcgtggaccacagcctgcaggtggtgagactggacagctgcagacccggcttcggcaagaacgagagactgcacagcaactgcgccagctgctgcgtggtgtgcagccccgccaccttcagccccgacgtgaacgtgacctgccagacctgcgtgagcgtgctgacctacggcgccaagagctgcccccagaccagcaacaagaaccagcagtacgaggactag

SEQ ID NO: 106386 - DNA, 1917 bp, Artificial Sequence
  Description of Artificial Sequence: Synthetic coding sequence
atggccggcggcagcgccaccacctggggctaccccgtggccctgctgctgctggtggccaccctgggcctgggcagatggctgcagcccgaccccggcctgcccggcctgagacacagctacgactgcggcatcaagggcatgcagctgctggtgttccccagacccggccagaccctgagattcaaggtggtggacgagttcggcaacagattcgacgtgaacaactgcagcatctgctaccactgggtgaccagcagaccccaggagcccgccgtgttcagcgccgactacagaggctgccacgtgctggagaaggacggcagattccacctgagagtgttcatggaggccgtgctgcccaacggcagagtggacgtggcccaggacgccaccctgatctgccccaagcccgaccccagcagaaccctggacagccagctggccccccccgccatgttcagcgtgagcaccccccagaccctgagcttcctgcccaccagcggccacaccagccagggcagcggccacgccttccccagccccctggaccccggccacagcagcgtgcaccccacccccgccctgcccagccccggccccggccccaccctggccaccctggcccagccccactggggcaccctggagcactgggacgtgaacaagagagactacatcggcacccacctgagccaggagcagtgccaggtggccagcggccacctgccctgcatcgtgagaagaaccagcaaggaggcctgccagcaggccggctgctgctacgacaacaccagagaggtgccctgctactacggcaacaccgccaccgtgcagtgcttcagagacggctacttcgtgctggtggtgagccaggagatggccctgacccacagaatcaccctggccaacatccacctggcctacgcccccaccagctgcagccccacccagcacaccgaggccttcgtggtgttctacttccccctgacccactgcggcaccaccatgcaggtggccggcgaccagctgatctacgagaactggctggtgagcggcatccacatccagaagggcccccagggcagcatcaccagagacagcaccttccagctgcacgtgagatgcgtgttcaacgccagcgacttcctgcccatccaggccagcatcttccccccccccagccccgcccccatgacccagcccggccccctgagactggagctgagaatcgccaaggacgagaccttcagcagctactacggcgaggacgactaccccatcgtgagactgctgagagagcccgtgcacgtggaggtgagactgctgcagagaaccgaccccaacctggtgctgctgctgcaccagtgctggggcgcccccagcgccaaccccttccagcagccccagtggcccatcctgagcgacggctgccccttcaagggcgacagctacagaacccagatggtggccctggacggcgccacccccttccagagccactaccagagattcaccgtggccaccttcgccctgctggacagcggcagccagagagccctgagaggcctggtgtacctgttctgcagcaccagcgcctgccacaccagcggcctggagacctgcagcaccgcctgcagcaccggcaccaccagacagagaagaagcagcggccacagaaacgacaccgccagaccccaggacatcgtgagcagccccggccccgtgggcttcgaggacagctacggccaggagcccaccctgggccccaccgacagcaacggcaacagcagcctgagacccctgctgtgggccgtgctgctgctgcccgccgtggccctggtgctgggcttcggcgtgttcgtgggcctgagccagacctgggcccagaagctgtgggagagcaacagacagtag

SEQ ID NO: 106387 - DNA, 993 bp, Artificial Sequence
  Description of Artificial Sequence: Synthetic coding sequence
atggccctgacccacagaatcaccctggccaacatccacctggcctacgcccccaccagctgcagccccacccagcacaccgaggccttcgtggtgttctacttccccctgacccactgcggcaccaccatgcaggtggccggcgaccagctgatctacgagaactggctggtgagcggcatccacatccagaagggcccccagggcagcatcaccagagacagcaccttccagctgcacgtgagatgcgtgttcaacgccagcgacttcctgcccatccaggccagcatcttccccccccccagccccgcccccatgacccagcccggccccctgagactggagctgagaatcgccaaggacgagaccttcagcagctactacggcgaggacgactaccccatcgtgagactgctgagagagcccgtgcacgtggaggtgagactgctgcagagaaccgaccccaacctggtgctgctgctgcaccagtgctggggcgcccccagcgccaaccccttccagcagccccagtggcccatcctgagcgacggctgccccttcaagggcgacagctacagaacccagatggtggccctggacggcgccacccccttccagagccactaccagagattcaccgtggccaccttcgccctgctggacagcggcagccagagagccctgagaggcctggtgtacctgttctgcagcaccagcgcctgccacaccagcggcctggagacctgcagcaccgcctgcagcaccggcaccaccagacagagaagaagcagcggccacagaaacgacaccgccagaccccaggacatcgtgagcagccccggccccgtgggcttcgaggacagctacggccaggagcccaccctgggccccaccgacagcaacggcaacagcagcctgagacccctgctgtgggccgtgctgctgctgcccgccgtggccctggtgctgggcttcggcgtgttcgtggcctag

SEQ ID NO: 106388 - DNA, 1317 bp, Artificial Sequence
  Description of Artificial Sequence: Synthetic coding sequence
atgggcagagtggaggacggcggcaccaccgaggagctggaggactgggaccccggcaccagcgccctgcccgcccccggcatcaagcagggccccagagagcagaccggcaccggccccctgagccagaagtgctgggagcccgagcccgacgcccccagccagcccggccccgccctgtggagcagaggcagagccagaacccaggccctggccggcggcagcagcctgcagcagctggaccccgagaacaccggcttcatcggcgccgacaccttcaccggcctggtgcacagccacgagctgcccctggaccccgccaagctggacatgctggtggccctggcccagagcaacgagcagggccaggtgtgctaccaggagctggtggacctgatcagcagcaagagaagcagcagcttcaagagagccatcgccaacggccagagagccctgcccagagacggccccctggacgagcccggcctgggcgtgtacaagagattcgtgagatacgtggcctacgagatcctgccctgcgaggtggacagaagatggtacttctacagacacagaagctgccccccccccgtgttcatggccagcgtgaccctggcccagatcatcgtgttcctgtgctacggcgccagactgaacaagtgggtgctgcagacctaccaccccgagtacatgaagagccccctggtgtaccaccccggccacagagccagagcctggagattcctgacctacatgttcatgcacgtgggcctggagcagctgggcttcaacgccctgctgcagctgatgatcggcgtgcccctggagatggtgcacggcctgctgagaatcagcctgctgtacctggccggcgtgctggccggcagcctgaccgtgagcatcaccgacatgagagcccccgtggtgggcggcagcggcggcgtgtacgccctgtgcagcgcccacctggccaacgtggtgatgaactgggccggcatgagatgcccctacaagctgctgagaatggtgctggccctggtgtgcatgagcagcgaggtgggcagagccgtgtggctgagattcagcccccccctgcccgccagcggcccccagcccagcttcatggcccacctggccggcgccgtggtgggcgtgagcatgggcctgaccatcctgagaagctacgaggagagactgagagaccagtgcggctggtgggtggtgctgctggcctacggcaccttcctgctgttcgccgtgttctggaacgtgttcgcctacgacctgctgggcgcccacatccccccccccccctag

SEQ ID NO: 106389 - DNA, 1122 bp, Artificial Sequence
  Description of Artificial Sequence: Synthetic coding sequence
atggtgatggtgagcaaggacctgttcggcaccggcaagctgatcagagccgccgacctgaccctgggccccgaggcctgcgagcccctggtgagcatggacaccgaggacgtggtgagattcgaggtgggcctgcacgagtgcggcaacagcatgcaggtgaccgacgacgccctggtgtacagcaccttcctgctgcacgaccccagacccgtgggcaacctgagcatcgtgagaaccaacagagccgagatccccatcgagtgcagataccccagacagggcaacgtgagcagccaggccatcctgcccacctggctgcccttcagaaccaccgtgttcagcgaggagaagctgaccttcagcctgagactgatggaggagaactggaacgccgagaagagaagccccaccttccacctgggcgacgccgcccacctgcaggccgagatccacaccggcagccacgtgcccctgagactgttcgtggaccactgcgtggccacccccacccccgaccagaacgccagcccctaccacaccatcgtggacttccacggctgcctggtggacggcctgaccgacgccagcagcgccttcaaggtgcccagacccggccccgacaccctgcagttcaccgtggacgtgttccacttcgccaacgacagcagaaacatgatctacatcacctgccacctgaaggtgaccctggccgagcaggaccccgacgagctgaacaaggcctgcagcttcagcaagcccagcaacagctggttccccgtggagggcagcgccgacatctgccagtgctgcaacaagggcgactgcggcacccccagccacagcagaagacagccccacgtgatgagccagtggagcagaagcgccagcagaaacagaagacacgtgaccgaggaggccgacgtgaccgtgggccccctgatcttcctggacagaagaggcgaccacgaggtggagcagtgggccctgcccagcgacaccagcgtggtgctgctgggcgtgggcctggccgtggtggtgagcctgaccctgaccgccgtgatcctggtgctgaccagaagatgcagaaccgccagccaccccgtgagcgccagcgagtag

SEQ ID NO: 106390 - DNA, 1275 bp, Artificial Sequence
  Description of Artificial Sequence: Synthetic coding sequence
atggagctgagctacagactgttcatctgcctgctgctgtggggcagcaccgagctgtgctacccccagcccctgtggctgctgcagggcggcgccagccaccccgagaccagcgtgcagcccgtgctggtggagtgccaggaggccaccctgatggtgatggtgagcaaggacctgttcggcaccggcaagctgatcagagccgccgacctgaccctgggccccgaggcctgcgagcccctggtgagcatggacaccgaggacgtggtgagattcgaggtgggcctgcacgagtgcggcaacagcatgcaggtgaccgacgacgccctggtgtacagcaccttcctgctgcacgaccccagacccgtgggcaacctgagcatcgtgagaaccaacagagccgagatccccatcgagtgcagataccccagacagggcaacgtgagcagccaggccatcctgcccacctggctgcccttcagaaccaccgtgttcagcgaggagaagctgaccttcagcctgagactgatggaggagaactggaacgccgagaagagaagccccaccttccacctgggcgacgccgcccacctgcaggccgagatccacaccggcagccacgtgcccctgagactgttcgtggaccactgcgtggccacccccacccccgaccagaacgccagcccctaccacaccatcgtggacttccacggctgcctggtggacggcctgaccgacgccagcagcgccttcaaggtgcccagacccggccccgacaccctgcagttcaccgtggacgtgttccacttcgccaacgacagcagaaacatgatctacatcacctgccacctgaaggtgaccctggccgagcaggaccccgacgagctgaacaaggcctgcagcttcagcaagcccagcaacagctggttccccgtggagggcagcgccgacatctgccagtgctgcaacaagggcgactgcggcacccccagccacagcagaagacagccccacgtgatgagccagtggagcagaagcgccagcagaaacagaagacacgtgaccgaggaggccgacgtgaccgtgggccccctgatcttcctggacagaagaggcgaccacgaggtggagcagtgggccctgcccagcgacaccagcgtggtgctgctgggcgtgggcctggccgtggtggtgagcctgaccctgaccgccgtgatcctggtgctgaccagaagatgcagaaccgccagccaccccgtgagcgccagcgagtag

SEQ ID NO: 106391 - DNA, 1116 bp, Artificial Sequence
  Description of Artificial Sequence: Synthetic coding sequence
atggagctgagctacagactgttcatctgcctgctgctgtggggcagcaccgagctgtgctacccccagcccctgtggctgctgcagggcggcgccagccaccccgagaccagcgtgcagcccgtgctggtggagtgccaggaggccaccctgatggtgatggtgagcaaggacctgttcggcaccggcaagctgatcagagccgccgacctgaccctgggccccgaggcctgcgagcccctggtgagcatggacaccgaggacgtggtgagattcgaggtgggcctgcacgagtgcggcaacagcatgcaggtgaccgacgacgccctggtgtacagcaccttcctgctgcacgaccccagacccgtgggcaacctgagcatcgtgagaaccaacagagccgagatccccatcgagtgcagataccccagacagggcaacgtgagcagccaggccatcctgcccacctggctgcccttcagaaccaccgtgttcagcgaggagaagctgaccttcagcctgagactgatggaggagaactggaacgccgagaagagaagccccaccttccacctgggcgacgccgcccacctgcaggccgagatccacaccggcagccacgtgcccctgagactgttcgtggaccactgcgtggccacccccacccccgaccagaacgccagcccctaccacaccatcgtggacttccacggctgcctggtggacggcctgaccgacgccagcagcgccttcaaggtgcccagacccggccccgacaccctgcagttcaccgtggacgtgttccacttcgccaacgacagcagaaacatgatctacatcacctgccacctgaaggtgaccctggccgagcaggaccccgacgagctgaacaaggcctgcagcttcagcaagcccagcaacagctggttccccgtggagggcagcgccgacatctgccagtgctgcaacaagggcgactgcggcacccccagccacagcagaagacagccccacgtgatgagccagtggagcagaagcgccagcagaaacagaagacacgtgaccgaggaggccgacgtgaccgtgggcaccgacctgcccggccaggagggctag

SEQ ID NO: 106392 - DNA, 1623 bp, Artificial Sequence
  Description of Artificial Sequence: Synthetic coding sequence
atgtggctgctgagatgcgtgctgctgtgcgtgagcctgagcctggccgtgagcggccagcacaagcccgaggcccccgactacagcagcgtgctgcactgcggcccctggagcttccagttcgccgtgaacctgaaccaggaggccaccagcccccccgtgctgatcgcctgggacaaccagggcctgctgcacgagctgcagaacgacagcgactgcggcacctggatcagaaagggccccggcagcagcgtggtgctggaggccacctacagcagctgctacgtgaccgagtgggacagccactacatcatgcccgtgggcgtggagggcgccggcgccgccgagcacaaggtggtgaccgagagaaagctgctgaagtgccccatggacctgctggccagagacgcccccgacaccgactggtgcgacagcatccccgccagagacagactgccctgcgcccccagccccatcagcagaggcgactgcgagggcctgggctgctgctacagcagcgaggaggtgaacagctgctactacggcaacaccgtgaccctgcactgcaccagagagggccacttcagcatcgccgtgagcagaaacgtgaccagcccccccctgctgctggacagcgtgagactggccctgagaaacgacagcgcctgcaaccccgtgatggccacccaggccttcgtgctgttccagttccccttcaccagctgcggcaccaccagacagatcaccggcgacagagccgtgtacgagaacgagctggtggccaccagagacgtgaagaacggcagcagaggcagcgtgaccagagacagcatcttcagactgcacgtgagctgcagctacagcgtgagcagcaacagcctgcccatcaacgtgcaggtgttcaccctgcccccccccttccccgagacccagcccggccccctgaccctggagctgcagatcgccaaggacaagaactacggcagctactacggcgtgggcgactaccccgtggtgaagctgctgagagaccccatctacgtggaggtgagcatcctgcacagaaccgacccctacctgggcctgctgctgcagcagtgctgggccacccccagcaccgaccccctgagccagccccagtggcccatcctggtgaagggctgcccctacatcggcgacaactaccagacccagctgatccccgtgcagaaggccctggacctgcccttccccagccaccaccagagattcagcatcttcaccttcagcttcgtgaaccccaccgtggagaagcaggccctgagaggccccgtgcacctgcactgcagcgtgagcgtgtgccagcccgccgagacccccagctgcgtggtgacctgccccgacctgagcagaagaagaaacttcgacaacagcagccagaacaccaccgccagcgtgagcagcaagggccccatgatcctgctgcaggccaccaaggacccccccgagaagctgagagtgcccgtggacagcaaggtgctgtgggtggccggcctgagcggcaccctgatcctgggcgccctgctggtgagctacctggccgtgaagaagcagaagagctgccccgaccagatgtgccagtag

SEQ ID NO: 106393 - DNA, 2340 bp, Artificial Sequence
  Description of Artificial Sequence: Synthetic coding sequence
atggccagcttcgtgaccgaggtgctggcccacagcggcagactggagaaggaggacctgggcaccagaatcagcagactgaccagaagagtggaggagatcaagggcgaggtgtgcaacatgatcagcaagaagtacagcgagttcctgcccagcatgcagagcgcccagggcctgatcacccaggtggacaagctgagcgaggacatcgacctgctgaagagcagaatcgagagcgaggtgagaagagacctgcacgtgagcaccggcgagttcaccgacctgaagcagcagctggagagagacagcgtggtgctgagcctgctgaagcagctgcaggagttcagcaccgccatcgaggagtacaactgcgccctgaccgagaagaagtacgtgaccggcgcccagagactggaggaggcccagaagtgcctgaagctgctgaagagcagaaagtgcttcgacctgaagatcctgaagagcctgagcatggagctgaccatccagaagcagaacatcctgtaccacctgggcgaggagtggcagaagctgatcgtgtggaagttcccccccagcaaggacaccagcagcctggagagctacctgcagaccgagctgcacctgtacaccgagcagagccacaaggaggagaagacccccatgccccccatcagcagcgtgctgctggccttcagcgtgctgggcgagctgcacagcaagctgaagagcttcggccagatgctgctgaagtacatcctgagacccctggccagctgccccagcctgcacgccgtgatcgagagccagcccaacatcgtgatcatcagattcgagagcatcatgaccaacctggagtaccccagccccagcgaggtgttcaccaagatcagactggtgctggaggtgctgcagaagcagctgctggacctgcccctggacaccgacctggagaacgagaagaccagcaccgtgcccctggccgagatgctgggcgacatgatctgggaggacctgagcgagtgcctgatcaagaactgcctggtgtacagcatccccaccaacagcagcaagctgcagcagtacgaggagatcatccagagcaccgaggagttcgagaacgccctgaaggagatgagattcctgaagggcgacaccaccgacctgctgaagtacgccagaaacatcaacagccacttcgccaacaagaagtgccaggacgtgatcgtggccgccagaaacctgatgaccagcgagatccacaacaccgtgaagatcatccccgacagcaagatcaacgtgcccgagctgcccacccccgacgaggacaacaagctggaggtgcagaaggtgagcaacacccagtaccacgaggtgatgaacctggagcccgagaacaccctggaccagcacagcttcagcctgcccacctgcagaatcagcgagagcgtgaagaagctgatggagctggcctaccagaccctgctggaggccaccaccagcagcgaccagtgcgccgtgcagctgttctacagcgtgagaaacatcttccacctgttccacgacgtggtgcccacctaccacaaggagaacctgcagaagctgccccagctggccgccatccaccacaacaactgcatgtacatcgcccaccacctgctgaccctgggccaccagttcagactgagactggcccccatcctgtgcgacggcaccgccaccttcgtggacctggtgcccggcttcagaagactgggcaccgagtgcttcctggcccagatgagagcccagaagggcgagctgctggagagactgagcagcgccagaaacttcagcaacatggacgacgaggagaactacagcgccgccagcaaggccgtgagacaggtgctgcaccagctgaagagactgggcatcgtgtggcaggacgtgctgcccgtgaacatctactgcaaggccatgggcaccctgctgaacaccgccatcagcgaggtgatcggcaagatcaccgccctggaggacatcagcaccgaggacggcgacagactgtacagcctgtgcaagaccgtgatggacgagggcccccaggtgttcgcccccctgagcgaggagagcaagaacaagaagtaccaggaggaggtgcccgtgtacgtgcccaagtggatgcccttcaaggagctgatgatgatgctgcaggccagcctgcaggagatcggcgacagatgggccgacggcaagggccccctggccgccgccttcagcagcagcgaggtgaaggccctgatcagagccctgttccagaacaccgagagaagagccgccgccctggccaagatcaagtag

SEQ ID NO: 106394 - DNA, 2019 bp, Artificial Sequence
  Description of Artificial Sequence: Synthetic coding sequence
atggccagcttcgtgaccgaggtgctggcccacagcggcagactggagaaggaggacctgggcaccagaatcagcagactgaccagaagagtggaggagatcaagggcgaggtgtgcaacatgatcagcaagaagtacagcgagttcctgcccagcatgcagagcgcccagggcctgatcacccaggtggacaagctgagcgaggacatcgacctgctgaagagcagaatcgagagcgaggtgagaagagacctgcacgtgagcaccggcgagttcaccgacctgaagcagcagctggagagagacagcgtggtgctgagcctgctgaagcagctgcaggagttcagcaccgccatcgaggagtacaactgcgccctgaccgagaagaagtacgtgaccggcgcccagagactggaggaggcccagaagtgcctgaagctgctgaagagcagaaagtgcttcgacctgaagatcctgaagagcctgagcatggagctgaccatccagaagcagaacatcctgtaccacctgggcgaggagtggcagaagctgatcgtgtggaagttcccccccagcaaggacaccagcagcctggagagctacctgcagaccgagctgcacctgtacaccgagcagagccacaaggaggagaagacccccatgccccccatcagcagcgtgctgctggccttcagcgtgctgggcgagctgcacagcaagctgaagagcttcggccagatgctgctgaagtacatcctgagacccctggccagctgccccagcctgcacgccgtgatcgagagccagcccaacatcgtgatcatcagattcgagagcatcatgaccaacctggagtaccccagccccagcgaggtgttcaccaagatcagactggtgctggaggtgctgcagaagcagctgctggacctgcccctggacaccgacctggagaacgagaagaccagcaccgtgcccctggccgagatgctgggcgacatgatctgggaggacctgagcgagtgcctgatcaagaactgcctggtgtacagcatccccaccaacagcagcaagctgcagcagtacgaggagatcatccagagcaccgaggagttcgagaacgccctgaaggagatgagattcctgaagggcgacaccaccgacctgctgaagtacgccagaaacatcaacagccacttcgccaacaagaagtgccaggacgtgatcgtggccgccagaaacctgatgaccagcgagatccacaacaccgtgaagatcatccccgacagcaagatcaacgtgcccgagctgcccacccccgacgaggacaacaagctggaggtgcagaaggtgagcaacacccagtaccacgaggtgatgaacctggagcccgagaacaccctggaccagcacagcttcagcctgcccacctgcagaatcagcgagagcgtgaagaagctgatggagctggcctaccagaccctgctggaggccaccaccagcagcgaccagtgcgccgtgcagctgttctacagcgtgagaaacatcttccacctgttccacgacgtggtgcccacctaccacaaggagaacctgcagaagctgccccagctggccgccatccaccacaacaactgcatgtacatcgcccaccacctgctgaccctgggccaccagttcagactgagactggcccccatcctgtgcgacggcaccgccaccttcgtggacctggtgcccggcttcagaagactgggcaccgagtgcttcctggcccagatgagagcccagaagggcgagctgctggagagactgagcagcgccagaaacttcagcaacatggacgacgaggagaactacagcgccgccagcaaggccgtgagacaggtgctgcaccagctgaagagactgggcatcgtgtggcaggacgtgctgcccgtgaacatctactgcaaggccatgggcaccctgctgaacaccgccatcagcgaggtgatcggcaagatcaccgccctggagtag

SEQ ID NO: 106395 - DNA, 1776 bp, Artificial Sequence
  Description of Artificial Sequence: Synthetic coding sequence
atgtgggagagactgaactgcgccgccgaggacttctacagcagactgctgcagaagttcaacgaggagaagaagggcatcagaaaggaccccttcctgtacgaggccgacgtgcaggtgcagctgatcagcaagggccagcccaaccccctgaagaacatcctgaacgagaacgacatcgtgttcatcgtggagaaggtgcccctggagaaggaggagaccagccacatcgaggagctgcagagcgaggagaccgccatcagcgacttcagcaccggcgagaacgtgggccccctggccctgcccgtgggcaaggccagacagctgatcggcctgtacaccatggcccacaaccccaacatgacccacctgaagatcaacctgcccgtgaccgccctgccccccctgtgggtgagatgcgacagcagcgaccccgagggcacctgctggctgggcgccgagctgatcaccaccaacaacagcatcaccggcatcgtgctgtacgtggtgagctgcaaggccgacaagaactacagcgtgaacctggagaacctgaagaacctgcacaagaagagacaccacctgagcaccgtgaccagcaagggcttcgcccagtacgagctgttcaagagcagcgccctggacgacaccatcaccgccagccagaccgccatcgccctggacatcagctggagccccgtggacgagatcctgcagatcccccccctgagcagcaccgccaccctgaacatcaaggtggagagcggcgagcccagaggccccctgaaccacctgtacagagagctgaagttcctgctggtgctggccgacggcctgagaaccggcgtgaccgagtggctggagcccctggaggccaagagcgccgtggagctggtgcaggagttcctgaacgacctgaacaagctggacggcttcggcgacagcaccaagaaggacaccgaggtggagaccctgaagcacgacaccgccgccgtggacagaagcgtgaagagactgttcaaggtgagaagcgacctggacttcgccgagcagctgtggtgcaagatgagcagcagcgtgatcagctaccaggacctggtgaagtgcttcaccctgatcatccagagcctgcagagaggcgacatccagccctggctgcacagcggcagcaacagcctgctgagcaagctgatccaccagagctaccacggcaccatggacaccgtgagcctgagcggcaccatccccgtgcagatgctgctggagatcggcctggacaagctgaagaaggactacatcagcttcttcatcggccaggagctggccagcctgaaccacctggagtacttcatcgcccccagcgtggacatccaggagcaggtgtacagagtgcagaagctgcaccacatcctggagatcctggtgagctgcatgcccttcatcaagagccagcacgagctgctgttcagcctgacccagatctgcatcaagtactacaagcagaaccccctggacgagcagcacatcttccagctgcccgtgagacccaccgccgtgaagaacctgtaccagagcgagaagccccagaagtggagagtggagatctacagcggccagaagaagatcaagaccgtgtggcagctgagcgacagcagccccatcgaccacctgaacttccacaagcccgacttcagcgagctgaccctgaacggcagcctggaggagagaatcttcttcaccaacatggtgacctgcagccaggtgcacttcaagtag

SEQ ID NO: 106396 - DNA, 1434 bp, Artificial Sequence
  Description of Artificial Sequence: Synthetic coding sequence
atggcccacaaccccaacatgacccacctgaagatcaacctgcccgtgaccgccctgccccccctgtgggtgagatgcgacagcagcgaccccgagggcacctgctggctgggcgccgagctgatcaccaccaacaacagcatcaccggcatcgtgctgtacgtggtgagctgcaaggccgacaagaactacagcgtgaacctggagaacctgaagaacctgcacaagaagagacaccacctgagcaccgtgaccagcaagggcttcgcccagtacgagctgttcaagagcagcgccctggacgacaccatcaccgccagccagaccgccatcgccctggacatcagctggagccccgtggacgagatcctgcagatcccccccctgagcagcaccgccaccctgaacatcaaggtggagagcggcgagcccagaggccccctgaaccacctgtacagagagctgaagttcctgctggtgctggccgacggcctgagaaccggcgtgaccgagtggctggagcccctggaggccaagagcgccgtggagctggtgcaggagttcctgaacgacctgaacaagctggacggcttcggcgacagcaccaagaaggacaccgaggtggagaccctgaagcacgacaccgccgccgtggacagaagcgtgaagagactgttcaaggtgagaagcgacctggacttcgccgagcagctgtggtgcaagatgagcagcagcgtgatcagctaccaggacctggtgaagtgcttcaccctgatcatccagagcctgcagagaggcgacatccagccctggctgcacagcggcagcaacagcctgctgagcaagctgatccaccagagctaccacggcaccatggacaccgtgagcctgagcggcaccatccccgtgcagatgctgctggagatcggcctggacaagctgaagaaggactacatcagcttcttcatcggccaggagctggccagcctgaaccacctggagtacttcatcgcccccagcgtggacatccaggagcaggtgtacagagtgcagaagctgcaccacatcctggagatcctggtgagctgcatgcccttcatcaagagccagcacgagctgctgttcagcctgacccagatctgcatcaagtactacaagcagaaccccctggacgagcagcacatcttccagctgcccgtgagacccaccgccgtgaagaacctgtaccagagcgagaagccccagaagtggagagtggagatctacagcggccagaagaagatcaagaccgtgtggcagctgagcgacagcagccccatcgaccacctgaacttccacaagcccgacttcagcgagctgaccctgaacggcagcctggaggagagaatcttcttcaccaacatggtgacctgcagccaggtgcacttcaagtag

SEQ ID NO: 106397 - DNA, 1434 bp, Artificial Sequence; identical to SEQ ID NO: 106396
  Description of Artificial Sequence: Synthetic coding sequence

SEQ ID NO: 106398 - DNA, 1275 bp, Artificial Sequence
  Description of Artificial Sequence: Synthetic coding sequence
atggccgccctgggcgacgaggtgctggacggctacgtgttccccgcctgccccccctgcagctacagatacccctaccccgccgccaccaagggcaagggcgccgccggcggcagctggcagcagagaggcagaggctgcctgcccgccagcagcccctgcagcgccggcgccgccagcctgagcttccccggctgcggcagactgaccgccgccgagtacttcgacagctaccagagagagagactgatggccctgctggcccaggtgggccccggcctgggccccagagccagaagagccggcagctgcgacgtggccgtgcaggtgagccccagaatcgacgccgccgtgcagtgcagcctgggcagaagaaccctgcagagaagagccagagaccccgagagccccgccggccccggcgccgagggcaccaccggcggcggcagcttcagccagcagcccagcagaagaggcctggagcagggcagcccccagaacggcgcccccagacccatgagattccccagaaccgtggccgtgtacagccccctggccctgagaagactgaccgccttcctggagggccccggccccgccgccggcgagcagagaagcggcgccagcgacggcgagagaggccccccccccgccagactgcagggccccgaggagggcgaggtgtggaccaagaaggcccccagaagaccccagagcgacgacgacggcgaggcccaggccgccgtgagagccagctgggagcagcccgccgacggccccgagctgccccccagagaggcccaggagggcgaggccgcccccagaagcgccctgagaagccccggccagccccccagcgccggcagagccagagacggcggcgacggcagagaggccgccgtggccggcgagggccccagccccagaagccccgagctgggcaaggagagactgagattccagttcctggagcagaagtacggctactaccactgcaaggactgcaacatcagatgggagagcgcctacgtgtggtgcgtgcagggcaccaacaaggtgtacttcaagcagttctgcagaacctgccagaagagctacaacccctacagagtggaggacatcacctgccagagctgcaagcagaccagatgcagctgccccgtgaagctgagacacgtggaccccaagagaccccacagacaggacctgtgcggcagatgcaagggcaagagactgagctgcgacagcaccttcagcttcaagtacatcatctag

SEQ ID NO: 106399 - DNA, 1719 bp, Artificial Sequence
  Description of Artificial Sequence: Synthetic coding sequence
atggccgcccccagacccagccccgccatcagcgtgagcgtgagcgcccccgccttctacgccccccagaagaagttcggccccgtggtggcccccaagcccaaggtgaaccccttcagacccggcgacagcgagcccccccccgcccccggcgcccagagagcccagatgggcagagtgggcgagatccccccccccccccccgaggacttccccctgccccccccccccctggccggcgacggcgacgacgccgagggcgccctgggcggcgccttcccccccccccccccccccatcgaggagagcttcccccccgcccccctggaggaggagatcttccccagccccccccccccccccgaggaggagggcggccccgaggcccccatccccccccccccccagcccagagagaaggtgagcagcatcgacctggagatcgacagcctgagcagcctgctggacgacatgaccaagaacgaccccttcaaggccagagtgagcagcggctacgtgcccccccccgtggccacccccttcagcagcaagagcagcaccaagcccgccgccggcggcaccgcccccctgcccccctggaagagccccagcagcagccagcccctgccccaggtgcccgcccccgcccagagccagacccagttccacgtgcagccccagccccagcccaagccccaggtgcagctgcacgtgcagagccagacccagcccgtgagcctggccaacacccagcccagaggcccccccgccagcagccccgcccccgcccccaagttcagccccgtgacccccaagttcacccccgtggccagcaagttcagccccggcgcccccggcggcagcggcagccagcccaaccagaagctgggccaccccgaggccctgagcgccggcaccggcagcccccagccccccagcttcacctacgcccagcagagagagaagcccagagtgcaggagaagcagcaccccgtgcccccccccgcccagaaccagaaccaggtgagaagccccggcgcccccggccccctgaccctgaaggaggtggaggagctggagcagctgacccagcagctgatgcaggacatggagcacccccagagacagaacgtggccgtgaacgagctgtgcggcagatgccaccagcccctggccagagcccagcccgccgtgagagccctgggccagctgttccacatcgcctgcttcacctgccaccagtgcgcccagcagctgcagggccagcagttctacagcctggagggcgccccctactgcgagggctgctacaccgacaccctggagaagtgcaacacctgcggcgagcccatcaccgacagaatgctgagagccaccggcaaggcctaccacccccactgcttcacctgcgtggtgtgcgccagacccctggagggcaccagcttcatcgtggaccaggccaacagaccccactgcgtgcccgactaccacaagcagtacgcccccagatgcagcgtgtgcagcgagcccatcatgcccgagcccggcagagacgagaccgtgagagtggtggccctggacaagaacttccacatgaagtgctacaagtgcgaggactgcggcaagcccctgagcatcgaggccgacgacaacggctgcttccccctggacggccacgtgctgtgcagaaagtgccacaccgccagagcccagacctag

SEQ ID NO: 106400 - DNA, 1623 bp, Artificial Sequence
  Description of Artificial Sequence: Synthetic coding sequence
gccgcccccagacccagccccgccatcagcgtgagcgtgagcgcccccgccttctacgccccccagaagaagttcggccccgtggtggcccccaagcccaaggtgaaccccttcagacccggcgacagcgagcccccccccgcccccggcgcccagagagcccagatgggcagagtgggcgagatccccccccccccccccgaggacttccccctgccccccccccccctggccggcgacggcgacgacgccgagggcgccctgggcggcgccttcccccccccccccccccccatcgaggagagcttcccccccgcccccctggaggaggagatcttccccagccccccccccccccccgaggaggagggcggccccgaggcccccatccccccccccccccaggtgagcagcggctacgtgcccccccccgtggccacccccttcagcagcaagagcagcaccaagcccgccgccggcggcaccgcccccctgcccccctggaagagccccagcagcagccagcccctgccccaggtgcccgcccccgcccagagccagacccagttccacgtgcagccccagccccagcccaagccccaggtgcagctgcacgtgcagagccagacccagcccgtgagcctggccaacacccagcccagaggcccccccgccagcagccccgcccccgcccccaagttcagccccgtgacccccaagttcacccccgtggccagcaagttcagccccggcgcccccggcggcagcggcagccagcccaaccagaagctgggccaccccgaggccctgagcgccggcaccggcagcccccagccccccagcttcacctacgcccagcagagagagaagcccagagtgcaggagaagcagcaccccgtgcccccccccgcccagaaccagaaccaggtgagaagccccggcgcccccggccccctgaccctgaaggaggtggaggagctggagcagctgacccagcagctgatgcaggacatggagcacccccagagacagaacgtggccgtgaacgagctgtgcggcagatgccaccagcccctggccagagcccagcccgccgtgagagccctgggccagctgttccacatcgcctgcttcacctgccaccagtgcgcccagcagctgcagggccagcagttctacagcctggagggcgccccctactgcgagggctgctacaccgacaccctggagaagtgcaacacctgcggcgagcccatcaccgacagaatgctgagagccaccggcaaggcctaccacccccactgcttcacctgcgtggtgtgcgccagacccctggagggcaccagcttcatcgtggaccaggccaacagaccccactgcgtgcccgactaccacaagcagtacgcccccagatgcagcgtgtgcagcgagcccatcatgcccgagcccggcagagacgagaccgtgagagtggtggccctggacaagaacttccacatgaagtgctacaagtgcgaggactgcggcaagcccctgagcatcgaggccgacgacaacggctgcttccccctggacggccacgtgctgtgcagaaagtgccacaccgccagagcccagacctag

SEQ ID NO: 106401 - DNA, 1248 bp, Artificial Sequence
  Description of Artificial Sequence: Synthetic coding sequence
atgaccaagaacgaccccttcaaggccagagtgagcagcggctacgtgcccccccccgtggccacccccttcagcagcaagagcagcaccaagcccgccgccggcggcaccgcccccctgcccccctggaagagccccagcagcagccagcccctgccccaggtgcccgcccccgcccagagccagacccagttccacgtgcagccccagccccagcccaagccccaggtgcagctgcacgtgcagagccagacccagcccgtgagcctggccaacacccagcccagaggcccccccgccagcagccccgcccccgcccccaagttcagccccgtgacccccaagttcacccccgtggccagcaagttcagccccggcgcccccggcggcagcggcagccagcccaaccagaagctgggccaccccgaggccctgagcgccggcaccggcagcccccagccccccagcttcacctacgcccagcagagagagaagcccagagtgcaggagaagcagcaccccgtgcccccccccgcccagaaccagaaccaggtgagaagccccggcgcccccggccccctgaccctgaaggaggtggaggagctggagcagctgacccagcagctgatgcaggacatggagcacccccagagacagaacgtggccgtgaacgagctgtgcggcagatgccaccagcccctggccagagcccagcccgccgtgagagccctgggccagctgttccacatcgcctgcttcacctgccaccagtgcgcccagcagctgcagggccagcagttctacagcctggagggcgccccctactgcgagggctgctacaccgacaccctggagaagtgcaacacctgcggcgagcccatcaccgacagaatgctgagagccaccggcaaggcctaccacccccactgcttcacctgcgtggtgtgcgccagacccctggagggcaccagcttcatcgtggaccaggccaacagaccccactgcgtgcccgactaccacaagcagtacgcccccagatgcagcgtgtgcagcgagcccatcatgcccgagcccggcagagacgagaccgtgagagtggtggccctggacaagaacttccacatgaagtgctacaagtgcgaggactgcggcaagcccctgagcatcgaggccgacgacaacggctgcttccccctggacggccacgtgctgtgcagaaagtgccacaccgccagagcccagacctag

SEQ ID NO: 106402 - DNA, 1458 bp, Artificial Sequence
  Description of Artificial Sequence: Synthetic coding sequence
atgggcagagtgggcgagatccccccccccccccccgaggacttccccctgccccccccccccctggccggcgacggcgacgacgccgagggcgccctgggcggcgccttcccccccccccccccccccatcgaggagagcttcccccccgcccccctggaggaggagatcttccccagccccccccccccccccgaggaggagggcggccccgaggcccccatccccccccccccccaggtgagcagcggctacgtgcccccccccgtggccacccccttcagcagcaagagcagcaccaagcccgccgccggcggcaccgcccccctgcccccctggaagagccccagcagcagccagcccctgccccaggtgcccgcccccgcccagagccagacccagttccacgtgcagccccagccccagcccaagccccaggtgcagctgcacgtgcagagccagacccagcccgtgagcctggccaacacccagcccagaggcccccccgccagcagccccgcccccgcccccaagttcagccccgtgacccccaagttcacccccgtggccagcaagttcagccccggcgcccccggcggcagcggcagccagcccaaccagaagctgggccaccccgaggccctgagcgccggcaccggcagcccccagccccccagcttcacctacgcccagcagagagagaagcccagagtgcaggagaagcagcaccccgtgcccccccccgcccagaaccagaaccaggtgagaagccccggcgcccccggccccctgaccctgaaggaggtggaggagctggagcagctgacccagcagctgatgcaggacatggagcacccccagagacagaacgtggccgtgaacgagctgtgcggcagatgccaccagcccctggccagagcccagcccgccgtgagagccctgggccagctgttccacatcgcctgcttcacctgccaccagtgcgcccagcagctgcagggccagcagttctacagcctggagggcgccccctactgcgagggctgctacaccgacaccctggagaagtgcaacacctgcggcgagcccatcaccgacagaatgctgagagccaccggcaaggcctaccacccccactgcttcacctgcgtggtgtgcgccagacccctggagggcaccagcttcatcgtggaccaggccaacagaccccactgcgtgcccgactaccacaagcagtacgcccccagatgcagcgtgtgcagcgagcccatcatgcccgagcccggcagagacgagaccgtgagagtggtggccctggacaagaacttccacatgaagtgctacaagtgcgaggactgcggcaagcccctgagcatcgaggccgacgacaacggctgcttccccctggacggccacgtgctgtgcagaaagtgccacaccgccagagcccagacctag

SEQ ID NO: 106403 - DNA, 495 bp, Artificial Sequence
  Description of Artificial Sequence: Synthetic coding sequence
atggccgcccccagacccagccccgccatcagcgtgagcgtgagcgcccccgccttctacgccccccagaagaagttcggccccgtggtggcccccaagcccaaggtgaaccccttcagacccggcgacagcgagcccccccccgcccccggcgcccagagagcccagatgggcagagtgggcgagatccccccccccccccccgaggacttccccctgccccccccccccctggccggcgacggcgacgacgccgagggcgccctgggcggcgccttcccccccccccccccccccatcgaggagagcttcccccccgcccccctggaggaggagatcttccccagccccccccccccccccgaggaggagggcggccccgaggcccccatccccccccccccccagcccagagagaaggtgagcagcatcgacctggagatcgacagcctgagcagcctgctggacgacatgaccaagaacgaccccttctag

SEQ ID NO: 106404 - DNA, 852 bp, Artificial Sequence
  Description of Artificial Sequence: Synthetic coding sequence
atggatctgtggccgggcgcctggatgctgctcttactcttgttccttctgctcctttttctcctgcccactctgtggttctgctcaccctccgcaaaatacttttttaaaatggctttttacaatggctggatcctatttctggctgttctggctatccccgtgtgtgcggtgagaggcaggaatgtggaaaatatgaagattctcaggctcatgctgctgcacatcaagtatctttacggcattagggtcgaggtgcgcggggcgcatcactttccaccctctcagccatatgtagtagtatctaatcaccagagctccctcgacctgctgggcatgatggaggttcttccagggcggtgtgtgccgatcgccaaaagagagcttctgtgggctgggagtgcaggcctggcctgctggctggcgggcgtgatctttatcgaccgcaaacggacaggcgatgccatcagcgtgatgtcagaggttgcccagacactacttacccaggacgtgcgcgtgtgggtcttccctgaaggcacaagaaatcataacggctctatgcttcccttcaagcgcggggcctttcacctggccgtgcaagcacaggtgcccattgtgcctatcgttatgtcctcatatcaggacttctactgcaaaaaggagcgcagattcacatccggccagtgtcaggtccgtgttttgcccccggtgccaactgaaggcctgactccagacgacgtacccgcactggccgaccgcgtaaggcattcaatgctgacagtgttccgtgaaatctccactgatggacgtgggggaggagactatctcaagaagccaggcggcggcggctag

SEQ ID NO: 106405 - DNA, 852 bp, Artificial Sequence
  Description of Artificial Sequence: Synthetic coding sequence
atggatttgtggccaggcgcttggatgttacttttgttactgtttcttctgctgttattccttttgccaaccctatggttttgtagcccttctgcaaaatacttctttaaaatggcattctacaatgggtggatcctgttcctcgcggtgctggccattccagtgtgcgctgtacgggggcggaacgtagagaatatgaagattctgcggctgatgctgctgcatatcaagtacctttatggaattcgggtggaggtgcgaggcgcacaccatttcccaccttcccagccttatgtagtggtgagcaatcatcaatccagcctggacctgctgggcatgatggaggtgctgccaggccggtgcgtgcctattgctaagagagagcttctctgggcaggaagcgccgggctggcatgctggttggctggagttatttttattgatagaaaacgtactggcgatgccatctctgtcatgagcgaagtggcccagacccttctgacacaggatgtgagggtctgggtgtttcccgaaggcactagaaatcataacggcagtatgttacctttcaaaagaggcgcctttcatctcgctgtgcaggcacaagtgcctatcgtgcccattgtgatgtcgtcataccaggacttttactgcaagaaggaaaggagatttactagtgggcagtgccaggtgagggtcctgccaccagtgcctaccgagggcctgactcctgatgacgtgccagcgctggccgacagagtgagacacagcatgctcacggtgtttcgggagatatcaacggacggcagggggggaggggactaccttaaaaaacctggaggcgggggttag

SEQ ID NO: 106406 - DNA, 852 bp, Artificial Sequence
  Description of Artificial Sequence: Synthetic coding sequence
atggatctgtggcctggtgcttggatgcttttacttctgctttttctgcttctccttttcctacttccaactctctggttttgttcccccagtgcaaaatactttttcaagatggccttttataacggttggatcttattccttgcagtcctggccatcccagtgtgtgcggtgcggggtcgcaacgtagagaacatgaagatactacggttgatgctgctgcatatcaaatatctgtacggtataagggtggaggttaggggggcccatcatttccccccttctcagccgtatgttgtggtttctaatcatcaatccagtcttgatctcctggggatgatggaagttctcccgggtcggtgtgtgccgattgccaagcgggagctgctttgggcaggatccgccggactggcttgttggctggctggggtgatcttcatcgaccggaagagaacaggcgacgctattagtgtgatgagcgaagtggcccagacactgctgacccaggatgtgcgtgtgtgggtttttcccgaaggcacccgaaaccataacggatccatgctaccatttaagcggggggcatttcacctggctgttcaagctcaggttcctatcgttccgatcgtaatgtccagttaccaagacttttactgtaagaaggaacggcggtttacgtcaggacagtgccaggtccgcgtactcccacccgtccctaccgagggactgaccccggatgacgtgccggcactggcagaccgcgttcgtcacagcatgctgaccgtcttccgagagatcagcaccgacgggcggggcgggggtgattacttaaagaaacctggcgggggaggctag

SEQ ID NO: 106407 - DNA, 852 bp, Artificial Sequence
  Description of Artificial Sequence: Synthetic coding sequence
atggacctgtggcccggagcatggatgctgttactcctcctcttccttctgttgctcttccttttgcctacgctgtggttctgtagtccatcagccaagtacttcttcaaaatggctttttacaacgggtggattttgtttctcgcggtcctcgcaattcctgtgtgcgcggtaaggggtaggaacgtggaaaatatgaaaatcctccgactcatgttactgcatatcaagtacctgtacggcattagagttgaggtccgaggtgctcaccacttcccgccctcacagccctacgtcgtagtaagtaaccaccagagcagcctggatttactcggcatgatggaagtgctgcctggacggtgtgtccctatcgcaaaaagggagcttctgtgggcaggttccgcaggcttagcctgttggctggccggagtgatatttatcgaccgtaaacgtactggagacgcaatcagcgtcatgagtgaggtcgcccagacgctcttgacacaagatgttcgggtgtgggtgtttccagagggcactaggaatcacaacggaagcatgttacctttcaaacgtggcgccttccacctcgcggttcaggcgcaggtcccaatcgtgcctatcgtgatgagcagttaccaggatttttactgcaagaaagagcgcaggtttaccagcggtcagtgccaggtcagggttctgccccctgtaccaactgagggcctgacccccgatgacgttcccgctctggccgaccgggtgcgccactcaatgctgaccgtgtttagagaaatctccaccgatggaaggggcggcggtgactatcttaagaagcccggcggcgggggctag

SEQ ID NO: 106408 - DNA, 852 bp, Artificial Sequence
  Description of Artificial Sequence: Synthetic coding sequence
atggacctgtggcccggggcttggatgctcttgttactgctgtttctcttgctcttatttctcctcccaaccctctggttttgttccccttctgccaaatacttttttaagatggccttctacaacggctggatcctatttctggccgtgctcgcaatccccgtgtgcgcagtccgagggaggaacgtcgagaatatgaaaatcctacgcctcatgctgctccatatcaagtacctctacggaattagagttgaggtacgaggtgcacatcatttccccccctcccagccttatgttgtggtgagtaaccatcaatccagtcttgacttactcgggatgatggaagtgctgccgggtaggtgtgtgcccattgctaaaagagaacttctgtgggctggaagtgctgggctggcatgttggctggctggcgtcattttcattgataggaagcgaactggcgatgcaattagcgtgatgagtgaagtggctcagactctactcacacaggacgtaagggtgtgggtgtttccagaaggaactcggaatcacaatggctccatgctgcctttcaagagaggtgctttccatttggctgttcaggcgcaggtgccaatcgtgccaatagttatgtcatcctatcaggacttctattgcaaaaaggaacgtaggttcacctccggacagtgtcaggtccgcgtcctcccaccggtccctactgaggggctcactcctgatgatgtgcccgccctggccgaccgagtgaggcatagcatgttaaccgtgttccgcgaaatctcaacagacggacgcggggggggggactatctgaagaaaccaggaggcggtggatag

SEQ ID NO: 106409 - DNA, 852 bp, Artificial Sequence
  Description of Artificial Sequence: Synthetic coding sequence
atggatttgtggcctggggcatggatgctgctgcttctgctttttctgctgctgctgttcttgctgccgacgttatggttctgtagccccagtgccaaatactttttcaaaatggccttctataacggctggatactttttctggccgttttggcgatcccagtctgtgcggttagggggcgtaacgtagagaatatgaagatactccgcctaatgctgctacacattaagtacttatacggaatccgggttgaggttaggggtgcccatcacttcccgccgagtcaaccatacgtggttgtgagcaatcatcagagctccctggatttactggggatgatggaggtgctgccaggacgatgcgtgcctattgctaaacgagaactgctctgggccggcagcgctggccttgcttgctggctggccggcgtaatttttatcgaccgaaagaggaccggggacgctatctcggtgatgagtgaagtggcccagactctgctgacgcaagacgttcgcgtgtgggtgtttcccgagggcactcgaaatcacaatgggagcatgctgcccttcaagaggggggctttccacctggcagtccaggcacaggttcccatcgttcctattgtgatgtctagctatcaggatttctactgcaagaaagagcgccgatttacaagcggccagtgtcaggtgcgcgtcttgcccccagttccaaccgagggacttacaccagatgacgtgccagcgttagccgaccgtgttaggcactcgatgttgaccgtcttcagggagatctctacggacggacgcggcgggggagactacctcaagaaacccggaggaggtggctag

SEQ ID NO: 106410 - DNA, 852 bp, Artificial Sequence
  Description of Artificial Sequence: Synthetic coding sequence
atggacctctggcctggcgcatggatgctgctacttctgctctttctcttgctgctgttcctcctccctactctgtggttctgcagtcccagcgctaagtactttttcaagatggcattctataatgggtggattctctttctggccgtactggcaattccggtgtgcgccgtccggggcaggaatgtagaaaacatgaaaatcttgaggcttatgctgctgcatataaagtatctgtacggtattagggtcgaagtcaggggcgcacatcactttccacccagccagccctacgtagttgttagcaaccatcagtcctccctggatcttctgggcatgatggaagtcctgcctggtcgatgcgtccccattgccaaaagagaattgctgtgggctgggagtgccgggctggcttgctggttggcgggagtgattttcatcgatagaaaaagaaccggcgatgccatctcggtcatgtctgaggttgcccagaccctgttgacgcaagacgtgcgcgtctgggttttcccagaaggaacaaggaaccacaacggctccatgcttccttttaagagaggcgcctttcatctggcagtccaggcacaggtgcctattgtgcccatcgtgatgagctcctaccaggacttctactgcaagaaagagaggcggttcaccagcgggcagtgccaggttagggtactgccccccgtgcccactgaagggctgacccctgacgatgttcccgccctcgccgatagggtaagacactccatgcttaccgtgtttagagaaatttctactgatggccgggggggaggggactacttgaagaagccagggggcggcggttag

SEQ ID NO: 106411 - DNA, 852 bp, Artificial Sequence
  Description of Artificial Sequence: Synthetic coding sequence
atggacctgtggcccggcgcctggatgcttctgctgcttctgttcttactgctcctgttcttgctccctaccctgtggttttgctctccatcagcaaaatacttctttaaaatggccttctataacggatggatcttgttcttggccgtgcttgcaattccagtctgcgccgtgaggggaaggaacgtggagaatatgaagatacttcgactgatgcttctccacatcaaatacttgtacggcattcgcgttgaagtcagaggagcgcatcacttccctcccagccaaccgtacgtcgtcgtctctaatcaccagtcgtccttagacctgctgggaatgatggaagtactccctggccggtgtgtaccaattgctaaacgcgagctactatgggcaggtagtgcaggtttggcatgctggctggctggggttatattcattgatcgcaaaaggacaggtgacgcaatatccgtgatgtcagaggtagcccaaacccttcttacgcaggacgtgcgcgtttgggtgtttcccgaagggactcgcaaccataatggtagtatgctcccattcaaacgaggggctttccatcttgccgtgcaggcacaggtgcccatcgtaccaattgtcatgagctcctaccaggatttctattgtaagaaggaacgtaggttcactagcggtcaatgccaagttagggtcctgccacctgtgcccacggagggccttaccccagacgacgtgccagccctggctgacagggtccggcacagcatgctgaccgttttcagggaaatctcaacagacggccgaggcggaggcgactacctgaaaaagcctggtggcggcggttag

SEQ ID NO: 106412 - DNA, 852 bp, Artificial Sequence
  Description of Artificial Sequence: Synthetic coding sequence
atggacctgtggccaggagcctggatgttgctacttttactgtttctcctgctcctttttctgctgcctaccttgtggttttgcagccccagtgccaagtactttttcaagatggcattctacaatggatggattttatttctcgccgtcctggcaatcccagtctgtgccgtgcgtggaagaaatgtcgaaaacatgaagatccttagactgatgctcctgcacataaagtatctgtatggtatacgagttgaggtgagaggcgcccatcattttcctccaagccagccttatgtcgtcgtgagcaaccatcaatcgtcattggaccttttagggatgatggaagtactaccagggagatgcgtgcccatcgctaagcgtgagctgctatgggccgggtcagcaggtcttgcctgctggctggccggggttatatttatagacaggaagaggacaggcgatgctatttctgtcatgtccgaagtggctcagactctgctgacccaggatgtgagagtctgggtatttcctgagggtactcggaatcataatggctcgatgctcccttttaaacgaggtgccttccatctcgctgttcaggcacaggttccgattgtgcccatagtcatgagtagctatcaggatttctactgtaagaaggagcgtcggttcacgtcgggccaatgtcaggtacgagtcctccccccagtaccgactgagggtctcacccccgatgacgtcccggcccttgccgaccgggtgaggcactctatgctgactgtatttagagagatcagcaccgatggaagaggaggcggagactatctgaagaaacccggaggcggtggttag

SEQ ID NO: 106413 - DNA, 852 bp, Artificial Sequence
  Description of Artificial Sequence: Synthetic coding sequence
atggacctttggccaggtgcatggatgctgttgctgctcttgtttttactactcttgtttctgctgcccacattgtggttttgttcccccagtgcaaagtatttctttaaaatggccttttacaatggatggatactgttccttgcagtcctggcaatccccgtgtgtgccgtaaggggccgcaatgttgagaatatgaaaattctccgcttgatgctgctccacatcaagtatttatacggcattcgcgtggaggttcgaggagcccaccactttcctccctcacagccttatgtcgtggtgagtaaccaccagagtagtctcgacctcttggggatgatggaagtgctgcccgggaggtgtgtgcctatcgccaaacgagaactgctctgggccggctctgctggactcgcatgctggctagctggggtaatttttattgaccgcaaaagaacaggcgacgccatctcagtgatgagtgaggtagcgcagacactccttactcaggatgtccgggtgtgggtctttccagagggaacaaggaatcacaacggaagcatgctgccatttaagaggggcgccttccacctggccgtgcaggctcaggtgccaatcgtaccaatcgtgatgtcatcctaccaggacttctattgcaagaaggagaggcgctttacatccggacagtgccaggtgagggtcctgccgcctgtcccaaccgagggacttacacccgatgacgtgccagccctggctgatagagtgcgacacagtatgctgaccgtctttagagagatcagtacagacggccgaggggggggagactatctgaaaaagcccgggggtggcgggtag

SEQ ID NO: 106414 - DNA, 852 bp, Artificial Sequence
  Description of Artificial Sequence: Synthetic coding sequence
atggatctgtggcccggcgcctggatgctcctccttcttctgtttttgttgctcctgtttctgctgccaacgttgtggttttgctcgccctccgcgaaatatttctttaaaatggctttctataatggctggattctgttcttggctgtattggccattcctgtatgcgccgtacggggaagaaacgtagaaaacatgaagatcttgaggttgatgctcctgcatattaaatacctgtatggcatccgagttgaggtcagaggggcacatcacttccccccctcccagccttacgtcgtggttagcaaccatcagtcttctctcgacctgctcgggatgatggaagtcctgcccggtcgttgcgtaccgatagctaagcgcgaactgctctgggccggttctgccggcctggcatgttggctagctggtgtgatctttattgaccgcaaaaggaccggcgacgctatttcggtcatgtctgaggtcgctcagacactactcacacaggatgtccgggtgtgggtgttcccagaaggcactaggaatcataacggctcaatgctacctttcaagcggggcgccttccacctggcagtacaagcccaggtccccatcgtgccaatagtaatgagcagctatcaggatttttactgcaagaaagagcgtaggttcacttcaggccaatgtcaggtgcgggtattaccgccggtaccaacagagggattgacccccgacgatgtcccggcactggcagatagagtgcgccacagtatgctcaccgtgttccgggaaatttccacagacgggcggggcggaggtgactacctgaagaaacccggtggcggagggtag

SEQ ID NO: 106415 - DNA, 852 bp, Artificial Sequence
  Description of Artificial Sequence: Synthetic coding sequence
atggacctgtggcccggcgcctggatgcttctgttactcctgttccttctgctcctgttcctgttgccaacactctggttttgcagtccctccgcgaagtatttcttcaagatggccttttataatggctggattctattccttgcagtgttggctatacccgtctgtgctgtgcgcggcagaaatgtggagaacatgaagattctcagactgatgctgctccacatcaagtatctctacggcatcagagtagaagtgcggggcgcacatcattttcctccctctcagccctacgtagtagtgtccaaccatcagagctctctagatctcctaggcatgatggaagtccttccagggcgctgcgtgcccattgccaagagagaactgctatgggccggctcggccgggctagcctgctggctagccggagtgattttcattgaccggaaacggaccggagacgctattagcgtgatgtcagaggtggcgcaaacattactcacccaggatgtgcgtgtgtgggttttcccagagggtacccgaaaccataatggatctatgctgcccttcaaaagaggagcgttccatttagctgtccaggctcaggtgccgatagtaccaatcgtcatgtctagctaccaggacttctattgtaagaaagagaggaggtttaccagtggccaatgtcaggtgcgtgttctgcctcccgtgcccaccgaggggctaacacccgacgatgtccccgcgcttgcagacagagtgagacatagcatgttgactgttttcagagaaatttcaacagatggacgaggtggcggggactacctcaaaaaacctggagggggaggatag

SEQ ID NO: 106416 - DNA, 516 bp, Artificial Sequence
  Description of Artificial Sequence: Synthetic coding sequence
atgatggaggtgctgcctggtagatgcgttcccattgctaagcgagagctcctgtgggcgggcagcgcagggctggcctgttggttggcaggagtgatcttcatcgaccgcaagagaaccggggatgcaatttctgtcatgtcagaagtggctcagacactgctcacccaggatgtgagggtctgggtcttcccagagggaacacggaatcataatggttctatgctcccatttaagcgcggtgctttccatctagccgtgcaggcccaggtccctatcgtccccattgtgatgtcttcttaccaagatttctactgcaaaaaagaaagaaggtttacgtctggtcagtgccaagttcgcgttctgccaccagttcccaccgaaggcttgacgccagacgacgttcctgccttggctgatcgcgtaaggcatagcatgctcacagtgttcagagaaatctccaccgatggtaggggcggcggcgattacctcaagaagcctgggggcgggggctag

SEQ ID NO: 106417 - DNA, 852 bp, Artificial Sequence
  Description of Artificial Sequence: Synthetic coding sequence
atggatctgtggcctggcgcatggatgcttctacttttactctttctcctactcttatttcttctgcctactttgtggttttgtagtccaagtgccaagtacttttttaagatggcattctataacggctggatccttttcctggctgtgctcgctattccggtgtgtgctgtgaggggacgcaacgtcgagaacatgaaaattctccgtctcatgctgctccatattaagtacctctacggcattcgcgtggaggtgcgcggcgcccaccactttccaccctcacagccgtacgtggtcgtcagcaaccaccagtctagcctggacctgctggggatgatggaggtgctgcccggacgctgcgtgcccattgctaaacgagaactcctctgggcagggtctgctgggctcgcatgttggctggccggggtcatctttatcgaccggaagcggaccggagacgctatctcagtcatgagcgaggtggcccagaccctcctcacacaggacgtgagagtgtgggttttcccagaaggcacccggaaccataatgggagtatgctaccttttaaacgaggggccttccatctggctgtccaggcacaggtcccaattgttcccatagttatgtcttcatatcaggatttttactgtaaaaaggagcgacgttttacgtcgggtcagtgccaagtgcgggtgttaccaccagtgccgacagaggggctgacaccggatgacgtcccagcccttgctgatagggtgagacatagcatgttaactgtattccgagaaatctccactgatgggcgcggggggggcgactacctcaagaaacctggaggcggcggctag

SEQ ID NO: 106418 - DNA, 852 bp, Artificial Sequence
  Description of Artificial Sequence: Synthetic coding sequence
atggacctctggcctggcgcctggatgctgctgttattactttttctactactcctctttcttctccccacgctgtggttttgtagcccaagcgccaagtatttctttaagatggctttctacaacggttggatactcttcttggcagtgttggctattcccgtgtgtgcagtcaggggacgaaacgtggagaacatgaagatcttgaggctgatgctgctgcatataaagtacctgtacggcatcagagtggaagtgagaggggctcaccatttcccgccttctcagccctatgtggtggtctctaaccatcagtcctctctagacctgctgggaatgatggaagtgctgcctgggcgctgcgtgccaatagctaaaagagaactactgtgggccggcagtgcagggttggcatgctggctggcgggtgttatctttatagaccgaaagaggacaggagatgcaatctccgtgatgagcgaagttgctcagacacttctgacgcaggatgtgagggtgtgggtgttccctgaggggacccggaaccataatggatcaatgttgcctttcaagcgcggtgcatttcatctagctgttcaggcccaggttcccatcgtacccatcgtaatgagctcctaccaggacttttactgtaagaaagagcggcgctttacatctggtcagtgtcaggtgagggttctgcctcctgtccccaccgagggcttaacacccgacgatgtaccagcacttgcagaccgcgtgagacactctatgctcacagtattcagggaaatctcaaccgatggtcgggggggaggcgactacctgaagaagccgggaggcggcgggtag

SEQ ID NO: 106419 - DNA, 852 bp, Artificial Sequence
  Description of Artificial Sequence: Synthetic coding sequence
atggatctttggcccggtgcctggatgttattactgttactttttcttttgttactctttctcctgcccaccttatggttctgcagtccaagcgccaagtactttttcaagatggccttttacaatggttggattcttttccttgctgtgctcgccatccccgtctgcgcagtaagaggcaggaacgttgagaatatgaagattttgcgtcttatgctcctccatattaagtacctctatgggatcagggttgaggttcggggtgcacatcattttccccccagccaaccttatgtagtggtctcgaatcaccagtcctcgttggatctactgggtatgatggaagtgctgcctggcagatgcgtcccgatcgccaagcgcgaactactgtgggccggtagcgcggggctggcgtgctggctggccggcgtgatctttatcgatcggaagaggaccggcgacgccatctccgttatgagtgaggtcgcacagaccctccttacccaggacgtgagggtttgggtgtttcctgagggcacacgcaaccacaacgggagcatgctcccttttaagaggggcgcgttccaccttgccgtgcaggcgcaggtgcctattgtcccaattgtgatgtcctcataccaggacttctactgcaagaaagagcggagattcacctctggccagtgtcaggtccgggtcctgccccccgtgccaacggaggggttgactccagatgacgttccagctcttgccgacagggtgcggcattcaatgttgacggttttccgggagataagtacggacggaaggggtggtggggattacctgaagaagcctggcggcggagggtag

SEQ ID NO: 106420 - DNA, 852 bp, Artificial Sequence
  Description of Artificial Sequence: Synthetic coding sequence
atggacctgtggcccggcgcgtggatgctgctcctcctcctgtttctgctcctgctcttcctgctacctactttatggttttgtagtccttctgcgaagtatttttttaaaatggcgttttataatgggtggatcctgtttctcgcagtcctggcaatacccgtctgtgctgtgcgcggacggaatgtggagaatatgaaaatattaaggctgatgctccttcacattaagtatctatacgggataagggtggaagtccgtggggctcaccattttccacctagccagccttacgtcgtggtctccaatcatcaatccagcttggatcttcttggcatgatggaggtgctgccgggccgctgtgtgcccattgccaaacgcgagctcctgtgggcaggatccgcgggactggcgtgttggctggctggtgtcattttcatagaccgaaagaggacgggcgatgccattagtgtcatgagcgaagtggcacagacattgctgacgcaggatgtccgggtgtgggtcttcccagagggaaccaggaaccacaatggctccatgctccctttcaagcggggggcattccacttggccgtacaggcccaggtgcccattgtgccaatcgtaatgtcctcctaccaggacttctactgtaagaaggagcgtcgctttacaagtgggcaatgtcaagtgcgcgtgttgcctcctgtccccaccgagggactaaccccggacgacgttcctgcgctggcagatcgggtgcggcatagcatgctgacagtgttccgtgagatcagcaccgatggaagaggcgggggtgattacttaaaaaagccaggtggtggaggttag

SEQ ID NO: 106421 - DNA, 852 bp, Artificial Sequence
  Description of Artificial Sequence: Synthetic coding sequence
atggatctgtggcccggcgcctggatgctactcttattgctctttcttcttctgctctttttgctgcccaccctgtggttctgctccccctcagcgaaatatttttttaagatggcgttctacaacggctggattctatttctggccgtgttggccattcctgtgtgcgctgtgagagggaggaacgttgaaaacatgaagattctccgtctgatgctgctgcatatcaagtacctttacggcattagggttgaggtcagaggcgctcatcatttccctccaagccagccatacgtcgtggtgagcaaccatcaatcctctttggacctgctaggaatgatggaggtgctccctggaagatgtgtcccaatcgcgaaacgcgagttgctgtgggcaggttccgctggtctggcctgctggcttgctggcgtcatatttattgatcggaagcggactggtgatgcaattagcgtgatgagcgaagtggcccagacactgctcacacaggatgtacgggtctgggtattccctgagggtacccgcaaccataatggctctatgctcccttttaaaagaggtgcgtttcacctggcagtgcaggctcaggtgccgatcgtccccattgtcatgtccagttatcaggacttctattgtaaaaaagaacgacgattcacaagcggtcagtgtcaggtacgggtcttgccccctgttcccactgagggtctcacccctgacgatgtgccagcccttgcagacagggttcgacacagcatgttaacagttttccgtgagatttcaacagatggccgaggcggcggcgattatctgaagaagccaggaggaggcgggtag

SEQ ID NO: 106422 - DNA, 852 bp, Artificial Sequence
  Description of Artificial Sequence: Synthetic coding sequence
atggatctgtggccaggggcttggatgctcctgctcctcttgttcttgctccttctattcctactccctacactgtggttttgttctccgtcagcaaagtacttttttaagatggccttttacaatgggtggatattgttccttgcagtgctcgctataccagtatgtgccgtaaggggcagaaatgtcgagaatatgaaaattttacggctgatgctgctccacataaaatacctctacgggatcagagtggaagtgagaggtgctcaccatttcccgccttctcagccctacgtcgttgtgtcaaaccaccagagtagcttagacttgctgggcatgatggaggtgttacctggacgatgcgtcccaattgccaagagggagctcctgtgggcaggatctgccggcctggcttgctggctggcgggtgttatcttcatcgaccgcaagagaacgggagacgcaatcagcgtgatgtctgaagtggcgcaaaccctgctgacccaagacgtcagagtgtgggtgtttcctgagggcacacggaaccataatggatccatgctacctttcaagcggggtgctttccacctcgcagtgcaggcccaagtgccgattgtgcccatcgtgatgtcgtcataccaggatttttactgcaaaaaagagcgtcgcttcacatccggacagtgtcaggtacgcgtactcccacctgtaccgacagaaggccttaccccagatgatgtaccagcgcttgctgaccgcgttcgccattctatgctgactgtgttccgggagatctctaccgacggtcgcgggggtggcgactacttaaaaaagccgggcggcggcgggtag

SEQ ID NO: 106423 - DNA, 852 bp, Artificial Sequence
  Description of Artificial Sequence: Synthetic coding sequence
atggatctgtggcctggggcctggatgctcttattactgttatttctgcttttgctgttcctccttcctacactgtggttctgcagcccttctgccaaatacttcttcaagatggccttctataatggttggatcttattccttgcagtactggccattccggtttgcgcggttcgcggaagaaacgtggagaacatgaagatcctgcggctgatgcttcttcatatcaaatacttgtacgggatacgcgtggaagtcagaggcgcccaccattttcctccaagccagccctacgtcgtggtcagcaatcatcaaagttcattggatctgctaggcatgatggaggtcctgcccgggcgttgtgtcccgatcgcgaaacgagagttgctgtgggccggcagtgctgggctcgcttgctggctggccggcgtgattttcatcgacaggaagagaaccggggacgccatttccgtgatgagtgaggttgcacagacactcctgactcaggatgtgagggtgtgggtattccctgaggggactcggaaccacaatgggtccatgctcccgtttaaacggggcgcatttcacctcgctgtgcaggcgcaggtaccaattgtccctatcgtaatgtccagctatcaggatttctactgcaagaaggaacgcaggtttacaagtggccaatgccaggtgcgagtgctcccccctgtgcctaccgagggactcactcctgacgacgtgcctgcccttgctgacagagtgagacatagcatgctgaccgtttttcgggagatcagtactgacggacgggggggaggcgattatctaaagaaacccggtggggggggttag

SEQ ID NO: 106424 - DNA, 852 bp, Artificial Sequence
  Description of Artificial Sequence: Synthetic coding sequence
atggatctatggcccggtgcctggatgctactgctgctgctgttcctcctcctgttgtttcttctacccactctctggttttgtagcccgagtgccaaatacttcttcaagatggctttttataatggctggattctattcttggctgtcctcgccataccagtgtgtgccgtgcgcggccggaatgtggagaatatgaagatcctaagactgatgctcctccacattaaatatctttacggcattcgcgtcgaggtcagaggcgctcatcattttcccccttcacagccgtatgtcgtggtgtctaaccaccagagttccctcgatcttttggggatgatggaggtcttacccggaagatgtgtgccaattgcaaagcgcgagctcctgtgggctggctctgccggacttgcgtgctggctggccggagttatctttattgatcgcaaacgcaccggagacgccatatcggtcatgtccgaagtggcccagaccctattgacccaggatgtcagggtgtgggtttttccggagggaacccgaaatcacaacggcagcatgctcccctttaaaaggggcgcctttcacctggctgtgcaagctcaggtgccaatcgtgccaatcgtgatgtcctcataccaggatttttattgtaaaaaagagaggcgctttacatcagggcaatgccaggtgcgcgtgctgccccccgtgcctacagaaggcctcacccccgacgatgtgcccgccctcgctgatcgcgtgcgccatagcatgctgaccgtgttccgcgaaatatcaactgatggccgcggagggggcgactatttaaagaagccaggcgggggtggctag

SEQ ID NO: 106425 - DNA, 852 bp, Artificial Sequence
  Description of Artificial Sequence: Synthetic coding sequence
atggatctctggcctggagcctggatgctgcttctcctattgtttctcctcctgttgtttcttctgcctaccctgtggttttgttcgccatctgcaaaatactttttcaagatggcattttataatgggtggatcctcttcttagccgtgctggccatccctgtgtgcgcagtccggggcagaaacgtggagaacatgaagatccttagacttatgctgctgcacatcaaatacctgtatggtatccgcgtagaggtgcggggtgcccaccattttcccccaagccagccatacgtcgtcgtgtccaaccaccagagttcactggatcttcttggtatgatggaggtgcttccaggcaggtgtgtgcccatagctaagagagagttactctgggctggctctgcgggcctagcctgctggctcgcaggggttatttttattgataggaagcgaacaggggacgccatcagtgtgatgtctgaagtcgcccagactctgctgacccaagacgtaagagtgtgggtttttcccgaaggtaccaggaaccacaacgggagcatgctgccattcaagcggggagcattccacctggctgtccaggcacaagtgcctatcgtacccatcgtgatgtcatcatatcaggacttttactgcaaaaaagagcggcgatttacctctggtcagtgccaggttcgtgtactgcctccggtacctacagagggattgactccagacgacgtgcccgccctggcagatagggtacgccacagtatgttaacagtcttccgggaaatcagtacggacggtaggggaggtggcgactatcttaaaaagccagggggcggcgggtag

SEQ ID NO: 106426 - DNA, 852 bp, Artificial Sequence
  Description of Artificial Sequence: Synthetic coding sequence
atggacctctggcctggtgcatggatgctgctgctactgctatttttactcctcctgttcctgctgccaactctgtggttttgcagcccttccgcaaagtattttttcaaaatggccttttacaacgggtggattctatttctggccgtcttagccattcccgtgtgcgctgtgcgcggcaggaatgtcgaaaacatgaagattctgcgtctgatgcttctgcatatcaagtatctgtatggcattcgggttgaggttcgcggcgctcaccactttccgccctcccagccgtatgtagtcgtctccaatcatcaatcctcactggaccttctgggtatgatggaggtactgccaggtcggtgtgtgcccattgctaagagagagctgctgtgggcaggctcagctgggctggcctgctggttagccggtgtgattttcattgaccggaagcggactggcgacgctatctctgtgatgtccgaggtggcccagactttattaactcaggatgttcgcgtttgggtgtttcccgaggggacgagaaaccataacggatctatgctgcccttcaagcgcggagcttttcacctcgccgtccaggcccaagtgcccattgttcctatcgtgatgtccagctatcaggatttttattgtaagaaagagcggagattcacctccggacaatgccaggtgcgcgttctaccacccgtgcctacagaagggctcacgcccgatgacgtccccgccctggcggaccgggtgagacacagcatgctcaccgtttttagagagatctctaccgacgggcggggtgggggcgactacttgaagaagccaggagggggcggctag

SEQ ID NO: 106427 - DNA, 852 bp, Artificial Sequence
  Description of Artificial Sequence: Synthetic coding sequence
atggatctgtggccaggcgcttggatgttgctcttgttgctgtttttattgctgctctttctccttcctacgctttggttctgcagcccatcagccaagtatttctttaagatggcgttctacaacggctggatactgttcttagcggttctggccataccagtgtgcgcagtacgcggccgcaatgtcgagaatatgaaaattttgcgtttgatgctccttcacattaagtacctctacggcatccgggtggaggtcaggggtgcgcaccatttcccgccttcgcagccatacgttgtggtgagcaatcaccagagctccttggatctcctgggaatgatggaagtactccctgggaggtgtgtacctatcgccaagagagagcttctgtgggccgggagcgccggcctcgcttgttggctggccggtgttatcttcattgataggaagaggacgggggatgctataagtgtaatgtctgaagtggcccagaccctcctgacacaagatgtcagagtctgggtgtttccagaaggaaccagaaaccataacggcagcatgctgcccttcaagcggggagccttccatctcgccgtccaggcccaagtgcccattgttccaatcgtcatgtcttcttaccaggatttctactgcaagaaggagcgtcggtttaccagcggacaatgtcaagtgcgcgtgctgccccctgtcccaactgaagggctcacgcccgatgacgttcccgcccttgcagaccgggttcgccatagcatgctcacagtgtttagagaaatcagcactgatgggcgcggtgggggtgattacctgaaaaagcccgggggtggcggctag

SEQ ID NO: 106428 - DNA, 852 bp, Artificial Sequence
  Description of Artificial Sequence: Synthetic coding sequence
atggacctttggcctggagcatggatgctcctgttgcttttattcctgcttctgctgtttctgttaccgacactctggttctgctccccaagcgctaaatacttctttaagatggctttctataatggatggatcctttttcttgccgtactggctatacccgtatgtgctgtccgcggcaggaatgtcgagaatatgaaaattctgcgtctgatgctactgcatatcaaatacctctacggcatccgggtggaggtgcgcggagcccaccactttcccccatcacaaccctacgtcgttgtctcgaaccaccagtcgtccctggacctacttggcatgatggaagtcctgcccggcagatgtgtgccaatcgccaagcgggaattgttgtgggccggctcagccgggctcgcatgctggctggccggggtgatctttatcgacagaaagcgcactggagacgccatatctgtcatgtctgaagtggctcagaccctactgacgcaggacgtaagggtatgggtgtttcctgagggcaccagaaaccataatggcagcatgcttcccttcaagcggggtgctttccacttggccgtgcaagcacaggtacccattgttccgatcgtgatgtcttcttaccaggatttctactgtaagaaggagcgccggttcactagcggtcagtgtcaggtccgggtgctaccacctgtgccaacagaggggctgacccctgacgacgtccctgccttagcagatagggtgaggcacagtatgctcactgtctttcgtgaaatttcaacggatgggcgtgggggaggtgactacttgaaaaaaccaggggggggagggtag

SEQ ID NO: 106429 - DNA, 852 bp, Artificial Sequence
  Description of Artificial Sequence: Synthetic coding sequence
atggacttgtggcccggagcctggatgttgctgttgctgctgttccttttactcctgtttttactgccgaccctgtggttctgtagcccgtccgcaaagtatttctttaaaatggcattctacaatgggtggattctctttctggccgtgctggccataccagtgtgcgctgtgagaggccgcaacgtggaaaacatgaagatcctgcgactgatgcttttacatatcaaatatttatacggaatccgggtggaggttcgcggtgcccaccacttcccccccagtcagccatatgttgtggtgtcgaatcaccaaagctccctcgacctgctagggatgatggaggttcttcctgggagatgtgtgcccatcgccaagcgggagctcctttgggctgggtcggctggactggcatgttggctcgcgggggtgatcttcatagaccggaagcgtactggcgatgccatatctgtaatgtctgaagtagcccagaccctgcttacgcaagacgtgcgagtgtgggtcttccccgaggggacaaggaaccacaacgggagtatgctcccttttaaacgcggcgctttccatctggccgtgcaggcccaggtgcctatagtgcctatagtgatgtcttcataccaggatttctactgcaaaaaagaaaggagattcaccagtggccagtgtcaagtcagagtactgccaccggttcccacagaagggctgacaccagatgacgtgcctgcactggcagacagagtccgccattctatgctcacggtctttcgagagatttcgaccgatggaaggggggggggggattacctgaaaaaacccggtggtggcggatag

SEQ ID NO: 106430 - DNA, 852 bp, Artificial Sequence
  Description of Artificial Sequence: Synthetic coding sequence
atggacctatggccaggtgcttggatgctcttgttgctgctgtttctgctcctcctattcctcttacctactctctggttttgctcaccaagtgctaagtacttctttaaaatggccttttataatggctggattttgttcctggctgtcttggcaatcccggtctgtgctgttcggggcagaaatgtcgagaacatgaagatcctacggctcatgctgctgcatataaaatacctgtatgggatccgagtggaggtgcgaggtgctcatcattttccgcccagccagccttacgtagtcgtgtcaaaccaccagtcttccctggaccttctgggaatgatggaggtactgcccgggaggtgtgtgccaatagcaaaaagagaactgctgtgggccggctccgctggcctggcctgttggctggccggagtgattttcatagacagaaagcgcaccggggatgccattagtgtaatgagcgaagtggcacaaaccctgttgacccaggacgtgcgtgtctgggtcttccccgaggggacaagaaaccacaacggctccatgctcccatttaaaaggggggcctttcacctcgctgtgcaagctcaggtcccaattgtgcctatcgtcatgtcttcgtaccaggatttctactgtaaaaaagagaggcgctttacgagcggccagtgtcaggtgagggtactgcccccggtaccaacggaggggctcactcctgatgatgtgccagccctggccgatagagtaagacactcaatgttgaccgtctttagggaaatcagcactgatggccggggcggaggagattatctgaaaaaacctggcggagggggctag

SEQ ID NO: 106431 - DNA, 852 bp, Artificial Sequence
  Description of Artificial Sequence: Synthetic coding sequence
atggacctctggccaggggcatggatgctcctcctgcttcttttcttgctcctgctgtttctcttgcctaccctatggttctgctctccgtccgccaaatacttttttaagatggctttctacaatggctggatcctgtttctagcagtactagcgatacccgtctgtgcagtgagaggacgcaacgtcgaaaacatgaaaattttacggttaatgctcctgcatattaaatacctctatggaatccgggtagaggtgcggggggcccatcatttccctccttctcaaccctacgtggtggtatcaaatcatcagagtagccttgatctgctcggcatgatggaagtgctgcccgggagatgcgtcccaatcgcgaagagggaactactgtgggcaggaagcgcaggtcttgcctgctggctggcaggagtcatcttcatcgacaggaagagaacaggggatgccatctctgtgatgagcgaggtcgcccagacattactgacccaagatgtaagagtctgggtatttcccgagggcaccaggaatcacaacggaagtatgctgcctttcaaacggggagctttccacctcgcagtgcaggcccaagtgcccatcgtgccgatcgtgatgagctcctaccaggatttctattgtaaaaaagagagacgctttacctccggtcagtgtcaagtgcgtgtactgccccctgtacccaccgagggactgacacctgatgatgtgcccgcattggccgacagggtgaggcattccatgctgaccgtgtttagagaaatttccaccgatggcaggggcgggggagactatcttaaaaaacccggcgggggcggctag

SEQ ID NO: 106432 - DNA, 852 bp, Artificial Sequence
  Description of Artificial Sequence: Synthetic coding sequence
atggacttatggcccggcgcctggatgttactcctgctcttattccttctcctgcttttcctgctccctacactgtggttctgttctccgtcagcgaaatacttcttcaaaatggcgttctacaacggttggattctgttccttgctgtgctggcgatcccagtttgtgcagtcagagggcgaaacgtagagaatatgaaaattcttcgactgatgctcctccatatcaagtatctgtatggaatcagagttgaagttcgcggagcacaccattttcctccgagccagccatacgtggtcgtctctaatcaccagtccagcctggaccttctaggcatgatggaagttctcccaggtcgatgtgtgcctatagccaagcgggagctcctctgggctggatcggccgggctggcgtgttggctcgcaggtgtgatcttcatcgaccgcaagcgtaccggggatgccatatcagttatgagcgaggtcgcacagactctgctgactcaggacgtccgagtgtgggtgtttcccgagggcacacggaaccataatggctcgatgttgcccttcaaaaggggggcttttcatttggcagtccaggcacaggtaccgattgtaccgatcgtaatgtcaagctaccaagacttctattgcaaaaaagagcgaagattcacctctggccagtgccaggtgcgtgtactgccccctgtgccgaccgaagggctgactcccgatgatgttccagccctggcagacagagtccggcacagtatgttgaccgtgttccgcgaaatctctaccgatggtcgaggggggggggattatctgaagaaacctggcggcggtggctag

SEQ ID NO: 106433 - DNA, 852 bp, Artificial Sequence
  Description of Artificial Sequence: Synthetic coding sequence
atggacctatggccaggcgcctggatgcttctgcttcttctctttttgctgctactgttcctgctgccaacgctttggttttgtagtccctctgccaaatatttcttcaagatggccttctacaacggctggatcctttttctcgccgtgctggccatacctgtgtgcgcagtccgcgggaggaacgtggaaaatatgaaaattctcagacttatgttgctgcatataaagtacttgtacggtattcgtgtcgaggttcggggggcgcaccatttcccacccagccaaccatacgtcgtggtcagtaaccatcagtcgagtctcgacctcttaggcatgatggaagtgctgcccggacgctgcgttcccatcgcaaaacgcgagctcttgtgggccggtagtgcagggcttgcttgttggttagccggcgtgattttcattgatcgtaagagaactggggatgcgatctctgtcatgtctgaagtcgctcagacactgttgacgcaggacgtccgcgtgtgggtctttcctgagggcacccggaatcacaatggcagcatgctgcccttcaaaagaggggctttccacttagctgtgcaagcccaagtcccgattgtgcccattgttatgtccagctatcaggacttctactgcaaaaaagaaagaaggtttacgtccggccaatgccaggtgcgggttttgccccccgtgcctacagagggcctaactccggatgacgttcctgcattggccgatagggtccggcattctatgttaacagtattccgcgagatttccaccgacggaagaggcggtggggactatcttaagaagcctggggggggaggatag

SEQ ID NO: 106434 - DNA, 852 bp, Artificial Sequence
  Description of Artificial Sequence: Synthetic coding sequence
atggacctgtggcctggggcatggatgctgttgctcctgctgtttctgctgctgctgtttttactgcccacactgtggttctgctcacccagcgcgaaatacttcttcaagatggccttctacaatggttggatactttttttagcagttcttgccatacccgtttgtgctgtccgcggtaggaacgtcgaaaacatgaagatcctgagacttatgttgttgcatattaagtatctgtatggaatcagggtcgaagttcgcggggcccaccactttccaccgagtcagccgtatgttgttgttagtaaccaccagagctccctggatctcctgggcatgatggaggttctgccagggcgatgtgtgcccatagccaagagggaactcctgtgggccgggagcgcgggattggcttgctggctggcgggtgtgatatttatcgacaggaagcggacaggcgatgcgatttccgtgatgagtgaggtggcgcagacactgttgacccaggacgtgagggtctgggtattccccgagggaactagaaaccataatggttcaatgttgcccttcaagagaggcgcctttcacctggcggtgcaagcacaggtaccaatcgtgcccatcgtgatgtcatcttaccaggacttctactgtaagaaagagcgccgtttcacttcagggcagtgccaagtgcgagtgttgccacccgtccctactgaaggtttgacccctgacgatgttcccgcgttagccgaccgtgtacgacactcaatgctgacagtgttcagagagatctcgactgatggacgagggggcggtgattacttgaagaaaccaggtggcggtgggtag

SEQ ID NO: 106435 - DNA, 852 bp, Artificial Sequence
  Description of Artificial Sequence: Synthetic coding sequence
atggacctgtggcctggggcgtggatgttattgctactgcttttcctcctcctgttatttctattgccgacgttatggttctgctcgcctagcgccaaatacttcttcaagatggctttttacaacggttggatactgtttttggcagtacttgccatccctgtttgcgctgtgcggggaagaaatgtagagaatatgaagatcctaaggctcatgctgctccacattaaatacctgtatgggattcgcgtggaagtacggggggcacatcacttccccccatcacagccttatgtggtcgtatcaaaccaccagagctctctcgacctcctaggcatgatggaagtgctgcccgggcggtgcgtgccaattgcaaaacgcgaattactgtgggccggaagcgcgggccttgcctgttggctggctggcgtcatcttcatcgataggaagcgaaccggcgacgcaatcagcgtcatgagcgaggtagctcaaaccttactcacgcaagatgttcgagtctgggtgtttccagaaggtacccgcaaccacaatggcagtatgctgccatttaagcgaggtgcatttcacttggccgtgcaggcacaggtgccaatcgtacccatcgttatgtcctcgtaccaggacttctactgtaagaaggaacggcggttcacttccgggcagtgtcaggttcgggtgcttccaccagtgccgaccgaggggctcaccccggacgatgtgcctgctcttgccgaccgggtgaggcattccatgttgactgtatttcgagagatttctaccgatggacggggcggcggggattacctcaaaaagccgggcggcggtgggtag

SEQ ID NO: 106436 - DNA, 852 bp, Artificial Sequence
  Description of Artificial Sequence: Synthetic coding sequence
atggacctctggcctggcgcttggatgctcctccttctactgtttcttcttctgctattccttcttccgacactgtggttttgttccccaagcgcaaaatacttttttaagatggctttctataacggctggatcctgttcctcgcggtgcttgctattcctgtctgcgccgtgaggggccgaaacgtggagaacatgaaaattctccgcctcatgctgctccatattaagtacctgtacgggattcgcgtcgaggtcagaggggcgcatcatttcccaccctcacaaccatacgtggtcgtttccaatcaccagagctcactcgatttactgggaatgatggaagtcctgcctggaagatgtgttccaatcgctaagcgagagctcctttgggccggctctgctgggctggcctgctggctagccggagtaatctttattgaccggaaaagaactggcgacgcaatcagtgttatgagtgaagttgctcagaccctgctcacgcaggacgttcgagtttgggtgttcccagagggtacaagaaatcacaacggctcaatgctacccttcaaacgcggagctttccatcttgcggtgcaggcacaagtgccaattgtaccaattgtgatgtcaagctaccaggatttttattgtaagaaggaacgacggttcacgtccgggcagtgtcaggtgcgggtcctaccacccgtgcccacggaaggtctgaccccagatgacgtccccgccttggctgacagagtccgccactcaatgctgaccgtgtttagagaaatatccacagatgggaggggaggaggggactacttaaaaaagcctggtgggggtggctag

SEQ ID NO: 106437 - DNA, 852 bp, Artificial Sequence
  Description of Artificial Sequence: Synthetic coding sequence
atggatctgtggcctggagcgtggatgttgctgctcctccttttcctgttactgctgtttttgctgccgaccctttggttttgcagtccttccgccaagtacttttttaaaatggccttctataatggatggattctgttcttagccgttttggcgatacccgtgtgtgcggtgagaggacggaatgtcgaaaacatgaagatcttacgtctgatgttactccatataaagtacctgtacggcatcagagtggaggtgaggggcgctcatcatttcccccccagccagccttatgtggttgtcagcaatcaccagagttcactcgatctgctgggcatgatggaggtgctgcccgggcgttgtgtgccaatcgctaaaagggagctgctgtgggcggggagcgccggcctggcttgctggctggccggggtcattttcattgatcggaaaaggacgggggacgctatctctgtcatgtccgaggtcgcccagactttactaactcaggacgttcgggtgtgggttttccccgaggggacacggaaccacaatgggagcatgctgccttttaaacgaggggcctttcacctggcagtccaggctcaggtgccaattgtccccatagtgatgtcatcttatcaagacttctactgtaagaaggagcgccgctttacttccggtcagtgccaggtcagagtgctgccacctgtgcctacagaggggctgacccccgatgacgttcccgctcttgcagacagggtcaggcacagtatgctaacagtgtttcgggagattagcacagatggacgtggcggcggggattacctcaagaaacccggcggtgggggttag

SEQ ID NO: 106438 - DNA, 852 bp, Artificial Sequence
  Description of Artificial Sequence: Synthetic coding sequence
atggatctgtggcccggtgcttggatgctgttgcttctgctctttctgctactgctatttttgctgcccacgctatggttctgttctccctccgctaaatacttttttaagatggccttctacaacggctggattctatttctggccgtcctcgcaattccagtctgcgccgtgcggggtagaaacgttgagaacatgaagatcctccgactcatgttgctgcacatcaagtacctttacggcatccgagtggaggtgcgcggggcccatcactttccacctagtcaaccgtacgttgtcgtcagcaatcaccaatcctccctagacttattgggaatgatggaggtgctccccggtagatgcgtgccaatcgctaagcgcgaattactgtgggcaggcagcgccggcctggcttgctggctcgccggggtaattttcatagatcgcaagagaactggcgatgcaattagtgtaatgagtgaggtcgcacagaccctgctgacacaggacgtgcgcgtatgggtgtttcctgaaggtacccgaaaccacaacggatctatgctccctttcaaaagaggcgctttccaccttgcagtgcaggcccaggtgcccatcgtgcccattgtcatgtcttcatatcaggacttctattgtaagaaggagaggcggtttacctccggccaatgtcaagttagggtattacctcccgtgccaactgaggggcttacacccgatgacgtacccgcgctagccgatcgcgtgagacacagcatgctaaccgtgtttagagaaatctcgaccgacggacggggaggcggagattatctgaagaaaccaggaggtggaggctag

SEQ ID NO: 106439 - DNA, 852 bp, Artificial Sequence
  Description of Artificial Sequence: Synthetic coding sequence
atggatttgtggcctggagcctggatgcttctgcttctcctctttctgttgttgctctttctgctgccaactctgtggttttgcagtccttccgccaaatatttctttaagatggctttctataacggctggattctgtttctagcagtcttggccatcccggtgtgcgcagtgcgaggaaggaatgtggagaacatgaagattctgagactgatgctactgcatatcaaatatctctatgggatcagagtggaagtcagaggtgcacaccattttccaccttcgcaaccatacgtagtggttagcaatcatcagtccagcctggacctcttagggatgatggaggtcctgcctgggaggtgtgtacctattgcaaagagagagctactgtgggcaggctctgccgggcttgcatgctggctagcgggggtgatttttatagatagaaagaggactggggatgctatctcagtgatgtctgaggtggctcaaaccttactcacacaagatgtccgtgtctgggtgtttcccgaggggactagaaaccacaacggttcaatgctgccctttaagagaggcgctttccatctggctgtacaggctcaggtgccaatcgtccccatcgtgatgtccagttatcaggacttttattgcaagaaagagcgccgttttacttccggacagtgtcaagtgcgtgtgctgccacccgtaccaaccgaagggctgacccctgatgatgttcccgccctcgctgatagagtcaggcactcgatgttgacagtgttcagagaaatctctacagacggccggggcggcggcgattatttaaagaaacctggcggcggaggctag

SEQ ID NO: 106440 - DNA, 852 bp, Artificial Sequence
  Description of Artificial Sequence: Synthetic coding sequence
atggacctgtggcccggggcctggatgcttctgttgctgctatttctgctcttgctcttcctgttgcccaccctttggttctgcagccctagcgccaagtacttcttcaaaatggctttttataatgggtggattctttttctggcggtgttggctataccagtttgcgcggtgaggggacggaacgtggagaatatgaagatcctcagactaatgctcctccatatcaagtacctctacggtattcgagtagaggtgcgaggggctcatcacttccctccctctcagccgtacgtcgtggtcagcaatcaccagagcagccttgacctgctaggaatgatggaggtgttgcccggaaggtgcgtgccgatagccaagcgggagttactttgggccgggtctgctggtctggcctgttggctcgcaggcgtcatttttattgaccgcaagagaacaggtgacgcaatttctgtcatgtccgaggtggcgcagacattattgacacaagacgtgagggtttgggtgttcccggaaggaaccagaaatcacaacggctcaatgctgccctttaagaggggcgcatttcatctggctgtgcaggcgcaggtgcccatcgttcccattgtcatgagctcttaccaggatttttactgtaaaaaggaacggcgctttacatcgggacaatgccaggtaagggtgctaccgcctgtccctacagaaggcttaaccccagacgatgtcccagccctggctgacagggtgcgccattccatgctgaccgtcttcagggagatcagtactgatggcaggggaggtggggactatctcaaaaagcccggtgggggagggtag

SEQ ID NO: 106441 - DNA, 852 bp, Artificial Sequence
  Description of Artificial Sequence: Synthetic coding sequence
atggatctgtggccgggcgcctggatgttactgcttctcctatttctcctgttactgttcttactccctacactctggttttgctcacctagtgctaagtatttttttaagatggcattctacaatggctggatcctcttcttggccgtcctggccatccccgtatgcgcagtgcggggccggaacgtggaaaacatgaaaatcctaagactgatgctccttcacattaaatatctgtacggcatcagggtggaagtgagaggcgcccaccacttccctcccagtcagccatatgtagtggtatcgaaccaccagtcatccctcgatctactggggatgatggaggtgctgcccggtaggtgcgttccaattgccaaacgggaactgctctgggccggcagcgccggtctcgcatgttggcttgcgggagtgattttcatcgaccggaaacggaccggcgacgcaatttcggtgatgtctgaggtggcacagaccctcctgactcaggacgtgcgcgtgtgggtcttccctgaagggacccgcaatcacaacggatctatgctgccattcaagcgaggcgcctttcatctcgcagtccaggctcaagtgcccatcgtacctatcgttatgagcagctatcaggacttttactgcaaaaaggagagaaggtttacaagtgggcagtgtcaggtgcgtgtcctgccgccagtacccactgaaggcctcactcctgacgatgtgcccgcactggccgaccgcgttagacattccatgctgaccgtgtttcgtgagatctccacagacggcagaggcggcggtgactatttgaaaaagcctggtggtgggggatag

SEQ ID NO: 106442 - DNA, 852 bp, Artificial Sequence
  Description of Artificial Sequence: Synthetic coding sequence
atggatctttggccaggggcatggatgttgctcttgctgctgttcctcctgcttctgttcttgcttcccactctttggttctgctctccgtcggccaagtatttttttaagatggccttttataatgggtggatcttatttctggctgttctagctatcccagtgtgcgcggtacgcggacggaatgtggagaacatgaagatacttcgactgatgctgctgcatatcaaatatctgtatggaattcgagtcgaagtcagaggtgcccaccattttcccccttcacaaccgtatgttgtggtcagcaaccatcagtcgtccctggacctgttggggatgatggaagtgttgcccggacgatgcgttccaatagctaagcgagagctactgtgggctgggtcagcaggtctagcctgttggctggccggggtcatttttatcgatcgcaagcgcacaggggatgcaataagcgtgatgtccgaggtagctcagacattgctgacccaggatgttcgtgtatgggtcttccctgaaggtacccgaaatcacaatggctctatgctgccgtttaagagaggtgcctttcacttggctgtgcaggcccaggtacctattgtcccaatcgtgatgtctagctatcaagacttctattgcaaaaaagaaaggcgcttcacaagtggacagtgtcaggtccgggtactaccccccgttccaaccgaaggtctgacccctgatgacgttcccgcgctggctgatagagtgcggcattccatgttgacggtcttccgcgaaatctctacagacggtcgaggaggcggggattatctgaagaagccaggcggaggaggttag

SEQ ID NO: 106443 - DNA, 852 bp, Artificial Sequence
  Description of Artificial Sequence: Synthetic coding sequence
atggatctgtggccaggagcctggatgctgctcctcctgctctttctgctactgttatttctcttgccgaccctgtggttttgctccccatctgctaaatatttttttaaaatggccttctacaacggttggattttgtttctcgccgtcttggccatacccgtgtgcgcagtacgcggacgcaacgtggagaatatgaagattctgagattaatgcttttacatatcaaatatctttacggaatcagggtggaggtcagaggtgcacatcactttccgccaagccagccctatgtcgtcgtgagcaaccatcagtcttctctcgaccttttgggaatgatggaagtcctgccaggaaggtgcgtgccaatagccaagagggaactgctctgggctggatccgccgggttagcttgctggctagccggagtcatctttatcgatcgcaagcgcaccggagatgccatctctgtgatgtctgaggttgctcagactctacttacacaggacgtcagagtgtgggtgttcccagaggggacccgaaaccacaacggaagcatgttgccttttaaaaggggcgcattccatcttgcagttcaggcacaggtgcccatagtacccatcgtgatgagttcttaccaggatttctattgtaagaaggaacggcgattcacttccggccaatgtcaggtccgcgtgctaccccccgtgcccaccgaaggcttgactcccgacgacgtgccagcgctagccgatcgggtccgtcactccatgctcacagtgttccgcgagatctctacggatggacgtggcggtggcgattacctcaagaagccaggaggcggtggttag

SEQ ID NO: 106444 - DNA, 852 bp, Artificial Sequence
  Description of Artificial Sequence: Synthetic coding sequence
atggatctgtggccaggagcctggatgctcctcctgcttctgtttttgctgctgctcttcctgctgcccaccctctggttctgtagtccaagcgcgaaatacttttttaagatggccttttacaacggttggatactgtttctggctgtcctcgccatccctgtctgcgctgtgcggggccgaaatgtggagaatatgaaaatcctgcgcctcatgctgctgcacatcaagtatttatatggcatccgtgtggaagttcgcggtgctcatcacttccctccgtcacagccatacgtggtagtctcaaaccaccagtcaagtctggatttgcttggcatgatggaagtgctcccaggaaggtgcgtgcctatcgctaaacgcgaattgctttgggccggcagcgcagggctggcctgttggctcgctggcgtcattttcatcgataggaaaagaactggggatgctatttccgttatgagcgaggtggcacaaaccctattgacacaggacgtaagggtttgggtgttccctgaaggcacacggaaccataatgggtctatgttgccattcaagcggggcgcatttcacttagcagttcaggcacaggtgccaatcgtgcccatcgttatgtcaagctatcaggatttctactgcaagaaagaaagaagattcacatcaggacagtgccaggtaagggtgcttccacccgtgcctactgaggggctcacaccggacgacgtgcctgcgctagctgaccgcgtgaggcactctatgcttacagtattccgcgaaatcagcacagatggccgcgggggcggggattacctgaagaaaccgggtggcggaggatag

SEQ ID NO: 106445 - DNA, 852 bp, Artificial Sequence
  Description of Artificial Sequence: Synthetic coding sequence
atggacctctggcctggcgcctggatgctgttactgctgctctttctgcttttattattcctgctgcccacgttatggttctgtagtccttcagctaaatatttctttaagatggccttttataacggctggatcctgttcctggctgttctggctattccagtgtgcgcagtccgaggccgtaacgtagaaaacatgaagattctacggctcatgctgcttcacattaaatatctttatgggatccgagtcgaagttcggggagctcatcacttccctcctagccagccttatgtcgtggtgagcaaccaccagagttccttggatctgctggggatgatggaagttctgcccgggcggtgcgtgccgatcgctaaaagggagctactgtgggccggttccgccgggttagcgtgttggctggctggggttatctttattgaccgcaagcgaaccggagatgccattagtgtcatgagcgaggtggcacagaccttactcactcaggatgtgcgcgtgtgggtctttcctgagggtacaaggaatcacaacggcagcatgttaccatttaagagaggcgcgttccacctggcagtacaggctcaggtgcccattgttcctatcgtgatgtcttcttaccaagatttctactgcaagaaggagcggaggtttaccagtggacaatgtcaggtacgtgtgctgcctcctgtcccaactgaggggctgacacccgacgacgttcctgccctggccgatagggttcgccactccatgctaacagtattcagagagatttccaccgatggacgaggaggaggggactatctcaagaagcccggaggtggcgggtag

SEQ ID NO: 106446 - DNA, 852 bp, Artificial Sequence
  Description of Artificial Sequence: Synthetic coding sequence
atggacttgtggccgggggcgtggatgctgctgttactgctcttcctgcttctcctcttcctgctgcccacactctggttttgtagcccttccgccaaatatttcttcaaaatggcattttacaatggatggattctgtttctggccgtactagcaatcccagtttgcgcggttaggggccgaaacgtggagaatatgaagattctgagactgatgctgttgcatatcaaatacctgtacgggattcgggtcgaagtgagaggcgcccatcatttcccgccaagccagccctatgtagtagtgtccaaccaccagtcctctctggatctgttgggcatgatggaagtgttaccagggcgatgcgtccctatagctaaacgagaactgctgtgggcagggtcggcaggactggcctgctggcttgcgggagtgatctttatagataggaaaaggacaggcgatgccatctcagtgatgagcgaagttgctcagaccctgctgacacaggacgtccgggtttgggtatttcccgaaggaacacgcaatcacaatggaagtatgctgccttttaagcgaggcgccttccatctggctgtgcaggcccaggttcctatcgtgcccattgttatgtcatcttaccaggacttttactgcaagaaggagaggcggttcacctccggccagtgccaggttagggtcctccctcctgtgcccactgaggggctgacccccgacgacgtgccggccctggcagatcgtgttcgccactcgatgcttactgtgttccgggaaatcagcaccgatggacgagggggcggcgactatcttaagaagccaggagggggaggatag

SEQ ID NO: 106447 - DNA, 276 bp, Artificial Sequence
  Description of Artificial Sequence: Synthetic coding sequence
cacagcgcatctactccaattttgacacacagccatcccgcccaggggatgatggaagttctgcctgggagatgcgtgcccattgctaaacgcgaactcctgtgggcaggaagcgctggccttgcctgttggctggctggggtgattttcattgatcgaaagcgaaccggtgatgccatcagcgtcatgagtgaggtggcccagactctgctcactcaggatgtgtcccaccccggattgttattgcaagaaggggcatccctgcacctggggtag

SEQ ID NO: 106448 - DNA, 276 bp, Artificial Sequence
  Description of Artificial Sequence: Synthetic coding sequence
cactcggcctcaacgccaatcctgacgcactctcatccggctcaaggcatgatggaagtgcttccagggcggtgcgtgccaatcgctaaacgcgagctgctttgggctggttccgccggcttagcctgttggctcgctggagtcatattcatcgatagaaaaaggaccggtgacgctatctccgtcatgtccgaagtagcccagacactcctgacccaggacgtgtcccacccaggtctgcttctgcaggagggagcgtccctgcacctgggctag

SEQ ID NO: 106449 - DNA, 276 bp, Artificial Sequence
  Description of Artificial Sequence: Synthetic coding sequence
cacagcgcatctacacctattctcacacactctcaccccgcgcaggggatgatggaagtactacctggccggtgcgtgccaatagcaaagagggaattgttatgggccgggtctgcaggactcgcgtgctggttagcaggcgtgatattcatagacagaaaacgcaccggagatgccatctccgtgatgtcagaagtggctcagacccttctcacacaggatgtaagccatccgggcctgctgttgcaagagggcgcatctcttcatctcggatag

SEQ ID NO: 106450 - DNA, 516 bp, Artificial Sequence
  Description of Artificial Sequence: Synthetic coding sequence
atgatggaggtgctgccagggcgctgcgtcccgatagcaaaacgagaactactatgggcagggagtgcgggcctggcttgttggctggccggcgtcatttttatcgaccgaaagagaactggagacgccatcagcgtcatgtccgaggtggcccaaacactgctgacccaggacgttagagtgtgggtgtttccagaggggaccaggaaccataatggtagcatgctcccctttaagcgcggcgccttccatttagccgtgcaagctcaagtgcccatagttccaatagtgatgtcatcttaccaggatttttattgcaaaaaggaacgccgattcacatcaggccagtgtcaggttcgcgtgctgcctcccgtgcccactgaaggtttaacaccagacgatgtccctgctctggcggatcgggtgagacacagcatgttaacagtgttccgcgaaattagtacagatggcaggggcggcggtgactatctaaagaagcccggagggggcggctag

SEQ ID NO: 106451 - DNA, 516 bp, Artificial Sequence
  Description of Artificial Sequence: Synthetic coding sequence
atgatggaggttctgcccgggaggtgcgtacccatcgctaagcgagagctgctttgggcaggatccgcgggtctggcctgctggcttgccggcgtgatcttcatcgaccgaaagagaaccggcgacgccatcagcgtgatgtctgaagtggcacaaacgttgcttacacaggatgtcagagtttgggtgttcccagaaggcactaggaatcacaatggctcaatgctcccatttaaaagaggcgctttccatcttgcagtgcaggcgcaggtgcctattgtgcctatagtgatgtcctcctatcaggatttttactgtaagaaggaacggcgctttactagcggccagtgccaagtgcgggtcctgccccctgtccctaccgaaggcttgaccccggacgacgttccagccctggcggacagggtgcgacattcgatgctgaccgtgttcagagagattagtaccgatggaaggggggggggcgactatcttaagaaaccaggcggcgggggatag

SEQ ID NO: 106452 - DNA, 276 bp, Artificial Sequence
  Description of Artificial Sequence: Synthetic coding sequence
cactcagcatcaaccccgattctgacccattcccaccccgctcaagggatgatggaggtgctcccagggcgatgtgttcctattgcaaaaagggagttgttgtgggctgggtcggccggactggcttgttggctggctggagttatattcattgaccgaaaaagaacgggtgatgccatcagcgtcatgagtgaagtcgcccaaactctacttacgcaggacgtcagccaccccggcttgctgctgcaggaaggtgcctccctccatctgggatag

SEQ ID NO: 106453 - DNA, 276 bp, Artificial Sequence
  Description of Artificial Sequence: Synthetic coding sequence
catagcgctagtacacctattttgacgcatagtcatccagcgcaaggaatgatggaggttctccctggacgttgcgtccccatcgcaaagagggaactactgtgggcgggatccgcaggtctcgcatgctggttagccggcgttatatttatagaccgcaaaagaaccggggacgccatctctgtgatgtcagaagtagctcaaaccctattaacacaagacgtctcccaccctggtttgctgttgcaagagggggcgtcattacatctcggctag

SEQ ID NO: 106454 - DNA, 276 bp, Artificial Sequence
  Description of Artificial Sequence: Synthetic coding sequence
cattctgcctctactccaattttaactcacagtcacccggctcagggtatgatggaggtgcttccaggtcgctgtgtgcccatcgctaagcgggagctcctgtgggcaggcagtgccggactcgcgtgttggcttgctggggtcatcttcattgaccgaaaaagaacgggcgatgcaattagtgtaatgtccgaagttgctcagacactgttgacccaggatgtgtctcatccaggcctgttacttcaggaaggagctagcctccacctcggatag

SEQ ID NO: 106455 - DNA, 516 bp, Artificial Sequence
  Description of Artificial Sequence: Synthetic coding sequence
atgatggaggtgcttccagggaggtgtgttcctattgcaaagcgcgagttgctgtgggcggggtccgccggcctcgcctgttggctagctggtgtaatctttatagatcgcaagaggactggcgacgcaatatcagttatgtcagaagtagcccaaaccctcctgacccaggacgtgcgggtgtgggtctttccagaaggtaccagaaaccataatggatcaatgctgccattcaagcggggggccttccacctcgcagtccaggctcaagttcccatcgtacccatcgttatgtcatcttaccaagatttttactgcaagaaggagcggcggtttacctctgggcagtgccaagtacgagtgctacctcctgtcccaaccgaagggctcaccccagacgatgtacccgctctggccgatcgggtccgacacagtatgctgaccgtatttcgggaaatcagtacagatgggcggggggggggcgactatcttaaaaaacccgggggaggcgggtag

SEQ ID NO: 106456 - DNA, 516 bp, Artificial Sequence
  Description of Artificial Sequence: Synthetic coding sequence
atgatggaggtcttgccggggcgctgcgtgccaattgcaaagcgagaactactatgggcaggatccgccgggctggcatgctggctggctggcgtgatctttatcgatcggaagaggacaggagacgccatctctgttatgagtgaagtggctcagacattgcttacacaggacgtcagagtctgggtctttcccgaggggacaagaaaccataacggatctatgctgccatttaagcggggcgcgttccatttggccgtccaagcccaggtgcctatcgtccccattgtgatgtcatcttatcaggatttttactgtaaaaaggagcgccgcttcacctcggggcagtgtcaggtgagagtgttgcctcctgtccccacagagggtctgacaccagacgatgttccagctctagccgaccgagtcagacatagcatgctcacagttttcagagaaattagcactgatggcagaggaggtggcgattacctgaaaaagcctggtgggggcggatag

SEQ ID NO: 106457 - DNA, 276 bp, Artificial Sequence
  Description of Artificial Sequence: Synthetic coding sequence
cacagcgcctcaacccccatactgacccactcacacccagctcagggcatgatggaagtacttccgggccggtgcgtccccattgcaaagagagagttactctgggccggcagcgccggcctggcttgttggttagcaggtgtgatatttatcgatagaaaacgaacaggcgacgcaataagtgttatgagcgaggttgctcagaccctgcttacgcaggatgtctcccaccccggcctcctccttcaagaaggcgctagcctccatctagggtag

SEQ ID NO: 106458 - DNA, 516 bp, Artificial Sequence
  Description of Artificial Sequence: Synthetic coding sequence
atgatggaggtgctgccaggccgttgtgtaccaatcgccaaacgcgaacttctctgggcaggatccgctgggctggcatgctggctcgccggtgttattttcattgatagaaagagaacaggcgacgctatttcggttatgtccgaggtggcccagacccttctgacacaggatgttcgtgtctgggtgttccccgaggggacacgaaaccataacggaagcatgctccccttcaagaggggggctttccatctggccgtgcaagctcaggtgcctatcgtaccaatcgtcatgtcctcctaccaggacttctactgcaaaaaggagcgccggttcacaagtggacaatgccaagtgagggtgctgccccccgtgcctacagaaggtcttacgcccgatgatgttccagccttggctgatcgggtgcgtcattccatgctcaccgttttcagggagatatctacagatggacggggaggtggggactatttgaagaagccgggaggaggcgggtag

SEQ ID NO: 106459 - DNA, 516 bp, Artificial Sequence
  Description of Artificial Sequence: Synthetic coding sequence
atgatggaagtactgcctgggcggtgtgttccaatcgctaaacgcgagctcctgtgggctgggagcgcagggcttgcctgttggctcgccggggtgatcttcatcgaccggaaaaggacaggtgacgcaatctctgttatgtcggaggttgcccagaccctgcttacccaggatgtcagagtctgggtttttcccgaggggacgcggaaccataatgggtcaatgttaccttttaagcggggcgccttccacctcgccgtgcaggcccaggtaccgatagtgccaatcgtcatgagcagttatcaagatttttattgcaaaaaagagcgtagattcacaagcgggcaatgtcaagtaagggtgcttccccctgtgccaaccgagggactcaccccggatgatgtccccgccctggcagaccgggtcaggcattccatgttaactgtgttcagggagattagtacagatggcagaggcgggggcgattacctcaagaagcccggcgggggtggctag

SEQ ID NO: 106460 - DNA, 741 bp, Artificial Sequence
  Description of Artificial Sequence: Synthetic coding sequence
atggaattgtggccttgtctggctgcagcccttcttctgttgctcttgctcgtgcagttaagccgggccgctgagttttatgcgaaagtcgcactctactgtgccctctgcttcacagtctctgctgttgcctcactggtatgtttactcagacatggcggaagaactgtcgaaaacatgagcatcatcgggtggtttgtgcgctcttttaagtacttttacggcttgaggtttgaagttcgggatcctaggcgactgcaggaagcccgtccctgcgtgattgtgagtaaccaccagagtattctcgacatgatgggactgatggaggtgctgccagagcgatgtgttcagattgctaagcgggagctgctgttccttggccccgtcggacttataatgtacctaggcggtgtgtttttcatcaatagacagcggtcgtctaccgccatgacggttatggccgatctgggcgagcggatggtgagggagaacgtgccaatagttccggtcgtctactctagtttttcaagcttctataacacaaagaaaaagtttttcacttctggtaccgttactgtacaggtactcgaagccattcctaccagcgggttaaccgccgccgatgtcccggccctggtcgatacctgccacagggcaatgaggaccacttttctgcacatctccaaaacgcctcaggagaacggggcaaccgccggcagtggcgtgcagccagcacaatag

SEQ ID NO: 106461 - DNA, 837 bp, Artificial Sequence
  Description of Artificial Sequence: Synthetic coding sequence
atggagctgtggccctgtctcgccgccgctctcctcctgctcctgctgctggtacagctgagtcgcgccgcagagttttacgctaaggttgctctgtactgcgctctatgttttaccgtgtctgctgtggcttcgctagtatgtctgctgcgacacgggggacgtactgtggagaacatgagtattatcgggtggtttgtacggagctttaaatacttttatggcctgcgcttcgaagtgagggacccaagacggctgcaagaagcccgcccttgcgtgattgtctcaaaccaccagagtattctcgacatgatgggactgatggaagttcttccagaacgctgtgttcagatcgccaaacgggagctgctattcctgggacccgtcgggctgatcatgtatctgggcggcgtatttttcatcaatcggcagcgctcaagcacagcaatgactgtgatggcggacctgggcgagcgcatggtgagggaaaacctgaaggtctggatctaccccgagggaacgcggaatgataacggcgacctactgccatttaagaaaggagcattttacctggccgtacaggcccaagtgcctatcgttcccgtggtgtactcttcgttctcttctttttacaacacaaagaaaaaatttttcacatccggtacagtgaccgtgcaggttttagaggcgatccctacgtccggtttgacagccgccgacgttcccgcgttagtggatacctgccacagggccatgcggacgacgttcctgcacatctcaaagactccacaggagaacggagctaccgcagggagcggggttcaacccgcgcaatag

SEQ ID NO: 106462 - DNA, 837 bp, Artificial Sequence
  Description of Artificial Sequence: Synthetic coding sequence
atggaattgtggccatgcctagctgccgcactgctgcttctactgctgctggtccaactgtctagagcagcggagttttacgctaaagtggctctgtactgcgcactttgcttcacggtcagcgcagtggctagtctggtgtgcttgctgcgccatggtggtagaactgtggagaatatgagcatcattggttggtttgtgcggtctttcaaatacttctacggcctcaggttcgaagtacgcgaccctagaagactccaggaggcgaggccttgtgtgatcgtgtccaatcatcagagtatcctagatatgatgggcctaatggaagtccttcccgaacggtgcgtgcagatcgccaagagggagctcctgttcctggggcccgtcggcctgattatgtatcttggtggcgtgtttttcatcaacaggcagcgcagctcgactgccatgaccgtcatggcggatttgggagagcgcatggtgcgggagaaccttaaggtgtggatttaccctgagggcactagaaacgataatggggacctcctgccctttaaaaaaggcgccttttacctggcagttcaggcccaggttcccattgtccctgtggtctatagttcattctcttctttctacaacactaaaaagaaatttttcacatcaggtacagttactgtccaagtgctcgaagccataccaacaagtgggctcaccgcagctgatgttcctgctctggtcgacacctgtcacagggctatgcgcaccactttcctgcatatatctaagactccgcaggagaacggggcaactgccgggtcgggcgtgcaacctgctcaatag

SEQ ID NO: 106463 - DNA, 1371 bp, Artificial Sequence
  Description of Artificial Sequence: Synthetic coding sequence
atgtttctgctccttcccttcgatagcttaatcgtgaatctactggggattagcctgaccgtcctcttcaccttgctgctcgtgtttatcattgttcctgctatcttcggggtgtctttcgggattagaaaactctacatgaaatcattgctcaagatcttcgcctgggctaccttgcggatggagcgcggggcaaaggagaagaaccaccaactgtataaaccttacaccaatggtataatagctaaggacccaacctctttggaggaggagatcaaggagattcgccgtagcggcagctccaaggcgttggacaacacaccggagttcgaactgagcgacatcttttacttctgtcgaaaaggaatggaaactatcatggacgacgaagtcaccaagaggtttagcgcggaagagctcgagagttggaacctgctctcaagaaccaactacaatttccagtacattagcctgcggctaacagtgttgtgggggttaggggtgctcatccggtattgtttcctgctgcccctacgaatcgcccttgccttcacgggcattagcctcctcgtcgtagggacaactgtcgtcggctatcttcctaacggccgcttcaaggagttcatgtcaaagcatgttcatttgatgtgttataggatttgtgttagggctcttactgccataattacctatcatgaccgagaaaatagacctagaaacggcgggatctgcgtcgccaaccacactagtcccatcgacgttataatcctggcgtccgacggatactatgcaatggtaggtcaggtgcacggtggcctgatgggcgttatccagcgagcaatggtcaaggcctgcccccatgtatggttcgagcggagtgaggtcaaagatcgccacctcgtggccaaaaggcttactgaacacgttcaagataaatctaagttgcccatcctcatttttccagaagggacatgtatcaacaataccagcgtgatgatgttcaaaaagggctctttcgaaattggagccactgtataccccgtagccattaaatacgacccccagttcggggacgcgttctggaactcctccaagtatggcatggtgacctatctcctgagaatgatgacttcctgggccatcgtttgctccgtgtggtatcttccaccaatgacacgtgaagctgacgaagatgctgttcaattcgctaacagggtaaaaagtgccatcgcgaggcagggcggcttggtcgatctgctgtgggatggaggactcaagagagaaaaggtcaaagacacctttaaggaagagcaacagaagttgtattccaagatgatcgtggggaaccacaaagatcgctctcggtcgtag

SEQ ID NO: 106464 - DNA, 1305 bp, Artificial Sequence
  Description of Artificial Sequence: Synthetic coding sequence
atggagggcgcagaactcgccggaaaaatcttatctacctggctaacccttgtgctgggatttatcttgcttccctcagtcttcggcgttagcctaggaatcagcgagatttacatgaagatcctcgtcaaaactctcgagtgggccaccatcagaatcgagaagggcacgcccaaagaatcaattcttaagaattcggcaagtgttggcataattcaacgagatgagtcccccatggaaaaagggttgagcgggctcagaggacgggacttcgagctgagcgacgttttttatttttccaagaaaggactagaggcgattgtcgaagatgaggtgactcagcgattttctagtgaggagctagtttcttggaaccttctgacccgtaccaatgtcaacttccagtatatttcgctccggctaaccatggtttgggttctgggcgtgatcgtccggtattgtgtgctactaccattacgtgtgaccttggcttttatcggcatctcactgttggtcattggcaccacactagtaggccagctgcctgacagtagccttaaaaattggttgtccgagctggtgcacctcacttgttgtagaatatgtgtccgcgctctttccgggactatccattaccacaataaacagtataggccacaaaaaggaggtatctgcgtggccaatcataccagtcccattgatgtgctgatcctgaccactgatggctgctacgcaatggtgggccaggtacacggtggcctgatgggcataatccagcgagcgatggtcaaggcttgcccccacgtgtggtttgaacgttctgaaatgaaggaccggcatcttgtgacaaagcgcctgaaggagcacattgcggataaaaagaagcttccaattctcattttccctgaaggcacctgtataaacaacacgtctgtgatgatgtttaagaaaggttcattcgaaatcgggggcaccatccaccctgtcgcaattaaatacaacccacagtttggagatgccttttggaatagtagcaaatacaacatggtctcctatctcctcaggatgatgacttcctgggcaattgtgtgtgacgtttggtacatgccgccaatgactagggaagaaggagaagatgccgtgcagtttgctaatcgcgtcaagagcgccatcgcgattcaaggagggttgactgaacttccctgggacggaggcctcaagagagccaaagtaaaggacatctttaaggaagagcagcagaaaaattacagcaagatgatcgtcggtaacgggagcttatcctag

SEQ ID NO: 106465 - DNA, 1305 bp, Artificial Sequence
  Description of Artificial Sequence: Synthetic coding sequence
atggaaggagccgagcttgccggtaagattctttcgacttggctgaccttagtactcggctttatattgttaccctcggttttcggtgtgtctctagggatttcggaaatctacatgaaaatactggtcaagactctcgaatgggccaccattcgaattgagaagggaacccccaaagaatccattcttaagaacagtgcatccgtcggcatcatccagagagatgagagcccaatggagaagggcctctccgggttacgtggacgggattttgaattgtctgacgtcttctatttctctaagaaaggactggaggctattgttgaagacgaagtgacccaacggttttcctcggaggagctggtgtcctggaatcttctgactcggacaaacgtgaacttccagtacatatctctgagactgaccatggtgtgggttttgggggtgatagtgagatactgcgttttgttacccctacgggttacattggccttcataggcatctcactgctggtcatcggtaccaccctcgtgggccagcttcctgactcttccctgaaaaactggctatccgaactggttcatctcacatgctgccgaatatgtgtaagagctcttagcggaactatccactatcacaataaacaatatagacctcagaagggtggcatctgtgtcgccaatcacaccagcccaattgacgtgttaatactcactacggacggttgttacgctatggtggggcaggtgcacggcggccttatgggtatcatccagcgagcaatggtgaaagcttgtcctcacgtttggttcgagcggagcgagatgaaagaccggcacttggtcactaaacgcctgaaggagcatatcgccgacaaaaagaagctgccaatacttattttcccagagggtacatgcataaataatacaagcgtgatgatgtttaagaagggctcattcgagattggcgggaccattcatcccgtagcaattaaatacaatccacaatttggcgacgcattttggaactcttccaagtacaacatggtaagttacctcctccgcatgatgacctcatgggcgatcgtgtgcgatgtgtggtacatgcctccgatgaccagggaggagggcgaggacgctgtacagtttgcgaatagagttaaatccgccattgctattcagggaggcctgactgaactgccatgggacgggggcctcaaacgagctaaggtcaaagacatctttaaagaagaacaacaaaagaattattccaagatgatcgttgggaacggctccctgtcctag

SEQ ID NO: 106466 - DNA, 1506 bp, Artificial Sequence
  Description of Artificial Sequence: Synthetic coding sequence
atgtttactctgccgcagaaggattttcgtgcaccgaccacttgcctggggcccacctgtatgcaggacctgggttccagccacggcgaagacctcgagggtgagtgctctagaaagctggaccagaaattacctgagctgagaggggtgggtgatccagctatgatttcaagtgatacctcttatctgagctctcgcggccggatgatcaaatggttctgggattccgcagaggaaggttataggacctaccacatggacgagtacgacgaggataagaacccatctggaattataaaccttgggaccagcgagaacaagctctgttttgacctgctgagctggaggctcagccagcgggatatgcaaagagtcgaacccagcctgctgcagtacgctgactggagggggcacttgttcttgcgcgaggaagtggctaaattcctgagtttttactgtaagtctcccgtacctctacgtccagagaatgtggtggtgctgaacgggggcgcatctttattttcagccctggctaccgtgctttgtgaggccggggaagccttcctcattcccacgccgtactatggcgctatcactcaacatgtatgtttgtacgggaatatacgcctggcgtatgtgtacctcgacagcgaggtgaccggcctcgatacaagaccattccagctgacagtagagaaattagagatggcactcagggaagctcatagtgagggggtgaaggtgaaaggcctcattctgatctccccgcagaatccactgggcgatgtttactcccccgaagagctacaggagtatcttgtttttgccaagcggcataggttgcatgtgattgttgatgaggtctacatgctgtctgtcttcgaaaaaagtgttggttaccggagcgtgctcagtctggaaaggctgcctgatccccaacgaacacatgtgatgtgggcaacaagcaaggatttcggaatgtcagggcttaggtttggaactctatatacagagaaccaggatgttgctactgctgtcgcaagcttgtgtcgctaccatggcttgagcggcctggtgcagtaccagatggctcagttacttcgggatcgcgattggatcaaccaggtgtatctgcccgagaatcacgcacgacttaaggccgcgcacacctatgtctccgaagagctgcgcgccctgggtatcccttttctgagccggggagctggattctttatatgggtagacctacggaagtacctgcccaaaggtacattcgaagaggagatgcttctgtggaggcggttcctggataacaaggtgctgttgagctttggcaaagccttcgaatgcaaagagcccggttggttccgattcgtgtttagcgaccaggttcatcgcctgtgtctgggaatgcagagagtccaacaagtgttggctggtaagtcacaagtggctgaggatccacgaccttcccagtctcaggagccaagtgaccagcggaggtag

SEQ ID NO: 106467 - DNA, 477 bp, Artificial Sequence
  Description of Artificial Sequence: Synthetic coding sequence
atgtttacccttccccagaaagattttcgggcgccgaccacctgtcttggccctacctgcatgcaggatctcgggagcagtcatggagaagatttggagggagaatgtagtagaaagctggatcagaaactgcccgagcttcggggtgtgggcgaccctgcaatgatctcctctgacacttcataccttagcagcagaggacgaatgatcaagtggttctgggatagtgcggaggaagggtatcgtacatatcacatggacgaatatgacgaggacaaaaacccctctggcattatcaatctggggacctctgaaaacaaactttgttttgaccttcttagctggagaccacccggtggaagtggccaagttcctgtctttctgctgcaagaacccagcacaccgcagacaagggagtgcgggtgtcctgaatggtggtgcctggccctactctgttcagggcacggggccgtttag

SEQ ID NO: 106468 - DNA, 420 bp, Artificial Sequence
  Description of Artificial Sequence: Synthetic coding sequence
atgtttactttaccacaaaaggacttccgggcccctaccacctgcctcggccctacgtgcatgcaggatcttggtagttcgcatggagaggaccttgaaggggaatgttcccgtaagctcgatcagaagctgcctgaactgcgaggcgtcggagatcctgccatgatctcctctgatacaagttacttatcgtcacgggggaggatgatcaagtggttttgggattcagcagaggagggatacagaacataccatatggacgagtatgacgaagataagaacccgagcggcattattaacctgggcacatccgaaaataaactctgttttgacctcttatcctggcggctcagccaaagggatatgcagagggttgaaccctctctgctgcagtatgcagattggcgcgggcatctgtag

SEQ ID NO: 106469 - DNA, 234 bp, Artificial Sequence
  Description of Artificial Sequence: Synthetic coding sequence
atgttcacactgccccaaaaagattttcgagcccctactacatgtctaggaccaacttgcatgcaagacttggggagttctcatggcgaagacctagagggcgaatgctctcgcaagctcgaccagaaactgccagagcttagaggcgtgggggatcctgcgatgatttcgtccgacacatcttatctgtcatctagaggccgaatgatcaaatggttttgggatagcgcctag

SEQ ID NO: 106470 - DNA, 780 bp, Artificial Sequence
  Description of Artificial Sequence: Synthetic coding sequence
atgtctaagtataagcttatcatgctgagacacggagagggagcttggaacaaagagaatagattctgctcttgggtggaccaaaaattgaatagcgaggggatggaggaggcccggaattgcggtaagcagttgaaggctcttaacttcgaatttgacctcgtttttacttctgtgttgaaccgaagcattcatacggcctggctgatccttgaggagttaggccaggagtgggtaccagtcgaaagcagttggcgccttaacgaacgacattacggtgccttgatcggattaaacagggagcagatggctctgaaccacggagaggaacaggtgcgcctgtggcggcgttcctacaacgtgacacctccacctattgaagaaagccatccatactatcaagaaatctataatgacagaaggtacaaggtgtgcgacgtccccctggaccagttaccaaggagcgaaagcttaaaggatgtgctggaaaggctgctgccgtactggaacgagaggatagccccagaagttctaagggggaaaacaattctgatctccgcccacggtaacagttctagggcactgctgaaacatctcgagggtatcagtgatgaggacataatcaatatcaccctgcctactggcgtccctattcttctggagctggatgaaaacctgcgtgcggtggggcctcatcagttcctcggcgatcaggaagcaattcaggcggccatcaagaaagtggaggaccagggcaaggtcaaacaggcgaaaaaatag

SEQ ID NO: 106471 - DNA, 780 bp, Artificial Sequence
  Description of Artificial Sequence: Synthetic coding sequence
atgtccaaatacaaactaattatgcttcgccacggagagggggcatggaataaggagaaccgcttctgtagctgggtcgaccagaaattgaactctgaaggaatggaagaggcaaggaactgcggcaagcagcttaaagcactaaatttcgagttcgacttagtgtttacatctgtcctgaaccgatctatacacactgcctggttgatcctcgaagaactgggccaggagtgggtaccagtggaatcaagttggcgactgaacgaacggcattatggtgctctgattggccttaaccgtgaacagatggccctgaaccacggggaggaacaggtgcgactctggcgccgaagctacaatgttactccccctccaatcgaggagagtcatccatattaccaggaaatttacaacgacaggagatataaggtatgcgacgtaccactggatcagctacccagaagcgagtctctgaaggacgtgcttgagaggcttctgccatactggaacgagaggatcgctcccgaggtgttgagaggcaagactattttaattagcgcccatggcaattcctctcgtgccctactgaagcacttagagggtatcagtgacgaggacatcatcaatataactctgcccacaggagtacctattctgcttgagttggatgagaatctccgtgccgtcggacctcaccagtttttaggggatcaggaggccatccaggccgccatcaaaaaagtagaagatcaaggaaaagtcaaacaggcaaaaaaatag

SEQ ID NO: 106472 - DNA, 780 bp, Artificial Sequence
  Description of Artificial Sequence: Synthetic coding sequence
atgtctaagtacaagctgattatgctgcgccacggcgagggggcatggaataaagaaaatcgcttctgttcatgggtggatcagaaactgaactctgaagggatggaagaggccagaaattgcggaaaacagctgaaagctctcaatttcgagtttgatctagtttttacttctgtcctcaacagaagtatacacacagcatggctgattctcgaggagctgggccaggaatgggtacccgtcgaatcatcttggaggctgaatgaaaggcattatggcgctctgataggattaaacagggagcagatggccctgaatcacggggaggagcaggtgcgcctgtggagaaggtcatacaatgttacaccgcctcccatcgaggagagccacccttactatcaagagatatataacgatcggagatataaggtatgtgatgttccattggatcagctcccacgaagtgagtccctaaaggacgtcctggagcgcctgctgccatactggaacgagaggatagcaccagaggtgttaagaggtaagaccattctgataagcgcccatggaaactctagtcgagcactgttgaaacatctagagggtatcagtgacgaagatatcattaacatcaccctgccaaccggcgtgcctattctgctggaactcgacgaaaatttacgcgctgtagggccacaccagttcctgggtgaccaggaggccatacaagctgctataaaaaaggtggaggaccagggcaaggtaaaacaagctaagaagtag

SEQ ID NO: 106473 - DNA, 237 bp, Artificial Sequence
  Description of Artificial Sequence: Synthetic coding sequence
atgtctaagtacaagcttattatgctgcgacatggcgaaggagcttggaacaaggaaaaccggttctgttcatgggtggatcagaaactgaactcagagggtatggaggaggcgcgcaattgcggaaaacagctgaaagcgctcaattttgagttcgatctcgtttttacaagtgtcctgaatcggagcatacacaccgcatggctgattcttgaagaacttggtcaagaatggtag

SEQ ID NO: 106474 - DNA, 894 bp, Artificial Sequence
  Description of Artificial Sequence: Synthetic coding sequence
atgaatcgtggtttctcccgcaagagtcacactttcctgcccaaaattttttttcgcaagatgagctcctcgggagcgaaggacaaacctgaattgcaatttcccttccttcaggatgaggacacagttgctactttactggaatgcaagaccctgttcatcctgcgtggactgcccgggtccggaaagtcgacacttgcccgcgtaatcgttgacaagtatcgggacgggaccaagatggtgtccgctgacgcctacaagattacccctggcgcccgcggggctctgaaagaactgcggcaattcgttccaggcgatgagcctcgggagaagatggacctggtgacgtattttggcaagagacctcccggggttctacattgtacaacaaaattttgtgattacggaaaggcaccaggtgcagaggaatacgctcagcaggatgtattaaaaaaatcgtatagtaaagcgttcaccttgacaatttccgcactctttgtgactcccaagaccaccggcgcaagggtcgagctcagtgaacagcagctgcagctatggccttccgacgtagacaagctgtcccctacagataacttgcctaggggtagtagagcccatattaccctcggttgcgccgccgacgttgaagccgtgcagaccggcttggatcttttagagattctgcgccaggagaagggtggttcacggggagaagaggtgggggagctgtcacgcggcaaactctattccttaggcaacggcaggtggatgctgacgttagccaagaatatggaagtaagggctatctttactgggtattatggcaaaggcaaacccgtcccaactcagggtagcaggaagggtggagcattgcaatcctgtactattatttag

SEQ ID NO: 106475 - DNA, 1206 bp, Artificial Sequence
  Description of Artificial Sequence: Synthetic coding sequence
atgtctagtagcggtgcaaaggataaaccagaactacagtttccatttcttcaagatgaggacacggtggccaccttgctggagtgcaagaccctgtttatcttgcgtggactcccagggtctgggaagtccacactggcccgcgtgattgtcgacaagtaccgggacggcactaagatggtgtcagccgatgcctataagattacaccaggtgccaggggtgcttttagcgaagagtataaacgcctagacgaagatctcgcagcttattgtcgcagaagggatatcagaattttggttctggatgatacaaaccatgaaagagagagacttgagcagctctttgagatggctgatcagtaccagtaccaggtggtactagttgaacctaaaacagcatggcgactagactgcgctcagctgaaggagaagaaccagtggcagctgtcggccgacgacctgaagaagctgaagccgggcttagaaaaggacttcctgcccctctactttggctggttcttgactaagaagagtagcgaaactctaagaaaggcaggccaggtgtttctggaagaactcggcaaccacaaggcattcaagaaggaactccgccagttcgttccaggtgacgagccgcgagagaaaatggacctggtcacctatttcgggaaaagaccccccggagtcctccattgtacgacaaaattctgtgattacggaaaagcgcctggcgcagaagagtatgctcagcaggacgttctaaagaaatcttattcaaaggccttcaccttgaccatctctgctctcttcgtgacaccgaaaactaccggggcgagggtcgagctgagcgaacagcaactgcagttgtggcccagcgacgttgacaaattgtcccctacagacaacctgcctagaggttcaagggcacacattacactgggttgcgctgccgacgtggaggctgtgcaaacggggctggaccttctggagatactcaggcaggagaaaggtggctcccgcggagaggaggtgggcgagttatcacgaggaaaactgtatagcttgggaaatggccgctggatgctcactcttgctaagaacatggaggtccgagcaatttttactggatactacggtaaggggaagcctgttcccacacagggcagcagaaaagggggcgctctgcaaagctgtacaatcatatag

SEQ ID NO: 106476 - DNA, 1266 bp, Artificial Sequence
  Description of Artificial Sequence: Synthetic coding sequence
atgaatcgcggcttttccaggaagtctcacacattcctccctaagatattcttcagaaagatgagttccagcggcgctaaggacaagcctgaattacagttccctttccttcaagacgaggacaccgttgcaactctgttagagtgtaagaccctgttcatattgcggggtctgccaggaagtggcaagtcgaccctggctagggttatcgtggacaaataccgtgacggcaccaaaatggtatctgccgacgcttacaagattacaccgggcgcaagaggagccttcagtgaggagtataagaggctggatgaagacctggccgcgtactgtcggcgcagagatattcgaatcctagtgctcgacgatacaaaccacgagcgggagcggcttgagcagctgtttgaaatggcagaccagtatcagtatcaggttgtcctcgtcgagcccaagactgcatggagactggactgtgctcaattgaaagaaaagaatcagtggcagctctcagccgacgatctgaagaagctcaaacctggcctcgagaaggactttcttccactttactttggatggttcctcactaagaagagctccgagacgctccgaaaagctggacaggtgttcctggaagagcttggcaaccataaggccttcaagaaagagctcagacagtttgtgcctggcgacgaaccacgcgaaaaaatggacctcgttacgtacttcgggaaacggcccccaggcgtcctgcactgtacaaccaaattttgtgattacggaaaagctcccggggccgaggaatacgctcagcaggatgttctgaagaagagctactccaaagcctttactcttactattagcgcccttttcgtcaccccaaaaacaaccggggctagagtggaactttctgaacagcagttgcagctgtggcccagtgatgttgacaaactgtcgcctactgataatctgccccgcgggtcgagagcccatatcacgctaggctgcgccgccgatgtagaggctgtgcagacagggctagatctgctagagatcttgcggcaggaaaagggagggtcacgcggtgaggaggttggggagctttctcgaggaaagctgtactccctgggaaatgggcggtggatgctgacgcttgctaagaacatggaagtcagggctattttcacaggctactatggaaaagggaaacccgttccaactcagggttccagaaaaggaggagcactgcagtcatgcacaatcatctag

SEQ ID NO: 106477 - DNA, 174 bp, Artificial Sequence
  Description of Artificial Sequence: Synthetic coding sequence
atgagcagttccggtgcaaaggacaaacccgagctacagtttccattcctgcaggatgaggatacagtagctaccttactggagtgtaagacactgttcatattacgaggattaccaggatccgggaaaagcacactggcccgggtcatagttgataagtaccgagatgggtag

SEQ ID NO: 106478 - DNA, 1419 bp, Artificial Sequence
  Description of Artificial Sequence: Synthetic coding sequence
atgaaattccttatatttgctttcttcggcggggtgcacttattaagcctgtgttcagggaaagctatatgcaaaaacggcattagtaaaagaacattcgaggaaattaaggaggaaatcgcttcctgcggagacgtcgccaaagctataataaatctggccgtatatggcaaggcacaaaacaggtcctacgagagactagccttactagtcgataccgtgggcccccgtttatctgggtcaaaaaatcttgagaaagccatccagatcatgtaccaaaacctccagcaggatggcctggaaaaagtgcatctcgagcccgtacggatcccacattgggaaaggggggaggagtccgccgtgatgcttgaaccgcgcatccacaagattgcaatcctgggattaggatctagtattgggacgccgccagaaggcatcaccgctgaggtgctggtagtcacatcatttgacgagctccaacggagagcgagcgaagcgaggggaaaaatcgtggtatataatcagccctatattaactattccaggacggtgcaatataggacacaaggagccgtggaagcagctaaagtcggtgcgctggccagtctgataagatcggttgcgagctttagcatctactctccccacaccggcattcaggagtaccaggacggagtccctaagattcctaccgcttgcatcactgttgaagacgccgaaatgatgtcgcgtatggcctcccatgggatcaaaatcgtgatccagctcaagatgggagccaaaacctaccctgacaccgacagttttaacaccgtggctgaaatcacggggagcaaatatcccgagcaggtggttctggtgagcggtcatcttgatagttgggacgtcggtcagggcgccatggatgatgggggtggggcatttatttcatgggaggcgttgtctctcatcaaggacttaggacttaggcccaaacggacactcaggctcgtgttatggactgctgaagaacaggggggagttggcgcgtttcaatattaccagctccacaaggtcaacatcagtaactacagcctcgttatggagtctgatgcgggcacttttctgccaacgggtctgcagttcacagggtctgaaaaggcacgagctattatggaggaagtgatgtccctgctccagcctctgaatatcacccaggttctctctcatggggaaggcacagatattaacttttggatccaggccggagtccctggagcatcgctgttagacgatctgtacaaatacttcttttttcaccactcccacggtgatacgatgaccgtcatggatcctaagcagatgaacgttgctgctgcagtctgggccgttgtcagctatgtggtggccgacatggaggagatgttaccccggtcctag

SEQ ID NO: 106479 - DNA, 981 bp, Artificial Sequence
  Description of Artificial Sequence: Synthetic coding sequence
atgtctggacttggcaaaaagcatctcctgctgatgggagaatttttttcctacggcaccaaaatactttaccagaataccgaagctctgcagagtaagttcttcagcccgctccagaaagcgatgctgccccctaatagcttccagggcaaggtagcatttattaccggtggtggcacggggcttggcaagggcatgaccaccctcctgagctctctaggggcacagtgtgtgatagctagtagaaaaatggatgtgctgaaggccaccgctgaacagataagtagccaaactggcaacaaagtccacgctatccaatgcgacgtgagagatcctgatatggtgcagaatactgtttccgaattaatcaaggtggcgggccatccaaacattgtcatcaataacgcagccggaaatttcatttctcctaccgaaagactgagcccgaatgcttggaaaactatcaccgatatcgtgctgaatggcaccgcttttgtgactctagagatcggcaagcagctaattaaagcacaaaaaggcgccgcttttttgagcatcacaaccatttatgctgaaaccgggagtggatttgtggtgccctctgcctccgcgaaggccggtgtcgaagccatgtctaaatccctagcagccgaatggggcaagtacggaatgcggttcaatgttattcagccaggtcctatcaaaacaaagggggcattttccaggctggacccgactgggaccttcgagaaagaaatgattgggcggattccttgcggacggctcggcactgtagaggagctggccaaccttgcggcatttctgtgcagcgactacgcctcctggattaatggggctgtcatcaaatttgacgggggagaagaggttctgattagcggcgagtttaacgacctgaggaaagtaacgaaagagcaatgggatacaatcgaggagctgattcgcaagacaaaaggcagttag

SEQ ID NO: 106480 - DNA, 1551 bp, Artificial Sequence
  Description of Artificial Sequence: Synthetic coding sequence
atggaaccagccgtttcgttggccgtctgcgctctgttgtttctgctctgggtgagactcaaaggtctcgaattcgtcctgatccatcagagatgggtgttcgtttgtctgttcctgctgccgctttccctcatcttcgatatttactattacgtgagggcatgggtggtgtttaaacttagttcagctcctcgactccacgaacagcgtgtgcgagatattcagaagcaggtaagggagtggaaagagcaaggttctaaaacctttatgtgcactgggcgtcctggctggcttaccgtgagtctacgcgtcggcaaatacaaaaagactcacaagaacatcatgataaacctcatggatattctggaggtcgatacaaagaagcagattgtgagagttgaacccttagtgaccatgggccaggttaccgcgctgcttacatcaataggatggacactgccggtgttgcccgagctggacgacctcacagtgggtgggttgatcatgggtaccggaatagaaagttcctcccataagtatggcctgttccagcatatctgcacagcatacgaactggtcctcgcagatggcagctttgtacggtgcactccaagcgagaactcagacctgttttatgctgttccatggtcctgtggtacgctgggcttcctggtggccgccgaaattagaattattccagcaaagaagtatgtcaagctgaggttcgaacccgtacgaggtttggaagccatttgtgctaagttcacccatgaatcgcaaaggcaggagaatcactttgtggaggggctcttgtactccctggacgaagcagtcatcatgaccggcgtcatgactgacgaagctgagccgtccaagctcaattcgattgggaattactacaaaccttggtttttcaagcacgttgaaaactacttaaaaaccaaccgagaaggcctcgagtacatacctcttaggcattattatcaccggcatactcggagcatattctgggagctgcaggacattattccattcggcaacaacccaatttttaggtatctattcgggtggatggtacctcctaagatctctctgctgaagctcacccagggcgaaactctgcgtaagctgtatgaacagcatcacgtcgtccaggatatgttagttcccatgaagtgtttgcaacaggctcttcatactttccagaatgatatccacgtgtatccaatttggctgtgtccctttattctgccatctcagcccggtttagttcaccctaaaggaaatgaagccgagctttacattgacatcggcgcttatggtgaacccagagtaaagcacttcgaggctcgaagctgtatgcgccagctggagaagtttgtgcggagcgtgcacgggtttcaaatgctctatgcagattgctacatgaatcgggaagaattctgggagatgttcgatggctccctttaccataaattgcgcgaaaaactcgggtgccaagacgcattccccgaagtgtacgataagatttgtaaggccgcgcggcattag

SEQ ID NO: 106481 - DNA, 465 bp, Artificial Sequence
  Description of Artificial Sequence: Synthetic coding sequence
tagagccttttgaagctcactcagggggagacgctgcggaaactgtacgaacaacaccacgtggtgcaggacatgctggttcctatgaagtgtctgcagcaggccctacacaccttccaaaacgacattcacgtatacccaatctggctgtgtccttttatcctgccttcccagccaggtcttgtccaccctaaggggaatgaggctgagctgtatattgacatcggtgcttatggagaaccacgggtgaaacatttcgaggcaaggagctgcatgaggcagctggagaagtttgtcaggagcgtgcatggattccagatgctttacgctgactgttacatgaatagggaagaattttgggaaatgttcgatggttccctgtaccacaaacttcgggaaaagcttggttgccaggacgcctttcctgaagtctatgacaaaatctgcaaggccgcccggcattag

SEQ ID NO: 106482 - DNA, 1428 bp, Artificial Sequence
  Description of Artificial Sequence: Synthetic coding sequence
atgggagccggggaacagaatcgccaatccgctcactgcgtacagggcatctgtgggtacctggagggcgacgaggagggagaagaaggcgaagtgcgcagtacccaggttcgtgagtggaaggagcagggctcgaagactttcatgtgtaccggacgacctggatggcttacagtgtctctgagggttggcaagtataagaaaacccacaagaacatcatgataaatctgatggacatcctggaagttgatacaaagaagcagattgtcagggtggagccactggtgacaatgggccaggtgacagcactgctcacttcaataggatggacactgcctgtgctgcccgagctcgacgacctgacggtcggaggactgatcatgggcactggcatagagtcttcttctcacaagtatggcctttttcaacatatctgtactgcgtatgaactggtattggccgacgggtcttttgtgcgttgtacacccagtgaaaatagtgatctgttctatgctgtcccttggagctgcggaactttggggtttctcgtggctgccgaaatccgaattatcccagcaaaaaagtacgtcaagctcaggttcgaaccggtccgaggcctcgaagctatctgcgcgaagtttacacacgaaagtcagagacaggaaaatcactttgtagaaggtctgctatattctctagacgaggcagtaatcatgacaggtgtgatgacagacgaggcagaaccgagcaagctcaactcaataggtaactattataaaccatggttttttaagcacgtcgaaaattacctcaagactaaccgggaaggcctcgagtatattccgctccgccactactatcaccggcatacaaggagtatcttttgggagcttcaggacataattccatttggaaacaatccaatatttcggtatctgttcggctggatggtgccacccaagatatccttgcttaagctaacacagggcgagactctgcggaagctgtacgagcagcatcatgtggtgcaggatatgctcgtgccaatgaagtgtctgcaacaggcattgcacaccttccaaaacgacatccacgtataccccatctggctctgtcctttcattttgccttctcaaccagggttggttcacccgaagggcaatgaggccgaactgtacattgacattggagcatacggggaacccagggtgaagcatttcgaggcaagatcttgcatgcgccagctagagaaattcgttcgatctgttcatgggttccagatgctgtatgcggactgttacatgaatcgtgaggaattctgggagatgttcgatggttccctatatcataagttgagagaaaaactcgggtgccaggacgcattccctgaagtgtatgacaagatttgcaaagcagcacggcactag

SEQ ID NO: 106483 - DNA, 903 bp, Artificial Sequence
  Description of Artificial Sequence: Synthetic coding sequence
atgggaaccggcattgagtcctccagccataaatacggcctctttcagcatatatgcaccgcctatgagctggtgctagcagatggctcattcgtccgctgtaccccctcagagaattctgatctgttctatgcagtgccctggagctgcgggacactcggttttctggtagcagccgaaatacgaattatccccgccaaaaagtacgtaaagcttagattcgaacctgtaagaggtttagaagctatatgtgcaaaattcacccatgaaagtcagagacaggagaatcacttcgtggaggggctgttatactccctggatgaagccgtgattatgacaggcgtgatgaccgacgaagctgagccatccaaggacatcattccttttggtaataacccaatctttagatatctgttcgggtggatggtgcctccgaagatctctcttctcaagctaacccagggagaaacgctgcgaaagctctacgaacagcaccatgtcgtgcaagacatgcttgtgccaatgaagtgcctccagcaggctctgcatactttccagaatgacattcacgtttatcccatctggctatgcccatttatactccccagccagcccggactagttcatcccaaaggcaatgaggcagaactatacatcgacataggggcttacggcgaacctcgcgtgaaacactttgaagcgcggagctgcatgaggcagctggagaaatttgttagatctgtgcatggcttccagatgttatatgccgactgctatatgaatagagaggagttctgggagatgttcgatgggtctctttaccataaactgagagagaagctgggatgtcaggacgcttttcccgaggtgtacgacaaaatatgtaaggcagccaggcattag

SEQ ID NO: 106484 - DNA, 729 bp, Artificial Sequence
  Description of Artificial Sequence: Synthetic coding sequence
atggagcctgctgtttctctggcagtatgcgcactcttattcctcctgtgggtcagactaaaggggcttgaatttgtgcttatccaccaacgttgggtgttcgtctgtctgtttctgcttccactgtccctgattttcgatatctactactatgtccgggcttgggtggtgttcaaactcagcagcgctcctcggcttcatgaacaaagggtgcgagacattcaaaagcaagtaagggaatggaaggaacaaggctccaaaacgtttatgtgcacaggccgccctgggtggctgaccgtatcacttagggtcggtaagtataagaagactcacaaaaatatcatgataaacctcatggacattttggaagtcgatacttttcagaacgacatccacgtgtatccaatatggctctgccccttcattttgccctcccagcctggcctggtccatccaaagggcaacgaggcagaactgtatatcgacattggcgcttacggcgagcctagagttaaacacttcgaggcacgttcctgcatgcgacagctcgagaagttcgtgcgctctgttcacgggttccagatgctgtacgcagactgctacatgaatcgtgaggagttctgggagatgttcgacggcagcctgtaccataaactgagagaaaagctcgggtgccaagatgcctttcctgaggtgtacgataaaatctgcaaggccgctagacactag

SEQ ID NO: 106485 - DNA, 1203 bp, Artificial Sequence
  Description of Artificial Sequence: Synthetic coding sequence
atgatggatcttcggaatacccccgcaaaatcgctggataaattcatcgaagactatcttcttcccgatacctgcttcaggatgcagattaatcatgctatcgacattatttgcgggtttctaaaggaacgctgtttccggggctcctcctaccctgtatgcgttagcaaggttgtaaaaggtgggtctagtggtaagggcaccactctaaggggacgttcagacgccgacttggtggttttcctgagtccgctcaccactttccaggatcagctaaacagacgcggggaattcatccaggaaatcagacggcagctggaggcatgccaaagggaacgtgccttcagcgttaaattcgaggtccaagccccaagatgggggaacccccgggcactttccttcgtcctttcttcgctgcagctgggcgagggagtggagtttgatgtgctgccggccttcgacgcccttggccaacttacaggcggttataaacccaaccctcaaatctacgtgaaactgatagaggaatgcaccgatctacagaaggaaggagaattctccacgtgttttactgaactgcaaagggatttcttaaagcagcgccctacaaagctgaagagcctgatcagactggtgaagcattggtatcagaactgcaagaagaaacttggtaagctgccacctcagtatgccctcgagctgctgacagtgtacgcctgggaacgcgggagtatgaaaacccacttcaataccgcgcagggattccgtaccgttttggagctggtgatcaactatcagcagctgtgcatttactggaccaaatactacgactttaagaatcccatcatagaaaaatatttgaggcgtcaactaacaaagcctagacctgtgattctggatcccgctgatcccaccggtaaccttggtgggggcgatccgaaaggctggcggcaattggctcaggaggctgaggcttggctgaattacccttgttttaagaactgggatggaagtcccgtgagttcctggatcctactggcagagtctaattccgctgacgatgagacagacgatccaaggcgataccagaagtacggttatatcggcacgcacgagtatccccattttagccacagaccatccacgctccaggccgcttctactccccaggccgaggaggattggacctgcaccatcctttag

SEQ ID NO: 106486 - DNA, 1146 bp, Artificial Sequence
  Description of Artificial Sequence: Synthetic coding sequence
atgatggacctccggaatacaccagccaagtcgctggataagtttatagaggactatctgcttccagacacttgcttccgcatgcagataaatcatgctattgatatcatctgcggtttcctgaaagagcgatgctttaggggatccagctaccccgtttgcgtgagtaaagtcgttaagggtggctcctccggaaagggaaccaccttgagaggccgttctgatgccgatctggtggtcttcctgtcaccactaaccactttccaggaccagctcaatcgcagaggtgaattcatacaggagatcaggcgccagctcgaggcttgtcagcgcgaaagggccttcagcgtgaaattcgaggtacaagccccacgatggggaaacccaagggctctcagcttcgtgctgagttcactgcagctaggcgagggcgttgagttcgacgtgttaccagccttcgatgccctggggcaattgacgggaggatacaagcctaacccacaaatatacgttaagttaatcgaggaatgtacagatctccagaaggaaggcgagttctctacctgctttactgagttgcagcgggacttccttaaacagaggccgactaagctaaagagtctaattcggctggtgaagcattggtaccaaaactgtaagaagaagctagggaaactgcctccccagtacgctcttgagctattaaccgtatatgcctgggaacgcggcagcatgaaaacccacttcaatacagcgcagggctttagaacagtgttggaactcgtaatcaactatcaacaactgtgcatctactggaccaagtactatgattttaagaatcctattatcgagaaatatctgcgccgccagctgaccaagccccgccctgtaatcctcgatccagccgaccccactgggaatttagggggcggcgatcctaaggggtggcggcagttagcccaggaggctgaagcctggctcaattacccctgttttaaaaactgggatggatcacccgtatcctcttggatcctgctggtgaatttaacactggtgggccgcaggaactatatcatttccgagcacgccgtgaacctgcagcaaacacggggagccagcctgagctacagtttccaagtggcctag

SEQ ID NO: 106487 - DNA, 1245 bp, Artificial Sequence
  Description of Artificial Sequence: Synthetic coding sequence
atgatggatcttagaaacacacctgcgaaaagtctggacaagttcatcgaagactacctgctcccagacacgtgctttcgcatgcagataaaccacgcgatcgacatcatctgtggctttctgaaggaacgctgcttccgcggctctagctatccggtatgtgtgtccaaagtggtgaaggggggcagttcaggaaaaggaaccactctgaggggaagaagcgacgcagatctggtcgtgtttttgtctccgttaactaccttccaggaccagctgaatcgtcggggagaatttattcaggaaatccgtcgccagctggaggcctgccagagagaacgtgcgttcagcgtgaagttcgaggttcaagctccccggtgggggaacccccgagctctgagttttgtactgtccagtctgcaacttggagagggcgtggagttcgatgtgctccctgcattcgacgcacttgggcaactgacaggtgggtacaagcccaacccacagatttacgtgaaactaatagaggaatgtactgacctccagaaagagggcgagtttagcacgtgcttcactgaactgcagcgagatttcctaaagcaacggcctacgaaactcaagtccctgattagactggtgaagcactggtatcaaaactgtaaaaaaaagctcgggaagttacctccacagtacgccctggaactgctgacggtgtatgcttgggaacgtggcagcatgaaaacgcatttcaatacggcacaggggttccgcactgtgctcgagctggtcatcaattaccaacagttatgtatttattggaccaaatactatgatttcaaaaacccgataatcgagaagtacctgaggcggcagctgaccaagccaagacctgtgatattggaccctgccgatccaaccgggaacctgggcgggggtgaccctaaaggctggcgccagctggctcaggaggccgaggcctggctgaactacccttgttttaagaattgggatggcagtccagtctcaagctggatattgcttacccagcacaccccaggtagcatccatcccaccggccggaggggtctggacctgcatcacccactgaacgcctccgctagctggggcaaggggcttcagtgctacctcgaccagtttttacattttcaggtggggcttctgattcagcgaggccagtcgtcttccgtgagctggtgtattattcaggatcgcactcaggtttcttag

SEQ ID NO: 106488 - DNA, 1095 bp, Artificial Sequence
  Description of Artificial Sequence: Synthetic coding sequence
atgatggacctcaggaacacccctgccaaatctctggacaagtttatcgaggattacttactcccagatacttgctttcgcatgcagattaaccatgccatagatattatctgcgggtttttaaaggagcgctgttttcgcggttctagttatcctgtctgtgtgtccaaggtggtcaagggaggttccagcggcaagggcactaccttgcgtggccgcagtgatgcagacctggtagtgtttctgagtccattgactacatttcaagatcagctgaatcgcaggggggagttcatccaggagatcagaaggcagctggaggcctgtcagcgggagcgagccttcagtgtgaagttcgaagtccaggcccccaggtggggaaacccgagagctctgagctttgtgctcagcagcctccagctgggggaaggcgtggagtttgacgtactgcccgcttttgacgcgctaggccagctgacaggggggtacaagcccaatcctcagatatacgtcaagctgatcgaggagtgcactgatctacagaaggagggagagttcagtacttgctttaccgagttgcagcgcgatttcttgaaacaacgccccacaaagttaaaaagtctgatccggctcgtcaagcattggtaccagaactgcaagaagaaactcggcaaactcccacctcaatacgcactcgaactgcttaccgtttacgcctgggagcgaggttccatgaagactcattttaacaccgcacaggggttcaggaccgtgcttgagctcgttatcaattaccaacagttgtgtatctactggactaagtactacgacttcaagaatccgataattgagaaatacctccgacgccagctcacaaaaccaaggccagttatcctcgaccccgccgatccgaccggcaatcttggtggcggggatccaaagggatggaggcaactcgcccaggaggctgaggcgtggctcaactatccgtgttttaaaaactgggacggctcccccgtcagcagttggattcttctggtcaggcctcccgcaagttctctgcctttcattcccgcccccctacatgaagcctag

SEQ ID NO: 106489 - DNA, 2160 bp, Artificial Sequence
  Description of Artificial Sequence: Synthetic coding sequence
atgggtaacggcgaaagccaacttagctccgtgccagcccaaaagctgggctggttcattcaggaatatttgaaaccatacgaggagtgtcaaaccctcatcgatgaaatggttaacactatctgcgatgtgctgcaggagcctgaacagtttcccctggtgcaaggggtagcaatcggaggtagctatgggagaaaaactgtgcttcgggggaacagcgacggaaccttggtgctcttcttcagcgacttaaagcagtttcaggaccagaagagatcccagagggatatcctcgacaaaacgggcgataaattaaagttttgcttgttcacaaagtggctcaagaacaactttgagatccagaagtctttggacggattcacaattcaggtcttcaccaaaaatcaacggatttccttcgaggtactggcggcctttaacgccttgagtcttaacgacaaccctagtccctggatataccgggaactgaagcgctccctcgacaagactaacgcctcacccggcgagtttgctgtttgttttactgagctgcagcagaagttttttgacaatagaccaggtaaactgaaggatctcatcttactgatcaagcactggcaccagcagtgccagaagaagattaaggatcttcctagcctaagcccatatgctttagagctgctcactgtttatgcatgggagcagggttgtaggaaagataactttgatatagctgaaggcgttagaaccgtgttggagcttatcaaatgtcaggagaagctgtgtatctactggatggtgaattataactttgaggatgaaacgattagaaacattctgctgcatcagctccagagtgcgcgccctgtcattctcgatcctgtggatcctactaacaatgtgtcgggagataagatctgctggcaatggttgaaaaaagaagcacagacctggttgacgtcccctaatctcgacaatgaactgccagctcccagttggaacgttttgcctgcccccctgtttactacccctggtcacctactagataaattcatcaaggagtttctccagcctaataaatgcttcctggaacagatcgattctgccgttaacattatccggacctttcttaaggagaactgctttaggcagagcacagcgaagatccagattgtacggggcgggagcaccgcaaaaggtacagctctaaagacaggcagcgacgccgatctggtcgtgttccataattctctgaagtcatacacaagtcaaaaaaacgagcggcacaagatcgtcaaggaaatccatgagcaactgaaagccttttggagggaaaaggaagaggagctggaagtcagcttcgagccacctaagtggaaggcccccagggtgctgtcattctctctgaagtcaaaggtgctgaatgaatcagtgtctttcgacgtgcttcctgccttcaacgccctcggccagttgagcagtggatctaccccttctccagaagtgtacgccggcctcattgatctgtataaatcatcagacctcccagggggcgagttcagcacgtgctttactgttctgcagagaaattttattagaagccgcccaacaaaactgaaggaccttattcggttagtcaagcattggtataaggagtgtgaaagaaagttgaaaccgaagggctccctgcctcccaaatacgccctggaactcctgacaatatatgcctgggagcagggatccggggtgcccgacttcgacactgcagagggtttccgcaccgtattggagcttgttacacagtatcagcagctctgtatcttttggaaagtcaactacaactttgaagacgagacggtgcggaaatttctgctttcgcaactgcagaaaacccgccccgtaattctggaccctgctgagcccactggggacgtcggggggggcgacagatggtgctggcatctcctggctaaggaggctaaggaatggttgtcttctccttgtttcaaggatggaacaggaaaccccattcctccatggaaagtacctactatgcaaacacccggatcatgtggcgcgcgcattcacccaattgtgaatgagatgttttccagccgtagtcacagaatccttaacaataatagcaaaaggaacttttag

SEQ ID NO: 106490 - DNA, 2064 bp, Artificial Sequence
  Description of Artificial Sequence: Synthetic coding sequence
atgggcaacggcgaatcacaactgtcttccgtgccagctcagaagcttggctggttcattcaggaatacctaaagccatatgaagagtgccagacgcttatcgatgagatggtgaacactatctgcgacgtgctgcaagagcctgagcaattccccctggtgcagggggtcgctatcgggggctcgtacggccgtaaaacagtcctacggggcaattcagacgggacacttgtccttttctttagcgatctgaaacaatttcaggaccagaaaaggagtcagcgtgacattctggacaaaactggggacaagttaaaattctgtctctttactaaatggttgaagaataattttgaaattcagaagtctttggatgggtttacaatccaggtgttcaccaagaatcagaggatcagcttcgaggttttagccgctttcaacgccctaagcctaaacgacaacccttccccatggatctacagagagttgaaaagaagtctcgacaagaccaatgcttcccccggggagttcgctgtgtgcttcacagagctgcagcagaagttctttgacaatcgtcccgggaagcttaaagatctgattctcctgattaaacactggcatcagcaatgccaaaagaaaatcaaggatctgccttccctcagtccttacgctttagaactgttgaccgtgtatgcatgggaacaggggtgtcgaaaggacaactttgatatagccgaaggggtgcgaacagtgctcgaattgattaagtgtcaggagaaattatgtatttattggatggtcaattacaatttcgaggatgaaacaataagaaacatcttgttacaccagctgcaatctgccagacccgtgattctggaccccgtcgaccccaccaacaacgtgtccggggacaaaatatgctggcagtggctgaagaaagaagcccagacctggctgacatcacccaacttagataatgaacttccagctccatcatggaacgtcctaccggccccactgttcactactcctggacatctgttggacaaattcattaaggagtttttgcagcctaataaatgttttctggaacagatcgactcagctgtgaatattattcggacttttcttaaagagaattgtttccggcagagtaccgctaagatacagatcgttcgtggtggcagtaccgcaaaaggcactgcactcaaaacgggaagcgatgccgacctggtggtgtttcataatagcctgaaatcctacactagccagaaaaatgaacggcacaaaattgtcaaggaaatccatgaacagcttaaagctttttggagggagaaggaggaagagctggaagtgagcttcgagcctccaaagtggaaagccccacgagtgctttcctttagcttgaaatccaaagtgctcaatgaaagtgtatcgtttgacgttctgccggcatttaacgctctgggacagctctcaagcggcagtacgcccagtccggaggtgtatgcaggactaatcgatctatataagagttcagatttgcccggtggggaatttagtacttgttttacagtgttgcagaggaactttattcgctccaggcctaccaagctcaaagacctgatacgcctcgtgaagcattggtataaggagtgcgagcggaagcttaaaccaaaaggctccctgccacctaaatacgctcttgagctgctgaccatctatgcatgggagcaagggtcgggcgttcctgattttgacacagctgaaggttttcggaccgtgctggagctggtaacccagtatcagcagctctgtatcttctggaaggtcaactataacttcgaagatgagacagtgcggaaattccttttgtcccagctgcaaaaaacaaggcccgtcattttggacccggcagagcccaccggagacgtcggcggaggcgaccgatggtgttggcacctgttggccaaggaggcgaaggagtggctttcgagcccctgtttcaaggatgggaccggtaaccccattccaccatggaaagtcccagtgaaggtgatctag

SEQ ID NO: 106491 - DNA, 519 bp, Artificial Sequence
  Description of Artificial Sequence: Synthetic coding sequence
atgggtaacggggaaagtcagttgtcaagtgtccccgcccagaagctgggttggtttatccaggagtacctaaagccctacgaggagtgccagactcttatcgatgaaatggtgaacacaatttgtgatgtgctgcaggagcccgagcaattcccacttgtgcagggggtcgcaattggggggagctatggccggaagacagttctgagggggaactcggatggtacactggtgttgttcttctctgatcttaaacagtttcaagaccagaaacgcagtcagagagatattctggacaagacaggggataaactgaaattctgcctgtttactaagtggctgaaaaataacttcgaaatccagaaaagtctcgacgggttcaccattcaagtctttactaaaaaccaacgcatttccttcgaggtgttggcagcttttaacgccctgtccaaacactgttgggtctctggagaaaagagccagcggagtggatgtcagaccgctctctgcaacctgtag

SEQ ID NO: 106492 - DNA, 1053 bp, Artificial Sequence
  Description of Artificial Sequence: Synthetic coding sequence
atggcaactgtgggagcccctaggcacttttgtcgctgtgcatgcttctgtactgataatctgtacgtcgcgcgatacggcctccatgtgcggtttagaggagagcagcagctgcggagggactatggacccatactgagaagtcggggctgtgttagcgccaaagatttccagcaactgctcgccgaactcgagcaggaggtggaacgtaggcagagattgggccaggagtccgctgcacgaaaggcgctcatcgccagtagctaccacccggcccgacctgaggtatatgattctttacaggatgcagccctggcacccgaatttctggctgtcacagagtactcagtctctcccgacgccgacctgaagggccttttacaaagactggagaccgtctctgaggagaaacgtatatacagagtccccgtattcaccgcccctttctgccaagccctgctcgaagagctcgaacatttcgagcaatccgacatgcctaaaggtcggcccaatacgatgaacaactatggcgtgttgctccatgagctgggtctcgatgaacctctcatgacgcctcttcgtgagcgattcctgcaacctctcatggcattactgtatcctgattgcggaggtgggaggctggactctcacagggcctttgttgtgaagtacgctcccggccaggatctcgagctgggctgtcactatgacaacgccgagttgacgctcaatgtggccctggggaaggtattcactggtggggcactctacttcggcggactgtttcaagcccctacagcactgactgaaccactcgaggtggaacatgtcgtgggacaaggcgtgctgcaccgggggggccaactgcacggtgctcggcctttaggaaccggggaacggtggaatctggtcgtgtggctcagggcgagcgcagtgcggaattctttgtgtcctatgtgctgtcgcgagcctgacctggtggacgacgagggattcggagacggctttacgagggaggaacccgcaaccgtggacgtctgcgccctgacctag

SEQ ID NO: 106493 - DNA, 3261 bp, Artificial Sequence
  Description of Artificial Sequence: Synthetic coding sequence
atggacctgtactccacccccgctgccgcattagaccgatttgttgcccgtagactccagccccgcaaagaatttgtggagaaggcaaggagagctctcggggccttagccgctgctctaagagaacgtggcggcagactaggagctgcagccccccgtgtcctcaagaccgtgaagggtggctcctctgggcgaggaacggccctgaaaggcggctgtgatagcgagcttgtgatctttctggactgtttcaaatcatatgttgaccagagggctaggagggcggagatcctcagcgagatgagggcatccctggaaagctggtggcagaaccctgtgccaggtctgcgacttacttttccggaacagtccgtccccggcgccctacagtttcgactcacgagcgttgacctcgaggactggatggatgtttcgctggtccctgccttcaacgtgttagggcaggctggatccggcgtgaaacctaagccccaagtgtacagtacactgcttaactctggatgccaagggggggaacacgctgcctgcttcacagagttaagacggaattttgtcaacatccgccctgcaaagctcaagaacctgattctgctggtgaagcattggtaccaccaggtgtgcctgcaagggttatggaaagaaactctccctcctgtgtatgcgttagaactcctcacaatcttcgcttgggaacagggatgtaagaaagatgccttctccttagcggaaggattgcgcaccgtcctaggattgatccagcagcaccagcatctttgcgtcttttggaccgtaaattacggattcgaggacccagctgtgggacagttcctgcagcggcaactcaagagaccacgcccagtcatccttgatcccgccgacccaacgtgggacctgggcaatggcgcagcctggcattgggacctgctagctcaggaagcagcctcatgctacgatcatccttgttttcttcggggaatgggtgaccccgtccagagctggaagggaccaggcctgccacgcgcaggctgctcgggattggggcatcccattcagctggatccaaatcagaagactccggagaattccaaatctttaaacgccgtatatccacgggcaggttccaagccccccagctgtccggctccagggccgactgggcagccggcgagttcttcagttccggggatggcactggatctgtcccagattcctaccaaggagctcgacaggtttatccaggatcatctgaaaccatcgccccagtttcaggagcaggtaaagaaagctattgacattattctcaggtgcctacatgaaaattgtgtgcataaggcctctagagtgtccaaaggagggtcttttggtagaggtactgacctccgggatggatgcgatgttgagctgatcatcttcctgaattgctttaccgattataaggatcaagggccgagacgcgccgagatccttgacgagatgcgtgctcagttggagtcatggtggcaagatcaggtgccgtcactgtcactgcaatttcctgagcaaaatgtgcctgaggccttgcaatttcagctggtatctacagccctgaaaagttggacagatgtctcccttctgcctgccttcgatgctgtaggccagttgtcctctgggacgaagccaaacccacaagtctattcccgacttttgacctccggttgccaggagggtgagcacaaggcctgtttcgcggagttacgtagaaactttatgaacatccgtcctgtaaaactgaagaatctcattctgcttgttaagcactggtatcggcaggtggccgctcagaataagggaaaaggaccggcccccgcatcattgccgcccgcctatgccttggaactgctgaccatctttgcctgggagcagggttgccggcaggattgttttaacatggcccaaggattccgcaccgtgctgggtcttgtgcagcaacatcagcaactgtgcgtatactggactgtgaattattcaaccgaggatcctgctatgcggatgcaccttttgggccagctcaggaaacccagacccctggtgctggaccccgcagatcccacctggaatgtcggccacggctcgtgggagttactggcacaggaagctgccgccctgggcatgcaggcatgttttctatctagggacggaacgagcgtccaaccctgggatgtcatgccagccctgttgtaccagacccctgcgggcgatttagataaattcatctccgagttcctccagcccaatagacaattcttagcacaggtgaataaagccgttgatactatatgtagttttctgaaggaaaattgcttcagaaattcgcccatcaaggtaattaaagtggttaaaggcggaagcagcgcaaaaggcaccgccctgcgggggcggtcggacgctgacttggttgtcttccttagctgtttttctcagtttaccgaacagggaaataagagagccgaaatcatctctgagatccgtgctcaattggaagcctgccagcaagagcgacagttcgaggtgaagtttgaggtatcgaaatgggagaatccgcgcgtcctgtcattcagcctcacatcacagacaatgcttgatcagagtgtagatttcgatgtgctgcccgcgttcgacgccttaggacagctggtgtccggaagccgcccgtcctcccaagtgtatgtcgatctgatccattcttactctaatgcaggggagtacagtacctgctttactgagctgcagagggatttcatcataagccggcctacgaagttgaagtcactgattcggctcgtgaagcattggtaccagcagtgtactaagattagcaagggaagaggaagtctgcctccccagcacggattagagttattgacagtctacgcgtgggaacagggggggaaagactcccagtttaacatggcagaggggttccgaactgtcttagagctggtcactcagtaccggcaactctgtatttactggaccatcaattacaatgccaaagacaaaacagtgggtgattttcttaaacaacaactgcagaaaccccggcccatcatactggaccctgcggatccgacgggaaatctgggtcacaacgctcgttgggatctactcgctaaggaagccgccgcctgtactagtgctttgtgctgtatggggagaaatgggatccctatccagccttggcctgttaaggcagccgtatag

SEQ ID NO: 106494 - DNA, 1545 bp, Artificial Sequence
  Description of Artificial Sequence: Synthetic coding sequence
atggctctcatgcaggagctgtactccactcccgcctccagacttgatagcttcgtcgctcaatggctccagccacacagggaatggaaagaggaagtgctcgatgccgtgcggacagttgaggaattccttaggcaggagcacttccagggaaagagaggcctcgatcaagacgtgagagtcctaaaagttgtcaaagttggatccttcggtaatggaacggtgctgcgcagtaccagggaggtggagctagtggccttcctctcatgctttcactccttccaagaggcagccaaacaccataaggacgtgctccggctgatttggaagacgatgtggcaaagccaggacctcctggacctgggcctcgaagacctcaggatggaacaacgagtgcctgatgccctcgtctttaccattcagactcgcggaacagccgagccaattactgtgacgatcgtacctgcctacagggctctggggcctagtctgccaaactcccaacccccccctgaggtttacgtgtctctcatcaaggcttgcggtggacccggaaacttttgcccatctttctctgagctgcaaaggaactttgtgaagcacaggcctacaaagctcaagtctttgctgcggctagtcaaacattggtaccagcagtacgtgaaggcgaggagtccacgcgctaacctgccaccactgtatgctcttgagctcctcaccatctacgcttgggagatggggaccgaggaagatgagaattttatgctggacgagggattcacaaccgtaatggatctcttgcttgaatatgaggtgatttgcatatactggaccaagtactacactctgcacaacgcaatcattgaggactgcgtccgaaaacaattgaagaaggaacgccccatcatcctggaccctgccgacccgacactaaacgttgccgaggggtatcgttgggatatcgttgcccagcgcgcaagtcagtgcctgaaacaagattgttgttatgataatcgagagaaccccatttccagttggaatgtcaaacgagcccgcgatatccatctgaccgtcgagcagcgtggctatcccgacttcaacctcattgtgaatccttacgaacctatccgcaaggtgaaagagaaaattcgtcgtacaaggggctattccggactgcagaggctgtctttccaagtgccagggtccgagcgtcagttgctctccagtcggtgcagcttggccaagtacggaatcttttcccacacgcatatctatctgttggagacaattccctctgaaatccaggtgtttgttaagaatcctgatggaggcagctacgcctatgctattaatccaaatagcttcatactgggcctgaagcagcagatcgaggaccagcagggcctccctaagaaacaacaacagcttgagtttcaaggacaggtcctccaagattggctgggcctcggcatctacggcatacaggatagtgacaccctaatcctgagtaagaagaagggtgaggctctgtttcctgcaagctag

SEQ ID NO: 106495 - DNA, 768 bp, Artificial Sequence
  Description of Artificial Sequence: Synthetic coding sequence
atggccctgatgcaagaactgtactctacacccgcttctcggctcgattctttcgttgcccagtggctccagccacacagggagtggaaagaggaagtcttggacgctgtgaggaccgttgaggagttcctcaggcaagagcactttcagggcaaacgggggctggaccaggatgtcagagttttgaaagtggtgaaagtgggaagcttcggaaatggaaccgttctccgaagcacacgtgaggtagagcttgtagcttttctcagctgtttccactccttccaggaggccgccaaacaccataaagatgtactgaggctgatttggaaaactatgtggcagtcgcaggacctgctggatcttggactggaggatctaaggatggagcagagggtccctgacgcacttgtgttcactattcagacccgggggaccgccgaaccgatcaccgtaaccatcgttcctgcctaccgggccctgggaccatctttgccgaattcacagccacctcctgaggtttacgtgtcattgatcaaggcctgcggtggcccggggaacttctgcccctccttttccgaactccagcgtaactttgtaaagcaccggcccacaaagctcaagtccctcctccgcctcgtcaaacactggtaccagcaagctcatcaccctggcagcggcagaccccaccctcagagaggacgacgcgttcagatgggtcatcggtgtagcgagggcctgccagtccccgagacgggactgctcctgtag

SEQ ID NO: 106496 - DNA, 1737 bp, Artificial Sequence
  Description of Artificial Sequence: Synthetic coding sequence
atgcctgactccaatttcgcagaaagaagtgaggagcaggtttctggggctaaagtaattgcccaagctcttaagactcaggacgtagagtatatcttcggtattgtgggaatcccggtgacggagattgccatcgctgcacagcagcttgggatcaagtatatcggcatgaggaacgaacaggcagcctgctatgcggcctccgccatcggctatctgacttcgcgtcctggtgtctgtctcgtggtcagtggtccgggactgattcacgcactcggcggtatggctaacgctaacatgaactgttggccactgctagtgataggaggctcctccgagcggaaccaggagactatgggcgctttccaggaatttccacaagtcgaggcctgtaggctgtacacaaaatttagcgccagaccaagctccatcgaggcaattccctttgtgatagaaaaagcagttagatccagcatctatggccggcctggtgcctgctatgtggacatcccagctgatttcgtgaacctccaggtgaatgtgaactcgattaagtacatggagcgttgtatgtccccacccatctcaatggctgagacaagcgcggtttgtacagccgcatcagttattcgcaatgctaaacagccactgcttatcatcggcaaaggcgccgcttatgcgcatgccgaggagtccattaagaagctggtggaacaatataaactgccattcctgcccacgccaatgggaaagggagttgtccctgacaaccacccttactgcgtcggggctgcacgctctcgggcactccaatttgcagacgttatcgtcctgttcggagcacggctgaactggattctccacttcgggctgccaccccggtatcaacccgacgtgaagttcatccaagtcgacatctgtgccgaagaactgggcaataacgtgaagccagcagtgacactcttggggaatatccatgcagtaaccaaacaactgctagaagagctcgataaaaccccatggcagtatcctcccgaaagcaagtggtggaaaaccttgagggagaaaatgaagtcgaatgaggcagcttccaaagaactggcttcgaagaaatctctcccaatgaactattatactgttttttatcatgtgcaagagcaactacctcgggattgcttcgtcgtgtcagagggagcaaacaccatggacatcgggcgcactgtcttgcagaactacctgcctcgccatcggctggacgctggcacattcggcacgatgggcgtcgggctggggttcgccatcgccgccgccgtggtggcaaaggacaggagcccgggccaatggattatctgtgtagaaggcgactctgcatttgggttctccggaatggaggtggagacaatatgcaggtacaacctgcccattattctcctcgtggtgaacaataacggtatctaccagggttttgatactgacacttggaaggaaatgctgaagttccaggacgcgacagccgtggtcccccctatgtgtttgttgcctaattcacactacgaacaagtaatgactgcatttggggggaaagggtacttcgtacaaacacctgaagaactgcaaaagagccttaggcaatcactggctgataccactaaacccagtctcatcaatattatgatcgagcctcaagccaccagaaaggcccaggacttccactggctcacccggtccaatatgtag

SEQ ID NO: 106497 - DNA, 1563 bp, Artificial Sequence
  Description of Artificial Sequence: Synthetic coding sequence
atgcctggctccctgccattgaacgccgaagcctgttggcccaaggacgtaggcattgtagccctcgagatctactttccgtcacaatatgtggaccaggctgaactggagaagtacgatggtgtggacgctggcaaatatactatcgggctaggccaggccaagatgggattttgcacggatagggaggacatcaattcactctgtatgacagtcgtgcagaatctgatggagcgaaataatttgtcatacgactgcatcgggcggcttgaggtagggactgagacaatcattgacaagagcaagtccgtgaagacaaatttgatgcagctgttcgaagagagcggcaacaccgacatagaggggatcgatacaacaaatgcctgctatggaggaaccgccgccgtcttcaatgctgtgaattggatagagtcctccagctgggatggtcgctatgcccttgttgttgctggagatattgctgtgtatgccactgggaacgctaggcccacaggaggcgttggcgccgtggccctgctcattggcccaaacgcacccctgattttcgagcggggactccgcggaacacacatgcagcacgcctacgacttctataagccagatatgttatccgagtaccccatagttgacggcaagttaagcatccagtgctacctctcagctctcgatcgatgctactccgtatattgcaagaagattcacgctcagtggcaaaaggagggcaatgacaaggacttcaccctgaatgactttgggtttatgattttccattcgccttattgcaaactggtgcagaaaagcttagctcggatgcttttgaacgactttcttaacgaccagaaccgcgataaaaactcaatttattccgggctggaagcctttggagatgtgaagttagaagacacctacttcgaccgggatgtggagaaggcattcatgaaggcatcatcagagttgttttcacagaagacgaaggcgtcattgctggtgtccaaccagaatgggaacatgtatacgtcgagcgtatatggatctctggcttctgtactggcacagtactctccccagcagcttgccggtaaacgaattggggtgttcagctacggctccggcttggccgccacactgtactccctgaaagtaacacaagacgccactcccggcagtgccttagataaaataaccgctagtctgtgcgacctgaaatcaagactggattcacgcacgggcgtggcccctgatgttttcgctgaaaatatgaaactccgagaagatactcaccatctggtgaactacatccctcaggggtcaattgattctttatttgaagggacgtggtacctcgtcagggtcgacgaaaagcatcgcaggacctatgctaggcgtccgacacccaatgacgacacactggatgaaggcgtgggactggtgcactcgaatattgccactgagcatattcccagccccgcgaagaaagtgccgagactccctgccacagctgcggaacctgaagccgctgtgatctcaaatggagaacattag

SEQ ID NO: 106498 - DNA, 1563 bp, Artificial Sequence
  Description of Artificial Sequence: Synthetic coding sequence
atgccaggttccctccctctgaacgccgaggcgtgttggccgaaggacgttggaatcgttgcacttgaaatttattttccctcccagtacgtggatcaggccgaactggaaaaatatgacggagtcgacgctggcaagtacactattgggctcggacaggctaaaatgggcttctgcacagaccgggaagatatcaattcattgtgtatgacagtcgtgcagaatttgatggagaggaacaatctcagctacgactgcatcggtcgcctggaagtcgggactgaaaccattattgataagtccaagagcgtcaaaaccaacctcatgcagctctttgaagaatctggcaatacggatatcgagggtatcgacaccacgaatgcatgttatggcgggactgctgctgtattcaacgcggtgaattggattgaaagttctagctgggacggtcgatacgcactggtagtcgccggggatattgctgtgtatgcaactggcaacgcccgacctactggcggagtgggggcagtggctctgctgattgggcccaacgcccccctcatctttgagagaggcctgcggggaacccacatgcaacacgcttatgacttctacaaaccggacatgctatctgaataccccatagtggatggcaagctgtccatccagtgctacctgtctgccctggatcggtgctacagtgtttattgcaaaaaaattcatgctcagtggcagaaggagggaaacgacaaagattttacactaaacgactttggattcatgatttttcacagcccatactgcaaattggtgcagaagtctctggcccgtatgctgctgaatgactttctcaatgatcagaaccgcgataagaattcaatctactcggggcttgaggccttcggtgatgtcaagcttgaagatacttactttgatagagacgtggagaaagcatttatgaaggcatcctcagagctgttcagccaaaagaccaaggctagtctgctggtgtccaaccaaaatgggaacatgtacacctcctcagtttatggctccctggccagcgtgcttgcccaatactcacctcagcaattggctggaaagcggattggtgttttttcttacggtagcggcctcgcggcgactttatattcactgaaggtgacccaggatgccacacccggctctgccttagacaagatcaccgcctcactgtgcgatcttaaatctagattagacagtagaaccggtgttgcaccagatgtgttcgcagagaacatgaagctcagagaagatactcaccatctggtgaactatattccacaggggtccatcgactctcttttcgagggtacatggtacttggtgagagttgacgagaaacatcggcggacctatgctcggaggccaacacccaacgatgacactcttgacgaaggggtggggctggtccattccaacatcgccacagaacacattccaagtccagcaaagaaagtgccccgccttccagctactgccgctgagcctgaggccgcagtgatttctaatggcgaacactag

SEQ ID NO: 106499 - DNA, 291 bp, Artificial Sequence
  Description of Artificial Sequence: Synthetic coding sequence
atgcctggcagcctgccacttaatgccgaggcgtgctggccgaaggatgtaggcattgtggccctggagatctacttcccttcgcaatatgtggaccaggccgaactggagaaatatgatggcgttgatgccggtaagtacaccatcgggcttgggcaggccaaaatgggcttctgtactgatcgggaagatatcaacagcctgtgcatgacagtggtgcaaaacctgatggaaagaaataatcttagttatgactgcattggaagactagaggtcggcacagaaacatag

SEQ ID NO: 106500 - DNA, 1530 bp, Artificial Sequence
  Description of Artificial Sequence: Synthetic coding sequence
atgccgggctccctgcccctaaacgcagaggcttgctggcccaaggatgtgggcattgtggcactggagatctacttccccagtcaatatgtggaccaggcagagcttgagaagtatgacggcgtggacgcggggaagtacactatcggactcgggcaagcgaaaatggggttctgtaccgaccgcgaggatattaactctctgtgcatgacagtggtccaaaatctaatggagcggaataacctctcctatgattgcatcggcaggcttgaagtgggaactgaaaccataatcgataaatctaagtcagtgaaaacaaatttaatgcagcttttcgaagagtctggcaacactgatatagaaggaattgacaccaccaacgccgtaaattggatcgagagttcctcatgggacggccggtacgccctagtggtcgccggggatattgctgtgtacgcgacaggcaacgcgagacccaccgggggagtgggcgcagttgccctcctgattggacccaacgcaccactaatttttgagagggggcttcgagggactcacatgcaacatgcttacgacttttataagcccgatatgctgtccgagtacccaattgtggacgggaaactgtcaatccagtgctacctcagcgccttggaccggtgctattcagtgtactgtaaaaagattcatgcccagtggcaaaaggagggcaacgacaaagatttcacactgaacgactttgggtttatgatctttcactccccttactgtaaactcgtacagaaaagcctggcacggatgctgcttaatgattttctgaatgatcagaacagggataagaactctatctactcgggcctggaagcattcggtgatgtgaagctagaggatacttattttgaccgggatgtggaaaaggccttcatgaaggcgtcctctgaactcttctcccagaagactaaagctagtctgctggtctcaaaccagaacgggaacatgtacacctctagcgtatacggctccttagcttctgtcctcgctcaatactcccctcagcagctcgctggaaagcgcatcggtgtgttctcatacgggtccgggctcgccgccacactgtactccctcaaggtgacacaagacgctacacctggctctgcactcgataagatcaccgctagtctctgcgacttgaaaagtaggctagacagtcgtaccggcgttgctcccgatgtgttcgccgagaacatgaagttgcgggaagacacccaccacctcgttaactatattcctcagggctcaattgactcactcttcgagggcacatggtatttggtgcgtgtggatgaaaaacaccggaggacatacgctagaagacctacccccaatgatgatacactagatgagggggttggcttggtgcactccaatatagctactgagcatatcccttccccagccaaaaaggtgccccggctgccggccaccgcagctgaacctgaagctgcagtcatctccaatggtgaacattag

SEQ ID NO: 106501 - DNA, 1527 bp, Artificial Sequence
  Description of Artificial Sequence: Synthetic coding sequence
atgcagaggttactgaccccagtgaaaaggattctccaactgactagagccgtgcaggagactagcttgacacccgccagattactccctgtcgcccaccagaggttctctacagccagcgctgtacccctggcaaagacagatacttggcctaaggatgtcgggatactcgcgctggaggtgtattttcccgcccaatatgttgatcagacagacctggagaaatacaataacgtggaggcagggaagtataccgtggggctgggccaaactagaatgggcttttgttccgtgcaggaggatattaattcactatgcctgactgtggtgcagagactgatggagaggatccagttaccatgggactcagtgggacggcttgaggtcggcaccgagacaattatagataagagcaaagccgtcaaaactgtgcttatggagctgttccaggacagtggtaatacagatatcgagggaattgatacaaccaacgcttgttacggcggcaccgccagtctcttcaacgcggccaattggatggagtcctcaagttgggatggcaggtacgccatggtagtttgtggggacatagcggtgtacccctccggaaacgctcggccgaccgggggggccggagcggtcgccatgctgattgggcccaaggctcccctcgccttagaaaggggcttgagaggaactcacatggagaatgtgtacgatttttacaaacctaacctcgcttctgagtacccaattgtggatggaaaattgagtatccagtgctacttgcgggcactggaccggtgttacacatcgtatagaaagaaaattcagaatcagtggaaacaagcgggctccgacaggcccttcacccttgatgaccttcagtacatgatatttcacacccccttttgtaagatggtccagaaatcgttagcacggctcatgtttaacgacttcctcagtgcttcatcggacacacagactagcctctacaagggattggaagcgttcggcggcctgaaacttgaagacacctacaccaacaaggatctggacaaggccttacttaaggcctctcaggacatgtttgacaagaagactaaggccagtctctatctttccacccacaacggtaacatgtacacctcttctctctacggctgtctggcatcgctgctgtcgcatcattcagcccaagaactggccggatctcgcattggagcattcagttatggttcaggccttgccgcttcattcttcagctttagggtctctcaggacgcggctccgggaagccccctggataaattggtttcttctacctcagacctgcccaagcggctagcatcacggaagtgcgtgtcaccagaggagtttacggaaatcatgaatcagagggaacagttttatcataaggtaaatttctctccaccaggcgacactaatagcctgttccccggaacctggtatctcgagcgagtagacgaacagcaccggagaaaatacgcaagaaggccagtgtag

SEQ ID NO: 106502 - DNA, 1401 bp, Artificial Sequence
  Description of Artificial Sequence: Synthetic coding sequence
atgcaaaggcttctcacccccgtcaagcgaattctccagcttacaagagccgtgcaggagacgagcctgactccagccaggttgctcccagtggcccaccaacgtttctcgacagctagcgcagtgccactggcgaagacggatacatggcccaaagatgtggggatactggcgctcgaggtgtacttccctgcgcagtatgttgaccagacagatctggaaaagtacaataacgtggaggccgggaaatataccgtaggcctgggccagactcgcatgggattctgctccgttcaggaggatattaacagcctttgtcttaccgttgtgcagagactaatggaaagaatacagttgccctgggactctgtcggccggctcgaagttggcacagaaacaataatcgataaatctaaagcggttaagacagttctgatggaactctttcaggactcagggaacacagacattgaaggcatcgatacgaccaatgcgtgttacggcgggactgccagtttattcaatgcagctaattggatggaatcctctagttgggatggactccgtggcacccatatggagaacgtgtacgacttctataagcccaatctcgctagcgaataccccattgtggacgggaagctgtctatacagtgctatttacgcgcccttgaccggtgctatacgtcctatagaaaaaaaattcagaaccagtggaagcaggccggttccgatagaccgtttaccctggacgatctccagtacatgatctttcacacgcccttctgtaagatggttcagaaaagcctggcgagactcatgtttaatgatttcctctccgcttcatctgacacccagaccagcctctacaagggtctcgaggcgtttgggggcctcaaattggaagacacatacacaaacaaggacctggataaagcgctgctgaaggcctcacaggatatgttcgataaaaaaacaaaagcttctctctacctttccacacacaatggcaatatgtacacatcgtcgctctacggctgtctcgccagcctcctgagccaccactcagctcaggaactcgccggttctaggattggggccttttcttacggctcgggactggcagccagctttttcagctttcgtgtctctcaggatgcagcaccaggctctcctttggacaagctggtgagttctacatctgatttacccaagcgtctagcatcgcgcaaatgcgttagcccagaggagttcaccgaaatcatgaaccagagagagcagttttatcataaagtcaacttctctccgccaggcgacacaaatagtctgtttcccgggacctggtaccttgagcgggtcgacgagcagcatcgcagaaagtacgctcgtcgtcccgtgtag

SEQ ID NO: 106503 - DNA, 1161 bp, Artificial Sequence
  Description of Artificial Sequence: Synthetic coding sequence
atgggtcagcgcgagatgtggagactgatgtcaagatttaatgcttttaaaaggaccaacactatcctgcatcacctgcggatgtcaaaacatactgacgccgccgaggaagtgctgctggagaaaaagggctgtaccggagtcatcacacttaatcgaccaaagttcctaaatgctctgacgctcaacatgatccgacaaatctacccccagttgaaaaaatgggagcaggatccagaaacgttcctaatcatcataaagggtgccggcggcaaggcattctgcgcgggaggggacatccgcgtcatttctgaagccgagaaggccaaacaaaagatagcaccagtgttcttccgcgaagagtacatgctcaacaacgccgtcggttcatgccagaaaccatacgtggcattgatccacgggatcacaatgggaggtggagttgggctctccgtccacggccagtttcgggtcgctaccgaaaagtgcctgttcgcaatgcccgaaaccgccattggtctgtttcccgacgtcgggggcgggtattttctgcctaggctccaaggaaaacttggctattttctcgcacttactggctttcgattgaagggacgcgacgtctatcgggccggtatagccacccacttcgtggactccgaaaaactggctatgctggaagaggatctgcttgcccttaaatcaccctctaaggagaacatcgcaagcgtcctggagaactatcataccgagtccaagatcgacagagataaatcgttcatcttggaggaacatatggataagatcaattcctgtttctccgcgaataccgttgaagagattatagaaaatcttcagcaggatggctcgtcattcgcacttgagcagttaaaagttatcaacaagatgagtcccactagtctgaagattaccctccggcagctgatggaaggatcttctaagaccctacaggaagttcttacaatggagtatagacttagtcaggcatgtatgaggggacacgattttcacgagggcgttcgagccgtgttgatcgataaagatcaatctcccaaatggaaaccggcagacctgaaggaggtcaccgaggaagacctgaacaaccacttcaaatcactgggatcctccgaccttaaattttag

SEQ ID NO: 106504 - DNA, 1017 bp, Artificial Sequence
  Description of Artificial Sequence: Synthetic coding sequence
atgggccagcgcgagatgtggcgactgatgagccgctttaacgcgtttaagagaacaaacaccattcttcaccatctgaggatgtcaaagcacactgacgcagcagaagaggttctcctcgaaaagaaaggttgcaccggggtgataacattaaatcggcctaagtttctcaatgctctgacactcaatatgatcaggcagatttatccccagcttaaaaagtgggaacaggatcctgagactttcctgattatcattaagggagctggtggcaaagcattctgtgctggcggtgacattcgggtcataagtgaggctgagaaagctaaacaaaagattgctccggtcttctttcgtgaagagtatatgctcaataatgctgtcggcagctgccagaagccttatgtcgccttaatccacggtatcaccatggggggaggggtgggcctcagcgtccacggccagttccgggtagcaaccgagaagtgcttattcgcaatgccagagaccgccatcggacttttccccgacgtgggcggcggatactttctgccgcgtctccagggcaaactgggctactttctggcactaactggtttccggctgaagggtagggatgtctacagggccgggattgccacacacttcgttgacagcgagaagttagcaatgcttgaggaggacctcttagctctcaaatcccctagcaaagagaatatcgcttccgtcctggagaattatcatacagaaagtaagatcgaccgggacaaatcattcattttggaggagcacatggacaaaataaattcctgtttttccgctaacactgttgaggaaataattgaaaacttgcagcaggacggctcgagtttcgccctggaacagctcaaggtgatcaataagatgagtcctaccagcttgaagatcactttgcgacaactgatggaggggtcatctaaaacactgcaggaggtcctcaccatggaataccgactctcgcaggcgtgcatgttttag

SEQ ID NO: 106505 - DNA, 117 bp, Artificial Sequence
  Description of Artificial Sequence: Synthetic coding sequence
tagctgattgacaaggatcaatcccctaagtggaaacccgctgacctgaaggaagtgactgaagaggacttaaataaccactttaaaagcctcggctccagcgatcttaagttttag

SEQ ID NO: 106506 - DNA, 903 bp, Artificial Sequence
  Description of Artificial Sequence: Synthetic coding sequence
atgggtaccttgccaaaacgcgtaaagatagttgaggtgggcccccgagatggtctccagaatgagaaaaacatcgtgtctaccccagtaaagataaaacttatagacatgctgagcgaggccggtctgagcgttattgaaacaacctcattcgtgtctcctaagtgggttccacagatgggggaccataccgaggtgctcaagggtattcaaaagttccccggaatcaactacccagtactgacgcctaatctgaaagggtttgaagccgccgtcgctgccggggcaaaggaagtcgttatattcggggccgccagcgagctgttcactaaaaaaaatattaactgctccatagaggagagctttcaaagatttgacgcgatcctgaaagccgctcagtccgccaacataagcgtcagagggtatgtaagctgtgctctcggttgcccctatgagggaaaaatatccccagccaaggttgccgaagtcactaaaaaattctactcgatgggctgttacgagattagcttgggggacaccatcggcgttgggacgcccggcatcatgaaagacatgctgagcgcagttatgcaggaggtgccgctcgccgctctggcggtccactgtcatgacacatacggtcaggctctggccaataccttgatggccctccagatgggggtcagcgttgtggacagttccgtagctggtctgggagggtgcccctacgctcagggcgccagtggcaacctagcgactgaggaccttgtttacatgttggaaggactcggcatccacacaggcgtgaatctccagaagctgctggaagcaggaaatttcatctgtcaagcactgaaccgcaaaacttcctccaaagtggcacaggccacctgcaagctgtag

SEQ ID NO: 106507 - DNA, 978 bp, Artificial Sequence
  Description of Artificial Sequence: Synthetic coding sequence
atggcggccatgaggaaagccctgccccgtagacttgtgggcctggcttcactccgggccgtcagcacctcatctatggggactctcccaaagagggtgaagatagtcgaagtcggcccccgcgatgggctccagaacgaaaagaacatcgtgtctacaccagttaaaatcaagctaattgatatgctgtctgaggcaggactctcagtgattgagaccacatctttcgtaagccctaagtgggtgccccagatgggggaccatactgaggtactaaagggaattcagaagttcccggggatcaactatcccgttctcacccccaatctcaaagggttcgaggccgctgttgctgctggggctaaagaagttgtgatatttggagctgcctctgaactcttcaccaaaaaaaacattaattgctcaatcgaggagtcatttcaaaggttcgatgccatcctgaaggcagctcaatctgccaacattagtgtaagaggttatgtgtcttgtgcccttgggtgtccatatgagggaaaaatctctccagccaaagtcgccgaggtgactaagaagttttactccatgggttgttacgaaatttccctgggggatacgatcggggtcgggacccccgggattatgaaagacatgctgagcgcggtgatgcaggaagtgcccttggcagcccttgctgttcattgtcacgacacctacggccaagccttagccaacactctgatggctctgcaaatgggagtgagtgttgtggattcatccgttgctggcctggggggctgcccttatgcccagggtgcctctggcaacttagcgacagaggacctggtgtatatgctcgaaggcctgggcatacataccggcgtcaatctccagaaactcctggaggccgggaactttatctgtcaggcgctgaatcggaaaacatcctcgaaggtcgcacaggcaacctgcaagctctag

SEQ ID NO: 106508 - DNA, 765 bp, Artificial Sequence
  Description of Artificial Sequence: Synthetic coding sequence
atggcggccatgcgaaaagccctgcctcgcagacttgtggggttggcctcattgagggccgtgtccacaagctccatgggaacgctccccaagagagtcaaaatagtggaggtgggacccagagatggcctgcagaacgaaaaaaacattgtgtctacaccagtgaagatcaagctgatcgacatgctgagcgaagctggcttatcagttatcgagaccacatcctttgtctcacccaagtgggtacctcaaatgggggaccacacggaagtgctaaaaggaattcaaaagtttcctggtattaattatccggtgctgactcccaatctcaaaggctttgaagcagcggtcaccaagaagttttacagcatgggttgctatgagatctctttgggggatacaatcggcgttgggacgcccgggatcatgaaagatatgttaagcgccgtgatgcaggaagtccctctggccgcgctggccgtgcattgccacgacacttatgggcaagcccttgcaaacaccctcatggcgctgcagatgggcgtatcggttgtggacagctccgtggccggactaggcggctgcccttatgctcagggagcaagtggtaatctcgcaaccgaggacctggtttatatgctagaggggcttggaatccacaccggcgtgaatctgcagaaacttctggaagcagggaatttcatctgtcaggctctgaatcggaaaacctcctcgaaagtggcccaggcaacttgcaagctgtag

SEQ ID NO: 106509 - DNA, 501 bp, Artificial Sequence
  Description of Artificial Sequence: Synthetic coding sequence
atgggaaccctgcccaagcgtgtgaagattgttgaggtgggacccagagacggcctgcagaatgagaagaatatcgtgtccacccccgtgaagattaagctaattgatatgttgtccgaggcaggcctgtctgtcatcgaaaccacctctttcgtttcccccaaatgggtgcctcagatgggcgatcataccgaagtgctcaaggggattcagaagtttcctgggatcaactatcctgtgctgactcccaaccttaaaggcttcgaggccgccatgggcgttagtgtggtggactccagtgtggcagggttggggggctgcccttatgcccaaggggctagtggcaaccttgccaccgaagacctcgtgtacatgctggaaggtctgggaatccatacaggggtgaacttgcaaaagctcttagaggccggtaatttcatttgccaagctctcaaccgtaagacatcctccaaggtagcccaggctacatgtaagctgtag

SEQ ID NO: 106510 - DNA, 1563 bp, Artificial Sequence
  Description of Artificial Sequence: Synthetic coding sequence
atggcagctctgaagctgctttcctccggcctgaggctgtgcgccagcgcacgcgggtctggcgccacatggtataaaggatgtgtgtgtagctttagtacatctgcacatcgtcacacaaagttttacaccgatccagtagaagctgtcaaagacattccagacggtgctactgtcctggtgggaggattcggactgtgtggaatccctgagaacctgattgacgcactgctgaagactggagtgaaagggcttacagcagtgtctaataacgcaggagttgacaattttgggttagggctgctgcttcgaagcaagcagattaaacggatggtttccagttacgtgggagagaatgctgagtttgaaaggcagtatctctccggtgaactggaggtggagctcacacctcaggggacccttgcggagagaatcagggctggaggagcaggggttccggctttttatacaccaaccggatacggaactctagtacaggaaggcggcagccccatcaaatacaataaagatgggtcagtggcaattgccagcaagcctagagaagtgagggagtttaatgggcagcactttatactggaagaggcaataactggcgacttcgctctcgttaaagcgtggaaggccgacagggctggcaacgtgatttttcgcaagagcgctagaaactttaatcttccgatgtgtaaggccgcagaaaccaccgtggtcgaagtggaggagattgtggacatcggtgcattcgcccccgaagacatacacatcccccagatctacgtgcacaggctgatcaagggggagaagtatgaaaagcgtattgagcgccttagcattcgcaaagaaggggacggagaggctaagagcgctaaacctggagacgacgttagagagaggatcattaagagggccgctctggaatttgaggatggtatgtatgcaaatcttgggattgggataccgctgctcgcctccaactttatttcacctaacatcactgtccacctgcagagcgaaaacggcgtgctgggcttgggcccttaccccagacagcatgaggccgatgccgatctgatcaatgccggcaaggaaaccgtaacaattctgcccggggccagcttcttctcctctgatgaaagtttcgccatgattcgcggtgggcacgtggacctcacgatgctaggcgccatgcaggtctcaaaatacggggaccttgcgaactggatgatcccggggaaaatggtcaagggcatggggggcgcaatggacctggtatcatcagctaaaaccaaagtcgtcgtgacaatggaacattccgccaaaggaaatgctcataagattatggaaaagtgcaccctaccacttacaggtaaacaatgtgttaacagaattatcacagaaaaggccgtctttgatgtggataaaaaaaaggggctgaccctgatcgaactttgggagggactgacagtggacgacgtgcaaaaatccacaggatgcgactttgccgtctctcccaaacttatgccgatgcagcaaattgcaaattag

SEQ ID NO: 106511 - DNA, 1005 bp, Artificial Sequence
  Description of Artificial Sequence: Synthetic coding sequence
atgatggtcagagagttcaatggacaacacttcattcttgaggaggcaatcacaggcgattttgccctcgtgaaggcgtggaaggccgatcgggccgggaatgttatattccgcaagtccgctcgcaacttcaatctgcccatgtgtaaagccgctgaaacaactgttgtggaggtagaggagatagtggatattggcgcctttgctcctgaagatatccacataccacagatttatgtacaccgcctcattaaaggcgaaaaatacgaaaagagaatagagcgtttgtccatcaggaaagagggcgacggcgaagctaagtccgccaagcccggggacgacgttcgagaacgcatcattaagcgtgctgctctggagtttgaagatgggatgtacgcaaacttgggtatcggaattccgttgcttgcctccaactttatctctcccaacattactgtacacctgcagtccgaaaacggcgtccttggacttggcccatatcctcggcaacatgaggcagacgccgatttaatcaatgcgggaaaggaaacagttacgatccttccaggcgcttctttcttcagcagcgacgagagtttcgctatgattaggggtggtcacgttgacctgaccatgctcggggccatgcaggtgagtaagtatggtgatcttgcaaattggatgatccccggaaaaatggtgaaaggtatgggaggcgctatggacctcgtgtcctctgcaaagaccaaggtcgtggttactatggagcattccgctaagggcaatgctcacaaaattatggagaagtgtacattgcctctgactggtaaacagtgcgttaatcgaattattaccgagaaagcagtgttcgatgttgataagaaaaaaggacttacgttaattgaactttgggagggcctgactgtggacgacgtgcagaagtctaccgggtgcgattttgctgtatccccaaaacttatgccaatgcagcagatcgccaattag

SEQ ID NO: 106512 - DNA, 372 bp, Artificial Sequence
  Description of Artificial Sequence: Synthetic coding sequence
atgctgggtgcgatgcaggtctccaaatacggcgatcttgctaattggatgatcccaggtaaaatggtgaaggggatgggaggcgcaatggatctcgtcagtagcgctaaaaccaaggtagttgtgactatggagcattccgctaaaggcaacgctcacaaaattatggagaaatgtacacttccactgacaggtaagcagtgtgtcaaccgcattattactgagaaggcagtattcgacgtggacaagaagaagggcctgacccttatcgaactgtgggagggtctcacagtagacgacgtacagaaaagtactggatgcgatttcgcggtttccccgaagctgatgccaatgcagcagatagccaattag

SEQ ID NO: 106513 - DNA, 372 bp, Artificial Sequence
  Description of Artificial Sequence: Synthetic coding sequence
atgctcggtgctatgcaggtgtccaagtacggggatttggcgaactggatgatcccgggcaaaatggtaaaggggatgggtggcgcaatggatctggtgagttctgcaaagacaaaggtggtggtcaccatggagcacagtgccaagggaaatgcccacaaaattatggagaagtgcacactccctttaacaggcaagcagtgcgtaaatcggatcatcactgaaaaggcggtgtttgacgtagataaaaagaagggtttaacgctcatcgaactgtgggagggcctgacagtcgacgatgtgcagaaaagcactggatgcgatttcgcggtgtcacccaagttgatgccaatgcagcagatagcgaattag

SEQ ID NO: 106514 - DNA, 453 bp, Artificial Sequence
  Description of Artificial Sequence: Synthetic coding sequence
tccaacgcttataaagtcgataactttgggctcggattattgctacgctcaaagcagatcaagcgtatggtgagcagctatgtgggagagaacgctgagttcgaacgccagtacctgtcaggtgaattagaggtggaacttacacctcaggggacattggccgaacgtatccgcgctggcggagccggagtgccggcgttttatactcctaccggctacgggaccttggtgcaggagggaggttcgccgataaaatacaataaggatgggagcgttgctattgcttcaaagccacgggaagtgcgcgaattcaacggccaacacttcattctggaggaagccatcactggagacttcgccctagttaaggcctggaaggccgacagggcaggcaatgtcatcttccggaaaagcgctcggaacttcaatcttccaatgtgcaaggctgcatag

SEQ ID NO: 106515 - DNA, 1131 bp, Artificial Sequence
  Description of Artificial Sequence: Synthetic coding sequence
atgtcgaactgtctgcagaattttctgaaaattacaagcaccagactcctatgttcaaggctttgccagcagctcaggtcgaaacgaaagttcttcggtaccgtgcccatttcaaggctgcatcgccgcgtggtgatcacaggcattggcttggtaacaccgcttggcgtcgggacccacctggtgtgggatcgcctgattgggggagaatccggaattgtgtcccttgtcggggaggagtacaaaagcatcccttgctcagtggcagcatacgtcccgcgcggaagcgacgaggggcagtttaacgagcaaaattttgtttcaaagagcgacatcaagagcatgagctcaccgacaataatggccattggagccgcggagttggccatgaaggactctggctggcatcctcagagtgaagcagatcaggttgccacaggagtcgcaattggcatggggatgattcctttagaagtggtcagtgagactgctctgaattttcaaaccaaaggctataataaggtcagtccattctttgtgcccaagatcctggtgaacatggctgctggccaggtgtcgattcgctacaagctgaaaggccccaaccacgcagtttcaactgcttgcaccactggagcccatgccgtaggtgattccttccgattcatcgcccacggcgacgctggacatataaccgcgcccgaccccgagggagaaggtgccctgcgctgcatggcagctgcactgaaggatgcaggagtgcagcccgaagagatttcttacataaacgcccacgccacaagcacaccattgggcgatgccgcagaaaataaggctattaaacacctgttcaaggaccacgcttatgccctggctgtatcgtcaacaaagggtgcaactgggcatctgttgggcgcagctggcgcggtggaagcggcgttcacgacactggcgtgttattaccagaaactgcctcccacccttaacctcgactgctcagagcctgaatttgatctgaattatgtgcccctaaaggcccaggaatggaaaaccgagaagcgcttcatcggtttgaccaatagttttgggttcggggggacaaatgcgacactctgcattgcagggctgtag

SEQ ID NO: 106516 - DNA, 1380 bp, Artificial Sequence
  Description of Artificial Sequence: Synthetic coding sequence
atgtctaactgtctgcaaaactttctcaagatcactagcacccggttactatgttccagattatgtcagcaactgaggtctaaacgtaaattttttggaacagtacccatctcccgtttacatagacgcgtggtaattactggcatcggtctcgtcacaccactcggcgtggggacacacctggtgtgggaccgcttgatcggcggggagagcgggattgtatcgctggtgggcgaagagtacaagtctatcccgtgcagtgtagccgcctacgttcctcgcggatccgacgaggggcagtttaatgaacagaattttgtctccaagagcgatattaagtcaatgagcagtcctacaatcatggctataggtgccgctgagctggccatgaaggactctggctggcacccccaatcggaggctgaccaggttgcgacgggggtagcaatcggaatgggtatgatccccctggaagtagtgagcgagacagctctcaacttccaaaccaagggatacaataaagtgtcacccttttttgtgccaaagatactcgttaatatggccgccggccaggtgagtatcaggtacaaactgaaggggcccaatcatgctgtgtccactgcctgtaccacgggggcccacgcggtgggagactcgttccggtttattgctcacggagacgccgacgtaatggtggcggggggaaccgactcttgtataagccccctctccctagccgggttttcaagggcgcgcgccctctccacgaactctgacccaaaactggcttgcagaccttttcacccaaaaagagacggcttcgtgatgggcgagggagccgctgtgctggtgctcgaagagtatgaacatgccgtgcagaggcgcgccaggatttatgccgaggtgcttggttacgggctgtctggtgatgccgggcacatcaccgcccctgaccctgaaggggagggcgcgctaaggtgtatggcagctgcccttaaggacgccggggtgcagcctgaagagatctcatatattaatgcccatgccacatccactcccctgggagacgctgctgagaacaaagccatcaagcacctgttcaaagaccatgcatatgccctggctgtctcctcaacaaaaggggccaccggtcatttgcttggagccgccggggccgttgaggccgcctttacaactctggcctgttattaccagaaactgccgccaactctgaatctagattgttccgagcccgagtttgatctcaactatgtaccactaaaagcacaggagtggaagacggaaaaacgattcataggcttgaccaatagtttcggcttcggaggtaccaacgccacactctgtattgctggactgtag

SEQ ID NO: 106517 - DNA, 696 bp, Artificial Sequence
  Description of Artificial Sequence: Synthetic coding sequence
atgtctaactgcctgcagaacttcctcaaaatcacctctactcggctcctctgctctaggctttgtcagcagttgcgtagcaagcggaagtttttcggcaccgtgccaatttccaggcttcataggagagtggtgatcaccgggattggcctagttaccccccttggagtggggacgcacctggtgtgggatcgtctgattggcggggaatcgggtattgtctctctggtaggggaggaatacaagtccataccctgctcggtagctgcatatgtccctcgcggcagtgatgagggacagtttaatgagcaaaacttcgtgtctaaatccgacatcaagtccatgagcagtcccactataatggccatcggcgcagccgaattggctatgaaggattcagggtggcacccacagagtgaagctgatcaggtggcgaccggcgtggccatcggcatgggaatgattccactggaggtagtgagtgagactgctttgaacttccagacaaagggttacaacaaggtgtccccgttctttgttcccaagatcctggtaaacatggccgccgggcaggtttcgatccgctacaagttgaagggccctaatcacgcagtttccacggcctgcactacgggcgctcacgctgtcggagattccttccggtttatcgcacatggcgacgcagacgtgatgtag

SEQ ID NO: 106518 - DNA, 663 bp, Artificial Sequence
  Description of Artificial Sequence: Synthetic coding sequence
atgagtaattgcttacagaattttctcaagattacctctacacgtctgttatgctcaagactgtgtcagcagttacgtagcaagcgaaagttcttcggcactgttcccatttcccggttgcatcgcagagttgtcattaccggaatcgggctggtcacacctctgggggtaggcacccacctggtctgggacagactaattggtggtgagagcggcatagtatctttagtaggcgaggaatacaaatccattccatgttcggtcgctgcctacgtgccccgaggcagcgatgaggggcaattcaatgagcaaaattttgtgtctaagagtgatatcaagtctatgagctcccccacgattatggccatcggagctgccgagctggcaatgaaagacagcggctggcatcctcaatccgaggccgatcaagtagccaccggtgtggccatcggcatgggaatgatccccctggaagtcgtttcagaaacggctcttaacttccaaacaaagggatacaataaggttagccccttcttcgtccccaagattctggtcaacatggctgccggtcaggtcagcatccgctacaaattaaaagggcccaaccatgccgttagtaccgcttgcacaacaggagcacacgccgtaggagattctttttag

SEQ ID NO: 106519 - DNA, 1875 bp, Artificial Sequence
  Description of Artificial Sequence: Synthetic coding sequence
atggaaattcccggctctctctgcaagaaagtgaaactcagcaacaacgctcagaattggggaatgcaacgtgcaacaaacgttacgtaccaggctcatcacgtctctcggaataaacgagggcaggtggtagggaccagaggcggttttcgcggctgtaccgtgtggctgactggtttatctggtgcagggaaaacgactgtgtccatggcattagaggaatatctggtgtgccacggaatcccatgctatactctggatggtgacaacataagacagggccttaacaagaaccttggctttagccctgaggaccgcgaggaaaatgtgcggagaattgctgaggtggctaagttgttcgccgatgccggcctggtgtgcataacgagctttatttctccatacacccaagatcgcaacaatgctcgtcaaatccatgaaggcgcctctttgcccttttttgaagtgttcgtagacgcgccactccatgtgtgcgagcagcgcgacgtgaagggcctgtacaagaaggcccgcgcaggcgagataaagggctttaccgggatcgacagtgaatacgagaagccagaggcccccgaactggttctgaagaccgactcttgtgatgtcaacgattgcgtgcagcaagtggtagagcttctccaagagcgagacatcgtgccagttgacgcgtcttacgaggtgaaggagctgtatgtccccgagaataaactccatctcgccaaaaccgacgcagagaccctccccgccctgaaaatcaataaggtagacatgcagtgggttcaagtactcgccgagggctgggcaacaccgctgaatggctttatgcgggaacgagagtacctgcagtgtctgcactttgactgtctgctggacggtggcgtgatcaacctgagcgtgccgatcgtgcttacagctacacacgaggacaaagaacgattagacggttgtacagcctttgccttaatgtatgagggacgacgcgtcgcaattctgcggaaccctgagttcttcgaacaccggaaggaggaacggtgcgcacggcagtggggaacgacatgcaaaaatcatccttacatcaagatggtcatggagcagggagactggctgataggaggcgacttgcaggtcttggatcgggtgtactggaatgacggattagaccagtatcgtctaacccccactgaattaaagcagaagtttaaggacatgaacgcagatgccgttttcgccttccagctcaggaatcccgtccacaacggacatgccctccttatgcaagacacacacaagcaactcctagagcgcgggtacagacggcccgtcctcttgctccaccctctgggcggttggacgaaggatgacgacgtcccattgatgtggaggatgaagcagcacgctgccgttctggaggagggggtgctgaaccctgagaccacagtcgtagccatcttcccctcaccaatgatgtacgcaggcccgaccgaggtgcagtggcactgccgagcacgaatggtcgccggagcgaatttttatatcgtgggcagggaccccgcaggtatgccacatcccgagacaggcaaggacctttatgagcctagccatggggctaaggtgcttacaatggcccctggcttgattactctggaaatcgtcccttttagggtagcagcctacaataagaagaagaaacgtatggattactatgacagtgagcatcacgaagactttgagttcatctctggcaccagaatgaggaagcttgctagggaaggccagaagccccccgagggttttatggctcccaaggcctggaccgtcctgactgagtactacaaaagcctggaaaaagcctag

SEQ ID NO: 106520 - DNA, 1845 bp, Artificial Sequence
  Description of Artificial Sequence: Synthetic coding sequence
atgtccggcataaagaagcagaagacagaaaatcagcagaagagtaccaacgtggtgtaccaggcacaccacgtatcacgtaataaacgcgggcaggttgtcggaactagagggggctttcgaggatgcactgtgtggttaaccggtctctccggagcaggtaagaccactatctcctttgctctggaagagtatcttgtgagtcatgcaatcccctgttacagcctagatggagataatgtgagacatgggttgaatagaaatctgggattctctcctggggaccgagaggagaacatcaggaggatcgcagaggtggcgaagttgtttgccgatgcaggcctggtgtgcatcaccagcttcataagtccatttgccaaagatcgggaaaacgcccggaaaattcacgaatctgcgggtctgccttttttcgagatcttcgtcgacgcaccgttaaacatttgcgaatcgagagacgtaaaaggactctataagagagcaagggccggagagattaagggtttcaccggcatcgactctgattatgagaaacctgagacaccagaacgggtgctaaagaccaacctcagtacagtctctgactgcgtccatcaggtggttgaactactgcaagagcagaatatcgtgccttacaccattattaaagacattcacgaactgtttgtgcctgagaacaaactagaccacgtgagagcggaagctgagacgttaccatcgttgtccatcaccaagctggatttgcagtgggtgcaggtgctgtcggaaggctgggcaacaccgctgaaaggtttcatgcgggagaaggagtatctgcaggtgatgcacttcgacaccctgctggacgacggtgttatcaatatgtccatcccaatcgtgcttcctgtttctgcggaggataagaccagactggaagggtgcagtaagttcgttctcgcccatggagggaggagagtggccattttgcgggatgccgagttttacgaacaccgaaaagaagagcgctgctctcgggtctggggaactacatgtaccaagcatccccatatcaaaatggtcatggaatccggagactggttagtaggtggtgatctgcaagtcctggaaaagatcagatggaatgatggtctggatcagtatcgcctcactccgcttgaactgaagcagaaatgtaaggaaatgaatgctgatgccgtgttcgcattccagctgagaaatcccgtgcataacggccacgcactcctgatgcaggataccagacgtcgtttattagagcgggggtataagcatcctgttctgctgctgcaccccctgggaggctggacaaaagacgacgacgtgccactggactggaggatgaagcagcatgccgctgtgttagaggagggagtgctggaccctaagtctaccatcgtggcaatttttccctcaccgatgctgtatgccggacctaccgaggtacaatggcactgcaggagtcgaatgatcgcgggggcaaatttctatattgttggcagagatcctgcagggatgccgcaccctgagaccaagaaagacctttacgagcccacacacggtgggaaggtcctgtctatggctcccgggttaaccagtgtcgagatcattccattccgggtcgccgcctataataaagccaagaaagccatggatttttacgatccagcccggcataatgaattcgacttcatctcgggaacccgaatgaggaagcttgcgcgtgaaggtgaaaaccctcctgatggcttcatggcgccaaaagcctggaaggttctcaccgattactatagaagcctggaaaagaattag

SEQ ID NO: 106521 - DNA, 1857 bp, Artificial Sequence
  Description of Artificial Sequence: Synthetic coding sequence
agcgggaaaaagcaggagaaagaggaaaatcagcaaaagagcacaaatgtcgtataccaggcccaccacgtcagtagaaataagcggggccaggtcgttggtaccaggggtggcttcaggggctgcacagtgtggctgactggtctgtctggagcaggtaagacaaccatctcctttgctctggaagaatacctagtctcacacgcaatcccttgttatagcttggatggggataatgtgcgacacgggctcaataggaaccttggtttctctcctggtgacagggaagaaaacatacgccgcatcgctgaagtggccaaactgtttgcagacgctggccttgtatgcataacaagctttatcagtccattcgcaaaagaccgagaaaacgcgaggaaaattcacgaatctgccggcttacccttttttgagatctttgtagacgcccccctaaatatttgcgagtcccgcgacgtcaagggactctacaagcgagcaagagctggagaaataaaaggctttacagggattgacagtgattacgagaaacccgaaactccagaacgtgttctaaagacgaacctttctacagtgtctgattgtgtgcaccaggtggtggagctgctccaggagcagaacattgtgccatacacaataattaaagacatccacgagctgttcgtccctgaaaacaaattggaccacgtgcgggctgaggctgaaacccttccgagcttaagtatcactaagctggatttacaatgggtgcaagtcctcagtgagggttgggctacgcctttaaagggctttatgcgagagaaagagtacttgcaggtgatgcacttcgacactctgttagacgggatgttcctgctggacggagtgattaatatgagtatcccaatcgttctccccgtctctgccgaggataagacacggctggaaggctgctcgaagttcgttctggcacacggaggccgccgggtggcgatcctcagagatgcggagttttacgaacataggaaagaagagcgttgcagccgggtctggggcacaacttgtacaaaacaccctcatataaagatggttatggaaagcggcgattggctagtggggggcgatctgcaggtactcgagaagatccgctggaacgacggtctggatcaatacaggctcacacccttggaactgaaacagaagtgcaaggagatgaacgccgacgccgtttttgcatttcagctcagaaatccagtgcacaacgggcacgccctgctgatgcaggatacacgacggcgtttgctcgagagaggctataagcaccccgtgcttctgcttcatcctctggggggctggacaaaggatgatgacgtccctctggattggaggatgaagcaacacgcagcagtgctggaagagggcgtgcttgatcctaagagcaccatcgtggccatcttcccatctcccatgctgtacgccggacctactgaggtgcagtggcattgccgatcccgcatgattgctggagccaacttctacatagttggaagggatcccgccggaatgccccacccagaaacaaagaaggatctctatgaaccaacacatggaggtaaagttttgtccatggctccaggactcaccagtgtggaaattatccccttccgggtggctgcttataataaggcaaagaaggctatggatttttacgacccggcacggcacaacgagttcgacttcatcagtgggacgcgaatgagaaaactcgcaagggagggagaaaatccccccgacggatttatggcccccaaggcgtggaaggtgctgactgactactataggtccctggaaaaaaattag

SEQ ID NO: 106522 - DNA, 1857 bp, Artificial Sequence
  Description of Artificial Sequence: Synthetic coding sequence
atgattgtcttggtcaccgaatgggtcgacctgagcctggagaatcagcaaaagtcaacaaacgttgtctaccaggcacaccatgtcagccggaacaaaagagggcaggtcgttggtactaggggtgggtttcgcgggtgcactgtctggctgaccggcctgagcggcgctggcaagacaacaatctccttcgctctcgaagagtatctcgtatctcacgccataccctgctactctctcgatggggataatgtgaggcacggattgaatcgcaacctcggcttcagtccgggagatcgcgaagagaacatcaggcgtatcgcagaggtagctaagcttttcgctgatgccggactggtctgtatcacgtcttttatcagcccatttgctaaagatcgtgagaacgcccgaaaaatccatgaaagcgccggcctacccttttttgaaatcttcgtggatgccccactcaatatctgtgagagcagggacgttaagggactgtataagagggctcgggccggggaaatcaaaggcttcacaggcatcgattccgattatgagaagcccgaaaccccggaacgggtgctgaaaacaaatctgagcactgtgtctgattgtgtgcaccaggttgtggagctgctgcaagagcaaaacattgtgccctacaccatcattaaagacatccacgagttgtttgtccctgagaataaactggatcacgtgcgagccgaggccgaaactcttccctcccttagtatcacaaaactcgacctgcaatgggttcaagtgttaagcgagggatgggctacccctttgaaaggatttatgagggagaaggagtaccttcaagtcatgcactttgacactcttttagatgacggggtgattaacatgtcaataccgattgtgctgccggtatcagcagaggacaaaacccgattagagggctgcagcaaattcgtcctggcccatggcgggaggcgagtcgccatcctcagggacgcagaattttacgagcatagaaaggaggaaaggtgtagtcgcgtctggggcacgacatgtacgaagcaccctcatatcaaaatggtcatggaatcgggggattggcttgttggtggtgatctccaggtgcttgagaaaattaggtggaacgacggccttgatcagtacagacttacccccctcgaactgaagcagaagtgtaaggaaatgaacgccgacgctgttttcgcctttcagctgcgcaatccagtgcacaacgggcacgcccttttgatgcaggacaccaggcggaggttgttagaaaggggttataagcaccccgtgctactccttcaccccttgggaggctggaccaaggacgacgacgttccactggactggagaatgaagcagcatgctgctgttctggaggagggagttcttgatcccaagagcaccatcgttgcgattttcccttctccgatgctatacgccggtccgacagaagttcagtggcactgtcgaagccgcatgattgctggagcgaatttttatatcgtggggcgggatccggcaggaatgcctcacccagaaactaagaaggacttatatgagcctactcacggagggaaggtcctttccatggcacccggactgacctccgttgagataatcccctttcgagtggctgcttataataaggcaaagaaagccatggatttttacgaccctgctcgacacaacgagttcgacttcatcagcgggactagaatgcgcaaactcgccagagagggtgagaatccacccgacggattcatggcgccaaaagcctggaaggtccttaccgactattaccgttccctggaaaaaaactag

SEQ ID NO: 106523 - DNA, 1860 bp, Artificial Sequence
  Description of Artificial Sequence: Synthetic coding sequence
atgtcaggcatcaaaaaacaaaagactgagaatcagcagaagtccacgaacgtggtgtatcaggcccaccacgtttctaggaacaaacgcggccaggtggtgggaactagaggcgggttcaggggatgcactgtgtggctaactgggctgagcggcgccggcaaaaccacaataagtttcgcacttgaggaatacttggtttcccatgccattccttgttattctctggatggcgacaacgtccgacatggactgaacaggaatttgggtttttcccctggtgacagagaggagaatattcgtcgcatcgcagaagttgcaaagctcttcgcagatgcaggtcttgtgtgtatcacaagcttcatctccccattcgcaaaggatagagagaatgctagaaagattcatgagtctgctggcctgccttttttcgagatatttgtggacgccccgctgaatatctgcgaaagtagagatgtgaaaggcctgtacaagagggcaagagcgggggaaattaagggcttcacgggtatcgattcagactacgagaagcctgaaacacccgaaagagtcctgaaaaccaatctttctaccgtgagtgattgcgtgcaccaggtcgtagaattacttcaggaacagaatattgtgccctacaccattatcaaggacatccacgagctgtttgttcctgagaacaaactagaccatgtacgggcagaggccgagacattaccgagcctgtctatcacaaaactggatttacagtgggttcaagttctgtcagagggctgggctacacctctgaaagggtttatgcgcgagaaagaatatctccaggtgatgcacttcgacaccctgcttgacggtatggctcttccagacggggtgatcaatatgagcatccccatcgttctgcctgtgtccgccgaagacaagacacgcctcgagggatgcagtaaattcgtactcgctcacggaggtcggagagtggccattctgagagatgccgaattctacgagcatcgtaaggaagaacggtgttcccgggtttggggaacaacatgtactaagcacccccacatcaaaatggtgatggaaagtggagactggctagttgggggtgatctgcaggtgctcgagaagattcgctggaacgatggacttgaccaatatagactgacacccctcgagctgaagcagaagtgcaaagaaatgaacgccgacgccgtgtttgccttccaactgcgtaatccagtccacaacgggcacgcactgctgatgcaggatacacggcgacggctacttgaacgtgggtacaagcatccagttctgctcttgcaccctttaggaggctggacgaaggacgacgacgtgcctctggactggcggatgaagcagcatgccgctgttctggaagaaggggtgcttgaccccaaaagtaccattgtagccatcttcccatcgccaatgctgtacgctgggcctactgaagtccaatggcattgtcgctcgagaatgattgccggggcaaatttttatattgttgggagggacccagcaggcatgcctcaccccgagaccaaaaaagatctgtatgagccaacccacggcgggaaggttctttctatggcaccaggattgacatctgtggaaatcatcccattcagagtagcagcgtacaacaaggctaagaaggcaatggacttctacgatcccgcccggcacaacgagtttgactttattagcgggaccagaatgcgaaagctagcccgagaaggggagaatcctcccgacgggttcatggcccccaaggcatggaaggtactgaccgactattatcgctctctagagaaaaactag

SEQ ID NO: 106524 - DNA, 1503 bp, Artificial Sequence
  Description of Artificial Sequence: Synthetic coding sequence
atggcaagcatgctgctggctcagagactggcctgttctttccagcatagctatcgcctgctggtgccagggagtcgccacatctcacaggccgccgcaaaagtggacgttgaatttgattacgacggccccctaatgaaaaccgaggtgccaggtcctaggtctcaggagttgatgaaacagctgaatattatccaaaatgccgaagccgtacacttcttttgcaactacgaggagtctaggggaaactatttggttgacgttgatgggaacaggatgcttgacctttacagccagatttcttcggtgccaatcggctattcacaccccgccctgttgaagctcatacagcagccccagaatgcctctatgtttgtcaacaggccggcactagggattctcccccccgagaattttgttgaaaaattgcgccaatccctgctgtcagtggcaccgaagggaatgtcccagctcataacaatggcttgcggttcttgcagtaacgaaaatgccctgaagactatcttcatgtggtaccgatccaaggaaaggggccagcgggggttttctcaggaggaactggagacatgtatgattaaccaggccccgggatgtccagattattctatcttgagctttatgggcgcctttcatggcaggacaatgggatgcctagcaactacccactccaaagcaatccataagatcgatattccatccttcgattggcccattgcaccatttcctcggctgaaataccctctggaggaattcgtaaaggaaaaccaacaggaggaagcaagatgtcttgaggaggttgaggacctgatagtgaagtatcgcaagaagaagaagaccgttgcaggaattattgtcgagcccatacagagtgaagggggagacaaccacgccagtgatgatttcttccggaagttgcgagacatcgcacggaagcatggttgtgccttcctggttgatgaagtgcagactgggggcggatgtactggcaaattttgggctcatgagcactggggcttagatgatcctgctgatgtgatgacgttttcaaagaagatgatgactggtggcttcttccacaaggaggaatttcgccccaatgccccttacagaatcttcaatacctggctgggtgatccctctaaaaacctgctacttgcagaggtgattaatatcattaaacgcgaagatctcttgaacaatgcagcccacgccggcaaggccctactcaccggcttactggacctgcaggcgcggtatcctcaatttatcagccgcgtgaggggcagaggcacattctgttcctttgacacccctgacgactctattcgcaacaaactgattctcatcgccagaaataaaggcgtggttcttggagggtgtggggataaaagtatcagatttagacctactctggtgttccgcgaccaccacgcccacttgtttctgaacatcttctctgatatccttgcggatttcaagtag

SEQ ID NO: 106525 - DNA, 1503 bp, Artificial Sequence
  Description of Artificial Sequence: Synthetic coding sequence
atggccagcatgctgcttgcccagcgtcttgcctgctccttccagcactcttaccggttgctcgtgcctgggtctaggcacatctcacaagctgccgctaaagtggacgtggaatttgattacgatgggccgctgatgaagaccgaggtgcctgggccacggtcgcaggaactcatgaaacagctcaatatcatccagaatgccgaagcagtgcacttcttttgcaattacgaggagagtcgaggaaactacctggtggatgtggatggcaatcggatgctggatctctattcccagattagctccgtccccattggatattctcaccccgctcttctgaaactgatccagcagccgcagaatgcaagcatgttcgtaaaccgccccgctctcgggattctgccacctgaaaattttgtcgaaaagctgcgtcagtcattattgagcgtggctcctaagggtatgtcccagctgataacaatggcatgcgggtcatgcagcaacgaaaatgcgcttaagactattttcatgtggtatcgaagtaaggagcgcggacaaagagggttctctcaagaagagctggagacttgtatgatcaaccaagctccaggttgtcccgattacagcatcttgtccttcatgggtgctttccacgggcgtacaatgggttgtctggcaacaactcactccaaggcaatccataaaatcgatattcctagttttgattggcccatagctccattccctaggcttaagtatcctctggaggaattcgtgaaagagaatcagcaagaagaagctcgctgtctggaggaagtagaagacctgatcgtgaagtataggaaaaagaaaaaaacggtcgcgggaataatcgtcgagcccattcaaagcgaaggaggagataaccacgcatcagatgacttcttccggaagttgcgcgatatcgctagaaaacacggatgtgccttcctggttgatgaagtgcaaacaggtggcgggtgcacgggaaagttctgggcacatgaacactgggggttggatgatccagcagacgtgatgacattcagcaagaagatgatgacgggtgggtttttccataaagaggagtttaggcccaacgctccctaccgaatctttaatacctggttgggcgatcccagcaagaatctgttgttggctgaagtgatcaatattataaaacgagaggacctcttgaacaatgcagctcacgctgggaaggctctgttaacagggttgctcgacctgcaagcccgatacccccagtttattagtagagtgcgcgggcgaggcacattctgcagctttgatacacccgatgatagtatcaggaacaagctaattctcatagcccgcaataagggcgtggtgcttgggggatgcggggataagtctattaggttccggcccaccctggtgttccgtgatcatcacgctcacctgttccttaacatcttttccgatattttagcagacttcaaatag

SEQ ID NO: 106526 - DNA, 1503 bp, Artificial Sequence
  Description of Artificial Sequence: Synthetic coding sequence
atggcttcaatgctgttggctcagcgcctggcctgctcattccagcactcttatagattactcgtccccggatccagacacatctcccaagccgccgccaaagtggatgtcgagtttgattatgacggccccctcatgaagactgaagtgcccgggccccgcagccaggaactgatgaagcagttgaatatcatacagaatgccgaggctgttcactttttctgcaattacgaagagtccagaggcaattatctcgttgatgtggatggcaaccggatgctggacctgtacagccagatctcctcagttcctattggctatagtcacccagctctgcttaagcttattcaacagccccagaacgcctccatgtttgttaatagacccgcgctgggcattttgcctcctgaaaacttcgttgaaaaacttcggcaaagcctactgtccgttgccccgaagggaatgagccagctcataacgatggcctgcgggagctgctccaatgaaaacgctctaaagactatattcatgtggtacagatcaaaggagagaggacagcgtggctttagtcaggaggagctggaaacttgcatgatcaatcaggccccgggctgccccgattactcaatcttatcctttatgggggcattccatggaaggacaatggggtgcctggccacaacacactccaaagcaattcacaagatcgatattccctcctttgactggccaattgctcccttcccgcgcctgaaatatcccctagaagagttcgtcaaagagaaccagcaggaagaggccagatgcttggaggaggtcgaggatttaatcgtgaagtatcgcaagaagaaaaaaactgtcgcagggatcatagtcgaacccatccagagtgagggaggcgacaaccacgcgtccgacgacttctttcgtaaactgagagatattgcacgcaagcatgggtgcgcatttctggttgatgaggttcagaccggcggagggtgcactggtaagttctgggcacacgaacattgggggcttgatgaccctgccgacgttatgacctttagcaagaaaatgatgaccggaggctttttccacaaagaggagttccggcccaatgcaccatacagaatttttaatacctggcttggagatccaagcaaaaacctgctgctggccgaagttatcaacattatcaaacgggaagacttacttaacaatgctgcccacgctggaaaggcgcttctcacaggattactcgacctccaggcccggtatccacagttcatctccagggtccgcggcagaggcaccttttgttcttttgacacccctgatgactccataagaaacaagctcattctcattgccagaaacaaaggcgtggtgctgggtgggtgcggagacaaaagcattcgtttcaggcctactctggtgtttagagatcaccacgcccacctgttcctaaatatcttctcggacatcctcgccgacttcaaatag

SEQ ID NO: 106527 - DNA, 462 bp, Artificial Sequence
  Description of Artificial Sequence: Synthetic coding sequence
gtggatatggatggggtgctagccgacttcgaagctggcctgctgagaggttttcggcgccgtttcccagaggagccacatgtgcccttagagcaacgacgaggtttcttggccagggaacaatatagagctcttaggcccgatctggcggataaggtcgcttccgtgtatgaggctccaggcttcttcctggatctggagcctatccctggggcactcgatgcggtgcgggaaatgaatgacctacccgatacccaagtctttatttgcacttcgccactgctaaaataccaccattgcgtgggggaaaaggaggaaacgccctcctgggagcatatcctgttcacctgctgccataatcggcacctggtgttgcctccgaccaggaggagattgctgtcttggtctgataactggcgggagattctagactcaaagcggggcgccgctcagagagaatag

SEQ ID NO: 106528 - DNA, 606 bp, Artificial Sequence
  Description of Artificial Sequence: Synthetic coding sequence
atggcacgatccgtgcgagtcctcgtggacatggacggtgttctcgccgacttcgaggcgggcctgctgcgtggtttccggcggcgctttcccgaggagccccatgtgcccctggagcagagaaggggattcctggcacgcgagcagtaccgcgccttgagaccggatttagctgacaaggtggcgtccgtatatgaggcacccgggtttttcctcgacctcgaacctattcctggtgcgttagatgccgtgcgcgagatgaatgacctccccgacactcaagtctttatatgcactagccctctgttgaaataccaccactgtgtgggagaaaagtatagatgggtggaacagcacttaggcccgcaatttgtggagcgcattatcttgacacgggataagacagtggtgttaggggatctcctaattgatgacaaggatactgtgcggggacaggaggaaactcctagctgggaacacattctatttacctgctgccataataggcatctcgtgctaccgcccacacgccggcggttactctcgtggagcgacaattggcgcgaaattctcgattcaaagagaggcgccgctcagcgggaatag

SEQ ID NO: 106529 - DNA, 687 bp, Artificial Sequence
  Description of Artificial Sequence: Synthetic coding sequence
atgattcggttgggcggatggtgtgctaggcggctgtgtagcgccgctgttcccgccggacgtaggggtgcagcgggaggactgggtctcgccgggggccgagccctgagggtactcgtggacatggacggtgtgctagctgactttgaaggtggctttctcagaaagttccgggctagattcccagaccagccattcatcgcgctggaggatcgacggggcttttgggtgagcgagcagtatgggcgcttgagacccggacttagcgagaaggcaatttctatctgggaatcaaagaatttcttctttgagctggagcctctgcctggtgcagttgaggcagtgaaggagatggcttctttacagaataccgacgtgttcatatgtacatctccaattaagatgttcaagtactgtccgtacgaaaaatacgcttgggtcgagaaatatttcggaccggattttctcgaacagattgttttaacacgggacaagacagttgtgagtgcagacttactgattgatgatagacctgacataactggagccgaacccacccctagttgggagcatgtgctgttcactgcctgccataaccagcatctgcagctgcagcccccaagaagaagactgcatagctgggcggacgactggaaagctatcctggactctaaacgcccctgctag

SEQ ID NO: 106530 - DNA, 720 bp, Artificial Sequence
  Description of Artificial Sequence: Synthetic coding sequence
atgataagactcggcggatggtgtgcaagacggctgtgctctgcggcagttcccgccgggcgtaggggcgcagctggcggcctcgggttagccggcggtagagcccttagggtgttggtagatatggatggagtgctggccgacttcgagggcggttttctgcgtaagttcagggcccgatttcctgatcaaccatttattgccctcgaggataggcggggcttctgggtaagcgaacaatacgggaggctaaggccagggctgtcagagaaagcaattagtatttgggaatccaaaaatttttttttcgagctcgaaccccttcctggagccgtggaagcagtgaaggaaatggcctccctgcagaatactgatgtttttatctgcacctccccgattaaaatgttcaagtactgcccttacgagaagtacgcctgggttgagaagtactttgggccagatttccttgagcagattgtgttgacacgtgacaaaaccgtggtaagcgctgacctcctgattgatgaccgacctgatatcacgggcaaccagcccccggccggtagcatgtcgagttctccccctgctactacctccacatgtagctgttcacctcctgccgcagggtgtaccagagggaggaccacgggaaggcctttctggaccgcaagcggacccgcagagctggattgtgcctctgggagttccgtgggcttgtag

SEQ ID NO: 106531 - DNA, 2853 bp, Artificial Sequence
  Description of Artificial Sequence: Synthetic coding sequence
atgggcgtgcccgctttcttccgatggctctcccgcaaatacccatccattatcgtaaattgtgtggaggagaagccaaaggagtgcaatggcgtaaagattcccgtggacgccagtaagccaaatccaaatgacgtggagttcgataatttatatctggacatgaatggtattatccacccctgtacccaccctgaagacaaaccagcacctaaaaatgaagacgagatgatggtcgccatattcgagtacattgatcggttgttttccatcgtccgcccacgccgactcctttatatggcaatcgatggggttgcccctagggcaaaaatgaaccagcaaaggtccaggagattccgggcatctaaggaaggcatggaggccgccgtggagaaacagcgtgtgcgcgaagagatactcgcaaagggcgggttcctcccgcctgaggagattaaagaaagatttgattccaattgtattacccccggcaccgaatttatggataatctggccaagtgccttcggtactatattgccgacagattaaataacgacccggggtggaaaaacttaactgttattctctcagacgcctccgccccaggcgagggcgaacataagattatggactatatacggcgtcagcgggcccagccgaaccatgatcctaacactcatcattgcctgtgcggtgcggacgccgatctgataatgttgggactggctactcatgaacccaattttaccataatccgggaggagttcaaacctaacaagcccaagccttgcggactctgcaatcagttcggccacgaggttaaagattgcgaagggctaccacgggaaaagaaaggaaagcacgatgaactggcagatagtttgccctgcgcggagggcgagtttattttcctacgcttgaacgtcctgagagagtatcttgagcgtgagctgacaatggccagcctcccattcactttcgacgttgaaaggagcatagatgactgggtctttatgtgctttttcgtgggaaacgatttcctcccgcacctcccttcgttggaaattcgagaaaacgcgatagacaggttggtcaacatatacaagaacgttgttcacaaaaccggaggatacttgaccgagtccggatacgtgaatctgcagcgcgtgcagatgattatgcttgcagttggggaagtggaggattccatcttcaaaaagcgaaaagacgacgaggactcttttcggaggaggcagaaagaaaaaagaaaacgcatgaaacgcgaccagcccgcgttcactccaagcggcatcctcacaccacacgcccttggcagccggaacagccccggaagtcaggtggcatccaatccacgacaggctgcctacgaaatgaggatgcagaacaattctagtccttccatcagcccaaatacatcatttacctctgacggctcacccagccctttgggggggattaaacggaaagccgaggatagtgacagcgagcccgaacccgaggacaatgtgaggctatgggaggccggctggaaacagagatactataaaaataaattcgacgtggacgccgccgacgagaagtttcgacgcaaggttgttcagtcttacgttgaagggctgtgttgggtattgcgatattattatcagggctgtgcatcctggaaatggtactaccctttccactatgcaccattcgccagcgactttgagggaatcgccgatatgccctctgattttgaaaagggcacaaaacctttcaagcccctggaacagttgatgggagtttttcccgccgcctctggaaacttcctccccccttcctggagaaagttgatgtccgatccagattcttcaatcattgacttttacccagaggacttcgctatagacttgaatggcaagaagtacgcctggcagggtgtcgcgctcctgccatttgttgacgagaggcggttgcgagcagccctggaagaggtgtacccagatttgactcctgaggaaactcgacggaactcccttgggggggacgttctgttcgtggggaaacaccatccactacacgacttcattctcgaactttaccagacaggcagtactgagcccgtggaagtacctccggagctatgccacggcatccaaggtaaattttcccttgatgaagaagccatcttaccagaccaaatcgtgtgttcccctgttcccatgctgcgggacctcacccagaacactgtcgtgagcattaacttcaaggacccacagttcgcagaagattatatctttaaagcagtgatgctccccggcgctcgcaagcctgcagccgtccttaagccctccgattgggaaaaatctagcaatggccgccagtggaagcctcagcttggctttaatagggaccggagaccagttcacctcgatcaggccgccttcaggacgcttggacacgttatgccgaggggaagcggaactggtatttactcgaacgctgcacctcccccagtgacctaccagggcaacctttacaggccgctgctgagaggccaggcgcagatcccgaagttgatgtccaacatgaggcctcaggacagctggaggggcccacctcccctgtttcagcagcagcgttttgatagaggggtcggagctgagcctctgcttccttggaaccgcatgctccaaacgcaaaatgccgcctttcagccgaatcaatatcaaatgctggccggacctgggggttaccctccccgccgagatgacaggggtgggagacaaggctacccacgggaaggaagaaaatatcccctaccacctcctagcggacggtataattggaattag

SEQ ID NO: 106532 - DNA, 2625 bp, Artificial Sequence
  Description of Artificial Sequence: Synthetic coding sequence
atgatggtggcaatcttcgagtacattgaccgtctgttcagcattgtgcggccgagaagactattgtatatggctatcgatggcgttgcaccaagggccaagatgaaccagcagaggagccggcgattccgtgcctcaaaggaggggatggaagccgctgtagagaagcagagggtgagggaagagatcctggctaagggggggttccttccacctgaggaaattaaagaacgcttcgattccaactgtattacaccgggaaccgaattcatggacaacctggctaagtgcctccgctactacatcgcagatagactgaacaacgacccgggttggaaaaatctgactgtgatactgtctgacgcatctgctcctggcgaaggagaacacaagattatggattatatacgtcgccagagggcgcagcctaatcatgacccgaacacccatcactgcctatgtggcgcggatgcagacctgataatgttagggctagccacccatgagccaaacttcacaattatccgcgaggaatttaaaccaaacaagcccaaaccatgcggcctctgcaaccagttcggtcacgaggtgaaggattgcgagggcctcccaagggagaagaagggtaagcatgatgagttggctgattccctcccttgtgccgaaggggagttcatcttcctgcgcctgaatgtgctgcgtgaatacctagagcgtgaactgaccatggctagcttgccctttacttttgatgtggaacgctctatcgatgattgggtcttcatgtgcttcttcgtgggtaatgactttttgcctcacctgcccagtttggagatcagagagaacgccatcgacaggctggtcaatatctacaagaacgtcgtacacaagactggcggatatctcacggagtctggctatgtgaatctgcaacgcgtccaaatgattatgcttgctgttggggaggtcgaggatagtatattcaaaaaaaggaaggacgacgaagactccttcaggagacgacagaaggaaaaacgcaaacgaatgaagcgtgatcaacccgcatttacccctagcggcatcttgacgccccatgcactaggaagccgtaattcccctggttcacaggtcgcctccaaccccaggcaggcagcttacgagatgagaatgcaaaataattcatcacccagtatctcacctaacacatcatttacaagtgacgggtctccttcgcctctgggggggatcaagagaaaggcggaggattcggactccgagccagagcctgaggacaatgtccgtctgtgggaggcgggctggaagcagcggtactacaagaataagttcgacgttgatgcggctgacgaaaaattcaggagaaaggtcgttcaatcttatgtggaaggcctatgttgggttctgcgatactactaccagggctgcgcatcttggaagtggtattatccttttcattacgctcccttcgccagcgatttcgagggcatcgcagatatgcccagcgattttgagaagggcactaagccgttcaaaccactggagcaactcatgggggttttcccagccgcatctggaaacttccttcctccctcttggagaaagttaatgtctgaccccgattcttccattatcgatttctatcctgaagattttgcgatcgatctgaatggtaagaaatacgcttggcaaggcgtggcgttgctgccttttgttgatgagcgtcgtctgagagccgcccttgaagaagtgtatccagacttgacccctgaggaaacccggagaaattccctgggcggcgacgtcctgttcgtgggcaagcaccatcctctgcacgactttatcctggagctctaccagactggcagcactgagccagtcgaagtacctcccgagttgtgccacggaattcagggcaagttctcactcgatgaagaagctatcctccccgaccagatcgtttgcagccccgtgccaatgttacgcgaccttacccaaaacacagtggtgtccattaatttcaaggacccgcaattcgctgaggactatatctttaaggccgtcatgctgccaggcgctcgcaagcctgcagctgtgctgaagccgagtgactgggagaaatcttctaatggccggcagtggaagccccagctgggcttcaatagagataggagacccgtgcacctcgaccaagctgccttcaggacgctggggcatgttatgccgcgcggcagtgggacgggtatatacagcaatgccgcacccccacctgtcacgtatcagggcaacctctacagaccactgctccgcggtcaggcacagatccccaagcttatgtcgaacatgcggccacaggactcctggagaggtcccccacctctcttccagcagcagcgcttcgatcggggggtgggcgccgaaccactgttgccgtggaataggatgcttcaaactcagaacgcagcattccagccaaatcagtaccaaatgttagcggggccaggtggatacccaccgcgtagagatgacaggggtggccgccagggatatcctagagagggccggaaataccccctgccacctccttcaggccgctacaactggaactag

SEQ ID NO: 106533 - DNA, 2691 bp, Artificial Sequence
  Description of Artificial Sequence: Synthetic coding sequence
atgaatggaatcattcatccctgcactcatccggaggacaagccagctcccaaaaatgaagatgagatgatggtggcaatcttcgaatatatcgatagacttttctccattgtccgcccacgtcgcctgctttatatggccatcgacggcgtggccccccgcgccaaaatgaaccagcaacggtcaagacgctttcgcgcctcgaaggagggcatggaagcagctgtggaaaaacagcgtgttcgggaagagatcttggctaagggtgggttcctgccccccgaagaaattaaggaacgcttcgattctaactgtataacgcccggtaccgaattcatggataacctggccaaatgccttcgttattacatcgcggaccgccttaacaacgaccccggatggaagaacctcaccgttattctgtctgatgcctctgccccaggtgaaggggaacataagatcatggactacattcggagacaacgtgcacagcctaaccacgaccctaatacccaccactgcctctgtggtgctgatgccgatctgatcatgctgggtctggccacccacgagccaaattttacaataattcgtgaggaattcaaacccaataaaccgaaaccatgtggactgtgcaaccaatttggccatgaggtaaaggactgcgagggcctcccaagggagaagaagggaaaacacgacgagctagccgacagtctgccctgcgcagagggagagttcatttttctgagactgaacgtgttacgcgaatacctggagagggaattaacaatggcctcactcccatttactttcgatgtagagcgatctattgatgattgggtctttatgtgcttttttgtgggtaacgactttctcccccaccttccaagtttggagatcagagaaaatgctattgacagactggttaatatttacaaaaatgtcgtgcacaagaccgggggataccttactgagtccggttatgttaatcttcaacgggtgcaaatgatcatgcttgccgtgggtgaggtggaggactccatttttaaaaagaggaaggatgacgaagatagcttccgccgaagacagaaggaaaagaggaagaggatgaagcgtgatcagcctgccttcaccccaagtgggattcttacaccacatgcgttggggtcacggaatagtcccggaagccaggtagcctccaaccctcgtcaggcagcatatgaaatgcgcatgcaaaacaactcgtctccatccatttctccaaataccagtttcacctccgacggctcaccttccccgctgggcggaattaagagaaaggcagaagactcagactccgagccagaaccggaagacaacgtccgtctctgggaagcgggctggaagcagaggtactacaaaaataagttcgacgtggatgctgctgatgaaaagtttcggcgcaaggtggtgcaaagctacgttgaaggactgtgttgggtcctcaggtattattatcaggggtgtgcaagctggaaatggtactaccctttccattacgctccgttcgccagcgacttcgaaggaatagccgatatgccttccgatttcgagaaggggaccaaacccttcaagcccctcgagcagctcatgggtgtcttccccgctgcctctggaaatttcctgcctccaagctggcgcaagttgatgagcgacccggattcttccatcatagatttctatcccgaggatttcgctatagatctgaatggcaaaaaatacgcttggcagggggtggccctgctgccttttgttgacgagcggcgcctccgcgctgctctagaggaagtgtatcctgacttgaccccggaagaaacccggaggaacagcctcggcggagacgttctttttgtgggtaagcaccacccactgcatgacttcatcttagaactctatcagaccggtagtactgaacctgtcgaggtccccccagagctgtgccacgggatccagggcaagttctctcttgatgaagaggcgattctgccggaccagatagtctgttcccccgttcctatgcttcgcgacctcacccagaacactgtcgtcagtatcaactttaaagacccccagtttgctgaggattatatctttaaagctgtgatgctgccaggtgccagaaagcccgcagccgtgctcaagccaagcgattgggaaaaatcatccaatgggcggcagtggaagccgcagcttggcttcaatagagacaggaggcctgtgcacctggaccaggctgcatttcgaacactggggcacgttatgccgagggggtccgggactggcatatacagtaacgccgccccacctcccgtcacttatcaaggaaacctctatcgacctctcctgagaggacaggctcagatccccaagttaatgtcaaacatgaggccacaggatagctggcggggcccacctccacttttccagcagcagcgcttcgaccgcggggtgggagccgagcctctattaccctggaatcgtatgctccagacccaaaacgctgcattccaacccaatcagtaccagatgctcgcaggaccgggaggttacccaccacgacgcgatgaccgcggtggtcggcaaggttatccacgggagggacggaagtaccctcttcccccaccatccggccgttacaattggaactag

SEQ ID NO: 106534 - DNA, 1779 bp, Artificial Sequence
  Description of Artificial Sequence: Synthetic coding sequence
atggctccaggccagctcgccctgttctccgtgtcagacaagaccggtctggtggaattcgcccggaacttaaccgccctgggcctgaaccttgtggcttctgggggaacagcgaaggctctccgtgatgccgggctggctgtgagggatgtctctgaactgactggattcccagaaatgctaggcgggagagtgaaaactctccaccccgcggtgcacgcgggcatcttggcacggaatatcccagaggacaacgcagatatggccaggctagactttaacttaattcgggtggtcgcctgtaatctttatccattcgtcaaaacagtcgcaagccctggtgtgactgtggaggaggctgttgaacagattgatatcggtggagtgaccctgttgagggctgccgcgaaaaatcacgccagggtcactgtcgtgtgcgagccagaggactatgtcgtggtttcaactgagatgcaaagtagcgagagcaaggacacatcccttgaaacccgacggcagttggccctgaaggccttcacacatacagcccaatacgatgaggcaatcagtgactacttccgtaagcagtattccaagggagtaagtcaaatgccactgagatacggcatgaaccctcaccagacgcctgcccaactttacacactgcagccaaaactaccgatcaccgttctgaatggtgctccgggctttattaacctctgtgacgctctgaatgcctggcagttggttaaggagctaaaggaggcactgggaatcccggccgccgcctcttttaaacacgtgagtcctgccggcgccgccgtcggtattcctctgagcgaggatgaggcgaaggtctgtatggtgtacgacctgtacaagaccctcacccccatcagtgcggcctatgctagagccagaggtgccgaccgaatgtcctctttcggggactttgtcgcgctctccgatgtatgcgacgtgccgacggctaagattatatcgcgcgaggttagcgatggcatcattgctccaggatacgaagaagaagcactgaccatattgtcaaagaagaagaatggcaactactgcgtcctgcaaatggatcagtcctataagccagatgagaacgaggtgagaacactctttgggctacacctgagtcagaagagaaataacggtgtggttgacaaaagcctttttagcaacgtcgtcaccaaaaacaaggatcttccagagagcgctctgagggatctcatagtggcgacgatcgcagtgaagtacacccagtcaaattccgtctgttacgctaagaatgggcaagttataggaattggggccgggcaacagtcacggatccattgcacacggcttgcaggtgacaaagcaaactattggtggctgcggcaccatccccaggtcctctccatgaagtttaagactggggtgaagcgcgccgagataagcaacgccatcgatcaatacgttaccggcaccattggagaagatgaggatctgatcaagtggaaagcccttttcgaggaggtgcccgagctcctaactgaggcagagaaaaaggaatgggtggaaaagcttaccgaagtgtccatttccagcgacgccttcttcccatttcgggataatgtcgatagagcaaagcggtcaggagttgcttatatcgcagcaccctctggctctgccgccgacaaggtggtcatcgaggcctgcgacgagctagggattattctcgcccacaccaaccttcgtcttttccatcactag

SEQ ID NO: 106535 - DNA, 1602 bp, Artificial Sequence
  Description of Artificial Sequence: Synthetic coding sequence
atgctgggaggacgggtcaagactttgcaccctgccgtgcacgctgggatcctggccaggaacattcctgaagacaacgccgatatggcgaggctggattttaacctgatacgcgtcgtggcttgcaatctgtacccgttcgtcaagaccgtggcgagtccaggtgtaaccgtcgaggaggccgtagaacagatcgacatcggcggtgtcacccttcttagggcagccgccaaaaatcatgccagagttacagtggtttgcgagcccgaggattatgttgtcgtttcgacggaaatgcagtcctccgaaagcaaagatacatccctggagacccgacggcagcttgccctcaaagcatttacacacacagcacaatatgacgaggcgattagcgactactttagaaaacagtactctaaaggcgtcagtcagatgccccttcgctatggcatgaatccacaccagactccagcccagctgtataccctccaaccaaaactccctatcaccgtgctgaatggcgctccaggcttcatcaatctgtgtgacgctctgaacgcatggcagttggtaaaggagcttaaggaggcactggggatcccagccgccgcctcctttaagcacgtttctcccgccggagccgctgttggcattcctctcagtgaagacgaagctaaagtctgcatggtttacgacctgtacaagaccctcacacctatcagtgctgcctatgcaagggccaggggtgccgacaggatgtcatccttcggagacttcgtggccttatcggatgtgtgtgatgtgccaactgcgaaaattatatctagagaggtgtctgacgggatcattgcacccgggtacgaggaagaggctttaaccatactgtcaaagaagaagaacgggaattattgcgttctgcaaatggatcagagttacaagcccgatgagaatgaggtgcggaccctgtttggtttgcatctgtcccagaagagaaacaacggtgtggtagataagagtctgtttagtaatgtagtcactaagaataaagatctcccagagtctgcccttagagatctgatcgtggcaactattgccgtgaaatacactcagtccaatagcgtgtgttatgcgaaaaatggccaggtcataggtataggagctggccagcagagccgtatccactgtactaggctggccggtgacaaggcaaactactggtggctcaggcaccaccctcaggttctcagcatgaagttcaaaacaggggtgaaacgcgctgaaatatccaacgcaatcgaccagtacgttaccggaacaattggcgaggacgaggaccttatcaagtggaaagctttgtttgaggaggttcctgaacttttgactgaggccgaaaagaaggaatgggtcgagaaactcacagaggttagcatcagctccgatgctttttttccttttcgcgataacgtcgatcgggccaaacggagcggggtggcctatatcgccgcccctagtggcagtgctgcggacaaggtcgtcatcgaggcttgcgacgagctgggaattattctggcccatacgaatctgcgattatttcaccactag

SEQ ID NO: 106536 - DNA, 3252 bp, Artificial Sequence
  Description of Artificial Sequence: Synthetic coding sequence
atgaaaggaacgagggccattgggtctgtgccagagcggagccccgctggtgtcgatctctcattgaccggcttaccccctccagtctcacgccggccggggtccgctgccaccaccaaacccatagtccgatccgtctcagtcgttaccggttccgagcagaagaggaaggtgctggaagcaaccgggcctggtggatcacaggcaatcaataacctcaggaggtcaaactcaacaacccaggtgagtcagcctcggagcggaagtccccgacccaccgagccaacagattttttgatgctcttcgagggttctccatcaggcaaaaaacgaccggcctccctgtctacagcccccagcgaaaagggagccacctggaacgtgctggacgatcagccccggggatttactctcccatcaaacgcgcggtcctcatctgccctggatagccctgcaggtcccagaagaaaggagtgcactgtggccctcgcacccaattttaccgcaaacaaccgcagtaataagggggctgtcggaaactgcgtgactactatggtgcacaatcggtataccccttccgaaagagcacctccccttaaatcttccaatcagaccgctccatctctcaataacattatcaaggccgcaacctgtgagggcagtgagtctagcggttttggcaagcttcctaaaaacgtgagctccgctacccattccgcaagaaacaacactggcgggagcacaggactgccccggaggaaagaagtaaccgaagaagaggcagaaagattcatacaccaggtgaatcaagctacagtcaccatccaacgctggtatcggcaccaggttcagcgaagaggggcgggcgccgcgcgcctggaacaccttctgcaggccaaacgtgaagaacagcgccagaggagcggcgaaggaacactgctggacctgcaccagcaaaaggaggcggccagacgcaaggctcgggaggaaaaggccagacaagcccgaagggcagctatccaggagttgcaacagaaacgcgcactgagagctcagaaggcttctaccgccgagcggggtcctccagagaatcctagagaaacccgcgttcctggcatgagacagccggcacaagaactgagccccacacccggagggacagcgcaccaggccctgaaagctaataataccggcgggggactgcctgccgcaggtccaggagacaggtgcttacctacatctgattcatcaccagaaccccaacagcctccagaggataggacccaggatgtccttgctcaggacgctgccggagacaacttagagatgatggccccctcacggggcagcgcgaagagccgggggcccttggaggagctgctccacactttacagttgctcgaaaaagaacccgatgttctgccccgcccccgcactcaccaccgaggcagatacgcatgggccagtgaggttactaccgaggacgacgctagttcgctcactgcagacaacctcgaaaagtttggcaaattgagtgcattcccagagcctcccgaagacgggacactactttccgaagctaagctgcagagcataatgtccttcttagatgagatggagaagtcgggccaggatcagttggattctcagcaagagggctgggtacccgaggcggggcccgggcctctggagctcggctcagaggtttctacaagtgtgatgaggcttaagttggaagtcgaagagaaaaaacaggccatgctgctcttgcagagagctttggcgcagcagagggacctcaccgccagacgcgttaaggagaccgaaaaggccttgtcgcggcagctccagaggcagcgagaacactacgaggcgactattcagagacatctggcctttattgatcaactaatagaagacaagaaggtcttaagtgaaaaatgtgaggcggtggtggctgagctgaagcaggaagaccagaggtgtactgaaagagtggcccaagcacaggcacagcacgaattagagattaagaagcttaaggaactgatgtccgccaccgaaaaggcccggagagagaagtggatcagtgaaaagactaagaagatcaaggaggttaccgtaagaggacttgagcctgagatccagaaactgatagctcgccataagcaggaggtaagaaggctgaagtcacttcacgaagctgagctgttgcagtccgacgagagggcaagtcagcggtgccttagacaggccgaggagctgcgcgagcagctggaaagagaaaaggaagcgcttggccagcaggagcgagagcgcgcgcgccaacgttttcagcagcaccttgaacaggagcaatgggccctgcagcagcaaaggcagagactgtacagtgaggtggctgaagaacgggagcgactaggtcagcaggcggcccggcagcgggccgagctggaagagctgagacagcaactagaggagagtagcagtgccctgacccgcgctctgagggctgaattcgaaaaaggacgcgaggagcaagaaaggaggcaccagatggagttgaacactcttaagcaacagctcgagctggagagacaggcatgggaagctggtaggacccggaaggaagaagcatggctgctgaaccgggagcaagagctgcgtgaggaaattagaaaggggcgtgacaaggaaatcgagcttgtgatccaccgactggaagccgatatggcacttgctaaagaagagagcgaaaaggccgcagagtctaggatcaaaagactgagggacaagtacgaagcagagctatccgagttggaacagtctgagaggaagttgcaggagaggtgtagcgaactgaaaggacaacttggggaagcagaaggggaaaacctgaggcttcaaggactcgtcaggcaaaaggaaagagcacttgaggacgcccaggcagttaacgagcaactgagcagcgagcgtagcaatttagctcaagtgatccgacaggaatttgaggatcgactcgcggcctcagaggaagagactcgacaggctaaggccgaactggccaccctgcaggcccgtcagcagctggaattggaagaggtgcatcgccgcgtgaaaaccgccttggcccgaaaggaggaagccgtgtctagcttacggacccagcatgaagcggccgtcaagcgtgccgaccatctagaggaactgctggagcagcatcggcgcccgacccccagcactaaatag

SEQ ID NO: 106537 - DNA, 3135 bp, Artificial Sequence
  Description of Artificial Sequence: Synthetic coding sequence
atgaaaggaacacgagctatagggagtgtacccgaaagaagtccagccggagtggacctgagcctgaccgggctgccccctccggtgagccgccgccctgggagtgcagctacaactaagcccattgtcagatcagtgagcgtagtgaccggatccgagcaaaagcgtaaagtgctggaagctaccggccccggagggtcccaagccatcaacaatttaaggcgatccaactccaccactcaggtctctcagccacggtctggctcgcctcggcccactgagccaaccgatttcctcatgcttttcgaaggatccccttctgggaagaagagaccagccagtttaagcacagcccccagcgagaagggtgcaacttggaacgtgctggatgaccaacctcggggattcactttacccagcaatgctagaagctcatctgccctggactcccccgccggaccgcgtagaaaggagtgcacggtggctctagcacccaacttcaccgccaataacagatctaataaaggggccgtcgggaattgcgtcacgactatggttcataaccggtatactccctctgagagggctcccccactgaagtcgtcgaatcagacagcacccagtttaaataacataattaaggctgccacctgtgagggatctgaatcttccggttttggaaagctgccaaaaaacgtgtcaagtgccacgcatagcgcacgaaacaacaccggcggtagcacaggactacctagacggaaagaggtgaccgaagaggaagccgaacgattcatccatcaagtgaatcaagccaccgtgactattcaaagatggtataggcaccaggtccaacggcgaggcgccggggcagcccggctcgagcacctgctgcaagctaaacgagaagaacagaggcagcgctccggggagggtacgcttctggatctgcaccagcaaaaggaggccgctagacggaaagctcgcgaggaaaaggctcggcaagcgcgccgtgcagcaatccaggaactccagcagaagagagccctgcgggcgcagaaagcttcaacagcagaaagggggcccccagagaatcctagagagacaagggtacccggaatgcgacaacctgctcaggagctttccccgacgcccggaggcacagcccatcaagctctgaaggccaacaatactggcgggggcctaccagccgccggccctggagaccggtgcctccccacctcggacagctcacctgaaccccagcagccccccgaggacagaacccaagatgtcctcgcccaggacgccgcgggtgacaatttggagatgatggctcccagccgagggtcagcgaaaagccgcggacctctggaggagctactccacaccctgcagttgctggagaaggagccagatgtgttgccgcgtcctaggactcaccacaggggacggtacgcctgggctagtgaggaggatgacgcttctagcctcacggctgataacctagagaagtttgggaagttgtctgcattccctgaaccacctgaggatgggactttgctgtcagaagccaagctccagtctatcatgtcctttctagatgagatggagaagtcgggccaggaccagctcgactcacaacaggagggatgggtgccagaggcaggcccagggccgctggagttaggctcagaagtcagcaccagtgtgatgcggctgaaactggaggtggaggagaaaaaacaggcgatgctcttactgcagagagctctagcgcaacagagagacctgactgcaaggcgggtaaaggagaccgagaaagctctgagccgacagctccagaggcagagggagcactatgaggccactattcagcgacatttggcattcatcgaccagctgatcgaagacaaaaaagttctcagcgaaaagtgcgaagcggtggtggccgagttgaaacaggaagatcagaggtgcaccgaacgggtggcccaggctcaggctcagcacgagctggagattaaaaagctcaaggagctgatgagtgcgacagaaaaggcacggcgcgaaaagtggatttccgaaaaaaccaaaaagataaaggaggtcaccgtccgcggactggagccggagatccagaagctgatcgctagacacaagcaagaggtgagaaggctaaaatcattacacgaggcggagctgctccaatccgatgaacgggcgtctcagcggtgccttagacaagccgaagagctcagggagcaactcgaacgggagaaagaagctctgggacagcaggaaagagaacgcgcccggcagcgacaacgagccgaactcgaagagctgcgccagcagcttgaggaaagcagcagtgctctgacacgagccctgcgggccgagttcgagaagggccgcgaggagcaggaaagacgtcaccaaatggagcttaatacacttaagcagcagcttgagttagagagacaagcatgggaggccgggcggaccagaaaggaagaggcctggcttctgaaccgggaacaggaactgagggaagagatacgcaaaggcagagataaggaaatcgaactggttatccatcggctcgaagccgacatggcacttgcaaaggaagagtcagaaaaagcagccgagagcagaattaaaagactgagagataagtatgaggccgaactctcagagctcgaacaatcagagcggaaactccaggaaaggtgctcggagctcaagggacagctgggtgaagcagagggagagaacttgcgtctgcagggtctcgtgcgccagaaggagagagccctggaagacgcccaggctgtgaatgagcaactcagctccgagagaagcaatctggcccaggtgataaggcaggagttcgaagaccggctcgcagcaagtgaagaggagacgcggcaggcgaaagccgaactagccacactgcaagcacggcagcagttggaactcgaggaggttcaccggagagtaaagacagccttggctcgaaaagaagaggccgttagcagcttgaggacacagcatgaagccgcggtgaagagagcagaccatctggaagagctcctggaacaacaccggcgtcctacacctagtacaaagtag

SEQ ID NO: 106538 - DNA, 3243 bp, Artificial Sequence
  Description of Artificial Sequence: Synthetic coding sequence
atgaaggggacacgagccatcggaagcgtgcccgagaggagcccagcaggggtagatctgagcctcacaggcctgcccccccccgtctccagacgccccgggtccgcagcgaccaccaagcccattgtgcgctctgtctcggtggtcactggttccgaacaaaaaaggaaggtgctcgaagctaccggcccaggtgggagccaggctattaacaacctgcgaaggtccaactccaccacacaggtaagccaaccaaggtcaggctctccacgccctactgagccaacagactttctgatgctctttgagggctccccttccggcaagaaaaggcctgcgtctcttagtacagccccaagcgaaaagggggcaacctggaacgtgcttgacgatcagcccagggggttcacgttgccctcaaacgctcggagttcctcagcgttagactcacctgctggaccccgaaggaaagagtgcacggtcgcactcgctccaaactttacagctaataataggagtaacaagggcgcggtgggcaactgtgttacaactatggtgcacaaccgctatacgccttccgaacgtgctcccccattgaagagtagcaaccagacggcaccttcccttaacaatataataaaagccgcaacatgcgaggggtccgagagctcgggctttggtaagctaccaaagaacgtgtcttcagccacccacagcgctagaaacaacacaggtggaagtaccggcctgcctcggagaaaggaagttactgaagaggaagctgaaagatttatccaccaggtcaatcaggccactgtgacaatccagcgatggtataggcatcaagttcaaaggaggggcgccggcgccgcaaggctggagcacctactgcaagcaaaacgagaggagcagcgccagaggagtggcgaaggcacccttctggacttacaccagcagaaagaggcggctcgccgtaaggcacgcgaggagaaagcaagacaggcgcggagagcggcaattcaggaattgcaacaaaagagggccctccgggcccaaaaggcttccaccgctgagagagggccccccgaaaatccgagagagacacgcgtgcctggtatgcgtcagccagcccaggagctatccccgacacctggcggaaccgcccaccaggcactgaaagctaacaacaccggcggggggcttcccgccgccgggcctggggatcgctgtctgcctaccagtgatagctcacccgaaccacaacagccacccgaagatagaacccaggacgtgctggcacaggacgccgccggcgataatttggagatgatggccccctcccggggctccgcaaagtccaggggcccacttgaggagctacttcacacgctgcagctcctggaaaaagagcctgatgtgctgcctagacctcgcacacaccaccggggtcgatatgcctgggcaagcgaggaggatgacgcatccagcctcactgccgataatcttgagaaattcggaaaactcagtgcattcccagagccccccgaggatggtaccttgctatccgaggcaaaactgcagagcataatgagcttcttagacgaaatggagaagtctggtcaggatcagctcgactcacagcaggaaggttgggttcccgaggccggaccaggcccgcttgagctgggatctgaggtgtccactagtgtcatgaggttaaagctggaagtcgaggagaaaaagcaggccatgctgcttctgcagcgtgccctggctcagcagagggacctcacggcccgcagggtgaaagagacagagaaggcacttagtcgtcaattacagcggcagcgggaacactatgaggctactatccagcgtcacttggcattcattgaccagttgattgaggacaaaaaagtgctgtccgagaaatgcgaagccgttgtcgccgagctgaaacaagaagatcaacgctgcactgagcgcgtagctcaagctcaggctcagcacgaactggagattaaaaagctgaaagagcttatgtccgcgaccgaaaaagcccgccgtgaaaaatggatctccgagaaaacgaagaagatcaaagaagttaccgttcgggggttggagcccgagatacaaaagctgatcgcaaggcacaaacaggaggtcaggcgccttaaaagtctgcacgaggcagaactgcttcaaagtgatgaaagggcttctcagcggtgtctgaggcaggctgaagaattgagggaacagctagaacgggaaaaagaggctttgggacagcaggagcgagagcgcgcccggcaacgcttccaacagcatcttgagcaagaacagtgggcgttgcagcagcaaagacagcgcctatatagcgaggtggccgaagagagggaacgcctgggacagcaggccgcacgccagagagcggagttggaagagctcagacagcaactggaggagtctagctccgccttgacaagagccctgcgggccgagttcgagaagggtcgtgaagaacaggagcgccgtcatcaaatggaacttaacacactgaaacagcagcttgaactggaaaggcaagcgtgggaggccggtaggacccgaaaagaagaagcctggctgctcaatagggaacaggagctgagggaggagattagaaaaggcagagacaaggagatcgaacttgttattcatagactggaagctgatatggcccttgctaaagaggagtctgagaaggcggccgagtctcgcatcaaacgtctcagggataagtatgaggcggaactctctgaactggagcagtcagagcggaaactccaggaaaggtgctccgagctcaaggggcaactgggagaggcggaaggcgagaacctgaggcttcaaggactggtccggcagaaagagcgggcgctggaggacgctcaggctgtgaatgagcaactctcatctgagcggtcaaacctggcccaggtaatcaggcaggaattcgaagacagactggcagcatctgaggaggagacaaggcaggcaaaagccgagctagcaaccctgcaagctcgtcaacagctagaattggaggaggtgcacagacgagtgaaaactgctctggctcgcaaggaagaagcagtcagctctttgcgcactcagcatgaggccgccgtgaagcgggcagaccatttggaggaactactggaacagcaccgtcggcccactccaagtactaagtag

SEQ ID NO: 106539 - DNA, 699 bp, Artificial Sequence
  Description of Artificial Sequence: Synthetic coding sequence
atggacgcattggttgaagacgacatttgcatactaaatcatgaaaaggcccacaagcgcgatacggtgaccccagtatcaatatacagcggtgacgagtccgtcgcctcacactttgctctcgtcacagcctacgaggatatcaagaaacgcctgaaggattcagaaaaggagaactctctcctcaaaaagagaatcaggtttctggaggagaagctcattgcccggttcgaagaagaaaccagttcagttggaagggagcaggttaataaggcatatcacgcgtacagagaagtatgtatcgatagagacaacttaaagtccaagctcgacaagatgaacaaggataattcagaaagtctgaaggtgctgaacgagcagctacagagcaaggaggtggaactcctccagttgcgtacggaggtcgaaacccagcaggttatgcgcaaccttaatcccccttctagtaactgggaggttgaaaagctctcttgtgatttgaagatacatggcctggagcaggaactggagctgatgcgaaaagagtgttcagatttgaaaattgagctgcagaaagctaagcaaactgacccctaccaagaagataaccttaagagcagagatctccaaaagcttagtatctcgagggtgagtgtggcccagcctggcgtgcagtggcgcaatcatggaatcgcttag

SEQ ID NO: 106540 - DNA, 648 bp, Artificial Sequence
  Description of Artificial Sequence: Synthetic coding sequence
atggatgctttagttgaggacgacatttgcatcttaaatcacgaaaaggcgcacaaaagagatactgtgacccccgtctcgatctactcaggagacgagtccgtggctagccacttcgccctcgtcaccgcttatgaggatatcaagaagagactaaaggactccgaaaaggagaactctctcctgaaaaagcgcatccgcttcctggaagagaaactgatcgccagatttgaggaggaaacctctagtgtggggcgcgagcaggtgaacaaagcctaccatgcatacagagaagtttgcattgatcgtgacaatcttaagtctaaactggacaagatgaacaaagacaacagtgagtcactgaaggtgcttaacgagcaactccagtcgaaagaggtcgagttgttgcagctgagaaccgaagttgaaacacagcaggtcatgagaaaccttaatcccccatccagcaactgggaggtggaaaagttgagctgcgacctgaaaatccacggcctggaacaggagctagagctgatgaggaaggaatgctccgacttgaagattgagctgcaaaaggccaagcagaccgacccataccaagaggacaacctcaaatcccgtgatctgcagaagttgagcatatcctag

SEQ ID NO: 106541 - DNA, 288 bp, Artificial Sequence
  Description of Artificial Sequence: Synthetic coding sequence
atggacgcattggtggaagacgacatctgtatcctgaaccatgagaaggctcacaagagagataccgttactcccgtctcaatatatagtggcgacgagtctgtggcaagccattttgccctggttacagcctacgaagatatcaagaaacggttaaaggattctgagaaggagaacagcctactgaagaagaggatccgttttctggaggaaaagcttatcgcccggttcgaggaagagacttcctctgtcggtcgggaacaagtgaacaaagcctaccatgcctag

SEQ ID NO: 106542 - DNA, 732 bp, Artificial Sequence
  Description of Artificial Sequence: Synthetic coding sequence
atggacgccctcgttgaagatgacatctgcattctgaatcatgagaaagctcacaaacgtgacacagttactcccgtctcgatctactcaggcgatgagagcgtcgcatcccacttcgcgctggttaccgcatatgaggacataaagaagcgactgaaggacagtgagaaagagaatagtttgcttaagaagagaatccgattcttagaggaaaagctcatcgcaagatttgaggaagagacctcgtccgtcgggcgcgaacaagtgaataaggcttaccacgcctatagagaagtgtgcatcgaccgggataacctcaaatctaagctggataaaatgaataaggataatagcgagtcgttaaaagtacttaacgaacaactacaaagcaaagaggtggagcttcttcagctgcgcactgaagtcgagacccaacaggtcatgcggaatctgaacccaccttcatctaattgggaggttgaaaagctgtcatgtgatctgaagatccatgggttagagcaggaactagagctcatgcgaaaagagtgttccgatttgaagattgagctacagaaagcgaagcagaccgatccttaccaggaagataacctgaagtctcgtgacctgcagaagctctctatttcgcggcagtccatctgtagcacagcatggagcgctgtcgcacagagttgggacagcatgaacttcgaggactgctcactgtttgcatag

SEQ ID NO: 106543 - DNA, 732 bp, Artificial Sequence
  Description of Artificial Sequence: Synthetic coding sequence
atggacgccttagtggaggatgatatctgcattctcaatcacgaaaaggcccataagcgagatacggtgacaccggtgagcatttactccggggacgaaagcgtcgcatcacattttgcccttgtcactgcctatgaagacatcaaaaagagactcaaagactcagagaaggaaaactccctgctgaagaaaaggatccgcttcctggaggagaaactaatcgcacgcttcgaagaggagacctcctccgtgggccgagaacaggtgaacaaagcctatcatgcatatcgggaggtttgtatcgaccgggataatctgaagtccaaattggataaaatgaataaggataatagcgagtcccttaaagtcttaaacgagcagctccagtccaaggaggtcgagcttttacaactgaggacagaagtcgagacacagcaggtaatgcggaatctgaatcccccctcgagtaactgggaggtcgaaaagctatcctgcgatcttaagattcacggactggagcaggagcttgaacttatgaggaaagagtgtagcgatctcaaaattgagttgcagaaagcaaaacaaactgatccgtatcaggaagataatctgaagagtcgcgatctccagaaactgtctatcagtcgacagtctatctgtagtaccgcatggagcgctgtggctcagtcatgggacagcatgaactttgaagattgcagcctgttcgcttag

SEQ ID NO: 106544 - DNA, 1179 bp, Artificial Sequence
  Description of Artificial Sequence: Synthetic coding sequence
atggatgcactggtggaggatgatatctgtatcctgaatcacgagaaagcacacaagagggatactgtgacaccggtatcaatctatagtggagacgagagtgtcgcctcccattttgctcttgtcaccgcttatgaggacatcaagaaaaggctgaaagatagcgagaaggagaactcactgctcaagaagcgtataaggtttcttgaggaaaaattaattgcacggtttgaggaagagacctctagcgttggccgcgaacaggtgaacaaagcctatcacgcctatagggaagtgtgcatcgaccgcgacaacctgaaatcaaagctagataagatgaataaagataactcagaatcactgaaggtcctgaatgaacagctgcagagtaaggaggtggagttactacagctgaggactgaagttgagacacagcaggtgatgcggaatcttaatcccccatctagcaactgggaagtggagaaactgtcttgcgacctcaaaatccatggccttgaacaagaactggagctcatgcgaaaagagtgctctgacctaaaaatcgagctgcagaaggccaagcagacagacccctaccaggaggacaacctgaaaagcagagatctccagaagctgagcatatcttccgataatatgcagcacgcatactgggagctcaagcgggaaatgagcaacttacacttggtgacccaggtgcaggccgaactgctaagaaaactcaaaacctcaactgccattaagaaagcgtgtgcacccgtcggctgtagcgaagacttggggagggatagcacaaaactacatctgatgaattttacagccacctatacgcgccatccaccgctgctccctaatggaaaggccttgtgccacacaaccagttccccgttgcctggggatgtgaaagtgctgtcagagaaagcaatcctgcagagttggaccgacaacgaacgtagcatccctaatgatgggacctgcttccaggagcacagttcgtacgggaggaatagcctcgaagacaactcctgggtgtttcccagcccacctaaaagcagcgagacagccttcggtgaaacgaaaaccaagactttgccattgcccaatctcccacctcttcattatttagatcagcacaatcaaaactgtctctacaaaaactag

SEQ ID NO: 106545 - DNA, 1269 bp, Artificial Sequence
  Description of Artificial Sequence: Synthetic coding sequence
atggatgttctctctcccggccagggaaacaacacgacttctccacccgcgccctttgaaacaggcgggaacacaacgggcatttccgatgtgacagttagttatcaggtcattacaagccttttgctcggaacattaattttctgtgcagtgttagggaatgcgtgtgtggtcgccgctattgccctggaaaggagtcttcagaatgtggcaaattacctgatcggctctctcgctgtgaccgacctcatggtctccgtgttggtgctcccaatggccgctctgtaccaagtgctgaacaagtggacattgggacaggtgacatgtgacttgtttatcgctctcgatgtgctgtgctgtacatcctccatattacatctatgtgccattgctctcgaccgatactgggcaatcacggatcccatagactacgttaacaagcggacccctaggcgcgctgcagccctgataagtctgacctggctgattggctttctcatttcaatcccacctatgctggggtggcgcacccccgaggacagatctgatccggatgcttgtactattagtaaggaccatggctacactatctattctacattcggtgccttctatattccactgctgctgatgctagttttatatggaaggatttttagggcagctcgctttcgaattcgcaagactgttaaaaaggtagaaaagacaggagcagataccaggcacggagcttctcccgccccgcagccaaaaaagtctgtcaacggagagagcgggtcccggaattggcgtctgggagtagaaagtaaggccggcggggccttgtgtgctaacggagcagtgcggcaaggcgacgacggggcagccctggaagtgattgaagttcatcgtgtggggaactctaaggaacacttacccctgcccagtgaagccggaccaacaccctgcgcgcccgcatcattcgagagaaagaatgagaggaacgctgaagccaagcggaagatggcgctcgctcgtgagcgtaaaaccgttaaaactctggggattattatgggaacttttattctgtgctggctgcctttctttatcgtcgctttggtgctgcctttctgtgaaagttcgtgccacatgccaacgctgttgggtgccatcatcaattggctgggatactcaaacagtcttcttaacccagttatatacgcttacttcaataaggactttcagaatgcctttaagaagataattaagtgtaagttttgtcggcagtag

SEQ ID NO: 106546 - DNA, 129 bp, Artificial Sequence
  Description of Artificial Sequence: Synthetic coding sequence
atggacgttctgtcccccggacaggggaacaacacaaccagcccccctgctccttttgaaaccggggggaatacaacaggcatttctgacgtcaccgttagctatcaggttatcacttcactattgtag

SEQ ID NO: 106547 - DNA, 1173 bp, Artificial Sequence
  Description of Artificial Sequence: Synthetic coding sequence
atggaggagcccggggcacagtgtgcaccccccccccccgcggggagcgagacctgggtaccacaggccaaccttagtagcgccccatcacagaattgctcagcgaaagattacatctaccaagactccatcagcctcccatggaaagtgctactggtaatgctattagccctgatcacgctggcaactacgctgtcaaatgcatttgtgattgccacagtgtatcgcacccgtaaactccacaccccagcaaattatctcatcgcctcccttgccgtcactgacctcctggtctcgatcctagttatgccaataagcaccatgtatacagtgacaggcaggtggacactgggacaggtggtgtgtgacttctggttgagcagcgacatcacatgctgcacggccagcatacttcacctctgtgtaatcgctctggaccggtattgggctataacagacgccgtggaatatagtgccaagagaacccctaagagagctgcagtgatgatcgctctggtttgggtattctccatttccatttctctgcctccatttttctggcgccaggctaaagcggaggaggaagtgagcgagtgtgtggtgaataccgaccatatactctacaccgtgtattctaccgttggagcattttattttcctactctactccttatcgcactctatggccgaatatatgtggaggccaggagcaggatacttaaacagacgcccaataggacaggtaagcgcctgacccgggcccagcttatcaccgactcgcctggatccacaagctcagtgacttcaattaactctagggtgcctgatgtgcccagcgagtccgggtcacccgtgtatgtcaatcaggtgaaggtccgggtctccgacgccctcctggaaaaaaaaaaactgatggctgctagagaaagaaaagctactaagactctgggaatcattctgggtgcttttattgtgtgttggctgccttttttcatcatcagtttggtgatgccaatctgcaaggatgcctgctggtttcaccttgctatcttcgatttctttacatggctcgggtacctcaactctctgattaaccctatcatctacacgatgtccaacgaagatttcaaacaagccttccacaaattgatccgtttcaaatgcaccagttag

SEQ ID NO: 106548 - DNA, 1134 bp, Artificial Sequence
  Description of Artificial Sequence: Synthetic coding sequence
atgtcacctctgaaccaatccgctgaaggtttgcctcaggaagcctcaaatagatcattgaacgccacggagacatctgaggcttgggacccgcgcacactgcaggcactcaagatcagcttggcggtggtgctgtctgtgattaccttggccaccgtcttatccaacgcatttgttctgacgacaattctgctcactcgcaagctgcacacacccgcgaattatctgatcggctctctagccaccactgacctgctcgtgtcaattcttgtgatgcctatctccattgcatatacaatcacgcatacttggaactttggacagattctctgtgatatctggcttagttcagatatcacatgttgcaccgcctctattttgcatctgtgcgtgatcgccttagataggtactgggccataaccgacgctctggagtacagtaaacggcgtactgccgggcacgccgccaccatgatcgccatagtatgggctatctctatctgcattagcattcctcctcttttctggagacaggccaaagcgcaagaagaaatgtcagactgcctcgtgaacacctcgcagatttcctacacgatttatagcacttgcggcgcgttttacattccgtcggtgcttttgatcatcctttacggtcgcatttacagagccgcaagaaatcgaatcctgaacccgccgtccctgtacggtaaacgtttcacgacagcccacctaatcactggaagcgccggaagcagcttgtgttcacttaacagcagcctccatgagggacacagtcacagcgcaggatctccactgttttttaaccatgtgaaaattaagctggccgacagtgctctagagaggaagaggatatcagctgccagagaacggaaggccaccaaaatcctcggcattatcctgggtgcttttataatctgttggctaccattctttgtggtgagcttggtcctgcctatatgtagggatagttgctggatccatccagctttgtttgacttcttcacttggttgggctatttaaacagtctgattaatcctattatttataccgtttttaatgaagaatttaggcaagctttccaaaaaattgtgcccttccgaaaggccagttag

SEQ ID NO: 106549 - DNA, 1134 bp, Artificial Sequence
  Description of Artificial Sequence: Synthetic coding sequence
atgtcgcctctgaatcaaagtgcggagggcctcccgcaagaggctagtaaccggagcctgaacgccacggagacatcggaagcctgggatccccggacactgcaagcactcaagatttcacttgctgtcgtgctatccgtgattacgctagcaactgtactctcaaatgccttcgttctgactaccatcttgttgacccgaaagctgcatacacccgcaaattatctaatcggttccctggccactaccgacttgctcgtgtccattctggtgatgcccattagcattgcctacaccattacacacacatggaactttgggcagatactttgcgacatctggctgagctctgacataacatgctgtaccgcttccattctacacctctgtgtaattgccctggaccggtattgggcaatcaccgatgcccttgagtattccaagcgacgaaccgccgggcatgcagcaaccatgattgctatcgtttgggccatctccatttgcatctccatcccacccctgttctggaggcaggctaaagctcaggaagaaatgagcgattgtctggtgaacacatcgcaaattagttacacaatctactcgacgtgtggggcattctatatcccatcagtgctcctcattattttatatggcaggatctatcgcgcagcccgtaatcgcatcctgaacccaccaagtctgtatggtaaacgtttcaccaccgcacatttaattaccggttccgccggtagctctctttgctccctgaactccagcttacatgaggggcactcccatagcgccggcagccccctcttttttaatcacgtcaagattaaattagccgacagcgctctggaacgtaaacgcataagtgcagctagggaaagaaaggctacaaagattttagggattattctaggagcctttatcatctgctggctgcctttcttcgttgtgagtctggtccttccaatatgtagggattcgtgctggattcacccggccctctttgatttcttcacctggttgggttatttgaatagccttattaaccctattatctacacggtgttcaacgaggaatttagacaagcctttcagaagatcgtcccgtttcggaaggcaagctag

SEQ ID NO: 106550 - DNA, 1098 bp, Artificial Sequence
  Description of Artificial Sequence: Synthetic coding sequence
atgaacatcacaaactgtacaaccgaggcgtctatggcaatacgccctaagacaattacggaaaaaatgctgatatgtatgacactcgttgtcataacaactcttacgaccctgctaaatctcgccgtgattatggcaattggaactactaagaaactgcaccagcccgcaaattacctgatttgttctcttgcggtcaccgacttgctggttgctgttttagtcatgccgctgagcatcatctacattgttatggatcggtggaaactggggtacttcttatgcgaagtttggctgagcgtggacatgacctgttgtacctgttcgattctccatctttgtgtgatagccctggacagatactgggctattaccaacgccattgagtacgctcgcaagaggaccgctaaacgggccgccctcatgatcctgacagtttggaccattagcattttcatcagcatgccacccctgttttggaggagtcacagacggctgtcaccacctccttcacagtgcactatccagcatgaccacgtcatctatacaatttattctaccctcggagctttctacattccccttactcttatcctgatcctctactaccggatttaccatgcggccaagtcactgtaccagaagcgcgggtcctctcgtcatctgtccaacaggtccacagactcgcaaaatagcttcgcatcttgcaaacttactcagacattttgcgtcagcgatttctctacaagcgaccctaccaccgagtttgaaaagttccatgcgagcatccggatccccccttttgataatgacctcgaccaccctggcgagaggcagcagatatcgtcaactagggaacgtaaggctgctcgcattctcggtctaatcctaggtgcattcattttgtcctggctccctttttttatcaaagaactaattgtcggactttcaatctacaccgttagcagcgaggttgcagatttcctgacatggttgggatatgtcaacagcctcataaatcccttactatatactagcttcaacgaagatttcaagctcgccttcaagaagctcattaggtgtagagaacatacatag

SEQ ID NO: 106551 - DNA, 1098 bp, Artificial Sequence
  Description of Artificial Sequence: Synthetic coding sequence
atgaacattacgaattgtacaactgaagcctctatggctattagacccaaaacgatcactgaaaagatgctaatttgcatgactcttgtcgtgatcaccacattgacaacattgctgaatctggcagtaataatggccattgggactactaaaaaactgcaccagccggctaactatctgatatgcagcctcgctgtcaccgatttgcttgtcgctgtcctggtgatgccattgagcattatctatatagtaatggacagatggaaactcggctattttctgtgcgaggtgtggttatctgtggacatgacttgctgtacttgttccatcttacacctctgcgttatcgcgctcgaccgctactgggctatcacaaatgccattgagtacgctagaaagcgcactgccaagagggctgcacttatgatcttgacagtgtggacaatctcgatcttcattagcatgcctccactcttctggcggtcacataggcgactgtcaccccctccatcccaatgcaccattcagcatgatcacgtgatctacaccatttacagtacccttggcgcattttacataccactcacgttgatacttattctttattaccgtatctatcatgctgccaagagcctgtaccagaaacgcggaagcagtcggcacctgagcaaccggagcaccgactctcagaacagcttcgccagttgtaagctgactcagacgttctgtgtgtccgactttagcacatctgatcctaccaccgagtttgagaagtttcacgccagtatccgtattcctccttttgataatgatctcgatcacccaggagaacgacaacagatcagttcaactcgggagcggaaggccgcgcgaatcctcgggttgatacttggggcattcatcctctcatggctgccattttttattaaagaactcatcgtcgggctgtcaatttacaccgtgagctccgaagtagctgactttcttacctggctgggctacgtgaacagcctgatcaatcccttgctgtacacttcctttaacgaggacttcaaactggctttcaagaagctgataaggtgccgcgagcatacctag

SEQ ID NO: 106552 - DNA, 1101 bp, Artificial Sequence
  Description of Artificial Sequence: Synthetic coding sequence
atggatttccttaacagcagtgatcagaacctgactagcgaggagttactgaataggatgccctctaaaattcttgtctccctaacactgtctgggctggccctgatgacaaccacaatcaacagtctggtcattgcggccattatcgtgaccagaaagttgcaccacccggccaactacctaatctgctctctggcggtgaccgactttctagtcgctgtgcttgtgatgccgttcagcatagtgtatatcgtacgcgaatcctggatcatggggcaggtagtttgcgacatttggctcagcgtcgacatcacatgctgcacttgcagcattctgcatctatccgccattgccttagacagataccgcgctatcacggatgccgtggagtatgcacggaaaagaacccccaaacatgccggtatcatgatcactattgtttggatcatctccgtgtttatatctatgcctccgctgttttggcggcatcagggaactagcagggacgatgaatgcattattaagcacgaccatatcgtatctaccatatactctacttttggagccttctatatccccctggccttgattctcattctgtactataagatctatagggcagcgaagactctgtatcataagcggcaggcatctcgaattgccaaggaggaagtcaatgggcaggtgctgctcgagtccggcgaaaaatccacaaagtctgtctccacttcttacgttctggagaagagcctgtctgatccctccactgatttcgacaaaatccacagcacagttcgatcactgaggtcggagtttaaacatgagaagagctggagaaggcagaaaatctcgggcactagggaacgaaaagcagcaaccacccttggcctcatcctgggagcctttgtgatttgctggcttccatttttcgtaaaggagctcgtagtcaacgtttgtgacaagtgcaagatcagcgaagaaatgagtaacttcctggcttggttggggtacttgaactcactgatcaatccactgatttacactattttcaacgaggatttcaagaaggcatttcagaaattagtgcggtgtcgctgctag

SEQ ID NO: 106553 - DNA, 1416 bp, Artificial Sequence
  Description of Artificial Sequence: Synthetic coding sequence
atggacatcctctgtgaggagaacacaagtttatcctctacaaccaactcactaatgcaattgaatgatgacacaagactgtactctaacgacttcaatagcggggaggctaatacatccgatgcctttaattggacagttgattccgaaaataggactaacctctcctgtgagggctgtctgtccccaagctgccttagcctcctgcacctgcaagagaaaaattggtctgcactgttgaccgctgtggtaatcattcttacaatagccggtaacatcttagtcataatggccgtctcattggagaagaagctccaaaatgctacaaattactttctgatgtccctggctatcgccgacatgttgctgggtttcctagtcatgccagtgtcaatgctcaccatactatacgggtatcggtggccccttccctccaagctgtgcgcagtctggatctatcttgatgtgctctttagtaccgcatcaatcatgcatttgtgtgctatctcactggatagatatgttgctattcagaacccaatccaccatagccggtttaattcacgaacaaaggctttcctgaagattattgctgtctggactatctcagtaggtatcagtatgccgattcccgttttcgggctacaggacgacagcaaggtgttcaaggaaggtagttgcctcctggcagatgataatttcgtactgatcggatcattcgtatcattcttcatccccctaaccataatggtaatcacctactttttaactatcaagagtctccagaaggaggctaccctgtgcgttagcgatttgggcacccgtgccaagctcgcttctttctcatttctgcctcagagttccctgtcatccgaaaaactctttcagaggagcatacatcgggagccaggtagctacacgggaagaagaacaatgcagtctattagcaacgaacaaaaggcttgcaaggtgttaggtatcgtgttcttcctgttcgttgtcatgtggtgtcctttcttcattacaaatatcatggcagtgatttgtaaagagagctgcaacgaggacgtcattggtgccttgcttaacgtgttcgtttggatcggttatctgagctcagccgtgaaccccctcgtgtacaccctcttcaacaagacgtatcggagtgcgttctctaggtatatacagtgccagtataaggagaacaaaaagcccctgcagttgatcttggtgaacactatcccggccctggcgtacaagagcagtcagctgcagatgggccagaaaaagaactctaagcaggacgcaaaaacgacagataacgattgttcaatggttgcactcggaaaacagcatagcgaagaggcctccaaggacaacagcgacggagtgaacgagaaggtgtcatgcgtgtag

SEQ ID NO: 106554 - DNA, 1416 bp, Artificial Sequence
  Description of Artificial Sequence: Synthetic coding sequence
atggacatcctgtgtgaagagaacacttctctcagctcaacaactaatagtctgatgcaacttaatgatgataccaggctgtacagtaacgatttcaactctggtgaggcgaatacctcagatgcgtttaattggactgttgattccgagaaccggacgaatctgtcttgcgagggttgcctgtcacccagctgtctctctctgctgcatctgcaggaaaagaactggtccgccctcttaaccgccgtggtcataattctgaccattgccggtaacatactggtgatcatggccgtcagtctagagaagaagttgcagaatgctacaaattattttttaatgagcctcgccatcgccgacatgttactcgggttcctggtcatgccagtgagcatgttaactatactctatggatataggtggcccctgccctccaagctgtgtgctgtctggatctatcttgatgttctcttctccactgcaagcatcatgcatctctgcgctatatccctggacagatacgtggcgatacagaatcccatacatcacagccgttttaactccagaaccaaggcatttctcaaaatcatcgccgtctggactatctcagttgggataagcatgcccataccagtgttcggtctgcaggatgacagtaaggtgtttaaggaggggtcatgtctgctggccgatgacaattttgtgcttattggctcctttgttagttttttcattcccctgacaattatggtgatcacatacttcctgacaataaaaagcctgcaaaaggaagccaccctgtgcgtgagtgacctggggacccgcgctaagctcgcttctttttctttcctgcctcaaagctccctttccagtgaaaagttattccagagatccatccacagagaacctggctcctacaccggaagacgaaccatgcaaagcatcagcaacgagcagaaagcctgcaaagtgctaggcatcgtatttttcctcttcgtggtaatgtggtgtcccttttttatcacgaatattatggccgtcatctgtaaggagagttgtaacgaagatgttattggggctctccttaacgttttcgtctggattggatacctctcatctgcagtgaatccactcgtgtacacattattcaataagacatacaggagcgcgttcagtcggtatatccagtgccagtacaaagaaaacaaaaaacccttgcagcttatattagtgaatacaatcccagcgctggcctacaagtccagccagctgcaaatggggcaaaagaagaacagcaagcaggatgcaaagacgaccgacaatgactgctcaatggtggccctcggtaaacagcacagcgaggaagcttccaaagacaacagcgacggcgtgaacgagaaggtgtcgtgcgtctag

SEQ ID NO: 106555 - DNA, 1164 bp, Artificial Sequence
  Description of Artificial Sequence: Synthetic coding sequence
atgcaattcctgaaaagtgccaaacagaaacctaactactaccatatcatgttagtggaagatcaagaggaggggaccttgcaccagtttaattattgcgaacgttgctcagagtcacaaaataacaagtgcatctcttgcgtcgatcctgaagacaagtggtatcgatggcctctaccatccaaactctgtgcagtttggatatacctggacgtgcttttctctacggcatcaattatgcatctctgcgcaatcagtttagacaggtacgtagccattcagaaccctattcatcattctagatttaatagtaggacgaaggccttcctgaagattatcgcggtgtggacaatctctgtggggatttcaatgcctataccagtcttcggattacaggacgattcaaaagtgtttaaggagggaagctgcctcctcgcggacgacaattttgttcttatcggctcttttgtatcattcttcatcccattgaccatcatggtgatcacatatttcttaacaattaagtctttgcagaaagaggctacactctgtgtctccgacctggggactcgcgctaagctagcgtcattcagtttcctgccacaaagtagcctctcttctgagaagctgtttcagcgctcaatccaccgcgagcctggctcctacacaggaaggcggacaatgcagagtataagcaacgagcagaaagcgtgcaaggttttggggatcgtgttttttctgttcgttgttatgtggtgccctttcttcatcacgaatatcatggctgtgatctgcaaagaaagctgtaacgaggacgtgattggcgcgttgttaaacgtctttgtctggattggatatctttcctcagcagtgaacccgctggtttataccctgttcaacaagacctatagatccgccttttcgcggtacatccagtgccagtacaaggaaaacaaaaagccattacagttaatcctcgtgaacacgatccctgcactggcatataagtcaagtcagctgcaaatgggccagaagaaaaactccaagcaggacgctaaaaccaccgataatgattgtagcatggtggcccttggcaagcagcactctgaagaagccagcaaggataattcagatggcgtcaacgaaaaagtgtcatgtgtgtag

SEQ ID NO: 106556 - DNA, 1446 bp, Artificial Sequence
  Description of Artificial Sequence: Synthetic coding sequence
atggccctgagctaccgcgtttccgagctgcagagtacgattcctgagcatattctacagtctacctttgtgcatgtaattagtagtaactggtctgggctgcagacggagagcatccccgaggaaatgaagcaaatcgtggaggaacagggcaataaactgcattgggcagcacttctgattttgatggttatcatccctaccatcggcgggaacaccctggtgatactggcagtatctctcgaaaaaaagctgcagtatgctacgaattacttccttatgtcgctcgccgttgctgacctccttgttggactgttcgttatgcccattgcattattgaccattatgtttgaagccatgtggcccctgccactggtattgtgccctgcatggctgttcctcgatgtgctgttttctactgcctctattatgcatctctgcgcaatttcagtggatagatacattgcaatcaaaaagcctattcaggcgaaccagtacaattcccgcgccacagcatttatcaaaataactgtcgtatggttaatcagcatcgggatcgcaatccctgtgcctatcaaaggcatcgaaacagatgttgataatcctaataacatcacctgtgttcttaccaaggaacgattcggggacttcatgctgttcgggagtctggctgccttttttacaccactagccataatgatagtgacctatttcctgaccattcacgcgctgcagaaaaaggcctacctggtgaagaataaaccgccacagcggctcacgtggctgaccgtgtctacagtttttcagagggacgaaactccctgtagctcccctgaaaaagtggcgatgttggacggcagcagaaaggacaaggctctgcccaacagcggcgacgaaaccctcatgcggaggacaagcacgattgggaagaaatctgtgcaaaccattagcaatgagcaaagagcgtcaaaagtcttaggcatagtcttctttctgtttttgctgatgtggtgcccgtttttcatcactaacattactctcgtcctgtgcgatagttgcaaccagacgacgctgcagatgctcttggaaatttttgtgtggataggctatgtttcatcaggagtgaatccactcgtgtatacactgtttaacaagaccttccgcgacgcttttgggcgctacattacctgcaattaccgcgcaaccaaaagcgtgaagaccttgcgcaaaaggtcctctaaaatctacttccggaaccccatggcggagaactccaaattttttaagaagcacggcatccggaatggcataaatcccgcaatgtaccagtcacctatgagactccggtctagcacaattcagtcctcctcaatcattttactagacacccttttgctgaccgagaatgagggtgataaaacagaggagcaggtgtcctatgtgtag

SEQ ID NO: 106557 - DNA, 195 bp, Artificial Sequence
  Description of Artificial Sequence: Synthetic coding sequence
atggtgatcatccccacaatcggaggaaacacgctcgttatcttagccgtcagcttggagaagaagctccagtatgccaccaattacttcttgatgtctctggccgtggctgaccttctggtgggcctattcgtgatgcccattgctctgctcacaatcatgttcggcattgcaatcccagtgcccatcaagtag

SEQ ID NO: 106558 - DNA, 1377 bp, Artificial Sequence
  Description of Artificial Sequence: Synthetic coding sequence
atggtgaacctgaggaacgcggttcattctttcctggtacacctaatcggcctcctggtctggcagtgtgatatatccgtcagtccagtcgccgctatcgtcactgacatttttaataccagtgacgggggccgattcaagtttccagatggtgtgcagaattggccagcgctctctattgtcattatcatcatcatgacaatcggcggtaacatccttgtcataatggccgtgtccatggagaaaaagctgcataatgccactaattactttctaatgtctctggccatcgccgacatgctggtggggttactcgtaatgccactctcactgctggccatcttgtatgattacgtgtggcctctgccccggtatctctgtcccgtgtggatcagcctggatgtgctgtttagtacagcctctatcatgcatctttgtgccatttctttagaccgctacgtcgccatcagaaaccctatcgagcactcgaggtttaactctaggacgaaagccataatgaaaatagctatagtatgggctataagcatcggggtttccgttcccatacctgttatcggcctacgggacgaggaaaaagtgttcgtcaacaatacgacatgtgtcctcaatgatcccaactttgttctgatcggctccttcgtcgccttcttcatcccccttactattatggtgattacgtattgcctgacaatctacgtgcttcgccgacaggccctgatgctgttgcatggccatacagaggaacctccgggtctctccctggattttttgaagtgctgtaagagaaacaccgctgaagaggaaaattccgccaatccgaaccaggatcagaatgcaagaaggcgcaaaaaaaaggagaggcgaccacgaggcaccatgcaggccattaacaacgagagaaaagccagcaaagttttgggcattgtgtttttcgtgttcctgatcatgtggtgtcctttctttattacaaatatcctgtccgtcttgtgcgagaaaagctgcaatcagaaactcatggagaaattgctcaacgtgttcgtctggatcggctacgtgtgttctggcatcaatcctctggtgtatactctatttaacaagatttaccgccgtgccttctctaactacctgcggtgcaactataaggtggaaaagaaacctccagtgcgtcagatcccccgcgtggctgccactgccctgagcggccgggaattgaatgtgaacatttaccggcacactaatgaaccagtaatcgaaaaggcttccgataacgagcccgggatcgaaatgcaggtggaaaacctcgagctcccggttaatcctagcagcgtcgtgagtgagaggatatcttccgtatag

SEQ ID NO: 106559 - DNA, 747 bp, Artificial Sequence
  Description of Artificial Sequence: Synthetic coding sequence
atggtgaaccttaggaacgccgtgcattcattcctggtccaccttattggtctgctggtttggcagtgcgacatatcagtttcgccagtggccgccatcgttacagacattttcaacacatctgacgggggaaggtttaaattcccggatggcgtgcaaaactggccagctctttctatagtgattatcatcattatgactatcggcgggaatatactggttatcatggcagtcagcatggagaaaaaactccataatgccactaactactttttaatgtcccttgccatcgcagacatgctggtggggctcctggtgatgcccctaagcctactggcgatcctctacgactatgtgtggccactgccgagatatctgtgtcccgtatggatctcactggacgtgttgttctctaccgcgagcattatgcacctatgcgccatcagtttggataggtgtatctcctcatacccgtgtgattggacagaaggcaggcgtaagggcgttcgggagcagcacgacgtccgagcccaacgtcccaagttccggtcctattgggtgctgcgctccttcctacacaccgcagatgactacggagactatgtgctcccggatcacctgcggagtgctccaacgtctttcgacgtcacagcgcggccacacaggggaactgcgtggaccaagagtggattccctgaggttctgcaggaagaatacgggcgaggcagggaattatgtaagccctag

SEQ ID NO: 106560 - DNA, 1377 bp, Artificial Sequence
  Description of Artificial Sequence: Synthetic coding sequence
atggtcaacctgcggaatgcagttcacagcttcctagtgcacctcattggactgttagtgtggcaatgtgacatttccgtaagccctgtggctgcaatcgtaacggacatctttaatacatcagacggaggacggttcaagtttccggacggcgtccagaactggcctgcgctatccatcgtgattatcataatcatgactataggtggaaacatcctagtcatcatggcggtatcaatggaaaaaaaactgcataacgccaccaactattttttaatgtcactggccatcgcagatatgctggttggcctcctggtgatgcccctgagcttgttagcgatcctgtatgactacgtgtggcctctcccacggtatttgtgtcctgtctggataagcctcgatgtgctctttagtaccgccagtataatgcatctgtgcgccatatcactggatcgctatgtggccattcgaaaccccattgagcatagccgcttcaattccaggactaaggcaattatgaagatcgccatcgtgtgggccattagcatcggagtgtctgttccaattcctgtcataggcttgagggacgaggaaaaggtgtttgtgaataatacaacgtgcgtcctgaacgatcctaacttcgtactgatcggctctttcgtcgcattcttcatccccttaactataatggttatcacctattgcctcacaatctacgtgctgagacggcaggcactgatgctgttgcatggccacactgaggaacctccaggactctccctggattttctcaagtgctgcaagagaaataccgccgaggaagaaaattctgcgaatccgaatcaggaccaaaacgcccgcaggcggaagaagaaggaaaggcggccacgtggcacaatgcaggcaattaataatgagagaaaggcctctaaagtacttggcatcgtcttctttgtctttcttatcatgtggtgcccattttttatcacgaatatcctctccgtgctctgtgagaaaagctgcaatcagaagttgatggagaagctactgaatgtgtttgtgtggatcggatacgtctgcagcggcatcaaccccctggtttacactctcttcaataagatttacagacgggctttcagtaattacctccgctgcaactataaggttgaaaaaaaaccccctgtgcgccagattcccagagtagcagctactgcactttccggtcgcgagttaaacgtgaacatctacagacacacaaacgaaccagtgatcgaaaaagcaagtgacaacgaacccggcatcgaaatgcaggtggagaatctcgagctacccgtcaaccctagttcagtggtctccgagcggataagcagcgtgtag

SEQ ID NO: 106561 - DNA, 840 bp, Artificial Sequence
  Description of Artificial Sequence: Synthetic coding sequence
atggcatcgatgagcatcgtaaaggccacatccaataccatcagtcagtgcggctggtccgcatcagcaaactggacgccctccatctcaccgagtatggaccgaggagagcgtagtccaagcgccttgtcaccaacccaggtggcaattcgtcgacgatgccgcccctccccctacgtggtgaacttcctggtcccctccggtatcctcattgccattgacgccctcagtttttatctccccctggagtcaggcaattgtgctccatttaaaatgactgtcctactaggatattccgtcttcctgctgatgatgaatgatttgctgcccgccaccagtacttcctctcacgcctcactcgttaggccacatccaagccgtgaccaaaagagaggagtgtacttcgcactctgcctgtcactaatggtggggagcctcctcgaaacgatcttcattacacacctgctgcatgtggccactacccagcctctgcccctgcctcggtggctgcacagcctcttgctccattgtacaggccagggcaggtgctgtcctactgcgcctcagaagggaaacaagggtccgggactcacccctacccacctgcccggagtcaaggagccagaggtctccgccggacagatgcctggccccggtgaggccgagctgaccggaggctctgagtggactcgagctcagcgcgagcatgaagcccaaaaacaacattctgtcgaactctgggtgcagtttagtcacgcaatggacgcccttctcttccgcctctatttgctgtttatggcttcttctataatcacggtaatctgcctgtggaacacgtag

SEQ ID NO: 106562 - DNA, 1365 bp, Artificial Sequence
  Description of Artificial Sequence: Synthetic coding sequence
atgcaaaagcattcccctggcccacctgcactcgctctgctcagccagtctctgttgactactgggaacggggatactctgattatcaactgtcccggctttggtcagcacagagtcgacccggcagccttccaggcggtattcgatcgaaaagcgatcggccctgtcactaactattctgtggccactcatgtgaatatctcattcacactgtctgccatctggaattgctattcacgaatccataccttcaactgtcaccatgcacgtccatggcacaatcaatttgttcagtggaaccctgatgagtgcggcggcattaaaaagagcggaatggccaccgagaacctgtggctgagcgatgtcttcatcgaagagtctgtggatcagacgcctgcaggactgatggcctccatgtctatcgttaaggcaacaagtaacacgatcagtcagtgtggctggagcgcatctgcaaactggacgccctctattagccccagcatggatagggcaagagcttggcggcggatgtccaggtcgttccagatacaccatagaacatcctttaggacgaggagggagtgggtgctcctaggcatacagaagcgcaccattaaggtgacagtcgccacaaatcagtatgaacaggccatttttcacgtggctattcggcgccgctgtagaccatcaccctacgttgtcaattttctcgtgcctagcgggatccttatcgctatcgacgcactgtctttctatctccccctagagtcagggaattgcgctcctttcaaaatgaccgtgttactcggctatagcgtgttcttgctcatgatgaatgatcttctcccagctactagcaccagctctcatgcaagtcttgtcgcccccctcgccctaatgcagacacccttacccgctggagtatattttgcattgtgtctgagcctcatggtcgggagtctgctggaaacaatcttcataacccaccttctgcacgtggccacaacccagcctctccccctccctagatggctgcattctctgctgctgcactgcactgggcagggccggtgctgtcctacagctccacagaagggtaacaagggcccaggcttgactccaacccatttgccaggggtaaaagaacccgaggtctctgcaggccagatgcctggcccgggcgaggccgaactcaccgggggctccgaatggacccgggcccagcgagagcacgaggcccagaagcagcattccgtagagctgtgggtgcagtttagtcatgccatggacgcgcttttattcagactctatcttctgttcatggcctcctccattattacagtcatatgcttatggaatacatag

SEQ ID NO: 106563 - DNA, 1215 bp, Artificial Sequence
  Description of Artificial Sequence: Synthetic coding sequence
atggaacgagggtggttccacggaaaggggttcctgcttggcttcatcttgcatcttctattacaagacagccacctgcagctagtgaccagcttcctgtggcttaatatgtggaacccggacgagtgcgggggtataaagaagagcggcatggcgaccgaaaatctgtggctgtctgacgtctttattgaggaatcagttgatcagacacccgccggattgatggcctccatgtctatcgttaaagccacctctaatacgatttcccaatgtgggtggtcagcctcagccaattggacgccttcgattagtccgtctatggataggggagaacgctccccctcggccctctcacctacacaggtcactcgtgcctggaggcggatgagccgaagctttcagatccatcaccgcacaagttttcgcacccggagggaatgggtcctgttgggcatccagaagaggaccatcaaggtcaccgtcgccaccaatcaatacgaacaggccatcttccacgttgcaatcagaagacgttgcaggcctagcccctatgtcgtgaacttcttagtgcctagtgggattctaatcgctattgacgctctgtccttttacctgcctctggaatcaggtaattgtgctcccttcaagatgaccgtcctcttgggatactccgtttttctccttatgatgaatgacctcttaccagctacttctactagtagtcatgcctctcttgtgcgcccacaccccagtcgtgaccaaaaaagaggagtatatttcgccttgtgtctcagtctaatggttggctccctgcttgaaaccatcttcatcacgcatctgctacacgtcgcaactacgcagccactccctcttccacgctggctgcactcattactacttcactgtactgggcaggggcgatgttgtccgaccgctccccagaaagggaataagggcccaggactgactccaacccatcttcctggtgtcaaggagccggaggtgagtgccggtcagatgcccggtccgggcgaagcagagctgaccggagggagcgaatggactagagcacagcgcgaacacgaagcacaaaaacagcactctgtggaactctgggtccagtttagccatgctatggacgcactgctgtttagactgtacctgctgtttatggccagcagcatcatcactgttatttgtctgtggaatacatag

SEQ ID NO: 106564 - DNA, 702 bp, Artificial Sequence
  Description of Artificial Sequence: Synthetic coding sequence
atggtcgccatccgacgaaggtgccgaccaagcccatacgtggtgaatttcctggttccttccgggatactgattgcaatagacgccctgtctttctaccttcccctggaaagcgggaattgcgccccttttaagatgaccgtgttactggggtattctgtgtttctcctgatgatgaatgatctgctgccagcaaccagcaccagttcccacgcatctttggtccggccccacccttccagggatcaaaagagaggtgtttattttgctctgtgtctcagcttaatggtgggatctttgctggagactatattcattactcaccttttgcacgtagcaactacccaacctttgccgctaccccgatggctgcattcgcttttgctgcactgcacagggcaggggcgctgttgtcctacagccccacagaaaggtaataagggacccggcttgactccaacacaccttcccggggttaaagagcccgaggtgtctgccgggcagatgcccggtcctggcgaagccgagttgacaggtggttcagaatggactagagctcagagagaacacgaggcccagaagcagcattcagtggagctgtgggttcaattctctcacgcaatggatgctctactgtttcggctctatctgctgttcatggcttcttcaattatcacagtaatctgtctgtggaacacctag

SEQ ID NO: 106565 - DNA, 1344 bp, Artificial Sequence
  Description of Artificial Sequence: Synthetic coding sequence
atggaaggtggatggccggccaggcaaagtgctcttctgtgcctgaccgtgtcgctactattgcagggacgcggcgacgcttttactatcaactgttctggatttgatcagcacggcgtcgatcccgcagtctttcaagcagtattcgaccgtaaagcattcaggcccttcacgaattactctattcctacccgtgttaatatcagcttcaccttgtccgctattctgggcgtggacgctcagctccagctcctcacatccttcctctggatggatctggtgtgggataatccctttattaactggaatcctaaagagtgtgtcggcattaacaagctgacggtgcttgcagagaacctgtggctccctgacatcttcatcgtggagtccatggacgttgatcaaactcccagcgggcttactgcgtacatctccagtgagggcaggatcaagtacgataaacctatgcgtgtgacctcaatttgtaatttagacatattctacttcccctttgaccaacagaattgcacatttactttttcctcatttctgtacaccgttgattcaatgcttctaggaatggacaaggaggtctgggaaatcactgacacctcccgtaaggttatccaaacacagggtgaatgggagctgcttgggattaataaggccacacccaaaatgtccatggggaacaatttatacgatcagatcatgttttatgtcgccattaggcgacgtccatccctgtacattatcaatctgctcgtcccttcttcatttctagtggccatagatgccctgagcttctatttgcctgctgagtctgaaaatagagccccctttaaaatcactctccttctcggctacaatgtttttctcctcatgatgaacgatctcttgcctgcctccgggactcccctcatctcagtgtacttcgctttatgcctgagtttaatggttgtgagcctgctggagactgtcttcatcacctacctcctgcatgtggccacaacacagccgccgcccatgcctcgttggctgcacagtctgctgctccactgcacttcgcctggccgctgttgtccaacagcgcctcaaaaaggtaacaagggactcgggctgaccctgacccacttacctggtcctaaggagcctggtgaactcgctggcaagaagctgggcccacgcgagaccgaacctgacggtggcagcggatggacaaagactcagctgatggagctgtgggtacagttctcccatgccatggacacactattatttcggctttatctactctttatggcctcatccatccttacggtgatcgtactctggaatacgtag

SEQ ID NO: 106566 - DNA, 1416 bp, Artificial Sequence
  Description of Artificial Sequence: Synthetic coding sequence
atgcttgcctttatcctcagccgcgcaaccccacggccagcgttgggcccactgtcctacagagagcatcgagtggctctacttcatctaacacacagcatgtctactacgggccgcggcgtgacattcaccattaattgctccgggtttggacagcatggggcagaccccaccgccctgaacagcgtgttcaacagaaaaccctttagaccagtcacgaatatctctgtgcccacgcaggtgaacatttcatttgccatgtccgccattttagatgtgaacgagcaactgcacctgttgtcttcctttctatggcttgagatggtctgggataacccctttatcagctggaacccggaggagtgtgaaggcatcacaaaaatgagcatggcagctaagaacctctggttgccagatatattcattatcgagctgatggatgttgacaagacgccaaaggggttgaccgcctacgtctccaacgagggacgaatacgctacaagaaacctatgaaggtcgattcaatctgtaaccttgacattttttactttccctttgatcagcagaattgtaccctgaccttcagttccttcctttatacggtagactccatgctgcttgatatggaaaaagaggtatgggagatcactgatgccagtagaaatatcctacagacccacggcgaatgggaactcctgggcctgtccaaggccaccgcaaagttgagcagaggagggaacctctatgaccagattgtgttctacgtcgccatacgccgcagaccttcactgtacgtgatcaacttactcgtgcccagtggctttctggtagcaatcgatgccctgagcttctatctcccagtcaagagtggcaatcgcgtaccattcaagatcactctgctactcgggtacaatgtgtttctgctaatgatgtcagatcttttgccaacatccggtaccccactgatcggcgtgtactttgccctgtgcttgtccctgatggtgggaagcctgctggagactatctttatcacacaccttctgcatgtggcaactacccagcccccaccgctgccgcggtggctccattctttgctgcttcattgcaactccccaggccggtgttgccctacggccccccagaaggaaaataagggtcccggactgactcccacccatctgcctggggtgaaagagccagaggtgagcgcaggtcaaatgccagggccagccgaagctgaactaaccgggggtagtgagtggacacgcgcacagcgcgagcatgaagctcagaagcagcactctgtggaactgtggctgcaattctcccatgctatggacgccatgcttttccggctttacctgctgtttatggcctcctcaatcatcactgtgatctgcttatggaatacttag

SEQ ID NO: 106567 - DNA, 1371 bp, Artificial Sequence
  Description of Artificial Sequence: Synthetic coding sequence
atggagggaagttggtttcaccgcaaacgtttttccttctatctcctcctgggctttctgctgcagggacgaggagtgacattcacaattaactgcagtggcttcgggcagcatggtgccgacccaaccgcccttaacagcgttttcaataggaagccatttcgtccggttacaaatatatcagttccaacgcaagtcaatatcagtttcgctatgagcgccattttagatgttaatgagcagctgcatctgctgtcgagctttttgtggctcgagatggtatgggataaccctttcatttcgtggaacccggaggagtgcgagggtattacaaagatgagcatggctgccaaaaacttatggctgcctgacatcttcatcattgagttgatggatgtcgataagacaccaaaaggcctcaccgcgtatgtttctaacgaagggcggatccgatataaaaagcccatgaaggtcgactccatctgcaatctggatatcttttacttccccttcgatcagcagaattgtacattgacctttagcagctttttgtacacagtagactccatgctgctggatatggaaaaggaagtttgggagataacggacgcaagtaggaacatccttcagacccacggcgagtgggagttgctgggattaagcaaagctacagcaaagctctcaaggggagggaatctgtatgaccagattgtgttctatgttgctattagaagacggcctagcctctacgtgattaatctgctggtgccctccggtttcctggtcgcaatcgatgccctgtcgttctacttgcctgtgaaaagtggaaaccgcgtgcctttcaagatcacattactgctggggtataacgtgttcctactgatgatgtctgatctgctgccgacgagcggaacacccctcattggagtgtacttcgcactgtgtctctctctcatggtaggctctctgctcgagactatcttcatcacccacctcttgcatgtggcaacgacccaacccccaccccttccacgatggctccattctttactgttgcattgcaactctcccggtcgctgctgccccaccgcaccacagaaggaaaacaaaggtccagggcttacacctacccacctgccaggcgtgaaggaacccgaagtcagcgccggccagatgcccggaccggctgaggcagaactcaccggggggagtgaatggacccgcgcccagagagagcacgaggcgcagaaacaacattcagttgaactctggttgcagttctcacatgctatggacgcaatgctcttccgcctgtacttgctgtttatggcttcttctattatcactgtgatatgcctgtggaatacctag

SEQ ID NO: 106568 - DNA, 1326 bp, Artificial Sequence
  Description of Artificial Sequence: Synthetic coding sequence
atggagggatcttggttccatagaaaacgattctcattttatttgctgttgggcttcctcctgcagggaagaggcgtgacttttaccattaactgtagcggcttcggccagcacggagcagaccccacagccctgaactcggttttcaatagaaagccgtttcgccccgtgaccaacattagcgtgcccacacaggtgaatatctcctttgctatgagtgctattctggatgtggtgtgggataaccccttcatttcatggaatccagaggagtgcgagggaatcacaaaaatgtcaatggcggctaagaacctctggctgccggacatatttattatcgaactgatggatgtcgataagacaccgaaaggcctgaccgcatatgtctcaaatgagggtcggattagatataaaaaacctatgaaggtggactctatatgcaatctagatatattttattttcccttcgaccagcagaattgcacgctcacgttctccagctttttatacacggtcgacagtatgctcctggacatggagaaggaagtctgggagatcactgacgcgtctcggaatatcttgcagactcatggagaatgggagctgctcggtctgtccaaggccacagcgaagctgtcaagaggaggtaacttgtatgaccagattgtcttttatgtcgccatacgtcgccggccttccctgtatgtgatcaacctgcttgtgccaagtggattcctggttgctatcgacgctctgtctttctatttgccggtaaaaagcgggaacagagtgccctttaagatcactctcctgcttggttacaatgttttccttttaatgatgagcgatcttctgcccacctccggcacacctctgataggcgtatactttgctctgtgtctctccctgatggtgggtagtctcttggagaccatcttcattacccatctccttcacgtagcgaccactcagccaccaccattgccgagatggctgcattccttgcttctgcactgtaattcccccgggaggtgttgtcctaccgcccctcagaaagaaaacaagggtcccggacttaccccaactcacttgccaggggtgaaggagcctgaagtgagtgcaggtcagatgcccggacccgccgaggccgaactcactggtggctccgagtggacacgggcccaaagagaacacgaggcccaaaaacagcacagcgtggaactgtggcttcagttttctcacgcgatggacgccatgctgtttagactgtatctcctgtttatggcctcaagtatcattaccgtgatttgcctgtggaatacatag

SEQ ID NO: 106569 - DNA, 1371 bp, Artificial Sequence
  Description of Artificial Sequence: Synthetic coding sequence
atgctggcgtttattctgagcagggccacaccaaggcccgcacttggacctctgagctatcgagaacacagggtcgcactgttgcacttgacccactccatgtctaccaccggtaggggggtcacatttacgattaactgcagcggattcggccagcacggggctgaccccacggccttaaacagcgtgtttaaccgcaagcctttcaggccagtcactaacatcagcgtgccgacacaggtcaacatctcatttgcgatgagcgccatattagatgtggtttgggacaacccctttatcagctggaatcctgaagagtgcgaagggatcacgaaaatgtctatggctgcgaaaaatctttggctgcctgacatcttcattatcgagttgatggacgtcgataaaactcctaagggcctaacggcttatgtgtcgaacgaaggaagaattaggtataagaagccaatgaaagtggatagtatctgtaacttggatattttctatttcccattcgaccagcagaattgtacccttaccttttcatcattcctgtatactgttgattcgatgttactcgacatggagaaagaggtctgggaaatcacagacgcatctagaaatatccttcaaacccatggagagtgggaactcttgggtttgtctaaagccaccgctaaactgtcacggggagggaacttgtacgaccaaatcgtgttttatgtggccattaggcggaggccttccctgtatgttattaacctgcttgtaccctctgggtttctcgtggccattgacgccctgagcttttatcttccagtgaaaagtggcaaccgtgtgccctttaagattactttgctattgggttacaacgtgttcctcctgatgatgtctgatctgcttccaactagcggaacaccactcattggagtctatttcgctctctgtctgtcactcatggtgggatcattgctcgagaccattttcattacacacctcctgcatgtagcgacaacccagcctcctcctctgccgcggtggttgcattctcttctccttcactgtaacagccctggccgctgttgtcccactgctccacagaaagagaataaggggcctggccttaccccaacccatttgccaggtgttaaggaacccgaggtgagcgccggtcagatgcctggtcctgcagaggctgaactcaccggaggctccgagtggacaagagcccagagagaacacgaggctcagaaacagcacagcgttgagctgtggctgcagttttctcacgccatggatgcgatgctgttcaggttatatctcctttttatggcctcctctataatcaccgtcatatgcctgtggaacacatag

SEQ ID NO: 106570 - DNA, 1326 bp, Artificial Sequence
  Description of Artificial Sequence: Synthetic coding sequence
atgctttcctcagtgatggcccctctgtgggcctgtatcctggtggccgcaggtatccttgctaccgacacccaccacccgcaggacagcgcattgtaccacctgagcaaacagttactgcaaaagtatcataaagaggtacgtcctgtttataattggaccaaagccacaactgtatatctggacctgttcgtgcatgccatattagacgttgatgcagagaaccagatcctaaagacgtccgtctggtaccaggaggtgtggaacgatgaatttctcagttggaattcgagcatgttcgacgaaatcagggaaattagtctcccactcagcgccatctgggcaccagacattattattaacgagtttgtcgatatcgagcggtatcccgacctgccttacgtttacgtgaactcaagcgggaccattgagaactataagcccattcaagtagtgtcagcttgtagcctcgaaacgtatgctttcccattcgacgtccagaactgttcgttgactttcaagagcatcctgcacacagttgaagacgtggatttagcttttcttcgaagcccagaagatatccagcacgataaaaaagcttttcttaacgatagcgagtgggaattgctgagcgtgagtagtacatactctatactccaatccagcgccggcgggttcgcacagatacaatttaatgtggtgatgcgccgtcacccgctggtctacgtggtgagcctcctgatcccatccatttttctcatgctcgtggatctggggtcgttttaccttcctcctaattgcagagccaggattgtcttcaaaactagtgtgctggtcggatacactgtctttcgggttaacatgtccaatcaagtgcccagatctgtaggctccaccccgcttatagggcactttttcactatttgtatggccttcctggtgctgtccctcgctaagtctattgtgttagtcaaatttctccacgacgaacagagggggggccaggagcagccgttcctctgtttgcgaggcgatacagatgccgaccggcccagggtggaaccccgggcacagcgcgctgtagtgaccgagagtagcttatatggtgagcacctagcacagcctgggacactcaaggaagtctggtcgcagctgcaatcaatttccaactacctgcagacacaagatcaaaccgatcagcaggaagctgaatggctggttttgctgagcaggtttgaccggctgctctttcagtcgtatttgtttatgctagggatctacacaatcactctgtgcagcctgtgggccttatggggcggcgtgtag

SEQ ID NO: 106571 - DNA, 1293 bp, Artificial Sequence
  Description of Artificial Sequence: Synthetic coding sequence
atgatcgtatacttccccgggattctcgcaacagatactcatcacccccaagatagtgccctgtatcatcttagtaagcagttgctgcagaaatatcacaaagaagtgaggcctgtatacaattggactaaagccactactgtgtatctggaccttttcgttcacgcaatactggacgtagacgccgagaaccagatcttaaaaacttccgtttggtatcaggaggtatggaacgacgagtttctgtcctggaatagttccatgtttgacgagatcagagaaatatctctgccgctgtcagctatatgggcacctgacatcattatcaatgagtttgttgacatagaaagatacccagatctgccctacgtatacgtaaatagctctgggaccattgagaactacaagcctatccaggtggtctccgcttgctccctggagacttacgccttcccctttgatgtgcagaactgctccctgacattcaagtctattttacacacggtcgaagacgttgatttggcatttcttcggagtcccgaggatattcagcacgacaaaaaggctttcctgaatgactcagagtgggaactgctatctgtatcatccacatactcaatcctgcaatcatctgctggaggattcgcccagatccaatttaacgtggtaatgcgaaggcatcccctggtgtacgtcgtttctctgttgatcccaagcatctttcttatgctggttgaccttggcagcttttatcttcctcctaattgccgggccagaattgtgttcaagacgtccgtcctggtcggctacacagtttttcgcgtaaacatgtcaaaccaggtcccacggtctgttgggtctacccctctcattggacatttcttcacaatctgcatggccttcctggttttgtcacttgcaaagagcatcgttttagttaaattcctgcacgacgaacagagggggggccaggaacaacccttcctatgccttcggggcgataccgacgctgaccggccgagagttgaaccaagggcccagcgggccgtcgtgaccgagagcagtctctatggggaacacctggcccagcccggaaccctgaaggaggtctggagccagctgcagtccattagtaattatctgcaaacccaggatcagacggaccaacaggaggccgagtggctggtacttctgtcccggttcgaccggctcctgtttcagtcatacctgttcatgctcggcatttacaccattacactctgttctttgtgggccttatggggcggcgtatag

SEQ ID NO: 106572 - DNA, 528 bp, Artificial Sequence
  Description of Artificial Sequence: Synthetic coding sequence
tgagctgagaatcagattctgaagacttcagtctggtaccaggaagtctggaatgacgagttcctgtcttggaattcctccatgttcgacgaaatccgggagatctccctgccactgtcagcgatctgggcccccgacatcataatcaacgaattcgtggacatcgaacggtaccccgatctgccttatgtctacgtgaacagtagcggtaccatagagaattacaaaccaatccaggtggtgtcagcatgttcgctagagacgtacgcgtttccatttgatgtgcagaattgttccctcacctttaaatctatcctccataccgtggaagacgtcgacctggcattcctgcgttcaccggaagatatccagcatgacaagaaagccttcctgaatgactcagaatgggagcttctgagcgtgtcgtcgacctatagcatccttcagtctagtgcgggagggtttgcacagattcagttcaatggaacaagtagcccatctgcttggccctcttggtttagcgcatag

SEQ ID NO: 106573 - DNA, 1449 bp, Artificial Sequence
  Description of Artificial Sequence: Synthetic coding sequence
atgctggcctttatactcagtagagccacacctcggcccgcactcgggccattgtcctatagggaacaccgggtggccctgttgcaccttacccactcaatgagtacaaccggcaggggcgtgacatttaccattaactgctcaggatttggccagcatggggccgatcctacagccctgaattccgtattcaatcgaaagcctttcagacccgttacaaacataagcgtcccaacccaggtcaacatctcttttgctatgtctgccatactcgacgtcgtatgggataacccttttatcagctggaatcccgaggagtgcgaaggcataaccaaaatgagcatggctgcaaagaacctgtggttgcctgatattttcattattgaactgtgtgtctccagagctgggcaacgagaagtgccatccccaggcagtcaccgggaccacagcctccctctcgggcctttgatggacgtggacaagactcctaaggggctgacggcttacgtgtccaacgagggcaggattagatacaagaaaccgatgaaagttgactcaatctgcaatctcgatatcttttatttcccctttgatcagcagaactgtacccttacattttcttcctttctctacactgttgactctatgctgcttgacatggagaaagaagtttgggaaatcacagacgccagccgcaatatcttgcaaacccacggcgagtgggagctgctgggcctaagcaaagcaacagcaaaattgagcaggggtgggaacctgtacgatcagatcgtcttttatgtggctatccgccggaggccttccctgtacgtgatcaatttgttggtaccctctggctttctcgtggctatcgatgcattgtcattctaccttcccgttaaaagtggcaatcgggttccttttaagataactctcctgctggggtataacgtgttcctgctgatgatgtcagatcttttaccgacgagcggcaccccactgatcggggtgtactttgctttgtgtctctctttaatggttggcagtcttcttgaaaccatctttatcacacatctgctccatgttgcaacgactcaaccacctcccctgcctcgctggctccactccttactgcttcactgtaactcaccgggacggtgctgccccacagctccacagaaggaaaataagggcccaggactgaccccaacgcacctgccgggagtaaaggaacctgaagtctctgccggacagatgccgggcccagctgaggcggaacttacaggaggctccgaatggacccgggcacagcgcgaacacgaggctcagaaacagcactcagtcgagttgtggttgcaattcagtcacgctatggacgctatgttgtttaggctttatctcctcttcatggcgtcctctattatcacagttatctgcttgtggaacacatag

SEQ ID NO: 106574 - DNA, 1137 bp, Artificial Sequence
  Description of Artificial Sequence: Synthetic coding sequence
atggacaagttggacgccaacgtaagtagcgaggaagggttcggctccgttgaaaaagtcgttttgctgacgtttctttctacagtgattctcatggccattctaggaaacctccttgtgatggtggctgtgtgttgggaccggcaactccgaaaaatcaagaccaactattttattgtgagcctggccttcgccgatctgcttgtctccgtgctggtaatgccattcggcgccatagaactggtacaggatatttggatctacggagaggtgttttgtcttgtgaggactagtctggacgttcttctgactaccgcgagtatttttcatttgtgttgtataagccttgaccggtattacgccatctgctgccagcctttagtttatagaaacaaaatgacccccttgaggatcgctttaatgttgggcgggtgctgggtaattcctacctttattagcttcctacctatcatgcagggatggaacaacatcggcatcatagacctaatcgaaaagcgcaaatttaaccagaactcaaatagcacctactgtgtgtttatggtcaataagccctacgccatcacatgttcagtagtggctttctacattcctttcctgctcatggtcctggcctattaccgcatttacgtcacagctaaggaacacgctcatcaaatccagatgctgcaaagggcgggtgccagctctgaatccaggccccagtcagctgatcaacactccacacaccggatgaggaccgagaccaaggctgcaaagaccttgtgcattattatggggtgtttctgcctatgttgggcccccttttttgtgaccaatatcgtggacccatttatagactatactgttcctggccaggtctggactgcctttctctggttgggctacattaactcaggtctgaatccctttctgtatgcgtttctgaataagtccttccggagagccttcctgatcatcctctgttgcgacgatgaacgataccggcgcccgtccatactgggccagactgtgccatgcagtacaactaccataaatggctccacccatgtgctgagcgggtgtagccctgtcagcagttttttactcttgttctgtaatcggccagtgcccgtctag

SEQ ID NO: 106575 - DNA, 1164 bp, Artificial Sequence
  Description of Artificial Sequence: Synthetic coding sequence
atggataagttagacgccaatgtgtccagcgaagagggatttggctctgttgagaaagttgttctgctgaccttcctctcaaccgttattctgatggctattctaggaaacctgcttgttatggtggcagtctgctgggaccgccaactgagaaaaataaagaccaattatttcatcgtgtcgcttgcgttcgctgatctgctagtctccgtcctggtgatgcccttcggagctatagagctggtacaggacatatggatttacggggaagtcttctgccttgtgcgcacatccctggatgtgctgttgactaccgcatcaatttttcacttatgttgtatcagtctggaccgttactacgcaatttgttgtcaacctctggtctaccgcaacaaaatgacccctcttcgcattgcactgatgctaggcgggtgttgggttattcctacattcatttccttcctgccaataatgcagggatggaacaatattggcattatcgatctgatcgagaagaggaagttcaatcagaacagtaactcaacttactgtgtgttcatggtgaacaaaccttatgctattacatgctccgtggtggctttctacattccctttctcttgatggtgctcgcatactatcggatctacgtgacggctaaagagcacgcccatcagatccaaatgcttcagcgagccggagcatccagcgagtcaagacctcagagtgccgaccaacacagtacgcaccgaatgcgcacagagacaaaggccgccaagaccctctgcattatcatgggttgtttctgcctgtgttgggccccattctttgtgacaaacatcgtggatcccttcatcgactatacggtgcccggccaggtttggacagcgtttctgtggctagggtatatcaatagcggtctcaacccttttctgtacgctttccttaataagagtttcaggagagcgtttctcatcatcctgtgctgcgacgatgagagatataggcgtccatcaatactgggtcagactgtgccgtgcagtacaacaaccattaatgggtcaacccacgtgctgcggtacacggttttacaccgcggccatcaccaggaactggagaaactgccaatacacaacgaccccgagagccttgagagctgtttttag

SEQ ID NO: 106576 - DNA, 1287 bp, Artificial Sequence
  Description of Artificial Sequence: Synthetic coding sequence
atggacaagctcgatgcgaacgtgagctcagaagagggatttggaagcgtggagaaggtggtcctgttgacattcctctcaacagtgatactgatggctatcctcggcaacttactggtcatggtggctgtttgttgggatcgacagctgcgcaagatcaagaccaactatttcatagtctccttggcatttgccgatctgctggtctctgtcttagtgatgcctttcggtgccatcgagttagtccaagacatttggatctacggggaggtgttctgcctggtccgtaccagcctcgacgttctactaactactgccagtatatttcacctgtgttgtattagcctggatcgatactatgctatttgttgtcagcctctggtctatcgcaataagatgacccccctgaggatagctctcatgctgggtggttgctgggtgatcccaacctttatcagctttctacctataatgcaggggtggaataacatcggaattattgatctaatagagaaaaggaaattcaaccaaaattccaattccacctactgcgtattcatggttaacaagccgtacgcgatcacatgtagcgtggtggcattctacattccattcttgctcatggtactagcttactatcggatctacgtgactgccaaggagcacgcccaccaaattcagatgttacagagagcaggggcctcttccgaaagcagaccacagagcgctgatcagcattccacccaccgcatgaggactgaaaccaaagccgcaaaaactctgtgtattatcatgggctgtttctgcttatgctgggcaccttttttcgttaccaatatcgtggatcccttcattgactacacggtccctggccaagtgtggacggccttcttatggttgggatatatcaacagcggtctcaacccttttctgtacgcttttctcaataaaagctttcgccgcgcctttctgatcatactgtgttgcgatgatgagagataccggaggccaagcatcctgggccagacagtgccttgttcgacaactactattaacggatcgactcatgtgttgaggactgactttcttttcgatcgagacatcctggcccgatattggacaaagcccgctagagccggcccgttttccggaacactgagtataaggtgccttaccgcaaggaaacctgtactaggggacgccgtagagtgcggaggccagtgggagagccaatgccatcccccagccacttcccccctcgtggccgctcaaccctcagacacatag

SEQ ID NO: 106577 - DNA, 1209 bp, Artificial Sequence
  Description of Artificial Sequence: Synthetic coding sequence
atggataaactcgacgccaacgtcagctccgaagaggggttcggttccgtggagaaggtcgtgctgctgacattcctctcaaccgtcatcctgatggctatcctgggtaatctcctcgtgatggtggccgtgtgttgggaccgccaattaagaaaaatcaaaaccaactattttatagtttccctcgcctttgcggatctgctagtttcagttctagtgatgccatttggcgctatcgagctcgtgcaggacatctggatctatggtgaggtgttttgtcttgtgcgaaccagtctagacgttctcttgacgacagcaagcatctttcacctctgctgtatatccctggatcgatactacgcaatctgctgccaaccactggtctaccgaaataagatgactcccctgcggatcgcccttatgctgggggggtgctgggtgattcctacattcatcagcttcttgccaatcatgcagggatggaataatataggtataatcgacctcgagaggagcttgaatcaaggactaggacaggacttccatgcaattgagaagagaaagtttaatcaaaacagcaattctacttactgtgtttttatggtcaacaaaccatatgctatcacatgctccgtagtggccttctatatccctttcctcctgatggttttggcatactaccgcatctacgtaactgcaaaggaacacgctcatcagattcagatgctgcaaagggcaggagcgtccagcgagagtcgaccgcagtcagctgaccagcatagtacccatcgtatgcggacagagactaaggccgccaagaccttgtgcattattatgggatgtttttgtttgtgctgggccccattttttgttaccaacatcgttgatccattcatcgactacaccgtacctggccaggtttggaccgcttttctgtggctggggtacatcaactcgggactgaacccattcctgtatgccttcctcaacaaatccttcaggcgggctttcctcatcatcctgtgctgtgatgacgaacggtataggaggcccagcatactcggtcagacagtcccttgttctacgactacaattaacggatctacccacgtcttgcgggatgcagtagagtgcggcgggcaatgggagtctcagtgtcacccgcctgccacatctcctctcgttgctgctcagccaagcgacacctag

SEQ ID NO: 106578 - DNA, 1167 bp, Artificial Sequence
  Description of Artificial Sequence: Synthetic coding sequence
atggacaaacttgacgctaacgtgtccagcgaagagggcttcgggtcagtggagaaagtggtattgctgacttttcttagtacagtgatcctcatggcgatcctgggcaatctcttggttatggtagctgtgtgttgggaccggcagctgaggaagatcaagacgaactactttatagtgagcttagctttcgcagatctgctcgtgtctgtgctggtaatgccctttggagccattgagctcgtgcaggacatctggatatacggcgaggtattctgcttagtacgcacgtctcttgacgtgctgcttacgaccgcatccatcttccacttgtgttgcatctcactggatcggtactacgccatctgttgtcagccactggtttataggaataagatgacccctctaagaattgctctgatgttgggaggatgctgggtgatccccaccttcatctcctttctaccaataatgcaaggctggaacaatatcgggataatcgacctgatcgaaaagagaaagtttaaccagaactcaaactctacgtactgtgtgttcatggttaataagccatatgccatcacgtgctctgtagtggccttctacatacctttcttattgatggtgttggcctattatcgtatttacgtcactgcaaaggaacatgctcaccagattcagatgttgcaacgagccggtgctagcagcgaatcaaggccccaatccgccgatcagcattcgacacacagaatgcggactgagacaaaagcagccaagacgctctgcatcatcatggggtgcttctgtctttgttgggccccgtttttcgtgacgaatattgttgaccccttcattgactataccgtcccaggtcaggtatggactgcctttttatggctgggatacatcaactctggtcttaacccgttcttatacgcctttctcaataaatcattcagaagagcctttctgatcatcctatgctgcgacgacgagaggtatcgccgcccttccatcttgggacagaccgttccctgttcaaccaccacaatcaatggctctacacacgtgctgcgggacgcggtggagtgcggtgggcaatgggagtcgcagtgtcaccctcccgccacatctcctctcgtggctgcacaaccttcggatacatag

SEQ ID NO: 106579 - DNA, 1083 bp, Artificial Sequence
  Description of Artificial Sequence: Synthetic coding sequence
atggacaagttggatgccaatgtgagcagcgaagaagggtttggcagcgtagaaaaggtcgtgctcctcactttcttaagcacagtgattctaatggctattttggggaacctcttagtcatggtggccgtgtgctgggaccggcagctgagaaaaataaaaactaactacttcatcgtttccctcgcttttgccgacctcttagtttctgtcctggttatgccatttggcgcgattgaactggttcaagatatctggatatacggggaagtcttctgtctagttcggacatcccttgatgtgttactgacaacggcctccatttttcacctctgctgtatctcattagatcgttactacgctatctgctgccaacccctcgtctatcgcaacaagatgacaccgcttcgcattgcgcttatgctggggggatgctgggtcatccccacatttatcagcttcctgcctatcatgcaggggtggaataatatcggaatcatcgacctaatagagaaacgcaaattcaaccagaatagcaactccacatactgcgttttcatggttaataagccctatgccatcacttgtagtgtggtcgctttctatatacccttcctgctcatggtcttggcttattacagaatctatgtgaccgcgaaagaacatgcccatcagattcagatgttacagcgggcaggagcgtcatccgagagccgcccccagagcgcggaccagcactctacccacaggatgagaactgaaaccaaagccgcaaagacactgtgcatcataatgggttgcttctgtctgtgctgggctccgttcttcgtcactaacatcgtggatccctttatcgattatacagtccctgggcaggtttggacagcatttctgtggctcgggtatatcaatagtggactgaacccattcctatacgccttcttgaataaatcatttaggcgggccttcctcattatcctgtgttgcgatgatgaaaggtacagaagaccctctatactgggacagactgtgccctgtagtacaacaacaataaatgggtcgactcatgtcctgcgattctag

SEQ ID NO: 106580 - DNA, 1236 bp, Artificial Sequence
  Description of Artificial Sequence: Synthetic coding sequence
atggacaaacttgacgccaatgttagctctgaggaggggtttggctctgtggagaaggtggttctccttacatttctctcgaccgtgattctcatggcgatcttgggcaacctgcttgtgatggtggccgtatgctgggaccgccagctgagaaaaattaagaccaactatttcattgtgagtttggcattcgcggatctgttagtgagtgtgttggtgatgccctttggagcgattgagctagttcaggacatctggatctatggtgaggtgttttgcttagttcgcacaagtctcgacgtgctactgactaccgcttccatcttccacctttgttgtattagcctggaccggtattatgccatttgttgtcaaccccttgtgtaccgtaataagatgactcctctgcggatcgctctgatgctcggaggctgctgggtgatcccaacctttatctccttcttacccattatgcagggttggaataacataggtatcattgacctgatcgaaaagcggaagttcaatcagaactccaatagcacctattgcgtgtttatggtaaacaaaccatatgcaatcacctgttcagtggtggccttttacattccctttctgctgatggtgctggcatactaccgcatctacgtgaccgcgaaggagcatgcccaccaaatacaaatgctacagagggcgggcgcctcatctgaatcaaggccacaatcggccgaccaacacagcacacatcgaatgcgaaccgagaccaaagctgcaaaaacactatgcattatcatgggatgtttctgtctatgctgggctcccttctttgtgacaaacattgtggatccattcatcgactataccgtgccgggccaagtttggactgcctttctatggttaggctatataaattccggtcttaatcccttcctgtacgccttcttgaataagtctttccgccgcgcattcctgataattctgtgctgcgatgacgagcgctatcgacggcccagcatcctcgggcagaccgttccttgctcaactacgaccatcaacggctctacccatgtgctgagcagtgggacagaaacagaccgcaagaaactgtggaataaggaggagaaaatcgaccagacaatccagatgccaaaacgaaagaggaagaagaaagcctcattatcttacgaggatctcattctgctggggcgcaagtcctgtttcagagaggggaagtag

SEQ ID NO: 106581 - DNA, 1164 bp, Artificial Sequence
  Description of Artificial Sequence: Synthetic coding sequence
atggataagctcgacgccaacgtgtcctctgaagaaggctttggatccgtggagaaggtcgtacttctgacctttctctcaactgtcatcctaatggcaatccttgggaacttacttgtgatggttgccgtttgctgggacagacagctcagaaagatcaagaccaattacttcattgtcagtttggctttcgccgacctgctggttagcgttctggtgatgccgtttggcgccatagaactagtccaggatatctggatctatggcgaagtgttctgtttggtaaggaccagcctggacgtgctgctgaccaccgcatcaatcttccatctgtgttgtatatccctcgatcggtattacgcgatttgctgtcagccacttgtttaccggaacaagatgaccccactgaggatcgcattgatgctcggtggttgttgggtaattcctacattcatcagttttcttccaattatgcaggggtggaataatataggcattatagatttaatagagaagcgaaagttcaaccaaaactccaactccacctattgcgttttcatggttaataagccttacgctatcacctgcagcgtagtggccttctacataccctttctgctgatggttcttgcctactaccgaatatacgtgaccgctaaggagcatgcccaccagatccaaatgctgcaacgggccggcgcatccagcgaatcacgtcctcagtcggcagaccagcactctacccaccgcatgagaaccgaaactaaagctgctaaaacactctgtattattatggggtgtttctgcctgtgttgggccccgttttttgttaccaatatcgttgatccttttatagattacacagtgccaggacaagtgtggacagcttttctgtggctgggttatatcaactcgggcctcaacccttttttatacgccttcctgaataaaagtttcagacgggccttcctgatcatactgtgctgcgacgacgagaggtacaggcgcccatcgattttaggacagactgtgccttgcagcaccaccaccatcaacggaagcacccacgtcctgcgatatactgtcctgcatcgagggcaccaccaggaactggagaagttgcctattcacaacgatcccgagtctctggagtcctgtttttag

SEQ ID NO: 106582 - DNA, 1137 bp, Artificial Sequence
  Description of Artificial Sequence: Synthetic coding sequence
atggataaactcgatgctaatgtgagtagtgaggagggcttcggatctgtggagaaggtggtccttttaacgttcctatcgacagttatcctgatggctattctgggcaacctactggtaatggtggcagtttgttgggatcggcagttgcgaaagatcaagactaattatttcatagtcagtctggcattcgccgatcttctggtaagcgtcttggtcatgccatttggcgctatcgagctcgtgcaagacatttggatttacggagaagttttctgccttgtgcgcacgagcctggatgttcttctcaccactgcctctatctttcacctgtgctgcatttcacttgacagatactacgccatctgctgccagccactggtgtacaggaataagatgactcctctgcggatagctctgatgctcggtgggtgttgggttatccccacattcatatcttttttacccattatgcagggttggaacaacattgggatcattgaccttatcgagaaacggaaatttaaccagaattcaaattccacgtactgcgtgtttatggtgaacaagccatatgcgattacatgcagcgtggttgccttctacatcccgttccttctgatggtgctggcttactaccggatttacgtgaccgccaaggagcatgcacatcagatccagatgctccagcgggcaggagctagctctgagtcaagaccgcagtccgcggatcagcacagtactcaccgaatgagaacggagacgaaagccgccaaaacactgtgcatcatcatgggctgcttctgcctctgctgggcacctttctttgtcacaaatatcgtggaccctttcatcgattacaccgtgcctgggcaggtgtggacagcctttctgtggctcggctacattaactctggtctgaacccgttcctgtacgcttttctgaacaaaagttttcggcgagcctttctgattatactgtgctgtgatgacgaacgctatagacgccctagtattctcggccagacagtcccttgcagcactactactatcaatggctctacgcatgttctctcaggatgttccccggtgtcttcattccttttactgttctgtaacaggccagtaccggtttag

SEQ ID NO: 106583 - DNA, 1137 bp, Artificial Sequence
  Description of Artificial Sequence: Synthetic coding sequence
atggacaagctggatgctaacgttagctctgaagaaggctttgggtcagttgaaaaggttgtactcctaaccttcctgagcacagttatcctgatggcaatcctggggaacctgcttgtcatggtagcagtgtgctgggaccgacaattgcggaaaattaagacaaattattttatcgtcagcctggcctttgccgacctgctggtgtccgttctggtgatgcccttcggagcaattgagctggtacaggatatttggatatacggtgaagtcttttgccttgtgcggacctccctggacgttctccttacgacagccagcatcttccacctttgctgcatctcgctggataggtactatgcaatctgttgtcagcccctggtatacagaaacaagatgacacccctcagaatcgccttgatgctcggaggatgttgggtcatccctacttttatcagcttcctgcctatcatgcagggctggaacaatataggcattatcgatcttatcgagaagcgcaagttcaatcagaactcaaactccacctattgtgtgttcatggtaaataaaccttatgcaatcacatgcagcgtggtcgccttctacatccctttcctcttaatggtgctagcttattacagaatctatgtgaccgctaaggagcatgcccaccagatccagatgttacagcgggcaggggctagttccgaaagcagacctcagtccgctgatcaacatagcacccaccggatgaggacagaaacaaaggccgctaaaacactctgtataatcatgggctgcttttgcctctgctgggctcccttcttcgtcacaaatattgtcgatcccttcattgactatacggtccccggacaagtgtggactgctttcttatggttaggctatataaactccggcctgaatccattcctgtacgcttttcttaataagtccttcagaagggctttcctgatcatcctatgttgcgatgacgaacggtaccgaaggccaagcatcttagggcagaccgtcccctgcagcacaaccacaattaacggtagtacccacgttctgagcggatgctctccggtcagttcattcctgctgttgttctgcaataggccggttcccgtatag

SEQ ID NO: 106584 - DNA, 1074 bp, Artificial Sequence
  Description of Artificial Sequence: Synthetic coding sequence
atggacctgcccgtgaatctgaccagtttcagccttagcacccccagccctctggagacaaaccactccttagggaaggacgacctgcgcccaagttcgccactgctgagtgtcttcggtgtgctgattctcacgttgctgggatttcttgtggctgccacgtttgcttggaacctattggtcctcgcgacaattctgagagttcgtacatttcatcgtgtaccgcataaccttgtagcaagcatggctgtgagcgacgtcctcgtggctgctctcgtaatgcccctctcccttgttcacgagctatcaggcaggcgctggcagttgggaaggcgactttgtcagctgtggatcgcttgcgacgtcttgtgttgcactgcgtcaatttggaacgttacagcaatagctctggacagatactggagcattactcgccatatggaatatacattaaggactaggaagtgtgtgtctaatgtcatgatcgccctcacctgggctctatctgccgtaatctcactggcccccctgttattcggttggggagagacctactcggaggggagcgaagagtgccaggtgtcacgagaaccttcctacgccgtcttttccacagtcggagccttctatttgcctctctgtgtggtccttttcgtatattggaagatctacaaggccgcaaaattccgggtcggatcaagaaaaacaaactctgtttctcctatatcagaagccgtggaagttaaggactcagcaaagcagccccagatggtgtttacggtgaggcacgctaccgttacattccagccggaaggagacacttggcgggagcagaaggaacagagggcggctctgatggtgggtatcctaattggtgtctttgtgttgtgttggattcccttttttctgactgagttgatttctccactttgctcctgtgacattccagccatctggaagagcatttttctctggttaggctactctaattctttcttcaaccccctcatctacaccgcatttaataaaaattataactcagcgtttaagaacttctttagtcgacagcattag

SEQ ID NO: 106585 - DNA, 1323 bp, Artificial Sequence
  Description of Artificial Sequence: Synthetic coding sequence
atggtgcccgagcctggccccaccgccaattctacaccagcatggggcgccggccccccctctgcccccggcggatccggatgggtggctgctgcgctgtgtgtggtgattgcactgactgccgctgccaactcactcctcatcgctctcatctgcactcagccagccctgcggaacacctccaacttttttttagtctctttgtttacgtcagatcttatggtgggattggtggtgatgcccccggccatgctgaacgcgttgtacggacgctgggttttggctagaggtctgtgcttgttatggacagcattcgacgtgatgtgttgttcagcttcgattctcaatctctgtcttatctccctggatcggtatctgctgatcctgtcccctcttaggtataagcttagaatgacacccctcagggccctagctctggttcttggcgcctggtccctcgccgctctagcgtcctttttaccgcttcttttgggatggcatgagctagggcacgctcgccctcccgtgcctgggcagtgtagactcctggccagcttgccatttgtactggtcgcctccgggctaacttttttcctgccatcgggcgccatctgtttcacatactgccgcatcctgctggctgccagaaaacaggcagttcaggtcgcctccctaacaacaggaatggcgtcgcaggcttccgaaacattgcaagttcctaggactccgaggccaggggtagaaagcgccgactcaaggcgccttgcgaccaagcactctaggaaggcactgaaggcctccctcactctgggaattctgctgggcatgtttttcgtgacatggctgccattcttcgtagctaacattgttcaggcagtttgtgattgtatctctccaggcctttttgacgtactcacatggctgggatattgcaatagcacaatgaaccctatcatttacccgctgtttatgagagactttaaacgagctctgggcaggttcctgccatgtcctcggtgtccgagagagcggcaggcatcactggcaagcccctcactccgcacttcccattccggccctaggcctggcctgagcttacaacaggtacttcccctcccactgccaccggacagcgatagcgatagtgacgcgggatctggcgggtccagcggcttgcggctgaccgcccaattactcctacctggggaagccacccaggatccaccactgcctacgagagccgcagcagcagttaatttttttaatattgacccagccgaaccagaactaaggcctcatccactgggaatcccaacaaattag

SEQ ID NO: 106586 - DNA, 1338 bp, Artificial Sequence
  Description of Artificial Sequence: Synthetic coding sequence
atgatggacgtgaattcctcagggcgacccgacctctacggccacctcagaagtttcctgcttccagaagtgggccggggattgccagatctcagccccgatggcggcgccgatcctgttgccggcagctgggccccccatctcctctcagaagtgactgcgagcccagctcccacctgggacgctccccctgataacgccagcggatgtggtgaacagattaactacggccgagttgagaaagtggttataggttcgatactgaccctgattaccctgctcactatcgccggcaactgcctggttgttatttcggtgtgttttgtgaaaaagttaagacagccgtcaaactacctaattgtcagtctagccctggctgatctcagtgtggccgtggccgtgatgccatttgtctcggtgacagatctcataggaggcaaatggatcttcggccatttcttctgcaatgtcttcatagcaatggacgttatgtgttgcacagcctccattatgacactgtgcgtgatcagcatcgacagatatctcggcatcactcgcccactcacctatcctgttagacagaacggaaagtgcatggcaaagatgatcctgtcagtgtggctactgagcgccagcatcactttgccccccctgttcggctgggcccaaaacgtgaatgacgacaaggtgtgccttatcagccaggactttgggtataccatatatagcaccgctgtcgcattctatattccaatgtctgtcatgctgttcatgtattaccagatctacaaggccgcccggaagtctgctgcgaagcacaaattcccaggcttcccgcgagtagagcccgattcagtgattgccctaaatgggatagtgaaactgcaaaaggaggtcgaggagtgtgccaacctgagtcggcttctgaagcatgagagaaaaaacatctcaatcttcaaacgggaacagaaagcagccacgactttgggaatcattgtaggagcattcaccgtgtgttggctgcctttttttctcctgtcgactgcccggccattcatctgcggtacaagctgctcctgcatcccactatgggtagaacgcactttcctgtggttaggatatgccaacagccttatcaatccttttatctatgcattctttaaccgcgacctcagaaccacatataggtcattgctgcaatgccaatacaggaatatcaatcgaaaactcagcgccgcgggcatgcatgaggctttaaaactggccgagaggcccgaaagacccgaatttgtactacaaaatgctgattattgccggaaaaaaggccacgactcatag

SEQ ID NO: 106587 - DNA, 1440 bp, Artificial Sequence
  Description of Artificial Sequence: Synthetic coding sequence
atgatggacgtcaactcctctggccggcccgatctctatggccacctgaggtcatttctgctgcctgaagtggggaggggattgccagacctttcacctgatggaggggccgatccagtcgccggaagctgggcaccccacctcctgagcgaagttactgcctcaccagcacccacttgggatgccccgcctgacaatgcctccggttgtggggaacaaattaactacggtcgggtcgaaaaggtggtgattgggagtatcttgaccttgatcacactgctcactattgcgggcaattgtcttgtggtaatctcagtctgcttcgtgaaaaaactgagacagcccagtaactacctcatcgttagcctggcacttgccgacctttctgtagctgtcgcagtcatgccgtttgtatctgtgaccgaccttatcggtggcaagtggattttcgggcactttttctgcaatgtattcattgcaatggatgtcatgtgctgtacagcatcaattatgaccctctgtgtgatcagcatcgatcggtacctgggaattactaggcccctgacctacccagtgcgtcaaaacgggaaatgcatggctaagatgattctgtccgtgtggctgctatcagccagtattaccctgcccccattgttcgggtgggctcaaaacgtcaacgacgataaggtgtgccttatctcacaggatttcggctacaccatttattcaaccgccgtcgcgttttacattcccatgtctgttatgctgtttatgtattaccagatttacaaggccgctcgcaagtccgctgcaaagcacaaattccctgggttcccgagagtagagcctgatagtgtgattgcactgaatgggattgtgaagctgcaaaaggaagtggaggagtgcgcaaacctctcacgtctgctgaagcacgagcgtaagaatattagcatttttaagcgagaacagaaggcggcgaccactcttggcattatcgtgggcgcctttactgtctgttggctgcctttcttcctgctttctacagcccggcccttcatttgcggaacgagctgttcttgtatacccttatgggtggagcgaacattcctgtggctaggctacgccaactccctcatcaatccttttatatacgcatttttcaatagggacctgcggacaacgtacaggtctctattgcagtgccagtaccgaaacattaatcgcaaactcagcgcagcgggcatgcacgaagcgcttaaactggcggagcggccggaacgcccggagtttgttctgcgagcctgcaccagacgggttcttttaagacctgagaaacgacctccagtgtccgtgtgggtcctccaaagccccgaccaccacaactggttagccgacaagatgttgacaacagtcgagaagaaagtcatgatccatgattag

SEQ ID NO: 106588 - DNA, 1299 bp, Artificial Sequence
  Description of Artificial Sequence: Synthetic coding sequence
atgatggatgtcaacagttctgggagacctgatctgtatggccatctgagaagttttttgctgcccgaagtgggtcgggggctgcccgatctgtcgccagacggtggcgccgatcctgtggccgggagctgggccccccacttgctgtccgaagtcaccgctagtcctgctccaacatgggacgcccccccagacaatgcctctgggtgcggagagcagatcaattatggccgagttgaaaaggtagtgattggatctatattaactctcatcaccctgctgaccattgccgggaactgccttgtggtgatcagtgtgtgcttcgtaaaaaaactacggcaaccctcgaactatctcatcgtgtcactcgccctcgccgacctctctgtagccgtcgcggtcatgcccttcgtgtccgtcacagacctcataggaggcaagtggattttcggccacttcttttgcaacgtgttcatcgcgatggacgtaatgtgttgcacagcatctatcatgacattgtgtgtaatcagtattgacagatacctgggcatcaccagacccttgacataccctgttcgacaaaatggaaaatgcatggccaaaatgatcctgtccgtgtggctcctttccgcctctatcaccttacctcccctcttcggatgggcgcagaatgttaatgatgataaagtctgtttaatttcccaagacttcggctataccatttattccaccgcggttgctttctatatccctatgtctgtcatgcttttcatgtattatcagatttacaaagctgctcgcaaaagcgccgcaaaacataaatttccaggattcccaagggtggaacccgattccgtgattgccctgaatgggatcgtgaagctgcagaaggaggttgaggagtgcgccaacctttctcgcctgttgaaacacgagaggaagaacatcagcatcttcaagagggagcagaaagccgccaccacgcttgggattatcgtgggagcctttactgtctgctggctgcctttcttcctcctgagtactgcacggccttttatctgcggaacaagctgctcttgtatcccattatgggtggaacgtacattcctgtggctgggctacgcaaatagtctgatcaatcccttcatatatgcctttttcaatagagacctgcgcacgacttacaggtctctgttgcagtgtcagtatcgtaatatcaaccgaaagttatctgctgccgggatgcacgaagccttaaaattggccgaacgaccagaacgaccagagtttgtcctgtag

SEQ ID NO: 106589 - DNA, 1440 bp, Artificial Sequence
  Description of Artificial Sequence: Synthetic coding sequence
atgatggacgtgaacagtagcgggagacctgacctgtacggacatctccgctctttcttgctccctgaagtgggccgaggactgccagatctgtcccccgacggcggggcagaccccgtggccgggtcttgggccccccacctgcttagcgaagttacagcctcaccggcccctacttgggatgcccctcccgataatgcaagcggatgcggggagcagatcaactatggcagggtcgagaaggtggtgatcggcagcatcctaaccctgataacactgctcaccatcgctggaaactgtctggtggttattagcgtctgtttcgttaagaaactgcggcagccctcgaactatcttattgtctccctggctctggctgatctgagcgtggccgttgcagtgatgcccttcgtgtctgtcaccgacttaattgggggcaaatggattttcggtcattttttttgtaatgtgtttatcgcgatggatgtgatgtgttgcacagcaagtatcatgacactgtgcgtaatttctattgacaggtatctgggaattacccgtcctctgacttacccggtgcgacagaatgggaaatgcatggcaaaaatgatcttgtcagtgtggctgctgagcgcctcaatcaccttgcctccactcttcggttgggcacagaatgtgaatgacgacaaagtgtgcctgatcagtcaagactttgggtatacaatctatagtaccgcagtggcattttacatcccaatgtcagtgatgctgttcatgtattatcagatttacaaagccgcccggaagtcagcagccaaacataagtttcccgggttccctcgggttgagcctgacagtgtgatcgcactgaacggaatcgtgaaactccagaaagaagttgaggaatgcgccaatttatccaggctgctaaaacatgagcggaagaatattagtattttcaagcgggaacagaaggccgctaccacgttgggaatcatagttggtgccttcaccgtgtgttggctgccctttttcctgctctcaactgccaggcccttcatctgcggtactagctgctcgtgcatcccgctgtgggtcgagcgtacatttctttggttagggtatgcaaattcattgatcaacccctttatttacgcatttttcaatagagatctcaggactacatataggtccttactgcagtgccagtatcgcaacattaatcggaaactgtccgccgctggcatgcacgaggcgctgaagttagccgagcggccagagcggccagagtttgtactgatcacccggacttctggcgtccatcaggccctggaaaactttccctggggaaatgaagtgaatagatggcgtaaatcttgcgaatacttctgcacagataaaatgctgacgaccgtcgagaaaaaggtgatgattcacgattag

SEQ ID NO: 106590 - DNA, 2460 bp, Artificial Sequence
  Description of Artificial Sequence: Synthetic coding sequence
ggcatgctggatggcccttcagctatgactcggttctgtaatcttatcgcctccgaaccggacatcgccaaagtacctttgtgtatcgacagctctaactttgctgtcatcgaagcaggactgaagtgttgccaaggaaaatgtattgtgaactccataagtctcaaggagggcgaagccactgaaactgataccaagattcgcgtgtgcacgcgggcctaccacctgctggtgaagaagctcggatttaacccaaacgatattatcttcgaccccaacatactcaccattgggaccggaatggaggaacataacttgtacgctatcaactttattcacgccactaaggtcattaaggaaaccctgcctggcgcacgtatctccggtggactgtccaatctgagcttctcttttcggggcatggaggctatccgcgaagctatgcacggtgtgtttctttatcatgctattaaaagcgggatggatatgggcatcgtgaacgctggcaatttgccagtctacgacgatatccacaaagaacttctgcaactgtgtgaggatctgatctggaataaagatcccgaagcgacagagaagcttctgaggtatgcccagacacaggggacgggaggaaagaaggttatacagacagacgaatggagaaacggacccgttgaggagagattagagtacgcgctggtcaagggtatagagaagcatattatcgaggatacagaagaggctcgactcaaccaaaagaagtatccccgacctttaaacatcatagaaggcccgctgatgaacggcatgaagatcgtgggcgatttatttggggctggcaaaatgttcctgccgcaggtgattaagtctgcacgagtgatgaagaaggccgtgggacacctgataccattcatggagaaggagcgggaagagaccagggtgctgaatggaaccgttgaagaggaggatccttatcaaggtaccattgtcttagctactgtgaagggggacgtgcacgatattggcaaaaacatcgtgggagtcgtgctgggctgtaacaatttcagggtgattgacctgggagtgatgaccccctgcgataagattttgaaggctgcactagaccataaggctgatattattgggctgagcggcctgatcacgccctcgttggatgaaatgattttcgtggccaaagagatggagaggctggcaatccggatacctctactaatcggaggcgctaccacgagtaagacacatacagcagtgaaaattgccccaagatattcggcacccgtgatccatgtgttggatgcttctaaaagtgtggtcgtatgttctcaactgctggacgagaacttgaaggacgagtacttcgaggaaatcatggaggagtatgaagacataaggcaggaccactacgagtctctcaaagagcggcgctatctgccgctgtctcaagcccgcaagtctgggttccagatggactggttgagcgaaccacacccagtgaagcctacctttatcggtactcaagtgtttgaggactatgacctccaaaaattggtggattatatcgattggaagccctttttcgacgtgtggcagctcagaggtaaatatcccaaccggggctttcccaaaattttcaacgataaaactgtaggcggagaagcacgcaaggtgtatgatgatgctcataacatgctgaacacattgatctcccagaagaaattgagagcacggggggtggtaggtttttggccagctcaaagtatccaggatgatattcatttgtacgccgaggctgctgttccacaagccgccgaacccatcgccactttctacggattgaggcaacaagctgagaaagactctgcctctaccgagccatactactgcctgtcagacttcattgcacctttgcacagtggcatcagagactatttggggctgttcgccgtagcatgtttcggcgtggaagaactgtccaaagcttatgaggacgatggggacgactatagctccataatggtgaaggctcttggcgaccgcctcgctgaggcatttgccgaggaactccacgagagagtgcggagagagctgtgggcctattgcggttctgagcagctggatgtggccgatttgaggagactgcggtacaaggggatccgacccgctccgggatatccttcccagccagaccacactgagaaactaacgatgtggcgcttggccgatattgagcagagtacagggatccgtctgacggaatctctggctatggcgccggcttctgccgtctcaggtctgtatttcagcaatctcaaatccaagtatttcgccgtaggcaagatttccaaggaccaagtggaggactatgccctacgcaaaaacatcagcgtagcggaagtagagaagtggctcggcccgattctgggctacgatacggattag

SEQ ID NO: 106591 - DNA, 3798 bp, Artificial Sequence
  Description of Artificial Sequence: Synthetic coding sequence
atgtccccagccttgcaggatctgtctcagcctgaaggactgaaaaagactctaagagacgaaatcaacgctattctgcagaagcgcattatggtgcttgatggcgggatgggcaccatgatacagcgagaaaagctgaacgaggagcacttccgcggccaggagttcaaggatcatgcgcgcccactgaagggcaacaacgatatcctctcgattactcagccagatgtgatctatcaaatccacaaagagtatttacttgctggggcagatattatcgaaaccaacacattttccagtacctctatcgctcaggccgactatgggttggaacaccttgcctaccggatgaacatgtgctcagctggcgtggcacggaaagcggctgaggaagtgactctgcagactggtatcaaaagatttgtcgctggggccttaggtccaacgaataagacgctctcagtaagtcctagcgtggaacgccccgattaccggaacataaccttcgacgagctcgtggaagcatatcaggagcaggctaaaggcctgctggatggaggtgtggatatcctgctgattgaaacaatatttgacactgctaatgccaaggccgctcttttcgcactgcaaaatttgttcgaagagaaatacgcccctagaccaatcttcatttccggtacaattgtcgataagagtggtagaactctgtcagggcagacgggcgaaggcttcgtgatctctgtctcacacggggagcccctttgtattggtctgaattgtgccctcggagccgcagagatgcggccctttattgagataataggaaaatgcacaacggcctacgtcttgtgttatccgaatgctggtctgccaaatactttcggcgattacgatgaaacacctagtatgatggcaaagcacctgaaagactttgcgatggacgggctagtcaacatcgtgggggggtgttgcggctcgacccccgaccatatcagggaaatcgctgaggctgtgaaaaattgcaagccccgagttccacctgccactgccttcgagggacacatgctgttgtccggcctggaaccgttccggatcggaccatacaccaacttcgtgaatattggagaaagatgtaatgtggccgggagccgaaaattcgcaaaactcatcatggcagggaactacgaagaagcactttgcgtagctaaggttcaggtggagatgggggcgcaagtgttggatgtcaacatggatgacggaatgctggatgggccgagcgccatgactcgcttctgtaacctcatagcctcagagcccgacattgccaaagtgccactatgtatcgattcctcaaacttcgccgtgatagaggccgggttaaagtgctgtcagggcaagtgcattgtcaacagcattagtttgaaggagggagaggacgacttcctagaaaaagcgagaaagatcaagaaatatggagcggctatggtcgtgatggcattcgatgaggaaggccaagccactgagacagacacaaaaatccgtgtgtgcacccgggcctaccaccttctcgtgaagaagttgggattcaatcctaatgatatcattttcgacccaaacattcttaccatcggcacgggcatggaggagcacaacttgtacgctattaacttcatccatgccactaaagtgattaaggagaccctgcctggggcacgcatttcaggcggtctcagcaatctgagcttttcgttcaggggtatggaggccattagggaggctatgcacggcgtattcctgtaccatgccatcaaatccggaatggacatgggcattgtaaatgcaggaaatctcccggtgtacgacgacatccacaaggaactccttcaactttgtgaggatctgatatggaataaggaccctgaagctacagagaagctgctcagatacgcccagacccaaggaactggcggcaagaaggtcattcagacagatgagtggaggaatggcccagtagaagaaagactggagtatgctctggtcaaggggatcgagaagcatatcatcgaagacaccgaggaggcaagattaaaccagaagaaatatccacggcctctcaacataatcgaagggccattaatgaacggcatgaagatcgttggggatctgttcggagcgggaaagatgttcctaccacaggttatcaagagtgcccgcgtcatgaagaaagccgtggggcaccttattcccttcatggagaaagagcgggaggaaactagggtgctcaatggaactgttgaagaagaggacccctaccagggcactatagtgctagccactgttaaaggggacgttcatgacatagggaaaaatatcgttggcgtggtgttgggttgcaacaacttccgcgtgatcgatctcggggttatgactccatgtgacaaaattctcaaggccgccttggatcataaggcggatattatcggtttgtccgggttgattacacccagcctagatgaaatgatatttgttgcgaaggagatggaaaggttggccattcggatcccccttctaattggaggggccactactagcaagacccataccgccgtcaagattgctcctcggtatagcgcccccgtaatccatgtccttgatgcttcaaaatccgtcgtggtgtgctcgcagcttcttgatgaaaatctgaaagacgagtacttcgaggagattatggaagaatacgaggatatccgacaagaccactatgaatctctgaaagagcggcgatacctgcccctcagccaggctcggaagagtggattccagatggattggctctccgaaccccacccagtaaagccaacctttatcggaacccaagttttcgaagattatgacctgcagaagttagtggattatatcgactggaagccattttttgacgtgtggcagttgcgggggaaataccccaatcgaggcttcccgaagatttttaacgacaaaactgtcgggggggaggcccggaaggtctacgacgacgcacataacatgctgaatacacttattagccaaaagaaactgagagcgcgcggggtagtcgggttttggcctgcccagtccattcaagacgatattcacctgtatgcagaagcggctgttccccaggcggccgagcccatcgcgaccttctatggactacggcagcaggctgagaaggattccgcttctactgagccttactactgtttgagcgactttattgcccctctgcattctggaatccgcgattatttaggtctgtttgctgtcgcctgctttggcgttgaagagctcagtaaggcttacgaggacgatggcgatgactactcatcaatcatggtgaaggcgctgggcgacagattagccgaagcttttgcggaggaactgcatgagagagtaagaagggagctatgggcttattgtgggtcggagcagttggatgtggccgatctgcgaagacttaggtataagggtattcgtcctgctcccggctacccatctcagccagatcataccgagaaactcacaatgtggcgtctggccgacattgaacagtctaccgggattcggcttacggaatccctcgctatggcccccgctagcgcagtctcagggttgtacttcagtaatcttaagagtaagtactttgccgttggaaagatctccaaggatcaggtggaggactacgcccttagaaaaaacattagtgtggccgaagtcgaaaaatggttgggaccaatcctcggatacgacactgattag

SEQ ID NO: 106592 - DNA, 3357 bp, Artificial Sequence
  Description of Artificial Sequence: Synthetic coding sequence
atgtcaccagcactgcaggatctgagccagcccgagggcctgaaaaagaccctgcgggacgagattaacgccatcctgcagaagaggattatggtcttagatggtggaatgggaactatgatacagcgggaaaagctcaacgaggaacacttccgcggacaagaattcaaagaccacgcgaggcctctgaaaggaaacaatgacatccttagtattacgcagcccgacgtgatctaccaaatccataaggaatatctcttagctggagccgacataattgaaaccaatacattctccagcacatcaatagctcaggcggactacgggctggagcatctggcctatcgcatgaatatgtgcagcgcaggggtggcacgcaaagcagccgaggaagtcacccttcaaacagggatcaaaaggtttgtggcaggtgcactgggcccaacaaacaaaaccctttcagtctcgccgtccgtcgaaagacctgactatcgaaatatcacttttgacgaactggtggaggcgtaccaggagcaggccaaaggtctactggacggcggtgtggatattctgctgattgaaacaatttttgacactgccaacgccaaggctgccctgtttgccctccaaaatctcttcgaggagaagtatgctcctagacccatcttcattagcgggaccattgtggacaaatcaggtaggactctaagtgggcagaccggagaaggctttgttatctcagtcagtcatggggagccattgtgcatcggccttaactgtgcactgggcgccgccgagatgcgtccatttattgaaatcatcgggaagtgcactaccgcatacgtgctgtgttatcctaatgccggtttacccaacacctttggcgactatgacgagacaccttcaatgatggcaaaacacctcaaagacttcgcgatggatgggctggtgaacatcgtgggcggatgctgcggatcaacccctgaccatattcgagaaattgcagaggccgttaagaactgcaagccacgggttccgccagccaccgcctttgaggggcacatgctgctcagtggcttggagccgttccgcataggcccatacactaactttgttaatatcggcgagaggtgtaatgtcgcaggatcgcgcaaattcgctaaactcatcatggctgggaactacgaagaggcactatgtgtagccaaggtgcaggtagaaatgggcgcccaggtcctggatgttaatatggatgacgggatgcttgatggcccaagtgccatgacccgtttctgtaatttgatcgcctcggagcccgatatcgcaaaggtgccactttgcattgatagcagcaatttcgcggttatagaagctggcctgaaatgttgccaggggaaatgtatcgtgaatagtatcagtctcaaagaaggcgaggacgatttcttggaaaaagcacggaaaattaaaaaatacggcgccgctatggtggttatggcgttcgacgaggagggccagacacaaggaacaggcggtaaaaaggtcattcagaccgacgaatggcgaaacggacccgttgaagagcgcctagagtatgcccttgtcaagggcatcgaaaagcacatcatagaggatactgaggaggcccggctgaatcaaaaaaagtaccctagacccctaaacatcatcgagggcccacttatgaacggtatgaaaattgtgggagatttatttggcgctggcaaaatgttcttaccccaggtgatcaagtccgctcgtgtgatgaaaaaggccgttggccacctgatacctttcatggagaaggaaagggaggaaactagagtcctgaacgggacggtggaggaagaagacccttatcagggcacaattgtgctagccacagtgaagggagacgtgcatgatattgggaaaaatattgtgggcgtggtgctaggctgcaacaatttcagggtgatagatctgggagtgatgacaccatgcgacaagatcctcaaagccgctttggatcacaaggcggatattattggcctgagcgggctgatcacaccaagccttgacgagatgatctttgtggccaaggagatggaaaggctggcaatccgcatcccacttcttatcggcggagccactacctcaaagacccatacggcggtcaagatcgcacccagatacagcgcccccgttattcacgtgctggatgcgtccaagtccgttgtcgtgtgcagccagttgctcgacgagaacttgaaagacgagtatttcgaagagattatggaagagtatgaagatatcaggcaagaccattacgaatctttaaaagagcggcggtatctgcctctgtctcaagcaagaaaatcaggctttcaaatggattggctctcagagccacacccagtcaagcccacatttataggcacccaagtgttcgaggactacgatttgcaaaaactggttgactacatcgactggaagccatttttcgacgtgtggcaactgcggggaaagtaccctaaccgggggttcccaaagatttttaatgacaagactgtcggaggggaggcaaggaaggtctacgatgatgcccataacatgctgaataccctgatttctcagaaaaagctgcgggcaaggggcgttgtgggattctggcccgctcagtctattcaggacgacatccatctctacgccgaagctgcagtccctcaggccgcagagcccatcgcaaccttttacggcctgcggcagcaggcagagaaggactcggcgtctacagaaccatactattgtctgtctgactttattgctccgttacactctggtatccgggattacctcggattatttgcggtagcatgcttcggcgtggaggagctgagcaaagcatacgaagacgacggggacgattatagctccattatggtcaaggctctgggtgatcgattggctgaggcttttgctgaggaactgcacgaaagagtgcgccgggaattatgggcctattgtggaagtgagcaactggacgtagccgatcttagaaggttgaggtataagggcattcgtcctgcacccgggtatccctcacagcccgaccacactgaaaaactgaccatgtggcgcctcgcggatatcgaacagagcacaggcattaggctgaccgaatcactggcaatggctccagcctctgctgtttctggcttgtacttcagcaatcttaaatctaagtatttcgccgtgggaaaaatttcgaaagatcaagtggaagactatgcactgcgcaagaatataagcgtggccgaggtggagaagtgtatgtctgtgtatcgaaaaatcggtgaatag

SEQ ID NO: 106593 - DNA, 690 bp, Artificial Sequence
  Description of Artificial Sequence: Synthetic coding sequence
atgagcgcaggcctgagggcaggctgtcacgtagtcctactttgtcggttttcgctggggtctttctccgttccatctagggattccgcgtcaggccgggcttgcttggcggcacgtccaactcctaggacaggacgagtacccggaaaaaaggcacgtgcccccgcagttgcggccccgagcccagaaaggggccctcgcgccctacgcgcgtttggcgtacggagccctcctgctaccagagctaacgggagaagacagaagacaagagctctctgcggacggttggcatggcggtggcttgcatggcctctggctgtggtcacatgcggggaacacgtgttctccgctgctccttccgctcagggaggcgattccactacctgtcacccccgtagcaaaacatgccggaatcccgagtacttactggcgggagctgacattatagagacgaatactttctcttcaacttccatcgcccaggctgattacggcttagagcacttggcctatagaatgaatatgtgctccgccggggtagctcggaaagcggcagaggaagtgacattgcagacaggtattaagaggttcgtcgccggcgccctgggtccgacaaataaaaccctatccgtgtcacctagtgtggagagaccagattatcggaatatcaatttaccggttggtagctag

SEQ ID NO: 106594 - DNA, 3645 bp, Artificial Sequence
  Description of Artificial Sequence: Synthetic coding sequence
atgtctcccgcacttcaggaccttagccagccagagggactgaagaagactttacgcgatgagattaatgcaattttacagaaaaggattatggtgctagacggaggcatgggaaccatgatacagcgagagaagctgaatgaggaacatttccgggggcaggagtttaaagaccacgcccgccccctcaagggcaataatgacatcctgagtatcactcagccagatgtcatctaccagatccacaaagaataccttctggccggcgccgacattatagaaaccaacaccttttcctctacttctatagcacaagcggactacggacttgagcatctcgcatataggatgaatatgtgcagcgctggcgtcgcacgcaaagctgccgaggaagttaccctgcaaaccgggatcaagaggttcgtggccggagcactaggtccaactaataaaaccctgtcagttagcccatccgtagaaaggcctgactacaggaacatcaccttcgacgaactggtggaggcctatcaggagcaagctaagggacttctggatgggggtgtggacatcttgctgatcgagaccatctttgacacggccaacgcaaaggccgctttgttcgccctgcagaatctgttcgaagaaaagtacgctccccgtccaatctttattagcgggaccattgttgacaagagcgggaggacactgtcagggcagacaggcgagggctttgtcatttctgtgtcgcacggcgagcccctctgtattgggctgaactgtgctctgggtgccgcagaaatgcggccttttatcgagatcattggcaagtgtactaccgcatatgtactctgctaccccaatgcaggccttcccaacactttcggagattacgatgagacaccatcaatgatggcaaaacacctgaaagactttgccatggatggtttagtgaacatagtgggagggtgctgcggctcaaccccggatcacattcgcgaaatcgctgaggctgttaagaattgtaaacctagagtgccccctgcaaccgcttttgagggccacatgctgcttagcgggctcgaaccctttcgtattggaccctatactaatttcgtcaacattggtgagaggtgcaatgttgccgggtcccgcaagttcgctaagttaatcatggctggcaactatgaggaagccctgtgcgtggctaaagtgcaagtggagatgggagcacaggtcctagacgttaacatggatgacggtatgctcgatgggccttccgccatgacacgcttctgcaatctcatcgccagcgaaccagatattgccaaggtccccttatgtattgacagctccaacttcgccgtcatagaggccggacttaagtgctgtcaagggaagtgcatcgttaatagtatatcgttgaaagaaggggaggacgacttcctggagaaggcaagaaagattaagaagtacggcgccgcgatggtggtaatggcctttgacgaagaaggccaggctacagaaacggacacaaagatccgggtgtgtactagagcctaccatctgctcgtcaaaaagctgggatttaaccccaatgacattatttttgaccctaatattttgactattggcactggcatggaggaacacaacctatatgccatcaacttcatccacgccacaaaggtgattaaagagacacttccaggcgctcgcatctctggtggcctcagtaacttgtcctttagcttcagaggcatggaagccattagagaggctatgcacggcgtcttcctataccacgcaataaagagtggaatggatatggggattgtgaacgccggaaatttgcctgtatatgacgacatacataaagagcttttacagttatgtgaggacctaatttggaacaaagatcctgaagctactgaaaagctcctgagatatgcccagacacagggtacagggggcaagaaggttattcaaactgacgagtggcgcaacggcccagtggaggaaaggctcgaatacgctctggtgaaggtaataaagtcagcacgcgttatgaagaaggctgtcggtcacctgatcccgtttatggaaaaggagcgcgaggaaacaagagtgcttaatggcactgtggaggaagaagatccataccagggcaccattgtgctcgcaaccgtgaaaggagacgtccacgacattggaaaaaacatcgtgggggtggtgctggggtgtaacaatttccgggtgattgacctgggagttatgaccccttgcgacaagattctgaaggccgctctggaccataaggcggacataattggactgtctggcctcatcacgccatcactcgacgagatgattttcgtggccaaggaaatggagagactggcaattcggatcccccttcttatcggcggagcaactacatccaagactcacactgcagtgaaaattgcccctaggtactccgctccggtgatccatgttcttgatgctagcaagagtgttgtagtgtgcagtcaacttctggatgagaatctgaaggacgaatattttgaggagattatggaagagtatgaggatattcgacaggatcactacgagagcctaaaggaacgtcgctacttacctctgtcacaggccagaaagtctgggtttcagatggactggttgtctgagccccacccagtgaaacctactttcattggaacgcaggttttcgaggactatgacctgcagaagcttgtcgactacatcgattggaagccctttttcgatgtttggcaattacgggggaaatatcccaatcgaggctttcccaaaatttttaacgacaaaacggtgggcggggaagccagaaaagtctacgatgatgcgcataatatgctcaacacgttaatatcccagaaaaaacttcgcgcgagaggcgtggttggattctggccagctcagagcattcaggatgatatccatctgtacgccgaggctgctgtacctcaggccgccgaaccaatagctaccttctatggactgcgtcaacaagcagagaaggacagtgcttccactgaaccgtactactgcttgtcagattttattgcaccgctacacagcggaatccgagattatttagggttgtttgcagtggcttgtttcggcgtggaggagctttctaaagcatatgaagatgatggggatgattactcctccattatggtgaaagccttaggcgatcgtttggcggaagccttcgctgaggaactccacgaacgggtgcggcgcgagctgtgggcttactgcggcagcgaacagcttgatgtcgccgaccttcggcgtcttcgctataagggaatacgacccgcccctggctacccttcacaaccagaccataccgagaaactgactatgtggagattagctgacatcgagcagtctacggggatccggctcactgagtccctcgctatggccccagcctcagccgtcagcgggctgtatttctctaatctcaaatccaagtattttgcagtagggaagatatctaaagaccaggtggaggactatgccctccgaaaaaatatcagtgtcgcggaggtggagaagtggcttggcccaattctgggatatgataccgattag

SEQ ID NO: 106595 - DNA, 2178 bp, Artificial Sequence
  Description of Artificial Sequence: Synthetic coding sequence
atgggtgccgcctcagtacgggccggcgcccgacttgtcgaggtggcattgtgttccttcacagttacttgcctggaagttatgagaagattccttctcctctatgcaacgcaacaggggcaggcaaaggcaatagctgaggagatttgtgagcaggccgttgtgcacgggttctctgcggatttacattgtataagtgagagtgacaagtacgatctcaagaccgagacagccccactcgtggtcgttgtaagtacaacaggcaccggagacccgcctgataccgcacgcaagttcgttaaggaaatacagaatcagactctgccggtagatttctttgcccatctacggtacggattgttgggcctaggcgattctgagtatacatacttctgcaacggtggaaagattatcgataagaggctgcaggagctgggtgcgcgacatttttacgacacgggccacgcagacgattgtgttgggcttgaattggtggtggaaccgtggattgcagggttatggcccgctctaagaaaacacttcaggagttctcgagggcaggaggagatctccggggcattgcccgtggcctcccctgcctcctctaggaccgatctggtcaagtccgagctgctccatatcgagtctcaagttgagttgttgaggtttgacgattctggacgaaaggatagcgaggtgttgaagcaaaacgccgtcaatagtaaccagagcaacgtggtcatcgaggattttgagtcttctctgacgagatcggtgccaccattgtctcaggctagtctgaacattcccggcctccctccagaatatctacaggtgcaccttcaggagtccctgggacaggaggagtcccaggtctctgtaacttcggccgatcctgtgtttcaggtccccatcagcaaagccgtgcaactcacaactaatgatgcaattaagactactttattagttgaactggacatctcaaatacagacttttcataccagcctggggatgcctttagcgtgatctgtccaaattctgattcagaggtccagagtctgctgcagagacttcagcttgaggataaacgagagcactgtgtgctgcttaagattaaggccgacaccaagaaaaaaggtgcaacactgcctcagcacatacctgcggggtgctccctccaattcatctttacatggtgtctggaaattcgagctattccaaagaaggcttttctgagagccctggtggattatacctccgatagcgccgagaagagaagacttcaggaattgtgtagtaaacagggtgcagcggattactctcgatttgtgcgggatgcttgtgcatgtctgttggatttgctacttgcttttcctagttgtcaaccaccgctttcacttctcctggagcatctgcccaagctgcaacctcggccgtatagttgtgcaagcagtagcctattccaccccggcaagctccacttcgttttcaacattgtcgagttcctgtccaccgccaccaccgaagttctaagaaaaggagtttgtactggatggctggctttactagttgcttcagtacttcagccaaatatccatgccagtcacgaagacagcggcaaggcactcgccccaaagatctctatcagtcctagaactacgaactctttccacttacccgacgacccctccatcccgataataatggtggggcccggaacaggcattgccccattcattggttttctccagcatagagagaagctacaggagcagcatcctgatggaaatttcggcgcaatgtggctctttttcgggtgtcgccataaagaccgagattatctcttccgtaaggagctgcgccattttctgaaacatggtattctcacccatctgaaggtttctttcagccgcgacgcaccagtcggagaagaagaagcaccagctaagtacgtgcaggataacattcagctccatggccagcaggtggccagaatcctactacaggaaaacggtcacatctacgtttgtggtgatgctaagaacatggcgaaggacgtccatgatgcactggtgcaaatcatctcaaaagaagtcggtgtagagaagttagaagcgatgaaaaccctggcaactctcaaagaggaaaagcggtacctccaggacatttggtcatag

SEQ ID NO: 106596 - DNA, 177 bp, Artificial Sequence
  Description of Artificial Sequence: Synthetic coding sequence
atgcggcgattcctgctcctttatgccacgcaacagggacaggctaaggctattgccgaagagatctgtgaacaggccgtggtgcacggtttttctgccgacctccactgcattagtgaatctgataaagtttcggttattcagaacacaccgacttttgcgatgggcggaaggtag

SEQ ID NO: 106597 - DNA, 2097 bp, Artificial Sequence
  Description of Artificial Sequence: Synthetic coding sequence
atgcggagatttctgcttctgtacgccacccagcaagggcaggctaaggctatcgctgaagagatctgtgagcaggccgttgtgcatgggttctccgcggatctgcattgcatctcagagagtgataaatatgacctcaaaaccgaaaccgcgccactggttgtggtcgttagcaccaccggtaccggcgacccccctgacaccgctagaaagtttgttaaggaaattcagaatcagacactgccggttgactttttcgcacacctgcgctatgggttgctgggcttaggcgatagcgagtacacttacttctgtaatggaggtaaaattattgacaaaaggctgcaggaactgggtgcccggcacttttatgataccggacacgccgacgactgtgtgggcctggaacttgtggtggagccctggatcgcgggactgtggcccgcgcttaggaagcacttccgctcttcccggggacaggaggagattagtggtgcccttcctgttgcttccccagcgtcctcccgtaccgaccttgtaaagagtgaactgctacacatcgagtcacaggtagagcttctgcgattcgacgatagcggtaggaaggactctgaggtactgaagcagaatgccgtaaactctaaccagtccaacgtggtgatcgaagattttgagagttctctcacgaggagtgtccctcccctgtctcaggcctcacttaacatcccaggcctcccgcctgagtatttacaagtgcacctgcaggagagtcttggccaagaggagagccaggtctccgtcacctctgcagatccggttttccaggtgcccattagcaaagccgtgcagctgacaacgaacgatgccataaagacaactctgcttgtggaattggatatctcaaacaccgacttcagttaccagccaggcgatgcgttctcggtcatatgtccaaatagcgattcagaagtgcagagtcttctgcaaaggctgcagctcgaggacaagcgggagcattgtgtgttacttaagattaaggctgatacgaagaaaaaaggtgctactttaccccagcatattcctgctggctgctcacttcaattcatcttcacctggtgtttagaaatcagggctatccccaaaaaagcatttctgcgggctctggtcgactacaccagcgatagcgccgagaaacggagactgcaagagctttgcagtaaacagggcgcagcagattactctagattcgttcgggacgcgtgtgcctgtctcctggacttattgttggcttttccctcttgccagccaccgcttagtctgcttctggaacacttgcccaagctccagccacgcccctattcctgtgcgagctcctcactgtttcaccccggaaagctacacttcgtgttcaatattgtggagtttctcagtacagcgaccacggaagtcttgcggaaaggagtgtgtactggatggcttgctcttcttgtggctagcgtgttgcagcctaatattcatgcctcccatgaagactcaggaaaagcgctcgcccctaagatctccattagcccaaggacgacaaatagcttccacctgccggacgaccccagtatccccatcatcatggtgggacctgggactggcatcgctcctttcattgggtttttgcagcatagagagaaactgcaggaacagcatccagacggaaatttcggcgccatgtggcttttctttgggtgcagacataaagaccgggattatctgttcagaaaggagctgcggcactttcttaagcacgggatcctcacacaccttaaggtgtccttctcgcgcgatgcccccgttggcgaggaagaagccccagctaaatatgtccaggacaacatccaactccacggtcagcaggtggcgaggatactcctgcaggagaacggacacatatacgtatgcggagatgcgaaaaacatggctaaagacgtgcatgatgcactcgtgcaaatcatttcaaaggaagtaggagttgaaaaattagaagctatgaagacactcgcgaccctgaaagaggagaagcggtacttgcaggatatatggagctag

SEQ ID NO: 106598 - DNA, 471 bp, Artificial Sequence
  Description of Artificial Sequence: Synthetic coding sequence
atgaggcggttcctccttttatacgcaacacaacagggccaggccaaagcaatagcagaggaaatctgcgaacaggcagtcgtgcatggattctccgccgatttacattgcatatcagaatctgacaaatacgatttaaaaacggaaacagcccccttggtggtcgttgtttcgaccactgggaccggggacccgcctgatacagccagaaaatttgttaaagaaattcagaaccagacattgcccgtggacttcttcgcacacctacggtatggcctgctggggctgggtgattcagagtatacttatttctgcaacggtggcaagattatagacaagcggctccaggaactaggagctcggcacttctacgacaccgggcacgctgatgattgtgtcggcctagaattagttgtggagccgtggatcgctgggctctggccagctttgcgaaaacatttccgaagctag

SEQ ID NO: 106599 - DNA, 126 bp, Artificial Sequence
  Description of Artificial Sequence: Synthetic coding sequence
atgagaaggttcctgttactctacgctacccaacagggacaggcaaaggctatcgcagaggagatttgcgaacaggctgttgtgcacggcttctccgcagatctgcactgtataagcgaatcgtag

SEQ ID NO: 106600 - DNA, 339 bp, Artificial Sequence
  Description of Artificial Sequence: Synthetic coding sequence
atgcgaagattcctcttgctctatgcaacacaacaggggcaagccaaggcaatagctgaagagatttgtgaacaggctgtcgtccacgggttcagtgcagacttacactgcatttcagagtccgacaagtatgaccttaagaccgagactgcccccttagtggttgtagtctcgactacaggcactggggacccacccgataccgctaggaaatttgtcaaagagattcagaaccagaccctgcctgtcgacttctttgcccacctgcgttatggtctcttgggccttggagattcagagtatacgtatttctgcaacgggggaaagataattgattag

SEQ ID NO: 106601 - DNA, 249 bp, Artificial Sequence
  Description of Artificial Sequence: Synthetic coding sequence
atgctgtgggatccggccttgccgcgcttagctgtgtacgccagctgtctgttcttttcctgcttggacgcccatgagggcccagttcacgggccaagaggtcgcggtgagggcggtcgagggtccgaacgacaaagagtgagaccgggcggagggggcggtgccgggtctgtgcacattcaccttgaggaagaggatggcgctgaggatcaagaccacagagatgaagactggataactaagaagtag

SEQ ID NO: 106602 - DNA, 1647 bp, Artificial Sequence
  Description of Artificial Sequence: Synthetic coding sequence
atgacaatggccgccgcggctgtcgtggcccggggtgccggagcgagggcggctaccgctgccgccctgcgtgggggatgcgggactgccgccagaggaaggccatgtgctggacccgcccggcctctctgtaccgcacctggcacggccccagatatgaaacgctacttatgggaacggtaccgcgaggccaaacgttccacggaggaactagtcccctccatcatgtccaatctgcttaacccggatgcaatcttctccaacaacgagatgtctctctctgatattgaaatttacggattcgattacgattacactctggtcttctactcaaaacacctgcacacattgattttcaatgcagctcgagacctgctcatcaatgaacatcgttacccagctgaaataaggaaatatgagtatgaccccaactttgccattcgcggtctccactatgacgttcagagggcggtgttgatgaagattgatgctttccactacattcagctgggcactgtgtacaggggattgagtgtagtcccagatgaagaggtcatagaaatgtatgaggggtcacacgtccctttagaacagatgagcgacttctatggcaagagttcacacggaaacactatgaaacagtttatggatattttctcgctaccagagatgactttgctcagctgtgtgaatgagtatttcctcaagaacaatatcgattacgagcccgtacatctctataaggacgtgaaagacagcattagagacgttcatatcaaagggattatgtaccgggctattgaagcagatattgagaagtatatctgctacgccgagcaaacaagagcagttcttgctaagctggctgaccatggtaagaagatgttcctgatcacaaactcaccatcatcatttgtggacaaagggatgtcgtatattgtcgggaaggactggagagatctttttgacgtggttattgtgcaagcagagaagcccaattttttcaacgataaacgcaggccatttcgtaagatgaatgaaaaaggcgtgctgctctgggataaaatccataagctccaaaagggccagatttataagcagggcaacctgtacgagttcctcaagctcacaggttggagggggagcagggtcctttacttcggcgaccacatctacagtgacctcgctgatctgaccctcaagcatggctggcgcacgggagccataatccctgaacttcggagcgaactgaaaataatgaacactgaacagtatatccagacaatgacttggttacagacactaacaggcctcctagaacagatgcaggtccatcgcgacgccgagagtcaactggtgctgcaggaatggaaaaaagaaagaaaggagatgcgagagatgactaagtcctttttcaatgcccaatttggcagcctctttcggacagatcagaaccccacatacttcctaaggcgtctatcccgcttcgccgacatctacatggctagtttgagctgtttgcttaactacgacgtgagccacaccttctacccaaggcgaacccccctgcagcatgagctgcctgcatggagtgagagacctcctacctttggaacccctttgctccaggaagcccaggcgaagtag

SEQ ID NO: 106603 - DNA, 1686 bp, Artificial Sequence
  Description of Artificial Sequence: Synthetic coding sequence
atgtctacttcatggtcggaccgccttcagaatgcagccgatatgcccgccaatatggataagcacgctctgaagaagtaccgccgcgaagcctaccatagagtgtttgtgaaccggagcctggctatggagaagataaaatgtttcggctttgacatggactacacgctggccgtatacaaatccccagagtacgagtcgctagggttcgagctgacagtggaacgcctggtgagtattggttatccccaggagctcctctcttttgcgtacgactcaacgtttccaacaagaggactagtgtttgataccttatacggcaatctgttaaaagtggacgcctatggtaacctgctggtttgcgcccacggcttcaattttataagaggcccagaaaccagagaacaatatcccaacaaattcatacagcgggacgacactgaacgattctacatactgaacactttattcaacttgcctgaaacctacttgctcgcgtgcctcgtggatttcttcactaactgtcccaggtacactagttgtgagaccggctttaaagacggggatctcttcatgagctacaggtccatgttccaggacgtcagagacgccgtggattgggtacactataagggcagcctcaaggagaaaaccgtagagaatctcgaaaaatatgttgtcaaggatggcaaactgcctctcctactctccagaatgaaggaggttgggaaagtctttctcgccaccaattccgactataagtacaccgacaagattatgacctacctattcgattttccccacggaccgaagccaggaagcagtcaccgcccctggcagtcttacttcgacctaatcctggtagatgctcgcaaacctctgttttttggcgaaggaacggtacttagacaggtagacacaaagactggtaaactgaaaattggcacatacaccggcccactgcaacacggaattgtctactccgggggttctagcgatactatttgtgacctcttgggagctaaagggaaagatattctctatatcggcgatcatatttttggggacatactcaagtccaaaaagcgccagggttggcggaccttcttggtgatcccggagctcgcgcaggagctgcacgtgtggaccgataagagctcgctatttgaggagctgcagtcactggatattttccttgctgaactatataagcatttagatagttcatctaacgaaagaccggatatctcttctatccagagacggatcaaaaaggtgacccatgatatggacatgtgctatggcatgatggggtccctgttcagatcagggtctagacagaccttatttgcctcccaggtcatgcgctatgctgacctctacgctgcctcctttatcaatctgctgtattatcccttctcttacctgtttagggctgcccatgttctgatgccacacgaatcgactgtggaacatacacacgttgacatcaacgaaatggaaagccccctggccacccggaaccgtacgtctgtggactttaaagatacggactacaagagacaccagttgaccagaagtatctccgagattaagcctcctaacctcttccccctggctcctcaggaaatcactcactgccacgatgaagacgatgacgaggaggaagaggaagaggaggagtag

SEQ ID NO: 106604 - DNA, 600 bp, Artificial Sequence
  Description of Artificial Sequence: Synthetic coding sequence
atggactacaccttggccgtgtacaaatcaccggagtacgaaagcctcggctttgagctgaccgtggagcgtctggtgagcattggttatccccaggagctgttgagcttcgcatatgactctacgtttcccacaaggggcctggtctttgatacattgtacggaaatttgttgaaggtcgacgcctacggaaacctgcttgtctgcgcgcacggattcaacttcatccgcgggtcccaagttgccgtgcaaaaaagacccgaaacccgcgaacagtatccgaataagtttatccagcgggatgataccgagaggttttatatcctgaacacactttttaatctgccagagacttatctccttgcctgtctggtagattttttcacgaattgcccacgctacacgtcctgtgaaactgggttcaaagacggggacttgtttatgtcttatagatccatgtttcaggatgtcagggatgccgttgattgggtgcactataaaggctctcttaaggagaaaactgttgagaacctggaaaagtatgtcgttaaggatagcaaaagttcacgtattcagtactttctgaaagtgctatggtag

SEQ ID NO: 106605 - DNA, 1686 bp, Artificial Sequence
  Description of Artificial Sequence: Synthetic coding sequence
atgagcacctcctggagtgacagattacagaacgcagccgacatgccagccaacatggacaagcacgcactcaaaaagtacagacgggaagcctaccaccgcgtctttgtcaatagatctctggccatggaaaagatcaaatgcttcggtttcgatatggactacacactagccgtttacaaatcgccagagtatgaatctcttgggttcgaactcacagtggagcggctggtgtcgattggctatccgcaggagttgctcagctttgcctacgacagtacattccccactaggggcctggtcttcgacactctgtacgggaacctcctaaaagtcgatgcttacggcaatctccttgtctgcgcccatggattcaatttcataagggggcctgaaacccgtgagcagtaccctaacaagtttatacagagagacgatactgaacgcttttacatcctaaatacactgtttaatctgcccgagacatatctcttagcctgtctggtagatttctttacaaactgtccccgatatacttcctgcgagaccggcttcaaggacggagacctgttcatgtcataccgttcgatgtttcaggatgtgcgagatgctgtcgattgggttcactacaaaggatcattgaaagagaagaccgtagaaaacctggagaaatatgtcgtaaaagacggaaagcttcccctgctgctttcccggatgaaagaggtggggaaggtctttctggctaccaatagtgactataagtatacagataaaattatgacctacctgttcgacttcccacatggtcccaagcccggctcatcacacaggccttggcagtcatactttgacctgatcctggtggacgcacgaaaaccactgtttttcggtgagggcaccgtgttaaggcaggtagacactaagactggtaaactgaagatcggaacgtacacaggtcccctgcagcacggaatcgtatactctggtggatcaagcgacaccatctgtgacctcctgggagctaagggaaaggatatactatatatcggtgaccacatttttggcgacatcctgaagagcaagaagcggcagggctggagaaccttccttgttataccggagctcgcccaggaactgcacgtctggacagataagtcttcactctttgaggaattgcagtccttagatatattcctggctgaactatataaacatctggattcttctagcaacgagcgcccagacatatctagcatccaaaggcggatcaaaaaagttacacatgatatggacatgtgttatggcatgatgggctccctattccggagcggctccaggcagaccttgttcgcttctcaggtgatgaggtatgccgatctttacgcagcgagtttcattaatctgttgtactatcccttctcctatctgtttcgcgcagcccacgtgctgatgccacacgaaagcacggtcgaacacactcatgtagatatcaacgagatggagagtcctctcgccacgcgtaatcgtacgagtgtggactttaaagacacagactacaaacgacaccagctgaccaggtctatcagcgaaattaagccccccaacctctttccacttgcacctcaggagatcacgcattgtcatgacgaagacgatgacgaagaggaggaagaagaggaagaatag

SEQ ID NO: 106606 - DNA, 444 bp, Artificial Sequence
  Description of Artificial Sequence: Synthetic coding sequence
gtgctgcgacaggtagacactaagaccggcaaactaaagataggcacctacacaggcccactgcagcacgggatcgtttacagtgggggctcctccgacacaatctgtgacttgctgggggcaaaaggcaaggatatcttatacatcggggaccatattttcggggatattctgaagtctaagaaaaggcagggctggcgcactttcttggtaattcccgagctcgcccaggagctgcatgtatggacggataaaagttctctctttgaggaactgcaaagcttggacattttcctggccgaactgtacaaacacctagattcatcatcgaatgagaggccagatatctcctccattcagaggcgaatcaagatgcctcacgaatcaactgtggaacatacccatgtggatatcaacgagatggagagccccctggcaacgtag

SEQ ID NO: 106607 - DNA, 1599 bp, Artificial Sequence
  Description of Artificial Sequence: Synthetic coding sequence
atgtctaaggagggggtgttcgtgaaccggtctctggcaatggagaaaattaaatgcttcggcttcgacatggactacacgctcgccgtgtacaagtcacccgaatatgagagtcttggattcgagctgaccgtcgaacggttagtgtctatcgggtacccacaggagctgctgagttttgcctatgacagtacgtttccaaccagaggcttggtgtttgacacactttatggtaatctcctgaaagtggatgcatatggtaacttactagtatgtgctcatggttttaactttatcagaggacctgaaactcgggagcagtaccctaacaaattcatacagcgcgacgatacagagagattttacatcctgaacacgttgtttaacctgcccgagacatatttactggcttgcctagttgatttttttacaaactgcccacgatataccagctgtgaaaccggctttaaggatggcgacctgtttatgtcctacaggtccatgttccaggacgtgagagacgcggttgactgggtccactacaaggggagcctgaaggagaagaccgtggaaaatttagagaagtacgtcgttaaggacgggaaattgcctctgctgctttcccgcatgaaagaagtcggaaaagtgtttctggctacaaactccgactacaagtataccgacaaaataatgacttatctgtttgatttccctcatggcccaaagccagggagctcgcaccggccttggcaaagctatttcgatttaatactggtggacgcaaggaaaccgctgttttttggtgaagggacggtcctccggcaggtggacacgaaaactggcaagctgaaaattggcacctacactggccctctgcagcacggcatcgtgtacagtggcggaagcagcgatacgatttgtgatctgctgggtgctaaagggaaagatatactttatatcggtgatcatatcttcggcgacattctcaagagcaagaagaggcagggatggagaacctttctggtgatcccagaactggctcaagaattacacgtgtggacagacaagtcgtctctgtttgaagaattgcagagtttagatatatttttagccgaactctacaaacatctggattcctcttccaatgaacggcccgatatcagcagcattcaacgacggataaagaaagtgacacacgatatggatatgtgttatggtatgatgggatcactttttaggtcaggcagtcgtcagacactgttcgcgagccaagtgatgaggtatgcggatctgtacgctgcttccttcatcaacttgctctactatcctttcagttatctgtttagggctgcacatgtccttatgccacatgagtccactgtggaacatacacatgttgacatcaacgagatggaatcccctctggccacccgcaaccggacatccgtcgacttcaaagacaccgactataaaagacatcagcttacccggtccatatctgaaattaagccccctaatctgttccccctggcgccacaagagattacccactgtcacgatgaagacgacgacgaagaagaggaggaagaggaagaatag

SEQ ID NO: 106608 - DNA, 798 bp, Artificial Sequence
  Description of Artificial Sequence: Synthetic coding sequence
atgtccacctcctggagcgaccggttgcagaacgccgcagacatgcccgccaacatggacaaacatgccctaaagaaatacagaagagaggcctatcatcgcgtcttcgtgaaccggtctctcgcaatggagaagattaagtgttttggctttgacatggactacacccttgcagtgtacaagtcacccgagtacgagagccttggttttgaattgactgtggaacgcctggtttcgatcggatacccacaggagctcctcagtttcgcctatgacagtacattccccacccgcggcttggtgtttgacacactgtatggaaacttgttgaaggtggacgcctatgggaatctcctggtctgcgcacacggatttaactttattcggggatctcaggttgcagtccaaaagcgacctgagacaagggaacagtatcccaacaagttcatccaacgtgacgatacagagcgcttctacatactcaatacactgtttaacctgccggagacctatctgttggcctgtctcgttgactttttcaccaattgcccaagatatacaagctgcgaaacagggttcaaggatggggacctgttcatgagttaccgatctatgttccaagatgtgagagacgccgttgactgggtacactacaagggatccctcaaagaaaaaaccgtcgaaaacttggaaaagtatgttgtcaaagatggcaaactgccacttctgctcagtcgtatgaaagaggtgggcaaggtgtttctggcaacgaatagcgattataaatacaccgattag

SEQ ID NO: 106609 - DNA, 525 bp, Artificial Sequence
  Description of Artificial Sequence: Synthetic coding sequence
gtgtcaatcgggtacccccaggagctgctgtccttcgcttacgactccacctttccaacacgaggtctggtgtttgatacactctatggcaatctccttaaggtggatgcctacggaaatctgcttgtgtgcgcgcacggctttaatttcatccggggttcccaggtcgctgtgcaaaaacgaccagagacgagggaacaatatccaaataagtttatccagagagacgatacagagcgattttacatccttaacaccttatttaacttacccgagacctacctgctagcttgtctggtcgactttttcactaattgtccccgttacacatcatgcgaaaccgggttcaaggacggggacctctttatgagttacaggagcatgttccaggatgtgagagacgccgtggactgggtgcattacaaggggtctctgaaagagaaaacagtcgaaaaccttgagaagtacgtggtgaaggatagtaaaagtagccggatccaatactttctgaaggtgttgtggtag

SEQ ID NO: 106610 - DNA, 1011 bp, Artificial Sequence
  Description of Artificial Sequence: Synthetic coding sequence
atgcgcgctccatccatggaccgcgccgccgtggcacgagttggtgctgttgcttcagcaagcgtctgcgctcttgttgcgggggttgtccttgctcaatacatttttacccttaagcggaaaacaggccggaaaaccaaaatcatcgaaatgatgcctgaattccagaagtcttcagtcagaattaagaatccaacaagggttgaggaaattatttgtggcctgataaaggggggcgccgccaaactccagatcattacagatttcgacatgactctgtctagattcagctataaaggaaagcgctgtccgacatgtcacaacatcatagataattgcaaactcgttacagatgagtgccggaaaaagcttttgcaactaaaagagaaatactatgccatagaggttgacccagtgctgacagttgaggaaaaatacccttatatggtggaatggtatactaaaagccacgggctgctggtgcaacaggcacttcctaaggccaagctcaaggagatcgtcgctgagtctgacgtgatgctcaaagaaggatatgagaacttttttgacaaactacagcagcactcaattcccgtgtttattttctccgctggaatcggtgatgtacttgaagaagtaattcgtcaggccggagtctatcaccctaacgtaaaagttgtctcgaacttcatggatttcgatgagacgggggtcctgaaaggatttaagggcgagctcatccacgtgttcaacaagcatgatggcgctttacgcaacactgaatatttcaatcagctcaaagataatagcaacattattctgcttggcgactctcagggggacctgcgtatggctgacggagtggcgaatgtggagcatatccttaagatcgggtatctgaacgaccgggtggatgaactcctggagaagtacatggacagctatgacatagtcctcgtccaggatgaatccctcgaagtagccaattctattttgcaaaaaatattgtag

SEQ ID NO: 106611 - DNA, 858 bp, Artificial Sequence
  Description of Artificial Sequence: Synthetic coding sequence
atgccggagtttcagaagtcttccgtgcggatcaaaaatcccacaagggtggaggagatcatttgcggcctgattaagggaggcgctgccaagttgcagattatcaccgattttgatatgaccttaagtagattcagctataaaggtaagaggtgtccgacttgccacaatataattgacaattgcaaacttgtgacagatgagtgccgcaaaaagcttctccagcttaaagagaaatattacgccattgaagtagacccagtcctcacagtagaggaaaaatatccatacatggtggagtggtacactaagagccacggcttactagtacagcaggctcttcccaaagctaagctcaaagagatcgtggcagaaagcgatgtaatgctgaaggagggatacgaaaatttctttgacaaactccaacagcactccatccccgtattcatcttcagcgccggaattggagatgtcctcgaggaagtgataaggcaggcgggagtgtatcaccctaatgttaaggtggtatcgaactttatggatttcgatgagacaggcgtgttgaaaggcttcaagggggagctgattcacgtgttcaataagcacgatggggcgctgcgtaacacggagtacttcaatcaactcaaggacaactccaatataatcttgctgggggactcccaaggggacttgaggatggccgatggcgttgctaacgttgagcatatcctgaagatcggctacttgaacgaccgcgtagacgagcttctagagaagtatatggactcttacgacatcgtccttgtccaggatgagagtttggaagtggctaatagcatactgcagaaaattctgtag

SEQ ID NO: 106612 - DNA, 894 bp, Artificial Sequence
  Description of Artificial Sequence: Synthetic coding sequence
atgactaaccaggaaagcgctgttcacgtgaagatgatgcccgagtttcaaaaatccagcgtcaggatcaaaaaccccacccgagtggaagagatcatatgcggtctcattaagggtggtgcggcaaaacttcagatcataacggatttcgatatgaccttgtccagatttagttataagggcaaacgatgcccgacctgtcataatataatcgacaactgtaagttggtcaccgacgagtgccgaaaaaagctgctccagctaaaggaaaaatactacgctatcgaagtagatccagtactcactgtggaagagaagtacccttacatggtggaatggtacacaaaaagccacggcctgctcgttcagcaggcccttccgaaggcaaagttaaaagaaatagtggccgagtcagatgtgatgttaaaggaagggtacgagaacttcttcgacaaactgcagcagcatagtatacccgtttttatcttctcagcagggattggcgacgtgcttgaggaggtaatccgccaggccggggtgtatcatcccaacgtcaaggttgtaagcaacttcatggactttgacgaaactggtgtattgaaaggcttcaaaggagagctgatacacgtctttaacaagcatgatggcgccttgcggaacacagagtacttcaatcagctgaaagacaacagcaatatcatcctacttggagacagccagggcgaccttcgtatggctgatggcgtggccaatgttgaacacattctgaagatcggctacctgaatgacagggtcgacgaactgttggaaaagtatatggactcttatgacattgtcctggtacaggatgaatccttggaagtggcaaactcaatcctgcaaaaaatcttgtag

SEQ ID NO: 106613 - DNA, 894 bp, Artificial Sequence
  Description of Artificial Sequence: Synthetic coding sequence
atgaccaaccaggagtcagctgtgcatgtgaagatgatgccagaatttcagaagtcatctgtaagaatcaaaaaccccacgcgcgtggaggaaatcatttgcgggcttattaagggtggcgcagctaagttgcagattatcacggacttcgacatgaccttgagcaggttttcatacaaaggtaaacgttgcccaacctgccacaatattatcgataactgcaaattggtgacggacgagtgccgcaaaaagttgctgcagctcaaggagaaatattatgccatcgaagtggatcccgtcctcacagttgaggagaaatatccatacatggttgagtggtacacgaagtctcacggtttgctcgtgcagcaggctcttcccaaggctaaactgaaggaaatcgtggctgagtccgacgtgatgctgaaagagggttatgaaaatttttttgacaaactacaacaacattcaattcctgtatttatattttcagccgggatcggggatgtgctagaggaggtaattcgacaagcgggtgtctaccatcctaacgtgaaggttgtgtctaacttcatggacttcgatgagaccggagtgctgaagggattcaaaggagagttgattcatgtgttcaataaacacgatggggccctgcggaatactgagtattttaatcagctcaaggataacagtaacatcatcctcttgggagactcgcaaggagaccttaggatggcagatggcgtggctaacgtcgagcatattctgaagattggttacctgaacgatcgggtggatgagcttctggagaaatatatggactcctacgacattgtgctggtgcaggacgagagcctggaagtggctaattccattctgcaaaagatactttag

SEQ ID NO: 106614 - DNA, 858 bp, Artificial Sequence
  Description of Artificial Sequence: Synthetic coding sequence
atgcccgaattccaaaagtcatccgtgagaattaagaatcctacccgggtcgaggagatcatttgcggcctgataaaggggggggcagccaaactccaaattatcaccgatttcgacatgactctttctcgattttcttacaaagggaagcgctgccccacctgccataacatcattgataactgtaaactggtcaccgacgagtgccgcaagaagctgttacagctgaaagagaagtactatgcaattgaggttgatccagtgctcacagtcgaggagaaatacccttatatggttgagtggtacacgaaatctcatggtttactcgtgcagcaagcgttgccgaaagcgaaattaaaagagattgtcgcagaatctgacgttatgttgaaggagggttacgagaactttttcgataaactgcagcaacatagcatccctgtatttatattctcggccgggattggtgatgtgctggaggaagtgattaggcaggctggagtgtatcacccaaacgtcaaagtggttagcaattttatggattttgacgaaaccggcgttctgaaaggcttcaagggtgaactgattcatgtgtttaacaaacatgacggcgcactgcgcaacactgagtacttcaatcagttaaaggacaattcaaatatcattctccttggtgactcccagggagatctcagaatggccgatggagtggcaaacgtcgaacacatcctaaagatcggatacctgaacgatcgggtggatgagttgctggaaaaatatatggattcttacgatattgtcttagtgcaggatgagtccttggaggtggccaatagcatccttcagaagatactctag

SEQ ID NO: 106615 - DNA, 129 bp, Artificial Sequence
  Description of Artificial Sequence: Synthetic coding sequence
atgcccgagttccagaagtcctcggtacgaatcaagaaccctacccgggtggaagaaattatatgcgggctgataaaaggcggggctgctaaactgcagatcattacagattttgacatgactttgtag

SEQ ID NO: 106616 - DNA, 1725 bp, Artificial Sequence
  Description of Artificial Sequence: Synthetic coding sequence
atgtgccctcgggccgcccgggctccggcaaccttgctcctggcgctgggtgcagtgctgtggcccgctgctggtgcatgggagctgactatcttacacaccaacgatgtgcacagcaggctggaacagacttccgaagattcttccaaatgcgtgaacgctagtaggtgcatgggaggcgttgctaggctgttcaccaaagttcagcagattcggcgggccgagcccaatgttctgctccttgatgcgggagaccagtaccagggtaccatttggttcaccgtatataaaggcgcggaggtcgcccattttatgaacgctttgaggtacgacgctatggcgctcgggaaccatgagttcgataacggagtggagggcctcatcgagccgttgctaaaggaagccaagttccccattttaagtgctaatatcaaagcgaagggccctcttgcaagccagatctctggtttatacttaccgtacaaagttctgccggtcggcgacgaggttgtggggatcgtggggtatacgagcaaggaaacccccttcctgtcaaaccctggaaccaatctggtcttcgaggacgaaatcacagcattgcagccagaagttgacaagttgaagacgctcaatgttaataaaataatagccttgggtcactctggattcgagatggataagctgatagcccagaaagtgagaggcgttgacgtggtggtaggagggcattcgaatactttcctgtacacgggaaaccctccctcgaaagaggtccctgctggcaagtaccccttcatcgtcacatctgacgatgggcggaaagttccggttgtgcaggcctacgcctttggaaagtacctgggatacctgaagattgaattcgatgagagaggaaatgtgatttcttctcacggcaatcctatcctactgaatagtagcatacccgaggacccctctatcaaggccgacattaataaatggcgcataaagctggataactatagtacccaggaactggggaagaccattgtctacttggatggatcgagtcagtcttgccgtttcagagaatgcaacatgggtaacctgatctgtgacgccatgattaataacaacttgaggcacacggatgaaatgttctggaatcatgtgagcatgtgcatactcaacggcggtgggatccgatctcccatcgatgaacgcaataatggcactattacctgggaaaatctggccgcggtattgcctttcggaggcacctttgatcttgttcagctgaagggcagcactttgaaaaaagcatttgaacatagtgtgcacaggtatggccagtctaccggggagttcctccaggtgggaggaattcatgtagtgtatgatctttctcgaaaaccaggcgaccgggtagtgaagttggatgttctgtgtacaaagtgtcgagtgccttcctatgatcccctcaagatggacgaggtgtataaggtaatcctgcccaacttcctggctaatggaggggatgggtttcagatgattaaagacgagctcctacgacacgattcaggtgatcaggatatcaacgtcgtttctacgtacatcagcaaaatgaaggtgatctatcccgccgtggaaggcaggatcaaattctcaactggatctcattgccacggctcttttagcttaatcttcctctctctttgggctgtcattttcgtactttatcaatag

SEQ ID NO: 106617 - DNA, 795 bp, Artificial Sequence
  Description of Artificial Sequence: Synthetic coding sequence
atgtgcccaagagctgccagagcgcccgctactctcctgctggcgctgggtgcagtgctgtggccggccgccggcgcctgggaactcactatattgcacaccaatgacgtgcattcgcggctggagcagacgtcagaagacagttccaagtgtgtcaacgcaagccggtgcatggggggcgtggccagattattcacaaaagtccagcagatcaggagggcagagcccaatgtgctcttgttggacgctggcgatcagtaccagggaaccatctggttcacagtgtacaaaggagccgaggttgctcacttcatgaacgcacttcgctatgacgccatggctttgggaaatcatgaattcgataatggggtcgagggactgattgaacccctgctgaaggaggccaagtttccaatcttatccgctaatattaaggccaaggggcctctggcgtcgcagatcagcgggctgtaccttccctataaggtcctacccgtcggggacgaggtcgtcgggatcgttggctatacatcgaaagagacgccctttcttagtaacccaggtaccaacttagttttcgaggacgagataacagctttacagcccgaggttgataagctaaagaccctgaacgtgaataaaatcatcgctctcggccacagcggcttcgaaatggacaagttgatcgctcagaaggtgcggggggtcgatgtagtcgttggcggtcactctaacacattcttgtatacagggaactgctttaagcggattgcatgggcgcggatgtctcgctag

SEQ ID NO: 106618 - DNA, 780 bp, Artificial Sequence
  Description of Artificial Sequence: Synthetic coding sequence
atggacaagctcattgctcaaaaagttcggggagtcgatgtggtggtcggcggacactccaacactttcctttataccggtaacccacctagtaaggaggtgcccgctggtaagtatcctttcatagtcactagcgatgacggccgcaaagtcccggtcgtgcaggcatacgccttcggcaaatacctgggctatcttaagattgaatttgatgagcgggggaatgtgatctcaagccacggtaatccaattctgttaaatagctccatacctgaagaccctagcatcaaggcagatattaataaatggagaattaagttagacaattactccacacaagagctaggaaaaactatagtgtacctcgacgggtccagtcagtcctgtaggttcagggaatgtaatatggggaacctcatctgcgatgctatgatcaataacaatttgagacacacagacgagatgttttggaaccatgtcagtatgtgcatcttaaacggaggtggaattaggagcccgatcgatgaaaggaataatgggaccattacatgggagaacttggcagctgttctgccgtttggaggcactttcgatctggttcagttaaaggggagcaccctgaaaaaagccttcgaacattctgtgcacagatatggccagagtacaggcgagttcctgcaggtcggagacttaaaagaatgttgccccatctgtatcaaccaggatgacagttggaaagaacagccaacagctcaaacatacttgaacacttggttctag

SEQ ID NO: 106619 - DNA, 1575 bp, Artificial Sequence
  Description of Artificial Sequence: Synthetic coding sequence
atgtgcccgagggccgcccgcgctcccgccaccctgctgctcgctttgggcgcagtgttatggcctgccgcgggtgcctgggaactgacaatactccataccaatgacgtgcactcaaggttagagcagaccagtgaggactcctctaaatgtgtaaacgcctcccgttgtatgggcggcgtagccagactgttcaccaaggtacagcaaatcaggagggccgagcccaatgtgctgcttctggacgcaggcgaccagtaccagggcacgatctggtttacagtatacaagggggctgaagtggcgcattttatgaatgccctgcgatatgatgccatggcactcggcaaccacgagtttgataacggcgtggaaggactgattgagcccctgttgaaggaggccaagttccctattctctctgccaatattaaagctaagggtccactggccagccaaatttctggactgtaccttccttataaagtgctgccagtgggtgacgaggtggtggggattgttggctatacatcaaaggagaccccattcctctctaatccaggaaccaacctcgtcttcgaagatgaaatcactgcgcttcagccggaggtggataagctcaagacactgaatgtgaataaaataatcgccctgggccacagcggtttcgaaatggacaaactcattgcgcaaaaggtgcgaggggtagatgttgtcgtaggcggacattctaacaccttcttatatacggggaatcctccttctaaagaggtgcccgctggcaagtatcctttcattgttacaagcgacgacggcagaaaagtccccgtcgtacaagcctatgcattcggaaaatatctgggatacttaaaaatcgaattcgatgaaagaggaaatgtgatctcttcacacggtaatcctatactgttgaattcaagcattccagaggatccaagtataaaggccgacatcaacaagtggcgtatcaaacttgacaattactctacacaggagctggggaagactattgtttacctcgatggatcttcccaaagttgcagattccgcgagtgtaacatgggcaatctgatctgcgacgccatgataaacaataacttgcgacatacagatgaaatgttctggaatcacgtcagtatgtgtatcctcaatggcgggggtatccgaagcccaattgacgaacggaataacgggatacatgtggtctatgacctttcccgtaagcccggtgacagggtcgtgaaactcgacgtgttatgcactaagtgcagggtaccgtcctacgacccacttaagatggacgaagtctataaagtcatcttgcccaatttcctcgccaatgggggagatggctttcaaatgattaaagatgaactgctccgccatgactctggggatcaggacattaatgtggtcagcacatatatcagcaaaatgaaagtcatatatccggcagtggaaggtaggataaagtttagcacaggatctcactgtcacggctcatttagtctgatcttcctctctctgtgggcagtcatcttcgtcttgtatcagtag

SEQ ID NO: 106620 - DNA, 693 bp, Artificial Sequence
  Description of Artificial Sequence: Synthetic coding sequence
taagacgtcgtggttggtggccactccaacacatttttgtataccggaaaccctccaagcaaagaagttcccgctggcaaatacccgtttatcgtaacctcagatgacggtaggaaggtgccagtcgtgcaagcctacgcttttggaaagtacttggggtatctaaaaatcgaattcgatgagagagggaacgtgataagtagtcacggcaaccccatactgctgaactcctctataccagaagacccatccatcaaggccgatatcaacaagtggagaataaaactggacaactattcaacccaggaacttggtaagacaatcgtatacttagatgggtctagtcagagttgtcggtttcgcgaatgtaatatggggaacttgatttgcgacgctatgataaacaataatctgcgacacaccgacgaaatgttttggaaccacgtttcaatgtgtatactcaacggaggaggcattcggagcccaatcgacgaacggaacaatggcatccatgtagtttatgatctgagtcggaagcctggagacagggtagtcaaactcgacgtgctgtgcaccaagtgtcgtgtgcctagttatgacccgttgaaaatggatgaggtgtataaggtgatcctgccaaatttcctcgctaatggcggggatggcttccaaatgataaaagacgaactatag

SEQ ID NO: 106621 - DNA, 540 bp, Artificial Sequence
  Description of Artificial Sequence: Synthetic coding sequence
tgaaatcctattttgttgaacagcagtattcctgaagacccctctataaaggccgatattaacaagtggagaattaagttagacaattactccacacaggaattaggtaagacaattgtgtatctggatggttcaagtcagagttgtcgatttcgggagtgcaacatgggcaacctcatctgcgacgccatgatcaataacaatctccgtcacaccgatgaaatgttctggaaccacgtcagcatgtgtatcctgaacggcggcgggattaggagcccgatcgatgaaaggaataacggaacaattacctgggaaaacctcgccgccgtgctgccttttggagggacattcgacttggtacaactgaaaggatctactctgaaaaaggccttcgagcactccgtgcaccgatatgggcagtccactggagaattcctgcaagtgggggatttaaaagaatgctgtccaatctgtattaatcaggatgactcgtggaaggagcagcccacggcccagacgtacctcaatacatggttttag

SEQ ID NO: 106622 - DNA, 687 bp, Artificial Sequence
  Description of Artificial Sequence: Synthetic coding sequence
atggttcggtattctcttgaccccgagaatcctactaaaagctgcaaaagtagaggttcaaacctgcgcgtgcattttaagaatactcgcgagaccgcccaggcgattaaaggcatgcacatccgaaaagccacaaaatacctcaaggatgtaaccctacagaagcagtgcgtgccattccgccgctataatggcggtgtgggccgctgtgctcaggccaaacagtgggggtggactcagggacgatggcccaagaaaagcgccgagttcctactccacatgctaaagaacgcagaatcgaacgctgagcttaagggcctcgatgtcgattccctggtcattgagcatatccaagtaaataaagccccgaaaatgaggcgtagaacctaccgagcccatggtcggataaatccctatatgtctagcccatgccacatcgagatgatactaaccgagaaagagcaaattgtccctaagcctgaggaggaagttgcgcagaagaagaagctgcgaagctcctcattgggcaaatggtgcgccttcttggtatcatcatttcagttctgctccgggagcacgaagaacagctggtctcatatctacactctgtggtttcctccttctcttgttgtgtacgggctgcggaagcagtataaaaaccctatgatccagacgaaagccaagtag

SEQ ID NO: 106623 - DNA, 816 bp, Artificial Sequence
  Description of Artificial Sequence: Synthetic coding sequence
atgagtcctgagatgggtgaactgactcagacacggctgcagaagatatggatccctcactccagcggcagctcacggttgcagcgcagacgcggcagttccatcccccagtttaccaactcacctacaatggtcataatggtgggactaccggccaggggcaagacgtatattagcactaagcttacaaggtacctgaactggatcgggaccccgaccaaggataatatggaggccctgcagattcggaaacaatgtgcgctggctgccttgaaggacgtgcacaattatctgtcgcacgaagaaggacatgttgcggttttcgatgcaacaaacacaacgcgtgagcgacgaagccttattctgcaattcgctaaggaacacggctacaaaggggtgtgtgaggaaatgacgtacgaagaaatacaagagcattatcctgaagagtttgccctccgggatcaggacaaatacagataccgctatcccaagggagagtcctatgaagacctagtgcaacgacttgagcccgtaattatggaactggagaggcaggagaatgtcttagtcatctgtcatcaggctgttatgcgctgcttgcttgcctactttctggacaaatcgtcggacgagttgccatacctgaagtgccccctgcacaccgtactgaaactcacacccgtcgcgtatggttgcaaagtggaaagtatatacctaaacgtggaggcagtcaacacccaccgggagaagcctgagaatgtggatataacccgcgagccagaggaggcccttgacactgtcccagcccactactag

SEQ ID NO: 106624 - DNA, 1416 bp, Artificial Sequence
  Description of Artificial Sequence: Synthetic coding sequence
atgtcacctgaaatgggagagctcacacagacacggctccagaagatatggattcctcatagctctggaagctcccggttacaacgcagaagaggctctagtattcctcaattcaccaacagccctaccatggttattatggtggggttgccagccaggggcaaaacctacatctccactaagctgaccagatacctcaactggattggtacacccaccaaggttttcaatttagggcagtatagacgcgaggccgtgagctacaagaactatgagttctttctaccggataacatggaagccttgcaaattagaaagcagtgtgctctggccgctttaaaggacgtacataattacctctctcacgaagaagggcatgtggctgtgtttgatgcaactaatactacgcgcgagagacgctccttgattcttcaattcgccaaggagcatggctataaggtcttcttcattgagtctatctgtaacgaccccggcatcatcgcagaaaacattagacaggtcaagttgggctcaccagactacatcgactgcgaccgcgagaaagttcttgaagattttctgaagcggatagagtgttacgaggtcaactaccagccactcgatgaggaacttgacagccacttatcatacattaaaattttcgacgtggggacacggtatatggttaatagagtgcaggatcatattcagagcaggacagtttactacttgatgaacatccacgttacccctagaagcatctatttatgcagacacggtgagagcgagctgaatatccgtgggcgaatcgggggtgatagcgggctgtcggtgagaggcaagcagtacgcctacgcccttgctaattttatccagtctcagggcatctcctctctgaaagtttggacaagccatatgaaacggactatccaaaccgcagaggctctcggcgtgccctacgagcagtggaaagcattaaatgagatagatgcaggagtgtgtgaggagatgacctacgaggagatacaggagcattatcctgaagaatttgccctacgtgaccaggataaatatcggtacagataccccaagggggaaagctatgaggatctggtgcagcggctggagcccgtgatcatggaattggagcgacaggagaatgttctcgtgatttgtcaccaagcggtgatgaggtgtctgttagcttacttcttagataagtcctccgacgaactgccatacctcaaatgtcctctgcatacagtattgaagctcaccccggtggcatacggttgtaaagtggaatctatctacctgaacgtcgaagccgtgaatactcaccgagagaagccagaaaacgtggacattacgcgggagcctgaagaagcactggataccgtgcccgcacattattag

SEQ ID NO: 106625 - DNA, 1221 bp, Artificial Sequence
  Description of Artificial Sequence: Synthetic coding sequence
atggaagagaaaacttcccggatcaaggtattcaacctcggccagtaccgcagagaggccgtatcctacaagaattatgaatttttcctaccagacaacatggaagcactgcaaatcaggaagcaatgtgccctggctgcactgaaagacgtgcacaactatctgtcccatgaggagggccatgtggccgtgtttgacgccaccaacacaacccgagagaggcggtcactgatcctgcagtttgccaaggagcacggttacaaggtcttcttcattgagagtatttgcaatgaccccggaattatcgctgagaatatcaggcaggtgaaactgggctcacctgattatatcgattgtgacagagagaaagtgttagaggattttctgaagcggatcgaatgttatgaggtcaactaccagccattagatgaggagctggatagtcatctgtcgtacatcaaaatattcgacgtcgggaccagatatatggtgaacagagtccaggatcacatccaatctagaactgtgtactacctaatgaatattcacgtgaccccgcgttctatatatctgtgccgacacggagaaagcgaacttaacatccgtggaaggattggcggggattcaggactgagtgtgaggggaaaacagtacgcttatgctctagctaacttcatccagtctcaaggcattagttctctcaaggtgtggacctcccatatgaagcgcactattcaaaccgctgaggcactgggcgtgccctacgaacagtggaaagcactgaacgaaatcgacgctggagtgtgtgaggaaatgacttatgaagagatccaggagcactatcccgaagaattcgcactgcgggatcaggacaagtacagataccggtaccccaagggtgagagttacgaggacctcgttcaacgactcgaaccagtgattatggaactcgagagacaggagaacgtcctggtaatttgccaccaggccgtgatgcggtgcctgctggcttacttcttggacaaatcttcagatgagcttccttacctgaaatgtccattgcataccgtcttaaagttaacacctgtcgcctacgggtgtaaagtcgagtccatttacctgaatgtcgaagctgtgaatactcacagagagaaacctgagaatgtagacataacaagagaacctgaagaagccctcgacaccgtgcccgcgcactactag

SEQ ID NO: 106626 - DNA, 1416 bp, Artificial Sequence
  Description of Artificial Sequence: Synthetic coding sequence
atgtcaggtgctagttcttcggaacagaacaacaacagctacgaaactaaaacaccgaatctccggatgtcagagaagaaatgttcctgggcttcgtatatgacaaattcacctacacttatcgtgatgattggcttgcccgcgcgaggaaaaacatatgtctccaagaagcttactcggtacctgaactggattggagtaccgaccaaagttttcaatctcggcgtttacagaagagaagctgtgaagtcatacaagtcatacgacttttttcggcacgataacgaggaagcaatgaaaatcagaaaacagtgcgcgctggtggcactcgaggatgtaaaagcttatttgactgaggagaacggccagattgccgtatttgacgctaccaacacaaccagggagcggagggatatgattttgaacttcgcagaacagaactcgtttaaagtgttctttgttgagtcggtctgtgatgacccagacgtgatcgctgccaatattctggaagttaaggtcagcagccctgactatcctgaaaggaatagggagaacgtcatggaagacttcctgaagagaatcgagtgctacaaagtcacctatcggccactcgaccctgataactatgacaaggacctgtcattcataaaggttattaatgttggccagcgctttctggtgaaccgggttcaggattatattcagtccaaaattgtctattacctgatgaacatccatgtgcagcctaggactatctacttgtgtagacacggagagtctgaattcaaccttctcggtaagattggaggcgattccggcctaagcgttcgtggcaagcagttcgctcaggccctgagaaagttcctggaagaacaggaaattacagatctgaaagtatggacaagccaactgaagcgcaccattcagaccgccgagtccctcggagtgccctacgaacaatggaagatcctgaatgaaatcgatgcaggagtgtgcgaagaaatgacttacgcggagatcgagaagcggtaccccgaggagttcgcactgcgtgaccaagaaaagtatctgtacagataccccggcggcgaaagctaccaggacctggttcagcgcttagagcccgtcattatggaattggagagacaagggaacgtcttggtgatctctcaccaagccgttatgagatgccttctggcctatttcctcgataagggcgctgacgaattaccctatctccggtgccccctccatactatcttcaaactcaccccggtggcttatggctgtaaggtggaaacgattaaactcaacgtggaggccgtcaacactcatcgcgataagcccaccgccgccgaaacaacccttgcggtccgccgtaggcctagcgccgcctctctgatgcttccatgctag

SEQ ID NO: 106627 - DNA, 1518 bp, Artificial Sequence
  Description of Artificial Sequence: Synthetic coding sequence
atgagcggcgccagcagctccgagcagaacaacaactcttacgagacaaagacacctaatctcaggatgtccgaaaagaaatgtagttgggcaagttacatgactaactctccaacactcatagtcatgatcggactgccagcgagaggcaaaacgtatgtgtctaaaaaacttacccggtatctcaactggataggggtgcctaccaaggtttttaacttgggtgtgtacagacgagaagcagtcaaatcctataaatcttacgacttcttccgccacgacaatgaggaggccatgaagatcagaaaacagtgcgctttagttgccttggaagacgtcaaggcatacttgactgaggagaacggacagatcgctgtgtttgatgcaacaaacacgacccgggagaggagagacatgatactgaatttcgccgagcagaactcctttaaagttttcttcgtggagtccgtgtgcgatgacccagacgtaattgccgccaatatcctagaagttaaggtttccagtccagactacccagaacgaaatcgcgagaatgtgatggaggattttttgaaacggattgagtgttacaaagtgacatatagacctttggatccagataattacgataaggatctgtcttttatcaaggtaattaatgtgggccagagatttttggtgaatagggtacaggattacattcagtcgaaaatcgtgtactaccttatgaatatccacgtgcaacccagaaccatatatctgtgccgtcacggggagagtgagtttaatctgctcgggaagatcggcggagactctggactgagcgtaaggggcaaacagtttgcacaggctttgaggaagttcctggaggaacaagaaatcaccgacttgaaggtgtggacctcacagctgaaacgtaccatccaaaccgccgagtccctgggcgtcccgtacgagcaatggaagatcttaaacgagatagatgctggggtctgcgaagagatgacctatgcagaaatcgaaaaacggtaccccgaagaatttgcccttcgggatcaggaaaagtacctctatagatatcccggtggtgagagttaccaggaccttgttcagaggctcgaacccgtgatcatggaattggagcgccagggcaacgtgctggtgatcagccaccaagccgtgatgcggtgcctcctggcttatttcctggataagggagccgacgagctcccctacctgaggtgccctctgcataccatcttcaaattaactcccgtggcctatggatgcaaggtggaaacgatcaagctgaatgtggaagcggtgaatacccatagagacaaacctacaaacaattttccgaaaaatcagacaccggtgcgtatgcggcgaaatagctttacaccccttagctctagcaacaccattcggcggcctaggaattattcggtcggatccagacctcttaagcccctatctcccctgagggcgcaggatatgcaggagggagctgattag

SEQ ID NO: 106628 - DNA, 1122 bp, Artificial Sequence
  Description of Artificial Sequence: Synthetic coding sequence
atgaagatcaggaagcagtgtgccctggtggccttggaggacgtgaaagcctacttgacagaggagaacggccagattgcagtgttcgacgctactaacactactcgggagagaagggacatgatattgaacttcgccgaacaaaacagctttaaggtttttttcgtggagtccgtctgcgacgatccagacgtcattgccgctaacattcttgaggttaaggtgtccagtcccgactatcccgaaaggaaccgcgagaacgttatggaagacttcttaaaacgaatcgagtgttacaaagtcacctaccgtcccctggatccagacaactatgataaggacctgtctttcataaaggttatcaatgtcggacagcgctttctggtaaacagggtgcaggactatattcagtcaaaaatcgtgtactatttgatgaacatccatgtccaaccaagaaccatatacctttgtaggcacggggagtccgagtttaacctactggggaagatcgggggcgactcagggctgtctgtgaggggcaagcagttcgcccaggcactgcggaagttcttagaggagcaagagatcaccgaccttaaagtgtggacgtcacaactgaaacggacaattcaaactgccgaatcactgggtgtaccttatgagcagtggaaaatactcaatgaaatagacgccggcgtatgcgaggaaatgacctacgctgaaatcgagaaacgctacccagaagaattcgcgctgcgggatcaggaaaagtatctgtatcggtaccctgggggtgaatcttatcaggacttggttcaacgtcttgagccggtaataatggagcttgaaaggcaggggaacgtactggttatctcccaccaggcagttatgcggtgcttgcttgcctactttctggataagggggccgatgaactcccttatttgcggtgcccactacataccatctttaaacttacgccagtggcctatggctgcaaggtagaaacgattaagctgaatgtagaggctgtcaacacgcaccgggacaagccaacagccgctgaaacgacactcgccgtcagacggagaccgtccgccgcaagcctgatgcttccctgttag

SEQ ID NO: 106629 - DNA, 795 bp, Artificial Sequence
  Description of Artificial Sequence: Synthetic coding sequence
atggaggactttctcaagaggattgagtgctacaaggtgacctaccgtccactcgaccccgacaactacgacaaggacctgtcttttataaaggtgattaacgtgggccagcggttccttgttaacagagtacaggattatattcagagcaagattgtgtattatctcatgaatatccacgtgcagccccgcactatttacctgtgtcgccacggcgagagtgaattcaatctcctgggcaaaatcggaggcgattccgggctgagcgtgagaggaaaacagttcgctcaggccctgaggaagtttctggaggagcaggagataaccgacctgaaagtgtggacaagtcaactgaagcgcactatccagaccgccgagtcccttggcgtaccgtatgagcagtggaaaatcctgaacgagattgatgccggcgtctgcgaggagatgacctacgccgaaatcgagaaacggtatccagaggagttcgcccttcgcgaccaggagaagtatctatatcgctacccaggcggtgaatcctaccaggacctggtccagagactcgaacccgtgatcatggagctggagaggcaaggaaacgtgttggtgatttcccatcaggccgtaatgagatgcctccttgcctactttctcgataagggcgctgggtgtaaagtggaaactattaaactgaatgttgaagccgtcaacacccaccgggataagcctaccgctgcagagacgactctagccgtgcggcggcgtccatcagcggccagtttgatgctcccttgttag

SEQ ID NO: 106630 - DNA, 1419 bp, Artificial Sequence
  Description of Artificial Sequence: Synthetic coding sequence
atgactaactcacctaccctaatcgtgatgataggactgcccgccagaggcaagacttatgtgtctaaaaagctcacccggtatctaaattggataggagtccctactaaggtatttaacctgggagtgtatcgccgagaggcagtcaaatcgtacaagtcgtacgacttcttccgacacgataacgaggaagccatgaaaatccggaagcagtgcgccctcgtggcattggaggatgtgaaggcttacctgacggaagaaaatggccagatcgcggtctttgacgcaacgaacaccacacgcgagaggcgagatatgatcctgaatttcgctgagcagaacagtttcaaggtctttttcgttgaatcagtatgcgacgatcccgacgttatagcagcaaacattttggaggtgaaggtgagctcccctgactatccagagagaaatcgtgaaaatgttatggaggattttctcaagcgcatcgaatgctataaagtgacgtataggcctctcgatccagataactatgacaaggatctgtcatttataaaggtgataaacgttggccagagattcctggttaatagggtgcaggattacatccagtcaaagattgtgtactaccttatgaatatacacgtccagcctcgaactatttacctgtgcagacacggagaatctgaattcaatttgttgggaaagattggcggagattcaggcctatctgtccggggaaaacaattcgcgcaggccctgcgtaagttcctggaagaacaggagatcaccgacctgaaagtctggacctctcagctcaagcgaaccatacagacggccgagagcttaggcgttccatacgaacagtggaagattcttaacgagattgatgctggggtctgtgaggagatgacctacgctgagatagaaaaaagataccccgaagagtttgcactaagggatcaagagaaatacctgtatcgctatcctgggggcgagtcctatcaggatttagtgcagcgattagagccggttattatggaactcgagcgtcagggaaatgtgctcgtcatttcacatcaggcagtgatgagatgcctgctggcctacttcttagataagggggccgatgaacttccttacttaaggtgtccactgcacaccattttcaagctgactcccgtggcttacggctgcaaggtcgagacgatcaagctgaacgtggaggcagtgaacactcatagagataaacccacaaacaactttcctaagaatcagacacccgtacgaatgcggcgcaacagttttacccctctttcaagcagtaatacaatccgccggccacggaactacagtgtaggtagtcggccactgaaacctttatcccctttgagggcacaggacatgcaagaaggggcagattag

SEQ ID NO: 106631 - DNA, 1542 bp, Artificial Sequence
  Description of Artificial Sequence: Synthetic coding sequence
atgccgcttgagctgacacagtcccgtgtgcagaagatttgggtgcctgtagaccaccggccctcactgcctagatcgtgtggcccaaagcttactaacagccctactgtgattgtgatggtcggtcttcctgcaagaggcaagacatatatttccaaaaaattgaccagatatctcaactggattggtgtgcccacaaaagtgttcaacgtgggagaatatcgacgagaggcagtgaagcagtactcctcctacaatttctttcggcccgataatgaggaggcaatgaaggtgaggaagcagtgcgctttggccgcgttacgagacgtgaagtcctacctggcaaaagaaggaggacaaattgcagtgttcgacgctacaaacacaacccgcgagcggcgccatatgatcctgcatttcgcaaaagaaaacgacttcaaggccttttttattgaatccgtgtgcgacgaccccactgttgtggctagtaacattatggaagtcaagattagctcacccgactataaagattgtaatagtgccgaagctatggacgatttcatgaaacggattagttgctatgaagctagttaccagcccctggatcccgataagtgcgatcgggatttatcattaatcaaggtcatcgacgtgggtaggcggtttttagtgaacagggtgcaggatcacatacagtctcgaatagtttactacctgatgaatattcacgtccagccccggaccatctacctttgccgacacggcgaaaatgagcacaacctccagggcagaatcggaggcgacagcggcctgagttctagggggaagaagtttgcctcagcactatccaaattcgtagaagagcagaatctgaaggatctcagagtatggacctcccagttaaagtctaccatccagacagccgaagccctccggctgccatacgagcagtggaaagccttaaacgagattgacgcaggcgtgtgtgaagagctcacatacgaggagattagggatacctaccccgaggagtatgccctgcgggaacaggacaagtattactaccgctatcccaccggcgagtcttaccaggacctggtccagcgccttgagcccgtcatcatggagctggagaggcaagagaacgttctggtgatttgccatcaagcagttctccgttgcctgcttgcatactttctagacaagtccgccgaagagatgccctacctgaaatgccccttgcataccgtactgaaactgacacccgtggcctatggatgcagggtcgagagcatttacttaaatgtggaatctgtgtgtacccatagagagagatccgaggatgccaaaaagggccctaatcctctgatgcggcgtaactccgtgacaccccttgcgtctcccgagccaaccaaaaaacctcgtataaattcattcgaggagcatgtagcgtcgacatcagccgcccttccctcgtgtctgcctcccgaagtccctactcagttgcccgggcaacctctgcttggccaggcctgcctttag

SEQ ID NO: 106632 - DNA, 1545 bp, Artificial Sequence
  Description of Artificial Sequence: Synthetic coding sequence
atgccactggagctcactcagagccgggtgcagaaaatctgggtgccagttgatcaccgtccttccctgccccggtcatgcggcccaaaactgacaaactctcccactgttatcgtcatggtgggcctgcctgctcgtggtaaaacttatatttccaagaagctgacacgctacctaaactggattggcgtcccaacaaaagtgtttaatgtcggagaatatagacgagaggcagttaaacagtacagttcctataatttcttcaggcctgacaatgaagaagccatgaaggtacgtaagcagtgtgctctggccgcactgcgggacgtcaagtcctatctggccaaagaggggggccagatcgcagtgttcgatgcaactaacactactcgggagcgccgccacatgatattgcacttcgccaaagaaaatgatttcaaagcatttttcattgaaagtgtttgcgacgaccctactgtggtcgcgtcaaatataatggaggttaagatctcaagtcctgactataaagattgtaacagcgccgaggcaatggacgactttatgaagcgaattagctgctacgaggcctcataccagccactggatcccgacaagtgcgatagggatctgagccttataaaagtcatcgatgtgggccgtcgctttctggtcaatagggtccaggatcacattcaaagccggatcgtatattacttgatgaatatacacgtccagcctaggacaatctatttatgtagacatggcgagaatgagcataatctccaggggcgcatcggtggggattccggcctcagtagtcggggaaagaaatttgccagtgcattatctaagtttgttgaagagcagaacttgaaggatcttcgggtgtggactagtcagctcaaaagtaccatccagacagctgaggctctccgtctgccatacgagcagtggaaagccctcaacgaaatcgacgctggagtgtgcgaggaattaacctacgaagagattcgcgacacgtatccggaggagtatgcacttagagagcaggacaaatattattacaggtatcctaccggagaatcttaccaggacctcgtccagaggttggaacctgttatcatggagctagagaggcaggagaacgtactcgtcatttgtcaccaggctgtgcttagatgcttattggcctacttcctcgataaaagtgctgaggagatgccttatctgaaatgtcccctgcacacggtgctgaaactgacacccgtggcgtatgggtgtagggtggagagcatctacctcaacgtggagtcggtgtgcacccatcgcgaaaggtctgaggacgcgaagaaaggtccaaatcctttgatgaggcgaaattccgttacgcctctggctagcccagagccgacgaaaaagccgaggattaactcgttcgaggagcacgtggcatcaaccagcgccgctctgccatcttgtctgcccccagaagtgcccacacagctgcccggacagcccttgctagggcaggcatgccttacatag

SEQ ID NO: 106633 - DNA, 1545 bp, Artificial Sequence
  Description of Artificial Sequence: Synthetic coding sequence
atgccattggaacttacccagtcccgggttcaaaaaatctgggttccagtggaccacagaccttcacttcctagaagttgtggccctaagttgaccaattcgcctacagtgattgtgatggtcggcctgcccgcacggggtaagacttatatctctaagaagctgacccgctaccttaactggataggcgtaccaacaaaggtcttcaacgtgggcgaatatcgcagagaagccgtgaaacagtacagctcttacaatttcttccgtccagataatgaagaggccatgaaggtgcgcaagcagtgtgccttagccgccctacgcgacgttaaaagctacctagccaaagaaggtgggcagattgcagtcttcgatgcgacaaacacgacacgggagcgcaggcacatgatcttgcatttcgcaaaggagaatgacttcaaagctttcttcatagagagcgtctgcgacgaccccaccgtcgtcgcttcaaacataatggaggtcaaaatctcgtcccctgattacaaggattgtaacagcgcggaggctatggacgactttatgaagagaatctcgtgttatgaggcctcataccaacctctggatcctgacaaatgcgaccgtgacctttcactcatcaaagtgattgatgtcggacggcgctttttagtgaaccgagtgcaggatcacattcagagcaggattgtgtattacttgatgaacattcacgtgcagccccggaccatttacctgtgtcgacacggcgaaaacgaacacaacttgcagggccgaattggtggtgactcaggtctctccagtaggggaaaaaagttcgctagtgctttgagtaagttcgtagaggaacagaatcttaaggatctgagagtctggacttctcaactgaagagcacaatccaaacagctgaagccctgaggctcccctacgagcaatggaaggctctgaatgaaatcgatgctggcgtgtgtgaggagttgacctatgaagagatacgcgatacatacccggaggagtatgctctccgggaacaagataagtattattatcgttatcccactggggagtcttatcaggacctagttcagcggctggaacctgtcataatggaactggaaagacaggagaatgttttggttatctgtcaccaggccgtcctgaggtgcttactggcatactttctggacaaatccgcagaagagatgccctacctcaagtgtcccttgcacacggttctgaaattaactcccgtcgcctacggctgcagggtcgaatcaatttatctgaacgtggagtcagtgtgcacacatcgagagcggtccgaggacgctaagaagggccctaatcctcttatgaggaggaatagtgtcacacccttagcaagccccgagccgacaaagaagccaaggattaacagtttcgaagagcatgtggcctctacttcagcggcactgcctagctgtctgccacccgaggttcccacccagttacccggtcagccccttctagggcaggcctgcttgacatag

SEQ ID NO: 106634 - DNA, 1563 bp, Artificial Sequence
  Description of Artificial Sequence: Synthetic coding sequence
atgcccctggagttgacacaaagccgggtgcagaagatttgggttccagttgaccacaggccttcattgccacggtcttgcggccccaaactgactaacagccctactgtgatagttatggtgggccttcctgcacgaggcaagacttatatctcaaaaaaacttacgcgatacttaaattggattggcgtgcccacaaaggtgtttaacgtgggagagtaccggcgcgaggctgtgaaacagtactccagttacaatttcttcagaccagataatgaggaggcaatgaaggtcagaaaacaatgcgcactcgctgccttacgcgacgtcaagtcctacttggcaaaggaggggggtcagatcgcagtgtttgacgctacaaacacaacccgggaacgcagacacatgattctacactttgctaaggagaatgacttcaaggccttcttcattgaatccgtgtgcgatgacccaaccgtggtagcctccaatattatggaagtcaaaatttcgagccccgattacaaagactgcaactcggcagaagcaatggatgattttatgaaacgcatctcctgttacgaggcttcataccagccattagatcctgataagtgtgatcgagatctgtccctgattaaagtgattgacgttggacgtagatttcttgtgaatcgggtacaagaccacattcagagccgcatcgtgtattatctgatgaatatccatgtgcagccaagaaccatctacctgtgccggcacggagagaacgagcacaatctccagggacgaatcgggggcgacagcgggctctcctcacgtggtaaaaagtttgctagcgctctgagcaaattcgttgaggaacagaatctgaaggacctacgggtgtggacctcacagttgaagtccaccatccagacagccgaggctttgagactaccatacgagcagtggaaggcactcaacgagatagatgctggggtgtgtgaagaactcacttacgaagagattcgagatacatatccggaggaatacgccttacgggagcaggacaagtattattatcgctacccaacaggagaaagctaccaggacctcgtccagcgcctcgaaccagtaatcatggagctggagaggcaggagaatgttctggtgatctgccaccaggccgttcttcgctgcctcctggcctacttcctcgataaatctgccgaggagatgccctacctaaagtgcccactgcatactgtgctcaaactgaccccggtcgcctacggatgccgcgtcgagtcaatctatctcaatgtggagagcgtgtgcactcaccgtgaacggtctgaagatgctaagaagggtcctaaccccctgatgaggcgaaacagtgtcacccctcttgcctctcctgaaccaaccaagaagcctcgtatcaattctttcgaagaacacgttgcctctacttctgcagctttaccaagttgtttacctccagaagtgcccacgcagctgcctggtcaaaatatgaagggtagtagatcttcagctgacagctcccggaaacactag

SEQ ID NO: 106635 - DNA, 354 bp, Artificial Sequence
  Description of Artificial Sequence: Synthetic coding sequence
atgccctacctaaagtgtcctctgcacacagtgctgaagctcaccccggtagcatatggatgcagggtggagtccatctacctgaatgttgaatcagtgtgtacacatcgtgaaagatctgaggacgccaagaaaggtcctaaccctctgatgcggcggaatagtgtgacccccctcgcatcaccagagcctaccaaaaaaccaaggattaatagttttgaagaacacgttgccagtacctctgccgccctgcctagctgcctcccccccgaggtccctacacaactcccaggccagcctcttttaggtcaggcctgcctaaattggaagggtgtgatgaggaacgctgcgtag

SEQ ID NO: 106636 - DNA, 1581 bp, Artificial Sequence
  Description of Artificial Sequence: Synthetic coding sequence
atgccattagaactgacccagtcacgcgtgcagaagatctgggtgcccgtggaccaccggcctagcctgcccagatcttgtggccccaagctgacaaattcccccaccgtgatagtgatggtgggcctcccagcgagaggcaaaacgtacatttccaagaagcttactcgctatcttaattggatcggcgtccctactaaggtcttcaacgttggagagtaccgcagagaagcagtgaaacagtactcctcttacaatttcttccgacctgataatgaagaggcgatgaaggtgcggaagcaatgcgcactggccgctctgcgagatgtcaaatcttacttggcaaaggagggcgggcaaattgcggtctttgatgccacaaatactacgagagagaggagacacatgatcttgcacttcgccaaggaaaacgatttcaaagctttttttattgagtcagtctgcgacgaccctacagtcgttgcttccaatatcatggaggtgaagatttcgagtcccgattataaagactgtaattcggctgaggctatggatgattttatgaaaaggatttcatgctacgaagcctcctaccagccactggatccagataaatgtgatcgcgatctttcattaataaaagtgatcgacgtgggccgacgtttcctggtaaacagggttcaagaccacatccagtcccggatagtgtactacttaatgaatatccatgtacaaccacgcaccatttacctgtgcaggcacggcgaaaacgaacacaatttacagggccgaatcggcggggacagcggactgtcatcaagaggcaagaagtttgcctcagcgctttctaagttcgtcgaggagcagaatttgaaggatcttcgagtatggacgtctcagctgaagtctaccattcagacggctgaagccctgagactgccctatgaacagtggaaggccctgaacgaaatcgatgcaggcgtgtgcgaagagctcacctacgaggaaatccgtgacacctaccctgaggaatatgccctgagagagcaggacaagtattactatcggtacccaaccggagagtcatatcaggatctcgtacagagactggagcccgtaatcatggagctagaaaggcaggaaaacgtactggttatctgtcatcaggcggtgctgcgctgcctactggcctactttttggacaagtccgccgaggagatgccctacctgaagtgccctctgcataccgtgttgaaacttacccccgttgcgtacggctgccgcgtcgagagtatctatttgaatgtggagagcgtgtgtacacatagggagaggagcgaggacgccaagaaaggacccaaccctttgatgagacgcaactccgtgaccccactggcctcccctgaaccaacaaagaaaccgcggattaactcttttgaggagcatgtggcttcaactagcgcagcattaccttcctgcctcccccccgaagtgccaacgcagctgccgggccagcccttattggggcaggcctgcctacgcaccgtgtgccacatctttagtaaattttctccctactag

SEQ ID NO: 106637 - DNA, 567 bp, Artificial Sequence
  Description of Artificial Sequence: Synthetic coding sequence
atgaatatccacgtccaaccacgaacaatttacttatgccggcacggcgagaatgagcataaccttcagggccgcatcggcggcgacagcggcctgagcagccggggcaaaaagttcgctagcgctctgtcaaaattcgtagaggaacagaatcttaaggatctgcgggtatggactagccagctaaagagcacgatccaaactgccgaggcactgaggctgccatacgaacagtggaaggctctcaatgagattgatgcctcttatcaggatctggtgcaaaggcttgagcctgtgataatggaactggagagacaggaaaacgtgttggtgatctgccaccaggcagttctccgctgtctcctggcttactttctggacaagagcgccgaggaaatgccatatctgaaatgtcctctgcacactgtcctgaaactgacgcctgtggcatatggctgccgggtggagtctatctatctgaacgtggaatctgtgtgtactcaccgtgaaagatctgaaaacatgaaaggaagtcggtcttccgcagactcctctcggaagcactag

SEQ ID NO: 106638 - DNA, 1581 bp, Artificial Sequence
  Description of Artificial Sequence: Synthetic coding sequence
atgcccttggaattaactcaaagcagggtccagaaaatatgggttcccgtcgaccaccggccgagcctgcccagatcctgtggcccaaaactgaccaacagtccgactgttatcgtgatggtcggactcccagcacggggcaagacctacatctcaaaaaaacttacacgataccttaattggatcggggtgccaacaaaggtattcaacgttggagaatatcgcagggaggctgttaagcagtactcaagttataacttcttcagacctgacaacgaggaagcgatgaaggtgcgcaagcagtgcgcgctggccgcactgcgggatgtgaagagctatctcgccaaggaaggcggtcagattgctgtttttgatgcaactaatactactagggagaggaggcacatgatcctccacttcgcaaaagagaacgattttaaagcgttctttattgagtcagtgtgtgatgaccctacagtagttgcttctaatataatggaggttaagattagtagtccggattataaagactgtaattccgcagaagctatggacgattttatgaagcgaatcagctgctacgaagccagttaccagccgctggatccagataaatgtgatcgggatcttagtctcattaaggttatcgacgttgggcgcagatttctcgtgaaccgcgtgcaagaccatattcagtcaagaatcgtgtactacctcatgaatatccacgtgcagcctcggacaatctacctctgtcgccacggtgagaatgagcataatcttcagggcagaattggcggcgactccggtttaagctctcgtggaaagaagttcgcctctgctctttctaaatttgtagaggaacagaatctgaaagacctacgggtgtggaccagtcagctgaagagcacaattcagaccgctgaggctctccgcctgccgtatgagcaatggaaggcactgaacgagatcgatgctggcgtgtgtgaagagctgacgtatgaggagatacgcgacacctatcccgaggaatacgccctaagggagcaggataaatattactatagatatcctactggagagtcataccaggacctggtgcaaaggctagagcctgtcataatggaactggagagacaggagaacgttctagtaatatgtcaccaggcggtgcttagatgtctactggcctacttcttggataagagtgcggaagaaatgccctacttaaagtgcccattacacactgtcctgaagttgactccagtagcatacgggtgcagggtggaatccatttatctgaacgtggagtccgtttgtacgcaccgtgagcgtagcgaagacgctaaaaagggtccaaaccccttaatgcgccgcaactcagtcactcctctagcgtctccagaaccgacgaagaagccacgcatcaactccttcgaggagcacgtcgcaagcacctctgccgctctgccgagttgcctacctccggaagtgcctacccagcttcccggtcagcccctcctcggccaggcatgccttcggacggtgtgtcacatctttagtaagttttcaccatactag

SEQ ID NO: 106639 - DNA, 1503 bp, Artificial Sequence
  Description of Artificial Sequence: Synthetic coding sequence
atgccattcagaaaggcctgcggtccaaagctcacaaactcaccaacagtgatcgtcatggtggggctgcccgccagaggaaagacatatattagcaagaagctgactaggtaccttaactggatcggagtccccaccaaagtgtttaatgtgggcgagtatcgcagagaggccgtcaaacaatacagcagttataacttcttccggccagataatgaagaggccatgaaggttcgtaagcaatgcgccctggccgccctgagagatgtgaagagttatttggccaaagaaggagggcagattgcagttttcgatgctacaaacacaacccgggagaggaggcacatgatcctccacttcgctaaagaaaacgattttaaggccttcttcatcgagagcgtttgcgatgaccctaccgtggtggcctctaatattatggaggtaaaaatcagcagtccagattataaagattgtaattccgccgaggctatggatgacttcatgaagcgaatttcctgctacgaggccagttaccagcccctggatcctgataagtgcgatagagatctgtctcttattaaagtcatagacgtgggcaggagattccttgtgaaccgggttcaggatcacattcaatctcggatcgtctattatcttatgaacattcacgtgcagccaagaaccatctatctgtgccgccacggcgagaacgaacataacctgcaggggagaatcgggggtgattccggcctttcaagtcgtggcaagaagttcgccagcgctctgtctaaattcgtggaagagcagaacctaaaagatctccgagtgtggaccagtcagctgaaatctacaatccagacggcagaggcattgcggcttccctacgagcagtggaaggccttgaacgaaatagacgctggggtctgtgaggaactgacctatgaggagattcgggatacctaccccgaggagtacgcactccgcgaacaagataagtactattaccgctatccaactggagaaagttatcaggacttagttcagcggctggaaccagttatcatggagttggagcgccaagagaatgtacttgtcatctgccatcaggctgtgctccggtgcctgctggcctattttttggacaagtctgctgaggagatgccctatctgaagtgtccattacacactgtgctgaaactgactcccgtagcctacgggtgtagagtcgaatctatctatctgaatgtagagagcgtgtgtacccatcgggagcggtcagaagacgctaagaaggggcccaatccacttatgaggagaaacagcgtgaccccactggcaagtcctgagcctaccaaaaagcctaggatcaatagtttcgaggaacacgtggcgagcaccagtgctgcactgccatcctgccttccccctgaagttccaacacagttgcctggacagaacatgaaaggctctcgcagtagtgcagacagctcccggaagcactag

SEQ ID NO: 106640 - DNA, 279 bp, Artificial Sequence
  Description of Artificial Sequence: Synthetic coding sequence
atctatctgaatgtggagtctgtctgtacacatcgcgagagaagtgaggatgcaaagaagggaccaaatccgctaatgcgccgcaattctgttacacctctagcctccccagagccaaccaaaaaacccaggatcaactcctttgaggaacacgttgctagtacttctgctgcactccccagttgcctccctccagaagtgcccacacaactgcccgggcaacccctcctggggcaggcctgccttaattggaaaggcgtcatgaggaatgctgcatag

SEQ ID NO: 106641 - DNA, 96 bp, Artificial Sequence
  Description of Artificial Sequence: Synthetic coding sequence
atttacctgaacgtggagtctgtatgcactcatcgggagcgctctgagaacatgaagggcagccgctcaagcgccgactcgtcacgcaaacattag

SEQ ID NO: 106642 - DNA, 261 bp, Artificial Sequence
  Description of Artificial Sequence: Synthetic coding sequence
atgccttacctgaagtgtcctctacacacagtgctgaaattgacccctgtcgcttacggttgccgagttgaaagtatctacttgaatgtagaaagtgtctgcacacatcgagagcgttccgagggcttatcacttttccccaggctcgagtgcgggggagctgtgaccgcgcactgctcccttaacctactgggctcttcggacccccctgctagcgctagccgggtggcggagaccacaggatgtaaggagggaacatag

SEQ ID NO: 106643 - DNA, 432 bp, Artificial Sequence
  Description of Artificial Sequence: Synthetic coding sequence
taggtggaggagcagaacctcaaggatttgagagtctggaccagtcagctgaagtcaactatacagacagccgaggccctgagacttccttatgagcagtggaaggccttaaatgaaatcgatgccagctaccaggacctggtgcagagactggagcccgtgatcatggaactggagaggcaagaaaacgtgcttgtgatttgtcaccaagctgtcctgcgatgtctactggcttattttctggataagtcagccgaggagatgccctacttgaaatgcccattgcacactgtactcaagctgactcccgtggcatacggctgtagggtggaatctatatacctcaatgttgaatcagtgtgtacacacagggagcgctctgaaaacatgaaagggagtcgatcatctgctgacagttctaggaagcattag

SEQ ID NO: 106644 - DNA, 555 bp, Artificial Sequence
  Description of Artificial Sequence: Synthetic coding sequence
atgccctttcggaaggcctgcggccccaaactgactaacagtcccacggtcattgtgatggttggcttgcccgcgcgcggtaagacttatatttccaagaagctcacccgctacctgaactggatcggcgtgccgacgaaagtctttaatgttggggagtatagacgcgaggctgtgaagcagtactcttcttacaatttctttaggccagacaatgaagaagccatgaaagttcgaaagcagtgcgctctggccgccctcagagacgtcaagtcctacttagctaaggaagggggtcagattgccgtgtttgacgctacgaacaccactcgggaaaggagacacatgatattgcattttgctaaggagaacgattttaaggctttttttatcgagtcagtgtgtgatgatccaaccgtggtggcctcaaacatcatgcagaaggcctttcagcgggacctcagcgcaacccctttatggtgttgcaggaaactgaagtcccccgcccggattactaagactgctacgcgccagaaaccctggacgactagctag

SEQ ID NO: 106645 - DNA, 1605 bp, Artificial Sequence
  Description of Artificial Sequence: Synthetic coding sequence
atgggggaaggaggacagaaagaaggggatagccagcaagccggcgctcttcccttgctctgtcagctagacacattcagtccaaaggccaccgtgttcggggtgtccattaatcccgcatgtgggccgaagctcaccaacagcccaacagttatagtgatggtgggactaccagcacgaggtaagacctacatttctaaaaagctcacgagatatctgaactggatcggggtgcctaccaaagtgttcaatgtgggggaataccgaagggaggctgtgaagcagtactcttcctataatttttttcgcccggacaacgaggaagctatgaaggtccggaaacagtgcgccctggccgccctaagggacgttaagtcctacctcgccaaggagggggggcagatcgcagtgtttgatgccaccaacacaacgagggaacgcaggcacatgatcctgcatttcgccaaggagaatgacttcaaagccttttttattgagtccgtttgcgatgatcccaccgtagttgctagcaatatcatggaagtcaaaatctcctctcccgactataaggactgtaacagcgccgaagccatggacgactttatgaaaagaatctcttgttacgaggcttcctaccaacctctggaccctgacaagtgtgatagagacctgtctcttattaaggtgatcgatgtgggcagacgatttcttgttaaccgcgtacaggaccatattcagagtcggatcgtgtactatctcatgaatatacacgtccagccccgaaccatatacctctgccgccatggcgaaaacgagcacaatctccaggggcggattggtggagactctgggctttccagcagaggcaaaaagttcgcatccgcattgtcaaaattcgtggaagagcagaacctcaaagacctccgagtatggactagccagctgaagtctactatccagactgctgaggcgctgcgactgccctacgaacaatggaaggccctgaatgaaatagacgcgggggtctgtgaggaactgacatatgaagagatccgggacacctatccggaggaatatgcactgcgtgagcaagataaatactactatcggtacccaacaggagaaagctaccaggatctagttcaacggttggagcctgtcattatggagctggagcgtcaggaaaacgtgttggtgatctgccatcaggcagtgctgagatgcctcttggcttattttcttgacaaaagtgcagaggaaatgccttatcttaagtgtccactgcatacagttctgaaattgacacctgtcgcatatggttgcagggtggaaagcatctacctgaacgtcgagagcgtttgtacccaccgagaacgctctgaggatgcaaaaaagggtcccaatcccttaatgagaaggaactctgtcacccccctcgcctcaccagagcctacaaaaaaacctagaatcaattcattcgaggagcacgtagcctcgacttctgcagctcttccttcttgtttaccccctgaagtgcctacccagttgccaggccagaatatgaaaggctcgaggagcagtgctgattcatcccgaaagcattag

SEQ ID NO: 106646 - DNA, 594 bp, Artificial Sequence
  Description of Artificial Sequence: Synthetic coding sequence
atggacccgcctgccggttttgtgcgcgccggcaatcccgccgtcgcggcaccacagtcacccctttcgccagaaggtgctcacttccgggccgctcaccaccctcggtccacgggatcccgatgtcccggtagcctgcagccctcacggccactggtggccaattggttacagagccttccagagatgcccgttgacttcaccggatactggaagatgttagttaacgaaaactttgaagagtatctgagggctctcgacgtgaatgtcgccctgcggaagatcgcgaatctcctgaagcccgataaggaaattgttcaagacggcgaccacatgataatccgaacgctttctacatttagaaactacatcatggacttccaagtgggaaaggaatttgaagaagatcttacgggaatcgatgatagaaagtgcatgaccactgtctcttgggatggggacaaattacagtgcgttcaaaaaggcgagaaagaagggagaggctggacgcagtggattgaaggtgatgaactacacctggagatgagagtggagggcgttgtttgtaagcaggtgtttaagaaggtccagtag

SEQ ID NO: 106647 - DNA, 528 bp, Artificial Sequence
  Description of Artificial Sequence: Synthetic coding sequence
atgaccaactgtcccactttaatcgtgatggtgggactcccagcgcgaggaaaaacgtacatcagtaaaaagctgactaggtatttgaactggattggggtgcctactcgtgagttcaacgtgggccaataccgcagagatgtggtgaaaacatacaagagctttgagttctttctgccagacaatgaggaagggctgaaaatccggaagcagtgtgccctcgccgcacttagagacgtgagaagatttctctcagaagaaggggggcatgttgccgtgttcgacgccactaataccacacgcgagagacgcgcgactatattcaattttggagaacagaacggctacaaaacttttttcgtagagtccatctgtgtcgatccggaagtgatcgcagctaacatcgtgcaggttaagctggggagccccgactacgttaaccgagactcagacgaggccactgaggacttcatgagacgaatcgagtgttacgagaacagctatgaatcacttgacgaagacctgtag

SEQ ID NO: 106648 - DNA, 1377 bp, Artificial Sequence
  Description of Artificial Sequence: Synthetic coding sequence
atggatcggggaagtttgggcggctccagcctgaccgacctggggcctggaagctcgagaagagtctgcatgaccaactgtcccacgctgatcgtgatggtaggactgccggcgcgaggcaagacctatatatccaagaagctgactagatacttgaattggataggcgtgccaacccgcgagttcaatgtgggacagtacaggagagatgtggtgaagacatataaatcttttgaattttttctgcccgataacgaagaggggctgaagatacgcaaacagtgtgccctggccgctttgagagatgtgcggaggtttctgagtgaggagggtggacacgtcgcagttttcgatgccactaataccacgcgggagcggagggccaccatatttaactttggagaacaaaacgggtataaaaccttttttgtggaaagtatctgcgtggatccagaggtgatagccgctaacattgtgcaggtaaaacttggaagccctgattacgtgaacagagacagcgacgaagctacagaagattttatgaggagaatcgagtgttatgagaattcatatgagtctttggatgaagatctggacagagacttaagttatatcaaaatcatggacgtcgggcagtcttacgtggttaatagagttgctgaccacatccaatcaaggattgtttactatctcatgaacattcacgtcactccgcgttcaatatacctctgtcggcatggcgagtcagaactcaatttaaagggaagaatcggtggggaccctggtctgagcccccgcggccgagagtttgcaaagagtctggcccagtttattagtgaccagaacataaaggacttaaaggtatggacaagtcagatgaaacgcacaatccagaccgccgaggccctgggcgtcccatacgaacaatggaaggttctaaatgaaattgacgccggagtttgtgaggagatgacttacgaggaaatccaggataactatcccctggagttcgccctgcgggaccaagacaagtaccgatataggtacccaaagggcgaatcatatgaagatctcgtgcagagactggaacctgttattatggagcttgaaaggcaggagaacgtattagtgatatgccaccaggcagttatgcgttgcctgctcgcctacttcttggacaaagctgcggagcaattgccttacttgaagtgccccctacataccgtgctgaaactcacgcccgtggcgtacgggtgcaaggtggagtcgatttttctaaatgtcgcagcagtgaacactcacagggaccgaccgcagaatgttgacatcagtcgcccaccagaagaagcactggtcacggtgccagcacaccagtag

SEQ ID NO: 106649 - DNA, 1308 bp, Artificial Sequence
  Description of Artificial Sequence: Synthetic coding sequence
atgactaattgcccgaccttgattgtgatggtcggattgcccgcacgcggaaaaacctatatttctaaaaaactgacccggtatctaaattggattggcgttcccacacgtgaatttaacgtcgggcagtaccggcgcgacgtagtgaagacttacaagagtttcgaatttttcctacctgataatgaggaaggactcaagatccgtaagcaatgcgccctggccgcactgagagacgtccgacggtttctttccgaagaaggcgggcatgtggccgtgtttgacgccaccaataccactcgagagcggcgcgccaccattttcaatttcggcgagcagaacggatataagacattctttgtggagagtatttgtgtcgatccagaggtgatcgccgccaatattgtgcaggtgaaactgggctcccccgattacgtcaaccgggactccgatgaagcaactgaagactttatgcgaagaatcgaatgctacgaaaattcgtacgaaagcctggacgaggatctcgatcgggatctgtcctacataaagatcatggatgtcggccagtcgtacgttgtcaacagggtagccgatcatatccagtcccgaatagtgtactatttgatgaacattcacgtcactcctcgcagcatatacctgtgtcgccacggcgagtcagagcttaatctgaaggggagaatcggaggtgatccaggtttgtcacctcgcggccgtgaattcgcgaagtctctggcccaattcatatcagatcagaatattaaggacctgaaagtgtggacctcccaaatgaagaggaccatccagaccgccgaagctctgggagtaccatacgagcaatggaaagttctgaatgaaattgacgctggcgtgtgcgaggagatgacttacgaagagattcaggataattacccgctcgaattcgcactccgtgatcaggataaatacaggtatagatatcctaaaggggaatcttacgaggatctggtccagaggctcgaacccgtgatcatggaactggagcggcaagaaaacgtgcttgtgatctgtcaccaggctgtgatgaggtgtctcctggcatatttcttggataaagctgccgagcagttgccgtacctcaaatgtcctctccacaccgtcctcaagctcacacccgttgcctacggttgtaaggtggagagcattttcctgaacgtggccgcggtgaacactcatagggatagaccacaaaacgtggacatcagccggccccccgaggaggccctggtgactgtgcccgctcaccaatag

SEQ ID NO: 106650 - DNA, 429 bp, Artificial Sequence
  Description of Artificial Sequence: Synthetic coding sequence
atggccagtccacgcgagctcactcagaaccctctcaaaaaaatctggatgccatattccaatggtcgcccggcactccatgcatgtcagagaggagtgtgcatgacgaattgtccaacactgatcgtgatggtgggtctgccagcacggggcaaaacctacatcagcaagaaacttaccagatatcttaactggattggagtgcctactcgagaattcaacgtggggcagtatagaagagatgttgttaagacgtataagagcttcgagttcttccttcctgacaatgaggagggtctaaagattagaaagtttctcatgccccagacaccgccggagaatggtgagcgacctagcctgatccttgaaaaccgaatggctacgcggcccttcctatcgtcgccatctgtgtggattcttagatcctag

SEQ ID NO: 106651 - DNA, 777 bp, Artificial Sequence
  Description of Artificial Sequence: Synthetic coding sequence
atggccgctcccgcccccgggttaatttcggttttctcatcttcgcaagagctgggggcagctcttgcccagctcgtggcgcagagagccgcttgctgtcttgctggggcacgggctagattcgccctcgggttgagtggcgggtcactggtgagcatgctggcccgagaattgcctgctgcagtcgccccagctgggcctgctagcctggcacggtggacccttggtttttgcgacgaacggctggtgccctttgaccacgctgaatccacctacggcctctacaggactcacctacttagccgcttacctattcccgagagccaggtcattactattaacccagagctgcccgttgaagaagccgccgaagactatgcgaaaaaactccggcaggcatttcagggagacagcattcctgtatttgatctgctcattttgggggtcgggcctgatggtcacacatgtagccttttcccagaccaccccctcttgcaagagcgggagaagattgtggcaccaatttctgactcccccaagccaccaccccaacgcgttacacttactctccccgtccttaatgccgctagaacagtgatcttcgtcgccactggggaagggaaggccgcggtactgaagcgcattttggaggaccaggaggaaaaccccttacccgccgccctggtgcaaccccataccggtaaactgtgttggttcctggacgaggctgccgctagactcctgactgtcccatttgagaaacacagcaccctgtag

SEQ ID NO: 106652 - DNA, 1428 bp, Artificial Sequence
  Description of Artificial Sequence: Synthetic coding sequence
atggccgccaagagccaacctaacattccaaaagctaaatctctggacggagttaccaacgatcggaccgccagtcaaggacagtggggcagagcatgggaggtggattggtttagcttggcctcggtgatcttccttctcctgtttgcacccttcattgtctactatttcatcatggcatgtgatcagtattcctgcgcacttacaggccctgtggtggacatcgttaccggtcacgcccgactgagcgatatctgggctaaaactcctccaatcaccaggaaagccgctcagctctacactctgtgggtaacctttcaggtattactgtacacgtcacttcccgacttttgtcacaagttcctgccggggtacgttggcggaattcaggaaggggctgtgactcccgcaggtgttgttaacaaatatcaaataaacggactgcaagcctggttactaactcacctcctctggttcgcaaatgctcatttattatcgtggttctctcctaccatcatattcgataactggattcccttactgtggtgcgccaacatcctgggctatgcagtctcgacatttgccatggtgaaaggctacttctttcctactagcgcacgcgactgtaagttcacggggaattttttctacaattacatgatggggatagaatttaatccaaggattggcaagtggtttgacttcaagttgtttttcaacggcaggcccggaattgtcgcctggactctgattaacttatctttcgctgctaagcaacgggagcttcattctcatgttaccaatgcgatggttctcgtgaatgtcctgcaagcgatttacgtgatcgattttttctggaatgagacatggtatcttaagactattgacatatgtcatgatcactttgggtggtatctgggctggggggattgtgtgtggttaccctacctctacactctgcagggcctgtacttggtgtatcatcccgtgcagcttagtaccccccacgctgtgggcgtcttgctgctgggattggtcggctattatatttttagagtagccaaccaccaaaaagacctgtttcgacggaccgacggacgttgtctgatttggggccggaagcctaaggttatcgaatgtagttatacgagtgccgatgggcagcggcaccactctaagctcctggtaagcgggttctggggcgtggccagacactttaactacgttggcgatctgatggggagtctggcatactgtctggcctgtggcggcggacacctgctaccatacttttacatcatctacatggcaatcttacttacccaccggtgcctgagggacgaacatcgttgcgcgtcaaaatacgggcgtgattgggagcgctacaccgctgctgtgccctaccgactgctccccggaattttctag

SEQ ID NO: 106653 - DNA, 1428 bp, Artificial Sequence
  Description of Artificial Sequence: Synthetic coding sequence
atggccgctaaatcacaacctaacatccctaaagccaaatcattagacggagtgaccaacgacagaactgcgtcacagggacagtggggacgggcctgggaagtagattggttttccctggctagtgtcatttttctcttactgttcgcccctttcatagtgtactactttattatggcctgtgaccagtatagttgtgcgctgaccggaccggttgtcgacatagtgactggacacgccaggctgtcggacatttgggccaaaactccccctatcacgaggaaggccgctcaactctatactctgtgggtgacattccaggtactactctatacgtctctcccagacttttgtcataaatttctcccagggtacgtgggcggaatacaggagggtgctgtaactccagcaggtgtggttaataagtaccagattaatggactgcaagcatggcttctgacccacctgctgtggttcgccaacgcccatctactttcatggttcagtccaacaattatttttgacaattggatcccgcttctgtggtgcgccaatatcctgggctatgccgtgtctacattcgccatggtcaagggctacttttttccaacgtcggcacgggactgtaagtttactggcaactttttttacaactacatgatgggtattgagttcaacccccgcatcggaaaatggtttgattttaagttattcttcaatggccgcccaggaatagtagcgtggaccctgatcaatctctccttcgccgcaaagcagcgtgagctgcacagccatgttacaaacgcgatggtcctggttaatgtgctgcaggctatctacgtgattgactttttctggaatgaaacatggtacctcaagacaattgatatttgccacgaccattttggctggtacctgggttggggcgattgtgtctggctgccttacctgtacacgttacagggactctacctggtctaccatcctgtgcagcttagcacccctcacgctgtgggagtcttgctgctgggccttgtagggtattacatctttcgtgtagccaatcatcaaaaggatctctttcgccggaccgatgggcgctgcctcatctgggggagaaagcctaaagtaattgaatgtagttacacttctgccgacgggcagagacatcacagcaagctgcttgtcagtggcttttggggagtcgcccgccacttcaactatgtcggcgatctcatgggtagcttggcatattgtctggcctgcggaggcggccacctgctcccttacttctacattatctatatggcaatcttgctgacacacagatgtcttcgggacgagcaccggtgtgcctccaagtatggaagggactgggagaggtacacggctgccgtaccttatcggctgttacccgggatcttttag

SEQ ID NO: 106654 - DNA, 327 bp, Artificial Sequence
  Description of Artificial Sequence: Synthetic coding sequence
atggctgccaagagccagcccaatatccccaaggctaagtccctcgatggggtcacaaacgatcgcactgcttctcaggggcaatgggggcgtgcctgggaggttgactggtttagtctggccagcgtcattttccttctcctgttcgctccctttattgtgtactactttatcatggcttgcgaccagtatagctgtgcccttactggtcctgttgtggatattgttacaggccacgccagactgtcagacatttgggccaagacccctcccatcaccaggaaagcggcccagctttatactttatgggttacattccaggtctag

SEQ ID NO: 106655 - DNA, 495 bp, Artificial Sequence
  Description of Artificial Sequence: Synthetic coding sequence
atggcagctaagagccagcccaacatccctaaggcaaagagcctggatggcgttactaacgatcgaaccgcttctcagggccagtggggaagggcttgggaggttgactggtttagcctggccagcgtcatttttctgcttcttttcgcaccgttcattgtctactactttattatggcatgcgatcaatatagctgtgccctcactggaccagtggtggatattgttactggccatgccaggttgagcgacatctgggccaagactccccctattacgaggaaagctgcacagctgtataccctgtgggtgactttccaggtcctcttgtatacctcactgccggatttttgccataagtttctgcctgggtatgtgggcggcatccaggagggtgctgtgactcccgctggggtcgtaaataagtatcagatcaatggcctgcaagcttggctattgacccatctcctctggtttgctaacgcccacctgtag

SEQ ID NO: 106656 - DNA, 276 bp, Artificial Sequence
  Description of Artificial Sequence: Synthetic coding sequence
atggcagcaaagtcacaacctaatatacctaaggccaaaagcctggacggcgtgacgaacgacagaacggcatcccagggccagtggggaagggcttgggaagtggactggttcagtctcgcatctgtgatctttttgctactgttcgcgccatttatcgtgtattacttcatcatggcctgtgatcagtattcctgcgcattaactggccctgtggtggacatcgtaactggacatgctcggctcagcgacatctgggctaagactcccccatag

SEQ ID NO: 106657 - DNA, 318 bp, Artificial Sequence
  Description of Artificial Sequence: Synthetic coding sequence
atggctgctaaaagtcagcccaacattccgaaagccaagtctctggacggtgttactaacgatagaaccgcctcacaaggacaatggggccgcgcctgggaagtggactggttcagtctggccagcgtcatcttcctgcttttgttcgcacccttcattgtgtactactttattatggcctgcgatcagtatagttgtgcccttactgggccggtggtcgatatcgtgacgggacatgcccggctcagcgacatatgggctaagactcctccaatcactagaaaggcggcacagctgtatacgctgtgggtcacctag

SEQ ID NO: 106658 - DNA, 846 bp, Artificial Sequence
  Description of Artificial Sequence: Synthetic coding sequence
atggactcatactccacttatctggccactgtgaaggtctcaggctcctggctggaagagcaggatgaggacatttatgaggtggagagccgggttccacttcctcacccgtttcccctctgtgaacacttggatgaaaacaatagtgtgatcgtgaatacctcaatcttccactttatccacaaacgtaacggtcatatcctcaagctaatttccaaaattagtctgcccacgcctccttattctttagaacacgccaaggtaactcagacagagctgatgcgtgaaagctttagacagaaacaggaagcaacagagagcctcaagtgtcaagaagagctgagagaacgattgcatgaggagtctagggctcgagaacagttagccgtagaactgagtaaagcggagggggtcatcgatggctacgcggatgagaaaacccttttcgaaagacagattcaggagaaaacggatattattgatagacttgagcaggagctcctatgtgcgtccaaccgcttacaagaattggaagccgagcagcagcagatccaggaggagcgcgaactcttgtctaggcagaaagaggcgatgaaggctgaagcggggcccgtggaacagcagctgctgcaggagaccgaaaaactgatgaaggagaagctggaggttcaatgccaagctgaaaaagtacgagatgacctacagaagcaggtcaaagccctggaaatcgacgtggaagaacaagtgtcacgctttattgagctggagcaggagaaaaatacggagctgatggacttgagacagcagaatcaggctctcgaaaagcagttagagaagatgagatag

SEQ ID NO: 106659 - DNA, 11724 bp, Artificial Sequence
  Description of Artificial Sequence: Synthetic coding sequence
atggaggacgaggagagacagaaaaagctggaagcaggaaaagctaagctggcccagttccgtcagagaaaagcacagagcgacggacagagccctagcaaaaagcagaagaagaaaagaaaaacgtcaagcagcaagcatgatgtgagtgcccatcacgatctgaatatcgatcaatcacagtgtaatgaaatgtatataaactcctcccaacgcgtggagagtacggtcatacccgagagcaccatcatgaggacgttacacagtggtgagattacctcgcacgaacagggtttcagcgtggagctcgagtccgagatttctactaccgccgacgactgctcctccgaggtaaacgggtgttctttcgtgatgagaaccggcaagccgacaaacttattgcgggaagaggagttcggagtggatgacagctattccgagcagggtgcgcaagactcacccacacacctcgaaatgatggagtcggagttggccggcaaacagcatgagattgaggagttgaatcgggaactggaggaaatgcgcgtcacatatgggaccgagggcctccagcagctccaggagtttgaggcagcgataaagcagcgggatggcattataacacaactgactgccaaccttcagcaggctcgaagagagaaggacgagacaatgcgagaatttctggagctgactgaacagtcccaaaaactgcagatccaatttcaacagctgcaagccagtgaaacacttcggaactccacgcacagctcaactgcagcagacctattgcaagcaaaacaacaaattctgacacatcaacagcagctggaggagcaagaccacttgctcgaagattaccagaaaaagaaggaggactttactatgcagatttcctttctccaggagaagataaaggtctatgaaatggagcaggataaaaaagtggaaaacagcaataaggaagagatccaggagaaggagaccatcatcgaagaactcaataccaagatcatagaggaggagaaaaaaactctcgaacttaaggacaaactaactacagccgataaactcctcggggagctgcaagagcagatcgtccagaagaaccaggaaatcaagaatatgaaacttgagttgaccaacagtaaacagaaggagagacaatcttcggaggaaattaagcaacttatggggacggtcgaggagctacagaagagaaaccataaagactctcagtttgagactgacatcgtacagcgcatggagcaggagacgcaacgaaaattagaacagttgcgggcagagctcgacgaaatgtatggacagcagattgtccaaatgaagcaagagttgattcggcagcatatggcacagatggaagaaatgaaaacacgtcataagggcgagatggaaaatgcacttagaagctattcaaacattacagttaacgaggaccagattaagcttatgaatgtggctatcaacgaactgaacatcaagctacaggatactaacagccagaaggaaaaactgaaggaagagttggggctcatactcgaggagaagtgcgcgttgcagaggcagctcgaggacctcgtggaggagctgtccttttcaagagagcagattcaacgcgctagacaaacaatcgctgaacaggagagcaaactgaacgaggcccataaatcactctccactgttgaggatctgaaagccgagatcgtttcagcttcagagtcgcgtaaagaattggaactaaagcacgaggccgaggtaaccaactacaagatcaaacttgagatgctcgagaaggaaaagaacgccgtgctggatcggatggcggagtcgcaggaggccgagttggaaagacttcggacgcaactgctcttttcccatgaggaagagctgtccaagctaaaagaggatttagagattgaacacaggattaatatagagaagctgaaagataacttgggtatccattacaagcaacagattgacggactgcagaacgagatgtcacagaagattgaaacgatgcagttcgaaaaggataacctgatcacaaagcagaaccaattaatactggagatttctaaactcaaagacctgcagcagtccctggtgaacagcaaatccgaggaaatgaccttgcagatcaatgagcttcagaaagagatcgagatactgaggcaggaagagaaagaaaaaggcaccctggaacaggaggtacaggaactgcagctgaaaaccgagcttcttgagaagcaaatgaaggagaaggagaacgatctacaggagaaatttgctcagctggaggcagagaattcgatcttaaaggatgagaagaaaacactggaagacatgttgaaaattcacacccctgtgagccaggaagagcgactgatctttcttgactctataaagtccaagtcgaaagacagcgtttgggagaaggaaatcgagattctcattgaagagaatgaggatcttaagcagcagtgcatacagctgaacgaagagatcgagaagcaacgaaatactttcagctttgccgagaaaaactttgaggtaaactaccaggagctacaggaagagtacgcttgtttgctaaaagttaaagacgatctggaagattccaagaacaagcaagagctagaatataagtctaagctcaaggcactgaatgaagagcttcacctccagcgtattaatccaactaccgtcaagatgaagagctctgtgttcgatgaagacaaaacattcgtggccgagacactggaaatgggcgaggtcgtcgagaaggacactactgaactgatggaaaaactagaagtcacgaagagagagaagctcgagctttcccagaggctgtcggacctatctgaacaactcaaacaaaaacatggagagatcagttttctgaatgaggaagttaaatccttaaagcaagagaaagagcaggtctcacttcggtgccgagagctcgagatcattattaatcacaatcgggccgagaacgtgcaatcttgtgacacacaggtaagctctttgctcgacggggttgtgactatgaccagcaggggcgctgaaggaagcgtgagtaaagtgaataagtcattcggtgaagagagcaaaatcatggtggaagacaaagtctcatttgagaacatgacagtgggtgaagaatcaaaacaggaacaattgatcctggatcacctcccctctgtgacaaaagagtcttctttgagggctacacaacctagcgagaatgataaactgcagaaggagctaaacgtgctgaagtccgaacagaacgaccttcggctgcagatggaagcacaacggatctgtctgagtctggtctactccacacacgtcgatcaggttcgagaatacatggagaacgaaaaggacaaagccctgtgctccttgaaagaggaacttatctttgcccaagaagaaaagataaaggagctgcagaagatacatcagctggagctgcaaactatgaagacacaggaaaccggagatgaagggaagcccctgcatttgctgatcgggaagcttcaaaaagccgtatctgaagagtgcagttacttcctgcagactttgtgttccgtcctcggtgagtactacactcccgccctgaagtgtgaggtcaatgcggaagacaaggagaatagtggcgattatatttctgagaacgaggacccagaactgcaggattacaggtacgaggtgcaggattttcaggaaaacatgcatactcttttaaacaaggtgacggaagaatacaacaagctactggttctccagacacgactcagtaaaatctggggacagcagaccgatggcatgaagttggagtttggagaggagaatctgcctaaggaggagaccgagttcctgagcatacattctcagatgaccaacctggaagacattgatgtaaaccacaaaagtaaactgtcctccttgcaggacctggagaagactaaactggaggaacaggttcaggagctcgagtcgttaatatcatctctccagcagcagctgaaggagacagagcagaattacgaagccgaaattcactgtctgcagaagagactgcaggcagtcagcgagtccactgtcccaccatctctgcctgtggactcagtggtaataaccgagtcagacgcccagagaaccatgtatcctggatcctgcgtgaagaagaacatcgatgggaccattgagtttagtggtgaattcggggtcaaggaagagaccaatatcgtgaagttgctggaaaagcaataccaagaacagctggaggaggaagtggctaaagtgatagtgagtatgtctatagcattcgcacaacagactgagctttccagaatcagcggaggtaaggagaataccgcctccagcaaacaggcccacgccgtttgccagcaggaacaacactacttcaacgagatgaagttgagccaggaccagattggtttccagacttttgagacagtggatgtgaagttcaaggaggaattcaaaccgctgtcaaaggagcttggggaacatggcaaggagatcctgctgagcaactccgatcctcacgacattcccgagtccaaggactgtgtgctcactatttcggaagagatgttttcaaaggacaagacttttattgtgagacaaagcattcatgacgaaatttcagtctcttcaatggatgcctcccggcagctcatgctgaatgaggagcagctggaggacatgagacaggagctagttagacaataccaggaacatcaacaggccactgaactcctgaggcaggctcacatgcgacagatggagcggcagagagaagatcaggagcagctgcaggaagagataaagcgactcaaccgccagctggcacagcgaagtagcatcgataatgagaatctagttagcgagcgagagagggtactgctagaggaacttgaggctctgaaacagctgtccctagctggcagggaaaaactgtgttgcgagctgcgtaacagctccacgcagacacagaacggcaacgaaaaccagggtgaggttgaggagcaaactttcaaagagaaagaactggaccgcaagccagaggatgtgccgcccgaaatccttagcaacgagcgttatgcattgcagaaagccaataacaggcttctcaaaatactcttggaagttgtgaaaactactgcggccgtcgaggaaactatcggcagacatgtcctgggcatactggacagaagttctaagtctcaatcttcagccagtctaatctggcggagcgaggccgaagccagcgttaaaagctgcgtacacgaggagcatactcgcgtgacagatgaatcaatcccatcttacagtggttccgatatgccacgaaacgatatcaatatgtggtcaaaggttacagaggaagggaccgaactctctcaacgtcttgtgcgatctgggttcgccgggacagaaatcgatcctgagaatgaggaactgatgttgaatatctccagccgtctgcaggctgcagtggaaaaactgttagaggctatcagcgaaacaagctcacagctggagcatgccaaggtgacccagacagagcttatgagggagtcttttcggcaaaagcaggaggcgactgagagtctgaaatgccaggaggagttgagagaacgtctgcacgaggagtcccgcgcacgagagcaactagctgtggaactgagcaaggctgaaggcgtgatcgacgggtacgcagatgagaagacgcttttcgagcggcagatacaggagaagaccgacattatcgaccggttagaacaggagctgctgtgcgcatccaatagattgcaggaactggaagctgaacagcagcaaatacaggaggaacgcgagttgttatcacgccagaaggaggctatgaaggccgaagcaggaccggtagagcagcagctccttcaagagactgaaaagctgatgaaagaaaaactcgaggtgcaatgccaagccgaaaaggtcagggatgacctgcagaaacaagttaaagccctggagatcgacgtcgaggagcaagtgtcaagatttatcgaactggaacaggagaagaacactgagctgatggatcttcgtcagcagaatcaggccttagagaaacagctggaaaagatgaggaagtttctggatgagcaggcgatcgatagggagcacgagcgtgatgtgttccagcaggagatacagaagttagaacagcagcttaaagtggtccccaggttccagcctatcagcgagcaccagacccgagaagttgagcagttggccaatcatctcaaggagaagactgacaagtgcagcgaactgctgctgagcaaggagcagctgcagcgggacatccaggagaggaacgaggaaattgaaaaattggaatttagagtgagagaactggagcaggccctcctcgtgtctgccgacacctttcagaaggtggaagaccgcaaacacttcggcgcagtggaagccaagcccgaactgtcattagaggtacagctgcaagccgagagagatgccatcgaccgcaaagagaaggaaattaccaacctggaagaacaactcgaacagtttcgggaagagcttgaaaacaagaatgaggaggtccagcagctgcatatgcagctcgagatccaaaaaaaggaaagtactacccggttgcaggaactggaacaagaaaacaagctgtttaaagatgacatggaaaaactgggacttgctatcaaagaaagcgacgcaatgtctacccaagaccagcacgtgttatttgggaagtttgcacaaataatacaggagaaggaggtggaaattgaccaactaaacgaacaagttactaagttgcaacagcagcttaaaattactaccgacaataaggtcatcgaggagaagaatgaactcatacgggatcttgagactcagatcgagtgcctcatgtctgaccaggagtgcgtcaagcgcaatagagaggaggagatcgagcagctgaatgaagttatagaaaaactgcaacaggagctcgctaacattgggcagaagacatccatgaacgcacactctcttagcgaggaggctgacagtctgaagcatcagctggacgttgtgattgcagagaaactagcactcgaacagcaggtcgaaacggctaacgaagaaatgactttcatgaagaatgtgctaaaagagactaattttaaaatgaatcagttgacacaagagctcttcagtttgaaacgtgaaagggagagcgtggaaaaaatccagagtatcccagagaacagcgtaaacgtggctattgaccacctgtccaaggataaacccgagctcgaggtggtgctgaccgaggacgcgttgaaatcactggaaaatcagacgtactttaagtcattcgaggaaaatgggaagggctcaatcattaatctggagactcgcttactccagttggaaagcacagtcagcgctaaggacctggaactgacccaatgctacaaacagatcaaggatatgcaagaacagggccagtttgaaaccgagatgcttcagaagaaaatcgtgaatcttcagaagatcgtggaggaaaaggtagccgccgctttggttagccaaattcaactggaagcagtgcaggagtacgcaaagttctgtcaagataatcagaccataagctctgagcctgaacggacaaatattcagaacttgaaccagctgcgtgaagacgagctcggtagcgacatcagtgcgctgactctccggatttccgagttggaaagtcaggtggttgaaatgcatacatcactcatcctggaaaaggagcaggtggaaattgccgaaaaaaacgtcctcgagaaagaaaagaaactgttagagctccaaaagctgctggaggggaacgaaaaaaagcagagagagaaggaaaagaagaggtcaccacaggacgtggaggttcttaagacgacgactgaattgttccactccaatgaagaatctggcttcttcaacgagctggaagccctgcgggcagaaagtgtcgcgactaaggcagaactcgcctcctacaaagaaaaggctgagaagcttcaggaggaactgcttgtaaaagagaccaatatgacaagcctacagaaggatctctcacaggtgagggatcacctggccgaggccaaggagaagctgtctatccttgagaaagaagacgaaaccgaggtgcaggagagcaagaaggcctgcatgtttgagcctcttccgatcaagctctctaagtcaatcgcctctcagacagacgggacactgaagatatcctccagcaaccagaccccacaaattttggtgaagaatgcgggaatccagatcaatctgcagtcagaatgcagtagtgaagaggtcacggagatcatatcccagttcaccgagaaaattgaaaagatgcaagagctgcacgcggcagagatcttggacatggaatccagacacattagcgagactgagacgctgaagcgcgagcactacgtcgctgtccagctgctgaaggaggagtgtggtaccttgaaagccgtgatccaatgcctgcgctcaaaagaggggtccagcattccagagctggcccactctgacgcgtaccaaacaagggagatttgcagctccgacagcggcagcgactgggggcagggaatctatctgacccatagtcagggattcgatattgctagtgaagggaggggagaggaatcagaaagcgccacggacagtttccctaaaaagatcaaggggctactacgggctgttcataacgagggcatgcaggtgctgtccctaacagagagtccctactcggacggggaggaccactccattcagcaagtgtcagaaccatggttggaggagcggaaggcatacattaacactatttcctcgctgaaagacctgatcacgaagatgcagctccagcgggaggccgaggtgtacgatagtagtcagagccatgagtctttttcggactggaggggcgagcttctgcttgcactgcagcaggttttcctcgaggaacggtctgttctacttgccgccttcagaacagagctgaccgccttgggaacaaccgacgccgttggactgttgaactgcctcgagcagcggatccaggaacagggcgtggaataccaggctgccatggaatgcttacagaaggctgataggcggtcccttcttagtgagatccaggctctgcacgcccaaatgaacgggaggaagattacccttaaacgagaacaggagtctgagaaaccctcccaggagcttctagaatacaatattcaacagaaacagagtcagatgctggaaatgcaggtggagctgagcagtatgaaagaccgggccacagagctccaagagcagctcagtagcgaaaaaatggtcgttgctgagttgaagagcgagctcgcccaaacaaaactggagctggagaccacacttaaggcgcagcacaagcacctgaaggagctggaagccttcagactggaagtgaaggacaagaccgacgaggtgcacctcctgaacgacacactcgcttctgaacagaaaaaaagccgcgagcttcagtgggctctggaaaaggagaaagctaagctgggaagaagcgaggagcgcgataaggaggagttggaagatctgaaattcagtttggagagtcaaaagcagaggaatctgcagttgaatctccttcttgagcagcagaaacagttgctcaatgaaagtcagcagaagattgaaagccagagaatgctgtatgacgcacagctgtccgaagagcaagggcggaacctggaacttcaggttctcctagagtcagaaaaggtgcgtatccgggagatgtcatccaccttggaccgcgagagagagctgcacgcccagttgcagtcctccgacggtacaggtcaatccaggcccccattgcccagtgaggaccttctcaaggaactgcagaagcagctcgaggagaaacattcgcgaattgtggaactattgaatgagactgagaaatataaactggactcacttcagaccaggcagcagatggagaaggaccgccaggtgcacaggaaaaccctccagactgagcaggaagctaataccgaaggccagaaaaaaatgcacgaactgcagtccaaagtcgaagatctgcagcggcagctggaagagaaacgacagcaggtgtataagctggacttagaagggcagcgtctgcagggaattatgcaagagtttcagaaacaggagctcgagagagaggaaaaacgggaaagccgaagaattctgtaccaaaaccttaacgagcccaccacgtggagcctgacatccgatcgaacaagaaactgggtcctccagcagaagatagagggcgagactaaggagagcaattacgccaaactgatagaaatgaacggaggcggcacaggatgtaaccatgaactcgagatgattcggcagaaactccagtgcgtggcaagtaaattgcaagtcctgccacagaaagcgtccgagagactgcagttcgaaacagcagacgacgaagacttcatctgggtgcaggagaacattgatgagattatcctacaactgcagaaactgacagggcagcagggagaggaacccagccttgtgagccctagcacctcatgtgggagtctgactgagagattactaagacagaacgcagaattaaccggacacatttctcagctcacggaggaaaagaacgacctccggaatatggttatgaaactggaagagcaaatcaggtggtataggcaaactggcgcaggccgtgacaattctagccggttttctttgaacggcggcgccaacattgaggccatcattgcctctgaaaaggaggtctggaatcgagagaagcttacgctgcaaaaatctcttaagagggcggaggcagaggtctataagctgaaggcagagctcaggaacgattctctgctgcagaccttgtcccccgattcggagcacgtcactctgaagcgtatttatggtaagtatttacgcgctgagtccttccgtaaggcgctaatttatcagaaaaaatacctcctgctcctgctcggaggctttcaggagtgcgaggatgcaactttggcacttctcgctagaatgggaggtcagcccgctttcactgatctggaggtcattactaaccggcctaagggttttacacgatttcggtctgccgtgcgggtgtctattgccattagtaggatgaaattccttgtgcgcagatggcacagagttactggctcagtgtctatcaatatcaacagagacggatttggtctcaatcaaggtgccgaaaagaccgatagtttctaccatagtagcggaggcctcgagctctacggcgagccccgtcacaccacctatagaagtcggtctgacctagattacatccggtcaccattgccattccagaatcggtatcccgggaccccagcggacttcaatcccggatccctcgcttgtagtcagttgcagaactatgatcctgacagagccttaaccgactatattaccaggctcgaggcgctgcaaagacgattaggcactatccaatcgggaagtacaacgcagtttcatgcgggaatgcggagatag

SEQ ID NO: 106660 - DNA, 11574 bp, Artificial Sequence
  Description of Artificial Sequence: Synthetic coding sequence
atggaggatgaggagcggcagaagaagctagaggccgggaaagccaaaatcgaagagctgagcctcgccttcctggtacgccaacttgctcagtttcgtcagagaaaggcccagtccgacggacagtcaccgtccaaaaagcagaagaaaaaacgaaaaacgagctctagtaagcacgatgtaagcgcccaccacgatcttaacatcgaccaatcacagtgcaatgagatgtatattaactctagccaacgggtcgaaagcacagtaatacccgagtcaacaattatgcgtacattgcatagcggggaaatcacctctcacgagcaggggttctctgtggagcttgagtccgagatctctaccactgccgacgactgcagtagcgaagttaatggctgtagcttcgtgatgagaaccggcaagccaactaatctgctccgcgaggaggagtttggcgtagatgactcctactccgagcagggggcacaggacagccctacccatctcgagatgatggagtcagagcttgcaggaaaacaacatgaaatcgaagagttaaatcgcgaactagaagagatgcgcgttacctatggcactgagggactgcagcagctgcaggaattcgaagctgcaatcaaacagagagacgggattatcacccagctgactgccaatctgcagcaggctagacgagagaaggacgaaactatgcgtgagttcctcgagctgaccgagcagagccagaaattacagatccagtttcagcagctccaagcctccgaaacactccgcaattctacacactcgtccaccgccgccgacctgttgcaagctaaacaacaaatacttacacaccaacagcagcttgaggaacaagatcatctactggaggactatcagaaaaaaaaggaggactttacgatgcagatctcattcttacaggaaaagataaaagtatatgaaatggagcaggataagaaagtggagaattcgaataaagaagagattcaggagaaggagaccattatcgaagaactgaacactaaaattattgaagaagagaagaaaacattagagcttaaagacaagttaacgactgccgacaagcttctgggagagctacaggagcagattgtccagaaaaaccaggagatcaaaaacatgaaactcgaactgacaaattccaaacagaaagagaggcagagcagcgaagagattaaacaactgatgggaactgttgaagagctgcagaagagaaaccacaaggactcccagtttgagaccgatatcgtccaacgcatggagcaagagacccaaagaaagctggaacagttaagggctgagcttgacgaaatgtacggacagcaaatcgtgcagatgaagcaggagcttatccgtcagcacatggcccagatggaggagatgaaaacccggcataaaggggagatggaaaatgccctcaggtcctattcaaatatcactgtgaatgaggaccaaataaaacttatgaacgtcgctataaacgagctgaatattaagctgcaggacaccaattcccagaaggagaagctcaaggaggagttgggactgatactcgaggagaagtgtgccctccagagacagctagaagatctggtcgaggagctgagtttctccagagaacagatacagagagcccggcagacgatcgcggagcaggaaagtaagctcaacgaggcacacaagagtttgagtacagttgaggatctgaaggccgaaattgtatctgccagtgaaagccgcaaggaattggagttaaaacatgaggctgaggtgactaattataagattaaactggaaatgctggagaaggaaaagaatgcagtcctggataggatggctgagtcccaggaggcggagctcgagcggctgcggacgcagctgttattcagccatgaggaagaactttccaagctgaaagaggatcttgaaatagaacaccgaattaacatcgagaaattgaaggacaatcttggaattcactacaagcaacagatcgatggtctgcaaaacgaaatgtcccagaagattgaaacgatgcagttcgagaaggacaacttgatcaccaagcagaaccaattgatcctggagatctccaaattgaaagatctgcagcagtctctggtaaactctaagtctgaagagatgacactgcagatcaatgaactgcagaaggagatcgagatcctgagacaggaagagaaagagaaaggaactcttgagcaggaagtgcaagagttacagctgaaaactgagcttcttgagaaacagatgaaagaaaaggaaaacgacttgcaggaaaagttcgcccagctcgaagctgaaaatagcatcttaaaggatgagaaaaagactctagaagacatgttaaaaatccataccccggtctcacaggaggaaaggctcatcttcctagactctatcaagtccaaaagcaaggatagcgtctgggaaaaggagatcgagatcctcatagaggagaacgaggacttgaaacaacagtgcatccagcttaatgaggagatcgaaaagcagcgtaacaccttttcctttgccgaaaaaaactttgaagtgaactatcaggaactccaggaagagtacgcatgcctgctcaaagtaaaagacgacctggaggatagtaagaacaaacaagagctggagtacaaaagtaagctaaaggctctcaatgaagagttgcaccttcagcgtattaatccaaccacagtcaagatgaaatcatctgtgttcgacgaagacaagacttttgtggccgaaacattggagatgggggaagttgtggagaaggacacaacagagttgatggagaagcttgaggtgaccaagcgggaaaaattggagctgtcacagcggttaagcgacctgtcggagcagttaaaacagaagcacggcgaaatcagtttcctgaacgaggaagttaagtcactgaagcaggaaaaggagcaggtctctctcagatgcagggagctggagattattataaatcataacagagctgaaaatgtccagtcctgtgacacacaagtctcttcgctactggacggggtggtcaccatgacttcgcgaggcgctgagggcagtgtttccaaagttaataaaagctttggagaagagtcaaaaatcatggtggaggacaaggtctcttttgagaacatgaccgtgggcgaggaaagcaaacaggagcagcttatcctggatcacctcccttccgtgaccaaggaatcttcactgagggccacgcagccctctgagaacgacaaacttcagaaggaactgaatgtgctaaagagcgagcagaacgacttacgactgcagatggaagcccagcggatctgcctgtccctggtgtactccacccacgtggatcaagtccgggaatacatggagaacgaaaaagacaaagcactttgttcactgaaagaggagcttatctttgcccaggaggaaaaaatcaaagagttacaaaagatccaccaattggagctgcagaccatgaagacacaggagaccggcgacgagggcaagccactgcacctactaatcggcaagctgcagaaggctgtaagcgaggagtgtagttatttcctgcagactctgtgtagcgtgttgggcgaatattatactcctgcacttaaatgcgaagtgaacgcagaggacaaggaaaattcaggggattatatctccgaaaacgaggaccctgaactacaagattacagatatgaagtgcaggatttccaggagaatatgcacactctgctgaacaaggtcacagaggagtacaataagctgctagtattgcagacacgactatctaagatttggggacaacagactgacgggatgaagttggaatttggggaggagaaccttcccaaggaggagacagaatttctatcaattcactcccagatgaccaatctggaggacatcgatgtgaatcacaagagtaagctgtcgtccctgcaggatctggagaagacaaagctggaagaacaggtgcaggagttggagagcctgatctccagcctacagcagcagttgaaagagactgagcagaattacgaggccgaaatccattgcttacagaaacgcttacaggcagttagcgagtctaccgtgcctccctccctccctgtggattccgttgtcatcactgaaagtgacgcccaacgaaccatgtatccgggcagctgtgtgaagaagaatattgatggcaccatcgagttctccggcgaatttggagttaaggaggagactaatatagtcaaattgctggaaaaacaataccaggagcagctagaagaggaagttgcaaaagtaattgtttctatgtccatcgcatttgcccagcagactgagctgtccagaatctcagggggtaaggaaaatacggccagctcaaagcaggcccatgctgtttgtcagcaggaacagcattattttaacgaaatgaagctttctcaggaccagattggctttcagacttttgagactgtggacgtgaaattcaaggaggagttcaagcctctgtctaaggaattgggagagcacggcaaggaaatcctcctttcaaactccgatccccacgatatccccgagtcaaaggattgtgtgctgacgatctccgaagagatgtttagtaaggataagaccttcatcgttaggcagagcattcatgacgaaatctccgtgtcctcgatggacgcttctaggcagcttatgttgaatgaagaacaacttgaggatatgcgacaagaactcgtgcgccaatatcaggaacaccaacaggcaacagaacttctgcgccaggctcacatgcgacagatggagaggcaacgggaagaccaggagcaattacaggaggagattaagcggctcaataggcagctggcccagagatctagcattgacaacgaaaacctggtatccgagcgggagcgcgttctcctggaggaactggaagccctgaagcagctgtccctcgccggtcgggagaaattgtgctgcgaactgagaaattcaagcacccagacccagaacggcaacgagaaccagggcgaggtggaggagcagacatttaaggagaaagagctggatcggaagccagaggatgtgcccccagaaattttaagtaatgaacggtatgccttgcagaaggccaataatcggctgttgaagattctgctcgaagtagttaaaaccactgccgcagtggaagaaacgatcggtaggcatgttctcgggatcctagaccgtagctcaaagtcacagagcagcgcctcactcatctggcgcagtgaggctgaggccagtgtcaagagctgtgtccatgaggagcatacaagagtgaccgacgaatctattccatcatatagcggatcagatatgccgagaaacgatatcaacatgtggagcaaggtaacagaggagggtacggagttaagtcagcggttggttcgcagcggatttgcagggactgagatcgaccccgagaacgaggagctcatgctcaacatcagcagccggctgcaggctgccgttgagaaactgcttgaggccatatcggagacctcctcacaactcgaacacgcaaaggtcacccagaccgagctgatgcgggagagttttcgtcagaagcaggaggcaacggaatctctgaagtgtcaggaggagctgcgagagaggttgcacgaggagagccgcgcccgcgagcagctcgcagttgaactctccaaggcagagggtgtgatcgatgggtacgcagatgaaaagaccctgttcgaacgtcagatacaggagaagacggacatcatcgatagactggagcaagagttgctgtgcgcgagcaaccgactgcaagaacttgaagccgaacagcaacaaattcaggaggagagggaactcctctcccgtcagaaggaggccatgaaggccgaggcgggacctgtcgagcagcagttgctccaagagacggaaaagctgatgaaagagaagctggaagtgcaatgtcaggccgaaaaagtaagagatgatctgcaaaaacaagtgaaggcactcgaaatcgacgtcgaagaacaggtcagtcgcttcatcgaactggagcaggagaagaataccgaactgatggacttacgccagcaaaatcaggccctagaaaaacagctggaaaagatgcggaagttcttagacgagcaggctattgatcgcgagcatgaacgggatgtgttccagcaggagatacagaaattggagcagcagctaaaagtggtgccacggtttcaacctatcagtgagcatcagacccgcgaggtggagcaattagccaatcacctaaaagagaagactgacaagtgctccgagctgctgctgtcaaaagagcaactgcagcgcgatatacaagagcgtaatgaagagatagagaaactcgagttccgggtgagggaactcgagcaggctcttctggtttcagccgataccttccagaaggtggaagaccgcaagcattttggtgctgtggaggctaaaccggaactgtccttggaggttcaattacaggctgaacgggacgccattgaccgtaaagagaaggaaatcaccaatctggaagagcaacttgaacagtttagagaagagctggaaaacaagaatgaggaggtgcagcagttgcatatgcaacttgaaattcaaaaaaaggagagtacaactcgattgcaagagttggagcaggagaacaagctgttcaaggatgatatggaaaagctcgggctggcgataaaggaaagtgacgcaatgtccacccaagaccagcacgtcctgtttgggaaattcgcacagattatccaggagaaagaagttgaaatcgatcagctaaacgagcaggttaccaaactccagcagcagctcaagatcaccactgataacaaggttatagaggaaaagaatgagctaatccgggatctcgaaactcagatcgagtgcctgatgtccgatcaggaatgcgtgaagagaaaccgggaggaagagatagagcagctgaacgaggttattgaaaaactccagcaggaactggctaacatcgggcagaaaacatcgatgaatgctcattctctgtctgaggaggctgattctttaaaacatcagctggatgtagtcatcgccgaaaaactcgcacttgagcaacaggtagaaacggccaacgaagagatgactttcatgaaaaacgtccttaaggaaactaatttcaagatgaatcagctgacccaggagttgttctctctcaaacgggaaagggagtctgtggagaagattcagtccattcctgagaatagtgtgaacgtggctatcgatcacctatccaaagataagcctgagcttgaggtggtgcttaccgaggacgcactgaagtcccttgagaatcaaacctatttcaaatccttcgaagagaacggcaagggtagcataataaaccttgaaacaaggcttttgcagctggagtcgacagtctcggctaaagacctggagttaacacaatgttataagcagattaaagacatgcaggaacaggggcaattcgaaacagagatgcttcagaaaaagatcgttaatttacagaagattgtcgaagaaaaagttgctgccgctttggtgtcacagatccagctcgaagctgtccaagagtacgccaagttctgtcaggacaatcaaacgatcagcagcgagcccgaacgaaccaacattcagaatctgaatcagctcagggaagatgagctggggagcgatattagcgccttgacgctgcggattagcgagctggagagccaggtggtggagatgcatacatcccttatcttggagaaggagcaggtagaaattgccgagaagaatgtactggagaaggagaagaagctattagagctgcagaaacttcttgagggaaatgagaaaaagcagcgcgagaaggaaaaaaaaaggtcccctcaggacgtggaagtgttgaagactactactgagctttttcattcaaacgaggaatctggttttttcaacgaactcgaggcactacgggcagagtccgtcgcgacaaaggcagagttagctagttacaaggagaaagctgaaaaattgcaagaggaattgctcgtgaaggaaacaaacatgacctcccttcaaaaagacctgagccaagtcagagaccaccttgctgaagccaaagaaaagctttctatcttggaaaaagaagacgaaacagaagtgcaggaatcaaaaaaggcatgtatgttcgagccactgcctatcaagctatcaaagtcaatcgccagtcagacagacgggacgctaaagatatcttcgagtaaccagaccccacagatcctggtgaaaaacgctgggatccagatcaatctgcaaagcgagtgtagctctgaagaggtcaccgagatcattagccagtttacagagaagattgagaagatgcaggaactccacgccgcagaaattcttgacatggagtctaggcacatcagcgagacagagactctgaaaagggaacactacgtagcggtgcaattgctgaaagaggagtgcggaacattaaaggccgtgatccagtgcctgcggtctaaagagggactgctgcgggccgtgcacaatgaggggatgcaggtgctgtccctgacagagagcccctattctgatggggaagaccactccattcagcaggttagcgagccttggctggaagaacgcaaagcctacattaacaccatatcttcccttaaagacctgattaccaaaatgcagctccagcgcgaggccgaggtctatgacagcagtcagtcacatgaatcattcagcgattggcgtggtgaattgctgctagcactgcagcaagtttttctggaggaacgcagtgtgctgctggcagccttccgcaccgaattgacggctctcggcactaccgatgccgtcggtctgttaaactgtctcgagcagcgcattcaggaacagggcgtggaataccaagccgcaatggagtgtctgcagaaggcagaccgacgcagcctcctgtctgagatccaggccttgcatgctcagatgaacgggaggaaaatcacactcaagagggagcaagaaagcgagaaaccgtcccaagagctgttagagtacaatatacagcagaaacagagccagatgttggaaatgcaggtcgagcttagtagcatgaaggacagggcaaccgagcttcaagagcagctgtcatcggagaaaatggtggtagctgaactgaaatctgaactggcacagaccaagttagagctcgagactacgctgaaggcccagcataagcaccttaaggaacttgaagcatttaggttggaggtgaaggacaagactgatgaagtgcacctgctcaacgataccctcgcaagcgagcaaaagaagtcacgcgaacttcagtgggctctggaaaaagagaaggcgaagcttgggagatctgaagaaagggacaaagaagagttggaagatctaaaattctccctcgaatcacagaaacagcggaatctgcagctaaacctgttgttagagcagcagaagcagctcctaaatgagtcacaacaaaagatcgagtcccagcgcatgttgtacgacgcccagctctccgaggagcaaggcagaaatctcgagctccaggtacttctcgagtccgagaaggtgcggattagggaaatgagcagcacactcgaccgggagagagaactgcacgctcagctgcaaagtagcgatgggactggtcaaagtaggcctccattacctagtgaggacctattaaaggaactccagaagcagctggaggaaaaacacagccggatagtggagctgctgaacgagactgaaaaatataagttagacagccttcagactaggcagcagatggagaaggaccggcaggtgcaccgtaagactctccagactgagcaggaggcgaacaccgaagggcagaaaaaaatgcacgaacttcaaagtaaggtcgaagacttgcagagacagctggaagagaaacgacagcaggtttataagctggatttggagggtcagaggctgcagggaatcatgcaggagtttcagaagcaggaactggaaagagaggagaaacgcgaatcccgcaggattctctaccagaacttgaatgagcccacaacgtggagccttacctccgaccgtactaggaattgggtgcttcagcagaaaattgaaggcgagacgaaggagtcgaactacgctaaactgatcgaaatgaacgggggcgggactgggtgcaatcacgagttggagatgatcaggcagaagttacagtgcgtggcctctaagcttcaagtgctcccgcagaaggctagcgagcggctacagttcgagacagccgacgatgaagactttatctgggtgcaagaaaatatcgatgagatcattctgcaactccagaaattgacaggccagcagggcgaggagccctcgcttgtgagcccttcaaccagctgtgggagtctgacggagcggctgctacgtcagaacgctgagcttactgggcacattagccagttgaccgaagaaaagaacgaccttcggaatatggtcatgaagctagaggagcagattagatggtaccgccagacgggtgctggtagggataacagttcaagattcagcctgaacggaggggccaatattgaagctattatagcatctgagaaagaagtgtggaatcgagagaaactaactctgcagaagagtctgaaaagggcagaggccgaggtatacaagctgaaggccgaactgagaaacgacagtctgctgcagacgttgagccccgatagtgaacacgtcaccctgaaacggatttatggaaagtacttgcgtgccgaatcattcagaaaagcactgatctaccagaaaaaatacttgttgctgttactcggcggattccaggagtgcgaggatgccacactggccttgctggcaaggatgggcggccagcccgcatttactgacctcgaagtaatcaccaaccgccccaaaggattcactcggttccgatccgctgtgcgcgtgtccattgccatcagcagaatgaaattcctggttaggcggtggcacagggtcactgggagtgttagcatcaacatcaatagagacgggttcggtctcaatcaaggtgctgaaaagacggactccttctatcattcttcaggcggactggaactctacggggaaccccgccacacaacttatagatctagaagcgatttggattacatccgatcccccctgccttttcaaaacaggtacccaggcacccctgcagactttaatcccggatctctggcttgtagtcaactacagaattacgatcctgaccgcgctctcacggactacattaccaggctcgaagcactccagcgacgactgggaaccatccagagcggtagcactacacaatttcacgccggcatgcgaaggtag

SEQ ID NO: 106661 - DNA, 11736 bp, Artificial Sequence
  Description of Artificial Sequence: Synthetic coding sequence
atggaggacgaagaaagacaaaagaaactggaggccgggaaagctaaaatagaagaattatctctagcatttctggttcgtcagctggcccagtttcggcagagaaaggcccagtccgatggccagagcccctcaaaaaaacaaaagaagaagcgcaaaacctctagctccaaacatgacgttagcgcgcatcacgatctgaatattgaccagtctcagtgcaatgagatgtacataaactcctctcagagagtggaatccaccgtgattcctgagtctaccattatgaggacgttgcactctggggagataacctcgcacgaacaggggttcagtgtggaactcgagtctgaaatatctacaaccgccgacgattgctcctctgaggtcaatggctgttcctttgtcatgagaaccggaaaacccactaatctacttcgcgaggaggaattcggggtggacgatagttactctgaacagggagcccaagactccccgacgcatctcgagatgatggagtcagaattggctggcaaacagcacgagatcgaggagctaaatagggagctggaagaaatgagagtgacttacggcacggagggcttgcaacagctgcaagagtttgaggcagccatcaaacagcgggacgggattataacgcaattaacggctaacctgcagcaggcacgccgggaaaaggatgaaactatgcgggaattcctggagctaacggaacagtctcagaagcttcaaatccagtttcagcagttacaggcatctgagacgctccgcaatagcacccacagtagtacggccgcggacctgctgcaggccaaacaacagatcctgacgcatcagcagcagctggaagaacaggaccacctcctggaagattaccagaagaagaaggaggactttaccatgcaaatcagctttctccaagagaagatcaaggtgtacgaaatggagcaggataagaaagtggagaacagcaataaggaagaaatacaggaaaaggaaaccatcatcgaagaactgaacacaaaaattatcgaggaagaaaaaaaaaccctggaactgaaagataagctcaccaccgcagacaaattgctaggggagttgcaggagcagatcgtgcaaaagaatcaagagatcaagaatatgaagctggagcttactaatagtaaacaaaaggaacgtcagtctagcgaggagatcaaacagcttatggggaccgttgaagaactccagaagcgcaaccataaggactcacagtttgagaccgacatagtccagagaatggagcaggagactcagcggaaactggagcagttaagggccgaactggacgagatgtacggacaacagatcgtacagatgaagcaagagctgatcagacaacatatggctcagatggaagagatgaaaaccaggcacaaaggcgagatggaaaatgccctacgttcatattccaatattacggtcaacgaagatcaaattaagctaatgaatgttgctatcaatgaactcaatattaaattgcaggacaccaattcccagaaggagaagctgaaggaggaacttggactcatactggaggagaagtgtgctttacagcgacagctggaggatcttgttgaagaactctctttttcccgcgaacagatccagagggctcggcagaccatcgccgaacaggaatccaaactcaacgaggcacataagtccttgagcacagtagaggacctgaaggccgagattgtatccgcgtctgaatcccgtaaggagcttgagttaaaacacgaagctgaagtgactaactacaagatcaaattggaaatgctcgaaaaggagaagaacgccgttctcgacagaatggctgagagccaagaggccgaattggagcgtctgcggacgcagctgctgttttcgcacgaagaggagttaagcaaattgaaggaggatttggagatcgagcatagaatcaacatcgaaaagcttaaggacaacctgggcatacattataaacagcagatcgatggattacagaatgaaatgtcccagaaaattgaaactatgcagtttgaaaaggacaacctcatcacgaaacagaatcagctcattctcgagatatccaaactgaaagacttacaacagagtttagtcaactccaagtctgaggagatgactttgcagattaacgagctgcagaaggagatagagattctgagacaggaagagaaagagaaggggaccctggaacaggaggtgcaggaattgcaactcaaaactgaattattggaaaaacaaatgaaggaaaaggagaacgatcttcaggagaagtttgcccagttggaagccgaaaactctatattgaaagatgaaaagaaaacactcgaggacatgctcaagatacatacccctgtgtcacaagaagagaggcttatctttctcgactcaatcaaatcaaagagcaaagactcagtctgggaaaaggaaattgagatcctgattgaggaaaacgaagacctgaagcaacagtgtatccaactgaatgaggagatcgagaaacagaggaatacattctcatttgcagagaaaaattttgaagtgaactaccaggagctgcaggaggagtatgcctgtttactcaaggttaaggacgatttggaagattctaagaacaagcaggagctggagtataagtcaaagctgaaggctctgaatgaagagcttcatcttcagcgcatcaaccccacgactgttaaaatgaagtcttcagtttttgatgaagataagactttcgtagccgaaactcttgaaatgggggaagtggtggagaaagataccaccgaactcatggagaaactcgaggtgactaaacgggagaagttagagttatcacagcgcctgtcagacctgtcagagcaactgaaacagaaacacggagagatatcctttttgaacgaggaagtgaaatcactgaagcaggaaaaggaacaggtttctctccgctgtcgcgagttagagattatcattaaccacaaccgagccgagaacgtccaatcctgcgacacccaggtgagctcactgttggatggcgtagttacaatgactagccgtggcgcagaaggaagcgtgagcaaggttaataaatcttttggcgaagagagtaagataatggtggaagataaggtttcctttgagaatatgacagtcggtgaggagtccaagcaggaacaattgattctggatcacctcccatccgtcactaaggagagctcccttagagctacccagccaagcgagaacgacaagcttcagaaagaactcaatgtgctcaagtcagaacaaaatgacttgcgtctccagatggaagcccagcgcatttgcctgagtctggtgtactcaacccacgttgatcaggtgagggagtacatggagaacgagaaagataaggccttgtgctcccttaaggaagagttgatcttcgcccaggaagagaagatcaaggaattgcagaagatacaccagctcgaattgcagaccatgaaaacgcaggagactggggacgaagggaagccgctgcaccttctgatcggcaagctgcagaaagcggtctccgaagaatgctcttacttcctccagaccctgtgtagcgtgttaggcgaatattacacaccggctctgaagtgcgaagttaacgctgaggacaaagaaaattccggggattatatctctgagaatgaagatccagagctgcaggactacaggtatgaagtgcaagacttccaggagaatatgcataccttgctgaataaggtaaccgaagaatacaataaactgctggtcctccaaacccgcctctcaaagatctggggacagcagacagatgggatgaaactggaattcggggaggaaaatctgcccaaggaagaaacagaattcctaagtatacattcacagatgactaatctcgaggatattgatgttaatcataagagtaagctatccagtttgcaggatctcgagaagaccaaactggaggagcaagtacaggaattggagtccctgatctccagtctccaacagcagctgaaggagaccgagcagaattacgaagcagaaatccattgtttgcagaagcgtcttcaggccgtcagcgagagtactgtcccgcctagtcttccagtggatagcgttgtaatcacagaaagtgatgcacagaggacaatgtaccccgggtcatgtgtcaagaagaatatcgatggaacaatcgaattctccggcgagtttggggttaaggaggagaccaacatcgtgaaactcctggagaagcagtaccaggaacagctggaagaggaagttgctaaggtgatcgtgtccatgtctattgcattcgcccagcagacagaactctctcggatctcgggcgggaaggaaaatacggcaagcagcaagcaggcccacgctgtgtgtcaacaagagcagcattacttcaacgaaatgaaactttctcaggatcaaatagggttccaaaccttcgagaccgtggatgtgaagttcaaagaggagttcaaacccctgtcaaaagaactgggcgagcacggcaaagaaattttgttgtccaactctgatccccacgacattcctgagtcaaaggactgtgttcttactatttctgaagagatgttctcaaaggataaaactttcatcgtcaggcagtctatccatgacgagatctcagtctcaagcatggacgcctcgcgtcaactcatgctcaatgaggagcaactcgaggatatgagacaggaactcgtcaggcaataccaggaacaccagcaggccactgagttattgaggcaagctcacatgcgacagatggagcggcaacgggaggatcaggagcaattgcaggaagaaatcaaacggctaaatcgccagctggcccagagatcctccatcgacaatgaaaacctggttagtgaacgcgaaagagttctcctggaggaacttgaggcactcaaacagctgagtctggctggtcgggaaaagctctgctgtgaactgagaaattcctccacacagactcagaatggcaacgagaatcagggtgaagtggaagagcaaaccttcaaggagaaggagctcgatcggaaacctgaggacgtacctcctgagattttatctaatgagagatacgctctgcagaaggcaaataaccgtctgctcaagatcctactggaagtcgtaaagacaacagctgctgtagaagagaccatcgggaggcacgtgctgggaatcctcgaccgaagtagcaaatcccagtcctccgctagtttgatatggcggtccgaagcagaggcctcggtcaagagctgcgtacacgaggaacatactcgcgtgactgacgagagcatcccatcctatagcggatccgacatgcctaggaacgatatcaatatgtggtctaaggtcaccgaggaggggacggaattgagtcagagactcgtgcgctccgggttcgccgggacagaaatcgatcccgagaatgaggaattaatgttgaacattagcagcaggctccaggccgccgttgaaaagctgctcgaggccatctccgagaccagctctcaactagagcatgccaaagttactcagacagagttgatgagggagagctttcggcagaagcaggaagccacagagagcttgaaatgccaggaagagctgagggagcgcctgcacgaagagagtcgtgctagagagcagctagcagtggagctgagcaaagccgaaggagtgatcgatggatacgcagacgagaaaacgctgttcgaacgacagattcaggaaaagaccgacatcatcgaccggttggagcaggagctgctttgcgccagcaatcgactccaggagctggaggccgagcagcaacagatccaggaagagcgggagctcctttcaaggcagaaagaggctatgaaagctgaggctgggcccgtggaacagcagctcctgcaggagacagagaaactgatgaaggaaaagctcgaagttcaatgccaggccgaaaaagtcagggacgacctgcagaagcaggtgaaggccctggagatagatgttgaggaacaggtatccagattcattgaactggagcaagagaagaacactgaattgatggacctaaggcaacagaatcaggctctggagaagcaactggagaaaatgagaaagtttctggatgaacaagccattgatagagaacacgaaagggacgttttccagcaggagattcagaagctcgagcagcagctaaaagtcgtcccacgtttccagccaatttcagagcatcagacccgcgaggtggagcagctggccaaccatctgaaggaaaagaccgacaagtgttctgagctgctcctgagtaaggagcagctccagagagacatacaggagcggaacgaagagattgagaaacttgaattccgagtgcgggagttggaacaggccctgctagtgtctgcagacacattccagaaggtggaagatagaaagcactttggcgccgtcgaagccaaaccggaattatctctggaggtgcagctacaggccgaacgcgacgcgatcgatcggaaggaaaaagaaattaccaaccttgaggagcagctggagcaatttagggaagagctggagaacaagaacgaggaagtgcaacagctccacatgcagctggagatccagaaaaaggagtcaaccacaaggcttcaggagcttgagcaagagaataagctgttcaaggatgatatggaaaagctcggacttgctattaaggaatccgatgcaatgtcaactcaggaccagcatgtgctctttggtaagtttgctcagatcattcaggagaaagaagtggaaatcgaccaattgaatgagcaggtgacaaagctgcagcagcagttgaaaatcacaacagacaacaaggtgattgaagagaagaacgagttgatcagggacctggagacacagattgagtgcctgatgagtgatcaggagtgtgttaaaaggaaccgcgaggaggaaatcgagcagctgaacgaagtgattgaaaaactgcagcaggagctggccaacattgggcagaagacctccatgaacgcgcattctttatctgaagaggcggattctctcaaacatcaattggacgtagtcatcgccgagaagctcgcccttgagcagcaagtcgaaacggcaaatgaggagatgacattcatgaaaaacgtgttaaaggaaactaactttaaaatgaatcaactcacccaggagcttttctctttgaagagggagcgcgagtccgtagagaagatccagagcatccctgagaattccgtgaacgtggcgattgaccatctctccaaagataagcccgagttggaggtcgtgttaactgaggacgctttgaagagcctggagaaccagacatacttcaagagttttgaggaaaacgggaagggctccatcataaacctggagactcgcctgcttcaactggagtctaccgtgagcgcgaaggatctggaactcacccagtgttataagcagatcaaggacatgcaagaacagggccagttcgagacagaaatgctccagaaaaaaatcgttaatctacagaaaatcgttgaagaaaaagtggccgctgcgctggtcagccagatacagctcgaggctgtccaggaatatgctaaattctgtcaggacaaccaaaccatctctagtgagccagaacggaccaacattcaaaacctcaaccagcttagggaagatgagctgggtagtgatattagcgcacttacactgcgtatatccgagctagagagtcaggtggtcgagatgcatacgagcctcatactagagaaagagcaagttgagattgctgagaaaaacgtcctcgagaaggagaagaagttgcttgaactgcaaaaactgttagaaggcaacgagaagaaacagcgggagaaggagaagaagcggagcccccaagacgtggaggtcctgaaaactaccacagaattgtttcactccaacgaagaatccggcttttttaacgagcttgaagccctgcgagccgaatctgttgcgaccaaggccgaactggcgagttacaaagagaaagctgagaagctgcaggaggaactcttggtcaaagaaaccaacatgacaagcctgcaaaaggatctatcccaggtgcgggaccacttagctgaagccaaagaaaagctcagtatactggagaaggaggacgaaacagaggtacaggaatccaagaaggcatgcatgttcgagccgctcccaatcaagcttagcaaaagtatagctagtcagaccgacggcaccctgaaaatttctagcagcaaccagaccccccagattctggtgaagaatgcaggcatacagattaatttacagtctgaatgcagcagcgaggaagttactgagattattagtcagtttaccgaaaaaatagagaaaatgcaagaactccacgccgcggagattctggatatggagtcaagacacatttccgaaaccgagacacttaagcgcgagcactacgtggccgtccaacttctgaaggaagaatgcggcaccttgaaagccgtcatccagtgccttagaagcaaagaggttttcgggttctacaatatgtgcttttccactctgtgtgactcggggagcgactggggacaagggatttacctgacgcattctcagggatttgacattgcttccgagggtagaggagaggagtccgaaagcgccacagacagttttccgaaaaagatcaaaggcctcctgcgggcagtgcataacgagggaatgcaagtgctgagccttaccgaaagcccgtattccgatggagaggatcactctatccagcaagtgtccgagccatggttggaggagcgtaaagcatacataaacacaatcagctccctgaaggatctcatcaccaagatgcaactgcagcgggaagctgaggtgtacgactcttcacaatcccatgaaagtttttctgattggcgaggagaattgcttttagcgctccagcaagtgtttttggaggaacggagtgtgctgctggccgcgttccggaccgaattaacggctttgggcacgacagacgccgttggacttctgaattgtctggaacaaagaatccaagaacaaggtgtggaataccaagccgccatggagtgcctgcagaaggccgatcgccggtcacttctcagtgaaatacaggccttgcacgcccagatgaacgggcggaagattaccttaaagcgagagcaggagtctgagaagccgagccaggagctgttagaatacaatattcagcagaagcagtctcagatgttagagatgcaggtggaactgtcatctatgaaggatcgggctaccgagctgcaagaacagctttccagtgagaaaatggttgtggcagagctgaagagcgagctggcccagacaaagctggagctcgagaccacacttaaagctcagcataagcatcttaaagaattggaggccttccgcctggaggtaaaagacaagaccgatgaggttcatctcctcaacgatacgctggcgtctgagcagaagaagtctcgggagttgcaatgggccttggaaaaagaaaaagcgaagctgggaaggtctgaggagcgggataaagaggaattggaggatcttaagttttccctcgaatctcaaaagcagaggaacctgcagctgaacctgctgctggagcaacagaaacagctcctgaatgagtcacaacagaagatcgagtcacagcggatgctctacgacgcccaactgtcggaggaacaggggaggaacctagagctacaggtcttactcgagagcgaaaaggtccgcatccgcgagatgagttcaactctagatcgcgagcgagagcttcacgctcagcttcagagtagcgatgggaccggccagtcccgacccccgctgccctccgaagacctcttgaaggagctccaaaaacagctggaggagaaacacagccggatcgtggagctgctcaatgagactgaaaagtataagctggactccctccaaacacggcagcagatggagaaggatagacaggtgcacagaaagaccctgcagactgagcaggaggcaaatacagagggacagaagaagatgcatgagctgcagagtaaggtcgaggacttacagagacaactcgaggagaagcgccagcaggtatacaagctagatctcgaggggcagcggctacaaggtatcatgcaggagtttcaaaagcaggagctggaacgcgaggagaaacgggaatcgagaagaattctttaccagaatcttaacgagcccaccacctggtctctgaccagcgatagaaccaggaactgggtcctgcaacagaaaatagaaggagaaaccaaggagagcaactatgcaaaacttattgaaatgaacggaggggggacgggatgtaatcacgaacttgagatgatccgccaaaagctccagtgcgttgcatctaaactgcaggtgctgcctcaaaaagcatctgaacgtctgcagtttgagaccgcagacgacgaggatttcatctgggtgcaggaaaacatcgacgagatcatactccaactccagaaactcacaggtcagcagggagaggaaccatcccttgtgtcgccttccacttcttgtgggagtctcaccgaacggctgctgaggcagaatgctgagttgactgggcacatctcacagctgaccgaggagaagaatgaccttagaaacatggtcatgaagctcgaagagcaaatccgatggtatcgccagacaggcgccggccgggacaattcgtctcgtttctccctgaatggaggagccaacatagaggccatcatcgcgtccgagaaagaggtgtggaaccgtgaaaagttgacccttcagaagtctctaaagagagctgaggccgaagtttacaaactgaaagctgagctcagaaatgactcacttttgcagacattgtctcccgacagtgagcacgtgactctgaaacgtatttatgggaaatacctgagggctgaatcattccggaaggctctcatctatcagaagaaatacctgctactgttgctcggtggatttcaggagtgcgaagatgcgactctcgcattgcttgcacggatggggggacagcccgcctttactgacttggaagttatcacgaaccggcccaagggttttacaagatttaggtcagccgtacgcgtgtctattgcgatctcacgtatgaagtttctcgtgaggcgctggcaccgggtcaccggtagcgtttccattaacatcaacagggatgggttcggcctgaaccaaggggcagaaaaaaccgattcattctatcactcaagcggggggctcgagctttacggagaacctaggcacactacctatcgttcacgttccgacctggattacattagatctccattaccttttcagaatcggtatccagggacacctgctgactttaaccctgggtcgctcgcatgctctcaactccaaaattacgaccctgatcgggcactgactgactacattacaagactggaagctctccagaggagattgggaacaattcaatccggctccaccacgcagttccatgctgggatgcgtcggtag

SEQ ID NO: 106662 - DNA, 4932 bp, Artificial Sequence
  Description of Artificial Sequence: Synthetic coding sequence
atggaggatgaggagaggcagaagaagcttgaagccggcaaggctaagatagaggagcttagcctggccttcctcgtacgccagctcgcacaattccgtcagcgcaaggctcagtcagacggccagtctccttccaagaaacaaaaaaaaaaacgcaagacatcgagtagcaaacatgatgtctccgcgcatcacgatctcaacatcgaccagtctcagtgcaacgaaatgtacatcaattcttctcagcgagtcgaatctaccgtaataccagagtccacgataatgcgcactcttcatagcggcgagatcacatcacatgaacagggctttagtgtggagctggagtctgaaatctccacaacagccgatgattgctctagtgaggtgaacggatgtagtttcgtgatgcgaaccggcaagccaaccaacctgctgagggaggaagagttcggagtggatgatagttatagtgagcaaggcgcccaggattcaccgacccacctggagatgatggagagtgaactggcaggcaaacagcatgagatagaggagctgaaccgcgaactggaagagatgcgagtgacatacggcaccgagggtttgcaacaactgcaagagttcgaggctgccattaagcagagggatgggattatcacacagctgactgccaatctgcagcaggcccggagagaaaaggatgagactatgcgcgaattcctggagctgaccgagcagagtcagaagctgcagatccagtttcagcaactccaagcctccgaaacactgaggaactctacacacagctcgacagccgccgaccttctgcaagcgaagcagcagatcctgactcaccagcagcaactcgaagagcaagatcaccttctggaagattatcagaagaaaaaggaggacttcactatgcagatctcatttctgcaggagaaaatcaaggtatacgagatggaacaagacaaaaaggtagaaaactccaacaaggaggagatccaagagaaggagacaatcatcgaggagcttaatacaaaaattattgaagaagaaaaaaagacactcgaactgaaagataaacttacaactgcagacaaacttcttggcgagttacaggagcagatcgtgcaaaaaaatcaggagataaaaaacatgaagcttgagctgactaatagcaaacagaaggagcggcaatcatctgaggagataaagcagcttatgggtactgtggaggagctgcagaagagaaaccacaaagactcccagtttgaaaccgatatcgttcagcgaatggagcaggagacccagcgcaagctagaacagctgagggcggaactggacgagatgtatgggcagcagattgtgcagatgaaacaagagctcattcggcagcacatggctcagatggaggagatgaaaacgaggcataagggagagatggagaacgccctcagatcttacagcaacattacagtcaatgaggaccagatcaagctcatgaatgtggccatcaacgagctgaatatcaaactgcaggataccaatagccagaaagaaaaactgaaggaggaactcggcctaattctagaagagaagtgcgccctacagagacaattggaagatctggttgaggaattgtcattttcccgggagcagatccagcgcgctaggcagactatcgccgagcaggaatcaaagctcaacgaggctcataaaagcctgagcaccgtggaggatcttaaagccgaaattgtttccgccagcgagtccagaaaagagttggagcttaaacatgaagccgaagtaacaaactacaaaatcaagctcgagatgctggagaaagagaagaatgccgtgctggacaggatggccgagtctcaggaggcagagctcgagagactaaggacccagttgctcttctcacatgaggaggagctttccaagttgaaagaggacttagaaatagaacaccgcatcaatatcgaaaagctgaaagacaatctggggatacattataaacaacagattgacggcttacagaacgaaatgtctcaaaagattgagactatgcagtttgaaaaggacaaccttattaccaagcagaaccaattaatcctggagatctctaagctgaaagatttacagcagtctctggtaaactcaaagtccgaggagatgactttgcagatcaatgaactgcagaaggagatagaaattctgaggcaagaggagaaggagaaaggaacgttagagcaagaagtgcaggagctccagcttaaaaccgaactgttggaaaaacagatgaaagaaaaggagaatgacctacaagaaaagttcgcccaattggaggccgaaaatagcatactaaaggacgagaagaaaacactcgaggatatgctcaagattcacacacctgtctcgcaggaagagaggttgatcttcctggacagcatcaagagcaaatctaaggactctgtgtgggagaaggagatagagatcctgatcgaagaaaacgaagatctcaaacaacagtgtatccagctcaatgaggaaatcgaaaagcaacgcaacaccttcagctttgccgagaaaaacttcgaagtcaattaccaggagctgcaggaagaatatgcctgcctcctcaaagttaaggatgatcttgaagatagtaagaacaaacaggagctcgagtataagtcaaagctgaaagccctgaacgaggagctgcatctgcagaggatcaatcctactacagtgaagatgaaaagcagcgtcttcgacgaggataagacgtttgttgccgagaccctagaaatgggagaggtggtggaaaaagacacaaccgaactcatggagaaactcgaggtgaccaagagagagaagctggaactgtctcagcgcctgagtgacttgtccgagcagcttaagcagaaacatggggagatctcctttctcaatgaggaggtgaaaagccttaaacaagaaaaggaacaggtctcactaagatgcagagaactggagattatcatcaaccacaaccgcgcggagaacgtgcagagctgtgacacacaggtgagttcccttctggatggggtcgtgacgatgaccagccgcggtgcggaagggagtgtgtccaaggtgaacaagtcatttggggaagaatcaaaaatcatggtggaggacaaggtaagctttgaaaatatgactgtgggggaagagtcaaaacaggaacaactgatcctggatcatctcccctctgtgacaaaggagagtagccttagggctacccaacctagcgagaatgataagttgcagaaggaactgaacgtactcaaatctgaacaaaacgacctgcgtctgcagatggaggcccagagaatctgcctcagtctcgtgtatagtacccacgtggaccaagttagagaatacatggagaacgaaaaggataaggccctgtgctctctgaaggaagagctcattttcgcccaagaagagaagattaaggagctgcagaagattcatcagcttgagctgcaaacgatgaagacgcaggaaaccggcgacgaaggaaagcctcttcatctcctgattggcaagttgcagaaagccgtcagtgaggagtgttcctactttctgcagaccctgtgctcagtgctaggcgagtattacaccccagccctaaagtgcgaagtgaatgctgaggacaaggagaactcgggtgactacatttccgagaacgaggaccccgaactccaggactatcggtacgaggtccaggacttccaggagaatatgcacacccttcttaataaagtgacggaggagtacaacaagcttctggtgttgcagacccgcctcagtaagatctggggacagcaaacggacggaatgaagcttgaattcggagaggagaacctccctaaagaggagaccgaatttctctccattcatagccagatgacaaaccttgaggatattgatgtgaaccataagtctaaattgagctctctgcaggatcttgagaagacgaaactcgaggaacaggtacaggaactggaatcccttatctcatcactccaacagcaactgaaagagacagagcagaactacgaagcagaaatacattgtttgcagaagcggctgcaggccgtctccgagtccactgtgccgcctagccttccagttgactcagttgtgatcaccgaatctgacgctcaaaggacgatgtatcctggttcttgcgtaaaaaagaatattgacggtacaatcgagttctctggagaattcggtgtcaaagaggagactaatatagtcaagttactggaaaaacagtatcaggaacaacttgaggaagaggtggctaaggttattgttagtatgtcaattgccttcgctcaacagactgagttgagtaggatcagcgggggtaaagaaaatacagctagctcgaagcaagcacacgccgtgtgtcagcaggaacagcattattttaatgaaatgaaactgagccaggatcagattggcttccaaacctttgagacggtcgatgtgaaatttaaggaggagttcaagcctctgagtaaggagcttggtgagcatggaaaggagattctcttgtcaaattccgatccacatgatatcccggagagtaaagattgtgtgctgaccatcagcgaggaaatgttcagcaaggacaagacatttattgtccgtcagagtatacatgatgaaatttcagtttcttccatggatgcgtcgaggcagttaatgctgaacgaagaacagctggaggacatgcgtcaagaactcgtgagacagtatcaggagcatcaacaggccaccgaactgctcaggcaagcacacatgcgtcagatggaacggcagcgggaggaccaggagcagcttcaagtgagagtgctgtag

SEQ ID NO: 106663 - DNA, 11631 bp, Artificial Sequence
  Description of Artificial Sequence: Synthetic coding sequence
atggaggatgaagagcgccaaaaaaaactcgaagcaggcaaggctaaaattgaagaactgtccctagcctttctcgtgcggcagttagcccagttcagacagaggaaggctcagtctgacggccagtcacccagcaagaaacagaagaagaaaaggaagactagttcttcaaaacatgacgtgagtgcgcaccatgatttgaatattgatcagtcccaatgtaacgaaatgtacattaattcgtcacaacgcgtggagagtacggtgatcccggaatccactattatgcgtactcttcattcaggcgagataacgtcccatgagcagggatttagtgtggaactcgaatcggagatctcaactaccgcggatgattgtagctctgaggtgaacgggtgctcgtttgtgatgagaacgggcaaacccacaaacttacttcgagaggaagaatttggcgtggacgactcatatagtgaacagggagcacaggattccccaacgcatctggaaatgatggagagtgagctggccgggaaacagcacgaaatcgaggagctgaaccgggaactcgaggagatgcgggtcacttacggcaccgaaggccttcagcagctgcaggaatttgaagctgccatcaagcagagagacgggattatcacccagctgaccgcaaatctgcagcaggcgcggagagaaaaagacgagaccatgcgagagtttctggaattaactgaacagagccaaaagctgcagatccagttccaacaactgcaggcctctgagactctgcgtaacagcacccatagcagtaccgcagccgacctgttgcaggctaaacagcaaattctcacgcaccaacagcaactggaagagcaggaccatctgctggaggactaccagaaaaaaaaggaggattttaccatgcaaatctctttccttcaagaaaaaatcaaagtgtacgagatggaacaggataaaaaagtggaaaatagcaacaaggaggagatccaggagaaagaaacaatcattgaggagctgaatactaaaattatagaagaagagaagaagaccctggagctcaaagataaactaactaccgctgacaaactactgggggaattgcaggagcagatcgtgcagaagaatcaggaaatcaagaacatgaaattggagctgacaaactccaaacaaaaggagcgtcaatccagtgaagagatcaagcagcttatgggcactgtcgaggagctgcagaagagaaatcataaggactcccagttcgagacagacattgtgcagagaatggagcaggaaacccaacgtaaactggaacagcttcgagccgagcttgacgagatgtacgggcagcagatcgtacagatgaaacaggagctgatcaggcagcatatggcccagatggaagaaatgaagactagacataagggcgagatggagaatgccctgcgcagctacagcaacataacggtgaatgaagatcagatcaagctgatgaatgtggccataaacgagctcaatatcaagcttcaggatacaaattcgcagaaggaaaagctcaaggaggagctggggttaatcctagaagagaagtgcgccctgcagagacagctcgaagatctggtggaagaactttccttctcacgcgagcagatccaacgggcccgtcaaacaatagccgagcaggaatccaagttaaacgaggcccataagtccctatctaccgtcgaggacctaaaagccgaaattgtttccgcaagcgaatctcgcaaggaactggaattgaaacacgaagctgaagtgacaaattataaaataaagcttgagatgctggaaaaggagaaaaatgccgtgctggacaggatggccgagtctcaggaagccgaactcgagcgcttgcgcacccagctgctcttctcacacgaagaggaactgtctaagctaaaggaggatctggaaatcgaacaccgcataaacatcgagaagctgaaagacaatctgggcatccattacaaacagcagattgatggcttgcagaatgaaatgagccagaagattgagacaatgcagttcgagaaggacaacctgatcaccaaacagaaccaattgatcctggagatcagcaaacttaaggacttgcagcagtccctggtcaactcgaagtcagaggagatgacgctccagattaacgagttgcaaaaggaaatagagatacttcggcaggaggagaaggaaaaagggaccctggaacaggaggtgcaggaactgcagcttaagaccgaactccttgagaaacagatgaaggagaaggaaaacgatcttcaggagaaattcgctcagctggaagccgagaactcaattctgaaggatgagaagaaaactctggaggacatgctgaagatccacactcctgtttcccaggaggaaaggctgattttccttgattccattaagagcaaatcgaaggacagcgtttgggagaaagagattgaaattctgattgaagaaaacgaagacttaaaacaacagtgtattcagcttaatgaagaaattgaaaaacagcgaaacacattctcttttgccgagaagaactttgaggtcaactatcaggagctacaggaagagtatgcgtgtctgctgaaggttaaggacgatctggaagatagtaagaacaagcaagagctggagtataagtccaaactgaaagccctaaatgaagagctgcacctgcagcggattaacccaacaacagtcaaaatgaagagcagcgtctttgatgaagacaaaactttcgtcgctgagaccctcgaaatgggcgaagtggtggaaaaagacaccaccgagctgatggagaagctagaggtgacaaaacgggaaaagcttgagctgtcacagcggctgtctgacctgtcagagcagctcaaacaaaaacacggagaaatcagctttctgaatgaagaggtgaagtctctgaagcaggaaaaggaacaggtgagtctgcgttgccgcgagctggaaattatcataaaccataacagggcggagaacgttcaatcctgcgacacccaggtgtcttctcttcttgatggcgtagtgacgatgactagtcggggggctgaagggtccgtgtccaaggtcaacaagagcttcggcgaagaaagcaagatcatggtagaagataaggtttccttcgagaatatgactgtgggagaggagtctaagcaggaacaattgatcttggaccacttacctagcgtgacgaaggagagctccctcagggccacgcagccaagcgagaacgacaaactgcagaaggaattgaacgtcctgaaatcggaacagaacgacctgagactgcagatggaggctcaaagaatttgcctttccctcgtttactccacccatgttgaccaagtgcgcgagtacatggagaatgaaaaagataaggctctatgttcactgaaggaagagttaatcttcgcccaggaggagaaaattaaggaactacagaagatccatcagctggagttgcaaactatgaaaacacaggagacaggagacgaaggcaagcctctccaccttctcatagggaagctccagaaggcggtgagcgaggagtgcagctatttcctccagaccttgtgctctgtcctcggagagtattatacaccagccctcaagtgcgaagtaaatgcagaagataaagaaaactccggagactacatttccgagaacgaagaccccgaattgcaggactacagatatgaggttcaggactttcaggagaacatgcacacacttctgaacaaagtcaccgaagagtacaacaagctactcgtactgcagactagacttagtaagatctggggacagcagactgacggcatgaagctcgaatttggggaggagaacctgcctaaggaagaaaccgaattcctcagtatccatagccagatgaccaatcttgaagacatcgatgtgaaccataaatccaagctatcgagtttgcaggatctggagaagacgaagttggaagaacaggtacaggaattggagagcttgatcagctccctgcagcagcaattaaaagaaactgagcagaattacgaagctgagatccactgcctccagaaaagattacaagccgtgtcggaaagtaccgtacccccatcccttcctgtagactcagttgtgatcaccgagtctgacgcccaaaggacgatgtaccccggctcttgcgttaaaaaaaatatagacggcactattgagtttagcggcgaatttggggtaaaagaggagacaaatatcgttaagctcttggaaaaacaatatcaggagcagctggaagaggaagtagctaaagtgattgtcagcatgtctattgctttcgcgcagcagaccgagctgagtaggatttctggagggaaggagaatactgctagctccaagcaggcccatgctgtgtgccagcaagaacagcactacttcaacgagatgaaactgagtcaggaccaaatcggcttccaaacgtttgaaactgtagatgtcaaattcaaagaggaattcaagccgctgtctaaagagcttggagaacacggaaaggagatacttctcagcaactctgaccctcatgacatccctgagtcaaaggactgcgtattgactatctccgaggagatgttctctaaggacaagactttcatagtgcgacagagcatccacgacgagatttccgtgagctccatggacgctagtcggcagttaatgctcaacgaagagcaactcgaggatatgcggcaagagctggttaggcagtaccaggaacatcagcaagctaccgaacttttgcgccaggcccacatgcgacagatggaacgccagcgggaggaccaagagcagctgcaagaagagataaaaagactgaaccggcagctggcccagcgctcaagcattgacaatgagaatctggttagcgaacgtgaacgggtccttcttgaagagctagaggctctcaaacagctttccctggctggcagagaaaaactttgttgtgagcttagaaactcttcaacgcagactcagaatggcaacgaaaaccagggcgaagtggaggaacagacctttaaagaaaaggaactcgatcgaaagcctgaagacgtgccaccggaaatcttgagcaacgaaaggtacgcccttcaaaaggccaacaatcggttgctgaagatcttgcttgaggtcgtgaagaccacagccgccgttgaggaaactatcgggaggcatgttctcgggatattagatcgcagtagcaagagccaatcctctgcctcgcttatctggaggagcgaagctgaggcttccgtgaagagctgcgtgcatgaggagcacacgcgcgtgaccgacgaatcgattccttcctactccggctccgacatgcctcggaacgatattaatatgtggtcaaaagttactgaagaagggacagaattgagccagaggctcgtgcgctccgggttcgcaggcactgagattgaccctgaaaatgaggagctgatgctcaacatctctagccggctgcaggcagcagtagaaaaactcctggaggccatctccgaaacatcttctcaactggagcacgcgaaggtgactcagacagagctgatgcgagagagcttcaggcagaagcaggaggccacagaatcccttaagtgccaggaggaactgagggagaggctccacgaggagtccagggcacgggaacagctcgccgtagaactgagcaaggcagaaggcgtgatagatgggtacgctgatgagaagacactgtttgagcggcagatccaagagaaaaccgatattattgaccgactcgaacaagagctgctctgcgcttcgaacagacttcaggagttggaagctgaacaacaacagatccaggaggagcgcgagcttctgtctcgccagaaagaggcaatgaaagccgaagcaggtcctgtcgaacagcagctgttacaggaaactgaaaagctgatgaaggaaaagctggaggttcagtgtcaagcagaaaaagtgcgagacgatcttcagaagcaggttaaggctcttgaaattgatgttgaggaacaggtctcaaggttcatcgaattggagcaggagaagaacaccgaacttatggacctgagacagcaaaatcaggcactggaaaaacaactcgagaagatgcggaagttcctggatgagcaagccatcgatagggagcacgagcgcgatgtctttcagcaggaaatccagaagctcgaacagcagctgaaggtggtcccaagatttcagcctatcagtgaacatcagacaagggaggtcgagcagctcgcgaatcatctgaaggagaaaactgataaatgttccgagctgctgctgtccaaggagcagctacagcgcgacatccaggagcgcaacgaagagattgaaaaactggaatttcgggtccgcgaactcgagcaagcgctgctagtggaagatcgcaagcatttcggagctgttgaagcaaaaccagagcttagcctggaggttcagctacaggcggaacgtgatgctattgaccgtaaggagaaagagatcacaaacttagaggaacagctggaacagttcagggaggaattagagaataaaaacgaagaagtccagcagctccacatgcagctcgaaatacagaagaaagaatcaactactcgcctgcaagaactcgagcaggaaaataaacttttcaaggacgacatggaaaaattaggactggcaattaaagagagtgatgctatgagcactcaggatcagcacgtgttgtttggtaagtttgctcagattatccaagaaaaggaggtagagatagaccagctgaacgagcaagtgaccaaattacagcagcagctgaagataacaactgacaacaaggtgattgaagaaaagaacgaactgatccgggacctcgagactcagattgagtgccttatgtctgaccaagaatgtgttaaaagaaaccgagaagaggaaatcgaacagcttaatgaggtaatcgagaaactgcagcaggagttggctaacatcgggcaaaagacctccatgaacgcgcattctttgtccgaggaggcggatagccttaaacatcagctggatgttgtgatcgcagaaaagttagccctcgaacagcaggtagaaaccgctaacgaagaaatgacattcatgaaaaatgttttaaaagagacaaattttaaaatgaaccaacttacccaggaactgttctctctgaagagagaacgggaatctgtcgagaaaatccagtctattccagagaattccgtgaatgtggccatcgaccatctatccaaggataagcctgaattggaggtggtgctcacagaggacgcactgaagtcactggaaaatcagacatatttcaagtcttttgaggagaacggcaagggatctattataaacttagaaacacgtcttttgcaactggagtccacggtgtccgccaaggatctcgaattgacccagtgctataagcagattaaggacatgcaggaacagggccagttcgagacggagatgttgcaaaaaaagatagtgaatctgcaaaaaatagtggaggagaaggtggccgctgcgctcgtgtcacagatccagctggaggccgtccaggagtacgcaaaattttgtcaggacaatcaaacaatcagttcagagccagaaagaaccaacatccagaatttaaaccagctccgcgaggatgagctagggtctgatatttcagctcttacattacgcatctcggagctagagtcccaggtggtggagatgcatactagtctgatcttagagaaggagcaggtggaaatcgcagaaaaaaatgtgctcgaaaaagaaaaaaagctgcttgaactccaaaagcttctggaaggcaacgagaaaaaacagagagagaaagagaaaaagaggtctccgcaggacgtcgaggttctgaagacaacaacggagttgtttcactcaaatgaggaaagcggatttttcaatgagttggaggccctgcgggctgagtccgtggctactaaggccgagctcgcttcatataaagagaaggctgaaaagctccaggaggaactcctggttaaggagacaaacatgacaagcctccagaaagatctatctcaagtgagagatcacctcgcagaggcaaaagaaaaactgtcaattcttgagaaagaggatgaaacggaagtgcaagagtctaaaaaggcttgcatgtttgagccgctcccaattaaactaagtaaatccattgcttcccaaaccgatggcacactgaaaatctcatcatctaaccagacaccacagatcttggtaaaaaatgctggcattcaaatcaacttacaaagcgagtgtagcagcgaggaggtgaccgaaataatcagccaattcacagagaagatcgagaagatgcaggagctccacgcagccgagattctagacatggagtctcgccatatctcagaaacagagaccctaaagcgggagcattacgtcgctgttcagttgcttaaagaggagtgtggtaccttaaaagcagtaatccagtgtttacggagcaaggagggaagttctatcccagagctggcccatagtgatgcctatcagaccagggagatctgttcttccgactctggctcagactggggccagggcatctacctcacccactcacagggtttcgatattgctagcgaaggtcgtggtgaggagagcgaaagtgctaccgatagctttcccaaaaagattaaggggctgttaagagccgttcataatgaaggtatgcaggttttgtcgctgacggagagcccttattctgacggagaagaccatagtatacagcaggtgtctgagccgtggctggaggaacgcaaggcctatattaatactatctcttccttgaaagacctgataaccaaaatgcaactgcagagggaagctgaggtctacgattccagccagtcccatgaaagtttttccgactggcgtggtgagctcctgctggcattacagcaggtcttcctggaggagaggagtgttctcctggctgcattcagaaccgagttgaccgccctgggcactacagatgctgtcggccttcttaattgtctcgagcagcgtatccaggagcagggtgtggaataccaggccgcaatggagtgcctgcagaaggccgacagaagaagcttgctctctgagatccaagccttacacgctcagatgaacggacgaaagattaccctgaaaagagaacaagaatcagagaagccttcccaggagctgctcgaatataacatccagcagaagcagtcccaaatgctcgaaatgcaggttgaactcagctccatgaaagaccgggcaacggaacttcaggaacagttgagctcagaaaaaatggtggtggccgaattgaagtccgaattagcccagactaaactcgagttagaaactacccttaaggcacaacataagcacctaaaagaactagaggccttccgccttgaggtgaaagataagactgatgaagttcatctcctgaatgatacactggccagcgaacaaaaaaaaagtagagagctgcaatgggctctggaaaaagagaaggcgaaattgggcagaagtgaggaacgggacaaagaagagctggaggacctgaaatttagcctcgaaagtcagaagcagaggaacttacagcttaatctgttactggaacagcaaaagcaactgctgaacgaaagccagcagaaaattgagagccaacggatgctttacgacgcccagctgagcgaggagcaaggccgcaatctggaactccaagtgctgttggagtcagagaaagtacgcattagagagatgagttccacattggaccgcgaacgggagctgcatgctcagctccagagtagtgacggcacaggccaaagcaggcccccactgcccagtgaagatttgctaaaagaactacagaagcaactggaagagaagcattcacggatcgtggaactcctaaacgagaccgagaagtacaagctggactcacttcagactcgccagcagatggaaaaagatagacaggtgcatcggaagacattgcaaacagaacaggaggcaaataccgaaggccagaaaaagatgcatgaactacagagcaaagtagaagacttgcagaggcaattggaggaaaagcggcaacaagtctataaactggatctggaggggcaaagactgcagggaataatgcaggagtttcagaagcaagaactagaaagggaggaaaagcgggaatctcggaggattctgtaccaaaacctgaacgaaccaaccacgtggagtctcacatctgaccgcaccaggaattgggtacttcagcagaaaatagaaggggaaacgaaagagtcaaactatgccaagctcatcgagatgaatggaggaggcacaggatgtaaccatgagttagagatgattcggcagaagcttcagtgtgtagcctcaaagctgcaggtcctgccacagaaggcaagtgagcggctacaatttgaaactgcggacgacgaggatttcatttgggtccaggaaaatatagacgaaatcattctgcagctgcagaaactcaccgggcaacagggggaagagccatctctggtgtctccctctaccagctgtgggtctctgactgagaggctgttgcggcagaatgccgaattgacgggacatatttctcagctgacagaggagaagaacgacctgagaaacatggttatgaaactggaggaacagatcaggtggtaccggcagacaggggccgggcgggataacagcagccggtttagcctcaacggaggagcaaatatcgaagctatcatcgcaagcgagaaggaggtgtggaacagggagaaactgacactgcaaaagtctctgaagcgagccgaggccgaggtctataagttgaaggccgaactgcggaacgattctctgctccagacacttagccccgatagcgagcacgttaccctgaaacgcatttacggcaaatatctgcgcgctgagtcatttaggaaagctctgatataccaaaagaagtaccttcttctgttgctggggggcttccaggagtgtgaggatgctaccttggccctgttggcacggatgggaggacagcccgctttcaccgatctggaggttataacaaacagaccaaaagggtttactcggtttaggtctgccgttagagtgagcatagctataagtcggatgaagtttttagtccgacgttggcatagagtgacaggttcggtctcaattaacataaatagagatgggttcggtctgaatcaaggtgctgagaaaacagactcgttctaccactctagtggcgggctcgagctttatggcgaacctcgacacactacctatcgctcaaggagtgacttagactatataaggtcccctcttccattccagaatcggtatccaggcactcctgcagacttcaaccccggaagcctcgcgtgctcccagctgcaaaactatgatccctag

SEQ ID NO: 106664 - DNA, 1782 bp, Artificial Sequence
  Description of Artificial Sequence: Synthetic coding sequence
atggctatccaatttcggtcgcttttccctctggctctgcccggaatgctggcactgctggggtggtggtggtttttcagtcgaaagaaagggcatgttagctctcatgacgagcaacaggttgaggccggggctgtgcagttgagagccgatcctgcgattaaagaacctcttcccgtcgaggacgtctgtccaaaagtagtgtctacaccaccaagtgtgaccgagcccccagaaaaagaactctctacggttagtaagcttcccgcggagccaccggctctgctccagacccatcccccttgtcgcagatctgaatcctcaggaatcctgcctaacacaacagacatgcgcttacggccaggaacaagaagagacgactccactaagttggagctggctctcacgggaggcgaggctaaatcaatccctctcgaatgccctcttagttcccctaagggagttttgttttcgagtaaaagtgcagaggtatgcaaacaggatagcccatttagccgggttcctaggaaggtgcagccaggctacccagtggtgccagcagaaaagcgatcttcgggcgagagggcacgagaaaccgggggggctgaaggtacaggggatgcggtgctgggcgagaaagtgctggaggaagcccttctgtcacgcgagcacgtgctggagcttgagaatagtaagggtccatcattagcatctctggaaggcgaggaggacaaaggcaaatcaagttccagccaagtcgttggacctgtgcaggaggaagaatacgtggccgagaagttacccagccggtttatcgagtcagcccatactgagctggccaaggacgatgctgccccagccccgccggttgccgacgcaaaggcccaggatcgcggcgttgagggagagctgggcaatgaagagtcactggataggaatgaggaaggcctcgatagaaacgaagaaggcttggatcggaatgaggagagcctggatagaaacgaggagggactggatagaaacgaagaaatcaagagagccgcatttcagatcatttcccaggtaatcagtgaggcaacagagcaggtcctcgctaccactgtgggcaaggtggcaggtcgcgtttgccaggccagtcagttgcagggacagaaagaagagagctgtgtgccagtccaccagaagaccgtgctgggccccgatacagccgagccagctacggcggaagcagcagtcgcacctcctgatgcagggctgcctctgcctggtttgcccgccgagggttcacctcccccgaagacttacgtgagctgccttaaaagtttgttgtcatctccaaccaaggattctaagccaaacatcagtgctcatcacatctcgctggctagctgtttggcacttaccacaccttccgaggagctgccagaccgtgcgggtatcctggtagaggatgcaacatgtgtgacatgtatgtctgattcctctcagtctgttccgcttgtggcctcacccggacattgtagcgactcattctcaacaagtggactggaggactcttgcacggagaccagttccagtcccagagataaagccatcacgccacctttgcccgagtcaaccgttccctttagcaacggagtactgaaaggtgaactctccgatctcggggctgaagatgggtggaccatggatgctgaggcggatcatagcggcgtggcggcacccccccctggcaaacgggggacactaattacccgctgccctgggttttttgaatgttag

SEQ ID NO: 106665 - DNA, 2712 bp, Artificial Sequence
  Description of Artificial Sequence: Synthetic coding sequence
atggctatacagtttcgttccttatttcctctggccctgcctggtatgctggccctactggggtggtggtggtttttctctcgaaagaagggacacgtaagctcccatgacgagcagcaggtcgaggcaggtgcggtacagttacgggcggatccggcaatcaaagaacctttgcctgtcgaggacgtgtgcccgaaggtcgtgtctacaccaccatccgtcaccgaacctcctgagaaggagctgtcaaccgtgtctaaactccccgctgagcctccagctctgctgcagacccaccctccctgccgtcgaagcgagagttcaggcatactgcccaacacaacagacatgcggctgagacccggaactcggagagatgactcaacaaaattagagttggccctgactggcggcgaagctaagtccatccccctcgaatgccccctatcaagtccgaaaggggttttgtttagcagcaagagtgccgaggtatgcaaacaagactctccattttctagggtgccccgaaaagtgcaacctggttatcctgtggtccccgcagaaaagaggtcctcaggcgagcgcgcacgcgaaactggaggcgctgaaggaacaggagatgccgtgctgggcgagaaagtgctggaggaagccctgcttagtcgggagcacgtacttgaactggagaattcaaaagggccatccctggcttccttggagggtgaggaggacaaggggaaatcgagcagtagtcaggtggtaggccctgtacaggaagaagagtacgttgccgaaaaacttccgtcccgatttatcgagtccgcccatacagagctggccaaggatgacgcagccccggcgccacctgttgccgacgccaaggcccaggacagaggagtagagggggagctggggaatgaggagagccttgacagaaacgaagaggggttagacagaaatgaagaagggctggaccgcaatgaggaaagtctggaccggaacgaagaggggctggatcgaaacgaggagattaaaagggccgctttccagataatatcccaagtgatctctgaggctaccgaacaggtcctggcaaccactgtaggcaaggttgccggcagggtctgtcaggccagccagctgcaaggtcagaaggaggagtcatgcgttcccgttcatcagaaaaccgtgcttgggccagataccgctgaacccgccacagctgaagctgccgtggcaccaccggacgctggcctcccacttcccggtctccccgcagaaggatccccgcccccgaaaacatatgtgtcttgccttaagtctttgctgtccagtcctaccaaggattccaagcccaatatatcagcgcatcacatctctcttgcttcctgtctggctctcacaacacccagtgaggaacttccagacagggccggtatcttggtggaggatgcaacctgcgtaacttgcatgtccgactcatcccagtcagtgccccttgtggcgagtcccggacattgcagcgacagtttttccacctcgggcctggaagactcttgcacggagactagtagttcccctagagataaagcaatcacaccccctctgcctgagtctaccgtccccttttcgaacggcgtgctgaagggagaattatctgatctaggtgcagaggatgggtggacgatggatgccgaggcagatcatagcggggggtctgacaggaattccatggatagtgttgattcatgttgctcactaaaaaagaccgagtcttttcaaaacgcccaggccggatctaaccctaagaaagtggatctcatcatttgggaaattgaagtaccgaagcatttagtgggccgcttgattgggaagcagggcagatacgtcagtttccttaagcagacatccggcgcaaagatttatatatcaacgttgccatacacacagtcggtgcaaatctgtcacattgaggggagtcagcaccatgtcgacaaggccctgaatctgattggaaagaagttcaaagagcttaacctcactaacatctatgcgcctcccttgccatccctggctctgccttcgctgcccatgactagctggctgatgttgccagacggaattacggtcgaggttatcgttgtcaaccaggtgaacgccggacacctcttcgttcaacagcatacccaccccacctttcacgccctgagatcactcgaccagcagatgtacctctgctacagccagcctgggattccaactctacctactccggtagaaatcactgttatctgtgccgctcctggcgcagacggcgcttggtggagggcacaggtggttgcctcttacgaagaaaccaacgaggtagagattcggtacgttgactatggcggttacaagcgcgtgaaggtcgacgttctgcgtcagattagaagcgattttgttaccctgccatttcaaggcgccgaagtactcttagattctgtgatgcctctcagtgacgatgaccagttttctcccgaagccgacgcagccatgagcgagatgacaggtaacaccgccctgttggcacaggtaaccagctacagccctaccggcctgccgttgatccagctgtggagcgtggtcggggatgaggtcgtgctcatcaacaggtctctggtggagcgcgggcttgcccagtgggtggactcttactacacatctttatag

SEQ ID NO: 106666 - DNA, 2838 bp, Artificial Sequence
  Description of Artificial Sequence: Synthetic coding sequence
atgggggctttaggggtcagtggctcctcgagccctggcggatgtccaggttggcggaggttgccggcggcagtaaacaccaacccagtcgattttgcacctggagtaattacacaagccagtaggatggcgatccaatttagaagtctatttccactagccctgcccggcatgttggctcttctgggctggtggtggttcttcagccggaaaaagggccacgtttcatctcacgatgaacagcaggtcgaagctggggcagtacagttacgtgccgaccccgcgataaaggagcctcttccagttgaggatgtatgccctaaggtagtgagcacgcccccgtccgtgaccgaacctccggaaaaggagctctccactgtgagcaagcttcccgcggagccccctgcactcttgcagacacacccaccctgccgcaggagcgaatcttccggaatactgccaaatacgaccgatatgagactccgcccaggcacacgcagggacgacagtaccaagctagagctagccctaacaggcggtgaagccaagtccatacctctcgagtgccccctgtcttcccccaaaggagtcctgttttcctcgaagagtgccgaagtgtgtaagcaggactcgccgttctcgcgggtaccgcgtaaggtgcagcccggttatcctgtggtacctgccgagaagaggagcagcggtgagagagctagagagacaggaggagctgagggtactggtgatgctgtgcttggagaaaaggtcctcgaggaggcactgctgagtcgcgagcacgttcttgaacttgagaacagcaaagggcctagcctggccagcctagaaggcgaggaagacaagggtaaaagttcaagttctcaagtggtgggacctgtccaggaggaggagtacgtggctgagaaacttcctagccgctttatcgagagtgcccataccgagctcgccaaagacgatgcagcccctgcccctcctgtggctgacgccaaagctcaggataggggagtcgaaggagagctcgggaatgaggaatccctggatcggaatgaggagggactcgatagaaatgaggaaggcttagaccggaacgaggaaagcctggacaggaatgaggaaggcttagaccgtaacgaggaaatcaaacgcgcagcgtttcagattatcagccaagtcatttcagaggctacagaacaagtgctcgcgacgacagtaggcaaagtggctggcagagtttgtcaggctagtcaactccagggacagaaggaggaaagctgcgtccctgtgcatcagaaaactgttctcgggcctgacactgcagaacctgccactgcagaagccgccgtggcgccccccgatgcggggctgccacttccagggctgcctgctgagggcagcccccccccaaaaacttatgtttcttgtcttaagagtttgttgtcttcccctaccaaggattctaagcctaatatctctgcacaccacatcagcttggcgagttgtctcgcgctcacaactccttccgaggaattgcccgatcgggcgggcattctcgtggaggatgccacctgcgtgacctgcatgtcagattccagccagtccgtgccccttgtggcatccccaggtcattgttccgacagcttttccacgtccggactggaggactcatgtacggagacttcctcctcgccccgtgacaaagcaatcacaccaccactgccagaatcaacagtgcccttttcaaatggcgtccttaagggtgagctcagcgatctgggtgctgaagacggttggacaatggacgcagaagctgatcacagcgggggcagcgatcggaacagcatggatagtgtggattcttgttgttccctaaaaaaaaccgaatcatttcagaatgcacaggccgggtcaaatcccaaaaaagtcgacctcatcatctgggagatagaagttcctaagcacctagtaggtcgcctcatcggtaaacagggacggtatgtctcattcctgaaacagacaagcggggcgaagatctatatcagcaccctgccatacacacagagtgtccagatctgtcatatcgagggctctcagcaccacgttgataaagcgctcaaccttattggcaaaaagtttaaggaactgaatctcacgaatatctacgcgccccccctcccatcattagcccttccctctctccccatgacaagttggctgatgcttccggacgggattacagtagaggtgatcgtggtaaatcaggtgaacgcaggacaccttttcgtgcagcagcatactcatcctacattccacgccctcaggagcctcgatcaacaaatgtatctgtgctattcccaaccaggcataccaaccctgccaacacccgtcgagataacggtgatctgtgctgccccaggagctgacggagcttggtggagagcccaagtggtcgcctcttatgaggagacgaacgaggtggagatacgatatgtcgactatggcgggtacaagcgcgttaaggtggacgtcctgcggcagatccgcagtgacttcgtcactctcccgttccaaggtgctgaggtgctgctggactctgtgatgcccctgagtgatgatgatcagttcagtcctgaggccgatgccgctatgtcggagatgactggcaataccgctcttctagcacaggttacctcttattcccccacagggctgccgctcatccagctgtggagcgtggttggagacgaggtcgtgctgattaatcgcagtctggtcgagcgcggactggctcagtgggttgacagctactacacttctctctag

SEQ ID NO: 106667 - DNA, 2712 bp, Artificial Sequence
  Description of Artificial Sequence: Synthetic coding sequence
atggccatccagttccgcagcctcttccccctggctctgcctggaatgctggcgctgctaggctggtggtggttcttctccaggaagaaggggcacgttagctctcatgacgagcagcaggttgaggcaggcgcagtccaactccgtgcagaccctgccattaaggagcctctgcctgtggaagacgtgtgtcctaaggttgtaagtacacctccatccgtgacagagccgcccgaaaaagagttgagtaccgtgtcaaaactgcctgctgagcccccagctctgctacagacacatccaccatgccgccggtctgagagctcaggcattctgcctaacactaccgacatgaggctgcgacctggcacacgacgcgatgattcgactaaactcgagttggccctcaccgggggtgaagcgaaaagcatcccactggagtgccccctttcaagtcctaagggtgtcctattttcaagcaaatcagcagaggtttgtaagcaggattcccctttttctcgagtgcctcgaaaggttcaacctggctaccccgtggtacccgctgaaaaacgcagttccggcgagagagcaagagaaaccggtggtgctgaaggaaccggagacgctgtcctgggcgaaaaagtgttggaggaggctctgttaagccgtgaacacgtgctcgagttagagaattccaagggaccgagcctggccagccttgaaggggaagaggacaaaggtaagagtagttccagtcaagtcgttggtccagtgcaggaagaagaatacgtggctgaaaagctgccatcgcgctttatagagagcgcccacacagagctcgcaaaagatgatgctgctccagccccaccggtcgccgatgctaaagcccaggatagaggggttgagggggaactgggcaatgaagagtcactggacaggaatgaggaaggcctggacagaaacgaggagggactggaccgcaatgaagaatcacttgataggaatgaggaggggcttgataggaacgaagagataaagagggcggcatttcagatcataagccaggtgatcagtgaggctactgagcaggttctggctacgaccgttgggaaagttgcgggccgcgtgtgtcaggcctcccagttacagggacagaaggaggagagctgcgtgcctgttcatcagaagactgtcctgggccccgacactgcggagcctgccaccgccgaggcggccgtcgctccgccagatgctggactaccactgcctggtctgcctgccgagggctcgcctcctccaaaaacatatgtcagttgtctgaaatcactgctgtcttcaccgactaaggattccaaacccaacatctctgcccatcacattagcctcgccagttgcttagccctgacaactccatccgaagaactgcccgaccgcgctggcattctggtggaggatgccacttgtgtgacgtgcatgagtgatagttcccagagcgtgccactcgtggcttctcctggacactgttccgactcattcagcactagtggactggaggatagctgcaccgagaccagctcttctcctagagacaaagccatcacacctccactccccgaaagtacggtgcccttctcgaatggcgtcctgaagggtgagttgtccgacctaggcgctgaggacggctggaccatggacgccgaagccgatcatagtgggggatctgaccgaaattctatggattcggtcgattcttgttgctccctcaagaaaactgaatcattccaaaacgcccaggcgggcagcaatccgaaaaaggtggaccttatcatttgggaaatcgaggtgcccaagcatctggtcgggcgccttattggcaagcagggtcggtacgtgtcttttctgaaacagacgtcgggtgccaagatttatatttcaactctgccatatacccagtcggtgcagatatgccacatcgagggatcccaacaccatgtggataaggctttaaatctgatcggaaagaagttcaaggagctaaatctaaccaatatttatgcccctcccctgcctagcctggccctccccagtctacccatgacttcatggctcatgctgcccgatgggattacagttgaggtgattgtcgtgaaccaggtaaacgctggacacttgtttgtccagcaacatacccatcccacgtttcacgccctgaggtcattggaccagcagatgtacctatgctactcacaacctggcatcccaacgcttccgacgccagtggaaattacggttatctgcgccgcccccggagccgacggtgcctggtggagagctcaggtcgttgcatcttacgaagagacaaatgaagtcgaaatcaggtacgtcgattatggcggctataagcgggtgaaggtcgacgtccttagacagatacgaagtgatttcgtaaccctgccattccagggtgctgaggtcctgctggacagcgtcatgccactgtcggatgacgatcagttcagtcccgaggccgatgctgccatgagcgagatgaccgggaacacagccctcttggctcaggtcaccagttattcccccacaggtcttcctttgatacagctctggagcgtcgtgggggacgaggttgttctgattaatcgtagcctggtagagagagggctggctcagtgggtggacagctattataccagcctctag

SEQ ID NO: 106668 - DNA, 1095 bp, Artificial Sequence
  Description of Artificial Sequence: Synthetic coding sequence
atgggaatcctggaaaaaatctctgagatagagaaagagatcgcaaggactcagaaaaataaggctactgagtaccacctggggttgcttaaggccaagctggcaaagtacagagcccagttattggaaccctcaaagtctgcttcgagtaagggagaagggttcgatgttatgaaatccggagacgccagggtggcgctcataggatttccctctgtggggaaatccacgtttttgtcccttatgacatccactgcatctgaagcggcatcttacgaatttaccaccctcacttgcattccaggggttatcgagtacaagggagcgaacatacagctgctagatctccctggcattatcgagggcgctgcacagggcaagggtcgcggccgtcaggtcatcgccgtggcccgaacagcggacgtgataattatgatgctggatgccaccaagggcgaggtccagcggagccttctagagaaggaactggaaagtgtcggcattcggctcaataagcacaagccaaatatctacttcaagcccaaaaaaggaggcggcatttcctttaatagcacagtcacactgacgcagtgctcagagaagctggtccagctgatcctgcacgagtacaagattttcaatgctgaggtcctctttcgggaagactgttcacctgatgaatttatcgatgtgatagtaggaaatcgggtttatatgccttgcttgtatgtgtacaataagatcgatcaaatttcgatggaggaggtagatagattagctcgaaagccaaattcggtggtgatctcgtgcgggatgaagttgaacctcgactaccttcttgaaatgttgtgggaatacctggccttaacttgcatatatacaaaaaaacggggacagcgccctgattttacggatgcaattatcctgaggaagggggcctccgttgaacacgtatgtcatcggatacaccgctctttggcatcacagttcaaatacgctctggtctggggaacctcgactaagtactcaccccagcgcgtgggcctgacacacacaatggagcatgaggacgttattcaaattgtgaagaaatag

SEQ ID NO: 106669 - DNA, 1815 bp, Artificial Sequence
  Description of Artificial Sequence: Synthetic coding sequence
atgcggggtgcaggaccaagtcccagacagagtcctagaaccctgcgtcccgaccctggccctgcgatgtcattttttagacggaaggtcaagggtaaagagcaggagaagacatccgatgttaagtccatcaaagcctccatcagcgtgcattctccccagaaatcaaccaaaaatcacgccctgttagaagccgctggcccatcccatgtcgcaatcaatgccatctcggcaaatatggattctttctcttcctcccggaccgccacactcaaaaagcagccctcgcatatggaagccgcacacttcggcgatctcggccggtcatgcctggattatcaaacacaggaaaccaaaagctccttatcaaagacactcgagcaggtgcttcacgataccattgtcctgccttactttatccaatttatggaacttaggcgaatggagcacctcgtgaagttttggctggaggccgagtcattccactcgacaacatggtctaggatcagggcccactcccttaataccgtaaaacagagtagcctcgctgagcccgtgagcccttcaaaaaagcacgaaacaaccgcttccttcctgacagacagcctcgacaagcggttggaggattccggttccgcacagctgtttatgacacacagcgagggtattgacctcaataatcgcacgaattccacccagaaccatcttctgctgtcacaggagtgcgatagcgcacactcccttcggctagaaatggcaagggccgggactcaccaagtctcaatggagacacaagaatccagctcaactttaaccgtcgcttcccgcaactcccccgcttcccccctgaaggagctaagcggtaagctgatgaagtctattgagcaggacgctgtcaacactttcaccaagtatatttccccggacgccgcgaaacctatccccataacagaggccatgcggaatgatatcatcgcccggatctgcggtgaggacgggcaagtggacccaaactgcttcgtgttggctcaaagcatagtgttctctgccatggagcaagaacacttttcagaattcctgcgctctcatcacttctgcaagtatcagatcgaagtcctcacatctgggaccgtgtatctggctgacatcctgttttgcgaatcagccttattctacttcagcgagtacatggagaaagaggatgccgttaacattcttcaattttggctagcagccgataattttcagagccagctggctgcgaagaaagggcagtacgacggccaggaagcccagaacgacgccatgatactgtatgacaaatactttagtctccaagccacacacccgctggggttcgatgacgtggtgcggttagaaattgaaagcaacatatgtcgggagggcgggccactgccgaactgctttaccactccccttcgccaggcctggaccactatggaaaagtcgtcggtcaagaaagcatccattaagattctgaaaaatttcgatgaggccattattgtggatgctgcaagtcttgatcctgagtctctttaccagcgcacctacgccggcaagatgacgttcggacgcgtgagcgacctgggtcagtttatccgggaatctgagcccgaacctgatgtgaggaaatctaagggttccatgttttcgcaggccatgaaaaaatgggtgcaaggtaataccgatgaagctcaggaggagcttgcctggaagattgcgaagatgattgtctcagacataatgcagcaggcccagtatgaccagccccttgaaaaatcaaccaaggtctag

SEQ ID NO: 106670 - DNA, 8454 bp, Artificial Sequence
  Description of Artificial Sequence: Synthetic coding sequence
atgaaacttaaccctcagcaagccccactttatggcgattgtgtagtaacggtgctgctggccgaagaggacaaagctgaggatgacgtggtcttctatcttgtcttcctaggttcaaccctaagacattgcacatccactagaaaagtttctagtgataccctcgagacaattgctcctggccatgactgttgcgaaactgttaaggttcaactgtgcgctagtaaggagggcttgccagtttttgtggtggcggaagaagattttcatttcgtgcaggatgaagcctacgacgctgctcaattccttgccacttcagcaggcaatcagcaagcgctcaacttcactcgcttccttgaccagagcggacctccgtccggtgatgtgaacagcctggataagaaactggttctggcctttagacatttgaaacttcccaccgagtggaacgtgctggggacagaccagagtttgcacgatgccgggccacgggagaccctcatgcacttcgcagtgcggttaggcctgctaaggcttacttggtttttactccagaagcccggaggacgcggggctctgtcaatccataaccaggaaggggcaactcccgttagtcttgcgttggagcgcggctaccataaactccatcagctattgacagaagaaaatgctggggagcccgattcatggagcagtctgtcgtacgaaattccatacggagactgttctgttcgccatcaccgggaattggacatctacacacttacttcggaatctgattcacaccatgagcacccctttcccggggacggctgtactggccctatttttaaactgatgaacatccagcagcagttgatgaaaaccaatctgaagcagatggattcgctcatgcctctcatgatgacagcccaagatccgtccagtgcgcccgaaactgatggccagtttctcccttgcgcccctgagccgacggaccctcagcggctatcatcgtccgaggagacagagtctacacagtgctgtcccggctcaccagttgcccagacggaatctccttgcgacctctcttcaatagtagaggaggagaacactgaccggagctgccggaaaaaaaataagggtgtcgaacggaaaggcgaagaggtcgagcctgcacctatcgtggacagtgggactgtttctgaccaggactcttgcttacagtcccttcctgattgtggggtaaagggcacggagggactatcgagctgcgggaacagaaacgaggaaactggtaccaagtcttctggcatgcctaccgaccaagagagtctgagctctggcgacgcagttcttcagcgagacctggtgatggagccggggactgcacagtactcctcagggggcgagttagggggtatctcgaccacgaacgtttctacacccgatacagcgggcgaaatggagcatggccttatgaatcccgacgccactgtttggaaaaatgtgctacagggcggggagtccacaaaggaaagatttgagaattcgaacatcggaacagcaggagcttcagatgtgcacgtcacctccaaacccgtcgacaaaattagtgtgcccaactgtgctcccgcggcatcttcgctggatggcaacaagcccgctgagtcgtcattagcgttctcaaatgaagaaaccagtaccgaaaagacagccgaaaccgagacatctcgtagccgggaggagtctgccgacgcccccgtggaccaaaattccgttgtgattcccgccgccgcaaaagacaaaatctccgatggcctggaaccatatacactgctggcagctggaatcggagaagccatgtctccatccgacctcgcccttctggggctggaggaagatgtcatgccccaccagaatagcgaaacgaactctagccacgcccagagccagaagggcaaatccagcccaatctgcagcaccactggtgatgacaaactatgcgcagacagcgcctgccagcagaatactgtgaccagttcaggcgacctggtcgcaaaactttgtgacaacatcgtctctgaaagtgaaagcactaccgctaggcaaccttcctcacaggaccctcctgacgcctctcattgtgaggacccgcaggcccacaccgtcaccagcgatccagtcagagatacacaagagagagctgatttttgccctttcaaagtggtggataataaaggccagcggaaggacgtgaagcttgacaaacccctgacaaacatgcttgaagtagtctcccatcctcatccagtggtccccaagatggagaaagagctggttccagaccaagcagtgatctcagatagcacattttctttagccaatagtcccggttccgagagcgtgactaaagatgacgcgctcagtttcgtcccctcacaaaaagagaaaggcacagctactccagagctccacacggccacagactacagagacggccctgacggcaacagcaacgagccagatacacggcctcttgaagatcgagctgtcggactgtccacaagcagcacagccgccgagcttcagcacggaatggggaacacatcccttacaggcttgggcggagagcacgagggccccgctccgccagccatacctgaggccctgaatattaaaggcaacaccgatagcagcctgcaaagcgtgggaaaggctacgctcgcgcttgacagcgtgctgacagaggaaggcaaactgctggtcgtatcggagagctcagctgctcaagagcaggataaagacaaggccgtaacgtgctcatctattaaagaaaatgctctcagtagcggcaccctccaggaagagcagcggacaccccctcctgggcaggatacgcagcaattccatgagaagagcatctctgccgattgtgccaaggacaaggctctgcagctgagtaactcacctggggctagttctgcttttctcaaagctgagaccgagcataacaaagaggtggcccctcaggtgtccttattaacccagggaggcgctgcccaaagtttggtgccccccggggcaagcctggcaactgaatcacggcaggaagcccttggggctgagcataacagttctgccctgttgccgtgcctcctgcctgacgggagtgatggtagtgacgccctgaactgttcacaaccctcgcctctggatgtgggagttaagaacacccaaagtcagggcaagacgtccgcatgcgaggtttctggcgacgtcaccgttgatgtcacgggcgttaatgctctgcagggtatggcagaacccagacgggagaacatttcccacaacacccaggacattcttataccgaatgttctgctgtcccaggaaaaaaacgcggtcctgggcttaccggtggcgctgcaggataaagccgtcaccgatccacagggagtgggaacccctgagatgatccctctggattgggagaaaggaaaacttgagggagctgaccactcatgtacaatgggagatgccgaggaagcgcagatagacgatgaagctcaccccgtgctacttcagccagtagcaaaggaactcccaaccgacatggagctgagtgcccacgatgatggggcccccgcgggggtgagggaagtgatgcgggcccctccctccggaagggaacgctccaccccatctctgccttgtatggtctccgcccaagacgcccctctgccaaagggcgcagatctgatcgaggaagcagcatccaggatcgtagacgctgtcatcgagcaggtcaaagccgccggcgccttgctaaccgagggcgaagcttgtcacatgtcattgagctcaccagaactgggccccctcactaaaggactggaatctgcgtttaccgaaaaagtcagcaccttcccacccggcgaaagcctcccaatgggatccactcctgaggaagcaacaggttccttggccggatgcttcgctggacgagaggagcctgagaagattatcctgcctgtgcaggggcccgagccagccgccgagatgccagacgtgaaagctgaagacgaggtcgactttagagccagctctatttctgaggaagtggctgtcggctccatagccgctacactaaaaatgaagcagggtcccatgactcaggccatcaatcgtgaaaactggtgtacaatcgaaccctgtccagacgctgcatcgctgctagcctctaagcaatccccagagtgcgagaattttctggatgtcgggctgggaagggaatgcacatctaagcaaggcgtcttaaaacgggagagcggcagtgacagcgacctgttccacagtccatctgatgacatggactctatcatcttcccaaagcccgaagaggaacaccttgcctgtgatattaccgggtcctcctcttcaaccgacgacactgcctcacttgatcgacactccagccacggatccgatgtctcactctcacagatcctgaaacccaacaggtcgcgggatcgccagagccttgatggtttctacagccacggaatgggtgcagaaggtcgggaatccgagagtgagccagctgacccaggcgacgtggaagaagaagaaatggattccataacagaagtccctgccaactgtagcgttttgagaagttcaatgcggtccctctctccttttagaaggcattcttggggacccggcaagaatgccgcttccgatgccgagatgaatcatcgatccatgagttggtgtccaagcggagtccagtacagtgctggactgtccgcagactttaactataggagtttctctctcgaaggcctgactgggggtgccggggtgggcaacaaacctagcagctcattagaagtttcctccgcgaacgccgaggagcttcgccaccctttcagtggcgaagaaagggtcgatagtctggtgtccctcagcgaagaagacctggagtccgatcagcgagaacatcggatgtttgatcaacaaatctgccacagatcaaaacagcaggggttcaactactgtacatctgctatctcttcaccattaaccaagtcgattagtctgatgacaatttctcacccaggcctggataacagccgacctttccactctaccttccataatactagcgcaaatctgaccgagtcaataaccgaggagaactacaactttctcccacactcgccatctaaaaaggattccgagtggaaatcaggcacaaaagtctctagaacattctcctatatcaagaataagatgtccagcagcaagaagtccaaagagaaggagaaggaaaaggataagattaaggaaaaagagaaagactccaaggacaaagagaaggacaaaaaaaccgtgaatggacacacttttagctctattcctgtcgtcggtcctatcagctgctctcagtgcatgaagcccttcaccaataaggacgcgtacacctgcgctaactgctctgccttcgtgcataaggggtgccgggaatccctggcttcttgcgcgaaggtgaaaatgaagcagccaaagggatccctgcaagcacacgatacgagctccctgcccacagtgattatgcggaacaagccttcccagccaaaagagaggccgagatccgccgtcctgcttgtggatgaaaccgctactacaccaatcttcgccaatagacgttctcagcagtcagtcagtctaagtaagtcagtttcaatacagaacatcacaggtgtcgggaacgatgagaatatgtctaacacttggaagttcctgtcccacagtacagactcactcaataagatcagcaaagtaaacgagagtacagagagcttaacagatgagggagtcgggaccgacatgaatgagggccagctccttggagattttgagatcgagtcaaaacaactagaggctgaatcgtggtctcggatcatagactccaagttcctgaaacagcaaaaaaaggatgtagtgaaaagacaggaagtcatctacgagctgatgcaaaccgaatttcatcacgttcgcaccctcaagattatgagtggagtgtatagccagggtatgatggccgatctgctgtttgaacagcagatggtggaaaaactctttccatgcctggatgagctcattagcatacattcccaattttttcagcggattctggagcgtaagaaagaaagcctggtggacaaatcagagaaaaatttcttgatcaagcgtattggcgatgtgctagtcaaccagttcagtggagaaaatgctgagcgcctgaagaaaacttacggaaagttctgcggacagcataaccaatcagtaaactacttcaaggacttgtacgccaaagataaacgctttcaggcttttgtgaagaagaagatgtcctcttccgtcgtgcggcggctggggattcctgagtgcatactcttagttacgcaaaggatcacaaaatatccagtgctgttccaacggattctgcaatgcaccaaggataacgaggtcgagcaagaggatttagcccagtctctttccctagtcaaggacgtgataggggccgttgatagcaaggttgctagttacgaaaagaaggtgaggctgaatgagatctatactaagaccgacagtaaatcgattatgaggatgaaatctgggcagatgttcgcaaaggaggatcttaagcgcaagaagctcgttcgcgacggttccgtctttttaaagaatgccgccggccgcctgaaggaggtccaggctgttctccttaccgacatcctggtgttcctccaggaaaaagatcaaaagtacatcttcgcctcccttgatcagaaatctacggttattagtctgaaaaaactaatcgtccgcgaagtggctcacgaggagaagggtctattcctgatttccatggggatgactgatccggagatggtggaggttcacgcgtcatccaaggaggagcgaaatagctggatccagatcatacaggacaccatcaacactctgaacagagacgaggacgaggggattccctctgagaatgaagaggaaaaaaaaatgctggatactagagcgcgggaactgaaggagcagctgcaccagaaagatcagaaaatcttgctccttcttgaagagaaggagatgattttcagggatatggcagaatgctcaaccccactacccgaagattgctctcctacccatagtccacgcgttctgttccggagcaataccgaagaggctcttaaaggtggccccttgatgaagagcgctatcaacgaggtggagattctgcaggggctcgtatcaggaaacctcggaggcaccttggggcccactgtgagttcgccaatcgagcaggatgtcgtgggccccgtttctctcccacggagggccgagacatttggcggttttgattcccatcagatgaacgcttctaaaggtggggagaaggaagagggagatgacgggcaagatctccggaggactgaaagcgactcgggactcaagaaagggggcaatgccaacctcgtgttcatgctgaagagaaacagcgaacaggtggtccagtccgtggtgcatctgtatgaattgctgagcgctctgcagggcgtggtgctgcaacaggactcttatattgaagatcagaaactggtcctctcggagagagcattgacaaggtctctgtccagaccctcctcgctgattgagcaggagaagcagaggtccctggaaaagcagagacaggatctcgccaacctgcagaaacagcaagcccagtacttagaagagaaacgcagaagagaacgagagtgggaggcacgcgagagagaactgcgggaaagggaggcactgctggcccagcgggaggaagaggtccagcagggccagcaagaccttgagaaggagcgcgaagaactccagcagaagaagggcacctaccagtatgatctcgaaagactcagagcagcccaaaagcagctggaaagggagcaggaacaactgaggagggaggcagaacgcctaagccagaggcaaactgagagggatctgtgccaagtctctcacccccataccaaactcatgcgcattccctcatttttccccagccccgaagagccaccgagtccctcggcacctagtatcgctaaatccgggagcctagactctgagttgtctgtgagtccaaagaggaacagcatctctcggacgcacaaggataaaggaccttttcacatcctgtcttctacatctcaaactaacaaaggccccgaggggcagtctcaggctcccgcttcgacctctgccagtactcgcctcttcgggctcacaaaaccaaaggaaaaaaaggagaagaaaaaaaagaacaaaacctctcgtagccagcccggggatggacccgcttcagaggtttcagccgaaggggaggagatattctgttag

SEQ ID NO: 106671 - DNA, 3177 bp, Artificial Sequence
  Description of Artificial Sequence: Synthetic coding sequence
atgtcatcctctaagaagtcaaaggaaaaagaaaaggagaaagataagatcaaggagaaggaaaaggactctaaagacaaggagaaggacaagaaaacagtcaatgggcacacctttagttcaattccagtggtcgggcccatatcctgttcacaatgtatgaagccattcaccaataaggatgcctatacctgtgccaactgttcggcatttgtccacaagggttgcagagagtctctggccagctgcgccaaggtcaaaatgaagcagcctaagggatcattgcaggcacacgacacttctagcctccccacagtcattatgcgtaataaaccctctcagccaaaggaacggcctcgctccgccgtgctattggtcgacgaaacagccacgaccccaatctttgctaaccgacgttcgcaacaaagcgtttccctatccaagtcagtgagcattcaaaacatcaccggggtggggaacgatgaaaatatgtccaacacttggaagtttctgagccacagtaccgactcacttaataagatctccaaggtgaatgagtcgacagagagtctgaccgacgaaggcgtcggaacagacatgaatgaaggacagttattgggagactttgaaattgaaagcaaacagctcgaagccgaatcttggagccggatcatcgactcgaagttcctgaaacagcaaaaaaaagatgttgtgaaacgacaggaagttatctacgagttgatgcagacagaatttcatcatgttcgcacgctaaagatcatgtctggagtatatagtcagggcatgatggccgatctgctgtttgagcaacaaatggtagagaaactctttccctgtttagacgagttgattagtatacacagtcagttttttcaaagaatactggagaggaagaaggaatctctcgtggacaaatcagagaagaacttcctcatcaagcgcatcggcgacgtgctggtgaaccagttctctggtgagaacgccgagcgcctcaagaagacttacgggaaattttgcggccagcataaccagagcgttaattactttaaagacctttacgccaaagataaaagatttcaggcctttgtgaagaaaaagatgagcagcagcgtggtaagacggcttggaatcccggaatgtatcctcttagtaactcagagaatcacaaaatacccagtgttgttccagaggatcttacagtgtacgaaggacaacgaggtggaacaggaggacctcgcccagtccctgtccctcgtaaaggatgttataggggctgtagactcgaaggttgcctcatatgagaagaaggtgcgcctgaacgaaatttatactaaaacagattcaaagtccattatgagaatgaaatctggccagatgtttgcaaaggaggatctcaaacggaagaagctagtgagagatggctctgtctttctgaaaaatgccgccggaagactgaaagaggttcaggctgtgttgttgactgacatcctggtgttccttcaggagaaagatcagaagtacatctttgctagcctggaccagaagtctacagtaatcagccttaaaaaacttatcgtccgagaagtcgctcatgaggaaaaaggattgttcctgatctctatgggaatgactgaccctgagatggtggaagtccacgccagctcaaaggaagagcgaaattcctggatccagattatccaagatactattaacacattgaacagagacgaggatgagggtatcccgtctgagaatgaggaagaaaagaagatgttagacacacgagcccgcgaactcaaagaacagttgcaccagaaggatcagaaaattttgctcttgttggaagagaaagagatgatattccgagacatggctgagtgttcgactccccttcctgaggactgcagtcccacacatagccccagggtgctgttcagatcaaacacggaggaggccctgaagggcggtccactgatgaagtccgctatcaatgaagtagagattctgcagggacttgtgagcgggaacctcggcgggacccttgggccgacggtttcctcacccattgaacaggatgttgtcggccctgtatctcttccacgcagggctgaaacattcggtgggttcgactctcatcagatgaatgcctccaagggcggagaaaaagaggagggggatgacggccaggacctgagacggacggagagcgacagtggactgaagaagggcggcaatgcaaacctagtttttatgttgaagcgcaattctgagcaggtggtgcagtctgtagtacacctctacgaattactctcagccttacagggcgtggtcctccagcaagatagttatatagaagatcagaaactagtgctgtcagagagagccctgactcgttctctatcacgcccttcctctctcatcgaacaggagaaacagcggtccctggaaaagcagcggcaggacctggctaacctgcagaagcagcaagcgcagtacctggaagaaaaaagacggcgagagcgggagtgggaggcgcgcgaacgggagctccgggagcgagaggccttgctcgcacagagggaggaagaagtacagcaaggtcaacaggacctggaaaaagagcgggaagagcttcagcagaaaaaaggtacctaccagtacgacctggaaaggctacgggcggcccagaagcagcttgaacgagagcaggagcagctgcggagggaggccgagcggctgagccagagacagaccgaacgggatctgtgccaagtctcgcacccccacacaaagctcatgcgaatcccctccttttttcccagtcctgaggagcccccttccccaagtgcgcccagcatagccaagtccggcagtctggactcggagctgagcgtatcccccaagagaaacagcatcagcaggacacacaaggacaaggggccctttcatatactgagttccacatcccaaacaaacaaaggtcccgaaggtcagtcgcaggcgccagcaagtacctccgcttccacaagactcttcggcctgacaaagccaaaagagaagaaggaaaaaaaaaaaaagaacaaaaccagtcggtcccaacctggtgacggcccagccagtgaggtgagcgccgaaggtgaagaaattttctgctag

SEQ ID NO: 106672 - DNA, 8451 bp, Artificial Sequence
  Description of Artificial Sequence: Synthetic coding sequence
aagctgctcgaaaagcagcctcccattgagggggattgcgtcgttaccgttttgctcgccgaggaggacaaggcagaagatgatgtcgtgttttatttggtcttcctgggctctactctgcgccactgtacatccaccagaaaagtgtcatccgacactttagaaacaatcgctcctgggcatgactgctgcgagacagtgaaggtgcaactgtgcgcttcaaaggaaggattgccagtcttcgtggtggcagaggaagattttcactttgtgcaggacgaggcctatgatgctgctcagtttctggcaacctccgccggtaaccagcaagctctgaactttaccagatttctggatcagagcgggccacctagcggcgatgtgaactccctggacaaaaagctggtgctagctttccgtcatcttaagctcccaaccgagtggaacgttctggggaccgatcaatcattgcacgatgcagggccacgagagacgctcatgcatttcgccgtaagactcggcttgctccgtctgacctggtttctgttgcagaagcccggcggcaggggagctctttccatacacaatcaggaaggggcaacaccggtttctctggctttggaacgggggtatcacaaactccatcagctgcttacagaagagaatgctggcgagccagacagttggagtagccttagttacgaaattccatatggggactgttctgtcagacatcacagggaattggatatctatactctgacatcagaatccgactcacaccatgaacacccttttccgggggacggatgcactgggcccatcttcaagttaatgaatattcaacagcagcttatgaagaccaacttgaaacagatggattcacttatgcccctgatgatgacagcgcaggatccgtcctctgcccctgagactgacgggcaatttctgccttgcgcacccgagcctacggaccctcaacgcctttccagcagtgaagaaaccgagagtactcagtgctgccccggcagtccagtcgctcagacggaaagcccttgtgatctcagttccattgtggaggaggaaaatacagatcgcagttgtagaaaaaagaataagggggtggagagaaaaggtgaagaggttgagcccgcccccatcgtggactccggaaccgtcagcgaccaggacagttgccttcaatccttacccgattgcggagtcaagggtaccgagggactctcaagctgcgggaatcgcaatgaggaaacaggtacgaaatcttctggcatgccaacagaccaggagtcactgagttcaggggacgcagttttacagcgcgacctggtcatggaaccaggcactgcccagtattcaagtggtggcgagcttggcggcatcagtacaaccaatgtgagtacccccgacaccgcaggtgagatggaacacggattgatgaaccccgatgccaccgtgtggaagaacgtacttcagggaggggagagtaccaaagagcgatttgaaaactcaaatattggcaccgccggggcttcggacgtgcatgttacttcaaagccagtcgataaaatttcggtgcctaattgcgccccagcagcaagcagcctggatggaaataaaccggccgaatccagtctagccttttcaaatgaggagacttctactgagaagaccgctgagactgaaacatctcgatccagggaagagtcagccgacgcaccggttgatcagaatagcgttgtgataccagccgccgcaaaagacaaaatcagtgatggtctggagccctacactctgttagcagccggaattggcgaggctatgagccctagcgatcttgcactgctggggctggaagaagacgtgatgccgcatcagaactctgaaaccaactcaagtcatgcccagtcacagaaaggaaagtcaagtccaatttgttcaacaaccggcgatgataagctttgcgcagacagcgcctgtcagcaaaacacagtcacctcctcgggagatctggttgccaagctctgtgacaatattgtgtctgaatcagagtcgacaaccgcaagacagccctcttcccaggatcctccagacgcctcccactgtgaagatccgcaggcacacaccgtgacttctgatcccgttagggatacccaggagagggcagacttttgtccattcaaggttgtagacaacaagggccagcgcaaagatgtcaagctggacaagcccctgacaaatatgctggaggttgtatcacacccacacccagttgtgcccaaaatggaaaaggaactggtgccggatcaggcggtgatttcagactctacatttagtctcgctaactcacctggatctgagtccgtgacaaaggacgatgccttgtctttcgtaccatcccagaaagagaaaggaaccgcaacccccgagcttcatactgcgacggactaccgcgatggtcctgatggaaacagcaacgagccagataccaggcccttggaagacagggctgtgggcttgtcaacaagctcgaccgcagccgagctgcagcacggtatggggaataccagcctgactggtctcggtggcgagcatgagggcccggcaccaccagccattcctgaagccctgaatatcaaaggaaatacagacagcagcttgcagtcggtcggtaaagcaacattggccctggatagtgttctgactgaagaaggaaagctcctggttgtctccgagtcctctgcggcccaggagcaggataaagacaaggccgtgacttgtagctcgattaaagagaatgctctaagctcaggaacattgcaggaggagcagaggacgccgccccctggacaggatacacagcagtttcacgaaaagagcatttccgcagattgcgccaaggataaagcacttcagctctcaaacagtcccggcgcctcctccgcttttctgaaggcagagacagagcacaacaaggaggtcgcccctcaagttagtctactgacgcagggcggagccgctcagtcacttgttcctccaggagccagcctggccacagagagcagacaagaggccctgggtgccgagcacaattctagcgcactgctgccctgcctgctccccgacggatcagacggaagcgacgcactgaactgctcacagcccagtccactcgatgtcggcgtcaagaacacccaatcccaaggtaagacctcagcctgtgaggtcagcggtgacgtcactgtggacgtgacaggcgtgaatgctctccaggggatggcggagcctcgccgcgagaacatcagtcacaacacccaggacatcctaatcccaaatgtccttctctcccaagaaaaaaacgccgtgctggggttaccggtcgcgcttcaggacaaggcagtgaccgaccctcagggcgtgggcacacccgagatgatacctctggattgggaaaaggggaaactggagggcgctgaccatagctgcacgatgggagacgccgaagaggcccagatcgacgatgaggcccaccccgtgttgctccaaccagtggccaaggagcttccaacggatatggagttatcagcccatgatgacggggcaccggccggtgtgcgcgaggtgatgcgcgctcccccaagcggaagagagaggtctactcccagtctgccctgcatggtgagcgcccaggacgcccccctgccgaaaggcgccgaccttatcgaggaagctgccagcaggatcgtagacgccgtgatagagcaagtaaaagccgctggtgcacttctcacagagggagaggcctgtcatatgagtctctcctcccctgagcttggccccctaaccaaaggactcgaatcagcctttaccgaaaaagtctctacctttccccctggcgaaagcttgccaatgggttcgaccccagaggaggcgacgggatccttggccggatgttttgcaggaagggaggaaccagaaaaaataattcttcctgtgcagggaccagagcctgccgcagagatgcccgatgtgaaggccgaggatgaggtggatttccgcgccagctccatcagtgaggaggttgcagtcggctcaatagccgccaccttaaaaatgaaacaggggcctatgacccaggccatcaaccgggagaattggtgtacaattgaaccctgcccagatgccgcaagcctgctagcttctaagcagtcacccgaatgcgagaatttccttgatgttggcctcgggcgcgagtgtacatccaaacagggcgtcttaaagagggaatctggtagcgactcagatcttttccactcaccaagcgacgacatggactcaataattttccccaagcccgaggaagagcacttggcctgtgacatcaccggttccagctcctctacagacgacacagccagtttggacaggcacagctcccatgggtcagatgttagtctgtcgcagatactgaaacccaacagaagtagggatcggcaatccctcgacggcttctactcgcatggtatgggagcagaggggcgggagtctgagtccgagcccgccgatcctggtgatgtcgaagaggaagagatggactccatcaccgaagtccctgccaattgctcagtgctccggtcctcgatgcgcagccttagcccatttcggcggcacagctggggcccagggaagaatgccgcctcagatgccgagatgaatcaccggtccatgtcctggtgccctagtggagtgcaatactctgctgggctctctgcggacttcaactaccggtccttctcactggagggattgaccgggggggccggcgtgggaaacaagccatcatcgagcttggaagtgtcttcagccaacgccgaggagctgcgccacccttttagtggggaggagcgagttgattccctggtgtcccttagtgaggaggacctggaaagcgaccaacgcgagcataggatgttcgaccagcagatttgtcacagatccaagcaacagggcttcaactattgcacctcagccatctctagcccacttacaaagtctatcagcctgatgacaatctcccacccaggtcttgataattccagacctttccatagcacctttcacaatacgagcgccaacctaacagaaagcatcaccgaagaaaattacaactttctcccgcattccccgagcaaaaaggattctgagtggaagtcaggcaccaaagtaagccgtaccttttcttatatcaaaaataagatgagttcctctaaaaagtccaaggagaaggagaaagagaaggacaaaattaaggaaaaggagaaggactccaaggataaggaaaaggataagaaaactgtgaatggccataccttttctagcatacccgtggttggtcctatttcctgcagccagtgcatgaaaccatttacaaacaaggacgcttacacatgtgctaattgctctgccttcgtacataagggatgtcgtgaatctctcgcaagttgcgccaaagttaaaatgaaacagcctaaagggtctctccaagcccacgatacaagctctttgcccaccgtgataatgaggaacaaacctagtcagcctaaggagcgccctagaagtgccgttttactggtggatgaaaccgccacgacaccaatctttgcgaatcgacggagccaacagtccgtgtcactgtccaagtcagtgagcatccagaatataaccggtgtgggcaacgacgagaatatgagcaatacgtggaagtttttgagccactctacagacagcttaaataagataagtaaagtgaacgaatcaaccgaatctcttacggacgagggagttggtacagacatgaacgaagggcaactgcttggggatttcgaaattgagtccaaacagttggaggccgaatcctggtctcggatcatagactctaagttcctgaagcaacagaaaaaggacgtggtcaagcgccaggaggtgatctacgagctgatgcaaaccgagttccatcacgtgcggacacttaaaatcatgtccggcgtctacagccaaggtatgatggccgatttgctattcgagcagcagatggtggagaaactgtttccttgcctggatgaactgatctccattcactctcagttcttccagagaattctggaaagaaagaaagagtccctggtcgataagagcgagaaaaattttctgattaagcgtatcggggatgtgctggtgaatcagttttccggagaaaacgccgagcggctcaaaaaaacctacgggaagttctgtggccagcataatcagtcagtaaattattttaaagatctgtatgccaaggataaacgcttccaggcattcgtcaaaaaaaagatgagctctagcgtcgtgcgcagactagggatcccggagtgcattctcctcgttacccagcgcataacaaagtaccccgtgctattccagaggatcctccaatgcaccaaggacaacgaagtggaacaggaggacctggctcaatctctgtcactggtgaaggacgtgatcggtgcggtcgacagcaaggtcgcctcctacgagaagaaagtgcgcctcaacgaaatctacacgaaaaccgacagtaaatcgatcatgagaatgaagtccggccaaatgttcgctaaagaggatctgaaaaggaaaaagctggtcagggatgggagcgtgtttctaaaaaacgctgctggaaggctgaaggaagtgcaggcagtcctacttaccgatatcttagtgttcctccaggagaaagatcagaaatacatatttgcctctctggatcagaagagtaccgtgatatctttaaaaaaactgatcgtgcgcgaagttgcgcatgaggaaaagggtctgtttcttatttcaatgggaatgaccgaccctgagatggtggaggtacatgcctcttctaaggaagagcggaacagttggattcagattatccaagacacaattaatacactgaaccgggatgaggatgaaggcatacccagtgaaaacgaagaagagaaaaaaatgctggatactagagcacgcgagctaaaagagcaactacatcagaaggaccagaagatcctcctcctgctcgaggaaaaagagatgatatttcgggatatggccgaatgcagcactcccctgccggaggactgtagcccgactcacagccccagagttctgtttaggtctaacacagaggaggcactgaaaggcggtcctctgatgaagagcgccatcaatgaagttgagatccttcaaggcctggtgagcggcaatctcggcggcaccctcggacccaccgtgtcgtctcctatcgagcaagacgttgtcggcccggtgtccctgccccgcagagctgagactttcggcggctttgatagtcatcagatgaacgcttccaaggggggggagaaagaggaaggcgacgacggacaagacctgcggcgtactgagtcggactcaggccttaaaaaagggggtaacgccaacctggtattcatgttaaaaagaaacagcgaacaggtggttcagagcgtcgtgcacctgtacgagcttctctcagccttgcagggagttgtgcttcagcaggactcctacattgaggatcaaaagcttgtgttatcggagcgagccttgaccaggtctttgagccgacctagctctctcatcgagcaggagaagcagcgttccctcgaaaagcagaggcaggacctggccaacctgcagaaacagcaggctcaatatcttgaggaaaagcgcagacgggagcgggaatgggaggcaagggagcgcgagctgcgggagcgggaagccttactggctcagcgggaagaggaggttcaacagggacagcaggacctagaaaaggaaagggaggagctgcagcagaagaaaggaacctaccagtacgaccttgaacggctgcgcgccgcacagaaacagctggaaagggagcaggaacagctcagacgcgaagccgagcgcctcagccagagacaaaccgagagggatctttgtcaggtgagtcatcctcatactaaattgatgcggattccgtcatttttcccctcacccgaggagcctccaagtccctctgctcctagcattgcaaaatctggctccctggacagcgagctatccgtgtcacctaagaggaactccatcagccggacacataaagacaaaggcccctttcacattttgtccagcacgagccagacgaataaagggcctgaagggcagtcgcaggcaccagcaagcacatccgcctccacaagattgttcggcctgaccaagcctaaggagaagaaagaaaaaaagaagaagaataagacctctagaagccagccaggcgatgggccagctagtgaggtgtccgccgagggtgaggaaatcttctgctag

SEQ ID NO: 106673 - DNA, 8442 bp, Artificial Sequence
  Description of Artificial Sequence: Synthetic coding sequence
atgaagcttaatccacagcaggcaccactgtatggggactgcgtcgtcacagttcttttggctgaagaagataaggcagaagacgatgttgtgttctacctggtgtttctcgggtctacactcagacattgtaccagcactcgcaaggtcagctcagataccctggagaccattgccccagggcacgattgctgtgagactgtgaaggtgcagttgtgtgccagtaaggaaggtctgccagtattcgttgtggctgaggaggatttccactttgttcaggatgaagcctacgacgctgcacagttcctcgccacatcagccgggaaccagcaagcgctgaactttacacgattcctggaccagtcagggcccccatccggggacgtcaactccctggacaagaaacttgtgctagcgtttcggcatctgaagctgccaactgagtggaacgtcctgggaacagaccagtcactacatgacgctggtccccgcgaaaccctgatgcacttcgccgtgcggttgggattactgaggttgacttggtttctcctgcagaagcctggaggccgaggtgccctatccattcacaatcaggaaggcgcaacgccggtctcacttgccctcgagcgtggttatcacaaactgcatcagcttttaactgaggaaaacgccggagagccagactcttggtcatccctcagctacgagattccctatggagactgctccgttcggcatcaccgcgagctggacatatacacactgacctctgaatccgatagccaccatgagcaccccttcccgggggacggctgcacgggccccatattcaagctaatgaacattcagcaacagctgatgaagactaacctaaagcagatggactcactgatgcctctgatgatgacggctcaagatccctcctcagctccggaaacagatggccaatttctaccttgcgcacccgagccgactgacccgcaacgcctgagctcgtcagaggagaccgagtctacacagtgctgccccggtagcccggttgcacagaccgaaagcccatgcgacctgtctagtatcgttgaggaggagaatactgaccggtcttgcaggaaaaagaataaaggcgtggaaagaaaaggtgaagaagtcgagccagcccctattgtggattcaggcactgtctccgaccaagactcttgcctgcagtccctgcccgattgcggagttaaaggcactgaggggctatctagctgcgggaaccggaacgaagagactggaacaaagtcaagcggtatgccaaccgatcaagaatctctgtccagcggcgacgcggtcttacaacgcgacctcgtgatggaaccaggaaccgcccagtattcatctgggggggagcttggtgggataagtaccaccaatgtgtccacaccggacacagctggggagatggagcacggactgatgaatcctgatgccactgtctggaagaatgtactgcagggtggagagtccaccaaggagcgatttgaaaattctaacatcgggaccgctggggcaagtgatgtgcacgtgacatctaaaccagtcgataagatcagcgtgcctaattgtgcacccgctgccagcagcctggatggcaacaagcccgcagaaagctccttggctttcagcaacgaggaaacttccaccgagaagacagcagaaaccgaaaccagtcgatcgcgagaggaatccgcagacgccccagttgatcagaacagcgtggttattccagccgccgctaaggataaaatcagcgacggactggaaccctatactctgctcgccgccggtattggtgaggcaatgtcgccttctgacctcgccctcctggggctcgaggaagatgtgatgccacaccagaactctgagacaaatagctctcacgcacagagccagaagggcaagtcatctcctatctgctcaacaactggcgacgacaaattgtgtgccgattctgcctgtcagcagaataccgttacatccagcggcgatttggtggcaaagctgtgtgataacattgtctccgagtctgagtccacgacagctcggcaaccctctagccaggaccctcccgatgccagtcattgtgaagatccacaagctcataccgtcacaagtgacccagtgcgcgatacacaggagagagccgatttctgtccattcaaagtggttgataacaaaggtcagcgcaaggatgtgaaactggacaaacctctgacgaacatgctggaagtggtttcccacccacaccctgtcgtgcctaaaatggagaaggagctggttcccgaccaggccgtgattagtgattcaacttttagtttggctaactctcccggaagcgaatccgtgaccaaagatgacgctcttagtttcgtgccaagccagaaagagaagggaacagctacaccggaacttcatacagcaacggactatcgtgacggacccgacggcaactccaatgagccagacacccggcctctggaagatcgcgcggtgggactgagtacttccagtacagccgccgagctgcagcatgggatggggaatacttccctgaccgggctggggggggagcacgaggggcctgctccgccagctatccccgaggctctcaacatcaagggaaatacggattctagcctgcaaagcgtgggcaaggcaacgctagccctggattccgtcttgaccgaggaaggaaagctccttgtcgtgtctgagtcctccgctgctcaggagcaggataaggataaggccgtgacatgctcaagcataaaggagaatgctctgagttccgggaccctccaagaagaacagcgaaccccccctccggggcaagatacgcagcagttccacgagaaatctatctctgccgactgcgcaaaagacaaggccctccagttatccaattcacctggggcttctagcgctttcctgaaggccgaaaccgagcataataaagaggtagctccacaagtcagccttctgactcagggaggcgccgcccagagtctggtaccgcccggggcctctctcgcaaccgaatcaaggcaagaggctttgggggccgagcataacagttccgctttactaccttgcttactgccagacggctctgacggcagtgatgccctgaattgttcacagccctctcccctggatgtgggcgtcaagaatacacagtctcaaggaaagacatcagcctgcgaggtgtcaggcgacgtgaccgtggatgtgaccggagttaacgccctgcaagggatggcagaaccccggagagagaacatctcccataacacacaagacatactgatcccaaacgtgctactatcccaggaaaagaacgccgtgcttggactgccagttgcactacaggataaagccgtgaccgatccacaaggagtgggcacccccgagatgattccacttgactgggagaaaggtaagctggaaggcgccgaccactcctgcacaatgggtgatgctgaagaagcccagatcgatgatgaagcgcaccccgtgcttctccagcccgtcgccaaggaactccccaccgatatggagcttagcgcccatgatgacggggcgcccgccggcgtccgcgaggtgatgcgggctcctccctccgggagagaaaggagtactccaagtcttccttgtatggtgagcgcacaggacgcccctttgccaaagggagccgacttgattgaagaggctgccagtcgaattgttgacgcagtgatcgagcaggtgaaggctgctggcgcactattaacggaaggcgaggcctgtcacatgtccctttctagtcctgagctggggcccctcaccaagggactcgaaagcgcctttacggagaaggtgtcaacctttccccccggagagtctctcccaatgggctcaacccctgaggaggccactggcagcttggcaggctgcttcgcaggccgggaggagcccgagaagatcatcctcccagtacaaggccctgagcccgcagccgagatgcctgacgtgaaagctgaggacgaggtagattttcgagcctcatccattagtgaggaggtcgccgttggatcgatcgcagccactctgaaaatgaagcaagggcccatgacccaggctatcaaccgtgaaaattggtgtaccatagaaccgtgtcctgatgccgcatcccttctcgcgagtaagcagtctcccgagtgcgagaatttcctggacgtgggactaggtcgagaatgtacttcaaaacagggcgtcctgaagcgagaatccggaagtgacagcgacctcttccacagtccttccgatgacatggactcaattatatttcctaagccagaggaagaacacctcgcctgcgacattacaggctcttcttcttccacagatgatactgcttcactcgatagacattcaagccatgggagtgacgtcagcctgtcacagatcttgaagcccaaccgcagcagagaccggcagtctctggatgggttttactcccatggcatgggggccgagggccgcgagtccgagtctgagccagccgacccaggcgacgtggaggaggaagaaatggactccattaccgaggtgcctgcaaactgctcagtcctgcgcagctccatgaggtctttgagccccttcagaaggcactcctggggccccgggaagaatgcagcatctgacgctgagatgaatcaccgttcgtctatgagagtactgggagacgtggtacggagaccgccgatacacaggcggtcctttagtcttgaaggcttgactgggggagccggcgtgggcaataagccaagcagttctctggaagtgagtagtgctaatgcagaagagctgagacacccgttctctggggaggaaagggtcgactctcttgtgtcattgtcagaggaagacctcgagagcgaccagagagagcataggatgttcgatcagcaaatctgccatagatcgaaacagcagggcttcaattactgtacatcggccatcagctccccattaaccaaatcaattagtctcatgacaatcagccaccctgggctcgataactctcggccctttcatagcaccttccataacacctctgccaatctcaccgagtcaattacagaggaaaattacaactttctcccgcacagccctagtaagaaggactccgagtggaaaagtgggactaaggtctcacggacattctcatacatcaaaaataagatgtcttcctccaagaaatctaaagaaaaggagaaagagaaagacaaaattaaagagaaagagaaagattctaaagataaggaaaaagacaaaaaaacggttaatggccacacattcagctctattcccgtcgtggggcctatatcctgcagtcagtgtatgaagcctttcactaataaagatgcttatacttgtgctaactgctcagcattcgtccataaggggtgtagagagagtctggcatcatgcgcaaaagtcaagatgaaacagcctaagggtagcttgcaggcgcacgacacatcctccctgcccactgtgattatgagaaataagccatcccagccaaaggagagacccagatccgcagtccttctggtggatgagacagctaccacccccatatttgcgaacagacgatctcagcagagcgttagtctcagtaagtcagtcagtatacaaaatatcaccggagtcgggaacgatgaaaacatgtccaacacctggaaatttctgagccattcaacagactccctcaacaaaatcagtaaggtcaatgagtctacagagtcgctgacggacgaaggggtgggcaccgatatgaacgaaggccaacttcttggggatttcgagattgaatcaaaacagttagaagcagagtcctggtcaaggattattgattctaaattcctgaaacaacagaagaaagacgtagtcaaaagacaggaagtcatctatgagcttatgcagaccgagtttcaccatgttaggaccctcaagattatgagtggggtatattcccaggggatgatggccgatctcctgttcgagcagcagatggttgagaagctgttcccttgcctggacgaactgatttctattcactctcagttcttccagaggattctggaacgcaagaaagagtctctggtagacaagtcggagaagaactttctgatcaagcgcattggggacgtgctcgtgaaccaattcagcggcgaaaatgcagagcgtttgaaaaagacctatggcaagttctgtggccaacacaatcagtccgttaactacttcaaggatctgtatgccaaagataagaggttccaagcctttgtgaagaaaaagatgagctcctcagtcgtgaggagattgggcattccagaatgcatattgctcgtcacacagagaatcaccaagtaccctgtgctgtttcagaggatacttcagtgtacgaaagacaatgaggtcgaacaggaagacctcgcacagagcttgtccctcgtgaaagatgtaattggcgccgtggattcgaaagtggcctcctatgagaaaaaagtgaggttaaatgaaatttatacaaagacagatagtaagagcataatgaggatgaagtccggacagatgtttgctaaggaggacctcaagcgcaagaaattagtaagggatggcagtgtttttctgaagaacgcggccggtcggcttaaggaggtgcaggcggtgctgcttacagacatcctcgtgttcctccaggaaaaggaccagaagtacatcttcgcatcactcgaccaaaagtctaccgtgattagcttaaaaaaactgattgtgagggaggtggcacatgaggagaaaggcctctttctgatttcaatgggtatgaccgaccccgaaatggtagaggtgcacgcatctagtaaagaagagcggaacagttggattcaaatcattcaagacaccatcaacacattgaacagagacgaagacgaaggtatccccagcgaaaacgaggaagagaagaagatgctcgacacccgggcgagggaacttaaggagcaattacaccagaaagatcagaaaattctcctgctgctggaagaaaaggagatgatttttcgggatatggcagagtgctctactcccctccctgaagattgctcccccacgcatagtccacgcgtgctgtttcggtctaatacggaagaagctttgaaaggcgggcctcttatgaaatctgcgattaacgaggtcgagattctccagggccttgtttcaggcaacctggggggcacattaggtcccaccgtgagctccccaatagagcaggacgttgttggccccgtaagtctaccacgcagggcagaaactttcggtggatttgattctcaccagatgaacgcctccaagggaggagaaaaagaagagggagacgacgggcaggacctgcgacgcaccgagtctgactccggacttaagaagggcggcaacgctaacctagtcttcatgctgaaacggaatagtgaacaggtcgttcaaagtgtcgttcatctctacgaactgttatccgctcttcagggcgtcgttctgcagcaggacagctacatcgaagatcagaagttggtgttatctgagagggccctgactagaagcctgagccggccctcgagtctgattgaacaggaaaaacaacggtctctggaaaagcagcgccaggatctggctaacctacagaagcagcaggctcaatacctcgaagagaaacgtcgacgcgaacgggaatgggaagccagggaacgagaactgcgggagcgggaagccctgctggcacagagagaggaagaggtacagcaggggcagcaggaccttgagaaagagagggaggaactacagcagaagaaggggacctaccagtacgacctcgaacggctgcgcgctgcgcagaaacaactcgaacgagaacaggagcagttgcggagagaagcagaacgactgagtcaacggcagactgagcgcgatctttgccaggtttcccatcctcatactaaactaatgagaatacctagcttctttccgagtccagaagagcccccctcacctagcgccccgtctatagccaagtccggatccctagattctgaactttctgtgagtcccaaaaggaactctatcagcagaacacataaagacaagggtccttttcacatcctgagtagcacttcacaaaccaacaaaggtcctgagggacagtcgcaggctcctgcctctacatcagcctccacgcggctctttggactgacgaagcctaaggagaagaaggagaaaaaaaagaagaataagaccagtcggagccagccaggcgacggccccgcctctgaggtgagcgctgaaggcgaagaaattttctgctag

SEQ ID NO: 106674 - DNA, 1245 bp, Artificial Sequence
  Description of Artificial Sequence: Synthetic coding sequence
atgtcgaacacctggaaatttttgtcgcatagtactgattccctcaataagatttccaaggttaacgaatccacagagagtctgaccgacgaagggaccgatatgaatgagggccaactgttgggcgattttgagatcgaatccaagcagttagaagcggaatcctggagcaggattatagattcaaaattcttgaagcaacaaaaaaaagatgttgtcaaacgccaggaggtcatatatgaacttatgcagaccgaattccatcacgtgcggaccctgaagatcatgagtggagtttacagtcagggaatgatggcagatctgctctttgagcaacagatggtggaaaaacttttcccgtgcctcgacgagctaatatcgattcactcacagttctttcagcggatactggagcggaagaaggaaagcctcgtggacaaaagcgagaaaaatttccttattaaacggatcggggatgtcctggttaatcagttctctggcgagaacgccgagagactgaagaagacgtacggtaaattttgcgggcagcacaatcagtctgtaaactattttaaggatctctatgctaaagataagagattccaggccttcgtgaaaaaaaaaatgtcatccagtgttgtgaggagactgggaatccctgaatgtatactgcttgtgacacaaagaattactaagtatcctgtgctcttccaaagaatactccagtgcacaaaagataatgaagtggaacaggaggacctggcacagtccttaagcctggtcaaggatgtgattggcgcagttgactcgaaagtcgctagctacgagaagaaagtgcgtctaaatgagatttacaccaagaccgatagcaagagcattatgagaatgaaatccggtcagatgtttgccaaagaagacctcaagagaaagaaactggtgcgagacggtagtgtgtttcttaagaatgctgccggccgactcaaggaagttcaagctgttctgctgaccgatattctcgtattcctgcaggagaaggaccaaaaatacattttcgcttctctagaccagaagagtacagttattagcctaaagaaattgattgttcgggaggttgcacatgaggagaaaggactttttctcatctccatgggcatgacggacccagagatggtggaggtgcacgcctcatccaaggaagagaggaatagctggatacagatcattcaggacacgataaacacctag

SEQ ID NO: 106675 - DNA, 1158 bp, Artificial Sequence
  Description of Artificial Sequence: Synthetic coding sequence
atgtatgagaggcacaagcggcggtattctctatgcgacatatctaaagttgataggaccgtggacgtcgtcctcctgaagattaatagggagaattggtgcaccatagaaccctgtcccgatgctgcgtctctacttgcctccaagcagagcccagagtgtgagaactttctggatgtggggctgggcagagagtgcactagcaagcagggggtgttgaaaagagaaagcggatctgactccgacctctttcactcgccttctgatgacatggactcaataatcttccccaaacctgaagaggaacacctcgcttgcgatatcacaggttcttcatcttcgaccgacgacaccgcttccctggatcgccactccagccacggctcggacgtgtccctgagtcaaattttaaagcccaacaggtcccgagatcgccaatccctggacggattctacagtcatggaatgggagccgaggggcgggagagcgaatctgagccggctgatcctggtgacgttgaggaggaggaaatggattcaatcacagaagtgcccgcaaattgcagtgtgctgagaagctcaatgcggtcactgtccccatttcggaggcattcatgggggccaggtaaaaatgctgcatctgacgctgagatgaaccatagaagcttttccttggagggtctaacgggaggagccggagtcgggaataaaccttctagcagtctggaagtttcttcagctaatgctgaagaactccggcaccccttctcgggggaagagagggtcgattccctggttagcctgtcggaagaagatcttgaaagtgaccagagagaacacagaatgttcgatcagcagatctgccaccgttctaagcagcagggattcaactactgtacaagcgctatctcatctccccttacgaagtcaatcagcctgatgactatatcccaccctgggttggataattcgaggccctttcatagcacttttcataataccagcgctaacctgaccgagtctattaccgaggagaattataacttcctcccccactccccctctaaaaaggacagcgagtggaagtcagggactaaagtgtctagaactttcagttacataaaaaacaaaatgtcaagctccaagaagtctaaatag

SEQ ID NO: 106676 - DNA, 8379 bp, Artificial Sequence
  Description of Artificial Sequence: Synthetic coding sequence
aagctgctggagaagcagccacctattgaaggtgactgtgtggtgaccgtcctgcttgccgaggaagacaaagccgaagatgacgtagtgttttacctggtcttcttaggctctacactgagacattgtacctctacccggaaagttagcagcgatacattagagaccattgcacccggccacgattgctgcgagacagtgaaggtgcagttatgtgcgtccaaggagggccttcccgtatttgtggtcgccgaggaagactttcatttcgttcaggatgaagcctacgacgctgctcagtttctcgctacctctgctggaaaccaacaggccctgaattttaccaggttcctcgaccagtccggcccgccctctggggatgtcaactcgctggacaagaaactggtgttggcttttcggcacctgaaacttcctaccgagtggaacgtgttaggtactgaccagagtctgcacgatgctggacctagggagaccctcatgcacttcgccgtaaggctggggctactgcgcctaacgtggtttttactacagaagcctggagggcggggagccctttcaatccataaccaggagggggccaccccagtttccttggccttagaacgaggttaccataaactccaccaactactgactgaagaaaacgctggagagccggactcctggtcaagcctttcctatgaaattccttacggcgactgctctgtgagacatcatagagagcttgacatctataccctaacaagcgagtctgacagccaccacgaacacccattcccgggcgatggctgcaccgggcctattttcaaacttatgaacattcaacagcagttgatgaagaccaacctgaaacaaatggacagcttgatgccattgatgatgacagcgcaagacccatccagtgcgcccgaaaccgacggtcagtttttgccttgcgctcctgaacccaccgatccccagagactctcatctagcgaagagaccgaatccacccagtgctgccctggcagtcctgtcgcccaaacggagtcaccttgtgatttaagttcgattgtggaggaagaaaataccgaccgttcatgccgtaaaaagaacaaaggagtcgagcgaaaaggcgaggaagtcgaaccagctccgatcgtggacagtggcactgtgtcggaccaagatagttgcctccagagtctccccgattgcggcgtgaagggaaccgaggggctctctagctgtggcaaccgcaacgaggagaccgggactaagtcctctggcatgcctacagatcaggagtccctgtcttcaggagatgctgtcctgcaacgcgacttggtgatggagcctgggaccgcgcaatatagctccggaggagagctgggcggaataagcacaaccaacgtttctactccggacacggccggggaaatggaacacggtttgatgaatccagacgcaactgtctggaagaacgtgctgcagggcggcgagtcgactaaggaaagatttgagaatagtaatatcggcactgcgggagccagcgatgtacacgtaacctctaagcccgtggataagatctccgtccccaactgcgcccctgccgcatcctccctggatggcaacaaaccagctgagtcgagcctcgccttcagcaacgaggaaacctcaactgaaaagaccgctgaaaccgaaacatctaggtctcgagaagaaagtgctgacgccccggttgatcagaattccgtggtaatcccagccgccgccaaagataagatcagtgatgggctcgagccttacactctccttgccgctggtataggagaagctatgtcgccgtccgatctggccctcctaggtctggaggaagatgtgatgcctcaccagaatagtgagaccaattcctctcacgctcagtcccagaaaggcaaatccagccccatttgctcaaccaccggtgacgacaagttatgcgctgattccgcctgccagcaaaacaccgttacatctagtggcgacctcgtggctaagctctgcgacaacatcgtatcagaaagtgagagtaccactgccaggcagcccagttcacaggatcccccggatgcgtcacactgcgaggatcctcaggcacatacggtcaccagcgaccctgttcgggacacccaggaacgtgccgatttctgcccttttaaggttgtggataataaaggtcagagaaaggacgtgaagctggacaagccgctgacaaacatgctggaagtagtgagtcacccgcacccagtggtgccgaaaatggaaaaagagctagtgcccgatcaggcagtcatctcagattccactttcagcctcgccaacagtccaggatcagagtcggtgaccaaggatgacgctctgagctttgtacctagccaaaaggaaaaagggaccgctacacctgagcttcatacagctacagactacagggacgggccggacggaaattctaacgagccggacactaggccgctcgaggatcgcgcggttggccttagtacttcctccaccgctgccgagcttcaacatggcatgggcaatacttcactcaccggactcggtggagaacatgaggggcctgcgccaccagcaattcccgaggcactgaacatcaagggaaataccgacagcagcctgcaatccgtaggaaaggccacacttgccctcgatagcgtgttgaccgaagagggcaaactactggtggtgtccgaaagcagtgctgcccaggagcaggataaagacaaagccgtgacatgttcatcgatcaaggaaaacgctctgtcctccgggacgttacaagaagaacagcggaccccaccacctgggcaggacacacaacagtttcacgagaagtccattagcgccgattgtgcgaaagacaaggccttacagctgtcgaattcgccaggcgcctcctcggccttcctaaaggccgaaacagagcacaataaggaggttgcccctcaggtgtcactgcttactcaagggggagccgctcagagtttggtgccacccggcgcgtctctcgctactgagagtagacaggaggcccttggagcagagcacaacagttccgcccttctgccttgtctgctgccagacggtagcgatggcagcgacgcactcaattgttctcagccatcccctttagatgtgggcgtgaaaaacacccagagccagggcaaaacttcagcgtgcgaggtgagcggcgatgtgactgtggatgtgaccggggtgaatgctctccaaggtatggccgagccccggagggagaacatcagtcacaatactcaggatatcctgatccctaatgtgttgttgagtcaggagaaaaatgcagtgttgggactgcctgtggccctgcaagataaggcagttaccgatcctcagggcgtggggaccccagaaatgatccccctggattgggaaaagggcaaactagagggcgcagatcactcctgcacaatgggggatgccgaggaggcccagattgacgatgaagcgcatcctgtgctgctacagcctgtggctaaagagctgcccactgacatggaactgtccgctcacgacgacggtgctcccgccggggtgcgagaggttatgcgagcccctccgtctgggcgggagcgcagtactccttccctcccgtgtatggtctctgcccaagatgcccctctccccaagggcgccgaccttattgaggaagcagccagcaggattgtggatgccgtgatagagcaggtcaaggcagccggagctctgctcaccgagggggaagcatgtcatatgtcactgtccagtccggaactcggccctctgaccaaggggctggagtccgccttcaccgagaaggttagcactttccctcctggagagtcactgcctatggggtccaccccagaagaagccacaggaagcctcgccggatgctttgccggacgggaggagcctgagaaaattatcttgcccgtgcaggggcctgagccggccgccgaaatgccagatgttaaagccgaggacgaagtcgactttcgcgccagtagtatctcagaggaggtggcagtcgggagtatcgcagctacactcaagatgaaacagggacctatgactcaggcgataaatcgcgagaattggtgcactattgaaccttgtcccgatgccgcctccctgctagcctctaaacaaagtcccgaatgcgaaaacttcctggacgtggggcttggtagagagtgtacgagtaagcagggggtgctgaaacgcgagagcggaagcgactctgatctgttccacagtccctctgacgatatggactctattatcttccctaagcccgaggaggaacatctagcctgcgatattactggatcgtcgtctagcacagatgacacagcgagcctggatagacactctagccacggctcagatgtgagcctctcgcagatactcaagcctaacagatccagagatagacaatctcttgacggattttattcccacgggatgggtgccgaaggtagggagagtgagtccgaaccagcagaccccggtgatgttgaagaggaggagatggacagtataactgaggtgcccgctaattgcagcgtactccgctcatccatgagatccttatctccttttcgacgacatagctgggggccggggaagaatgccgcctccgacgctgagatgaatcaccggagcttttccctcgagggactgacaggaggcgcaggggtgggtaataagccatcaagttctttagaggtatcgtcagcaaacgctgaggagcttagacatcctttttctggagaggagcgggttgattccttagtcagtttaagtgaggaagacctcgagtctgaccagcgcgaacatcgcatgttcgaccagcaaatctgtcaccgttctaaacagcagggcttcaactactgcacttctgcaatttcatcacctctcacaaagtcaatcagtctgatgactatcagccacccggggctagataacagtcggccatttcattctacctttcataacacttcagctaacctaaccgagtcaatcaccgaagagaactacaatttcctgccacatagtccctctaagaaagactcagagtggaagagtggtacgaaggtgagcagaactttctcatatatcaagaacaagatgtcgtctagtaagaaatccaaggagaaggagaaagagaaggacaaaatcaaagagaaggagaaagactcaaaagacaaggaaaaagataaaaagaccgtgaacgggcatactttttcatccatcccagtcgttggccctataagttgtagccagtgcatgaaacccttcactaataaagatgcctacacgtgcgccaactgctccgccttcgtgcataaagggtgcagggagagtcttgctagctgcgccaaagtaaagatgaagcaacccaagggaagtttgcaggcacatgatacatctagtttgcctacagtgatcatgagaaacaaacccagccaaccaaaggagaggcctaggagcgctgtgctgcttgtggacgagactgccactactccaatttttgccaaccggcgctcacagcagagtgtctctttgtccaagtcggtcagtattcagaacattactggagtgggaaatgatgagaatatgtctaacacatggaaatttctgagtcactctactgatagtttaaataagatcagtaaagtgaatgaatccactgaatctctcaccgacgagggcactgacatgaacgagggacagctgctgggagatttcgagattgagagcaaacagctggaggccgaatcctggtcccgaatcatagatagcaaattcctgaagcagcagaaaaaagacgtcgttaagagacaggaggtaatctatgagcttatgcaaactgaatttcaccacgttcgtactctgaagattatgagtggagtctactctcaggggatgatggccgacctgctcttcgaacaacagatggtggagaagctgttcccttgtcttgacgagctgatatccatccactctcagttcttccaaaggatcctcgaacgcaaaaaagagtccctagttgataagtctgagaagaacttcctgatcaagcgcataggcgacgttttggtgaatcagtttagcggagagaatgccgagcgactgaagaagacttacggcaaattttgtggccaacacaatcagtctgtcaattactttaaggacctgtatgctaaggacaagcgattccaggcatttgtaaagaagaagatgtcttcttctgttgtgaggcgactaggtattccagagtgtatcttgctggtaacacagcgtataacaaaatacccagtgttgtttcagcgaattctccagtgcaccaaggataacgaggttgagcaagaggatcttgcccagtcattgtcgctggtgaaggacgtgataggagccgtggatagcaaagtggcatcttacgaaaaaaaggtgcgcctgaacgagatttacactaagacagattcaaaaagtattatgcgaatgaaatctggccagatgttcgctaaggaggacttaaaacggaaaaagcttgtcagagacggtagcgtgttcttgaagaacgccgcagggcgcctgaaggaagtgcaggcagtactgctcaccgatatcctcgtcttcttacaagaaaaagaccaaaagtatatctttgctagtctcgaccagaagtcgacagttatcagcctcaaaaagctgatagtgcgggaggtagcccatgaggaaaaaggcctgttcctaatcagtatgggaatgactgatcccgaaatggtggaagttcatgcttcctctaaagaagaaaggaactcgtggatccagattatccaagatacgatcaataccctcaacagggatgaggacgaggggatcccctcagagaacgaggaggagaaaaagatgctggacactagggcccgcgaattgaaggaacagcttcaccagaaagatcagaagatcttactgctcctcgaggagaaagagatgatctttcgagatatggctgaatgttcaacacctctccccgaagattgttcccccactcacagcccaagggttctatttagatcaaacaccgaggaagccttgaaaggaggtccactgatgaagtctgcgattaatgaagtggaaatcctgcagggactggtgtcaggtaatctaggtgggaccttgggcccaactgtgtcaagtcctatcgagcaggacgtggtcggtcccgtttctctgcctaggcgcgcagagacctttggaggcttcgactcgcaccagatgaatgcttccaaaggaggggaaaaagaggaaggggatgatggccaggacctgcggcgtaccgagagtgactctggattgaagaagggcggaaacgctaacttggtcttcatgctgaagcgaaactcagagcaggttgtgcagtcggtcgttcatctttatgaactgctgagtgctctccagggagtcgttcttcagcaagattcgtacatcgaggaccagaagctggtacttagcgagcgtgctcttacccggtcactctcaaggccgtcaagcttaatcgaacaggagaagcagcggtctttggagaaacaaagacaagacttagccaacctgcagaagcaacaggctcagtatctggaggaaaaacgcaggcgggaacgggaatgggaggctcgagaaagagagctgagagaacgagaggcactcttggcccagcgcgaggaagaggtgcagcagggccagcaagacctcgagaaggaacgggaggaattgcagcagaaaaaaggaacctatcagtacgaccttgagagactgagagcagctcagaaacaattggaacgggaacaggaacagctgaggagagaagcagagaggctttcccagcgccagaccgagcgggatttgtgtcaggtgtctcatccccacaccaaactgatgcgcatcccctctttctttccttccccggaggagccaccaagcccctctgcaccttcaattgcgaaaagcggcagcctggattccgaactgagtgtgagtccgaaacgcaacagcattagccggacacacaaagacaaggggcccttccatatcctttcttccacttcgcaaaccaataagggtcctgaaggacagtcgcaggccccagctagcacttccgcgtccacacggttatttggcctcacaaagccaaaagagaagaaggaaaagaagaaaaagaataagactagtaggtctcagcccggcgacgggcctgccagtgaggttagtgccgagggggaggaaatcttctgttag

SEQ ID NO: 106677 - DNA, 5238 bp, Artificial Sequence
  Description of Artificial Sequence: Synthetic coding sequence
atgaagctgaatcctcagcaggcacccctctacggggattgcgtggtgactgtcctgctggccgaagaagacaaggccgaagatgatgtggtgttctatctggtcttccttggatcaaccctgagacactgcacatccactcggaaggtctcctctgacaccctggagacaatcgccccaggtcacgactgctgcgaaaccgtgaaagtgcagttgtgtgcaagtaaggaagggctgcctgtgttcgttgtcgcagaggaagacttccacttcgtccaagatgaagcctatgatgccgctcaatttctagcaacatctgctggaaatcagcaagcactgaatttcacccggttcctcgaccagtcaggtccaccttccggtgatgtgaactctctggacaagaaactggtgctggcctttcgccacctgaaactcccaacagagtggaatgtgctgggcacagaccaaagccttcacgacgctgggccgcgggaaacattgatgcacttcgccgtaaggctgggcctgctgcgactgacctggttcctgctccagaaacctggagggcggggcgccctctccatccataaccaagagggagcaacaccagtgtctctggcattagagcgggggtatcataaacttcaccaattgctgaccgaagaaaacgcaggagagccagactcatggagctcgctgtcctacgagattccatacggcgactgtagtgtccgccatcacagggagctggatatctacacattaactagcgagtccgattcgcaccatgagcatcccttccccggcgacgggtgcaccgggcctatctttaaactcatgaacatccagcaacaactgatgaagactaatctgaagcagatggattcactcatgccgctaatgatgactgctcaggatccttcatccgcccccgagaccgacggtcaatttctgccttgtgcccctgagccaaccgatcctcagcgactgtcttccagcgaggagactgagagtactcagtgctgccctgggtccccagtggcccagacagaatccccctgcgaccttagctcgattgtcgaagaggaaaatacagacagatcgtgccgaaagaaaaacaagggagtggagcggaagggcgaagaggtggaacctgctccgatcgttgactccggcacagtctctgatcaggacagttgcctgcaaagtctcccggactgcggtgtgaaagggaccgaaggcttgagctcttgcggaaaccgcaacgaggagacaggcaccaaatccagtggaatgccaacagaccaggagtctcttagcagtggagatgcggtgctgcagagggatctagtcatggaacctggtaccgcacagtactcctctggcggagagctcggggggatttctaccaccaatgtgagtacccccgacacagccggagaaatggagcacggcctgatgaatccagacgccactgtctggaaaaacgtcttgcagggcggagagtctactaaggaaagattcgaaaactcgaacatcggtaccgcgggcgcctccgatgtgcacgttacttccaagccagttgacaaaatctctgtgcccaactgcgcaccagccgcttccagccttgatggaaacaaacctgcggaaagcagcctcgccttctcaaatgaagaaaccagcaccgagaagactgcagagaccgaaacatctagaagtcgggaggagagcgccgatgccccagttgaccagaactcggtggtcataccagcggcagctaaagacaaaattagtgacggcctcgaaccgtacacactgctggccgcaggcattggggaagctatgtctccttccgatctggctctgctggggttagaggaggacgtaatgccgcatcagaactcagaaaccaattcttctcacgcccagtcccagaaaggcaagagcagccctatctgttctactacgggcgacgataagctgtgcgccgacagtgcctgccagcagaatacggtcacatcatcgggcgatctcgtggccaaactctgcgataacattgtgagtgaatccgagagtacgacggcaagacagccatcctctcaagatcccccggatgcatcccactgtgaggatccccaggctcacactgttacctctgatcccgtgcgggacacacaggagagagctgacttttgtccatttaaagtggttgataacaaagggcagagaaaggacgtgaagctcgacaaaccgctgaccaacatgctggaagtggtttcgcaccctcatccagtcgtacctaaaatggagaaagagctggtccccgaccaagcagtgatcagcgactcaacattctccctggcaaattcccccggttcggagagcgtgactaaggatgacgcacttagcttcgttcccagccagaaggaaaaaggtaccgctacacccgagctgcatacagctaccgactatcgcgacggacctgacggcaattccaatgaacctgacaccaggccactggaggatcgtgcagtggggctgagcacctcttccacagctgccgagttgcaacacggcatgggtaatactagcctgacagggctgggcggggagcacgagggcccagcccccccggcaatacctgaagccctaaatattaaaggaaacaccgattcctctctgcagtcagtgggtaaggctaccttggccctggacagcgtacttactgaagaaggaaagctgctggtagtgtctgaatcaagcgcagcgcaggaacaggataaagacaaagccgtaacatgctccagcattaaagaaaatgcactgagtagcggtactctgcaggaagagcagcgaacaccaccacctggacaggatacccagcagttccacgaaaaaagcatttctgccgactgcgcaaaggataaggctctccagctatctaattcccccggtgcaagcagtgctttcctgaaagccgagacagagcataacaaggaggtcgccccgcaggtttccttgctgacgcaaggtggagcagctcaaagcctcgtgccccccggtgcgtctctggctaccgagagcaggcaggaagccttgggggctgaacataacagcagcgccctcctcccgtgtctccttcccgatggcagtgacgggagcgacgcattgaactgttcacagccttctccgctcgatgtcggtgtgaagaatacccagtcccaagggaagacatcagcctgcgaagtgtccggcgatgttaccgtcgacgttactggggtgaatgccctacagggaatggccgagcctagacgggaaaatatctctcataacactcaagacattttgatacctaatgtgttactgagccaagagaagaacgccgtgctcggactccctgtggccctgcaagacaaggccgtgacagaccctcagggcgtgggaaccccagagatgatacctttggactgggagaaggggaagctggaaggcgctgatcactcgtgtaccatgggcgacgccgaagaggcgcagatcgacgacgaggcccaccccgtccttctgcagccagtcgcaaaggagctgccgactgatatggagttgagtgcacatgacgatggagcccctgccggggtgcgggaagtgatgagggccccaccttctgggcgtgaaagatctacaccttccctgccctgcatggtgtccgcccaagatgccccactgcccaagggtgcagacctcattgaagaagctgcctcccggatcgtcgacgctgtgattgaacaggtgaaggcagccggagctctgctgaccgagggtgaggcttgtcacatgagcctgagtagtccagagctaggacccctcacaaagggtttggaatccgccttcaccgagaaagtgtccacctttccaccaggtgaaagcctgcccatgggatctacgccggaagaagcgaccggcagcctggctgggtgcttcgccggccgagaggagcccgagaagatcatcctgcctgtgcaggggcccgaaccggccgcggagatgcccgatgtgaaagcagaggacgaggtcgactttcgggccagtagcattagcgaggaagttgcagtgggcagtatcgctgcgacacttaagatgaaacaggggcctatgacgcaggcaatcaaccgcgagaattggtgcaccatcgaaccttgccccgatgcagcttccctgctggcatctaaacagagcccggaatgcgaaaatttcttggacgttggactgggcagagagtgcactagcaaacagggcgtgctgaagagagaatccggaagcgattccgacctgttccattcaccctccgacgacatggattccattatattccccaaacccgaggaagagcacttggcctgtgatatcacgggtagcagctcatctacagatgacacagctagcctcgaccgccactccagtcacgggtccgatgtgagcctgtcccagatcctgaaacccaatcgaagtcgcgatcgacagtctctggatgggttctatagtcacgggatgggtgccgaagggcgcgagtctgaaagcgaaccagcagatcccggggacgtcgaggaagaggagatggacagcattacggaagtgcctgctaattgctccgtgctacgtagctctatgcgctctctcagcccctttcggaggcactcttggggtccagggaaaaatgctgcatcagacgcagagatgaaccaccgatccttcagtctcgaaggactgacaggaggtgctggcgtgggcaataagcccagttcctctttggaagtgtcatcagccaatgcagaggaactccgacaccccttttcaggagaagaaagagtcgactcactggtcagccttagcgaagaagacctggagagtgaccagcgggagcaccgcatgttcgaccagcagatctgtcaccgatctaaacagcagggcttcaattattgtacgtctgcgatcagctcccctttgacaaagtctatttcccttatgaccatcagtcaccctggtctggacaattcccgcccattccactccacttttcacaatacgagcgctaacctgactgaatcaatcacagaggagaattataacttcctgcctcattctccttcaaagaaggattcggaatggaagtctggtaccaaggtgtctcggacattttcctatattaagaacaagatgtcaagctcaaagaagtcaaaatag

SEQ ID NO: 106678 - DNA, 828 bp, Artificial Sequence
  Description of Artificial Sequence: Synthetic coding sequence
ccatccgatgacatggacagcataatcttccctaagcccgaggaggagcatcttgcatgtgatattacaggcagcagcagctctactgatgataccgccagtctcgatcgacattcttcccacggatccgatgtttccctctctcagatccttaagcctaaccgctcgcgcgatagacagtctctggatggcttctactcccacgggatgggcgccgaaggccgggaatccgaaagcgaaccggcggaccctggagacgtggaagaggaggaaatggactcgattacagaggtgccagcaaattgctctgtgctgagatccagcatgcggtctctttctcctttccgaaggcattcttggggacccggaaaaaacgctgcatcagacgccgagatgaatcaccggagtagcatgagagtgctgggagatgtggtcaggcggcctccgatccacagaaggagcatgtcatggtgtccatctggagtgcagtactccgcagggctgtccgcagactttaattataggtccttctccctggagggacttactggtggggcgggcgttgggaacaagccatcctccagcctcgaggtatcaagtgcaaacgcagaagagctccgccacccgttctcaggcgaggaacgcgtggacagccttgtttctttgtccgaagaggatctggagagtgatcagcgggaacatcgcatgtttgaccagcagatttgccatagatctaagcagcagggatttaactactgtacttccgccatctcttcccccctgactaagtcgatctcactcatgacgataagccaccctgggttatag

SEQ ID NO: 106679 - DNA, 117 bp, Artificial Sequence
  Description of Artificial Sequence: Synthetic coding sequence
atgaagctcaatcctcagcaagcccctttatacggcgattgcgtcgtaactgtgttgctggccgaagaagataaagccgaggatgacgtggttttttatctggtctttctgggatag

SEQ ID NO: 106680 - DNA, 540 bp, Artificial Sequence
  Description of Artificial Sequence: Synthetic coding sequence
atgaagctaaatccacaacaggcgcctctgtatggcgattgcgtagtgacagtgctgctagccgaagaggataaggctgaggacgacgttgtgttttatttggtgtttctggggagcacgctgcgacactgtacctctacaagaaaagtcagcagtgacacactggaaaccattgcaccgggtcacgactgttgcgaaaccgtgaaagtacagctgtgcgcctccaaggagggtctgccagtgttcgtcgtcgccgaggaggactttcacttcgtgcaggacgaggcttacgatgcggcccaatttttagctacctcggctggaaaccagcaagcgctcaacttcactcgatttctcgaccagagcggtcccccatcaggcgacgtgaacagcctcgacaagaaacttgtactggcttttaggcacctcaagttgcctaccgagtggaacgtgctgggtactgatcagagcctgcatggcgagaatctgtacgacctccagacacacttcaagttcgtgatatttctcttgttcttctag

SEQ ID NO: 106681 - DNA, 414 bp, Artificial Sequence
  Description of Artificial Sequence: Synthetic coding sequence
atgtcagaaacccagaacagtacatcccagaaggccatggatgaggataataaagccgcttcacagaccatgcctaacacgcaggataagaactatgaagatgagctgacccaggttgccttggctcttgtcgaggatgttattaactatgccgtgaaaatcgtggaagaggagcgtaatcctctgaaaaacatcaagtggatgacccacggggagtttactgttgaaaaagggttgaaacaaatcgatgaatatttctcggatgctcctatagtggtctcttacgttggggatcaccaggctctggtgcaccgacccgggatggtcaggtttcgggagaattggcaaaagaacttaaccgacgcgaaatactctttcatggagagcttcccgtttctattcaatcgggtttag

SEQ ID NO: 106682 - DNA, 270 bp, Artificial Sequence
  Description of Artificial Sequence: Synthetic coding sequence
atgtctgagacccagaactcgacaagtcagaaggcaatggatgaggacaacaaggccgccagccagacaatgccgaacactcaggataagaactatgaagatgaactaacccaggtcgctcttgctttagttgaggacgtgattaattacgctgtgaaaatagtggaggaggaacgcaatcccctgaaaaacatcaagtggatgacccatggggaatttacagtggaaaaagggttaaagcagatcgacgagtatttttccgtgtcttag

SEQ ID NO: 106683 - DNA, 417 bp, Artificial Sequence
  Description of Artificial Sequence: Synthetic coding sequence
atgtcagaaacacagaatagtacctctcaaaaagcgatggacgaagataacaaggcagcttctcagacaatgccaaatacacaggataaaaattacgaagatgagctgacccaggtagccctggcactggtggaagacgtgatcaactatgccgtgaagattgtggaggaggagaggaatcctctcaaaaacatcaaatggatgactcacggcgagtttactgtggagaagggactgaagcagattgacgagtactttagccccgatgcgccgattgttgtgtcatatgtcggtgaccatcaggccctggtgcatcgcccaggcatggtacgattcagagaaaactggcaaaagaatctgaccgatgccaaatactcatttatggaatcctttcccttcctatttaatcgcgtttag

SEQ ID NO: 106684 - DNA, 414 bp, Artificial Sequence
  Description of Artificial Sequence: Synthetic coding sequence
atgagtgagacacagaactccacgagtcaaaaagcaatggacgaagacaataaggctgcaagccaaactatgcccaacacacaagacaagaactatgaggacgagctcacacaggtggccctcgccttggtggaggacgtgatcaactatgcagtgaagatcgttgaggaggagagaaatccgctgaaaaacatcaagtggatgacccacggcgaattcacagtcgaaaaaggcctgaagcagatcgacgaatattttagtgacgcccccatagttgtgagttatgtgggcgatcaccaggcgcttgtgcatcgaccagggatggtgcgatttcgcgagaactggcaaaagaatctgactgacgcgaagtacagtttcatggagagcttccccttcctctttaacagagtgtag

SEQ ID NO: 106685 - DNA, 594 bp, Artificial Sequence
  Description of Artificial Sequence: Synthetic coding sequence
atgtctgagactcaaaactctacttcccagaaggcgatggatgaagacaacaaggccgctagtcagacaatgcccaatactcaagataaaaattatgaagacgaattgacccaggtggctcttgctttagtggaggatgtgatcaattacgctgtgaagatagtggaggaagagcggaatcccttgaaaaacattaaatggatgacacatggagagtttaccgttgaaaaagggcttaagcagattgacgagtacttttccaagtgtgtctctaagaagtgctgggcacatggagttgagtttgtggaaagaaaggacctaatccacagttttctgtatatatactatgtgcattggtcgatctctacagccgatctccctgtcgccaggattagtgccggaacatacttcacaatgaaggtttctaaaactaaaccaccagacgcacctattgttgtttcttatgtaggagaccatcaggctctggtacaccgcccaggcatggtacgttttcgcgagaattggcaaaaaaacttaacagacgcaaagtattccttcatggaatcatttcccttccttttcaacagagtgtag

SEQ ID NO: 106686 - DNA, 270 bp, Artificial Sequence
  Description of Artificial Sequence: Synthetic coding sequence
atgagcgaaacccagaatagcacgagtcagaaggccatggacgaagataataaagcagctagccagactatgccgaatacccaggacaagaactacgaagatgagctgacacaggtcgcactcgcactggtcgaagacgttattaattacgctgtaaagattgtggaggaggagcggaacccactcaagaacattaaatggatgacccacggtgagtttacagtcgagaagggcctcaagcagattgatgagtacttcagcgtctcctag

SEQ ID NO: 106687 - DNA, 2088 bp, Artificial Sequence
  Description of Artificial Sequence: Synthetic coding sequence
atggccgctgctaccatcgtccatgacacttcggaagctgtcgagctgtgcccggcttatgggctatatttgaagcctatcacgaagatgactatttctgttgccctgcctcagctcaagcaacccgggaaaagtattagcaactgggaggtgatggaacggctgaagggcatggttcaaaatcatcagttttcaactctacgcatttcaaagagtaccatggatttcatacggttcgaaggtgaggtcgagaataaaagtctagtgaaaagtttcctggcctgcttggacgggaaaacgatcaagctgtccggcttttctgatatactcaaagtacgggccgcggagttcaaaatcgactttcccactaggcacgattgggattcctttttcagggacgctaaagatatgaatgaaactctacctggcgagaggcctgataccatccaccttgaaggactgccctgcaagtggttcgcactgaaagagtcggggagcgaaaagccgagcgaagatgtgcttgttaaggttttcgagaagtttggagagattaggaacgtggacatcccaatgctcgacccttaccgggaggagatgaccggcagaaactttcacactttcagctttggtgggcacttgaatttcgaggcttatgttcagtacagagagtatatgggtttcatacaagctatgagtgctttgaggggtatgaagcttatgtataagggtgaagatggcaaggcggtggcatgcaacataaaggtgtccttcgatagtaccaagcacctgtctgacgcaagcatcaagaaaaggcaattagaacggcaaaaactgcaggagctggaacagcaaagggaggagcagaaacgacgtgaaaaagaggcagaagagcggcagagagcagaggagaggaagcaaaaagagctggaggaactcgagcgcgagagaaaacgtgaagaaaaactgagaaaaagggaacagaaacagagagaccgagaactaaggaggaaccagaagaaattggagaagcttcaggccgaggagcagaaacagctgcaggagaaaattaaattggaggagcggaagctacttctggctcaacggaacctgcagagtataaggctgatcgccgagcttttgtctcgcgcaaaggccgtgaagttgagagaacaagaacaaaaagaggagaaactgaggctccagcagcaggaggagcgacggcgattgcaggaagccgagctgagaagggtggaggaagagaaagagcgcgctttagggctgcagcgaaaggaacgcgagctacgggagcgactgttaagcatcctgttatcaaaaaagcctgacgatagtcacacccacgacgagttgggggtggcacatgccgatttgctccaacctgttcttgatatcctgcaaacagtgagttccggctgtgtgagcgctaccaccctgcaccctctgggcggccagccccctgccggcgctcccaaggagtcccctgcccacccagaggccgacggagcaccgaagtcagttaatggaagcgtcgccgaggaggccccatgcaaagaggtgcagtcgagctgcagggtcgtgcctgaggacggctcccccgagaagcggtgcccgggtggagttttgagctgcatccctgacaacaaccagcagcctaaaggcatacctgcctgtgagcaaaatgtcagcaggaaggatacaaggtccgaacaggataagtgtaatagggagccttcaaaggggcgtggtcgtgcaactggagatggcctggctgacaggcacaagcgggagaggtcaagagcaagacgggctagttctcgggaagatggcagaccaagaaaggagaggaggccacataagaagcatgcatacaaggatgacagccctcggcgccgtagcacgtctccagaccataccaggtcacggaggagccattctaaagacaggcacagaagagagagaagtagggaacgtcgaggaagtgcgagtagaaaacacagtcgacatcggagaaggagcgagaggagccggtcaagaagtccgagccgacataggagcacttggaatcgctag

SEQ ID NO: 106688 - DNA, 1341 bp, Artificial Sequence
  Description of Artificial Sequence: Synthetic coding sequence
atggcagctgcgacgatcgtgcacgacacttccgaggccgtcgaactctgtcccgcatacggactttatctgaagccaataaccaaaatgaccattagtgtggctcttcctcagcttaaacagccgggaaaatctatcagtaattgggaggttatggagaggctgaagggcatggtgcagaaccaccagttctctacattgcgaatcagtaagtcgacgatggacttcatccgttttgagggtgaagtggaaaataagtctttggtcaaatcgttcctggcttgtctcgacgggaaaacaattaagctatcaggcttctccgatatcctgaaggtgagagcagctgagtttaagattgacttcccgacacgacacgactgggacagcttttttagagatgcgaaggacatgaatgagacccttccaggagagcgacctgatacaatccatctggagggattgccctgcaagtggttcgccctgaaggagagtggaagtgagaagccgagcgaagatgtcctagtaaaggttttcgaaaagttcggagaaatccgcaatgtcgacattccgatgctggatccctacagggaggagatgactggcaggaactttcacactttcagctttggtgggcacctgaactttgaggcttacgtgcaataccgggaatatatgggatttattcaggctatgtctgcgctccgggggatgaaactcatgtacaagggagaagatggaaaagcagtagcgtgcaacattaaagtctcttttgactccacgaaacacctgtcagacgcatcgatcaaaaaacggcaattggagcggcaaaaactgcaggaactggagcagcagcgagaggagcaaaagagacgcgagaaggaggccgaggaaagacagcgcgctgaagagaggaaacaaaaggaactcgaagaactggaacgggagaggaagagagaagagaaactgcgaaaacgcgagcagaaacagagggacagggagctgcgcaggaaccagaagaagctggagaaacttcaggctgaagagcagaaacagttacaggagaagatcaagctcgaagagagaaaactgcttctcgctcaacggaatttgcaaagtattcgcctgattgccgaactgctgtctcgcgctaaagtgccaggaggctcgttgtgctccaggcagcccaggcccggttgtcctcagtgcccccccctcaagtgtggccgacgccacggggccgtgtcgcccccagctgcagcagtcgccaccaaacctgccctcatgccgaggatgacggctcccagccgcgaaggcgtggctcttgtgtgtaggtccaggtag

SEQ ID NO: 106689 - DNA, 2580 bp, Artificial Sequence
  Description of Artificial Sequence: Synthetic coding sequence
atggaaattgaagtttctgtggccgaatgtaaaagcgtgccaggcattaccagtacaccgcaccccatggatcacccttccgctttttactcgcctccccacaatgggctgcttaccgaccaccatgaaagtctggacaacgacgtggcccgggagatccggtatctcgatgaggtactggaagccaactgttgcgattccgccgtcgatgggacttataacggcaccagcagtcccgaaccaggtgctgttgtgctagtgggtggcttgtcgccacccgtccacgaagccactcagcccgagccaacagagaggacagctagccgacaggctccaccccacatagagctcagcaacagtagccccgatcccatggccgaagcggagaggacaaacggccattcaccctcccaaccccgagacgccctcggcgattcattgcaggtgcccgtgtcaccctctagcaccactagcagcagatgtagcagcagagatggcgaattcacactcacaacactgaaaaaggaggctaaattcgagctcagggcctttcacgaggacaaaaaacccagtaagctgttcgaagacgacgagcacgaaaaggagcagtattgcatccggaaagtccggccaagcgaagaaatgctcgagctcgaaaaggagcgcagggagcttatccgctcccaggctgtcaaaaagaaccccgggattgcagccaagtggtggaaccctcctcaagaaaagacaattgaggaacagctcgacgaagagcatttggaaagccacaaaaagtacaaggaaaggaaggagagacgggcccagcaggaacagcttctgctgcaaaagcaattacagcagcagcagcagcagcctccctcgcagctatgtactgcccccgcatctagtcacgaaagggcctctatgatcgataaagctaaagaagatatcgtcacggagcagattgatttctctgccgcccgtaagcaattccagctaatggaaaatagtcgtcaggctgttgccaaaggtcaatccacaccccgcctgttctctatcaaacctttctaccggcccctcggctcagtgaattccgataaacctctcacaaatccccgtccacccagtgtcggggggccccccgaagatagcggtgcgtccgctgccaaggggcaaaaatcacctggtgccctggagacacctagtgccgccggcagccaggggaataccgcttcccaaggtaaagaaggaccttattctgaaccctccaaaaggggccctctgtctaagctctgggctgaggacggcgaattcacatctgcgcgggctgtgcttactgttgtgaaggacgatgaccacgggatcctcgatcagttttctaggtccgtgaatgtgagtctgacgcaggaggagctggactcgggcctggacgagctcagcgtccgtagccaagatacaaccgtcctggagactctctcgaatgacttctctatggacaacattagcgactccggggcttcaaatgagactacgaacgctcttcaagaaaactcgctggctgatttttcactcccacagaccccccagacggacaacccatccgagggccgaggcgaaggtgtatctaagtcattctcagatcatggattctattcaccaagcagcacattgggggactccccgctggtcgacgacccgcttgaatatcaggctggattgcttgtccagaacgccatccaacaggctatcgccgagcaagtcgataaggctgtgtctaagacatcgcgcgacggagctgagcagcaagggcccgaagctactgtggaagaagctgaggccgctgccttcggatccgaaaagccccaaagtatgtttgagccaccacaggtgtcttctcctgtccaggagaagcgtgatgtccttccgaaaatccttccggcagaggacagggccttacgcgagcgcggaccccctcagcctctccccgccgtgcagccctccggaccgattaatatggaagaaaccaggcccgaaggaagttatttctcaaaatattcagaggcggcagagctgcggagcaccgcatcccttctggcaacccaggaaagtgatgtcatggtgggccccttcaaactgaggagtcgaaagcagagaactctgagtatgatcgaggaggaaatcagggcagctcaggagagggaggaagagctcaaacgtcagaggcaggtgctgcagtcaacacagagccctagaaccaagaacgcaccatctctgcctagcaggacatgttacaaaaccgcccctggcaagatcgagaaggttaagcctcccccatccccaaccaccgagggaccttctctgcaacctgacctggcccctgaggaagccgcaggcactcagcgccccaagaatcttatgcagacactgatggaggactacgaaacacacaaatcgaagcggcgggagagaatggacgacagttcagtgctcgaggctacccgggttaatagaagaaagtcggcacttgccctgaggtgggaggcaggcatttatgctaatcaggaagaagaggataacgagtag

SEQ ID NO: 106690 - DNA, 2847 bp, Artificial Sequence
  Description of Artificial Sequence: Synthetic coding sequence
atgcggtggccccaacctggagcagccgctaggctgcccccggagtcccctggccctcctgagtccccgggcccacctgaacgagaggccgcagcagctaggaggtggacaggcgcggaacctcaggattgcgccccggggtccggtcgcccagagaaacccccacagctgtcagaggatgacatttggcttaagagcgagggggacaattactctgcaaccttgcttgaacccgctgcgagtagcctctcccctgatcacaagaacatggagattgaggtgtccgtggccgaatgcaaatcagtgcccggtatcacgtctaccccccatcccatggatcaccccagtgctttctactccccacctcacaatggactgttaaccgatcatcacgaaagcctggacaatgatgtggcccgggaaatacggtacctggatgaagtgcttgaagccaattgctgtgactccgcggtggacggtacgtacaatgggactagctccccggaacctggagccgtcgtgcttgtcggtggcttgagcccacctgtccacgaagctacccagccggagccgacggaacgaactgcaagtaggcaggcaccaccgcacattgaactctctaattcatcaccggacccgatggccgaggccgagcgtacaaacgggcactctccctcgcagccgcgcgatgcattgggtgacagtctgcaagtcccagtatctcccagcagtacaacttcctcaaggtgtagttccagggacggagaatttaccttaaccacgctgaaaaaggaggcaaagtttgagctcagggcattccatgaagacaagaaaccttcgaaattatttgaagatgacgagcacgagaaggagcaatactgtatccggaaggtgcggccctccgaggagatgcttgagctggagaaagagaggagggaactcataaggtcccaggccgtgaagaaaaacccaggtatagccgccaagtggtggaatccaccccaggaaaagaccatcgaggagcagctggacgaagaacaccttgagtctcacaagaagtacaaggagcgcaaggagcgaagggcccagcaggagcagctcctgctccagaagcagttacaacagcagcagcagcagcctccctcacagctgtgcacagcccccgcatcatcccatgaaagggcgtccatgattgacaaggctaaagaggacattgtcacggaacagatagatttctccgccgcccgtaagcagttccaactcatggaaaattcacggcaggcagttgccaagggtcagagcacgccccgtctcttctcaattaagcctttctaccgcccactgggctcagtaaattccgacaaaccactgaccaatccgcgtccccccagtgttggcggtccccccgaagattctggtgcctctgctgctaaggggcaaaaaagccctggagccctcgagacacccagtgctgcaggatcccaagggaatacggcatcacaaggcaaagaaggaccatattccgagccatcaaaaagaggacccctctctaagctgtgggctgaagacggagagtttaccagtgccagagctgttctgacggtagttaaagatgacgatcatggcatattagaccaattttcacggagcgttaacgtaagtctgacccaggaggagctagactcaggcctggacgaattgtcagtgagatctcaagataccaccgtcctggagactctcagtaacgacttttcaatggacaatatctcagactcaggggcctccaacgaaaccacgaatgcactgcaggagaactcactagccgatttcagccttccccagacacctcagacagacaatccctccgaaggtcggggagagggggtcagtaaatccttttccgatcacggattctactctcccagcagcacgctgggcgacagcccactggtggatgaccctctggagtaccaagccggtctgctggtacagaacgcaatccagcaagcaatcgcagagcaggtggataaggcggtgtccaaaacgtccagggatggcgccgagcagcagggccccgaggctaccgtggaggaggctgaagccgctgctttcggctcagagaagccacagtcaatgttcgaaccgcctcaggtaagtagcccggtacaggagaagcgagacgttctccctaagatactgcccgccgaggatcgagctcttagagaaaggggccctcctcagcccttgcccgcagttcagcctagtggccccatcaacatggaagagactaggcccgagggttcatacttctccaagtattctgaagctgccgagctgcgttccacagcaagtctgctggccacacaggagtctgacgtcatggtgggccctttcaagctccggagccgcaagcaaagaacattaagcatgattgaagaagagattagggccgctcaggaacgggaggaggaattgaaaagacagcggcaggtcctccagagcacacagagccctagaactaagaatgctccttcccttcccagccggacctgctataaaaccgcacccggaaaaattgaaaaggtgaagccacccccatcgcctaccaccgagggaccatcactgcaacctgacttggctcccgaagaagctgctgggacccagcgcccgaaaaatcttatgcaaacgctaatggaagactacgagacacataaatccaagcgccgcgagagaatggatgatagtagcgtgcttgaggccacgcgtgttaacaggaggaaaagcgctctggccctcaggtgggaggccgggatttacgccaaccaggaagaggaagacaatgaatag

SEQ ID NO: 106691 - DNA, 3273 bp, Artificial Sequence
  Description of Artificial Sequence: Synthetic coding sequence
atggcagaggccgagcttcacaaggagcggctgcaggccatcgcggaaaaacgcaagaggcagaccgagatcgaaggaaagcgacagcagttggacgagcagattctcttgctccagcacagtaaaagcaaggtgcttagggaaaaatggctactgcagggaattcccgcaggcactgcggaagaagaagaggctagaaggaggcagagcgaggaagatgagtttcgagtcaagcagctggaagacaacattcagaggctggagcaggagatccaaacattagaatctgaggagtcacagataagtgcgaaggaacagataatcctggaaaagctgaaggaaactgagaagagtttcaaggatttccaaaagggcttcagcagcaccgacggtgacgccgtcaattacataagcagtcaactacccgatctcccaatactgtgttcccggaccgccgagccttcccctggccaagatggcacttcacgtgctgctggggtcgggtgggagaatgtgcttctgaaggagggagagtcggcatctaatgcaacagaaacatcagggccagatatgactattaaaaagcctccccagctgagtgaagacgatatctggctcaagagtgagggcgataattatagcgccactctcctggagcctgctgccagcagccttagccctgatcataaaaacatggagattgaagtatccgttgcagaatgcaaatccgttccgggcattaccagtaccccacaccccatggaccacccgtcagccttctacagtcctccacacaacggcttgctcacagaccatcatgaatccctggataatgatgtggccagagaaatacgttatcttgatgaggtgctcgaagcaaactgttgcgactccgccgtggatgggacctataacggaacttcgtcgccagagcctggcgctgtggttctggtcggcgggctgagtcctccagtgcatgaggccacgcagccagagcccaccgaaaggactgcaagccgtcaggcaccaccacatatagaactgtcgaattcctcccctgatcccatggcagaagccgaaagaactaatgggcacagcccctcacagccccgggatgctctcggcgactccctgcaggtacctgtcagtccgtcttcaacaacatctagcaggtgcagcagtagagatggcgaattcactctgaccaccctgaaaaaggaagcgaaatttgaactcagagcattccatgaggataagaagcccagcaaactgtttgaggatgatgaacacgagaaagagcaatactgcattcggaaggtgcgcccctccgaggaaatgctggagctcgagaaagaaagaagagaacttattcgaagtcaagccgtgaagaagaatcctgggattgctgccaagtggtggaatcccccacaagagaagacaatcgaggaacagcttgatgaggagcacctggagagtcataagaagtacaaggagcgcaaagaaagacgtgcgcagcaagaacaacttcttctacagaaacagctccagcagcagcagcagcagccaccttcacagctgtgcaccgctccggcttcctcccacgaaagagcatccatgattgataaggccaaggaggacattgtcactgagcaaatagattttagcgctgcgaggaagcagtttcaacttatggagaactcccggcaggcagttgcgaaaggacagagtactccgaggctgttttccattaagcccttttaccgtccgctgggctcagttaatagcgacaagccactgactaacccccggccaccctcagtgggcgggcctcctgaggattccggagcgtcagccgccaaagggcaaaagtcacctggcgcccttgagaccccaagcgccgccggctcccagggtaacacggcctcccagggtaaggagggcccctactccgagccgtccaagagaggtcctttaagtaagctatgggctgaagacggcgagttcacctcagctagggccgtgcttaccgttgtgaaggacgacgaccacggaatcctggatcagttctcacgtagcgtaaacgtttcattgacgcaggaggaattagactccgggctggatgaactgagcgtacggtcccaagacactacagtgcttgagacactgagtaacgactttagcatggacaacatatctgactccggtgcctccaacgaaaccactaatgccttgcaagagaacagtttggctgatttcagcctcccgcaaacaccccaaaccgataacccatctgaaggtcggggggaaggggtctctaagagcttttctgatcacggcttctattcaccaagttctactctgggggattccccactggtggatgatccattggagtatcaggccggacttcttgtccagaacgcaatccagcaagccatcgctgagcaagtcgacaaggctgtcagcaagacctccagggacggcgctgaacaacagggtccagaggcgaccgtggaggaggcagaggctgcagctttcgggagtgaaaaaccgcaatctatgtttgagccgccccaggtgtccagcccggtgcaggagaagcgcgatgtgttgcccaaaatcctgcccgcggaggacagggccctccgggagcgaggcccaccgcagccacttcctgcagtgcaaccaagcggccccataaatatggaagaaacgaggccggaaggctcctattttagcaaatattcggaagcagctgaactgcgtagcaccgcaagcctgctcgctacccaggagtctgatgtcatggtgggcccatttaaattacgctcacgcaaacagaggacgctcagcatgatcgaagaggaaatacgggctgcgcaagagcgggaggaggagctcaaacggcaaaggcaggtgctgcagtcaactcagagcccaaggactaaaaacgcaccatccctaccaagtcgtacctgttacaaaacagcccccggaaagatcgagaaagtgaagccgccccctagtcccactacagaggggccttctctccaacccgatctcgcacccgaagaagccgcaggtacacagcggcccaaaaacttgatgcaaaccctcatggaggactacgagacgcataaatctaagagacgtgagcgaatggatgattcatcagtactggaagccacgcgggttaacaggagaaaatctgccctggcactgcgatgggaggcggggatttatgctaaccaagaggaggaagataacgaatag

SEQ ID NO: 106692 - DNA, 3312 bp, Artificial Sequence
  Description of Artificial Sequence: Synthetic coding sequence
atggccgaggctgagttgcacaaggaaagacttcaggctattgccgaaaaacgaaagcgtcaaacagagattgaaggaaagcgtcaacagctggacgaacaaatactgctcctgcagcatagcaagtcgaaagtgctccgagagaaatggctgctacaaggaatcccagcgggaacggcagaagaggaagaggcgcgtaggcgccaaagcgaggaggatgagttccgggtgaaacagctcgaggataatatccaacgtctggaacaagagattcagacacttgagagcgaagaatcacagattagcgccaaggaacaaattattctggaaaaattgaaggaaactgaaaaatccttcaaggactttcagaaaggtttttcgtctaccgacggcgacgctgtcaattacattagctctcaattgcctgacctgccaatcctctgctcccgcaccgctgagcccagccccggccaagacggtacatccagggctgccggcgttggttgggagaatgttctactcaaggagggtgagtcagcctcgaatgctaccgaaacttcaggccccgatatgaccattaaaaaaccacctcagctttctgaggacgatatttggcttaaatcagaaggcgataactactcagctaccctgcttgaacccgccgccagcagtctgtctcccgatcataagaacatggagattgaggtatccgtcgccgagtgtaagtccgtaccgggcattacatccacacctcatccaatggatcacccatctgctttctactctcccccccataacggtctgcttacggatcaccacgagagtcttgataatgatgtggcaagagagattcgttacctggacgaagtgctcgaggccaattgctgcgatagcgccgtggatggaacttacaatggaacaagcagtcccgaacctggggccgtcgtactggtcggcggcttgagtccaccagtgcatgaggccacacagcccgagcccacggagagaactgctagccgtcaggcccccccacatatcgagctgagcaactctagtccagatcccatggctgaggctgagcggacaaatgggcatagccctagtcaaccacgggacgcattgggagactcactacaggtccccgtttcgccctccagcaccactagtagcagatgtagttcacgtgacggcgaatttacacttaccacactgaagaaagaggctaagtttgagctacgggccttccacgaggacaagaagcccagcaagctgtttgaggatgatgagcatgagaaggaacaatactgcatccgtaaggtgagacctagtgaggagatgctggaactggaaaaggagagaagggaacttattcgctcccaagccgtgaaaaagaaccctggcatcgccgcaaaatggtggaatccaccccaggagaaaacaatcgaggagcagctggacgaagaacacctggagtcccataaaaaatataaggaaaggaaagagcgccgcgcacagcaggagcagctgttactgcagaagcagctccagcaacagcagcagcaaccaccctcccaattgtgcaccgccccagcaagttcgcatgagcgcgcttcaatgattgacaaagccaaagaggatatcgtgaccgaacagattgacttctccgccgccagaaaacagttccagttgatggagaacagtcggcaggccgtggcaaagggccaatccactcctaggctgttttcgattaagcctttctatagaccactaggctcagttaatagcgacaaacccctgacaaacccgcgaccgcccagcgttggaggcccccctgaggacagcggggcaagcgctgctaaaggacagaagtcacctggcgcactagagaccccaagcgcagcaggctctcagggaaataccgcaagtcagggaaaagaagggccttacagcgagcctagtaaaaggggtcctctgtctaaactttgggctgaggatggtgagtttacatcagctcgcgcagtactgactgtcgtcaaggacgatgaccacggcattttggaccagtttagccggagtgtaaacgtctctctgacccaagaagagttagactcaggcctggacgagctgtccgtgcgctcccaggataccaccgttttagaaaccctttccaatgatttttccatggataatatatcggattctggagcctctaatgaaacaaccaatgccctgcaggagaacagtctcgccgactttagcctgccgcagaccccccagacggataatcccagcgagggccgcggagaaggggtttcgaaatcctttagcgatcacgggttctacagcccaagctccaccctgggcgacagcccgttggttgacgaccctctcgaatatcaggctggactgctggtgcagaatgcaattcaacaggccattgccgaacaggtcgacaaggcggtcagcaaaaccagccgggatggtgccgagcagcaggggccggaggctacggtggaggaagccgaagctgctgcattcggatccgagaagccccagtcaatgttcgaacctcctcaagttagctcacctgtgcaggaaaagcgggacgttctgcctaaaatcctgcctgcagaggatcgcgccctgcgggagcggggccccccccagccgctgcccgcagtgcagccctcaggcccgataaacatggaggaaactcggcctgaaggatcatactttagcaaatactcagaggcagccgaactcagatccacagcctcgcttctggctacacaggagtccgacgtaatggtcggcccttttaaactacggagcaggaaacaacgaacactctccatgatcgaagaggaaatcagggcagctcaagagcgcgaggaagagttaaaaagacagcgccaggtacttcaatccacccagtcccctcgaaccaaaaacgcaccgagcctgccctcacggacatgttacaaaaccgcccccggtaaaattgagaaggtgaaaccaccaccctctcccactacagagggcccatccctccagccagacctcgctcccgaagaagcggctggcacccagaggcctaaaaaccttatgcaaaccttgatggaggactacgagacccacaaatccaagaggcgcgagcgtatggatgacagtagctacacgtcaaagttactctcctgcaaggtgaccagcgaggtcttggaggccactagggtgaaccggcgaaagagcgccctcgcccttcgatgggaggcaggaatttacgcgaaccaagaggaagaggacaatgagtag

SEQ ID NO: 106693 - DNA, 2886 bp, Artificial Sequence
  Description of Artificial Sequence: Synthetic coding sequence
atgcgatggccccagcctggagcagctgccagacttccacctgagagtcctgggccccccgagtctccggggcctccggaaagagaggctgctgccgccaggcgatggactggagcagaaccccaggactgcgctccgggaagtggaagaccagaaaaacccccgcagctttccgaggatgacatttggctcaagagcgaaggcgacaactatagcgcaacattactggagcctgctgcaagttctctgtcaccagatcataagaacatggagattgaggtatctgttgccgagtgcaaaagcgtgcccggcatcacctctacgccccaccccatggaccaccctagcgctttttacagcccaccccataatggcttactgacggaccaccacgagagcttggacaacgatgtcgctcgcgaaatccgctacttagacgaagtgctggaagcaaattgttgcgactctgctgttgatggcacttacaacggtacatctagccctgagccaggtgcggtggtgctcgtcgggggtttaagtccgccggttcatgaggccacccagcctgaacctacagagaggactgcctctagacaggccccacctcacatagagctcagcaatagttccccggacccaatggccgaggctgagagaaccaacggccacagtcccagtcaaccgagggatgctctgggagactcactgcaggtccccgtttccccgagctctacaacaagctctcggtgttctagtagagatggggagttcacattaaccaccctgaagaaggaagcaaaatttgagcttagggcatttcacgaggacaaaaagccctcgaaactttttgaagacgatgagcacgagaaggaacaatactgtatacgcaaagtcagaccttctgaggaaatgctggagcttgaaaaagagagacgggagttgatccggtcacaagccgtcaaaaaaaatcctgggatcgcagccaagtggtggaaccccccacaggagaagaccatcgaagagcagctggacgaagagcatctcgaatctcacaagaagtacaaagaacgcaaagaacgccgagctcagcaggagcagttgctgttgcagaagcagcttcagcagcagcagcagcagcccccttcccagctgtgtaccgcccctgcgtcctcacacgaaagggcctctatgatcgacaaagccaaggaagatatcgtgacagaacagattgatttttccgctgccagaaaacagttccagctgatggagaacagccggcaggcagttgcgaaggggcagtcaacccctaggcttttctccattaaaccattttatcgccctcttgggtcagtgaatagtgataaaccgctgactaatcctcgaccgcctagtgtgggcggcccaccagaggattcaggagcatccgccgcgaaagggcagaaatcccctggtgccctggagactccaagtgctgccgggagccaagggaacactgcatcccagggaaaggaaggaccctattctgagccgtctaagcgcgggcctctcagcaaactctgggctgaagacggtgaattcaccagcgcccgcgcagtcttgaccgtcgttaaggacgatgaccatggcatcctggatcagttctctcggtctgtgaatgtgtctttaacgcaggaggagctggacagtggcctggatgaactttcggtacggagtcaagatacaaccgtgctcgagacactctccaatgacttttctatggataatatcagcgactccggggcatccaatgagacaacgaatgctctccaggagaactctctggcagacttctcacttcctcagactccccaaaccgacaaccctagcgagggcagaggggagggagtgtcaaagtccttctcggatcatggtttttactcaccatcgtcgacgctcggcgacagtccgctggtggacgaccccttggaatatcaggcagggctcttagtgcagaatgccatccagcaggccatcgccgaacaggtggataaggctgtatctaaaacctctagggacggcgctgagcagcagggtcctgaggccactgtcgaggaagctgaggccgctgcttttggcagcgaaaaaccacagtctatgttcgaacccccccaagttagtagcccagtgcaagaaaagcgtgatgtgttgccaaagattctgcctgcagaagacagggccttaagagaacggggaccaccccagcctcttccagctgtgcagcctagtgggcctataaacatggaagagacacgaccagagggaagctacttctctaagtactcggaagcagctgagctgaggtctacggcttccttgctcgccactcaggaaagcgatgttatggtgggaccctttaaactgaggtcacgaaaacaacgtactctctcaatgatagaagaggagatccgcgcggctcaggaaagagaggaggagctaaagagacagcgccaggtcctgcaaagtacccagtccccaagaacaaagaacgcaccgagcttgccatctcgtacctgctacaaaaccgcccccgggaagattgagaaggttaagccaccccccagccctacaaccgaggggccctccctgcagccagacctcgcgccggaagaggccgccggaacacagaggcccaaaaacttaatgcagacattaatggaggactatgagacacacaagtctaaacggcgggagaggatggatgacagcagctacaccagcaaactgcttagttgtaaggtaacaagcgaggtcctggaagctactagagtgaatcggcgtaagtcagccctcgccctgcgatgggaggccggcatttacgctaatcaggaagaagaggacaacgagtag

SEQ ID NO: 106694 - DNA, 2565 bp, Artificial Sequence
  Description of Artificial Sequence: Synthetic coding sequence
atgatggcctactctgataccacaatgatgagcgacgatattgactggctccgtagtcatcggggagtctgtaaggttgacttatataatccagagggccagcaagatcaggataggaaagttatctgtttcgttgacgtttcaacactgaacgttgaagacaaggattacaaagatgcagcatctagcagctcagagggcaatcttaatttaggatcactggaggagaaagagatcattgtcatcaaagacacagagaagaaagaccaatccaagactgaaggttcggtgtgcctgttcaagcaggcacctagcgaccctgttagcgtgctgaattggctgttgagcgacctgcaaaagtacgcattagggtttcagcacgctctgtctccctccacttctacatgcaagcacaaggttggggatacggaaggagagtatcatcgggcgtcgagcgagaactgttacagcgtgtatgctgaccaggttaacattgattacctgatgaaccgcccacagaatttaagacttgagatgaccgctgctaagaacaccaacaacaaccagtcgccctccgcccccccggccaaaccaccaagcacacaacgggctgtcatttcccccgacggggagtgcagcatcgacgacctgtcgttttatgtaaatcggttatcgagcctggttattcagatggcacataaggagataaaagaaaagctggagggcaagagtaagtgcctgcaccactccatttgtccttccccaggcaataaggaacgcattagcccacgaacgccggcaagcaaaatagcgtcagagatggcttacgaggcggtggagctgaccgccgccgagatgcgcggcaccggcgaggagagcagggaaggcggtcaaaaatccttcctatacagtgaactctccaacaagtcaaagtccggtgacaaacagatgtcacaacgcgagtccaaagagtttgcagacagtattagcaaaggactgatggtgtatgccaaccaggtcgcttccgatatgatggtctctcttatgaagactctgaaggtccatagtagcgggaaacctattcccgcatccgttgtccttaagagagtgctgctgagacataccaaagaaatagttagcgatctgattgattcatgtatgaaaaacctccacaatattactggcgtgctaatgacggattcagacttcgtcagcgccgtgaaacggaacctgttcaaccagtggaaacagaacgcgaccgacatcatggaggccatgctgaaaagactggtctcagcacttataggagaagagaaggagactaaaagtcagagtctgtcatatgccagcctcaaagctggttcccatgatcccaaatgccggaatcagtctctggaattttcaacgatgaaagccgaaatgaaggaaagagataagggaaagatgaagtcagatccatgtaaatccctcactagtgcagaaaaggttggagagcacattctcaaagagggtttgaccatatggaaccagaagcaggggaacagttgcaaggtcgcaacgaaagcttgctcaaataaagacgaaaaaggcgagaagatcaacgcttccaccgactcgttggccaaagatctgattgtctctgccttaaagttgatacagtatcacctcacccagcaaaccaagggcaaggatacatgtgaggaggattgccccggctccacaatggggtacatggcacaatccacacagtatgaaaagtgtggaggcgggcagagtgctaaagctctttctgttaaacaactcgagtcccacagggctcccgggccctcaacttgtcagaaggagaaccagcacctcgatagtcagaagatggacatgagcaacatcgtcttgatgttaatccaaaagctgctgaacgagaatcctttcaagtgtgaagatccctgcgagggtgaaaacaaatgttcagagcctagagcctccaaagcagcatcaatgagtaatcgcagcgacaaagcagaagaacagtgccaagaacatcaggagcttgattgtacttcaggcatgaagcaggctaatggccagtttatcgataaactggttgagtcagttatgaagctctgcctaatcatggccaaatactcaaatgacggcgctgcccttgccgagctggaggagcaagcggcctccgccaataaaccgaacttcaggggtacaagatgcatccactctggagcaatgcctcagaattaccaagactccctgggccacgaggtgatcgtcaataatcagtgttcgaccaactcactccagaagcagctccaggctgtcctgcagtggatagcagcaagtcagttcaatgtgccaatgttatattttatgggagacaaggatggacagcttgagaagctgcctcaagtgtctgcaaaggctgccgagaaaggatatagcgtgggtggcctgctacaggaagtgatgaaatttgcaaaagaaaggcagcccgatgaggctgtaggaaaggtcgcccgcaaacagctgctcgactggctccttgcaaacctgtag

SEQ ID NO: 106695 - DNA, 2538 bp, Artificial Sequence
  Description of Artificial Sequence: Synthetic coding sequence
atgagtgatgacattgattggttgagaagccaccggggggtttgtaaggtggacctgtataatcccgagggtcagcaggatcaggacaggaaggtcatatgttttgtggacgtgagtacactgaacgtcgaggacaaagattacaaggatgcggcctcctcttccagcgagggaaatctgaatctggggtcactagaggagaaggaaataatcgtcatcaaggacaccgagaagaaagaccagagcaaaacagagggaagcgtgtgccttttcaagcaggcccccagcgaccccgtctctgtcctgaactggctcctgtccgatctgcagaagtatgctctgggattccagcacgctctatccccaagcacttctacctgtaagcacaaggtaggtgatacggaaggagagtatcatagggcttcttctgagaactgctatagcgtctacgctgatcaggtcaacatcgactatttgatgaaccgtccgcagaatctgcggctcgagatgaccgcggccaaaaacacaaataacaatcagagcccaagcgcaccacccgccaaaccaccctccacgcaaagggcagtaatcagccccgatggcgaatgttccatagatgatctcagcttttacgtgaaccggttaagctcgctggttatacagatggctcacaaagagattaaggaaaagctggagggtaaaagcaagtgtctacaccacagtatttgtccgagtcccggcaacaaagaaagaatctcaccacggacgcccgccagcaaaattgcctctgagatggcctacgaagccgttgagctaacagccgctgaaatgagaggcaccggggaggaaagtagggagggaggacagaaaagctttctatattccgaactgagcaataaatctaagtctggtgacaaacagatgagccagcgcgagagcaaagagtttgccgattccataagcaagggcctcatggtgtatgccaaccaggtagccagcgacatgatggtctcactgatgaagaccttaaaggtacactcctctgggaagccaattcctgcatccgtggtgcttaaacgggtgctgctgagacatacaaaggaaattgtgtcagatctcattgactcatgcatgaaaaatcttcacaacattactggagtgctgatgactgactcggacttcgtttccgccgtgaaacgaaatttgtttaaccagtggaagcagaacgcgaccgacatcatggaagctatgttaaaaaggcttgtttctgccctgattggcgaggaaaaagaaaccaagtcacagtctcttagctatgcctctttgaaggccggttcacatgatccgaaatgcagaaaccagagtctcgaattcagcactatgaaagccgagatgaaggaaagagacaaaggcaaaatgaagagcgacccgtgtaaaagtctgacgtccgccgagaaagtcggggagcacattttgaaggaggggttgaccatttggaaccagaagcaggggaactcctgcaaggtcgccacgaaagcatgctctaataaagatgagaaaggcgaaaagatcaacgcctctaccgattccttagccaaggatctcatcgtgagcgctcttaaactgatccaatatcacttgactcagcaaacaaaaggcaaagacacttgcgaggaagactgtccaggaagcacaatggggtacatggcccaaagcactcaatatgaaaagtgcggtggaggacaaagtgcgaaggcccttagtgtaaagcaactagagtctcacagggcccctggcccgtcaacctgtcagaaggagaaccagcacctcgactcccagaaaatggatatgagtaacattgtcctcatgctaatccaaaagctcctgaatgagaatcctttcaagtgtgaggatccttgcgaaggagagaataagtgttctgagcccagggcctccaaagccgccagcatgagcaaccgttcagataaggctgaagagcagtgtcaggaacatcaggagctagattgcacaagtggcatgaagcaagctaacggccagttcatcgataaactggtggaatccgtgatgaagctgtgtctgatcatggcaaaatactcaaatgacggtgccgcactcgcagagcttgaagaacaggccgctagtgccaataaacctaatttccgtggtactcggtgcatacactctggagcaatgccacagaactaccaggattctctcggacatgaggttatcgtcaacaatcagtgcagcacaaacagccttcagaagcagctccaggcggtattacagtggatcgcggctagtcaatttaatgttccgatgctttacttcatgggtgataaagatgggcaactggagaaactacctcaggtctccgccaaggctgctgagaagggatacagtgtgggcggtctcctgcaggaggttatgaagttcgccaaagaacggcagcccgacgaagctgtggggaaggttgcccgcaaacagctgctagattggctgctagccaatctgtag

SEQ ID NO: 106696 - DNA, 1416 bp, Artificial Sequence
  Description of Artificial Sequence: Synthetic coding sequence
atgagtgacgatatcgactggttgcgaagtcataggggggtctgcaaagtggacctgtacaaccccgaaggtcaacaggatcaggaccggaaggtgatttgttttgtcgacgtgtcgacactgaatgtggaagataaagattataaggatgccgccagctcaagcagcgaggggaacttgaatctgggctcactcgaagaaaaagagattattgtaattaaggacacggaaaaaaaagatcagagcaaaaccgaagggtccgtgtgtctgttcaagcaggctccttcggatcctgtttctgtattgaattggttgctgagtgacttacagaagtacgctctgggcttccagcatgcactgtctccctctacttcaacatgcaagcataaagtgggggatacagaaggcgaataccacagggctagtagcgagaattgctatagtgtgtacgcagaccaagtcaatatagattacctgatgaacagacctcagaatctgaggctggagatgaccgctgctaagaacaccaataataaccagaatacttgcgaagaggactgtcctggctccaccatgggttacatggcacagagtacacagtacgagaaatgtggtgggggccagagcgccaaagccctgagcgtgaaacagctggaatcacacagggcccctggcccttcaacctgccagaaagaaaaccaacacttggattctcagaaaatggacatgagcaatatcgtcctcatgcttatccagaagcttttgaacgaaaatccttttaagtgcgaagatccctgtgagggagagaataagtgttcagaaccgcgtgcctcaaaggccgcctcaatgtccaacaggtccgacaaagcagaagaacagtgtcaagaacaccaagaattagactgtacgtcgggcatgaaacaggccaacggacagttcatagacaaactggttgaatcagttatgaagctgtgccttataatggctaaatatagtaacgatggtgccgccttggctgagctggaagaacaagccgcgtctgccaataaacctaacttcagaggtacaaggtgcatccactcaggggcaatgccgcagaactaccaggattccctgggccatgaagttatcgtgaataaccagtgtagtaccaacagcctgcagaagcagctccaggccgtcctacagtggatcgccgcgtctcaattcaacgtgcctatgctgtacttcatgggagacaaggacggacagttagaaaaactcccgcaggtgagcgcaaaggcagccgaaaaggggtatagtgtggggggcctgctacaggaggtgatgaaattcgctaaggaaaggcagcctgacgaggccgttggaaaggtcgcaaggaagcaactgctggactggctactggccaatctttag

SEQ ID NO: 106697 - DNA, 2538 bp, Artificial Sequence
  Description of Artificial Sequence: Synthetic coding sequence
atgtctgacgatatagactggctgagaagccatcggggggtctgcaaagtcgatttgtataatcctgaaggccagcaggatcaagatcggaaagtgatttgcttcgtggacgtctctactctgaacgtggaagacaaagactacaaggacgccgccagcagtagttcagaagggaatctgaatctgggaagcctggaggagaaagaaatcatcgttatcaaggatactgagaaaaaggatcaaagcaaaacggagggcagcgtctgtctctttaaacaagccccaagcgatccagtctctgtgctgaactggctcttgagcgatcttcagaaatatgccctgggatttcagcacgccctttccccctccacttctacctgtaagcataaagtgggcgataccgaaggggaatatcacagagcctcaagtgagaattgttacagcgtgtacgcggatcaggtgaatatcgactacctgatgaataggcctcaaaacctgcggctcgagatgactgccgccaagaatactaacaacaatcagagtcctagcgcaccccccgccaaacctcccagtactcagagagccgtgatctcccccgacggtgagtgctcaattgatgacctgtctttctatgtgaatcgcctgtcctctttggtcatccaaatggcccataaagaaattaaagagaagctggaagggaaatcaaagtgcctgcaccactccatctgcccttcccccgggaataaagaacgtattagtccaagaacacctgcctctaagatagcgtctgaaatggcctacgaagcagtggagctgacagcagcggaaatgcgaggcaccggcgaggagtcgagggagggcggccagaaatcctttctgtattccgaactgtctaacaaaagcaagtccggggataagcagatgtcccagcgggagtcgaaggagttcgccgatagtatttcaaagggcctaatggtatacgccaaccaggtagcgagcgacatgatggtgtccctgatgaaaacattaaaggttcacagtagcggaaagcccatcccagcatcagtcgtgttgaaacgggtgctgctacggcatacaaaagagattgtgtcagaccttatagacagctgcatgaagaacctgcacaatatcaccggtgttctgatgacggattccgacttcgtgtctgctgtaaaacggaacttattcaaccaatggaagcagaacgccactgacattatggaagcaatgttaaagagactggtttccgctctaattggtgaggaaaaagagaccaagtcacaatccctctcttacgcttctctgaaggccgggtcccacgacccgaagtgtcgcaaccagtcactggagtttagcactatgaaagctgaaatgaaagagagagacaaagggaagatgaaaagcgatccatgtaagagtttaaccagtgccgaaaaagttggcgagcatatcctgaaagaaggtctaacgatttggaaccaaaagcaaggaaactcttgcaaggtggccaccaaggcgtgttctaacaaagatgaaaagggagaaaaaatcaatgctagcactgattctctcgctaaggatctaatagtcagcgctctcaagctcattcagtatcaccttacacagcagacgaaaggtaaggatacgtgtgaagaagattgcccaggcagcactatggggtatatggctcaatctacacagtacgaaaaatgcggcggtgggcagtctgccaaggcattaagcgtcaaacagctcgagtcccaccgcgccccaggaccaagtacctgccagaaggagaaccaacacctggattcacaaaaaatggacatgtctaatatcgttctgatgttgattcagaagttgttgaacgaaaaccccttcaaatgtgaggatccctgtgagggggaaaacaagtgcagtgaacctcgggcttccaaagccgcatcaatgtccaatcgttctgataaggccgaggaacagtgccaggagcaccaggaattggactgcacctccggtatgaagcaagccaacgggcagtttatcgacaaactagtggaaagcgttatgaaactttgtttaattatggcgaaatactccaacgacggggcagcgttggcagagttggaagagcaagcggcctctgctaataagcctaatttcaggggcacgcgttgtatccatagcggcgcaatgccccagaactatcaggactcactcgggcatgaagtgatcgtaaacaatcagtgttcaacaaacagcctccagaaacaattacaggctgttctccaatggatagccgctagccagttcaacgttcctatgttatacttcatgggggacaaagacggacagctggaaaaattgccacaggtcagtgctaaggcagccgaaaaaggctactcggttggagggctcttgcaggaggtcatgaaattcgcaaaggaaaggcaacccgacgaagcggtagggaaagttgctagaaagcagctgcttgattggttgctggcaaacctgtag

SEQ ID NO: 106698 - DNA, 765 bp, Artificial Sequence
  Description of Artificial Sequence: Synthetic coding sequence
atgtccgatgacattgactggttgcggagccaccgcggcgtatgcaaggtcgatttgtataaccccgagggccagcaggaccaggacagaaaggtgatttgcttcgtggacgtcagcacgctcaatgtcgaggacaaggattacaaggacgccgcatcttcttcctctgaaggaaatcttaatctgggctcactggaggagaaagaaattatagtgataaaggatacagaaaaaaaggaccagtctaagactgaaggcagcgtatgtctgttcaaacaagccccatctgatcctgtctccgttctgaattggctgctgtccgaccttcagaaatacgctctgggttttcaacacgcactatctccctccacctcgacctgcaaacacaaagtgggggatacagaaggcgagtaccatcgtgccagctcagaaaattgctactccgtttatgcggaccaggtgaatatcgactacctcatgaaccgtccccaaaatctgcgtttggaaatgactgcagcaaagaataccaataataaccagtccccgagtgctcccccggctaaacctccatccactcaacgcgctgtgatcagcccggacggggagtgctccatcgacgacctgtctttctatgtgaatcggctgtcctctcttgtcatacagatggctcataaggaaatcaaggagaaactggaggggaaatcaaaatgccttcaccattcaatttgcccatctccaggcaataaagagaggatctctccttag

SEQ ID NO: 106699 - DNA, 642 bp, Artificial Sequence
  Description of Artificial Sequence: Synthetic coding sequence
atgtccgatgatattgattggctgcgctctcaccggggagtttgcaaggtcgacctctataatccagaagggcaacaggaccaagaccgcaaggtgatctgttttgtggacgtctcaacgctgaacgtagaagacaaagactacaaagatgcggcttcatcgtcctctgagggaaacctgaatctgggaagtctggaagaaaaggaaatcattgtgattaaggacaccgaaaagaaagatcagagcaaaacagaaggctccgtgtgcctgtttaaacaggccccaagtgacccagtgtccgtgctcaattggctgctctccgatctccagaaatatgctctcggctttcaacatgcgttaagtcctagtacatctacatgtaagcacaaagtcggtgataccgagggcgagtaccatagggcctcatccgaaaattgctactccgtatatgctgatcaggtgaatattgattatctaatgaacagaccgcaaaatctgagactggagatgacggctgctaagaataccaataacaaccagaatacttgcgaggaggactgtcctggatcaacaatgggttacatggcacagtctacccagtacgagaaatgcgggggagggcaatccgccaaggccctgtag

SEQ ID NO: 106700 - DNA, 552 bp, Artificial Sequence
  Description of Artificial Sequence: Synthetic coding sequence
atggataattgtctggctgccgccgcattgaacggcgttgatcgaaggagccttcagcggtcggcacgcctcgcactcgaggtcctcgaacgcgccaaacgccgcgccgtggattggcatgcgctggagagacctaagggatgcatgggggtgctggcacgggaggcgccacacctggagaagcaacctgccgccggtccccagcgagttctgccaggcgaaaagtactactcctccgtgcccgaggagggaggggccacccacgtctacaggtaccatagaggggaaagcaagctacacatgtgtctggatatcgggaatgggcagagaaaagatcggaagaagacttctttaggtccaggcggaagttaccagatatctgagcatgcacccgaagcgtcacagcccgccgagaatatctccaaggacctctatatcgaggtctacccgggcacgtattccgtgactgtaggtagtaatgacctcaccaagaagacacacgttgtggccgtcgacagcggccaatctgtggatcttgtgttccccgtgtag

SEQ ID NO: 106701 - DNA, 552 bp, Artificial Sequence
  Description of Artificial Sequence: Synthetic coding sequence
atggataactgtctcgctgctgcagcactgaacggtgttgatcgcagatccctgcagaggtctgcgagacttgccctagaggtgttagagcgggctaaaaggcgcgccgtagactggcatgctctggaaagacctaaaggctgtatgggtgtactggcacgggaagccccccatctggaaaaacaacccgccgctggaccacaacgtgtgctgcccggggaaagggaggaacgcccgccaactctgagcgctagctttcgcacaatggctgaattcatggattatacttcctcccaatgcgggaaatattactcttccgtccccgaggagggaggagcaacacacgtgtaccggtatcacagaggagagtcgaaactacacatgtgcctagatatcggaaatggacaggccgagaacatctctaaagacctgtacatcgaggtgtacccaggcacttactccgttaccgtcggttctaacgacctgactaagaaaactcacgtggtggctgttgacagcggccagagtgttgacctggtttttccagtgtag

SEQ ID NO: 106702 - DNA, 633 bp, Artificial Sequence
  Description of Artificial Sequence: Synthetic coding sequence
atggacaactgccttgctgctgcggctctgaatggagttgaccggagatctttgcagcgctcagcccgcctcgcccttgaggtgttggagagagccaaaaggcgagcagtggactggcacgcactcgagcgtcctaaggggtgtatgggagtcctggcacgggaagcaccacatctggagaagcagccagcagccggccctcagcgagtgctgcccggggagagggaagagaggccaccgacattaagcgccagtttcagaacgatggccgagttcatggattacacctcatcccagtgtggaaaatactattcgtccgtccccgaggagggaggcgccacacacgtatataggtatcatcggggggagagtaaattgcatatgtgccttgatattggcaacggccagcgcaaagatcggaagaagacatccctcggtcctggaggttcttaccagatatctgagcatgccccggaggcaagtcagcccgccgagaatatttctaaggatttgtacatagaagtgtatccggggacctactctgtaacagtggggtctaacgatctgaccaagaagactcacgtggtggccgtcgactccggacagagcgtggatttagtctttccagtctag

SEQ ID NO: 106703 - DNA, 552 bp, Artificial Sequence
  Description of Artificial Sequence: Synthetic coding sequence
atggataattgtttagccgccgcagccctcaacggtgtggaccggcgttcattgcagagatcagccagactggccctcgaggtgctcgaacgcgctaagaggcgcgctgtcgattggcacgctttggagaggcccaaggggtgtatgggcgtcctggctcgggaggcacctcatttagaaaagcagcccgctgccgggcctcagagagtactgccaggggaaaagtactactcctcagttcctgaggaggggggggcgacgcatgtgtacagatatcatagaggagagagcaagctgcacatgtgcctagacattggcaatggccaacgaaaagacaggaaaaaaacatcccttgggcccggtggttcttaccagatttcagaacatgctcctgaggcctcacagccagccgaaaacattagcaaggatctgtacatcgaggtttacccaggcacctattctgtgactgtggggtctaatgatctcaccaaaaagacacatgtggtggccgtggactctggccaaagcgtggatctggtgtttcccgtctag

SEQ ID NO: 106704 - DNA, 633 bp, Artificial Sequence
  Description of Artificial Sequence: Synthetic coding sequence
atggataactgcctcgcagctgcagccctgaacggcgtggatcgtcgtagtcttcagcggtctgcacgtctcgctttagaggtccttgaaagagctaaacggcgagctgtcgactggcacgccctggaaaggccaaagggatgtatgggggtactcgcccgagaagcaccacacctggagaaacaacctgcagctggaccccagagggtgttgccaggcgaacgcgaggagagaccacctacattatcagcctctttcagaacgatggcggagtttatggattataccagcagtcaatgcggcaagtactactcatcggtacccgaagaaggcggcgctacccacgtatacagataccataggggggaatccaagttgcatatgtgtttggacatcggaaatggtcagcgcaaagataggaaaaagacttcgctaggtccggggggttcctaccagattagtgagcatgcaccagaggcctctcagccagctgagaatatcagcaaagatctttacatagaagtgtacccaggaacttacagcgttaccgtgggctcaaacgatctgaccaagaaaacccatgtggttgcggtcgattctggacagagcgtggacttggtgttcccggtgtag

SEQ ID NO: 106705 - DNA, 1479 bp, Artificial Sequence
  Description of Artificial Sequence: Synthetic coding sequence
atgggattccagcgaagattcttccaccaggatcagagccctgtgggggggcttaccgcagaggacatcgagaaggcaaggcaagccaaggctcgcccagagaataagcagcacaagcagactctgtcagagcacgccagagagaggaaggttccagttacgcggatcgggaggcttgccaattttggcgggctggccgtgggactaggattcggtgcccttgctgaggtagctaagaaatccctgcgctccgaggatcccagcgggaagaaagctgtcctcgggtcttcccccttcctgtcggaagcaaacgcggaacgtatcgtccgcactctttgtaaagttcggggcgctgcattgaaactggggcaaatgttgagtatccaggacgacgccttcatcaacccacacctggcaaaaattttcgaacgagtgagacagagcgctgatttcatgcctctgaagcagatgatgaagaccttaaataacgatctcgggcctaactggagagataagctagagtatttcgaagaacggcccttcgctgccgcttcaattggacaggttcaccttgcacgaatgaagggagggcgggaagtagccatgaaaatccaatacccgggcgtagctcagagcattaattctgatgtgaataatctcatggctgttttgaacatgagcaacatgctgccagaaggactgttcccagaacacctcatcgatgttctcagacgggaacttgcattagaatgtgattatcagcgggaagccgcctgcgcgcgcaagttcagagatctcctgaaaggacacccctttttttacgtccccgaaatagtggacgaactatgcagcccgcatgtgcttaccacagaactggtgtcaggattcccactggatcaggctgaggggctgagtcaggagatacggaatgagatctgctataatatcctcgtcttgtgtttgcgagaactgtttgaattccatttcatgcagacagaccccaactggagcaatttcttctacgatcctcaacagcacaaggttgccctcctggactttggggctacacgggaatatgatcggagcttcacggatctctatatccagataatccgtgcagctgccgatcgcgatcgagaaacggtcagagccaagtctatcgaaatgaaattcctcactggatacgaggtaaaggtgatggaagacgcacatctcgacgcaatacttattctgggtgaggcatttgccagtgatgaacctttcgacttcggaacgcagtctacaaccgagaagattcacaatctgatccccgtaatgctgaggcacaggttggtgcctcctccagaggaaacctactccctccatcggaaaatgggggggtcctttctaatctgctcaaaactcaaagcacggtttccctgcaaggccatgtttgaagaggcttacagcaactattgtaagagacaggcgcagcagtag

SEQ ID NO: 106706 - DNA, 1719 bp, Artificial Sequence
  Description of Artificial Sequence: Synthetic coding sequence
atggccgccatattaggggacacaatcatggtagctaaagggctggtgaaacttacccaggccgctgtggagacccatctacaacaccttggcatcggtggcgaactgattatggggcccgcacccgcctacgtcgcatccggaccatttagagaggccgggtttcccggacaagctagcagcccgctgggcagagctaacggacggctctttgcaaatccccgggatagcttttcagccatgggctttcagcgccgattcttccaccaagaccagtctccggtcggcggactgacagcagaagatatcgagaaggcaaggcaagctaaggctaggcctgagaataaacagcataagcagaccctatctgagcatgcgagggagaggaaggtgcctgtgaccagaattggaaggctcgccaacttcggcggtttagcagtcggcctcggtttcggagccctggccgaggttgccaagaagagcctccgtagcgaggacccgtccgggaagaaagccgtcctgggatcatctcccttcttatcggaggccaacgctgagcgcatcgtgagaacactctgcaaagtcaggggcgctgccctaaagcttggccagatgttgtccattcaggatgatgcctttattaatcctcatcttgccaaaatttttgaaagggttcgacagtctgcagactttatgcccctgaagcagatgatgaaaacactgaataacgacttagggcccaactggagggacaagttggaatactttgaggagagaccgtttgccgccgcttctattggccaagtccatctcgcaaggatgaagggcggcagagaagtggccatgaagattcaataccctggagtggcccaatcaatcaattccgacgtgaataacttgatggccgtacttaacatgagtaacatgctacccgagggacttttcccggaacacctgatagacgtgctgaggagggagttggcgttggagtgcgactaccagagagaggccgcttgtgcaaggaagttcagggatttactcaaaggccacccattcttctacgtacccgaaatagtcgatgaactctgctctccgcacgtcctaacaactgagctggtgagtggctttcctctcgatcaagctgaaggcctgagccaagaaatccggaacgagatttgttataatatactggtcctgtgtctgcgggagctctttgagttccatttcatgcaaaccgatcccaattggtccaatttcttctacgatccacagcagcataaagtagccctactagacttcggggccacaagagagtatgatcgctctttcacagacctgtacatccaaataatacgcgccgcagcggaccgtgatagagaaaccgtgcgggccaagtcaatcgaaatgaaatttctgacgggttacgaagtgaaagtcatggaggatgcacatctcgatgcaatcctgatcctgggcgaagcattcgcttctgatgaaccctttgatttcgggactcagagcactacggagaagattcacaatctcatccccgttatgctgcggcataggctggtgccaccgccagaggaaacctatagcttgcacaggaaaatgggtggctccttccttatttgtagcaaacttaaggccagatttccatgcaaggcaatgtttgaagaggcctactctaactattgcaaacgccaggcgcaacagtag

SEQ ID NO: 106707 - DNA, 1944 bp, Artificial Sequence
  Description of Artificial Sequence: Synthetic coding sequence
atggctgccatcctgggggacaccattatggtcgcaaaggggctggtgaaactgacccaggcagctgttgaaactcacctgcagcacctggggatcggaggggaattgattatggccgctcgtgcgcttcaatctactgcggttgagcagattggaatgtttctgggcaaagtgcagggacaagacaaacacgaggagtacttcgccgaaaactttggaggacccgaaggggagttccatttctctgtgccacatgccgctggagcctctacagacttttcctcggcaagtgcaccagaccagtccgccccgcctagcttaggccacgcccatagtgagggtcctgcaccagcatatgttgcctccggtcctttccgtgaggcagggttccccggacaggcaagctcccccctcggaagggccaatggcaggttattcgccaatcctagggactccttttcagccatgggattccagcgcaggttcttccaccaggaccagtctcccgtgggaggattgaccgctgaggacatagaaaaggcgaggcaggccaaagctcgacccgagaacaaacaacacaagcagaccctgtcagagcacgctcgggagcggaaagtcccagtgactagaatcggaaggctcgccaactttggagggcttgcagtagggctcggcttcggtgccctcgcagaggtcgcaaagaagtcgctgcgttctgaggacccatctggcaagaaggcggtgctgggctcatctcctttcctttccgaggcaaacgctgaaaggatcgtgagaactctgtgcaaagttcgcggcgctgcattgaaactcggtcagatgctttctattcaggatgatgccttcattaatccacacctggcaaaaatttttgagcgagtacgccagagcgctgattttatgccactcaaacagatgatgaagacacttaacaatgacctgggacccaattggcgggataagctggagtatttcgaagagagaccttttgcggccgcttccattggtcaggtgcatctcgcgcgcatgaaaggtgggcgcgaggtggcgatgaaaatccagtatccaggagtcgcgcaatccatcaactctgacgttaataacctgatggccgtgctgaatatgagcaatatgcttcctgaaggcctatttcctgagcacctcatagacgtcctgagacgggagctggccctggagtgcgattatcaaagagaggctgcctgcgcacgcaagttcagagacctgctcaaaggtcaccccttcttctacgtccccgaaattgtggacgaattgtgtagtcctcacgttcttaccactgagttggttagtggctttccgttggaccaagcagaagggctcagtcaagagatccgcaacgaaatctgttacaacattctggtgctgtgcttgcgagagctattcgaattccactttatgcaaaccgatcccaattggtctaatttcttctatgatccacagcagcacaaggtggctctgctggacttcggcgctacacgcgagtacgatcgctccttcaccgacctgtatattcagatcatacgggcagccgcagatagagaccgtgagactgtgcgcgccaaaagtatcgagatgaagttccttaccggctatgaagtaaaggtcatggaagacgcccacctggacgccatcctgatccttggggaggccttcgcttccgatgaacccttcgattttggaacccagagcacaaccgagaaaatccataacttaatcccagtgatgctgcggcatcggcttgtgccgcctcccgaggagacatattcacttcataggaagatgggcggttcttttctgatctgctcaaagctgaaggcccgtttcccatgcaaagcaatgtttgaggaagcttattctaactactgtaagcggcaggcacaacagtag

SEQ ID NO: 106708 - DNA, 1788 bp, Artificial Sequence
  Description of Artificial Sequence: Synthetic coding sequence
atgttcctgggaaaggttcagggccaggataagcacgaagagtattttgcagaaaattttggaggtcctgagggcgagtttcacttttccgttcctcacgccgcaggcgcttcgactgacttttcatcagcctccgcgcccgaccaaagcgcaccccctagcctgggccacgctcactcagaaggcccagcacctgcttatgtagccagtggccccttccgggaggcaggtttccccggccaggcctcaagtccacttggtagagccaatggccgcctttttgcaaatcctagagattccttttccgcaatggggttccagagacgttttttccatcaggaccaaagccccgttggaggcctgactgccgaagatattgaaaaggcccgccaggcaaaggcccggccagaaaacaaacagcataaacaaaccctgagcgaacatgcccgcgagcggaaggtgcccgtgaccaggatcggccgcctcgccaactttgggggcttagcagtgggactgggcttcggagccctggctgaggtggccaagaagagtctccggagcgaagatccttctgggaagaaggctgtcctcggctcatcacccttcctctccgaagccaacgcagaaaggattgtaaggactttatgtaaggtgcggggcgctgcactcaagctgggccaaatgctgagcatccaggatgacgcgttcattaacccacacctggctaagatctttgagagggtccgccaaagtgccgatttcatgcccctgaagcagatgatgaagaccctcaataatgacctgggacccaactggagagataaactggaatattttgaggagcgtccttttgcagcagcttctatcggccaggtgcacctggctcgcatgaaaggcggaagagaggtcgccatgaagatacagtatccaggggtggctcagtcaatcaattcagacgtgaataatttaatggcagtacttaatatgtctaatatgttacccgaaggtctttttcccgagcatcttatcgacgttttgagacgggaattggctctcgaatgtgactaccagcgtgaagcagcttgcgcccggaaatttcgagatctacttaagggccatcctttcttctatgtccctgagatcgtggatgaactctgcagcccccacgtcctaaccactgagctggtttccgggtttccactggatcaggctgagggactgtcacaggaaattagaaacgagatatgctacaatattctggtcctgtgtttacgcgagctcttcgaatttcacttcatgcagaccgatcctaattggtccaattttttctacgaccctcaacagcacaaggtggctctgctggacttcggcgccacccgggagtacgatcgctcattcacagacttatatatacaaatcatcagagcggctgctgaccgggacagagagacagtgagggctaagtccattgagatgaaatttctcacgggatacgaggtgaaggtgatggaggatgcccatctggatgccatactgatactgggagaagccttcgcttccgatgaacctttcgattttggaacccagagtacaacagagaagattcacaacctcattccggtcatgctgagacaccggctggtgccaccccctgaagagacctacagcttacatcgtaagatgggcggttcctttcttatttgctctaagcttaaagcccggtttccttgcaaggcgatgttcgaagaagcctattcaaactattgcaagcggcaggcccagcagtag

SEQ ID NO: 106709 - DNA, 1944 bp, Artificial Sequence
  Description of Artificial Sequence: Synthetic coding sequence
atggccgccatcctgggtgacactatcatggttgctaaaggcctggtgaagctgacccaagcggctgtggagacacatcttcagcacctcggaataggcggcgaactgattatggccgctcgagctctccagtcaaccgcagtggagcagattgggatgttccttggaaaagtacaagggcaggacaagcatgaggaatacttcgcagagaactttggcgggcccgaaggtgagtttcacttctccgtcccacatgcggccggggccagcaccgacttttcctcagcttctgctcccgaccagtccgcccctccctccctaggccatgcccactcagaaggcccagctcctgcttacgtggctagcggcccttttcgggaagccgggttccctggacaggcatctagccctctgggccgcgcgaatggacgactgttcgcaaatccaagagactctttctcggcaatgggatttcagcggcgcttctttcaccaggatcaatcccctgtcgggggccttaccgccgaggatatcgaaaaggcgcggcaagctaaggctagacccgagaacaagcagcataagcaaacactttcagagcacgcacgagagcgcaaggtgccagtcacacgcattggccgcctggccaacttcgggggcctggctgtcggactggggttcggagccctcgccgaggtggccaaaaagtcgctacgaagcgaagacccaagcggaaaaaaggcagtgcttggctcgagcccatttctttcagaggccaacgccgaacgaattgttcggactctctgtaaagtcaggggcgcggcacttaagctaggacagatgttgtcaatccaagacgacgcattcatcaacccccatctggcaaaaatctttgagcgtgtgcggcagagcgctgattttatgccgcttaaacagatgatgaaaactttgaacaacgacctgggcccgaactggcgggataagctcgagtattttgaggaaagacccttcgctgctgcttccattggccaggtgcacttagcccgcatgaaggggggccgtgaagtcgcaatgaaaatccaataccctggcgttgcccaatccatcaattcggacgtgaataacctcatggctgtgcttaatatgagcaacatgctgcccgaaggtctgttccccgagcatctgattgatgtgctacgccgcgaacttgccttagaatgtgactatcaacgggaggctgcctgcgcccggaaatttcgggacctgttaaaggggcatccttttttctacgtgccagaaattgtcgacgagctctgtagtcctcacgttctaacaacggaactggtttcaggatttcctctggaccaggcagagggcctgtcacaggagatcagaaatgaaatttgctacaatatactcgtgctgtgcctcagagagctgtttgagtttcatttcatgcaaactgatcccaattggtcaaacttcttttatgacccacagcagcacaaggtggcacttctggacttcggggctacaagagaatacgatagatcattcactgacctgtatattcaaatcatccgggctgctgctgaccgcgatagagagacggttagagcgaagtccatcgaaatgaagtttctgactggatatgaagtgaaagtgatggaagacgcccaccttgatgcaattctgatcttaggggaagccttcgctagcgatgaacctttcgattttggtacccagagtacgaccgaaaagattcacaaccttatccctgtcatgctccgccacaggcttgtgccccccccagaagaaacatattcactccacaggaaaatgggcggtagcttcctcatctgctcaaagctgaaagccaggttcccttgtaaggctatgttcgaggaggcctattccaactattgtaagaggcaggcacagcagtag

SEQ ID NO: 106710 - DNA, 1797 bp, Artificial Sequence
  Description of Artificial Sequence: Synthetic coding sequence
atggccgcccgggctctacagagcaccgcggtggaacagataggaatgttcctgggaaaggtccagggacaggacaaacacgaagagtatttcgctgagaatttcggggggcctgaaggggagtttcacttcagctctgcttcagccccggatcagtcggcacccccaagtctcggccacgcccacagcgaagggcccgcaccagcatatgtagcctccgggccttttagggaagccggctttccgggacaggcatcgtcacctctgggccgcgctaacggccggctgtttgccaatccccgggatagcttctcagccatggggtttcagcgacgtttttttcaccaggatcagagcccagtgggaggccttacggcagaagatatagagaaggcgcgccaggccaaggcgcggcctgagaacaagcagcacaagcagaccctgtctgagcatgcccgcgagaggaaggtccctgtcacccggatcgggaggttggccaattttggagggctcgccgtcggacttggcttcggggctctggctgaggtcgcgaagaagagcctgagatccgaggatccctccggtaaaaaagccgtattggggtctagcccatttctgtctgaggcaaatgccgaaagaatcgtgaggaccctatgtaaggtaaggggcgccgccttaaagctcgggcaaatgctgagcattcaagacgacgccttcatcaacccgcatctggccaagatttttgaacgggtgaggcagtcagcagatttcatgcctctcaagcagatgatgaagaccctgaataacgatctggggcctaattggagggacaaacttgaatacttcgaagaacgcccgttcgctgccgccagcatcggccaagtgcacttggcacgcatgaagggcggaagagaggtggccatgaagatccagtaccctggggtagcgcagtcaatcaactccgacgttaataatcttatggccgtcctgaacatgtcgaacatgttaccagaagggctgttcccagaacatctcatcgacgtgctgaggcgcgagttggccctggagtgcgattaccagagagaggccgcctgcgctcgcaagttccgcgacctcctcaaaggccacccttttttttacgtaccagaaatagtggatgagctgtgtagcccgcatgtgttgacaactgagctcgtatccggattcccccttgatcaggctgaaggcctttcacaggaaattcggaatgagatctgttacaacatccttgtgctgtgtctaagagagctattcgagttccacttcatgcagaccgaccccaactggagtaatttcttctacgatcctcagcagcataaggtcgcactcttggattttggcgccacccgcgagtatgataggagctttacagacctgtacattcagatcatccgagcggcggctgatcgggatcgagagacagtccgcgccaagtctatcgagatgaaatttctgactggatacgaagtgaaggtaatggaggatgcccatctggacgcgatcctgattctaggcgaagccttcgcctcagacgaacctttcgacttcggtacccagtccacaactgagaagatacataaccttataccggtgatgctgagacaccgacttgtgccccccccagaagagacatacagcctgcatcggaagatgggggggtcttttctaatttgctcaaagttgaaggcaagatttccctgtaaagcaatgttcgaggaggcgtacagtaactactgtaagcgccaggcacaacaatag

SEQ ID NO: 106711 - DNA, 966 bp, Artificial Sequence
  Description of Artificial Sequence: Synthetic coding sequence
atgttgagtatccaggatgatgcatttattaacccacatctggccaaaatattcgagcgagtccgtcaaagcgcggattttatgcctctgaagcagatgatgtacccaggggtggcccagtctataaattcagatgtgaataatctgatggctgtgcttaacatgtctaacatgcttccagaagggctctttcctgaacacctgatcgatgtcctgcgacgtgaactagcgttggagtgtgattatcagcgagaagcggcctgcgcgcgaaagttccgcgatctgctgaagggtcacccatttttttatgtcccagaaatcgttgacgaactgtgtagcccacatgttttaaccactgagttggtctcaggatttcccttagaccaggccgagggcttaagtcaggaaatccgcaatgagatctgctacaacattcttgttctctgtctgcgggagctctttgaattccatttcatgcagaccgacccaaattggagtaatttcttttatgacccccagcagcacaaggtcgcgttactggattttggtgccacgagggaatacgacagaagtttcacggatctctatatccagatcatccgcgccgccgcagatagagatcgcgagactgtcagagcaaagtctatcgagatgaagttcttaactggttacgaagtaaaggtgatggaagatgcgcatctcgatgccatcctgatactcggggaggccttcgcgagcgacgaaccttttgactttggaacccagtctactaccgagaagattcacaatctgatcccagtgatgctaagacaccgcctagtcccccctcccgaggaaacgtattcattgcaccgaaagatgggcggcagctttctgatctgctctaagctcaaggcccgctttccttgcaaggccatgtttgaggaggcctatagcaattattgcaaacgacaggcccagcagtag

SEQ ID NO: 106712 - DNA, 1107 bp, Artificial Sequence
  Description of Artificial Sequence: Synthetic coding sequence
atgctgagcatacaggatgacgccttcatcaacccacacctggccaaaatcttcgagcgcgtccgtcaatctgctgactttatgcctttgaaacagatgatgaagacactcaataatgacctggggccgaattggcgcgacaaactggagtattttgaggagcggccatttgccgccgcttccataggtcaggttcacttagcccgtatgaaggggggcagggaggtagcaatgaaaatccagtaccctggggtggcccagagcattaattcagatgtcaacaatctgatggccgtgctcaacatgtccaacatgctgcctgagggtctatttcctgagcatcttatcgacgttctcagaagagagcttgcgcttgaatgcgattatcaaagggaggcagcttgcgcccggaagttccgcgatctcttgaaaggccacccattcttctacgtcccggaaatcgtggacgagctctgttcgcctcacgttcttaccactgagctggtgtcgggattccccctagaccaggccgaaggactgtcccaggagattcggaatgagatttgttacaacatccttgtcctctgtcttagggagctctttgaattccacttcatgcagacggatccgaactggtcgaacttcttttatgatcctcagcagcacaaggtcgcactgttggatttcggtgccacccgcgagtatgatagatctttcactgacctgtatatccagatcattagagcagccgccgacagggaccgggaaacggtccgggctaagagtatcgaaatgaagttcttgactggctacgaggttaaagtgatggaggacgctcacctcgatgccatactcatactgggcgaggcctttgcaagtgatgagccttttgattttggcacccaaagcaccaccgagaagatccacaatctgatccccgtgatgctccgccatcgcttggttccaccacctgaagagacctactccttacacagaaagatgggcggcagctttttgatttgcagcaagttaaaggcacggtttccgtgcaaagccatgttcgaggaggcttacagcaattattgtaaacggcaggcacagcagtag

SEQ ID NO: 106713 - DNA, 3591 bp, Artificial Sequence
  Description of Artificial Sequence: Synthetic coding sequence
atgccgacagcagagtcagaggccaaggtgaaaacaaaagtccggtttgaggaactcctgaaaacacattcagaccttatgcgcgagaagaagaagctgaaaaagaagctagttcggagcgaggagaacatttcccccgataccatacggagtaacctgcactatatgaaggaaactaccagtgacgatccagacaccattcggtccaatctgccccatataaaggagactaccagtgatgacgtttcagctgcaaacactaataatctgaagaaaagcacccgggtgaccaagaacaagcttcgcaatacacagctggcgactgagaaccctaacggcgacgcctccgtggaagaggacaagcaggggaagccaaataaaaaggtcatcaaaaccgtgccacagctgacaactcaggatctaaagccggagacacccgagaataaagtggactcaacccaccagaaaactcacacaaagccacagcctggcgttgaccaccaaaagagcgagaaagcaaacgagggtcgcgaagaaaccgacctggaggaagatgaggagcttatgcaggcatatcagtgtcacgtcaccgaggaaatggccaaggagattaaacgaaaaatacggaaaaagctcaaggagcagctcacatactttccttctgacactctgtttcacgacgataagctgtctagtgagaagaggaagaaaaagaaagaggtcccggtgttcagcaaagccgagaccagtaccttgactattagcggcgataccgtggaaggggagcagaagaaggagagtagtgttcgatctgtgtcttcagatagtcatcaagacgatgaaattagcagcatggagcagtcgactgaggatagcatgcaagatgacacgaagccaaagcccaaaaagacgaaaaaaaaaaccaaggccgtggccgataataacgaggacgttgatggcgatggtgtgcacgagatcaccagtcgtgactctccggtctacccaaaatgtctgctggatgacgatctggtattgggtgtctatattcaccgcactgatcgccttaaatctgattttatgataagccatcccatggtcaagatacatgttgttgacgaacacacaggccaatacgttaaaaaggacgattcaggtaggcccgtctcaagttattacgaaaaagagaatgtggactacatcttacccatcatgacacagccctacgacttcaaacaactaaagtcacgtttgcccgagtgggaggaacagattgtcttcaacgaaaatttcccatatctcctgagggggagcgacgaaagccctaaggtcatcctcttttttgagattctcgatttcttatccgtagacgaaattaagaacaactctgaggttcaaaaccaggaatgcggattcagaaagatcgcttgggcattccttaaactcctcggcgccaatggaaacgcaaacattaacagtaaactcaggctgcagttatactaccctccaactaaaccccggtctcccctgagtgtggtggaagcttttgaatggtggtcaaagtgtccacggaatcattacccatcaacactgtatgtgacagtccgcggcctaaaggtcccggattgtataaagccttcctaccgatctatgatggcacttcaggaagaaaagggcaagcccgtccactgcgagcggcaccacgaaagctcctctgtcgacacagaaccggggctcgaagaatcaaaggaagttattaaatggaagaggttacctgggcaggcctgtaggattccaaataaacatctgtttagcctgaacgctggtgagcgagggtgcttttgtctggattttagtcataacggcaggatactggccgccgcttgcgcttctcgcgatgggtatcccatcatcctgtatgagatcccgagcggcaggtttatgcgagaattgtgtggacatctaaatattatctacgacctaagttggtcaaaagatgatcattacattctgacatcttcttccgatggcaccgctaggatatggaagaatgaaatcaataacaccaacaccttccgagttctcccgcacccatccttcgtatacacagcaaaatttcatccagctgtccgcgagctcgtggttaccgggtgttatgattcgatgatcaggatctggaaggtggaaatgcgagaagacagtgctatcttagtgagacagtttgacgtgcacaagagctttatcaatagcctgtgcttcgatactgagggccaccacatgtactctggtgactgcaccggcgtcatcgtggtgtggaatacctacgtgaaaatcaacgacctcgagcattcggttcatcactggacgattaacaaagagattaaagaaactgagtttaagggaatcccaatctcttacctggaaatacaccccaatggaaagcggcttctcatccataccaaagattcgacactccggattatggacttgagaattctggttgccagaaaatttgtgggagcggcaaactaccgagagaaaatccattcaaccctcaccccttgcggaacattcttgtttgctggaagtgaagatggcatcgtctatgtgtggaatccagaaacaggtgagcaggtcgcgatgtactctgatctgccttttaagtcccccatcagagatatctcataccaccctttcgagaacatggtcgcattttgcgcgttcggacaaaatgaacccatcctgctgtacatctacgactttcacgttgcacaacaggaggctgaaatgtttaaacgatacaatgggaccttccctttacctggaatccaccagtctcaggacgctctgtgcacatgtccaaagttaccccatcagggatcttttcagattgacgagttcgtccatactgaatccagcagcactaaaatgcagctggtgaagcagcgcctcgaaaccgtcacagaggtcatccgctcatgcgctgctaaggtgaataagaacctgtctttcacttctcccccggcggtgtcttcccagcagagcaagctgaagcagagcaacatgctgactgcacaagagatcctgcatcagtttggcttcacccaaaccggaattatttccattgagaggaaaccttgtaaccatcaagttgacactgccccaacagtggtggccctctatgattatacagctaatcggtctgatgagcttaccatccacagaggtgacatcatacgagtgttctttaaggataatgaggactggtggtacgggtcgattggcaaaggccaggaaggctatttccccgccaatcatgtggctagtgagaccctttaccaggaacttcctcccgagattaaagagcgctctccacccctatctcccgaagaaaagaccaaaattgaaaaatctcccgcaccacagaaacagagcataaacaagaataagagccaggactttcgcttgggtagcgagagtatgacacacagcgaaatgcgaaaagagcagtcccacgaagaccagggacatattatggacacacgaatgcggaagaataagcaagctggcagaaaggttactctgatcgaatag

SEQ ID NO: 106714 - DNA, 3162 bp, Artificial Sequence
  Description of Artificial Sequence: Synthetic coding sequence
atgcctaccgcagagtctgaggccaaggtcaagaccaaggtgcgctttgaagaattactgaagacccactctgatttaatgagagagaagaaaaagttgaaaaagaaactggtgcgcagcgaggagaatatttcgcccgacacgatccggtccaaccttcactatatgaaggaaacaacctctgacgaccccgatacaatccgttcaaatctgccccacattaaagagacgacatcagacgacgtcagcgctgcaaataccaataatctgaaaaaaagcactagggtgacgaagaacaaactgcgcaacactcaactagccacagagaaccccaacggggacgctagtgtggaagaagataaacagggcaagcctaataagaaggtcattaaaaccgtcccacagttgaccacccaagacctcaaacccgagaccccggaaaacaaggtagacagcacacatcaaaagacacacacgaagccgcagcccggtgtcgatcaccagaaaagcgaaaaggccaacgaaggccgtgaagaaacagacttggaggaggatgaagaactcatgcaggcataccagtgccatgtcactgaggagatggcgaaagaaatcaaacgcaagatccggaagaagctaaaggaacaactgacatatttccctagcgacactctgttccacgatgataaactctcaagcgaaaaaagaaagaaaaagaaggaggtcccagttttcagtaaggcggagactagtaccctgactatttcaggcgatactgtcgaaggcgaacagaagaaagagtcatccgtccgcagcgtaagcagcgactcccaccaagatgatgaaataagctcaatggaacagtcaactgaggactcaatgcaggatgataccaagcctaagcctaagaagacgaagaagaagacaaaagccgtggccgataacaacgaggatgtggacggcgatggagtgcacgagatcacttcacgagactctcccgtgtacccaaaatgcctcctagatgatgacctggtgctcggagtttacatccataggaccgatagattgaaatctgatttcatgatcagtcacccaatggtgaaaattcacgttgtggacgagcataccggacagtatgtcaagaaagacgactccggtcgcccagtctcctcctattatgaaaaagagaacgtggattacatcctacccatcatgacccagccatacgattttaagcagctaaagagtagacttcctgagtgggaagaacaaatagtctttaatgaaaacttcccgtacctgttgcgtggctcagatgagtccccgaaggtgatcctgttttttgaaattttggatttcctgtctgtggacgaaattaaaaacaattctgaggtgcagaatcaagaatgcggcttcagaaaaatcgcttgggcctttttaaaactattgggtgccaacggaaacgctaacatcaactctaagctgagattacagctgtattaccccccaaccaaaccaagatcgcccctttccgtggttgaggcatttgagtggtggtctaaatgtccccggaaccactacccgtcaactttgtatgtcacagtccggggcctgaaggtccctgattgtataaagcctagttaccggtctatgatggcgttacaggaagagaagggtaaacccgtgcattgcgagcggcaccacgaatctagttcagtcgacacagagcccggcttagaggagtccaaggaggtgatcaagtggaaaaggttacccgggcaggcatgtcgaataccaaataaacacctgttcagcctgaatgctggagagcggggctgtttctgtctcgacttctcacacaatgggaggatattggccgcagcttgcgcgagtcgagacgggtaccccattatactgtacgagatcccatctgggcgctttatgcgtgagctgtgtgggcacttaaatatcatctacgatctttcttggagcaaggacgatcattacatcctcacctcttcaagcgacggaaccgctaggatttggaagaatgagattaacaacaccaacacattccgggtcttgccacacccgtcctttgtgtatacagcaaaattccatcccgcagtgcgcgaactcgtggtgacggggtgctacgatagcatgatccgaatttggaaagtcgaaatgcgagaggactcagcaatcttggtccggcagttcgatgttcataagagttttattaatagcctgtgcttcgacacggagggccatcacatgtacagcggggactgtaccggagtgatagtggtgtggaacacctatgtcaagatcaatgatctcgagcacagcgttcatcactggacaataaacaaggagattaaggagactgaattcaagggtatcccaatttcctatcttgaaatccaccctaatgggaaaagactgctgattcacaccaaagattcaacactacgcatcatggacctacgcatactggtggcgcgcaaatttgtaggcgccgccaactatcgcgaaaagattcatagtacattaaccccatgtgggacctttctgtttgctggtagcgaggatgggatcgtgtacgtgtggaatccggaaacaggagagcaggttgccatgtactcggacctgcccttcaagtcccctatcagggatatttcataccaccctttcgaaaatatggttgctttctgcgcctttgggcaaaatgagccaatcctactctacatttacgatttccacgtggcacagcaggaagccgaaatgttcaagcgatataacggcacgttcccattacccggtatacatcagagccaggatgctctgtgcacgtgtcccaaactgccccaccaggggtctttccagatcgacgaattcgtgcataccgaatcaagttcaaccaagatgcaattggtaaagcagagacttgagacggtaacagaagttattcgctcttgtgctgccaaagtgaacaagaatttgagttttacgtcccctccagcagtgtcctctcagcagagcaagctcaagcagtctaacatgctcactgctcaggagatactacatcaattcgggtttacccagactgactctcactttgcggaattcaacacgtgcatcctgtggtggaagaagcattag

SEQ ID NO: 106715 - DNA, 165 bp, Artificial Sequence
  Description of Artificial Sequence: Synthetic coding sequence
atgcctaccgccgagtcggaagctaaggtcaaaacgaaggtgcgctttgaggaactgctaaaaacacacagtgatttgatgcgggaaaagaaaaaactgaaaaaaaaactggttaggtccgaagagaatatttctaaccaggaaaaatcaatggccgtctggtag

SEQ ID NO: 106716 - DNA, 3591 bp, Artificial Sequence
  Description of Artificial Sequence: Synthetic coding sequence
atgcctacagctgagtccgaagcgaaggtgaagactaaggtgcgcttcgaggagttgctgaagacccactcggatctgatgagggagaaaaaaaaactgaagaaaaaactggtgcggtccgaggagaatattagccccgacactattcgctctaacctgcattatatgaaggagaccaccagcgacgacccagataccatccgctcaaacctgcctcacataaaagagactacttccgacgacgtgtccgccgcgaacacaaacaatcttaagaaaagcactagagtgacaaaaaataaattgcggaatacacagctcgcgacagaaaaccctaatggcgatgcgagcgtggaagaggataaacaggggaaacccaacaagaaagttattaaaacagtgccccaattaaccacacaggatctgaagccagagacacccgaaaataaagtcgattccacacatcaaaagacccacacaaaacctcaaccgggtgtggaccatcaaaaatccgagaaggccaacgagggcagggaagagacagacctggaggaggacgaagagctcatgcaagcctatcagtgtcacgtcaccgaggagatggccaaggagataaaacgcaaaattcggaaaaagcttaaggagcagctaacgtatttccccagcgatactctcttccacgacgataagctgagtagcgaaaagagaaagaagaagaaggaggtgcccgttttcagtaaagccgaaacgtctaccctcaccatctcaggcgacaccgtagaaggtgagcaaaaaaaagagtcgtccgtgagaagcgtcagctctgactctcatcaggacgacgagatctcttcaatggagcagagcacagaagacagtatgcaggacgataccaaacccaagccgaagaaaacaaagaagaagactaaggctgttgccgacaataacgaagacgtcgatggagacggcgtgcacgagattacatctagggactcacctgtttatcccaaatgcctactggacgacgacctagtgcttggagtgtacatccaccggacagatagactaaaatccgacttcatgattagccacccaatggtgaagatccacgtggtggatgagcatacaggtcagtacgtaaagaaagatgactctgggagaccggtttccagctactatgaaaaagaaaatgtggactacatcctgcctataatgactcagccatatgatttcaaacagttgaaatcccgcctgcctgaatgggaggaacagattgtctttaacgagaacttcccatacctcctccgtggctctgatgaatcccctaaggtcatactgttctttgagatcctggatttcttgagtgtcgacgagattaaaaacaacagcgaggtgcagaaccaagagtgcggattccgcaagatagcctgggccttcctcaagctcctgggagcaaacggcaatgcgaatataaatagcaaattgcgcctccaattatattaccccccaaccaagccgcgcagccctctgagtgtggtggaagccttcgaatggtggtccaagtgccccagaaatcattacccaagtacgctgtatgttactgtgagaggactgaaggtccctgattgcatcaagccatcgtaccgcagcatgatggcgctgcaagaagagaaaggcaaacctgtccattgtgagagacaccacgaaagttctagtgtagacaccgaaccgggcctggaggagagcaaggaggtgataaagtggaagagactccctggacaggcttgccggattcctaacaagcatttgtttagtctgaacgcaggtgagagagggtgcttctgcctggactttagtcacaatgggcgcatcctggctgccgcgtgcgccagtagggacggttaccccatcatactgtacgagatcccatcaggaaggtttatgagagagctatgcggtcacctgaatatcatttacgatctcagttggtcaaaggacgatcattatatactcacctcctcctcagacggtacagcgcgaatatggaagaacgaaatcaataataccaacacatttagagtcttaccccatccatcctttgtatatactgctaaatttcaccctgctgtccgcgaacttgttgtgaccggatgttacgactccatgattagaatttggaaagttgaaatgagggaggactctgccatattggtaaggcagtttgacgttcacaaatctttcatcaacagcttgtgcttcgacaccgagggccaccatatgtattctggcgactgcaccggcgtgattgtggtgtggaatacctacgtgaaaataaatgatctggaacatagtgttcaccactggaccatcaataaagagataaaagaaacggagttcaagggcattccgatcagctacctcgagattcacccaaatgggaaacgcctgctgattcataccaaggactctactctgcgcataatggaccttagaatccttgtagctaggaagttcgtgggcgccgctaattaccgcgaaaaaattcacagtacgttaaccccctgcggaacgttcctgtttgcgggctctgaggacggcatcgtctatgtgtggaacccagaaactggtgagcaggtggccatgtactctgacttaccctttaaatcacccatcagagatatctcatatcatcctttcgagaatatggttgccttctgtgcctttggccagaacgagcctattctcttgtatatttacgattttcacgttgcccagcaggaggcggaaatgttcaaaaggtataatggcacttttccgctcccaggcatacatcaatcccaggatgccttgtgcacctgtcccaagttgccgcaccaaggttctttccaaattgacgagtttgtgcacactgagagttcctcgacaaaaatgcagctcgtcaagcagcgcctggaaactgtgaccgaggtaatacgctcctgtgcagccaaagttaataagaacttgtctttcacctcaccccccgcggtgtcctctcagcagtccaagttaaaacagagcaacatgctgacagcccaggaaatcctgcaccagttcggcttcacccagaccgggatcattagtattgaacgtaagccttgcaaccaccaggtcgatacggcaccaaccgtggtggctttatatgactataccgccaataggagtgatgagctgacaattcataggggggatatcatccgcgttttttttaaggacaatgaagattggtggtacggaagtattggaaaaggacaggagggttacttccctgctaaccacgtggcaagcgagaccctgtaccaagagttaccaccagaaattaaggagagatcacctccattgagcccagaggaaaaaaccaaaatcgagaagtccccggcccctcagaaacagtcaatcaacaaaaacaagagccaagattttcggctgggcagcgagtccatgactcacagcgagatgcgcaaggagcagtctcacgaggatcagggccatatcatggacacaaggatgaggaaaaacaagcaagctggtcgaaaggtgacattgatcgagtag

SEQ ID NO: 106717 - DNA, 3162 bp, Artificial Sequence
  Description of Artificial Sequence: Synthetic coding sequence
atgccgaccaccgagtcagaagcaaaagttaagacgaaggtgcgcttcgaagagttactgaaaacccactccgaccttatgagggaaaagaagaagttaaaaaagaaattggtgcgatcggaggaaaatattagccccgacaccattagatctaacctgcactacatgaaagagacaacctctgatgacccagatactatcagaagcaacctgccacatattaaagagacaacgtccgacgacgtgtctgctgcaaacaccaacaacctgaaaaagtctacacgggtaaccaagaacaagttgcgtaacacgcagctggccaccgagaatcccaacggcgacgcgtccgtggaagaggacaagcagggcaaaccaaataaaaaggtgattaagacggtgccccaactgactactcaggatctgaaaccagagactcctgagaacaaagtcgattccacccatcagaaaacccacacaaaaccccaacctggggttgatcaccagaaatctgagaaagccaatgagggacgagaagagaccgatctggaagaagatgaagagctgatgcaggcatatcaatgtcacgttaccgaagagatggccaaagaaattaaaagaaaaatcagaaaaaaattgaaagaacagcttacgtattttccctcggatactctgttccatgacgacaaactgagctctgaaaaacgaaagaagaagaaagaggtgccagtcttctcaaaggcggaaacctctacactgacaatctctggggataccgtcgagggggagcagaagaaggaaagtagcgtgagatccgtctcctcagactcccaccaggacgatgagataagttctatggaacagtccacagaggatagtatgcaagacgatactaagccaaaaccaaagaaaaccaagaagaagaccaaagcggtcgccgacaacaatgaggacgtggacggggacggtgtgcatgaaattacatcgcgcgatagccccgtttaccccaagtgtctcctagacgacgatctggtcctgggggtgtatattcatcgaactgaccgcttgaagtccgacttcatgatttcacaccctatggtgaaaatacacgtagtagacgagcacaccggtcagtacgtcaaaaaggatgattccggccggcctgtaagctcatactatgagaaagagaacgtggattatatccttccaatcatgactcagccctatgatttcaaacagctgaagtccaggctgcccgaatgggaggagcagattgtcttcaacgaaaatttcccatacttgctccgcggcagcgatgagagcccaaaagtgattctgttcttcgagattctcgacttcctctccgtggacgaaatcaaaaataacagtgaagtccagaaccaggagtgcggatttcgtaaaatcgcctgggcctttttgaaactattgggcgccaatgggaacgccaacatcaacagcaagcttcggcttcaattatactatccccccaccaaaccgcggagccccctgagtgtggtggaagcgtttgagtggtggtcaaagtgccctaggaatcactatccgtctacactctacgtgacggttcgcgggctgaaggtgcccgactgcatcaagccttcctacagatctatgatggcattgcaagaggagaagggcaaacccgttcactgtgagagacaccacgagtcatcctcggtggataccgagcccggcctcgaagagtcaaaggaggttattaaatggaaacggcttcctggacaggcgtgtcgaattcctaacaagcacctgtttagcttaaatgcgggcgaaaggggatgcttttgcctggacttttcacataacggacgcatcctagccgctgcctgtgcgagcagagatggctacccaatcatactgtacgaaatccctagcggacgcttcatgcgagaattgtgtgggcacctgaatattatatatgatctgtcatggagcaaagacgaccattacatactcacatcaagttccgacggaacagcaaggatctggaagaatgaaattaacaacacaaacaccttcagggtgttgccacatccatcttttgtttataccgctaagtttcacccagcagtacgggagcttgttgttaccggctgttacgactcaatgattcgaatttggaaagtggaaatgcgggaggatagtgctattttagttcgacagttcgatgtccacaaatcctttattaactcgttgtgcttcgacactgaaggtcaccatatgtatagcggtgattgtaccggcgtgatcgtcgtgtggaatacatacgtgaagatcaacgacctcgaacactctgtccatcactggacaatcaacaaagagatcaaggagaccgaattcaagggcattcccatcagctacctggagatccatcctaacgggaagagattgctcattcacactaaagactcaaccttacgcatcatggatctcaggattttagtggcaagaaagtttgtcggagcggctaattatcgggaaaagatccactcaacattgaccccctgcggtacctttttgttcgctggctctgaagatgggattgtgtacgtttggaatcccgagaccggggaacaagtcgctatgtattccgacttgccttttaagagccctatccgtgacatttcctatcatccctttgaaaatatggtcgccttctgcgcgtttgggcaaaacgagcccattcttctttatatctatgactttcatgtggcccagcaggaggccgaaatgtttaagagatataatggtacttttcctctgcccgggatccatcagtcgcaggacgctctgtgcacgtgccctaagttgccacaccagggatcctttcagattgatgagttcgtccatacagagtcctcatctaccaagatgcaactggtgaaacagcggttagagaccgtaacagaggtgataaggtcgtgcgctgcaaaggttaacaaaaacctcagcttcacatctccaccagccgtttcctcacagcaatccaagctgaagcagtccaatatgcttactgcccaggagattttgcaccagtttggctttacgcagacagatagccatttcgccgagttcaacacatgtattctttggtggaaaaaacattag

SEQ ID NO: 106718 - DNA, 1497 bp, Artificial Sequence
  Description of Artificial Sequence: Synthetic coding sequence
atgagagaactgtgtggccacctgaacattatctatgacctgagttggtccaaggacgaccattacatcctgacatcatcatcagacggaacggcccgtatatggaaaaacgagatcaacaataccaacactttccgggtgctgccgcacccttccttcgtgtacaccgctaaattccaccctgccgtaagggaacttgtcgtgactgggtgttacgattctatgattcggatctggaaggtcgaaatgcgggaagatagtgctatactcgtgcgtcagttcgacgtgcacaaaagctttattaactccctgtgtttcgatacagaaggccaccatatgtacagcggtgattgtaccggcgtaatagtggtttggaatacctacgtgaaaatcaacgacttggaacactctgttcaccattggactattaataaagagatcaaagagacggaattcaaggggattccaataagttatcttgagatccaccccaacggcaagaggctgctcatccacacaaaggactctaccctcaggatcatggatctgcgcattttagtcgctcgcaagtttgtgggagccgccaactacagggagaaaattcactctactctgactccctgcggcacttttctctttgccggctctgaggatggcattgtgtacgtttggaatcccgagaccggcgagcaggttgccatgtactccgacctgcccttcaagtcgcccataagggacattagttaccatcctttcgaaaatatggttgccttctgcgcattcgggcagaacgagcccatccttctgtatatctacgatttccatgtggcacagcaggaagctgaaatgttcaagcgctacaatggtacattccccctgcctggaattcaccagtcccaggacgcactgtgcacctgccccaaactgccacatcagggaagctttcaaatcgatgagtttgttcatacagagtcatcaagtacaaagatgcagcttgttaaacagcggctggagactgtgactgaggtgattcgctcatgtgccgcaaaggttaataaaaacttgtcatttacgtctccccctgccgtgtcatctcagcagtctaagctgaagcagtcaaacatgttaaccgctcaggagattctccatcagtttggattcacacagacaggcataatctccatcgaaaggaagccctgcaaccaccaagtcgatacggcaccaacagtggtcgctttgtacgactatactgccaatcgaagtgacgagctgacaatacatcggggcgatataatccgcgtgttctttaaggataacgaggactggtggtacggctcaataggaaagggacaggaaggctatttcccagcaaaccatgtggctagtgaaacactttaccaggagttgccacccgaaattaaagagaggagcccgccattatcaccggaagaaaaaaccaaaatcgaaaagtctcccgccccacagaaagtaaaatag

SEQ ID NO: 106719 - DNA, 3591 bp, Artificial Sequence
  Description of Artificial Sequence: Synthetic coding sequence
atgcccacagcagagtccgaggccaaggtgaaaacgaaagtgcgtttcgaagaactcctcaagacccatagcgatctaatgagagaaaaaaaaaaactcaagaaaaaactggtgcgaagcgaggagaacatctctcccgacaccatccgcagtaatctccattacatgaaggagacaacgtccgacgaccccgacacaattagatcaaatttgccccacatcaaagagactacatccgatgacgtgagcgctgcaaacacaaataatttaaagaagagtacccgcgtcacgaaaaataaactgcgtaacactcagcttgcaaccgaaaaccctaatggcgacgcctcagtcgaggaggacaagcagggcaaaccgaataaaaaggtgattaagactgtcccccagttaacaacccaggaccttaagcccgaaacccccgagaacaaggtcgactccacccatcaaaaaacccataccaagccccagcccggcgtggaccaccaaaaatctgagaaggccaatgagggtagagaggagaccgatctggaagaagacgaagaactaatgcaggcgtatcagtgccatgtcaccgaggagatggcgaaagagatcaaacgtaagatacggaagaaactgaaggagcagcttacgtacttcccctccgacactctgtttcacgacgacaaattgtcatcagagaaaagaaagaaaaagaaggaggtgccagtgttttctaaagctgaaactagcactttgaccatttctggagacactgtcgagggcgagcagaagaaagaatccagtgtgcggagcgtttcttctgatagccaccaagatgatgagatatccagtatggaacaaagcaccgaggacagcatgcaggacgacaccaaaccaaaaccaaaaaagaccaagaaaaagacgaaggccgtggccgacaacaacgaagacgtggatggggacggtgtgcatgaaattacaagcagagactcacctgtgtatccgaagtgtctcctcgacgatgacctggtcctcggagtctacattcatcggactgacagacttaagagcgactttatgatctctcaccccatggttaagatccacgtggttgacgaacacaccggacagtacgtgaagaaggatgacagtgggagaccagtgtcttcatactatgaaaaagaaaacgttgattatattctgcctattatgactcagccttacgacttcaaacagctgaaatcacggctaccagagtgggaggaacagatcgtgtttaacgagaacttcccgtacctacttcgtggatcagatgaaagccccaaagtcatattgttctttgagattctggattttctctctgtggatgaaattaagaataactcagaggttcagaatcaagagtgcggattccgcaagatcgcctgggcctttttgaagctgctcggcgcaaatggaaacgcaaacatcaatagcaagctccgcttgcagctatactatccaccaacaaaacccaggtctccactcagcgtcgtggaagccttcgagtggtggtctaagtgtcctagaaatcactatcctagcactctgtatgtgaccgttcgtggtctgaaggtccccgactgtatcaagccatcttatcggtccatgatggccctgcaagaagaaaaaggcaagcccgtccactgtgagaggcatcatgagtctagtagtgtggataccgagcccggactcgaggaaagcaaagaggtgattaagtggaaaaggctgcccggccaggcctgtcgcatacctaacaagcatctcttcagccttaacgccggggagcgcggatgtttctgcttggatttctcccacaatggtcgcatccttgccgctgcatgcgccagccgcgatgggtatccaatcatcctgtacgagatccccagcggacgctttatgcgggagctttgcggacacttgaatatcatctacgacctgtcttggagcaaggatgatcactacatacttaccagctcttctgatgggacagcgaggatttggaaaaacgagattaataataccaacacattccgcgttttaccccacccatctttcgtctataccgccaaattccaccctgctgtaagggaactcgtggtaaccggatgttacgactctatgattagaatctggaaagtcgagatgagagaggatagcgccatcttagtaagacagttcgatgttcacaagtcgtttatcaatagtttgtgctttgatactgaaggtcatcatatgtattctggcgactgcactggtgtcattgtagtatggaatacctacgtcaaaataaacgatcttgaacactccgtgcatcattggacgattaacaaggagattaaggagaccgaattcaaaggtatcccaatcagctatctggagattcacccgaatggcaagcgcctcttgatacacactaaggatagtaccctgcgcattatggatctgaggattcttgtggcccgcaagttcgttggcgcagctaactatcgcgaaaaaattcatagcacattgactccttgtgggacattcttattcgccggatctgaggacggtatcgtgtatgtctggaatcccgagacaggcgagcaggttgccatgtattcagacctgcctttcaaaagccccattcgggacattagctatcacccttttgagaacatggtagctttctgtgccttcggacagaacgagcccattctgctctatatttacgatttccatgtggcccagcaggaggccgaaatgtttaagaggtataacgggaccttccccctcccaggaatacaccagagtcaggatgccctctgcacttgtccgaagctacctcaccagggctcgttccagatcgacgagttcgtgcatactgagagttctagcaccaagatgcagctggtgaagcaaaggctggagactgtgaccgaggtgatccggtcctgtgctgcgaaggtgaacaagaatctttcattcacatcgccccccgcagtatcttcgcagcagagtaaactgaaacaaagtaacatgcttacagcccaggagattctgcaccaatttggtttcacacaaacaggaataataagcatcgaacgcaagccctgcaatcatcaggtcgatacggctccgaccgtagtggcgctttatgactatacggctaaccgcagtgatgagcttactatccaccgtggcgatattattagggtctttttcaaagacaatgaagactggtggtatggtagcatcggaaaaggccaggagggttacttccccgcgaaccatgtggcgagtgaaacgttgtatcaggagcttcctccagaaatcaaagagaggtctcccccactgtctcccgaggaaaaaacaaagatcgaaaaatcacccgccccccaaaagcagtctatcaataaaaacaaatcccaggatttcagactgggatcagagtccatgactcattccgaaatgcgtaaggagcagtcccacgaggatcagggccatattatggatacacgcatgcgcaaaaataagcaggccggcaggaaagttacactcattgagtag

SEQ ID NO: 106720 - DNA, 1218 bp, Artificial Sequence
  Description of Artificial Sequence: Synthetic coding sequence
atgctgagctccttcctgtccccccagaatgggacttgggccgacaccttctcactcctattagcgctggctgtcgctctgtatctgggttattattgggcctgcgtcctccagcgtccaagacttgtggccggaccgcagttcctagcttttctcgaaccccactgctcgattacaacagagactttttatccgacgttatggtgctttgaagggagactgcagagtatcttccaagtccttctgcagagccagcccttagtgctatatcagtccgacatcctgcagactccggatggtggccagctactcctggattgggccaagcagccggattccagccaagaccctgatcctacaactcagcctatcgtgctgcttctgccgggcatcacgggctcgagccaggatacctacgtgctgcatctggttaatcaagcgctgagagatggataccaggccgtggtattcaacaatcgtgggtgtcggggcgaagaactacggacacaccgagccttctgtgcctcgaatactgaagatcttgaaacggtcgtcaaccatatcaagcacaggtacccacaggctcccctgctggcggtcggtattagtttcggcggaattctggttttgaatcatctcgcccaagctagacaagctgctggactcgtggccgcactgactctcagtgcctgttgggacagtttcgagacaacacggagcctcgagacccctctgaatagtctgctgtttaaccagcctctcaccgccggactgtgccagttggtggagagaaaccgcaaagtcattgagaaggtggtcgacattgattttgtgctgcaggcccgaacaatcaggcagttcgatgagagatacacatctgtggcatttggctatcaggattgtgttacctactataaagccgcctcaccacgaaccaagatcgacgccattcgaatacccgtgctctatctgtcggctgccgacgacccttttagccctgtatgcgccttgcctatccaggctgcccagcatagtccatatgtggcgctcttgattaccgcaagaggcggacatattggcttcctggagggactgctgccatggcagcactggtacatgagtcgactgctgcatcaatacgccaaggcgatctttcaggatcccgagggcttacctgacctgcgagctctactcccaagcgaagacaggaattcttag

SEQ ID NO: 106721 - DNA, 1197 bp, Artificial Sequence
  Description of Artificial Sequence: Synthetic coding sequence
atgaggaaacgaacagagcccgtcgcactggaacatgagagatgcgccgcagcagggagttctagtagtggcagtgctgctgccgcactggacgccgattgccgcctgaaacagaatctgcgactcactggacccgccgctgccgagcccagatgcgctgcagatgcgggtatgaagcgcgccctcggacgtaggaaaggagtttggcttcgactacgcaaaattctgttttgtgtcctcggactgtatatcgcgatcccttttctgataaagctttgtccagggattcaggccaaactgatcttcctgaactttgtgcgtgtgccttattttattgatctgaagaaaccacaggaccaaggactgaatcatacctgcaactattacctccaacccgaagaggatgtgaccattggtgtttggcatacagtcccggctgtgtggtggaaaaatgcccaggggaaggatcagatgtggtacgaggatgcgctcgcatctagccaccccattatcctgtacctgcatggtaacgcaggcactcgcggcggcgaccatcgtgtggaattatacaaggtattaagctcactgggctatcacgtcgttacattcgactaccgtggatggggagacagcgtagggacacctagcgaacggggcatgacatatgatgccttacacgtgttcgattggatcaaggctagaagtggtgacaaccctgtgtatatttggggtcatagcctcggaacaggcgtggcaacaaatcttgtgcggcggctttgcgaaagggagacaccaccagacgctcttattctcgaatcccccttcaccaacatccgagaggaggcgaaaagccatccattctcagtgatttacaggtactttcctgggtttgactggttctttcttgaccccatcacttcgagtggtattaaatttgctaatgacgaaaacgttaaacacatcagctgcccactgttaattcttcacgccgaggacgatcctgtggtgcctttccagcttgggcgaaagctgtacagcatagccgccccagccagatccttccgagacttcaaggttcaattcgtgccctttcattctgatctcggctaccgccataaatatatctacaagagtcccgagcttcctcgcatcttaagggaatttctagggaaatcagagcccgagcaccaacactag

SEQ ID NO: 106722 - DNA, 1215 bp, Artificial Sequence
  Description of Artificial Sequence: Synthetic coding sequence
atgcgcaagaggaccgaacccgtggccctggaacatgaacggtgcgcagctgctggatcctcaagtagcggaagcgcagccgccgcattggatgccgattgtcgcctgaaacagaacctcagactgacaggccctgccgcagctgaacctcgctgcgcagccgacgccggtatgaagcgggcactgggacgaaggaaaggcgtttggctcagactgcggaaaattctattttgcgtgctgggcctgtatatagcgatcccctttcttataaagctctgtcctggaattcaggcaaagctgatctttttaaactttgtccgcgtgccttatttcatagatctgaaaaagccacaggatcagggactgaatcacacttgcaattactacctgcaacccgaggaggatgtgaccattggagtctggcatacagtgccagcagtatggtggaagaacgcacaggggaaagatcagatgtggtacgaagatgctctcgcgtcctcccacccgattatcctctacctgcacggtaatgctggcactaggggtggcgatcaccgtgtcgaactgtacaaggtcctctcctccctgggttaccacgtggtcacattcgattacagaggttggggcgatagcgtcggaacgcctagcgagcgagggatgacatacgacgctctccatgtgtttgattggattaaggccagatccggggataacccagtgtatatatggggccactccttgggcactggtgtggccactaatctagtgcggcgattatgtgagagagaaacacctcctgatgccttgatattagaaagcccattcaccaatattcgggaagaggcgaaatcacaccccttctcagtgatctaccgctatttcccagggtttgactggttttttctggacccaattacttcatccggaatcaagtttgccaatgatgagaatgtgaagcacatctcttgtccactcctcatcctgcacgcagaggatgatcccgtcgtgccttttcaactgggtcgaaaactatacagcattgctgcaccagccaggtcatttcgggattttaaagttcagttcgtgccattccactccgaccttggctaccgccataaatacatttacaagtccccggagttgccccgaatcctccgcccccaacagggtccgggtagctcaccagatccgtcaatgtggtccgaattagtgtag

SEQ ID NO: 106723 - DNA, 564 bp, Artificial Sequence
  Description of Artificial Sequence: Synthetic coding sequence
atgtcaggcggcggtcatggaggggtctgcttcctgtgctgtatactgcttcagggccggaagggagtgtggctcagacttaggaagatcctcttttgcgtactggggctttatatcgctatcccctttctgataaagttgtgccctggcattcaggctaagctgatatttctgaacttcgttagggtgccttattttatcgacttaaaaaagccccaggatcaaggcctgaaccacacttgcaactactacctgcagcccgaggaggacgtcactattggcgtctggcatacagtgccagccgtgtggtggaagaacgctcaaggtaaggaccaaatgtggtatgaggacgccctcgcctcctcccacccgatcattctctatctacacggcaatgcaggaacccggggcggcgaccaccgcgtcgaactgtacaaagtcctgagctcccttggctaccacgtggtaactttcgactaccgcggctggggtgattctgtgggtacccctagtgaacgaggcatgacctacgatgccctccacgttttcgactggatcaagtag

SEQ ID NO: 106724 - DNA, 1083 bp, Artificial Sequence
  Description of Artificial Sequence: Synthetic coding sequence
atgcgtaaacgcacagagccagtggccctcgagccccgttgcgcagcggacgccgggatgaagagagccctcggccgtcggaagggagtgtggttgagactaaggaaaatactgttttgcgtgctgggactatacatcgccatccctttcctgatcaaattgtgcccaggcattcaggccaaactcatcttcttgaatttcgttagagtcccttattttattgacttaaaaaaaccccaggatcaggggttaaaccacacctgcaactactatctgcagcccgaagaggacgtgactattggagtgtggcacactgtgcctgccgtttggtggaagaatgctcagggcaaggaccagatgtggtatgaggacgctctagcttcatcccaccctatcattctttacctccacggtaatgctggcacgcgcggcggagatcatcgcgttgagctttacaaggtgcttagcagcttgggatatcatgtggttactttcgactaccggggctggggcgacagcgttggaactcctagcgaacgcggtatgacctacgatgctctccatgtctttgactggatcaaggcgcgcagcggcgacaaccccgtgtacatttgggggcactcattgggaacgggagtcgccacaaacctggtaaggaggctttgtgaacgcgagacaccacctgacgcacttattctggaatctccattcactaacatacgggaagaagctaaatctcacccattctcagtgatttaccgttactttccagggttcgactggttttttctcgatcccattactagcagcggtatcaaatttgctaatgacgaaaacgtgaagcatatttcctgtcccttgcttattctgcacgcggaggacgacccggtggtgccgttccagctggggcgaaagctgtactccatagcggcgcctgccaggtcttttagagattttaaggtccagtttgtgccctttcactcagacttgggctatcgtcataaatacatctacaaaagccctgaactcccccgtatacttagggagttcttagggaagtctgaaccagagcatcaacactag

SEQ ID NO: 106725 - DNA, 1020 bp, Artificial Sequence
  Description of Artificial Sequence: Synthetic coding sequence
atgctttaccccggtagtgtctacctcctacagaaagcccttatgcctgtgttgctccagggacaggcccgcctggtcgaagaatgcaatgggcgcagggccaaattgctggcatgtgatggcaacgagatagacactatgttcgtagaccgtagaggaacagcagagcctcaaggtcagaagctcgtcatttgctgcgagggaaatgccggtttctacgaggtaggctgtgtgtccaccccactggaagccggctattcagtacttgggtggaatcatccaggatttgcaggctccacgggcgtgcctttcccccagaatgaggctaatgcaatggacgtggtggttcagtttgctatccatcgcctaggatttcagccgcaagacatcattatctatgcatggagcatcggcgggttcaccgctacatgggctgcgatgtcataccccgatgtgagtgccatgatcctagatgcatccttcgacgacttagtccctttagctcttaaggtgatgccagattcttggcgaggtttggtaacccgcactgttagacaacacctcaatctcaataatgctgagcaactgtgtcggtaccaaggaccggtgttactgatcaggcgtacaaaggacgagatcatcaccaccacggttccagaagacatcatgagtaaccgcggaaacgaccttctgctgaagcttttgcagcatcgatatccacgggtaatggccgaggagggcctgcgagtcgtacgtcagtggttagaggcgagtagtcaattagaggaggctagtatttactctagatgggaagtcgaagaggattggtgcttaagcgttctgcgttcgtaccaggctgagcatggtcctgacttcccttggtcagtcggcgaggatatgtcagctgatggtagacgtcagctggcactctttttagccagaaaacatctccataattttgaggctactcattgtacacccctccccgcccagaactttcagatgccttggcacctgtag

SEQ ID NO: 106726 - DNA, 1677 bp, Artificial Sequence
  Description of Artificial Sequence: Synthetic coding sequence
atggccaagctgttaagttgtgtgctgggaccgaggctttataaaatctatagagaacgagacagtgagcgtgctccagcctcagtgcctgaaacgcctaccgcagttactgctccccactcttcaagctgggatacatattatcaaccgcgcgcactcgagaaacatgccgacagtatcctcgccctcgcgtcagtgttttggagcattagttactatagttcacctttcgcgtttttttacctatatagaaaaggctacctcagcttatccaaagtggttcccttcagtcactacgccgggaccctcttactgttactggcgggtgtggcctgtctgcggggcatcggccgctggacgaatcctcagtaccgtcaatttattaccatactagaggccacacaccgtaaccagagctcagagaataaacgccagctcgctaattacaactttgactttcggagttggcccgttgatttccactgggaagagccatcctctcgtaaagaaagccgaggcgggccatctcgcagaggagtggcccttcttcgacctgaacccctgcaccgtggtaccgccgatactctgcttaacagggttaagaaattgccatgtcagattacaagttaccttgtggctcatacgctgggccgacggatgttgtatccaggctcagtttacctccttcaaaaagcgctcatgcccgttctcctgcaaggccaggcccgtttggtggaagaatgtaacggaaggcgagcgaagctgctggcctgcgacgggaacgagattgataccatgttcgtggaccgcagggggacggctgagccccaaggtcaaaagctggtgatctgctgcgagggcaacgcgggcttttatgaggtcgggtgcgtttctacccccctggaggcaggatactcagtcctgggctggaaccaccctggattcgccgggagcaccggcgttcctttcccccaaaacgaggctaatgccatggacgtcgtcgttcagtttgccatccaccgcctgggcttccagccacaggacattattatatacgcatggtcgatcggtgggttcacggccacgtgggccgccatgagttaccccgatgtttcagctatgatcctcgatgcttcttttgacgacctcgtgcctcttgccttgaaagtgatgcccgattcctggcggggtctggtcactagaacggtccgccagcatctgaatctgaacaacgcagaacagctgtgtcggtatcaagggccagttttactgatcagaagaaccaaagacgagattataacaactaccgtgcccgaagacatcatgagtaaccgaggcaatgacctgctgttgaaactgctgcagcatcgttatcctcgggtcatggcggaggagggactgagggttgtacgccaatggcttgaggccagcagccaactcgaagaagcttcaatctacagccggtgggaggtcgaagaagattggtgcttgagtgtgcttcgatcgtaccaagctgagcatggaccagattttccatggagtgtcggagaagacatgagcgccgacgggcggcgtcagctggccctcttcttagctagaaagcacctccataactttgaggccacccattgcacacctctacctgcccagaatttccagatgccatggcatctgtag

SEQ ID NO: 106727 - DNA, 1806 bp, Artificial Sequence
  Description of Artificial Sequence: Synthetic coding sequence
atgagccagctcgccagaagacggtcacggtatggcctgacgagtagagctcataacaccagcgaggcggggagggccgggcctgccggcgggccagcggccggccgggccgcagcacgcgcaggggccatggccaagctgctgagctgtgtactggggcctagactgtacaaaatttatagagagcgggactctgaaagggcgccggcaagcgtccccgagactccgaccgcagtcactgccccccactcctcttcctgggatacctactaccagccacgggccctggaaaagcacgctgactccatcttagctttagcctctgtattctggtctatttcttattactcatcgccctttgcattcttttacttgtaccggaaaggctacctgtcactttccaaggtggtcccatttagccactatgccggcacgctcctgttactgcttgccggagtcgcttgtctgagaggaattgggagatggactaatccacagtaccgccagtttattacaatactggaggcaactcaccgcaaccagtcgtctgagaacaaaaggcagctggccaactacaattttgacttcagatcttggcctgtcgattttcactgggaagagccatcaagccgcaaagagtctcgcggaggccccagtcgcaggggtgtcgccctgcttaggcccgaacctctccacagaggcacagcagacactcttctgaaccgagtgaaaaaactgccctgccagataacgagctacctggtggcacacactctcggacgccggatgctgtaccctggttctgtttacctgctgcagaaggcactgatgcctgtgttgttgcagggacaagcccggttggttgaagaatgcaacggacgcagagctaagctcttagcctgcgacggcaacgaaattgacacgatgttcgttgacaggcgcggtaccgcagagccacaaggccaaaagctcgtgatctgctgtgaagggaacgcgggtttctatgaggtcggttgcgtgagcaccccgctggaggcgggctattcagtgttggggtggaatcacccaggctttgctggctctactggggtgccctttcctcagaacgaagctaatgctatggatgtggtggttcaattcgccattcatcggcttggattccaaccccaagatatcataatttatgcctggagtattgggggatttacagcaacctgggccgcaatgagctatccagacgtctccgcgatgatcctcgacgcatccttcgatgaccttgtacctttagccctcaaggtgatgccagattcctggagaggcctagttactcggacagttcgacagcaccttaacctaaacaatgctgaacaactgtgtcgctatcaaggccctgtactacttatcagaagaacaaaagacgagattatcactaccacagtgccggaggacataatgtccaacaggggcaatgatctcctcttgaagctgctgcagcaccggtacccaagggtgatggccgaagaaggtctcagagttgtgagacagtggctggaagcctcatcccagctggaggaggcatctatctacagcagatgggaggtagaagaggactggtgcctctcagtgcttaggagttatcaggctgagcacggaccagactttccttggtcagtcggcgaagatatgtccgcagacgggcgcaggcagttagcattattcttggcgaggaagcatctgcacaacttcgaggccacacattgtacaccactgcccgcccagaactttcagatgccttggcatttatag

SEQ ID NO: 106728 - DNA, 795 bp, Artificial Sequence
  Description of Artificial Sequence: Synthetic coding sequence
atgccaccacctgccctgttcttaagctcactgtatccacggttagaattccagaatgacttttacagatcctgcattaggaggagctccccgcagccacctcccaacttggcatggcgtcctgagagcctgtactctggcgagctggcaggagggggctatctgagtttaagcaaagtggttccttttagccactacgcggggactctgctcctgctcctagcgggagtagcctgccttagggggatcggaagatggacaaacccccagtacagacagttcattaccattctcgaggccacgcacagaaaccagtccagtgagaacaagcgccaactagccaattataactttgacttccggtcctggcctgtggattttcactgggaagagcctagcagccgaaaggagagtaggggaggaccgtcccgtagaggtgtggctcttctgcggccagagccattgcaccgcggaacagccgatacactgctgaatcgtgtcaagaaactgccctgccagatcacatcctatctggtggcccatacgctcggtagacgcatgctgtaccctggtagcgtgtaccttctgcaaaaagcactcatgccagttttactgcagggacaggcccgtttagtggaggaatgtaatggacgcagggcgaagctactggcatgcgacggcaatgagatcgatactatgttcgtagaccggcggggcactgccgaacctcaggggcaaaagcttgtcatctgctgtgagggaaacgccggcttctacgaagttggatgtgtctag

SEQ ID NO: 106729 - DNA, 795 bp, Artificial Sequence
  Description of Artificial Sequence: Synthetic coding sequence
atgccaccgcctgctttattcctgtcttctctctatcccagactggagttccaaaatgatttttatcgatcatgtatacggcgctcatccccacagccacctcctaacctggcctggcgacctgagtcgctgtattccggtgagctggctggtggaggatacctgtctctttctaaagtcgtaccattctctcactatgcgggcacactactcttgctactggctggggtcgcttgccttcgggggatcgggcggtggactaatccacagtacaggcagtttatcacaatcctggaggcaactcacagaaatcagagctctgagaacaagaggcaactggcgaattataatttcgattttcggtcttggccagtggatttccactgggaagaacccagtagcaggaaagagagcagggggggaccaagtcgacggggcgtagctctgctgcgccccgaacccttacacagagggactgccgacacgctcctgaatagggtgaagaagctcccttgtcaaattacgtcatacctggtggcccatacgctagggcggcgcatgctgtaccctggcagcgtgtacctgcttcagaaagccctgatgccggttcttctacaaggacaggccagacttgtggaagaatgcaacggcaggcgcgccaagctgctcgcctgcgatgggaacgaaatagacacaatgttcgtagatcgccggggcactgccgagccacaggggcagaaattagtcatctgctgcgaaggaaacgccggattttacgaggtgggatgtgtgtag

SEQ ID NO: 106730 - DNA, 795 bp, Artificial Sequence
  Description of Artificial Sequence: Synthetic coding sequence
atgcctccccctgctttgttcctaagttccctataccccaggctcgaattccagaacgatttttatcgctcatgtatcaggaggagttcacctcaaccacctcctaatttggcatggagacccgagtctctgtatagcggggaactcgcagggggtggctatctttccctctctaaagtcgtccctttctcccactacgcagggaccctgttattactcctggcaggtgtggcctgtctccgtggcattggcagatggaccaatccgcagtatagacagtttattaccattctggaagcaactcaccggaatcagtcaagtgagaataagcgccaattagccaattataactttgactttcgtagctggcctgtggactttcactgggaggagcctagcagcaggaaggaaagtaggggggggccctccagaagaggcgtcgccctgctacgtccagagcctctgcacaggggtaccgccgacacattactgaacagggttaagaagctgccatgccagataacttcttaccttgtggctcatacccttggcaggagaatgctctaccccggctcagtgtatctcttgcagaaagccctcatgcccgtgttgctgcaggggcaagcgcggctcgtggaggaatgtaacgggcggagggccaagttgctcgcctgcgatggtaatgagatcgatacaatgtttgtggacagaagaggaacagccgagcctcagggccagaaactggtcatatgttgcgagggtaatgctggcttctatgaggtggggtgtgtgtag

SEQ ID NO: 106731 - DNA, 1806 bp, Artificial Sequence
  Description of Artificial Sequence: Synthetic coding sequence
atgtcccagttagccagacgtagatctcggtatggcctgacatcccgagctcacaatacttctgaggccggcagagcaggccccgccggcggacccgccgcaggtcgagccgccgctcgcgccggagcaatggccaaactcctcagttgcgttcttgggcctagactgtataaaatctaccgtgaacgggacagcgagcgggccccagcttcagtcccagagactcccaccgctgtgactgcccctcattccagctcttgggacacctactatcaaccccgcgctttggagaagcacgccgatagtatcctggccctggcatctgtgttctggtcgatcagttactattctagtccgttcgcctttttctacctgtacaggaagggatatctgtccttgtctaaggtggttcctttttcgcactatgcagggaccttgctgctgctcctggctggcgttgcctgtctccggggcatcggacgttggactaatccccaatatcgccagttcattacgattctcgaggccacccatcgcaatcaaagtagcgaaaataagcggcagctggctaattataacttcgatttcagatcgtggcctgtggattttcactgggaggaaccttcctcacggaaggagtctagggggggtccttctagaaggggcgtggcattgctgaggcccgaaccgctccatagaggaacagcagatacccttctcaacagggtgaagaagctcccatgccagattacttcatatctggtggcccacactctcggcaggcgtatgttgtaccccgggagtgtgtatctcctgcagaaggccctgatgcccgttctcctccagggacaggcacggttggtggaagagtgcaacgggaggcgcgccaaacttctggcctgtgatggaaacgagatcgacacaatgttcgttgatcggcggggtactgccgaaccacagggacagaagcttgtgatatgttgcgaagggaatgccggcttttacgaagtggggtgcgtgtccacccccctcgaggctgggtattccgtgcttggttggaaccaccccggttttgcaggcagcacgggtgttcctttcccccaaaacgaggctaacgccatggacgttgtcgttcagttcgcaatccaccggcttgggtttcagccacaggatataataatttatgcatggagcattggcggatttaccgccacatgggccgccatgagttatccagacgtctcagcgatgatcctcgatgcctccttcgacgacttagtccctctcgccctgaaagtgatgcccgattcctggcgaggactggtgacgcgcacggtacggcagcacctgaacctaaataatgccgaacaactctgcaggtaccaaggtccagtgcttcttattagaaggaccaaggatgagatcataaccaccactgttcccgaggatatcatgtcaaaccggggcaatgacctgctcttaaagcttctacagcataggtatccccgcgtgatggcggaggagggtctgagagtggtgcggcagtggctggaagcgagctctcagcttgaggaagccagcatctattcacgttgggaagttgaggaggactggtgtctctccgtgctgcggagctatcaggcggaacacggacctgactttccctggagtgtgggggaagacatgtcggccgatggaagacggcagcttgccctcttcctcgctcggaagcatttgcacaatttcgaagcaacacactgcacccctcttcctgctcaaaatttccagatgccatggcacctgtag

SEQ ID NO: 106732 - DNA, 795 bp, Artificial Sequence
  Description of Artificial Sequence: Synthetic coding sequence
atgcctccccccgctctgttcctcagcagcttgtaccctaggctcgaatttcaaaacgatttctatagatcatgcatccgccggtccagtccgcaaccaccacctaacctagcatggagaccagaaagcctttactccggtgagcttgcaggaggtggttacctttctctgtctaaagtcgtgccgttcagtcactacgctgggactctgctgttgctcctggctggcgtcgcctgtttgagggggattgggcgctggaccaatcctcaatacagacagtttattaccattctagaagccacccacagaaatcagtcctccgaaaataagagacaattggccaattacaacttcgatttcaggtcatggccagtggatttccattgggaggaaccctcatcccgcaaagaatccaggggcgggccttccaggaggggagtggccctgctccgacccgaaccactccatcgcggaacggccgatactctacttaatagagtcaagaaacttccttgtcagattaccagctatctcgtggcacacactctgggacgcagaatgctgtacccgggatctgtgtacctattacagaaggcacttatgcccgttttacttcagggacaggctcgattggtcgaggaatgtaacggccgtcgggctaagctcttggcatgtgatggaaacgaaatagataccatgtttgtagatcgacgtgggaccgctgagccgcagggccagaagctggtaatctgctgcgaaggtaatgccgggttctacgaagtgggttgtgtctag

SEQ ID NO: 106733 - DNA, 1806 bp, Artificial Sequence
  Description of Artificial Sequence: Synthetic coding sequence
atgtctcaactcgcacgtcgaagaagccgctatggactgacttcaagggcacataatacatcagaagccggccgagccggtcctgcaggagggcccgccgccggtcgagccgctgcgcgggcaggcgccatggccaaactgttgagctgcgtgctggggccccgcctctataaaatttacagagagagagactccgagagagcccccgcctcagtgccagagactccgaccgctgtcacggccccgcacagcagttcgtgggatacctactatcagccccgggccctcgaaaaacatgccgactccattctagccttggcctcagtattttggagtatctcgtactattcctctcccttcgcttttttttacctttacaggaagggctacctgtccctgagcaaggtcgtaccctttagccattatgccggcacattactgctattgctggcaggcgtagcctgcttgagaggtatagggcggtggacaaatcctcagtatagacagttcataacgatacttgaagccacccacaggaaccaaagttccgagaacaaaagacaattggcaaattacaacttcgactttcggtcctggcctgttgactttcactgggaggaaccctctagtagaaaggagagtagaggtggtccttctcggcgcggtgttgctctcctgagacccgaacctcttcatcggggaactgccgacactctcctcaacagagtcaaaaaacttccttgccaaattacctcttacctggtagcgcacactttgggccggcgcatgctgtaccccggaagcgtgtacttgctccagaaggcactgatgcccgtgctattgcaggggcaggcccgcttggtggaggaatgcaatggccggcgggcaaaactgctggcctgcgatgggaatgaaattgacaccatgtttgtggatcggcgagggacggctgaacctcagggacaaaaattggtgatctgttgcgagggcaacgcaggattttatgaggtaggatgtgttagtacaccactcgaggccggctactcagttctcggatggaaccatccaggatttgccggctctaccggcgtgccattccctcagaacgaagctaacgccatggatgtggtggtgcagttcgccattcaccgtctgggatttcagccacaggacataataatctacgcttggtccatcggtggattcacagcgacttgggcggctatgtcataccccgatgtcagcgccatgatcttggacgcctcattcgacgacctggttcccctagctctcaaggtgatgcctgattcgtggagagggctggtgacaagaacagtgagacaacacctgaacctgaataatgctgagcagttgtgccggtatcagggccctgttctgttgatacgacgaacaaaggacgaaatcataactaccacagtgcctgaagatatcatgagtaataggggcaatgacctgttgctgaagctcctgcaacatcgttaccctcgagtgatggccgaggagggtctgcgcgtggtgcgccaatggctcgaagcaagctctcagctggaagaggccagtatctacagccgatgggaagttgaagaagactggtgtttgtccgtcctcagaagttaccaggcagagcatgggcctgacttcccatggtctgtaggtgaggacatgtccgctgacggtaggcggcagctcgcgctgttcctggccagaaagcaccttcataattttgaggctacccactgtactcctctgcccgcccagaattttcaaatgccctggcacctgtag

SEQ ID NO: 106734 - DNA, 795 bp, Artificial Sequence
  Description of Artificial Sequence: Synthetic coding sequence
atgcctccacccgccctttttctgtctagtttgtacccacgactggagttccagaacgacttctatcggtcttgtattcgacggtcatccccacaaccaccccctaacctggcctggagacctgaatccttatactctggagaactggctggaggaggatatttgagccttagtaaggtggtgccctttagtcattacgctggaactcttctgctgctactggccggagtggcttgcctgagaggaattgggcgatggaccaatcctcagtacaggcagtttatcaccatactagaagctacccataggaaccagagcagcgagaacaagaggcagcttgcaaactacaacttcgattttagatcctggcctgtggatttccattgggaagagccgtcctcccgaaaggagtcgaggggcggccccagtcggagaggtgtggcattattgaggccagagccattacatcggggtaccgccgatactctgttgaatcgggtgaagaagctgccgtgtcaaattactagttacctagtggctcacaccttaggaagacgcatgctgtatcctggtagcgtctacttattgcagaaagcccttatgcctgtgttgttgcaggggcaggctagacttgtggaggagtgtaatgggcgtcgcgccaagctgctagcatgcgacggtaatgagattgacacaatgttcgtagatcgcagaggcacagccgagccccaggggcaaaagctcgtgatatgctgcgaggggaatgcaggattctatgaggttggttgtgtgtag

SEQ ID NO: 106735 - DNA, 1806 bp, Artificial Sequence
  Description of Artificial Sequence: Synthetic coding sequence
atgagccaactggcccgacggcgctcccggtacggcctgacctcgagagcccataacacttctgaggctggtcgggcgggtcctgccggcgggcccgccgccggcagggctgccgcacgtgctggggccatggcaaaactattgtcatgcgtgttggggcctaggttgtataagatctacagagaacgtgattccgagagggcaccagctagtgttccagaaacccccactgccgtgacagcaccacactcctcgtcttgggacacatactatcagccgcgggcattggagaagcatgcagatagtatcctcgctctggcgagcgttttttggtctattagttactatagttccccattcgcgtttttctacctttaccgcaaaggctaccttagtctcagtaaagtggttccttttagtcactatgccggtacactgttactcctgctagccggcgttgcctgcctgcggggcatagggcgctggactaaccctcagtatcggcaatttattacgattctcgaggccactcatagaaaccagagcagcgagaacaagaggcaattggccaattataattttgatttcaggagttggcctgtggactttcattgggaggagccttcaagccgcaaagagagtcgaggcgggcccagccggaggggggtggccctgctgcggcccgaaccgttgcacaggggtaccgcagatacactgctgaatcgcgtgaaaaaactcccttgtcagatcacttcgtacctggtggcacacaccctgggacgccgtatgctgtatcccggatctgtctacctgcttcagaaagccctcatgcctgtgctcctgcaaggtcaagcacggctggtcgaggaatgcaacggccggcgtgctaagctgctcgcgtgtgacggcaacgagatcgataccatgtttgtggatcggcgcggcacagctgaaccgcagggccagaaattggtgatctgttgcgagggcaacgccgggttttacgaggttggttgtgtgtccacccctttggaggcaggctactcggtcctaggctggaatcaccccggatttgcaggctcaactggcgtcccattcccacagaacgaggccaatgctatggatgtggtggttcagtttgctattcataggctcggcttccagccacaagatatcatcatttatgcttggtccatcggaggcttcacagcgacatgggctgccatgagctacccagatgtatccgccatgattttggatgccagtttcgacgatctagtccccttggctctcaaagtgatgcctgactcatggagggggctggtaacgcggaccgtgagacagcatctcaatctcaacaatgcagagcagctctgtcgctaccaggggccagtgctgcttatccggagaaccaaggacgagatcatcacaaccactgtgcctgaagatatcatgtcaaatcggggcaacgatttgctgctcaagttgctgcagcacaggtacccacgggtgatggctgaagagggactcagagtcgtacgacaatggctggaagcaagctcccagctggaggaagcttcgatatacagtcggtgggaagtcgaggaggactggtgcctaagcgtcctccgcagctatcaggcggagcacggaccagacttcccctggtcagtcggtgaggacatgtccgccgacggaaggcggcagttagctctgtttctggcgcggaagcacctacacaacttcgaagccactcactgcacaccgcttccggcccagaattttcagatgccctggcatctgtag

SEQ ID NO: 106736 - DNA, 795 bp, Artificial Sequence
  Description of Artificial Sequence: Synthetic coding sequence
atgccccctcctgctctgttcctgtcctccctctatccccggctggagttccaaaacgatttttaccgttcatgtattagaagatcctccccccagccgcctcccaatttagcttggcgccccgagagcctgtactctggtgaactcgcagggggaggatatttaagtctttctaaggtcgtacctttctctcattatgccggaactcttcttctgttactagccggtgtggcgtgtcttagaggaattggaaggtggactaacccgcagtatcgccagttcatcacaatattggaagcaactcataggaatcaaagttcagaaaataaacgacagctagcaaactataatttcgactttcggtcttggcctgtcgacttccactgggaggaaccatcatcaaggaaggagtcccgtgggggcccatcaaggagaggagtggcgctgttgagacctgagcccctccatagagggaccgcggataccctcttgaatcgcgtgaagaagctgccgtgtcagatcacctcttatttggttgctcatacgctaggtcgtaggatgctgtatccaggatccgtgtatttactacagaaagctctgatgcccgtgctgttgcaagggcaagctcgcctggttgaagagtgtaatggtaggcgagcaaagttactagcttgcgatggaaatgagattgatacaatgttcgtggaccggcgtgggacggccgaacctcaaggccagaagttggtaatctgctgcgaggggaacgcaggtttttatgaggttggatgtgtatag

SEQ ID NO: 106737 - DNA, 1677 bp, Artificial Sequence
  Description of Artificial Sequence: Synthetic coding sequence
atggctaagctgctctcatgtgtcctgggtccacgcctgtacaaaatttacagagagagagattcagagcgcgctccggcctccgtcccagaaactccgaccgctgttactgcgcctcatagcagttcttgggatacatactatcaacctagggcattggaaaagcatgcagactctatcttagcgctggcaagtgtgttttggagtatcagctattactctagtcccttcgcttttttctatttatacaggaaaggatatctcagtctaagcaaagttgttccgttctcccattacgccggaacgctgcttttgctgttggcgggcgtagcatgcttgagaggtatcggaaggtggacaaaccctcagtatcgccagttcattacaattcttgaggcaactcatagaaatcaaagcagtgagaataaaagacagttggcaaactacaacttcgactttaggagttggcctgtcgacttccactgggaagagccctcaagtcggaaggagtccaggggtggtccttcaaggagaggcgtggctctgctgcggcctgaaccactccataggggaactgccgacaccctgttgaatcgggtgaaaaaactcccatgccagattacatcatatctagtggcccatacgctgggcagaagaatgctatatcctggctccgtgtatcttcttcaaaaggctctcatgcccgtgctgcttcagggccaggcccgccttgttgaggaatgtaatggacgcagggctaaacttctcgcctgtgacggcaacgaaatcgacactatgttcgtggaccggaggggcaccgctgagccccaggggcagaagctcgtgatctgttgcgaaggaaacgccggattctacgaagtgggatgcgtgtccacacctctcgaggccggctactctgtcttaggttggaatcacccaggtttcgcggggtcaaccggagttcctttcccacaaaacgaagccaatgctatggacgtcgttgtccagttcgccattcaccgcttggggttccagccacaggatattatcatctatgcgtggagcatagggggttttacagccacctgggccgctatgagctacccagacgtgagtgctatgatacttgatgccagcttcgacgatctcgtccccttggctttgaaggtgatgcctgactcctggagaggattagttacccgcaccgtcagacagcacctgaacctgaacaacgccgagcagctgtgccgataccaaggaccagtcctgctcatccgtcgcaccaaggatgaaataatcactacaaccgtcccagaagacattatgagtaataggggcaatgacctactgcttaaactgctgcaacaccgctacccccgggtgatggccgaagagggactgcgggtggtaaggcagtggcttgaggcctccagtcagctcgaagaagcaagcatctattcacgatgggaagtggaagaggattggtgtctgagtgtactccggtcataccaggcagaacacggacccgacttcccatggtcagtgggggaggacatgagtgctgatggcagacgccagctggccctgtttctagctaggaagcacctgcacaacttcgaagctactcactgcactcctcttccggcccaaaacttccagatgccttggcacctatag

SEQ ID NO: 106738 - DNA, 1806 bp, Artificial Sequence
  Description of Artificial Sequence: Synthetic coding sequence
atgagccagctggccaggcgtaggtcccgatacgggctcacatctagagcccacaacacctctgaagccgggagggcgggccccgccggggggcccgccgccggccgggccgcagcccgggccggagctatggccaagctcttgagttgcgttttgggccccagactgtacaaaatctatcgggaaagggactctgagagggcacctgcatcggtcccagaaacccccacagcagttaccgcgccccactcaagtagctgggatacatactaccagccccgggccttggagaaacacgcagactctattttggcccttgcctctgtgttttggagcattagttactactctagtccctttgcatttttctatctctacagaaaaggttacttgagcctatccaaagtagtccctttttcccactacgcaggaactttgcttctgcttcttgcaggagtggcttgcctgagaggcatcgggaggtggactaatcctcagtatagacaatttatcaccattctggaggcaacccatcgaaaccagtcctctgagaacaagagacagttggctaactataatttcgactttcgctcctggcctgtagatttccactgggaagaaccttcctcacgcaaagaatcacggggtggccctagccgtcggggggttgctttactgcgccctgagcctctgcaccgcggtaccgcagatacactgcttaaccgcgtcaaaaaacttccttgtcagatcacaagttatctggtggcccacacactcggccgaaggatgttataccctggatcagtgtatttacttcagaaggccctaatgcccgttctcctgcagggccaggcacggttggtggaggagtgcaacgggcgacgcgcaaaattgctggcctgtgatgggaacgagatcgacaccatgtttgtagaccgcagggggactgccgagccccagggtcagaagctcgtcatttgttgcgaggggaatgcgggattttatgaagtcggctgcgtatccacccctttggaagctggttacagtgtactgggatggaaccaccccgggttcgctggatccactggcgtgccttttccacagaatgaggcaaacgccatggatgtcgtagttcagtttgcaatacaccgtctcggattccaacctcaggatattattatttacgcctggagtattggtgggttcactgctacttgggccgctatgagttatccagatgtctcggccatgatactcgacgctagtttcgatgatttggtcccgctagctctgaaagtcatgcccgactcttggcggggtctcgtgactcgcacagtgcggcagcatcttaacttgaataacgcagagcaactctgccgctatcagggaccggtcctcctaattcggcgcacgaaagacgagataattactacgactgttccagaggacataatgagtaatcgggggaatgaccttcttttgaagttactgcagcacagatacccccgagtgatggccgaagaggggctcagggtggtgaggcagtggctcgaagcatcgtctcagctggaggaggcttctatctattctagatgggaagtggaggaggactggtgtctgagcgtgctgaggtcataccaggctgaacacggcccagacttcccgtggagtgtgggcgaggatatgagcgcagacggccggcggcaactggcactgtttctcgcacgaaagcacctccataactttgaagccacacactgcactcccctgcccgcacaaaatttccagatgccctggcacctgtag

SEQ ID NO: 106739 - DNA, 438 bp, Artificial Sequence
  Description of Artificial Sequence: Synthetic coding sequence
atgttagggcactgctgctacttttggcaggtttggcccgcttccgaagccctagcagcaggccctacacctagtactggatcaagcagcccatcttggaagcagcacataggcacctctctgcagaaaacccgtggatccctgccaaccacgaccctgacatctggagcgggccagagtacctccacaggcaaaaatcctgccgctggtcggtcccttgaaggtgctctcccagcaggcgtctggccttgcttcgcacagtccccctgtaccggcgggcagcagaccccatctagcaccgggctgaggtcctgtctagtccgttctcctggaggaaaacaacagagaggcgaggcccactggggcggcggtgctatcagtggagtgctctgggagtgggccctgcattgcaagattgcggtgactcattgggcctag

SEQ ID NO: 106740 - DNA, 1677 bp, Artificial Sequence
  Description of Artificial Sequence: Synthetic coding sequence
atggcgaagcttctttcctgtgttctgggaccgcggctctataagatctacagggagcgcgactctgaaagagccccggcatcagtgcccgaaacacctaccgctgtgacagcgccacactcttcttcctgggatacatattaccaacccagggccttggaaaagcacgccgatagtatattggcgctggccagcgttttttggagtatcagctattactccagccccttcgcatttttttacctatatcgaaaaggttacttgagtctcagcaaggtggtacccttttcccattacgcaggcacgttgttattgctactggccggcgtagcctgcctgaggggcattgggagatggacaaacccccagtatcgacagtttatcacaatcctggaggcaacccacagaaatcagagctccgaaaacaagcggcaattggcaaactacaactttgatttccgcagctggccagtcgacttccattgggaagagcccagcagtcgcaaggaatcgcgaggaggtccaagtaggcgaggcgtggcgctgctgcgccccgagccgctgcatcgtggtacagctgatactcttctgaaccgggtcaagaaactgccgtgtcagattactagctatcttgtcgcacacaccctagggaggcgcatgctatatccaggaagtgtgtaccttttgcagaaagctttaatgcccgttctactgcaggggcaggcccggttggtcgaagagtgtaatggccgccgggccaagttactggcttgtgatggaaacgagatcgacacaatgttcgtcgaccggcggggcaccgcggaaccccagggtcagaaactggtgatctgctgcgaaggcaacgccggattttatgaagtaggttgcgtctccacacctctggaggctgggtattctgttctgggatggaaccaccccggatttgccggttccactggagtgccctttccacaaaacgaggctaacgccatggatgtggtggtccagttcgctatccaccgccttgggttccagccacaagacattatcatctacgcttggtcaatagggggtttcacagcaacgtgggcggctatgtcctaccccgacgtttctgccatgattcttgacgcatcgttcgatgacctagttccactcgctttgaaagtcatgccggacagctggcgggggctcgttacaaggaccgtccgccagcatctgaatctcaataatgcggagcagttatgtagataccaaggccctgtgctcctgattcgccgcacaaaagatgaaatcattacaacgactgtccccgaagacattatgtcgaatagaggcaatgacctcctgctcaagctcctgcagcaccggtaccctcgagtgatggctgaggagggtctccgcgtcgtccggcagtggctggaggcgagtagccaactggaggaggcgtctatatacagcagatgggaggtggaagaagattggtgcctgtccgtcctgaggagttaccaggcggaacacggcccagacttcccctggtccgtcggtgaagatatgagtgccgacggccggcgccaattggctctgtttttggcgaggaagcacctccataattttgaggccacacattgtacaccgttgccagcccagaatttccagatgccctggcatctgtag

SEQ ID NO: 106741 - DNA, 1677 bp, Artificial Sequence
  Description of Artificial Sequence: Synthetic coding sequence
atggcgaagctgctgagctgtgtgctgggtccacggctttataagatctaccgcgagcgagatagtgaaagggctcccgcatccgtgcccgaaacacccactgccgtgacagctccccatagctcctcctgggacacatactaccaaccacgggcactcgaaaaacatgctgattctatcctcgcactcgctagtgtcttctggagcatttcatactatagcagtcccttcgcatttttctacctatatcggaaaggatatcttagcctatcaaaggtcgtaccattttcccactatgctggcacactacttctccttcttgctggggtggcgtgtcttcggggcattggacgatggaccaacccacagtaccgacaattcattactatactggaggctacgcatcgcaatcagagctcggaaaataagagacaactggccaattataatttcgacttccgcagttggccagtggacttccactgggaggaaccctcatcccgcaaggaatctcgcggtggccctagccgccgtggcgtggcactgctgagaccagagcctctccataggggcaccgcggacaccttgctgaaccgggtgaaaaagctgccatgccagataacatcttacctagtagcccatactctgggccgccggatgctgtaccccggatccgtttacctgctgcagaaggctttgatgccagtgctgttacaaggacaggccaggctagtcgaggagtgtaatgggaggagagccaaattactagcctgtgatgggaacgagatcgacacaatgttcgtagatagacgaggcaccgctgagcctcagggtcagaagttagtgatttgctgtgaaggcaacgccggcttttacgaggtggggtgtgtctctacccctctggaggcaggatactccgtgctggggtggaatcatccaggcttcgccggcagcacaggggtgccgtttccacagaacgaggccaatgctatggacgtggtcgtgcagtttgccatccatagattagggtttcagccacaggatatcattatctacgcttggtcaatcggggggtttacggctacttgggctgcgatgtcctatcctgacgtgtcggcgatgatcctggacgccagttttgatgatctggtccctctggccttgaaggtcatgccagacagttggagaggtctcgtaactaggaccgtgcgccagcacctgaacctgaacaacgccgaacagctctgtaggtaccaaggacccgtccttctgattcgcagaactaaagacgagattatcacgacgactgtgcctgaggacatcatgagcaatcgcggcaacgacttgttactgaaattactccagcaccggtaccccagggtgatggccgaggaaggcttgcgagtggtgcgacagtggctggaggcatcttcccagctggaggaggcttccatttacagccgttgggaggtggaagaggactggtgtctgagcgtcctgcgttcttatcaagccgaacatggacccgatttcccatggagtgttggcgaggatatgagtgccgacgggcgccggcagctagcactgttcttggcgcggaagcacctgcacaatttcgaggcgacccattgcacccccctccctgcccaaaacttccagatgccttggcacctttag

SEQ ID NO: 106742 - DNA, 1677 bp, Artificial Sequence
  Description of Artificial Sequence: Synthetic coding sequence
atggctaaactcctatcctgtgtgctgggccctcgactctacaagatttatcgcgaaagggacagtgaaagggctcctgcttctgtgccagagactccaaccgccgtgacggcgccacacagcagtagttgggacacttattaccagcctagagctttggagaagcatgccgactccatcctggcactcgcatcagtgttttggtctatctcctattactcctcaccctttgcttttttctacctgtacagaaaggggtatctctcactgtctaaagtggtgccattcagtcattatgccggcactctgcttctgctgctcgcgggagtagcgtgtttacggggcataggacgatggacgaatccgcaatacagacaatttataaccatcttagaggctacacatagaaatcaaagttccgagaacaagagacaattggcaaattataacttcgatttccgcagttggcccgtggacttccattgggaggagccctccagccgtaaggagtctcgaggcggacctagtcgccggggagtcgcactgctgagaccggagcccttgcacagaggcacagccgacacacttctaaacagggttaaaaagttaccttgccagatcacatcgtaccttgttgcccatacactgggtaggcggatgctgtaccctggatctgtctacttgctccagaaggcgttgatgcctgtgctgttacagggccaggccagactagtggaagagtgcaacggccgcagggcaaagctactcgcttgcgatggaaacgaaatcgatactatgttcgtggatagacgtggaacagccgaaccccaagggcagaagctggtgatctgctgcgaggggaacgcggggttttatgaggtgggatgcgtaagcacgcccctagaagccggatatagcgtcttaggttggaaccacccaggtttcgccgggagcaccggtgtcccctttccccagaacgaggctaatgcaatggacgtggttgtacagtttgctattcacaggctggggttccaacctcaagatatcattatctacgcctggtccatcggcggctttacggccacttgggctgccatgtcgtacccggacgtcagcgcaatgatactggacgcctcttttgacgatttggttcccttagcactcaaagtcatgcccgactcctggcgggggttagtgacgagaacggtacggcagcaccttaatcttaacaatgctgaacagctgtgcaggtaccagggcccagtcctcttgattagacgtactaaagacgaaattattacaactacagtgccagaggacattatgtcaaatagaggcaatgatctactcctcaagctgctccagcaccggtatccccgggtcatggccgaagaaggcctgcgggtggtgcggcaatggctggaggcctcgagccagcttgaggaggcgagtatctactcacgctgggaagttgaagaggattggtgtctgtccgtgctccgctcttatcaagccgagcacggtcccgatttcccctggagtgtcggcgaggacatgtccgcagacggccgtaggcagcttgccctcttcctggcgaggaagcatctacataacttcgaggccacccactgcacccccctgcctgcccagaacttccagatgccatggcatctgtag

SEQ ID NO: 106743 - DNA, 438 bp, Artificial Sequence
  Description of Artificial Sequence: Synthetic coding sequence
atgcttggacactgttgctatttctggcaggtgtggccagcatctgaggcgctcgccgccggtcctaccccttctacaggatcctcctcccctagctggaaacagcacattggaacttctctgcagaagaccaggggcagtcttccaaccaccaccctcacttctggagcaggccaatcaacttcaaccggcaagaaccctgccgctggacgctctctggaaggcgcccttccggcgggagtgtggccctgcttcgcccagagcccatgtactgggggtcagcaaactccgagctctaccggactgcggtcatgtctcgtgcgctcacctggcggcaagcagcaacggggggaagcacattggggaggcggagctatatccggagtgttgtgggagtgggctctgcactgtaaaattgctgtgactcattgggcgtag

SEQ ID NO: 106744 - DNA, 438 bp, Artificial Sequence
  Description of Artificial Sequence: Synthetic coding sequence
atgctgggacactgttgttacttctggcaagtgtggcctgcttccgaggctcttgcagccggaccgacacctagcaccgggtcaagttccccttcatggaaacagcacataggtacttctctgcagaaaacgcgcgggtcactccccaccaccacgttaacttctggtgcgggacagtcgacttccacagggaagaaccccgccgccgggaggagtctggagggggcccttcccgccggagtctggccctgcttcgctcagtcaccttgcacagggggacagcagactccttcgtctaccggactgagatcgtgtctggtcaggagcccaggggggaaacagcaaaggggggaggctcactggggcggaggcgccatctccggcgtgttgtgggaatgggccttgcattgtaagattgcagtcactcattgggcctag

SEQ ID NO: 106745 - DNA, 438 bp, Artificial Sequence
  Description of Artificial Sequence: Synthetic coding sequence
atgctgggacattgttgctatttctggcaagtttggcctgcctccgaagccctcgctgccgggcctactccctctaccgggtcgtcctctcccagctggaagcagcacatcggcacgtctcttcagaaaactagggggagcctgcccactacaaccctgacgtccggtgctggccaaagtacctccactgggaaaaaccccgcagccgggagaagccttgaaggtgctctaccagctggcgtttggccgtgtttcgctcagagcccttgcaccgggggtcagcagaccccctccagcaccgggctgcgctcgtgccttgtgcggagccctggggggaagcaacagcgcggcgaggctcactgggggggtggagccattagcggcgttctgtgggaatgggccctccattgtaaaatagctgtcacacattgggcttag

SEQ ID NO: 106746 - DNA, 1578 bp, Artificial Sequence
  Description of Artificial Sequence: Synthetic coding sequence
atgccacccccagccctcttcctgtcatccctgtacccaaggctggagttccagaacgatttctacaggtcctgtattcgcaggagttccccccagccacctcccaacctggcttggcggccagagtcactgtacagcggcgagctcgcaggcggcggatatctgtccttgtcgaaggtggtcccattctcccactacgccggaacactgcttctcctcctggctggggtggcctgtctgcgagggataggccgatggaccaatccgcagtacagacagttcattaccattcttgaggctactcatcggaatcagtcatccgaaaacaaaagacaactcgccaactacaacttcgattttcggagctggccggttgattttcattgggaagaaccctcatcaagaaaagagtctcgtggcggcccatctcggcggggtgtggccctgcttagaccagaaccactccacaggggcacagccgatacactactaaaccgcgttaaaaagctcccctgtcaaatcacctcttacctcgtggcccacaccttgggtcggagaatgctctacccgggatctgtatatctgctccagaaagctctcatgccggtgctgctccagggtcaagcccggttagtcgaagagtgtaacgggcgaagagccaaacttcttgcctgcgatggaaatgaaattgacaccatgtttgttgacagaagggggactgcagagccgcaaggacagaaactggtgatctgttgcgagggcaatgccggcttttatgaggtgggctgtgtttccacacctctggaagctgggtatagtgtgttgggctggaaccacccaggattcgcaggatcaacgggtgttccttttccccagaacgaggccaacgcaatggacgtggttgtccagttcgctattcatcggctgggctttcagcctcaagacatcataatttacgcttggtccatcggtggcttcaccgccacttgggccgccatgagctaccctgatgtcagtgccatgattctagacgcttcattcgatgacctggtgccactagccctcaaggtgatgcctgactcctggagggggttggtgacgaggactgtaagacagcatcttaacctcaacaatgcggaacagctttgccgataccaaggaccagttcttttgatcaggcggaccaaagatgagattatcacaacaacagtgcccgaggacatcatgagcaatcggggtaatgacttgctacttaagctcctgcagcatcgatatccacgtgtgatggcagaggaaggactaagggtcgtgcggcagtggcttgaagcctcctcacaactggaggaagcgtcgatctactcgcgctgggaggtggaggaggactggtgtttgtcagtccttcggagctatcaggccgagcatgggccagactttccttggtcagtcggcgaagacatgtctgctgatggcaggcggcagctcgccctgtttctcgcgcggaagcaccttcataacttcgaagcaacccactgtacccctctcccagcccagaacttccaaatgccctggcacctctag

SEQ ID NO: 106747 - DNA, 1677 bp, Artificial Sequence
  Description of Artificial Sequence: Synthetic coding sequence
atggccaagctgctgagttgcgtcctgggtccaaggctgtataagatctatcgagagcgggactcggagcgagctccagcatcagttccagagacaccaactgcggtgactgcccctcattcatccagttgggatacatattatcagcctagggccctggagaagcacgctgactccattttagctctggccagcgtgttttggagtattagttattactcctctccatttgccttcttttacttgtaccggaagggatatttatcactatccaaagtggttccatttagccactatgccggcaccctgctgctgctgttagctggggtggcttgtctgagggggatcggccggtggactaatccacagtatagacaatttatcacaatattagaggctacacatagaaaccagagctcagaaaacaaacgacagttggccaactataacttcgatttccgctcctggccggttgatttccactgggaggagccatcttcccgcaaggagtcccgggggggccccagtaggcggggcgttgcacttctccggcccgagcccctgcacaggggtactgcagatactcttctgaaccgggtgaaaaagctgccgtgccaaatcacctcctacctggttgcccacacattaggacgcaggatgctgtaccccggaagcgtttatttgttgcagaaagcactgatgcccgtgttgctgcaaggacaggcccgcctcgtggaagagtgtaatggcagacgcgctaaactgctcgcatgcgatggaaatgagattgacactatgtttgtagatagacgaggaaccgccgaacctcaaggccagaagttagtcatttgttgtgagggcaacgctggattctacgaagtgggttgtgtgtccacccccctggaagctggctattcagttctgggctggaaccaccctggcttcgccggtagcacgggtgttccatttccccagaatgaggcgaacgcgatggatgtagtggtgcaattcgccattcatcggctgggcttccaaccgcaggatattattatctacgcatggtccattgggggtttcaccgccacctgggccgcaatgagctaccccgatgtgagcgcaatgatccttgatgccagctttgacgatttagtgccgctcgcactcaaagtgatgcccgacagctggcgcgggttggtaacccgtaccgtgcggcagcacttaaacctgaataacgccgaacagttgtgtcgctaccagggccccgtcctgttaattcggcgaacaaaggatgaaatcattaccacgactgtcccggaagacatcatgtccaacagggggaatgatttgctactgaagctcctgcagcaccgctatcctcgggtcatggcggaggaaggcttgcgcgtggtgcggcagtggttagaggccagtagccagttggaagaagcttctatttattctaggtgggaagtggaggaagactggtgcttgagtgtgttacgctcctatcaggccgagcacggacccgattttccctggtcagtcggcgaggatatgagcgctgatgggcggcggcaactggctctgttccttgctagaaagcatctgcataattttgaagccactcattgcacccccctccccgcccagaatttccagatgccctggcatctgtag

SEQ ID NO: 106748 - DNA, 1578 bp, Artificial Sequence
  Description of Artificial Sequence: Synthetic coding sequence
atgcccccacctgcactattcctgagcagtttgtacccccgcctcgagttccagaatgacttttatcgctcctgcatcaggcgctcatctccccagcctccacccaacctggcctggaggcctgaatcattatattccggagaattggctggtgggggatatctgtccctgagcaaagtcgttcccttctctcactacgccggaaccctgctgctattactggctggagtcgcatgcttacgtggtattggcagatggacaaacccccagtatcggcaattcataacgatcctcgaggcaacccataggaaccagagctctgagaacaaaaggcagctggctaattacaacttcgatttccgctcctggcccgtggatttccactgggaagagccttcctcacgcaaagagagccgcggagggcctagccgacgaggggtggccctgctccgtcccgagcccctgcatagaggcaccgctgacactctgctgaaccgtgttaagaagctgccatgtcagattacatcctacctagtggcccacaccctggggcgaagaatgttgtatcccggatcagtctatctgctgcaaaaggccctcatgcccgtgctcctgcagggccaggccaggctggtggaagagtgcaatggccgccgtgcgaaattgctggcatgtgatgggaatgaaatcgacaccatgtttgtggaccgtaggggcaccgctgagcctcagggccagaaacttgtgatttgctgcgaggggaatgccggcttttatgaggtgggctgcgtttctacaccgctagaggctggctactccgtgctaggatggaaccaccctggattcgctggcagtactggcgttccatttcctcagaatgaggccaacgcgatggacgttgtggtgcaatttgccattcaccggctcggttttcagccccaggatatcattatctatgcttggtctatcggaggtttcacagccacatgggccgctatgagttatcctgatgtgtcagctatgatcctcgatgcctcatttgacgatttggtgccactggcattgaaggtcatgcccgactcttggagaggtcttgttacacggacagtcagacaacacctgaaccttaacaacgccgaacagctgtgtcgttaccagggtccggtgctccttattagacggactaaggatgaaatcattacaaccaccgtaccggaggacattatgtctaatcgtggcaatgacctgcttcttaaacttctccagcacagataccctagagtcatggccgaagagggactgagagtcgtcaggcagtggcttgaagccagctctcaactggaggaggcctctatttattcccgctgggaggttgaagaggattggtgcctctcagtgctacgctcctatcaagcagaacacggacccgacttcccctggtcagtcggggaagatatgtccgccgatggtaggcggcaactcgctcttttcctggcaaggaagcatctgcacaacttcgaagctacgcattgcacacctcttcctgcacagaactttcagatgccatggcacctctag

SEQ ID NO: 106749 - DNA, 1578 bp, Artificial Sequence
  Description of Artificial Sequence: Synthetic coding sequence
atgcctccgcccgccctgtttctgtcaagcctgtatcctagactagaattccagaacgatttctatagatcctgcatccggaggtccagtccacagcctcccccgaacctggcttggcgtccagaatctctttacagtggggagttagcaggaggcggatatctgagcctgtcaaaagttgtccctttcagtcactatgccggtaccctgctgctgctgctcgcaggggtggcatgtttgcgggggattggacggtggaccaaccctcaataccgccagttcattaccatcctggaagccacccatcggaatcaatcctctgagaacaaaagacagttggccaactacaacttcgacttcagatcttggccagttgattttcattgggaggagcccagttcgcgcaaagaatcccgaggtgggcccagccgcagaggggttgcgctcctgcggcctgaacccctgcatagagggacagcggacactctgcttaaccgggtgaagaagttgccctgccagatcacctcctacctggtggcacacactttagggagaaggatgctctatccgggctctgtctatcttttgcaaaaagccctcatgccagtgttgttacaggggcaggctaggctggtcgaagaatgtaacggacgtcgcgcgaagctgctggcttgcgacggcaacgaaattgataccatgttcgttgatcgcagaggcaccgcagaacctcagggccagaagctcgtgatttgctgcgagggaaatgcgggattctacgaggtcggttgcgtcagtacacctcttgaggccggatatagtgtgctggggtggaaccacccaggattcgcgggaagcacgggagtgccattcccccagaatgaggctaacgccatggacgttgtcgtccagttcgcaatacacaggctcggctttcaacctcaggacattattatatacgcttggtccataggagggttcaccgctacctgggccgccatgagctatccagatgtgagtgctatgatattggatgcaagctttgatgacctggtccctctcgcactaaaggtgatgccagatagctggcgagggctcgtcacacgaacagtacggcaacacctgaatctcaacaacgccgaacagctgtgtagataccagggccccgtcttgctgattcgtcgcacgaaagatgagattattaccacgaccgtaccggaggatataatgtccaatcgaggcaatgatcttcttctgaagttactgcagcacagatatcctcgggtaatggctgaagaagggctgcgggtagtacggcagtggctggaagccagttctcagttggaggaggcaagcatctattccaggtgggaggttgaagaggattggtgcctgagtgtgctgagatcttaccaagccgagcatgggcctgatttcccgtggtctgtgggcgaagatatgagcgcggatggaaggcgccaactggccctcttcttggctcgaaaacacctacacaacttcgaggccacccattgcacgcctctccctgctcagaatttccaaatgccttggcacctatag

SEQ ID NO: 106750 - DNA, 438 bp, Artificial Sequence
  Description of Artificial Sequence: Synthetic coding sequence
atgttgggacactgctgctatttctggcaggtgtggcctgcatctgaagctcttgctgccggcccgactcccagcacgggctcctcatccccttcgtggaaacagcatatcggtacatccctgcagaagacaaggggcagccttcctacaacaactctcactagtggggctgggcaatccacgagcaccgggaaaaatcccgctgccgggcggtcgctggagggcgctctgcctgcaggcgtgtggccatgtttcgcacagtccccatgtacaggtggccagcagacaccttcctcaactggcctccggtcctgcctggtgcggtcccccgggggaaagcagcagaggggagaggcacactgggggggcggcgccatctcaggcgttctttgggagtgggcactccattgcaaaatcgcggttactcactgggcctag

SEQ ID NO: 106751 - DNA, 1578 bp, Artificial Sequence
  Description of Artificial Sequence: Synthetic coding sequence
atgccaccccctgccctattcctaagcagcctgtatcctcgactcgaatttcagaacgacttttatcgatcctgcatcaggaggtcgtctccccagccgccacccaacctcgcatggcgcccagaatctctgtactccggcgagctcgccggtgggggttatctgtcactttctaaagtcgttcccttctcacactacgctgggactctcttactgctgttagcgggggtggcttgccttagaggcatcggcaggtggacaaacccgcagtatcgtcagttcatcactatactcgaagccacacaccggaatcagtctagcgaaaacaaacggcagcttgctaactacaacttcgacttcagaagttggccagtcgactttcactgggaggaaccaagctcacgaaaagaaagccgcggaggcccttctcgacgcggtgtggccctcctccgacctgagcctctacaccgaggaactgccgataccctgctcaatcgagtgaaaaagttaccgtgtcagataacaagttacctggtggcgcataccttggggcgcaggatgctctatcccggctccgtctacttactgcagaaggcactcatgcccgtcctcctgcaagggcaggcccgcttggtagaggaatgcaatgggagacgggctaaattactggcttgtgatggaaacgaaatcgataccatgttcgtggaccgcagagggaccgccgagccccaaggccagaagctggttatctgttgcgagggaaatgccggcttctacgaagtgggatgcgtgtctacccccctggaagctggttactcggtgttgggatggaatcatcccggcttcgccggcagtacgggcgtcccttttccccagaacgaggcaaacgctatggacgtggtggtgcagttcgccattcatcgcttggggttccaacctcaggatatcatcatttatgcttggagcatcggggggtttacagcgacatgggccgctatgtcatatcccgacgtatctgcgatgatccttgacgcttcattcgatgatttggtgcccctagcgttgaaagtgatgcctgattcatggcgggggctggtcacccgcacggtaaggcagcacttgaacctaaacaatgctgaacagctgtgccgataccaaggcccagtcctgctgatccgcagaaccaaagatgaaattatcaccaccacagtaccggaggatatcatgagcaatcgcggcaatgacctcctgctgaaactcctacagcaccggtaccctagggtgatggccgaggaaggtctgcgggtggtcaggcaatggctcgaggccagctctcaactcgaggaagcatctatttactctagatgggaagttgaggaagactggtgcttgagtgtgttgcggtcctatcaagccgaacatggtcctgatttcccgtggtcggtcggtgaagatatgtctgccgatgggaggcgccagctcgcactgttcttggcccgaaagcacttgcataacttcgaggctacacattgtactcctttgccagcacagaatttccagatgccttggcatctgtag

SEQ ID NO: 106752 - DNA, 1677 bp, Artificial Sequence
  Description of Artificial Sequence: Synthetic coding sequence
atggccaaattgttatcctgtgtactgggccctcgcctctacaaaatttatcgggaaagggattcagagcgcgcccctgctagcgtcccagagacaccgacggccgtcacagctccccacagctcttcatgggatacttattaccagcctcgcgccctcgagaagcatgcagatagcatcctcgccctcgcatcagtgttttggtccatttcttactacagcagccccttcgcgttcttttacctgtatagaaagggttatctgtcactcagtaaggttgtccccttcagccactatgccggaacacttctccttcttttggccggcgtggcctgcttacgagggatcggccggtggactaatccacaataccgacagtttattaccatcctggaagcgacccacaggaaccagagcagcgagaacaaacgccagctggccaactacaatttcgatttcagaagctggccagtggattttcattgggaggagccatcttcccggaaggagtcgcgcggaggtccgagcagacgaggagttgccctactgcggcccgaacctctgcatagaggaaccgctgatacgttgctgaatagggtcaagaagctgccatgtcaaatcactagttacttggtcgcacacacacttggcaggcgcatgctgtatcccggatcagtgtatctccttcagaaagcgttgatgcccgtgttattgcagggacaggccagactggtggaagaatgcaacggccggcgagctaaactgctggcttgtgatggtaatgaaattgatactatgtttgtggatcgtagaggcactgccgaaccccaggggcagaagctggtgatttgttgcgagggaaacgccggattttatgaagtaggatgtgttagtaccccactcgaagccggctactcggtcttagggtggaatcatcctgggtttgctggctctaccggcgtcccttttcctcaaaatgaagccaacgctatggacgttgttgtgcagttcgcgatccacagactcggcttccagccacaagatatcatcatatacgcgtggtcaatagggggtttcacagcaacttgggcagccatgtcctacccagacgtcagcgccatgatcctggacgcatcatttgacgacctcgtacccttagccctcaaagtaatgcctgattcttggcggggactggtcacaagaactgtgcgacagcaccttaatctgaacaacgcggaacaactgtgtcgctaccaaggccctgtcttgctgatacgcagaacaaaagatgagatcatcacaaccacggtaccggaagacatcatgtccaacagaggaaacgatctcttactcaagctgctgcagcacagatatcctagagtgatggctgaggagggcctcagagtcgtccggcagtggttggaagcctcctcccagctggaagaagcgagcatctatagcagatgggaagtggaagaggattggtgcctgagtgtgctgcgttcttaccaggctgaacacgggccagattttccttggagtgtaggagaagacatgagcgcagatggccgccgccagctggccctgttcctcgcacggaaacatcttcacaatttcgaggccactcattgcactcctctgcctgctcagaattttcagatgccatggcatctgtag

SEQ ID NO: 106753 - DNA, 1578 bp, Artificial Sequence
  Description of Artificial Sequence: Synthetic coding sequence
atgcctcctcctgccctgtttttgtcttctctctacccacggctcgagttccagaatgacttttatcgatcttgcattcgccgctcgtcaccccagcccccgccaaatctggcctggcgtcccgaatccttatactcaggtgagctcgccggcggcggctacctgagtctgtcaaaggtggtcccatttagccactacgccggtaccctcctgctcctgctagccggcgttgcctgtttaagagggattggcaggtggactaatccccagtaccgccagttcatcactatactcgaggcaacccatcggaaccagagctcagaaaataaacgacagctggccaactacaactttgacttcaggagctggccggtagactttcattgggaagagcctagtagcaggaaagagtcacgcggcgggccatccaggcgtggcgtcgcacttctgcgaccagaacctctccatcgcggaaccgcagatacactccttaatcgcgtcaaaaaactgccttgccagatcacttcttatctcgtcgcacacactctcggacgacgcatgctgtatccgggtagcgtctatctcctccagaaggcactcatgccagtcttattgcagggccaagccaggcttgtcgaagagtgtaatggcaggcgcgcgaagttgttagcatgtgacggaaacgaaattgatactatgttcgtcgatcgccgcggaacggccgagcctcagggccagaagttggtcatctgttgcgagggtaacgcaggtttctatgaagtggggtgtgtttcgacccctctagaggccggatacagtgtcctaggctggaaccacccagggttcgctggctccacgggtgtacctttcccccagaacgaggctaatgccatggacgttgtagtccagttcgctatccatcggctgggcttccagcctcaggatatcatcatatacgcgtggtcaattggaggattcaccgccacctgggccgcaatgtcttaccccgatgtgtccgcgatgatcctcgacgcgtccttcgatgacctcgtgccacttgcccttaaggtcatgcctgactcctggcgtggactagtgacacggactgttcggcagcaccttaacttaaataatgcggagcaattgtgccgttaccagggacctgtgctgttgatccggcgcactaaggacgaaatcatcaccactactgttccagaggacatcatgtccaatcgcgggaatgatctgctcctgaagctccttcagcaccggtaccccagggttatggccgaggagggccttagggtggtccgccaatggttggaggcaagttctcagttggaagaggccagcatatactcaaggtgggaggttgaagaagactggtgtctatcagttctccggagctaccaggcagagcacgggcccgattttccctggagcgtgggagaggatatgtccgctgatggtagacggcagctagcactatttctggcaaggaaacacctgcataacttcgaggcgactcactgtacacctctgccggcacagaactttcagatgccatggcacctctag

SEQ ID NO: 106754 - DNA, 438 bp, Artificial Sequence
  Description of Artificial Sequence: Synthetic coding sequence
atgctcgggcactgctgctatttttggcaagtgtggcccgcctccgaggccctggctgcagggccgacccctagcacaggaagttcttccccttcctggaagcagcacattggaaccagtcttcagaaaacaagggggagtctgcccacgaccaccctcacgagtggtgcaggtcagtctacctctacgggcaagaaccccgctgccggccggtcgctcgaaggtgcattgccagcaggtgtgtggccatgcttcgcgcagagcccctgtacaggaggccagcaaactccatcgtccaccggactccgttcgtgtcttgtgcgcagtcctggcggaaaacagcaacggggcgaagcacattgggggggaggcgccatatctggcgtactttgggaatgggcactgcactgcaagatcgcagtgacgcactgggcttag

SEQ ID NO: 106755 - DNA, 1578 bp, Artificial Sequence
  Description of Artificial Sequence: Synthetic coding sequence
atgccacccccggctctatttctgagcagcctctatcctcggctcgagttccagaacgacttttaccgcagctgcatccgcagaagctctccgcagccaccgccaaatttagcctggaggccagagagtctatatagcggcgagctggccggaggaggatacctcagcttgagtaaagtggtccccttcagccactatgccgggactctgctgctgttactggcgggtgtcgcttgcttgcgtggcatcggacgatggacaaatccacaatatagacagttcattaccatcctggaggctacccaccgcaaccagagttccgagaataagcgccagctcgcaaattataactttgactttaggagttggccggtggattttcattgggaggagccttcaagtcgcaaagagtctagaggcgggccatcaagacggggagtcgcactcctccgccccgagccattgcacagaggcacagcggacactctgctgaacagggtaaaaaagctaccctgtcagattacttcttatcttgtggcccacacccttggccgacggatgctctaccccggaagcgtttacctgttgcaaaaggccctgatgcctgtcctcctacaagggcaggccaggctcgtcgaagagtgtaacggacggcgggctaaactgctcgcctgtgatggaaacgaaattgataccatgttcgttgaccgacgggggactgctgaacctcaagggcagaagctggtgatctgctgcgagggcaatgccggattctatgaagtcggatgcgtgtctactccactggaggccgggtactccgtgctcggttggaatcatccaggctttgctggtagcactggggtcccattcccccagaacgaggccaacgccatggatgtagtggtgcagtttgccattcaccggttaggctttcagcctcaggatataattatttacgcatggtctattggcgggtttacggcaacttgggcagccatgtcgtatcctgacgtgtctgccatgatactggacgccagctttgatgacctggtgcccctggcacttaaagtgatgccggactcttggaggggactggtaacccgcacagtgcgccagcatttaaatctgaacaacgccgaacagctgtgtcggtaccagggccctgtcctgttgatcagacggacaaaggacgaaattattaccactacagttcccgaggacatcatgtccaatcgtggcaatgatttacttctaaagttactgcagcacagatacccccgcgttatggctgaggaaggcctgcgagtcgtacgacagtggctcgaagcaagttcacaattagaagaggcttccatttactcaagatgggaggttgaggaggactggtgcctctcggtgctgcgttcctaccaggccgaacacggacccgattttccatggtcagttggagaagacatgagtgctgacggcagacgccagcttgcactgtttctcgccaggaagcacctgcacaacttcgaagctacccattgcactccattgcctgctcaaaattttcagatgccttggcatctctag

SEQ ID NO: 106756 - DNA, 438 bp, Artificial Sequence
  Description of Artificial Sequence: Synthetic coding sequence
atgcttggtcattgttgttacttctggcaggtgtggcctgcaagcgaggccttagctgccggcccaactccatccaccgggtctagctctcccagctggaagcaacatattgggacctccttgcaaaaaactcgcggctctctcccaacgacaaccctgacaagcggcgccggccaaagcaccagcacagggaaaaatcccgcagctggccgcagccttgaaggtgcattgcccgcgggcgtctggccttgcttcgcccagtccccctgtacaggcggccagcagaccccgtcatcaaccggcctgagatcatgcctggttaggagtcccggggggaagcagcaacggggagaagcccactggggcggcggagcaatatctggagtcctctgggagtgggcgcttcactgcaaaatcgctgtgactcattgggcctag

SEQ ID NO: 106757 - DNA, 1578 bp, Artificial Sequence
  Description of Artificial Sequence: Synthetic coding sequence
atgcctccacctgctcttttcttatctagcctatatccgcgcctggaattccagaacgacttttatcgaagctgcatcagaaggagcagtccgcagcctcctcccaatcttgcctggcgacctgaatccctctactcaggggaactggcaggaggcggctatctgtcattgagcaaggtagtgcctttctcacactatgccgggaccctactccttctgctggccggagtggcttgcctgcgagggataggcagatggaccaaccctcaataccgtcaattcattaccatcctagaggccacccatagaaaccagagttctgagaacaaacgacaactagcaaattacaattttgattttcgatcctggccggtcgatttccactgggaggaaccctcaagtcggaaggagagcagaggcggtccaagtcgccggggtgttgccctcttgagaccagagccacttcacaggggaaccgcagatactctgctgaatcgcgtgaagaagttaccctgtcaaatcacaagctacttggtggctcatacattggggcggcgtatgttgtatcccggtagcgtctatctgctccagaaagccctgatgcccgtcttgttgcagggacaggcaagactggttgaagaatgcaacggtcgacgtgctaaactgcttgcatgcgatggaaacgagatagacacaatgttcgtcgatcggagggggaccgctgagcctcagggccagaaacttgtgatatgctgcgagggaaacgccgggttctacgaggttggctgcgtcagcacacctttagaggccggttactctgtgctgggatggaaccacccaggcttcgcgggcagcacgggtgtgcccttcccccagaacgaggctaacgctatggacgttgtggtgcagtttgctattcaccgcctgggtttccagccgcaggacataattatttacgcatggtccattgggggcttcacagccacttgggcggccatgagttacccggacgtttccgccatgattctagatgcctctttcgacgatttagtgccactggctttgaaagtgatgcccgacagctggcggggactcgtaactcggaccgttcgccagcatctgaacttgaataacgcggaacagctgtgcagataccaggggcctgtgcttttgattcggaggacaaaagatgagatcattactacaaccgtgcctgaggatattatgagtaatagggggaatgatctgttgctgaagctgctgcagcaccgctaccccagggtgatggctgaagaaggattacgggtggttcgccagtggctggaagcaagctcacagctggaggaggctagtatctactcacggtgggaggttgaagaagactggtgtttaagcgttctccggagctaccaggccgaacatggaccggatttcccttggagtgtgggggaggacatgagcgccgatggaagacggcagctggctcttttcttggcccgaaaacatctacacaactttgaggcgacacattgcacgccccttccagcacagaatttccagatgccgtggcacttgtag

SEQ ID NO: 106758 - DNA, 1278 bp, Artificial Sequence
  Description of Artificial Sequence: Synthetic coding sequence
atgaatgccatgttggaaactcccgaactgccggcagtttttgatggtgtgaagctagcggctgttgccgcggtactgtatgtgattgttcgatgccttaacctgaagtccccaaccgcgcctcctgacttgtattttcaggattccggactaagccgattcctgcttaaaagttgccctttgttaactaaggagtatattcctccattaatttggggaaagagtggccatattcaaaccgcactgtacggaaagatggggagggtgagaagtccccacccttatggccacaggaaatttatcaccatgtccgacggagccacgtccacgttcgacctctttgagccattagctgagcactgcgtcggcgatgatataaccatggttatatgtcctggcattgccaatcactcggaaaaacagtacatacggaccttcgtggactacgctcagaagaatggatacaggtgcgcagtactaaaccacttgggagcactccccaacattgagctcacaagcccgcgcatgtttacatacggatgcacctgggaatttggcgccatggtgaactacattaagaaaacatatcccctgacccaactcgttgtggttggtttctcactgggcggaaatattgtgtgtaaatacctgggggagacacaggcaaatcaggagaaggtcctctgttgtgtttccgtttgccaggggtatagtgcactcagagctcaagagacattcatgcaatgggatcagtgtcgtcgattctataattttcttatggccgataacatgaaaaaaatcatcctgtctcacaggcaggccctttttggagatcacgtcaagaagccacagtcactggaggataccgatctgagcaggttgtacactgctactagcctgatgcaaatcgatgacaatgtaatgaggaagttccacggatacaactctctgaaggagtattatgaagaagagtcttgcatgcggtatttgcaccgtatatacgtcccactgatgttggtcaacgccgcagacgacccactcgttcatgagagtctgctgaccatcccaaagagtctcagcgaaaaaagggagaatgtgatgttcgtgttacccctccatggcggccacctgggctttttcgaaggaagcgtgctttttcctgaaccattaacctggatggataaactggtggtcgagtacgcaaatgccatttgtcagtgggaacggaataaattacagtgttctgacacagagcaggtggaagccgacctggagtag

SEQ ID NO: 106759 - DNA, 1278 bp, Artificial Sequence
  Description of Artificial Sequence: Synthetic coding sequence
atgaatgcaatgctcgaaaccccagaacttcccgctgtcttcgatggggtgaaactagccgcagtggctgctgtgctgtatgtgatcgtgaggtgtctcaaccttaagtctccgactgccccccctgacctgtacttccaggatagcggactgagcagattcctgctcaagtcttgtcccctgctgacgaaagaatatattcccccactgatctggggtaagtctggccacattcagacagcactttacggtaagatgggccgcgtgcggtctcctcatccctacgggcacaggaagttcattactatgagtgacggtgcaacttccaccttcgatctctttgagcccctcgccgaacactgcgtgggcgatgatattaccatggttatttgtcctgggattgctaaccacagcgagaaacagtacatccgtacatttgttgactacgcccaaaagaacgggtatcgatgcgcagttctgaatcatctcggtgctttaccgaacatcgaactgacttcaccaaggatgttcacatatggatgtacctgggagtttggcgccatggtaaactatattaagaaaacatatcccctcacgcagctcgttgtcgttggtttcagtctaggcggaaacatagtatgtaagtacctgggggaaactcaggccaatcaggaaaaggtgttgtgctgtgtcagtgtgtgtcaaggttattccgcattgagggctcaggagacgtttatgcagtgggaccagtgtagaaggttttacaatttccttatggctgacaatatgaagaagatcatactctcacatcgccaagccctcttcggtgaccatgtgaaaaagccacagagcctcgaagacaccgacttgtcacggttgtacacagcaacgagcctcatgcaaatcgacgataatgtgatgcgcaagttccatggatataacagcttaaaggaatattatgaggaagagtcatgcatgcgatatctgcacagaatctacgtgcctctgatgttagtcaatgccgccgacgatcctcttgttcacgaatcattacttacaatccccaagtcactctcagaaaaaagggaaaatgtgatgttcgtgctacccttacacggaggtcacctcgggtttttcgaaggaagcgtgctattccccgagccccttacatggatggataaactggttgtagaatatgcgaatgctatctgccagtgggaaaggaacaaactccagtgtagtgatactgaacaggtagaggcggaccttgagtag

SEQ ID NO: 106760 - DNA, 1230 bp, Artificial Sequence
  Description of Artificial Sequence: Synthetic coding sequence
atgcagcggctggcaatggaccttcgcatgctgtcacgcgaactctctctgtatttagaacaccaggtgcgcgtgggcttctttgggtcaggtgtgggcctgtctctgatccttgggttctcagtggcctacgcattttactatctgtccagtatagccaagaagcctcagctggtgaccggcggcgagtccttctcacgttttctgcaggaccattgtcctgtggtgactgaaacctactaccccaccgtctggtgctgggagggaaggggtcagaccctgcttaggccatttatcacgtctaaaccacccgttcaataccgtaacgaactaatcaaaacagcagacggaggtcagattagcctggactggttcgacaacgataacagtacctgttacatggacgcttcgacccgccccaccatactccttctccccggattgacagggacaagcaaagagagctatatcctgcatatgattcacctgtccgaggagctgggatatcggtgcgtcgtctttaacaaccggggcgtcgctggcgagaacttgctgaccccaaggacctattgctgcgctaataccgaggacctggagaccgtgattcatcacgtccacagcctctacccatccgcccctttccttgccgcaggtgtgtccatggggggaatgctgctgcttaactatcttggtaagattggttccaaaacaccactgatggccgcagcaaccttctcagtcggttggaataccttcgcctgttctgagtccctggagaagcccctgaattggctcctctttaattattacctcacaacctgtcttcagtcttctgttaacaaacaccggcatatgttcgtcaaacaggtggatatggatcacgtgatgaaggctaagtctatcagggagtttgacaaacgctttacgtctgtgatgtttggataccagacaatagacgattactacaccgatgcgtcaccatcacccaggcttaagagcgtcggaattcctgtgttgtgcctcaactccgtcgatgacgtgttttcaccttcacacgccatccccatcgagacagcgaaacagaaccctaatgtggccctggtgctgacaagctatggagggcatatcggtttcctcgagggaatttggccgaggcagtcaacatacatggaccgggtgttcaaacaatttgttcaggcgatggtcgaacacggtcatgaactatcctag

SEQ ID NO: 106761 - DNA, 1050 bp, Artificial Sequence
  Description of Artificial Sequence: Synthetic coding sequence
atggcagctgaagaagaagaggttgacagtgcagacacaggagaacgcagcggatggctgacaggttggttgcctacatggtgtccgacatctataagccacctgaaagaggcggaagaaaaaatgttgaagtgtgtcccatgtacttacaagaaggagcccgtgcgaatctcgaatggaaataagatatggactctaaagttcagccacaacatcagtaacaagacccctctggttctcctccacggattcgggggtgggttgggcctatgggcactgaattttggggacttgtgtactaatagaccagtttatgccttcgatctgcttggcttcggccgcagcagccgacccagattcgactcagacgctgaggaagtggaaaaccagtttgtagagagcattgaagagtggagatgcgccctgggtttggataagatgatattgctaggccacaatctcgggggtttcctagcagcggcctactccttaaaatatcccagtcgcgtcaaccatctgatcttggtcgagccatggggcttcccagagcgcccagatctggccgaccaggaccgcccaattcccgtgtggattagggcattaggagccgcacttacccccttcaacccacttgccggcctgagaatcgctggaccttttgggttgagcctggttcagcgcctgcgccctgacttcaagcggaagtattctagcatgtttgaagacgatacagtgaccgaatacatctaccactgcaacgtgcagactccatccggcgagaccgccttcaagaacatgaccattccttacggctgggccaaacgccctatgctgcagcgcatcggtaagatgcaccccgacattcccgttagcgtgatattcggagcacgcagttgtatagatggcaactctggtacatctattcagtcacttcgcccacactcgtacgtcaaaaccatcgctatcctaggtgccgggcattacgtctacgcggaccagccagaagaattcaatcagaaggtcaaagagatctgtgataccgtggactag

SEQ ID NO: 106762 - DNA, 1491 bp, Artificial Sequence
  Description of Artificial Sequence: Synthetic coding sequence
atggccgagctgcagatgctcttggaggaagaaatccctagcggcaaaagggctttgattgaatcctatcagaatcttacccgggtcgcagactattgcgagaacaattacatacagcggcatgggtttgcggtgttgctatgtctgctctctaattcttggccgcaggcaacagacaaacgcaaagctttggaggagactaaagcctacacaacccaatcattggcttccgtcgcatatcagattaacgccctggcgaataatgtgctgcagttgctggacattcaagccagccagctgagacggatggagtcttctatcaatcacatctcccaaaccgtggacattcacaaggagaaggtggcgagacgagaaattggcatcctaacgacaaataagaacaccagtaggacgcataagatcatcgctccggccaacatggagaggccagttagatacatccgtaaacctattgactacactgtgcttgatgacgtgggccacggtgttaagtggctgaaggccaagcacggtaataaccagcctgctaggactggcactctcagccggacaaacccgccgacacagaagcctccttcacccccaatgagtggcagaggcacgctgggcagaaataccccctataaaactctcgaacccgtgaagcctccgactgtgcccaacgattacatgacaagccccgcacggctagggagtcagcactctcccggccgtactgctagtcttaaccagagaccaaggacacatagtgggagttccggcggcagcggttcaagagagaattctggcagtagctctattggaattccaatcgcagtgcccacaccgtcgcccccaaccatcggaccagaaaacatttctgtcccccctccctcaggcgcccccccggcgcctccgctagcccctttgttgccagtttccacggtgatagccgccccagggtccgctcccggaagtcagtatggaactatgacgcgacaaatctctcgccacaactcaactacttcctccacgagctccggagggtaccggcgaaccccatcagtgactgcccagttttctgcgcaaccacatgtgaatggaggaccgttgtactctcagaattctatcgccgacagccctactcctcctccccccccccccccggacgacatcccgatgttcgacgacagcccccccccccccccaccccctccggtggattacgaggatgaagaggctgcggttgtgcagtataatgatccgtatgccgatggtgaccctgcttgggcacccaagaactatattgaaaaggtcgtggctatatacgattatactaaggataaagacgacgagctttcctttatggaaggtgcaatcatctatgtgattaaaaagaacgatgatggatggtatgaaggggtgtgcaaccgggtgactgggctgttccctggaaattacgtggaatccattatgcattacaccgactag

SEQ ID NO: 106763 - DNA, 1530 bp, Artificial Sequence
  Description of Artificial Sequence: Synthetic coding sequence
atggccgaactgcaaatgctcttggaagaggaaatccctagtggcaagcgggccctcatcgagtcgtaccagaacttaacaagagtagccgactactgtgaaaataactacattcaggccacggataagaggaaagctctcgaggagacgaaggcatataccactcaatccctggccagcgtcgcctatcagattaacgctctggccaacaatgtcctgcagctgctggatattcaagcttctcagctccgccgaatggaatcatcaataaaccacatctctcagaccgtagatatccacaaggagaaggtagctcggcgggagatcggaatcctgaccaccaataagaacacatccaggacccataaaatcattgcacctgctaacatggagcgacctgtgcgatacatacggaaacctattgactacaccgtactggatgacgtgggtcacggtgtgaagaaatggcacaagattattcacggaaacaatcagcctgcccgtactgggactctcagtcgtaccaatcctccgacgcagaaacctccaagccctcccatgtccggcaggggtaccctggggcgaaacaccccctacaaaactttagagcctgtgaaacctccaaccgttccaaatgattacatgacctcaccagcccgtctgggaagtcagcacagtccaggcagaaccgcttcgttaaatcagcggccgcgaacccacagtggttcctccggcggtagtggtagccgggagaactccggatcatcttccataggaatcccaattgcagttcccaccccttcacctcctacaattggacccgagaatatatctgtgccaccaccaagcggagccccccccgccccccccttggccccactgctccccgtatcgaccgtgattgcggctcccggaagtgccccggggagtcaatatggcacgatgactcggcagattagcagacataattctactacatcttccacttccagcgggggctaccggcgcaccccttctgtcacggctcagttttccgcccagcctcatgttaacggcggccctctgtattctcaaaactctataagtatagccccacccccaccacccatgccccaactgacaccacaaattcccctgacaggattcgtcgccagggtccaggagaatattgcagacagcccgacaccccccccgccccccccgcccgatgacatccctatgttcgatgactcccctccgcccccacctccgcccccggttgactatgaggatgaggaagcagccgtggtgcagtacaatgatccctacgctgacggcgaccctgcctgggcacccaagaactacattgaaaaagtcgtcgctatctacgactacacaaaagacaaagacgacgagctgtcatttatggaaggggcaatcatttatgtgatcaagaagaatgatgatggttggtatgagggggtttgcaaccgagtgactggactcttcccaggcaattatgtagagagcataatgcattacaccgactag

SEQ ID NO: 106764 - DNA, 1443 bp, Artificial Sequence
  Description of Artificial Sequence: Synthetic coding sequence
atggctgaattacagatgttgctcgaggaggagattccttctgggaaacgggcattaatcgaaagctaccagaacctcacacgggtggcggattactgtgagaataattacattcaagcaacagacaagagaaaggctctggaagaaacaaaggcttatacgacacagtcgttggcaagcgtcgcataccagatcaacgcactggccaacaatgttcttcagttactcgatatccaagcctctcagctgcgccgtatggagagcagcattaaccatattagccagactgttgatatacacaaagaaaaggttgctcgccgcgaaatcggcattttgacaaccaacaaaaatacctctagaactcacaaaattattgcccccgctaacatggagcggcctgtcagatatatccggaaacccatcgactacaccgtcctggacgatgtgggacacggcgtcaagtggctcaaagctaaacatggaaacaaccagccggcgcggaccggaactctcagccgcactaatcccccaacacagaaaccccccagccccccaatgagcggccggggcaccttagggaggaacaccccctataaaacactggagcccgtgaagcccccgactgtacctaacgattacatgacctcccccgcccgtttaggatcacagcattctcccggacgcaccgcctccctgaatcagcgccctcggactcactctggatcctcaggagggagtggcagtagggaaaactctggctcatcaagtattggcattcccattgccgtgcctactccctctcctccaacaatcggcccagcaccaggatcagcccctggctcacagtacggcaccatgacaagacaaatcagccggcacaattccacaacctcaagcaccagttcgggcggctaccgcaggacacctagcgtcacagcgcaattctctgcccagccacacgtgaacggagggcccttgtatagccagaattctatctctatcgcccctcctcccccacccatgccccaactcaccccccaaatcccgcttacagggtttgtcgcccgagttcaggaaaacatcgccgactcccccacccccccaccaccacctcctccggatgacatcccaatgtttgacgatagcccccctcctccgccaccgccccccgtggactacgaggacgaggaggccgctgtggttcagtacaatgacccttatgcggacggagatccagcctgggcccccaagaattacatcgaaaaggttgttgcaatctatgattatactaaagataaagatgacgaacttagctttatggaaggcgccattatttatgttatcaagaaaaacgacgacggatggtatgagggagtctgcaacagagtgactgggctcttccccggaaattacgtggaatctatcatgcactacaccgattag

SEQ ID NO: 106765 - DNA, 1449 bp, Artificial Sequence
  Description of Artificial Sequence: Synthetic coding sequence
atggccgagctgcagatgcttcttgaggaagagattccttccggcaagagggcactgatcgaatcgtaccagaacctaaccagggtggcagactattgcgaaaacaactatattcaggcaacggacaagaggaaagcacttgaggaaactaaggcatacactacgcaatcactggcgtcagtcgcctatcagattaacgcccttgctaataacgtgctgcaactcctggacatccaagctagtcaactgcggcggatggagtcaagtattaaccacatcagtcagaccgtggatatccacaaagagaaggtggcgagaagggaaattggtattctcaccaccaataaaaatactagccgaacgcacaagataattgcccctgctaatatggagcgtcccgttcggtacataaggaagcctatagactacacagtattagacgacgtgggacacggtgtgaagaagtggcataaaattattcacggcaacaatcagccagctcgaactggaaccctatctaggacgaatccccctacacagaagcctccctctcctcccatgtccggacgtgggaccctgggccgcaataccccttataaaactttagaaccagttaagccccctaccgtccctaacgactatatgacttcccccgcccggctgggatcccagcactctcccggccgaacggctagcctgaatcaacggccccgaactcactctggatcttcggggggatccggcagcagggaaaacagcggatctagttccataggtatccctatcgcagtccctaccccaagtccccccaccataggaccagccgcccctggctctgcacccggttcccaatatgggaccatgaccaggcaaattagtcgccataattcaaccacctcctctacaagtagtggaggttacaggcgcaccccaagcgtgactgcccaattctccgcccagccgcacgtgaatggcgggcccctgtattcccagaacagcatatcgatcgcaccaccccctcctccaatgcctcagcttaccccacagatcccattgaccgggttcgttgctagagtgcaagaaaacattgccgattccccaacgccaccccctccgccaccgcctgatgacatacctatgtttgatgactcgcccccacctcctccccccccgcccgttgactatgaggacgaggaggccgctgtggtgcagtacaatgatccatatgccgacggagaccccgcatgggcgcccaagaactatattgaaaaagtcgtcgccatttatgactacactaaagacaaagacgacgaactgagctttatggaaggggcgatcatttacgttatcaagaagaacgatgatggatggtacgaaggggtgtgcaacagggtgactggactctttcctggaaattacgttgagagtattatgcactatacagattag

SEQ ID NO: 106766 - DNA, 1272 bp, Artificial Sequence
  Description of Artificial Sequence: Synthetic coding sequence
atggcagaactccagatgctgctggaggaggagatcccctccggaaaaagagccctcatcgagtcatatcagaatcttacacgggttgctgactactgcgagaataactatattcaggcgaccgacaagcggaaggcactagaagagactaaggcatacaccacccagtccttggccagcgtggcataccaaatcaacgccctggccaacaatgtgcttcagctgctcgacattcaagcatcacaactcagacggatggaaagctcaatcaatcacataagtcagacggtcgacattcataaagaaaaggttgccagacgcgagatcggtatcctgacaaccaataagaacaccagtagaacacataagattattgcaccggcgaacatggagcggccagtgaggtacatcaggaagccgatcgactacaccgtactcgatgacgtaggccatggagtgaaaaagtggcacaagattatccacgggaacaaccaacccgcccgcactgggaccttgtcccgcaccaacccccctacgcaaaagccaccatctcctcccatgagtgggcgcggtaccctagggagaaacacaccatataaaacacttgaaccagtgaaaccccccaccgttccgaacgactatatgacctcacccgctagacttggctcacagcattcgcccggtcgtactgctagcttgaaccagcgaccgcggacgcacagcggaagtagcgggggaagcgggtcaagagagaacagtggcagttctagcatcgggatcccaattgcggtgccaaccccaagccctccgaccattggtcccgtatcgattgctccaccccctccacccatgccccagctgacaccccaaattcctttgactggctttgtcgcaagagtccaagaaaatattgctgatagtccaactcctcctccccctcccccccctgatgacataccaatgtttgatgattctccgccccctccccccccacctccagtcgactacgaggacgaagaggccgccgtagttcaatacaacgacccatatgcagacggggatcccgcctgggctcctaagaactatattgagaaagtggtcgccatttatgattacacaaaggataaagatgatgagttgtcattcatggagggtgccatcatctacgtgatcaagaaaaacgatgatggctggtatgaaggcgtgtgtaaccgcgtcaccggactctttcctggcaactacgtagagtccatcatgcactatacagattag

SEQ ID NO: 106767 - DNA, 1359 bp, Artificial Sequence
  Description of Artificial Sequence: Synthetic coding sequence
atggctgagctgcagatgctcctggaggaggagattccgtcaggaaagcgggcgctaatcgagtcctatcagaatctgactagggtggccgactactgtgagaataattacatccaggctactgacaagcgcaaggccttggaagaaacaaaggcatacaccacacaaagcctcgcctcagtcgcttatcagatcaacgctctggccaacaacgtcctgcagttgctagatatccaagctagtcagctgcggcgaatggagagcagcatcaaccatatatcccagaccgtggatattcataaggagaaggtagcacgccgcgagattggcatattgacaactaataaaaatacgagcagaacacataagatcatagcccccgccaatatggaacgtcctgtcaggtatatacggaaaccaatcgattacaccgtcctcgacgacgttggtcacggggtgaagtggctgaaggcgaaacatgggaacaatcagcctgctcggactggtaccctttcacgcacaaaccctccaactcagaaacccccatcccctcccatgagcggacggggtaccctgggccgtaacaccccctacaaaactctggagcccgtcaagccaccaacagtgccaaacgattacatgacgtcaccggcacgattggggtcccagcattcacctgggagaacagctagccttaatcagagaccccgtacccatagtggctcatctggggggtccggcagtagagaaaactcaggaagtagttccattggcatcccaattgcagtccccacccctagccctcccacaatcggccctgctgctcccggtagcgcccctggctcccagtacggtactatgacccggcagatcagcaggcataacagtacaacttcctccactagttccggaggttacaggcggaccccttctgtgaccgctcagttctcagcccaaccacacgtgaacggtgggcctctgtactcacaaaatagcattgctgactccccaaccccgccacccccccctcccccggacgacatcccaatgttcgacgactcacctcccccacccccccctccaccagtggactatgaggatgaagaggcagccgtggttcagtataatgatccatatgccgatggcgatccggcttgggccccaaagaattacattgaaaaggtggtagcgatctacgattatacaaaagataaggacgacgaactcagcttcatggagggcgccattatatatgtcatcaagaagaacgacgacggctggtacgaaggcgtgtgtaaccgagttaccggcctgttccccggcaactacgtagaatccatcatgcattatacagattag

SEQ ID NO: 106768 - DNA, 1431 bp, Artificial Sequence
  Description of Artificial Sequence: Synthetic coding sequence
atggctgagttgcaaatgttgctggaggaggaaatacccagtggcaagcgggcactcatcgagtcttatcagaacctgacacgggtggccgattactgcgagaataactacatccaggctacagataagaggaaagccctggaggaaactaaagcatataccacgcagagcttagctagtgttgcctaccagataaacgccctggcaaacaacgtgttacagctattggatatccaggccagccagctgcgacgaatggagagttcaataaatcatatatcacagacagttgacattcacaaagagaaagtggcaaggagagaaattggcatcttgacaacaaataaaaacacctcaagaacccacaagataattgcacctgctaacatggagagacctgtgcgctacattcggaaacctatagattacaccgtgctggacgatgtgggtcacggagttaaacacggaaacaaccagcccgccaggacgggtactctttcccggacgaacccacccacacagaaacccccatcacccccaatgagtgggcggggcactctcgggcgtaataccccatacaagacccttgagccagtgaagcctcccaccgtgcctaatgattatatgacgtctccagcaagactcgggtctcagcactcacccggaagaaccgcttctctgaaccaaaggcctcgtactcactccgggtcaagtggcgggtctggttcaagggagaactctggttctagttcaatcgggatccccattgcagtgcctactccttccccacccacaattgggccagctgcgccaggtagcgctcctggctcccagtacggcacgatgactcgtcagatttccaggcataatagcacgacctcctctacatcctccggaggatatagaagaactccaagtgtcacggcacaattctctgctcagccccacgtgaatggagggccgttgtattcacaaaattctatcagtatagcacctcctccaccccccatgccgcaacttacccctcagatccccctcacaggattcgtagcaagagttcaagaaaacattgccgacagtccgaccccccccccaccaccgccccccgatgatatccctatgttcgatgacagcccaccgccccctccccccccgccggtggactatgaggatgaagaggcggcggtcgttcagtataacgacccgtatgccgatggggatccagcctgggccccaaagaattacatcgaaaaagtcgtcgctatctatgactacacgaaggacaaggatgacgagctatcatttatggaaggagccatcatctacgtgattaaaaaaaacgacgacggttggtatgagggggtttgtaacagagttacaggactgtttcctgggaactatgtggagtcaattatgcattatacagactag

SEQ ID NO: 106769 - DNA, 1446 bp, Artificial Sequence
  Description of Artificial Sequence: Synthetic coding sequence
atggcagagcttcagatgctgctcgaggaggagatccctagtggaaagcgggcactgatcgagtcttaccaaaatctcaccagggtggcggattattgcgagaacaactatatccaggccacggacaagagaaaggcccttgaggagacaaaagcatacacaacacagagcctggcgagtgtagcgtaccaaataaacgccctggctaacaacgtactacagctcctcgacatccaggcctcccagttgagaagaatggaatcttccatcaaccacattagccagacagtagacatacacaaagagaaagtggctagaagggaaataggcatactcacaacaaataagaatacctcaagaacgcataagataatcgcacccgctaacatggagagacctgtgagatacataagaaagcctatagattatactgtgctggacgacgtggggcacggggtgaaatggctgaaagctaagcatgggaacaatcaaccggcaaggaccggcaccttgagtagaaccaaccctcctacgcagaaaccaccgtctccccctatgtcggggcgcggtactctgggacggaacacaccctacaagacgctggaacctgtcaaaccaccaaccgtgccaaatgattacatgacatctcctgcaaggctgggctcacagcattctccaggacggacagcctccctgaatcaacggccgcgtacccactctggtagctcaggcggctccggatctagggaaaacagcggcagcagcagtattggcatacccatagctgttcccactccatctccaccgactattggtcccgccgctccaggtagcgcaccagggtcacagtacggcactatgactagacagatctccagacacaactccactacgagcagcacttcaagcgggggttaccgccggacccctagtgtgacggcccagtttagcgcacagccccatgttaatggaggacctttatacagtcagaatagcatctctattgccccaccgcccccgccgatgccccagctgacacctcagattccgctgacagggttcgtcgccagagttcaggagaatattgcggattcccctacccccccccctccgccgccgcccgacgacatccccatgttcgatgattctccaccacctccaccccctccaccagtggattacgaggatgaagaggctgcggtcgttcagtacaacgacccttatgcagatggagatcccgcttgggcccccaagaactatatcgaaaaagttgtcgcaatttatgactacactaaggataaagacgatgaactgtctttcatggagggtgctattatctacgtcattaaaaagaacgatgatggttggtacgagggcgtgtgcaatcgcgtcaccggtctgttccccggaaattacgtagaaagcatcatgcattacaccgattag

SEQ ID NO: 106770 - DNA, 1527 bp, Artificial Sequence
  Description of Artificial Sequence: Synthetic coding sequence
atggctgagctgcagatgctcttagaagaagagatccccagtggaaagcgcgcactcatcgagtcataccagaacctcactcgggtggccgactactgcgagaataattacatacaggccactgataaacgcaaagccctggaggaaacgaaagcctataccactcagagcttagcatctgtggcttatcagataaatgctctggcgaataacgttctacagcttcttgacatccaggccagtcagctacgccgcatggagagctcaatcaaccacattagccagactgtggatatacacaaggaaaaggtggctcgtcgggagattggcatcttgactacgaacaaaaatactagcaggactcataagattatcgctcctgctaacatggagaggcctgtaaggtacattcgaaagcccattgattacacagttttagatgacgtcgggcacggtgtgaagtggctaaaggcaaagcacggcaataatcagcctgcccggactggcactttgagcaggaccaacccccccacccagaaacctccgagtccacccatgtctgggcgcggcactctcgggcggaacactccctataaaactctagaaccagtcaagccccccaccgttccaaatgactacatgacatcccccgccaggttaggcagccaacacagcccaggacgcactgcttccctgaaccaacgaccacgcacccattctgggagctcagggggcagtggcagtagagagaatagcggctctagtagcattggaattccaatcgcagtgccaacgcctagcccaccaacgatcggacccgagaacatctctgtgcctcccccctcaggggcccctcctgccccaccgctggcacccctgttacccgttagtacagtgattgcagcccccgggagcgcccctggttcacaatacggcaccatgacaaggcagatctctagacacaactccaccacatcatccactagttccggaggatacagaaggactccaagtgttacagctcaattttcagcacaacctcacgtgaacggcggcccactatattcccaaaatagcatcagtatagcacccccaccgcctcccatgcctcaactgacacctcaaattcccctgactgggttcgtggcccgtgttcaggaaaatatcgcagacagtcctactcccccgcccccccctccgccagatgatataccaatgtttgacgacagcccacctccccccccgccaccacccgtggattacgaggatgaggaggccgccgttgtgcagtacaacgatccatatgccgacggagatccagcatgggctccgaaaaactacatcgagaaggtcgtcgccatctatgattacacgaaggataaagatgatgaactctcattcatggagggcgcaatcatttacgttattaagaagaatgacgacggctggtacgagggagtctgcaatagagttacaggcctgttcccagggaactacgttgagtctataatgcactataccgattag

SEQ ID NO: 106771 - DNA, 1428 bp, Artificial Sequence
  Description of Artificial Sequence: Synthetic coding sequence
atggccgagctacaaatgctcttggaagaggagatcccatcgggcaaaagagccctgatcgaatcttaccagaatctgactcgggtcgcagactactgtgaaaacaactacatccaggccaccgacaaaagaaaggctctcgaagagacaaaagcttatacaacgcagtccctcgcgtccgtcgcatatcagattaatgccctcgcaaacaacgtgctacagcttctcgacatccaggctagccagctgaggaggatggaatcctctattaatcacattagtcagactgtggatattcacaaggagaaggtagcccgtagagagataggcatcctcaccaccaacaagaacactagccgaacacacaagattatcgctcctgccaacatggaacgccccgtgcggtacatcaggaagcccattgattacaccgttctcgacgacgtagggcatggtgtcaaacacggaaataatcagcctgccaggacaggcactcttagcagaactaatcctcctacacagaagcctccctcccctccaatgagcggtcgaggaaccctgggtcggaacaccccctataagacactggaaccggtgaaacctccaacagtgccaaacgattacatgaccagtcctgcacgattgggcagccagcacagccctggtcgcactgctagtcttaatcagcggccccggactcactctggatcatcaggaggctccggatccagagaaaacagtggttcctcttccattggcatccctatcgccgtgcccacaccctcacccccgacaataggtcctgcaccagggtcagcaccgggctcccagtacggaaccatgacaagacagataagcagacacaattctaccacatcttctaccagctcaggaggttataggcggaccccatctgtgactgcccagttctccgcgcagccccatgtgaacggcggccctctgtatagccagaattcaattagcatcgcccctccaccaccccctatgccacagttgacacctcagatccccctcaccgggttcgtcgctagggtgcaagaaaatatcgctgactctcccacgccacctccaccacctccaccagatgacatccctatgttcgatgactctcccccccccccacccccaccccccgtcgactacgaagacgaagaggcagcagtagtgcagtataacgatccatatgctgatggagacccagcctgggcgcctaaaaactatatcgaaaaagtcgtggccatctatgactacaccaaagataaagacgatgaactgtctttcatggagggtgctatcatttacgtcatcaaaaaaaatgatgatgggtggtatgagggagtatgtaaccgcgtgaccggactttttccaggaaactatgtggaatcaatcatgcattacacagactag

SEQ ID NO: 106772 - DNA, 1341 bp, Artificial Sequence
  Description of Artificial Sequence: Synthetic coding sequence
atggcagagctgcaaatgctgctggaagaagagatcccgtcagggaaacgcgctctcatcgaaagttatcaaaatctaaccagagtggctgactattgtgaaaacaattatatccaagccacagacaagcggaaagccttagaggaaaccaaagcctatactactcagtccctagcttccgtagcatatcagataaacgccctggcgaataacgtgttacagctgctggacatccaggcgtctcaattaaggcgtatggaatcaagtatcaatcatatcagtcaaacagtggacatccataaagaaaaagtcgcccgcagagagatcggcatcttgactacaaataagaacacttcaaggacgcataaaataattgcgcctgccaacatggagcgccctgtcaggtacatccgcaaaccaatcgactacacagtattggatgacgttggacacggagtaaagcacggcaataatcagccagctcggacaggaaccctcagtaggaccaaccctcctacccagaaaccaccgtcacctccgatgagcggacgaggtaccctgggacgcaacaccccatataagactttggagcccgtcaagccaccaactgtgccaaacgactatatgacttccccggcccggctagggtcccagcattcacccggacgaacggccagccttaaccagcgacccaggacccactccgggagcagcgggggctcaggatccagggagaactcaggtagttctagtattggaatccctatcgcagtccccaccccttcaccgcctaccatcggcccagctcccggctctgctcctggctctcagtatggtacgatgacgaggcagatttccaggcacaactctacaaccagttccacgtcaagcgggggttacaggcgtacgccctccgtgactgcacaatttagcgcccagccccatgtgaacggcggtcccctttactctcagaactccattgccgacagccctacgcccccacccccccctcccccggatgatatcccaatgtttgatgatagccccccacctcccccgccgccaccggtggactatgaggatgaagaggcggcagttgttcagtataacgatccatacgcagacggggatccagcttgggcccctaagaattacattgagaaagtcgtggctatctacgactataccaaggacaaagacgacgagttgtcgtttatggaaggcgccattatctacgtcataaagaagaatgatgacgggtggtacgaaggagtgtgtaaccgcgtaaccggccttttccccggaaattatgtcgaaagcattatgcactacacggattag

SEQ ID NO: 106773 - DNA, 1356 bp, Artificial Sequence
  Description of Artificial Sequence: Synthetic coding sequence
atggccgagctgcagatgctactggaggaagaaattccctcaggaaaacgggcccttatcgaaagctaccagaatctaacacgcgtggctgactactgtgaaaacaattatatccaggcaacagacaaaagaaaggctctggaggagaccaaggcctatacaactcagagcttggcttccgtggcttatcagatcaacgccctagctaataacgtactgcagctgctggatatacaagcttcgcagctgcggcggatggaatcctccataaatcatatctcacagactgtagatattcacaaggaaaaagtggcgcgccgggagattggtattttgaccactaacaaaaacacttccagaacccataaaattatcgccccagcaaatatggagcgcccggtcagatatattaggaagccaatagattatacagttctggatgatgtgggacacggagtgaagtggttgaaggccaaacacgggaataatcagcccgcccgcactggcacattatcccggacaaacccgcctacccagaagcccccctccccccctatgagtggccgtgggacattaggacggaatacgccttacaagaccctggagccggtgaaacctcccactgtgcctaatgactatatgacttccccagcacgcctgggttcacaacactctcccgggagaacagctagtcttaaccaacgtccccggacccacagcggctcctcagggggctccggatcccgggagaacagcggtagctcttcaatcggcattccaattgcggtacctacccctagtccacccactattgggcccgcacctggcagcgcccctggaagccaatacggcacaatgacacgccagatttctagacataacagcaccacctccagcaccagttctggaggctacaggcggactccaagtgtgacagctcagttcagtgctcagccccacgtcaatggcggccctttgtacagccagaattcaattgctgacagccccaccccccccccccctccccctcctgacgacattccgatgttcgacgacagtccaccccccccccctcccccccccgtcgactatgaggacgaggaagccgctgtggtgcaatacaatgacccttacgcagacggcgatccagcttgggcgccgaaaaattacatcgagaaggttgttgctatttatgattatacgaaggataaggacgacgagctgtctttcatggaaggagctatcatctatgtgataaagaaaaatgatgatggctggtacgaaggggtgtgtaatcgcgtgaccgggttgttcccaggcaactatgtggagagtatcatgcactatactgactag

SEQ ID NO: 106774 - DNA, 990 bp, Artificial Sequence
  Description of Artificial Sequence: Synthetic coding sequence
atggcagagctacaaatgttgctggaggaagagatcccatctgggaagagagcacttatcgagtcctaccagaacctgaccagagttgctgattattgcgaaaacaattatatccaggcaactgacaagcggaaggctttggaggagaccaaagcttatactacccagagtctggcttccgttgcctaccagatcaatgccctcgctaataatgtgttgcagctccttgatatccaggctagtcagcttcgccgaatggagagctccatcaatcatatcagccagcacggaaataaccaaccagcaaggacagggactctttcacggacaaacccacctactcagaagcctccttcaccacccatgtcagggcggggaactcttggtaggaataccccctataagacccttgaacccgtgaagccacctaccgtacctaacgactacatgacctcgccagctcgattagggtcccagcactcaccaggacgaaccgcaagcctgaaccagaggcccaggactcattctggaagcagtggtggatccgggtccagagagaattcaggcagctcctccattggtatccccatcgctgtgccgaccccctcccctccaacaattggaccggttgcagactctccaacgccacccccaccaccccctcccgatgatatccccatgtttgacgacagccctccaccgcctcccccaccacctgtggactatgaagacgaggaagccgccgtcgtccagtacaacgatccctacgctgacggggatcccgcctgggcccctaaaaattatatcgagaaagtggtggcaatctacgactacactaaggacaaagacgacgagttgagttttatggaaggagccatcatatacgttatcaagaaaaatgatgacggttggtatgagggcgtctgcaatagagtgaccggtctgttcccaggtaactacgtcgagtcaatcatgcactacacagattag

SEQ ID NO: 106775 - DNA, 1185 bp, Artificial Sequence
  Description of Artificial Sequence: Synthetic coding sequence
atggccgagctacagatgcttctagaggaagaaatcccttcgggcaagagagcattaattgaatcctaccagaacctgactagggtcgctgactactgtgagaacaattatatacaggccaccgataagcgtaaagcacttgaggagactaaggcatatacgacacagagcttggcgtcagttgcctaccagataaacgccctcgcaaataacgttctgcaattacttgacatccaagcttcacaattgcgcagaatggagagcagcatcaatcatattagccagacagtggatatccataaggagaaagtggcaaggcgggagatagggatactgaccactaacaaaaatacctcgagaacccataagataatcgcaccagccaatatggaacgacccgtgcgttatatcaggaaacccatagattacactgtgctggacgacgtggggcacggtgtaaagaagtggcataaaattattcacggaaataaccagccagctcgcacaggtacactgagtagaacaaatccacccacccaaaagcccccatctcctcctatgagtggacgtggtaccttgggacggaatactccttacaaaacacttgagccagttaaaccaccgacagtgcccaacgattacatgacatcccctgctcggttagggtcccagcacagtcccggaaggaccgcctcccttaaccagcggccccgcacccattcgggaagttccggcggtagcgggtctagagagaactcaggctctagcagcattggaatccctatagcggtgcccacaccaagcccgcccaccatcggccctgtcgcagatagcccgactcctccacctccccccccacccgacgacatcccaatgttcgatgactccccccccccgccaccaccaccccccgtggattacgaggatgaggaggcagccgtagtccagtataatgacccctacgctgacggggacccagcgtgggcacctaagaactacatagaaaaggtggtcgcgatatacgactatacaaaagacaaagacgacgagctttcattcatggaaggtgccataatctacgtgattaagaaaaatgacgacgggtggtacgagggggtttgcaatcgagtgacgggcttgttcccgggcaactacgtcgaatctattatgcattacaccgattag

SEQ ID NO: 106776 - DNA, 3993 bp, Artificial Sequence
  Description of Artificial Sequence: Synthetic coding sequence
atgcctctctcccctcccgcccagggggaccctggagagccatcaccatgtaggccgcccaagaagcacaccactttccatctctggcgcagtaagaaaaaacaacaaccggcgccgcccgattgcggggtgtttgtgccccatccactccctgctcccgccggagaggctcgggctctggacgtggtggatggtaaatacgtggtgcgagatagccaggagttccctctgcactgcggggaatcacagttttttcatacaacttccgaggccctcggatcattgctgttagagtccgggatcttcaaaaaatcccgcgcccagccgcctgaagacaatcggcgtaaacctgttttggggaagttgggaaccttgtttactgctggccgcaggagaaacagtcggaatggcctggagtcccctacaaggagtaacgctaagcccctgtcccctaaagatgtggtcgcctctcccaaacttccagagagagaatctgagaggagtcggagtcagtcctcgcagctgaagcaaaccgatacctcggaggagggcagtcccagggagaacccgcgcgaagccgaaggcgagttgcccgagagcgggggccccgccgcgccaccggatgctgagctgtcccccaggtggtccagttcggcagccgccgttgcagtgcagcagtgtcacgagaacgattctcctcaactggaacccctagaggcggagggagagccatttccagacgccaccactaccgctaaacagttgcacagcagccctggcaacagcagtagacaggagaacgctgagactccagcccgatcacctggtgaagatgccagccccggcgctggacacgagcaggaggcctttctgggcgtgcgcggagccccagggagcccaacacaggagcgaccagcagggggcctgggtgaagcccccaatggcgcaccctcagtgtgtgcagaggaaggatccctcggtccccgcaatgccaggtcccagccaccaaaaggcgcatccgacctgcctggagaaccacccgccgagggagccgcccatactgcctctagcgcacaagccgattgcactgccaggccaaaaggacacgcccaccccgcaaaagtcttgacactggacatttacctgtccaaaaccgagggtgctcaagtggatgagcccgtcgttattacaccacgtgccgaagactgtggagactgggatgacatggagaaaagatcctctggccgccgctcaggtaggcggaggggcagtcagaagagcaccgacagtcccggagccgacgccgagttacctgaaagtgcggccagagacgatgcagtgtttgacgacgaggtggctccgaatgcagcttcggacaacgcttccgcggagaagaaagtcaaaagcccgagggccgccttggacgggggggttgcctccgccgctagccctgagtccaagccttcaccaggtaccaaaggacaattgcgaggggagagcgacagaagcaagcaaccccctcccgcctcttccccaactaaaagaaagggacggagcagggcgctggaggccgttcctgccccccccgccagcgggccacgggcacctgccaaggaatcaccaccaaaaagagtgcccgacccttctccggtgactaagggcaccgccgcggaatcgggcgaggaggccgcccgagcgattccacgcgaattgcccgttaagtcttcttctcttctgcctgaaatcaagcccgagcacaaacggggacctttgccaaaccacttcaacgggagggccgagggcgggagatctcgagagcttggccgagccgccggagcgcctggcgccagcgatgccgatggactgaaaccccgaaatcacttcggcgttggccggagtacagtgaccacgaaagtcaccctccctgcgaaacccaagcacgtggaactgaatctgaaaactccaaagaacctggattcactgggaaacgagcacaacccattctctcagcctgtgcacaaaggcaatacagccactaaaatctcactgttcgagaataagaggacgaacagctcaccccgtcatactgacatcagaggtcagcgaaatacaccggcaagctcaaagacgtttgttggaagagctaaacttaatctggcaaaaaaagccaaggagatggagcaaccggagaagaaggtgatgccaaactcaccacagaatggtgtactggtgaaggagacagcaatcgagacaaaggttacagtgtcagaagaggagattctcccagccactcgaggaatgaatggagattcctctgagaaccaagctctaggccctcaacccaatcaggacgacaaagccgatgtccagacggacgccggatgcctgtcagaaccagtggccagcgcccttattcctgtgaaggatcacaagcttttggaaaaggaggactccgaggccgccgacagcaagtccctcgtgttggagaacgttactgacaccgcccaggatatccctaccactgttgatactaaagacttgccgccaaccgccatgcctaagccgcaacacactttttccgatagccagtcccccgcagaatcatctcctggccctagcctgagcctttcggctcctgcccctggagatgtgccgaaggatacatgcgtgcagagcccgatttctagttttccatgcactgacttgaaagttagcgagaaccataagggctgtgtgttgcccgtcagtcggcaaaacaatgaaaaaatgccactcctggaactggggggcgagactacacccccactatcaacagagcggtctcccgaggctgtagggagtgaatgcccatcgagagtgctagttcaagtgcgctccttcgtgttgccagttgagtctacacaggacgtctcttcacaggttatccccgaatcttcggaggtcagggaagtgcagctccctacttgccattccaatgaacccgaggttgtttccgttgcctcgtgcgcacccccgcaagaggaggttctgggaaacgagcatagccactgcacggcagagctcgccgccaagtcagggccacaggtgatccccccagcctctgaaaaaactctccccattcaggcccagtcacagggatctagaacaccattgatggccgaatcctcccctaccaactctcctagttctggaaatcacctcgctacaccccagaggccagatcagaccgtgactaatggccaggacagccctgccagtttactgaacatctcagcaggcagtgacgatagtgttttcgattcatcctccgacatggagaagtttaccgaaattatcaagcaaatggatagcgctgtctgcatgcccatgaagcgcaagaaggcacgaatgcccaatagtcccgcgccccattttgctatgccacctattcacgaggaccacctggagaaagtctttgatcctaaggtgttcacctttggacttggtaagaagaaagagtcacaacccgaaatgtcgcccgcacttcatttaatgcagaatttagataccaagtcaaagttaaggcctaaacgtgcaagtgccgaacaatccgtcttatttaagagtctccacacaaatacgaatggcaatagcgaaccactggtgatgccagaaattaatgataaggaaaatcgtgatgtcactaatggtggaatcaaacggagcagactggagaaaagcgcactgttttcttccctgctgtcctcactaccacaggataagatcttcagtccatccgtgacatccgtgaatacaatgacaactgctttcagcacgtcacaaaatgggagcctaagccaatcctctgtcagccaacctactaccgaaggcgcgcccccgtgtggacttaataaggagcagagcaacctgctccccgacaacagcctgaaagtgtttaatttcaactcctcgtccacgagtcactcttccctgaagagcccctcacatatgtag

SEQ ID NO: 106777 - DNA, 5172 bp, Artificial Sequence
  Description of Artificial Sequence: Synthetic coding sequence
atggagaaacgcagctctgggagaagatccggcagaagacgggggagccaaaaaagtacagatagccccggcgctgatgctgaattgccagagagcgccgctcgcgacgacgcagtcttcgacgatgaggtggctcccaacgctgcatctgataacgccagtgctgagaaaaaagttaaatctccaagggccgctctggatggcggcgttgcaagcgccgcatctccggagagcaaaccatctccaggcacgaagggccaattacggggtgaatctgacaggtctaaacagccaccccctgcaagttcacccactaaaaggaagggccgctcccgagccctggaggctgttccagccccccccgccagtgggcctagggctccagcgaaagaatcccctcctaagagggttcctgacccttcccccgtgacgaagggaacggctgcagagagtggagaggaagcagcaagagctatcccaagagagcttccagtcaagtcttcgtccctgctacccgagatcaaacctgagcataagagaggtcccctccccaatcactttaatgggcgagcggaaggtggcagatcacgcgaattaggcagagcggcgggagctcccggcgcatctgacgccgatggactgaaacctaggaaccatttcggagtcgggcggagcacggtaactaccaaggtcaccctccccgctaagccaaagcatgtggagctcaatttaaagacacccaagaatttagattcattgggcaatgaacacaatcccttttcccagcccgtgcataagggaaatactgcaaccaagattagcctcttcgaaaacaagcggaccaatagcagtcctcgccatacagacattcggggccagagaaacacacccgcctccagcaaaaccttcgttggcagggctaagctgaatctggctaaaaaagctaaggaaatggagcagccggagaaaaaggtgatgccgaattcgcctcagaatggtgtgctggttaaggagacggcaatcgaaaccaaggttacagtgagtgaggaagagattttaccagctaccaggggtatgaacggcgactctagcgaaaatcaggctttgggacctcaacccaaccaagacgacaaagccgatgttcaaaccgatgctggctgtctctctgagcctgtggccagcgcactaatccccgtgaaagatcacaagcttctcgagaaggaggattcagaagccgcagattccaaatcactggtcctggagaatgtcacggacacggctcaggatattccaacaacagtggatactaaagacctcccccccaccgcgatgcccaagcctcaacacactttctccgactcacaaagtccagctgagtcttccccaggtccgtcgcttagtctgagcgcccctgcccctggcgacgtaccgaaggacacctgtgtgcaaagccccataagctccttcccatgcactgacctgaaagtttctgaaaatcacaaaggatgtgtcctgcccgtgtcacgtcagaacaatgaaaaaatgccccttctggagcttggaggtgagactactccaccactgtccactgagcgttcgcctgaggctgttggatcagagtgcccatctagggtcctggttcaggtgcgcagttttgtccttccggtcgaatctacccaggacgtctcatcacaggtgatacccgagtcatcagaggtgcgcgaggtccagctgccaacgtgccattcaaatgagcctgaggtcgtgtcagttgccagttgcgcccccccccaggaagaagtgttggggaacgagcattcacattgcaccgcagagttggcagccaagtccgggcctcaggtgatcccgccagcctcggaaaaaaccctacctatccaagcgcagtcacaaggtagccggactccattgatggccgaatcttctccaaccaactcaccttcttcaggcaaccacctcgctaccccccaaagaccggatcaaactgtcaccaatggtcaggacagcccagctagcctgctgaatatttcagccggatcagacgactcagtctttgacagctcttctgatatggagaaatttacggaaattatcaaacaaatggattctgccgtctgcatgccaatgaagcggaagaaagctcgcatgcccaacagcccagcaccacattttgctatgccccctatccacgaagaccatcttgagaaggtgttcgaccccaaagtctttacatttggcttggggaagaagaaggaatcccagcctgaaatgtcccctgccctgcaccttatgcagaacctggacacaaaaagcaagctccgccccaaacgtgcatccgcggaacagagtgtgctcttcaaatccttgcataccaatactaacggtaatagtgagcccttagtgatgcccgagatcaatgataaggagaatcgtgacgtcactaacggaggaatcaagcgctctcgactcgaaaagtccgcccttttcagcagcctcctgtcaagccttccgcaagataagatattctcaccgagcgtaacctccgtgaacaccatgactactgcatttagcaccagtcaaaatggctccctgtctcagtcctcagtctcccagcctacaacggaaggagcccccccgtgcggcttgaataaggagcagtccaacctgctaccagataactctctcaaggtctttaattttaattcatcttcaaccagtcattcctccctgaaaagtccgtctcacatggaaaagtatcctcagaaggagaagactaaagaagacctcgattcacggtcaaaccttcatcttccagaaaccaaattttccgagctgtcgaagctcaagaatgatgacatggaaaaggctaatcacatcgagagcgttattaagagcaaccttcccaactgcgcaaactcagacacagacttcatggggcttttcaagtcgtctcgttatgacccctcgatcagctttagcgggatgagtctctccgacaccatgacactaagaggatctgtgcaaaacaaactgaatccccgtcccggcaaggtagttatttacagcgagccagatgtgtccgaaaaatgcatcgaagtgttcagtgacattcaagattgctcaagctggtccctgagtcccgtaattctcataaaggtagtgaggggttgctggatactttatgaacagcctaattttgagggccattccattcctctggaagagggggaactcgaattgagtgggctgtggggaatagaagatatcctggaaaggcatgaggaggctgagtcagataagcccgtggttatcgggagtattcgccacgtcgtccaagactaccgggtctcacatatcgatctgttcaccgaaccagagggactaggaatactgagcagctacttcgatgataccgaagaaatgcaggggttcggagtaatgcagaagacctgctctatgaaagttcactgggggacctggttgatatatgaagaaccaggattccagggagtccccttcatcctagaacccggggagtaccctgacctgtcattttgggacactgaagaggcctatattggcagcatgcggccgctgaagatgggtggtcggaaagtcgaatttccaaccgacccaaaggtagtagtttacgagaaacctttttttgaggggaagtgtgtggaactcgaaacgggaatgtgctccttcgtgatggagggcggcgagacagaagaggctactggcgatgatcacttgccctttacttccgtgggatcgatgaaggtattacgtggaatctgggtggcgtatgaaaaaccaggcttcaccggtcaccaatatctgcttgaagagggggagtatcgagattggaaggcctggggaggatacaatggagagctgcagtccctcagacccatcctaggcgacttctcaaatgcgcatatgattatgtactccgaaaaaaactttggcagtaaagggtcctccattgatgtgctgggtattgtcgctaacttgaaggagactggttatggcgtgaaaactcaaagtatcaacgtcctaagcggtgtctgggtggcttacgaaaaccccgatttcaccggagagcaatatatccttgacaaaggcttctacacgtcttttgaggattggggcggcaaaaattgcaaaatctccagcgtgcagccgatctgcttggactcattcacgggcccccgcagacgcaaccagatccacctattctccgaacctcagtttcagggccatagccaaagcttcgaagaaactacatctcagatcgacgacagcttctcgactaaatcatgccgcgtgtccggtggcagctgggtggtgtatgacggcgagaacttcaccggaaaccaatacgtgttggaggagggtcattatccatgcttgtcagcgatgggatgcccacctggtgccacatttaaaagcctcaggtttatcgatgttgagttctctgaacccactatcatcttgttcgagcgggaagactttaaagggaaaaagattgagctcaacgctgagactgtgaaccttcggtcactggggtttaacacacagatccgatcagtccaggtgatagggggcatttgggtgacttacgagtatgggtcttacagaggccgacagtttctgctctccccagccgaagtgcccaattggtacgagttctccggttgtcggcagattggcagtcttcggccttttgtccagaagagaatctactttaggttgagaaacaaagccacaggtctgttcatgtctaccaatggcaatttggaggacttaaagctgttgcgtattcaggtgatggaagacgtaggcgccgacgaccagatatggatttaccaggagggttgcattaaatgtagaattgccgaagattgctgcttgacaatcgtcgggtccctggtgactagcggcagcaagctcggtctagccctggatcagaacgctgacagccagttctggtcgctgaaatctgatggcaggatttacagtaagttaaagccaaatctggttctagacataaaaggaggaactcaatacgaccaaaaccacattattttaaatacagtttccaaagagaagttcactcaagtctgggaagccatggtattgtatacatag

SEQ ID NO: 106778 - DNA, 951 bp, Artificial Sequence
  Description of Artificial Sequence: Synthetic coding sequence
atgcagaaacccaagaccgtggcatgggagaacctcggccccgagatgtcagcgcttggtacggcgttcagccgggagggcgggagaaaggtggagtttcctactgatcccaaggtggtggtctatgagaagccttttttcgagggaaaatgcgttgaactcgagacggggatgtgcagcttcgtgatggaagggggagagaccgaagaagcaacaggcgatgatcacctgcctttcacatccgtcggttctatgaaagtgctgaggggaatttgggtggcctacgagaaaccagggttcaccggccatcagtacctgctcgaagagggcgaatatcgagactggaaggcgtggggcgggtataacggagagttacagagcctgaggcccatcctgggcgatttcagcaatgcacatatgattatgtactccgagaaaaacttcgggtccaagggaagcagtattgacgtcctgggaatcgtagctaatctgaaagaaacaggttatggggtgaaaacccaaagcattaacgtactgagcggggtgtgggtggcctatgagaaccccgactttacaggggaacagtacatcctcgataagggcttttatacaagtttcgaagactggggaggcaaaaattgcaagatttctagcgtccaaccaatttgcttggactcgttcaccgggccccgacgtcgtaatcagattcacctgttctctgagcctcagtttcagggccacagtcagagctttgaggagactaccagtcaaattgatgacagcttctccacgaagtcctgcagagtaagcggcggcagctgggtggtgtatgacggagagaattttactggcaatcagtacgtgttagaggaagggcactatccatgtctcagtgcgatggggtgtcccccaggggccaccttcaagagcctgcggtttattgatgtgtag

SEQ ID NO: 106779 - DNA, 1629 bp, Artificial Sequence
  Description of Artificial Sequence: Synthetic coding sequence
atgcaaaaacccaaaacagtggcatgggagaacttgggtcccgaaatgtctgctctaggcactgccttttcacgcgaaggcggacgcaaagttgaatttcccaccgaccctaaagttgttgtttacgaaaagcctttctttgagggaaaatgtgtggaactcgagaccgggatgtgctctttcgtgatggaaggaggtgagacagaggaagcgacaggcgacgaccaccttcccttcacttcagtcggaagcatgaaggtgctgcgggggatctgggttgcttacgagaagccgggcttcacaggccatcagtacctgctcgaagagggggaataccgggactggaaagcctggggcggatataatggcgaattacagagccttcgcccgattctgggagacttcagtaatgcccatatgattatgtatagcgaaaaaaatttcggaagtaagggttcaagtattgacgtgttgggcatcgtggcaaatctgaaggaaacaggttatggcgtgaaaacacagagtattaacgttctgtccggggtgtgggtggcctacgagaatccagattttaccggcgagcaatatattctggataaagggttctatacttctttcgaggattgggggggcaaaaactgcaagatctctagcgtgcaacccatctgtttagattcatttaccggacccaggcgcaggaatcagattcacttgttttccgaaccccaatttcagggacatagtcaatcctttgaagagactacaagccagatagatgactcatttagtaccaaatcatgtcgggtgagcgggggctcttgggttgtctatgatggagagaacttcactggcaatcagtacgtcctggaagaagggcactatccctgcctgtctgctatgggctgccctcctggggcaaccttcaagtccctgagattcattgatgtagagtttagcgaacccactataatcctgtttgaaagggaggattttaaaggaaagaaaatcgaactgaatgcagagactgtcaatttaaggagtttaggtttcaacacacagattcgcagtgttcaggtgattgggggtatatgggtcacctacgagtacggaagttacagggggcggcaattcctcctgtcccctgccgaagtgccaaattggtatgagtttagcggctgccgtcagattgggtccctgaggccattcgttcagaagaggatatatttccgtttaagaaataaggcaactggactgttcatgtctacaaatggcaacctggaagacctcaagttgttaaggatccaggtcatggaagacgtgggagcagacgatcagatctggatttatcaggaggggtgtattaaatgtagaatagctgaggattgttgtcttacaattgttggcagcctggtaactagcgggagtaagcttggcttagctctcgatcagaacgcagacagccagttctggagcctgaagagcgacggtagaatctatagtaagctaaagcccaatctggttctggatatcaaaggcgggacccagtacgatcagaatcatataatattgaataccgtcagcaaggaaaagttcacccaggtgtgggaagctatggtgctgtacacctag

SEQ ID NO: 106780 - DNA, 504 bp, Artificial Sequence
  Description of Artificial Sequence: Synthetic coding sequence
atggttgcccagcaagagagtatccgagaaggttttcagaagcgatgtttaccggtcatggtgctgaaagcaaagaagccctttactttcgaaacgcaggagggcaaacaggaaatgtttcacgccacggtagctacagagaaggaatttttcttcgtgaaagtcttcaacaccctgttgaaagacaaattcatccctaagcgcatcatcattattgccagatactatcgtcattcaggatttcttgaagtgaatagtgcttcccgggtgctggatgccgaatctgatcaaaaagtgaatgtgccattgaacatcatccggaaagcaggggaaacacccaaaatcaacactctccagacacaaccattaggcacaatcgtcaacggactttttgtggtccagaaggtgactgagaagaagaaaaatatcctgtttgacctcagtgataacacaggcaagatggaggtgctcggtgttcgtaacgaggacacaatgaagtgctag

SEQ ID NO: 106781 - DNA, 1032 bp, Artificial Sequence
  Description of Artificial Sequence: Synthetic coding sequence
atggaatcaaaatataaggagattctccttctgaccggacttgataatattacagatgaggagttggacaggttcaaattttttctctccgatgagttcaatatcgcaactgggaagcttcatacagccaatcgtatccaggttgccactctgatgatacagaatgcaggtgccgtttctgcagtgatgaagactatacgcatcttccagaaacttaactacatgctgctggcaaaacgcttacaggaggagaaggaaaaagtcgacaaacagtacaaatcggtgaccaaacctaagccgctttcccaagcagagatgagccccgcggcctctgctgccattcggaatgatgtggccaaacaaagagctgcccctaaagttagtccccacgtaaagcccgagcagaagcagatggtcgcgcaacaagaaagcattcgggagggcttccagaagcgttgccttccagtgatggtcctcaaagctaaaaaacctttcacctttgagactcaagagggcaagcaagagatgttccacgccaccgtggccactgagaaggagttcttctttgtcaaggtgtttaacacattgctcaaagataagttcatccctaaaaggatcattatcatcgcacgctactacagacatagcgggttcctcgaggtgaacagcgcgagccgcgtgttggatgccgagtcagatcagaaggtaaatgtgcccctcaacattattcgaaaggcaggagaaacgcctaaaatcaatactttgcagacccagccactagggacgattgtcaacggccttttcgtcgtgcagaaagtcactgaaaaaaaaaagaatattctgttcgatctttcggataacactggaaaaatggaggtgttgggtgtgcggaacgaggatactatgaaatgtaaggagggcgacaaagtgcgtctgacctttttcaccctgagcaaaaatggggagaagttgcagttgacctctggcgtccactcaacgattaaagttattaaggccaagaaaaaaacttag

SEQ ID NO: 106782 - DNA, 411 bp, Artificial Sequence
  Description of Artificial Sequence: Synthetic coding sequence
atggagagtaaatataaagagattctgctgctcaccgggttggataatattaccgacgaggagctcgatcggtttaaatttttcctgtccgacgaattcaacatagccactggaaagctccatacagctaaccggatccaggtggcgacccttatgatccaaaacgcaggtgccgtcagtgcagtgatgaagaccattcggatcttccaaaaactcaattacatgctgttggctaagcggctgcaggaagagaaggagaaagtggacaaacagtataaatctgtgacaaagccaaagccattgagccaggctgagatgtccccagcggcaagtgctgcaataagaaacgacgtcgccaagcagcgtgctgcgccaaaggtgtctccccacgtaaaaccggagcagaaatag

SEQ ID NO: 106783 - DNA, 1800 bp, Artificial Sequence
  Description of Artificial Sequence: Synthetic coding sequence
atgtctaaggaagagcgtcccgggagggaagagatccttgagtgtcaggtcatgtgggaacctgacagcaaaaagaacacccaaatggatcggtttcgggcagctgtgggggccgcgtgcggtttagccctcgaatcttacgatgatctctaccactggagtgtggagtcctatagcgacttctgggccgagttctggaaattcagcggtattgtgttttctcgcgtctatgacgaagtcgtggatacatcaaagggaattgcagatgtgcccgagtggttcaaaggctcccgcctgaactatgccgaaaatctgctgagacacaaggaaaacgaccgagtggctctgtacattgcccgtgaggggaaggaggagatcgtgaaagtgacttttgaggaactgcgacaggaggtggccctgttcgccgccgctatgagaaagatgggggtgaaaaagggagatagagtggtgggttatcttcctaatagcgagcacgctgttgaagccatgttggccgccgcctctattggtgctatctggtcgtcaacgtcacccgactttggcgtcaatggtgtgttagatcgcttcagccagatccagccaaaactgattttttccgtggaggctgtggtgtataatggtaaagaacacaaccatatggagaaacttcagcaggttgtgaaaggtcttccggacttaaaaaaagtcgtggtgatcccttatgttagttcaagggagaacattgacttgagtaagatccccaattcagtatttcttgatgacttcttggcaactggcaccagtgaacaggctcctcagttagaattcgagcagctcccgttttcacaccccctgttcataatgttttccagcgggaccaccggcgctcctaaatgtatggtgcactctgcggggggaaccttgatccaacatcttaaggagcatctgcttcacggaaacatgaccagttccgacatattattatgttacaccacagtaggctggatgatgtggaactggatggtgagcctgttagcaacaggcgccgccatggtattatacgatgggtcacccttggtgcccactcccaacgttctatgggacttagtcgaccgtattggaattactgtacttgtgacaggcgccaagtggctgagcgtactggaggagaaggctatgaagcccgtcgagacgcactccctgcagatgctgcacaccattctgtctaccggcagccctttaaaggcccaatcttatgagtacgtttatcgttgtatcaagagttctattctccttggctcgatcagcggggggacagatattatctcctgtttcatgggccataactttagcctgcctgtatacaagggagagatccaggctaggaacctaggaatggccgtggaggcttggaatgaagaggggaaagcggtgtggggcgagagcggcgaactggtgtgcaccaagcccattccatgtcaaccaacccacttctggaacgacgagaacggtaataagtaccggaaggcgtatttctccaagttccccggtatatgggcacacggagactattgcaggattaaccctaagaccggtggcatcgttatgctaggccggagcgacggcactcttaatcccaatggggtccgcttcggctcatcagaaatctataatattgtctatgcacagagacaagaatcagggtcttgtcgccagacggaccacaggtggaagagccgaggtgccaggaggtgtttcttggagccccgggatccaggctcggtgcccggccacccctag

SEQ ID NO: 106784 - DNA, 2019 bp, Artificial Sequence
  Description of Artificial Sequence: Synthetic coding sequence
atgagcaaggaggagcgccccggtagggaggagatcctagagtgtcaagttatgtgggagcctgactctaagaagaacactcagatggataggttcagagctgctgttggggctgcttgtggcctcgcattggagtcctatgatgacctctatcactggtccgtggaaagctattctgacttttgggccgagttttggaagttctccgggatagttttctcccgtgtgtatgacgaggtcgttgatactagcaaaggtatcgccgatgtgcccgagtggtttaagggctctaggctcaattacgctgaaaatctactacggcacaaggagaacgacagagtggccttatacatcgccagggagggaaaggaggaaattgtgaaggttacttttgaagagctgcggcaggaagtagctttgtttgcagccgcaatgcggaaaatgggggttaaaaagggtgatagggttgtcggctacctccccaatagcgagcatgcagttgaagccatgctggcagcagcgtccattggggccatttggtccagcacctcccccgactttggcgtgaacggggtacttgaccgcttcagccagattcaacctaagttgatattctctgtggaagctgtcgtatacaacggcaaggaacataaccatatggagaagctgcaacaggtagtcaaaggactcccagatctcaagaaagtcgtggtgatcccttatgtctcatcccgggaaaacattgacttatccaagatccctaattccgtgtttcttgacgacttcctggccaccgggactagtgaacaagcaccccagctggagttcgaacagctgccgttctcccaccccctgttcatcatgttttccagtgggaccacaggcgccccgaagtgcatggtgcatagcgccggcggaacgctcatccagcacctgaaagaacatctcttgcacggcaacatgacgtcatcagacatcttactgtgttataccactgtcggatggatgatgtggaattggatggtgagcctgcttgcaacgggagccgcgatggtgctgtatgacggatcaccactggtaccgacaccaaacgtcctgtgggacctggtggataggataggcatcactgttctagtgacaggggcgaaatggctgagcgtacttgaggaaaaggctatgaagcccgtggaaacccatagcctgcaaatgctgcacaccatcttgtcaacaggttctccacttaaggcacagtcctacgaatacgtttaccggtgcattaaatcttctatcctgctcgggagtatcagcggtggcacagacatcatttcttgctttatgggacacaacttttccctaccagtctacaaaggtgagatccaggccagaaacctgggaatggccgtcgaagcatggaacgaggagggcaaagccgtgtggggggagagcggtgaactggtgtgcactaaaccgattccctgtcagccaactcacttttggaacgacgaaaatggcaataaatacagaaaggcctacttctctaagttcccaggaatttgggcacacggagattactgtagaataaaccctaaaacaggagggattgtcatgcttgggcgctccgacggcacactgaatcccaacggggttcggttcggatccagcgagatctataatattgtggagtccttcgaggaggtggaggactccctatgtgtgcctcagtacaacaaatacagggaggagagagtcatcctgtttctcaagatggcctctgggcacgctttccagccagacctcgtgaagcgcatccgtgatgccatccggatgggactgtcagccagacacgtgccttccctgattttggagaccaagggcatcccttacactttgaacggaaagaaagtggaggtcgccgttaaacagatcattgccggaaaagctgtcgagcagggaggagcattttccaatccggagacactagatctgtacagagatatcccggagctgcaaggattttag

SEQ ID NO: 106785 - DNA, 762 bp, Artificial Sequence
  Description of Artificial Sequence: Synthetic coding sequence
atgagaaagatgggcgtgaaaaaaggggatagggtggtgggctatctccctaatagcgagcacgccgtcgaggccatgcttgcagcagctagtattggcgccatctggtccagtactagtccggactttggtgtcaacggagtgctggatcggttctcgcagattcagcccaaattgatcttcagtgtcgaagcggtggtctataatgggaaggagcacaaccatatggagaaactgcagcaggttgtaaagggccttccagatttaaagaaggtcgtagtcataccctacgtgtcttccagggagaacattgacctctcaaaaatcccgaattctgtgttcctggacgacttcctggccacagggacaagcgagcaggccccccaactggagttcgaacagttgccattttctcacccgctctttatcatgttctctagcggcaccaccggggcccctaagtgtatggtacatagtgccggagggacgctcatccagcatctgaaagagcacctgctgcacggaaatatgacaagcagcgatatactgctgtgttataccaccgttggatggatgatgtggaactggatggtgtccctccttgccaccggcgcagccatggttctttatgacggcagccctctcgtgcctacccccaacgtcctgtgggaccttgtagaccgaataggatatctgggctcatggaggttactgcagaatcagccccaagacagagggcaccgccatgcctggccagagtag

SEQ ID NO: 106786 - DNA, 1845 bp, Artificial Sequence
  Description of Artificial Sequence: Synthetic coding sequence
atgcggcctcctcaatgtctactgcacacaccaagcctggcctctccactgctcctgctcttattgtggctcctgggcggcggtgtgggtgctgaagggcgggaggacgccgaactcctcgtgaccgttagaggaggtagactgcgcggtattcggctcaagactcccggggggcccgtcagcgccttcttggggatacccttcgccgagccccccatgggaccccgacgctttctgccgcctgaaccaaagcagccttggagtggtgtggtagatgccaccactttccagtcagtatgttatcagtatgtcgacactttgtatcccggctttgaaggcactgaaatgtggaacccaaaccgagaactctcagaagactgcttgtatctgaacgtttggaccccatatccacggccgaccagtcctacaccggtcttggtgtggatctacggagggggcttctattctggcgcttcgtccttggacgtttacgatggacgatttctagtccaggccgagaggactgtattagtgtccatgaattacagggtgggcgccttcggcttcctggccctgcccggcagccgcgaagcccctggaaacgtcggtcttctggaccaacggctcgccctgcagtgggtgcaggaaaacgtcgcagcttttgggggtgatccgacaagcgtcacgctgtttggtgaatcggccggcgctgcttctgtcggaatgcacttgttgtcccctccaagtcgcgggctttttcacagagccgttctgcaatcgggtgcaccaaatggcccgtgggcaacagtgggaatgggcgaagcacgtcgacgggcaactcagcttgcccatctagtgggttgtccacccgggggtacggggggcaacgatacggaactggtagcctgcttgagaactcgccctgcacaagttctggtgaaccacgaatggcacgtactaccccaggaatccgtcttccggtttagctttgtgccagtcgtggacggggacttcttgagtgacacccctgaggccttgatcaacgcaggcgatttccacggtctgcaggtgcttgtaggcgtggttaaggatgaaggcagctacttcctggtctatggcgcgcccggattctcaaaggacaacgaaagcttgatcagtagggccgagttcctcgccggagtgcgagtcggcgtcccacaggtgagcgaccttgccgcagaggctgtggtcctacactatactgattggctgcaccccgaggaccccgcacgcctgagagaagccctgagtgacgtggtgggggaccacaacgtagtttgccctgttgcccaactggcgggtcggctcgccgctcaaggagccagagtgtacgcatacgtcttcgagcatagggcttccaccttatcgtggcctttgtggatgggcgtgcctcacggttacgagattgaattcatctttgggattccactggatccgagccgcaattatactgctgaggagaaaatattcgcccaacggcttatgaggtactgggcgaactttgctcgcacaggcgaccctaacgaaccccgcgatcctaaagccccacagtggcctccctatacagcaggggcccagcagtacgtctccctggacctgagaccattagaggtccgaagagggctgcgcgcccaggcctgcgccttttggaaccgtttcctgcctaagctcttgtcagctactgacacgctcgacgaagcggagcgacaatggaaagccgaatttcatagatggagctcatacatggtgcactggaagaaccaatttgatcattacagcaagcaagatcggtgttctgacctctag

SEQ ID NO: 106787 - DNA, 1854 bp, Artificial Sequence
  Description of Artificial Sequence: Synthetic coding sequence
atgagacccccacaatgcttactgcatactcccagcttagcctcaccattgttgcttctcctgttatggctcctgggcggtggtgtgggtgccgaaggacgcgaagacgccgagttgttagtgaccgtgcgcggtggccggcttagggggattcgcctgaagacacctggtggccctgtgtccgcctttctgggtattccctttgcagaacccccaatggggccccgcaggttcctccctcccgaacccaagcagccgtggagtggagttgtcgacgccactacattccagtctgtgtgttatcagtacgtggacaccctgtatccaggctttgaggggactgagatgtggaacccaaaccgagaactctctgaggactgcttgtacttgaacgtttggacgccctaccccaggcccaccagcccgacacccgtactcgtttggatctacggtggaggattctacagcggcgcctcctctctggatgtttatgacggacggtttctggtgcaggccgaacggaccgtcttggtgagtatgaattatcgcgtcggagctttcggttttctcgccttgccaggctctagggaggcgcctggcaacgtaggcttactggatcagaggctcgccctacagtgggtgcaggagaatgtagcggccttcggaggcgaccccacctctgtcacactgttcggagaatcggccggggctgcttcagtagggatgcaccttttgtcacctccaagccggggactgtttcaccgagccgtgctgcagtcaggggcgcctaacggcccatgggccaccgtgggaatgggcgaggctagaaggcgagccacccagctagcacacctagtgggatgtcccccaggtggcaccggcgggaatgacacggaattggtcgcctgcctgcgaactaggcctgcacaggtactagtgaatcacgagtggcacgtcctgccacaggaaagtgtgtttcggttttcatttgtgcccgtggtagatggggactttctctctgacacgcctgaagccctcatcaacgcgggagatttccacgggctgcaggttctggtgggagtagtcaaggacgaggggtcttacttcctcgtgtacggtgctcccggattttctaaagacaacgagagtctgatttctcgggccgaattcctcgccggtgttagagtcggcgtccctcaagtgtccgacctggcagcagaagcggtggtgctgcattatacagattggttgcatcccgaggacccagctcgccttagggaggcattgtccgatgttgtaggagaccacaacgtggtgtgcccagtggcccaactcgcgggcagactggccgctcagggcgctcgcgtgtatgcttacgtattcgagcatagggcctccaccttgtcatggccattgtggatgggtgttccccatggctacgagatcgagttcatatttgggatcccccttgacccttcccggaattatacagctgaggagaagattttcgcacagcggctgatgcgttattgggccaactttgcacgaaccggtgatcctaacgagcctagggaccctaaggctccacagtggccaccttatacagccggggctcagcagtatgtgagcctggatctgcgaccactcgaagtgcgcagagggctgcgcgctcaggcctgcgcattttggaacaggttcctgcctaaactgttgtctgcgacagccagcgaggcccctagtacatgtcctggattcacccatggagaagccgcccccagacccggtctccccctgccactgctgttactgcaccagctgctcttactatttttgagccacttgcgtagactatag

SEQ ID NO: 106788 - DNA, 1854 bp, Artificial Sequence
  Description of Artificial Sequence: Synthetic coding sequence
atgaggcccccacagtgtctgctgcacacgccttcgctggctagtccgctgcttctactgcttctgtggttgctcggtgggggagtaggagctgagggccgcgaagacgcagaactgcttgtgacagtccgtggcggtcggctgaggggtattaggctaaaaacacccggcggtcccgtgagtgcctttttaggtatcccattcgctgagccgcccatgggcccaaggaggtttctccccccagagcccaagcagccttggtccggtgtcgttgacgccaccaccttccagtccgtctgctatcagtatgtggacacattgtatcctggctttgagggcactgaaatgtggaatcctaacagagaactgtctgaggattgcctctacctcaacgtatggacaccatatccacggccaacctcaccgactcccgtgctggtctggatttatgggggtggtttctactctggcgcctcttcactagacgtgtacgatggaaggtttttggttcaggctgagaggaccgtgctggtgagtatgaactaccgggttggggcgtttggctttctggcactgcccggaagccgcgaggcacccggcaacgtcggactactggaccagcgcctggctctgcagtgggtgcaggagaacgtagccgccttcgggggggaccctactagcgtaactctctttggcgaatcagcaggcgccgccagcgtcggaatgcacctattaagccccccaagccgtggcctatttcaccgggccgtgctgcagagtggcgctcctaacggaccgtgggcaacagtaggaatgggggaagccagaaggagggccacacagctcgcccacctggttggttgtcccccaggtggcactggcgggaacgatacagaactggtggcttgcctgaggacacgccctgcccaggtgttggtaaatcacgaatggcatgtcctccctcaggaaagcgtgttcagattcagcttcgttcctgttgtagacggtgatttcctgtcagacacaccagaagcattaatcaacgcgggcgatttccacgggttgcaggttctggtgggggtagtcaaggacgagggaagttacttcctcgtgtatggcgccccaggcttctcgaaggataacgagtcgcttatttccagggccgagtttcttgccggcgtacgcgttggagtgcctcaggtgagtgacctggcagcggaggccgtagtcctgcactacactgactggctgcacccagaggatccggcccggctgcgtgaagcactgtccgacgtcgtaggtgaccataatgttgtctgtcctgtggcccaactagccggtcgtttggccgctcagggcgcacgcgtctatgcttacgtgttcgaacacagagcttctacactgtcatggccactgtggatgggggtcccccacggctacgagatcgagttcattttcggcatcccgctcgatccttctcggaactatacagccgaggagaagatttttgctcagcggttaatgaggtactgggcgaatttcgctcggacaggagatcctaacgagccaagagacccaaaggccccccaatggcccccttacactgcaggggcccaacagtatgtcagtttggatctccgcccactggaggtgcgtaggggtttacgggcgcaggcttgtgccttttggaatcgattcctgcccaagcttctttcggctacagcatccgaggcccccagcacgtgtcctgggtttacacatggtgaggccgccccaagaccaggtctcccgctgccattactgctgctacaccaactcctactgttatttctgagccacctcaggaggctgtag

SEQ ID NO: 106789 - DNA, 1845 bp, Artificial Sequence
  Description of Artificial Sequence: Synthetic coding sequence
atgagacccccccagtgtctgctgcacacaccatctttagcatcccccttactcttgctactgctttggcttctggggggcggagtgggagccgaagggagagaggacgccgagttgctagtgaccgttcgcggggggcgtctccggggcataagacttaagactcccggtggccccgtctcagcgttcctcgggatcccctttgccgagccacctatgggacccaggcgcttcctcccgcccgagcctaagcaaccatggtcgggggtagtggatgccacgacttttcaaagcgtgtgctaccaatatgtagatactctgtatcccggattcgaagggacggagatgtggaacccgaacagagaacttagtgaggactgtctgtacctgaacgtctggactccttaccctagaccaaccagtccgacacccgttctggtgtggatctacgggggcggattttacagcggagcctctagtctggatgtctatgatggtagattcctggtgcaagccgaaagaaccgtcctggtttccatgaattacagagtcggcgctttcggcttcctcgctttgcctgggtccagggaggcccccggcaatgtgggtctgctggaccagcgactggcgctgcagtgggtgcaggagaacgtggccgccttcggcggcgatccaacttctgtcaccctgttcggagaatcagccggggccgcctctgttggtatgcatctcctgtctcccccgtcccgtggcctattccatcgcgcagtcttacagagtggcgcacccaatgggccttgggctactgtgggaatgggggaagcgcgccgtcgggcaacacaactggcccacctggtgggatgcccgccgggtgggaccggcggcaatgacactgaattggtcgcctgcctcaggactagacctgcccaagttctggttaatcacgaatggcatgtgcttccacaagaaagtgtgtttagattcagcttcgtacccgtcgtggatggagatttcctgtccgatacaccagaggctctgatcaacgctggcgactttcacgggctgcaggtgcttgtgggggttgtgaaagatgagggtagttatttcctcgtgtatggggctccaggcttcagcaaggataatgagtctttgatcagccgggcagagttcttggcaggggtaagggtgggcgtaccacaggtatccgatttagcagctgaagccgtggtgctgcactacaccgactggctacaccccgaagatcccgccaggttgagagaagcactgagcgatgtcgttggtgaccataatgttgtttgccccgtggcacaactggctggtcgcctagccgcacaaggtgcccgagtctatgcctatgtgttcgagcaccgggctagcaccctgtcatggcccctctggatgggagtcccccacggatatgaaattgaattcatcttcgggattccactggatccctctagaaattatacggccgaagaaaagatcttcgcccagcgcctgatgcggtactgggctaatttcgctcgaacaggagacccaaacgagccacgcgacccgaaagccccccaatggccaccgtacaccgctggagcgcaacagtacgtctcactggatctgcgacccctcgaggtcaggagaggactgagggcgcaggcttgcgccttctggaaccggtttctgccgaagcttctcagtgcaacggacacactggatgaagctgagaggcaatggaaagccgaattccataggtggtcctcttacatggtgcactggaagaaccagttcgatcactatagcaagcaggacaggtgctctgacttgtag

SEQ ID NO: 106790 - DNA, 1581 bp, Artificial Sequence
  Description of Artificial Sequence: Synthetic coding sequence
atgagacccccacaatgcctcctccatactccatctctcgcctcacctctgctcctgttgctgctgtggctgttaggggggggggtcggagccgaagggagggaagatgcagaacttctcgtgaccgtgcgcggcggccgcctgcggggcatccggctgaagacaccaggagggcccgtcagcgccttcttaggcattccttttgcagagccgccaatgggcccccgtcggttcctccctcccgagcccaagcaaccctggtcaggggtcgtcgacgccactacattccagtcagtctgttaccaatacgtggacactctgtaccccggctttgaaggcactgaaatgtggaatccaaacagagaactatcagaagactgtctatacttgaacgtatggactccttaccccagaccaacctccccgacaccggtcctagtgtggatatacggaggtggcttctacagcggagcctcttctctcgacgtgtatgacggtcggttcttggtgcaggccgagcgcaccgtacttgtcagtatgaattatagggtgggagctttcgggtttctagcgttgccaggatcaagggaggctccaggaaacgtcggcctgttagatcagcggctggccctacaatgggtccaggagaacgttgcagccttcggaggcgacccaacatctgttactctctttggggagtcagcaggggcagcctctgttggaatgcacctgctgtcgcctccgtcaaggggcttgttccatcgtgcagtactccagagtggggctccgaatgggccatgggcaacagtggggatgggcgaggccagaagacgggccacccagctcgcccacctggtgggctgcccgcccggaggcactggcgggaacgacacagagttagtcgcatgtctccggacacgtcccgctcaagtcttggttaatcacgaatggcacgttttacctcaggaatctgtgttccggttttctttcgttcctgtcgtggatggagattttttaagtgacacacctgaagctctgataaacgctggggattttcatgggctccagttagctggccgtctcgccgcgcagggcgcaagagtttacgcatacgtgttcgaacacagagccagcacactcagctggccattgtggatgggtgtgccccacgggtacgagatcgaatttatcttcggcattcccctcgaccctagtcgaaattacacggcagaagaaaagatcttcgcccagagactgatgcgctattgggctaattttgccaggactggagatcctaacgagccacgggatccgaaggctccgcaatggcctccctacacagccggggcccagcagtacgtcagtcttgatctgcggcccctggaagttaggagaggattgagagcccaggcttgcgctttttggaacagattcttgcctaagttgcttagtgctaccgacacactggacgaggcagagcggcagtggaaagccgaatttcatcgctggtccagctatatggtgcactggaagaaccagttcgatcactacagcaagcaagacaggtgtagtgatctttag

SEQ ID NO: 106791 - DNA, 1806 bp, Artificial Sequence
  Description of Artificial Sequence: Synthetic coding sequence
atgaggcctccacagtgtctcctgcatactccatcattggcctcccctcttttgttgctcttgctttggctgctgggaggcggggtcggggccgagggacgcgaggacgcagagcttctggtcacagtccggggcggcaggcttcgcggcatcagactgaaaacccccggcggaccagtgtccgccttcctggggattccctttgccgagccacctatgggcccgcgacgttttcttcccccagaaccaaagcagccatggtctggagtcgtagatgccacaacgtttcaatctgtgtgctaccagtacgtggacactttatatcccgggtttgagggaaccgaaatgtggaaccccaacagggagctgtccgaagactgcctctaccttaatgtgtggaccccctaccccagaccgacctcccccactccagtcctggtgtggatctacggaggcggcttttactctggggcgagctcactggacgtgtacgatggacggtttctcgttcaggccgagcgaacagtattggtctccatgaactaccgtgtgggggccttcggttttctggcactgcccggtagtcgagaagcaccaggaaatgtaggactcctggaccagcgtctggcgcttcagtgggtgcaggagaacgtggctgcatttggcggggacccaaccagcgtcaccctttttggagaaagtgccggggctgcttccgtgggcatgcacctcctgtctccaccgtcaaggggtctattccatagagctgtactccagtcaggagctcctaatggcccatgggccacagtgggtatgggagaggcccgacgccgggctacccagctagcacatctagtcggctgcccgccaggggggaccgggggaaatgacacggagctggtcgcatgcttgcggacacgaccagctcaggtgctggttaaccacgagtggcatgttcttcctcaggaatccgtcttcagattctcatttgtgccagtcgttgatggcgatttcctcagcgacactccagaggctctcattaatgccggtgactttcacggccttcaggtgctggtaggcgttgtcaaggatgaaggatcttacttcctggtttacggcgctcccggctttagcaaggacaatgaaagccttatctcccgcgccgaattcttagccggagtgcgcgtgggcgtaccccaggtgagcgacttagccgccgaagcggtcgtgctgcattacacagattggcttcaccctgaagaccctgctagactgcgcgaggcactgagtgatgtagtcggagaccataacgtggtctgcccagtagctcaacttgccgggaggctggcagcccaaggcgctcgcgtgtacgcatacgtgttcgagcaccgcgccagtacactaagctggcctctatggatgggagtgccgcatggatacgagattgagttcatctttggtatcccattggacccctcaagaaattacaccgctgaggagaagatcttcgctcagagactcatgcgctactgggccaacttcgccagaaccggggatcctaatgaaccacgggaccccaaggccccccaatggccaccctacacagctggtgcccagcagtatgtttccctcgatctgcgcccacttgaagtcagacggggcctcagggcccaggcatgtgccttctggaaccgcttcctgcctaagttgctgagcgcgaccggaatgcaggggcctgcaggaagtgggcggaggggcgtaggagcacgctgcaacccatctctgctgcccctggcgtctgagtag

SEQ ID NO: 106792 - DNA, 1845 bp, Artificial Sequence
  Description of Artificial Sequence: Synthetic coding sequence
atgcggccaccacagtgcctgctccacactccgtccttagcttcccctctgttgctgctgcttctatggttacttggtgggggcgtgggcgcagaggggcgggaggatgctgaactgctggttactgtccgggggggaagattgcggggcatacggcttaagacaccgggcgggcccgtaagtgcattccttggcataccttttgccgagccccctatgggaccccggcgatttctcccacccgaaccgaagcagccctggtccggggtggtggacgccacaacatttcagtccgtgtgttaccaatacgtcgataccttgtatcctggattcgagggcactgagatgtggaacccgaatcgtgagctcagcgaggactgcttgtacctgaatgtgtggactccataccctcgccccactagcccgacccccgtactggtgtggatatatgggggcggcttctactccggcgctagctcgctcgatgtttacgatggtagattcctggtacaggccgaaaggacagtgttggtatccatgaactacagagtcggggcatttgggttcttagccctgcccggatctcgtgaggcccctgggaatgtcggcctgctggaccagcggctggccctccagtgggtgcaagagaacgtggcagcattcgggggggatcccaccagtgtcactctctttggtgagtcagcgggcgctgcctctgttggcatgcaccttttgagccccccttcacggggactcttccaccgcgcagttctccagtccggcgcccccaatggtccttgggcgacggttggtatgggcgaagcacgcaggcgagcaactcagctcgcccacctcgtcggttgtccccccgggggaaccggtggaaatgacaccgagcttgtcgcttgcctccgcactagaccagctcaagtgttggtgaaccacgagtggcatgttctgccacaagaaagtgttttccgcttcagctttgtacctgtcgtggatggggactttctctccgatacaccggaggcactgataaacgctggggacttccacggactccaggtgcttgttggagtagtgaaggatgaagggtcttattttctcgtctatggcgcccccgggttctccaaggacaatgagagcctcatctcacgagccgagttcctcgcaggggtccgggtgggggtccctcaggtgagcgatctcgcagctgaggcagtcgtcctccattatacggactggttacaccctgaggacccagccagattgcgggaggctctgtccgatgtggtgggtgatcataatgtcgtgtgtcccgtagctcagctcgctggaagactggccgcccaaggcgccagggtctacgcgtatgtcttcgagcaccgcgcttctacactctcatggcctctttggatgggcgttccccacggttacgaaatcgagtttatcttcggaatccctctcgaccctagccgcaactacaccgcggaggaaaagatttttgctcaaaggctgatgagatactgggccaatttcgctcggactggggatccaaacgaaccgcgagaccccaaggctccacaatggcctccatataccgctggtgcccaacagtatgtgagtctggacctccggccacttgaagtgcgaagaggattgcgggctcaagcttgcgctttttggaatagattcctacctaagctgttgtctgccactgacacactggatgaggccgagcgacagtggaaggccgaatttcacaggtggtcttcttacatggtgcactggaagaatcagtttgaccattattcaaaacaagaccgctgcagcgatctgtag

SEQ ID NO: 106793 - DNA, 480 bp, Artificial Sequence
  Description of Artificial Sequence: Synthetic coding sequence
atgcggccaccccaatgcctgcttcatacaccttccctagcctccccactgcttttattgctgttatggttactgggcggcggcgtaggggccgagggaagggaggatgccgaactcctggtgaccgtgagaggtgggcgtctgcgcggtatacggctcaagactccgggaggcccagtctccgcattccttggaataccgtttgcagagccccccatgggcccccgcaggtttctcccaccagagcctaagcagccatggtcgggagtggtggacgcaaccacattccagtccgtgtgctatcagtacgtcgatactctctacccaggatttgaggggacggaaatgtggaacccaaaccgcgaattgagcgaggactgcctgtacctcaatgtctggaccccttatccaagacctacgagcccaaccccagtgttagtgtggatatatgggggcggtttctactctggcgcctcctag

SEQ ID NO: 106794 - DNA, 87 bp, Artificial Sequence
  Description of Artificial Sequence: Synthetic coding sequence
atgaggcccccccagtgcctccttcatacaccttctctcgccagccccctgcttctcttactgctgtggcttctcggggggggctag

SEQ ID NO: 106795 - DNA, 282 bp, Artificial Sequence
  Description of Artificial Sequence: Synthetic coding sequence
atgctggggctagtgatgtcttgccctgaccgtactctggttaccaaggttagatcacatccatctggcaatcagcatcggccgactcggggtggcagtagatcctttcactgcagaaggggtgtcccacggcccgctgccctgagggtattacccaggtgccccgcattttcagacgccgcatgcccggcagccatgcggcctccccaatgtctgctacatactccatcgctcgcctctcccctgctcttgttgctgctctggctgttgggaggtgggtag

SEQ ID NO: 106796 - DNA, 1284 bp, Artificial Sequence
  Description of Artificial Sequence: Synthetic coding sequence
atggccgtgctggccgcactgctgagaagcggagcacggtctagaagcccgctgcttagacggcttgtgcaagagatacggtacgtcgagaggagctacgtcagtaagcctaccttgaaagaggtcgtgatcgtctctgcaactcgcactccaatcgggtcatttctaggctcgttgagcctgctgcccgctaccaaactcggaagcattgccatccagggtgcaattgaaaaagctggaatacctaaagaggaagtgaaagaagcctatatgggaaacgtgctccaggggggggagggccaggcacctacccggcaagccgttcttggcgcaggcctgcccatctctaccccctgcaccactataaataaagtctgcgcaagtgggatgaaagcaattatgatggcttcccagtccctgatgtgtggccaccaggatgtgatggtagctgggggaatggaaagcatgagcaatgtaccatatgtaatgaaccgcggcagtaccccttatggtggtgtgaaactcgaagatctgattgtcaaagatggcctcacggatgtgtacaataagattcatatggggtcctgcgccgaaaataccgccaagaagttaaacattgcacggaacgagcaggacgcgtacgcaatcaactcttatacgaggagtaaggccgcttgggaagctggaaaattcgggaatgaagtcatccccgtgacagtaaccgtgaagggccagccagatgtggtggtcaaggaggatgaagaatacaaacgcgtggacttcagcaaggtccctaaattgaagactgtgttccagaaggaaaatggtactgtgaccgccgccaacgcttctacactcaacgatggcgccgccgctctggtgcttatgacagctgatgccgctaagaggttgaacgtgacgccattggcccggattgtggccttcgccgacgctgccgtcgagcctattgacttccccattgcccccgtttatgccgcctccatggttctgaaggatgtgggactcaaaaaggaagacatcgcaatgtgggaggtaaatgaggccttcagcctcgtcgttctcgccaacataaaaatgctggaaatagatccccaaaaagtcaatatcaatggaggagccgtttccttagggcaccctataggaatgagcggcgctcgaatcgtgggccatcttacccatgccctgaagcagggcgagtacggcctggccagtatttgcaatggaggggggggcgctagcgccatgctgatacaaaagctctag

SEQ ID NO: 106797 - DNA, 1194 bp, Artificial Sequence
  Description of Artificial Sequence: Synthetic coding sequence
atgaacgctggatccgatcccgtggtcatagtgtcggcggcacgcaccattatcggatccttcaacggcgctctagccgccgttccagttcaggacttgggctctaccgtgatcaaagaggttctaaaacgcgccacagtggcccctgaagacgtatcagaagtgatctttgggcatgtgctcgccgccggatgcggacagaatccggttcgccaggcttccgtgggggccggaatcccctattccgtgccagcctggagctgccagatgatatgtggtagtggtttgaaggccgtctgtctggcggtacaaagcataggaattggggacagctccattgtggtagccggcgggatggaaaacatgagtaaggcgccgcacctcgcctatctgagaaccggagtgaagataggggaaatgcctctcactgatagcatcctctgcgacggtttaaccgatgcatttcacaactgccacatgggtattacagccgagaacgtggcaaaaaagtggcaggtgagcagggaggatcaggacaaggtggccgtcctgagtcagaacagaacagaaaacgcgcaaaaagctggtcatttcgacaaagagatcgttcctgtactagtgtctacccgaaaaggacttattgaggtgaagacggatgaattccctcgccacggatccaacattgaggctatgagcaagctaaagccatattttctgacagacggaactggtacagttacgccggcaaacgcttccggaatcaacgatggcgcagctgcagtcgtattgatgaaaaagagcgaagctgataagaggggcttaactccgctggctagaatagtgagttggagtcaggtgggcgttgaaccaagcataatggggattggccccatacccgccatcaagcaggctgtgacaaaggccggttggtctctggaggacgtggacatttttgaaataaatgaagcctttgctgctgtgtccgccgccattgtgaaggagctcggattaaaccctgaaaaggtgaatattgaggggggggccatcgctttgggccacccgctgggtgccagtgggtgtcgaatattagtgacgctcttgcatacgttggaacggatgggtcgctcccggggagtcgccgcgctgtgcataggggggggcatgggtatcgccatgtgcgttcagagggaatag

SEQ ID NO: 106798 - DNA, 1281 bp, Artificial Sequence
  Description of Artificial Sequence: Synthetic coding sequence
atgggcagccatccagtgctccgcatttgggggaaccgtagagcaaccgctgcgtccctgggccgctcaggcgggcgactgagctccccacgtctgctgagagttgtcgcccccaccttgacttttgcccaaactagccgttgtagctttaacggcgccttagctgcagtgccggtgcaggacctcgggtcgaccgtgatcaaggaggtgctgaaacgcgcaaccgtagcccctgaagacgttagcgaggtgatatttggccacgtgttagcagcaggatgcggacagaatccagtacggcaggcctcagtgggggccgggataccttatagcgtacctgcatggtcatgccagatgatttgcggaagtggtctcaaagcggtgtgtctggccgtacagagtatcggaatcggagacagttccatcgtggttgccggcggaatggaaaacatgagtaaggccccccatctcgcctatctcaggactggagttaaaataggtgaaatgcccctcactgactccattttgtgtgacggcctcactgacgcctttcacaactgtcacatgggaatcactgccgagaacgtagccaaaaagtggcaggttagtagagaagatcaagataaggtggccgttctctcccaaaataggacagaaaacgcacagaaggccggccattttgacaaggagattgtgccagtgctcgtgtctactaggaaggggctcatagaggtcaaaaccgatgagttccccagacatgggtccaacatcgaggcaatgtccaaactgaaaccttattttctcaccgatggcacgggaacagttaccccagccaatgcatccggcatcaatgatggagctgctgcagtcgttcttatgaagaaatcagaggccgacaagcgagggctgaccccacttgctcggatcgtgtcttggtcccaggtaggggtggagccctcgattatggggattggccccataccagcaatcaagcaggccgtcaccaaagctgggtggagtctggaggacgttgacatatttgaaatcaacgaggcgttcgcagcagtctcggcagccatcgtcaaagagcttggactgaaccccgaaaaggtgaacatagaaggcggagcaattgcacttggacatcctctcggggcctccggatgccggatactcgttacgctactgcacacactcgagagaatgggccggtccaggggcgttgcggctctgtgtattgggggcggcatgggcatagcaatgtgtgtgcagagagaatag

SEQ ID NO: 106799 - DNA, 1275 bp, Artificial Sequence
  Description of Artificial Sequence: Synthetic coding sequence
atgcagcggctgcaggtcgtgttgggacacctgcgcggccccgcggacagcgggtggatgccacaagcagctccctgtctgagcggtgcccctcaggcatcagccgccgacgtggtcgtggtgcatggaagaagaacagccatctgccgcgctggccgaggagggttcaaagacactacacccgatgagttactgtctgccgttatgactgccgtcctaaaagatgtgaatcttaggccagagcagttgggagacatctgtgtcggcaacgtactccaacccggagcgggggctatcatggcccgcattgcccagttccttagcgatatacccgagaccgtacccctcagcacagtcaaccgacagtgctctagcggtctgcaggccgtcgcttccattgcaggtgggattcgcaatggctcctacgacatagggatggcttgcggagtggagtctatgagtctcgctgacaggggaaatccgggcaacataacgtctcgtctcatggaaaaggagaaagcccgcgattgtctgattcctatgggaattacctctgagaacgttgccgaaagatttggcatttctcgcgaaaagcaggacacatttgccctggcgagccaacagaaggcagcccgcgcccagtccaagggatgtttccaggccgaaatagtccccgtgacgacaactgtgcacgacgataagggaacgaagagatctattactgtgacacaggacgaagggattcggcccagtacaacaatggaagggttggctaagctaaaaccagctttcaagaaagacggaagtaccaccgcggggaacagtagccaagtgtccgacggagccgccgctatcctacttgcgaggagaagcaaagctgaggaacttgggctgcccatattgggtgtgcttaggtcctatgcggtggtgggagttccacccgacattatgggcattggaccagcttatgccatcccggtcgccctacagaaggctggtctgaccgtgagcgatgtcgatatttttgaaatcaatgaagcctttgcctcacaagcagcctattgtgtcgaaaaacttcgtttacccccggagaaggtcaaccccctggggggagccgtcgccctgggacaccccctggggtgcacaggggcccgccaggtcattactctgctgaatgagctgaaacgcaggggcaaaagagcctacggagtggtgtcaatgtgtatcgggacaggtatgggcgctgctgcggttttcgaatacccaggcaactag

SEQ ID NO: 106800 - DNA, 1071 bp, Artificial Sequence
  Description of Artificial Sequence: Synthetic coding sequence
atgacagctgtcctgaaagatgtgaatcttcggcctgaacagcttggagacatatgtgtggggaatgttttacagcccggggctggggcaattatggctcggatagcccagttcctatccgatatccctgagacagttccattatctacagtgaatcgacaatgctccagtggcctgcaggcagttgccagtatcgctggtgggattagaaacggttcatatgacattggcatggcctgcggcgttgagtcaatgtcactggccgatagagggaaccccggcaacataacatctcgccttatggagaaagagaaggcaagagactgtcttatccccatgggtatcacttccgagaacgtggccgagcgtttcggtatttctagagaaaagcaggatacctttgctttggcgtcccaacagaaggcagcaagagcacaatcgaagggttgcttccaggccgaaatcgtccctgttactaccactgtgcatgacgataaaggaaccaagcggagtatcacggtgacgcaggatgagggcatcagaccatcgaccaccatggagggtctagcgaaactgaagccagcgtttaaaaaagacgggagcacaacagccggcaactctagccaagtgagcgacggtgcggccgccatcctgttggcccgtcgcagcaaagcagaggaactaggcctgccgatcctgggggtgcttcgcagctacgcagtcgtaggagtacctcctgatattatgggcataggtccagcttatgcaatacctgtcgccctgcaaaaggccggtctgacagtgagcgacgtggatatatttgaaattaatgaggcgttcgccagtcaggcggcttactgtgtggagaagttacgactgcccccagaaaaggtcaaccctctcggtggcgcagtggccctgggccatcctctggggtgtacaggggctaggcaggtcataaccctgttaaacgaattaaagcgtagggggaagagagcatatggcgtcgtatctatgtgtataggtactgggatgggggcggccgccgtcttcgaataccctggcaattag

SEQ ID NO: 106801 - DNA, 462 bp, Artificial Sequence
  Description of Artificial Sequence: Synthetic coding sequence
atgcagcgcctccaggtggtcctaggacacctccgaggaccagccgacagtggatggatgccccaggcagccccttgcctcagcggagctccacaggcgtctgccgccgacgtggtagtggtgcacgggcgacgcacggctatttgtcgggccgggaggggggggttcaaggacacaacccctgatgaactgctctctgctgtgatgaccgcagtgctcaaggacgtgaatttgagacccgagcagcttggcgatatctgcgttggcaacgtcctgcaaccgggcgctggcgccattatggccaggatcgcgcagttcctgtctgatatcccagagacggtgccgctgagcactgtgaaccgacagtgttcctccgggctgcaggccgtcgcatccatcgccggctggtccccatgcccgtggcttaccgaaggaaccctggagattttgctgcgagcctag

SEQ ID NO: 106802 - DNA, 381 bp, Artificial Sequence
  Description of Artificial Sequence: Synthetic coding sequence
atgtccctggccgatcgcggaaaccctggaaatataacaagtcgactcatggagaaggaaaaggcgcgcgattgcctgatccctatgggaattacatcagagaatgtcgctgagcgctttgggataagcagggagaagcaggacacttttgcactggcttcccagcagaaagccgcacgagcgcagagcaaggggtgttttcaggccgagatcgtacctgtcacaactactgtgcacgatgataaaggcaccaaacgctccattaccgtcacgcaggacgagggaattcgcccctccacaaccatggagggacttgccaagctcaagccagcctttaagaaggatggcagcacaactgcaggcgaaactggcccaggatag

SEQ ID NO: 106803 - DNA, 996 bp, Artificial Sequence
  Description of Artificial Sequence: Synthetic coding sequence
atgcagcgactacaggtagtgcttggacacctccggggcccagccgattctggatggatgccccaggccgctccatgcctatccggagccccgcaagccagcgccgcagatgttgttgtggttcacggtcggcgcactgctatatgtcgagctggccgggggggattcaaggatacaacaccagatgagcttctgtccgctgtgatgacggccgtcctgaaagacgtgaatttacggcccgaacaattgggtgatatttgcgtgggaaacgttctccagcctggggccggggccattatggccaggatagctcagttcttgtctgacatacctgagacagtccccctgagcactgtgaatagacagtgcagctccggcctgcaggccgtggcaagcattgcaggaggcatcagaaacggatcctatgatatcggcatggcttgcggaatcaccagtgagaacgtggctgagcgattcggcataagtagggaaaaacaagacacatttgccctggctagccaacagaaggccgctcgggcccaaagtaaaggctgtttccaggctgagattgtacccgtgacgaccaccgtgcacgacgataaaggaaccaagcgctccattacagtaacacaagatgaggggattcgacctagcactaccatggagggtctggccaaactgaaacccgcctttaagaaggacgggtccaccaccgccggactcacagtaagcgacgtagacatctttgaaatcaacgaggcctttgcttcacaggccgcctactgtgtcgaaaagcttcgcttgcctccagagaaagtaaatccactgggaggagctgtcgccctcggccaccccctgggatgcacaggggccagacaggtgatcactctcttaaacgagcttaagagacgaggtaagagagcctatggggtggtgtctatgtgcattggcacagggatgggggccgccgcagtctttgagtaccctggtaattag

SEQ ID NO: 106804 - DNA, 7377 bp, Artificial Sequence
  Description of Artificial Sequence: Synthetic coding sequence
atggttcttttactctgtctgtcctgcttaatctttagctgcctgacctttagttggctcaaaatctggggaaagatgaccgacagcaagcccataactaagtctaagtcggaagccaacctcatcccaagccaggaacccttcccagcatccgacaatagcggcgagacaccacagagaaatggcgaaggccacactctgccaaagactccctctcaagccgaacctgcttcccacaaaggtcccaaagacgccggcaggaggaggaactctcttcccccttcccaccagaagcccccccgcaacccattatcaagttctgacgccgcaccttctcctgagttgcaggccaatggcaccggcacccaggggctcgaagcaacagatacgaatggtctgtcctcgtctgctcgcccccagggccagcaggcaggaagcccgtccaaggaggataagaaacaggctaacattaagaggcagctgatgacgaacttcattctgggcagcttcgacgactactccagtgacgaagacagtgtggctggaagctcacgcgaaagcacgcggaaaggctcccgcgcctcactgggcgcccttagcctggaggcctacttgaccaccggtgaagccgagacgagggtcccaacaatgcgtccttccatgagcggccttcacttggtgaagagaggccgcgagcataaaaagctcgacttgcatcgggatttcaccgtggctagcccagcagaatttgtgacgcgattcgggggcgaccgcgtgatcgaaaaggtgctgattgccaataacggaatagcggctgtgaagtgcatgcggtccatccgccgatgggcctatgagatgttcaggaatgaacgtgccattcggtttgtggtaatggtaaccccagaagacctcaaggccaatgctgaatacattaagatggcagaccattacgtcccggtacccgggggaccaaacaataacaattacgcaaatgtggagttaatcgtggacatagccaagcggatacccgtacaagctgtgtgggcagggtggggtcatgcaagtgaaaaccctaaactccccgagcttttatgtaagaatggggttgcatttcttggtcctccatctgaggccatgtgggctttaggcgataaaattgcgtctactgtcgtcgcacaaacattgcaggtgcctacgctcccatggtcaggtagcggcttgactgtcgagtggaccgaggacgacctgcagcaagggaaaaggatttctgttcccgaagacgtgtacgataaagggtgtgtgaaggatgtcgacgaagggcttgaggctgcagagagaataggatttccactcatgatcaaagcgtctgaaggaggcggcgggaagggaataaggaaagctgaaagcgctgaagatttccccattctttttaggcaggtgcagagcgaaatccctggcagtcctatcttccttatgaagctggcgcagcatgccaggcatctggaagttcaaattctggccgaccagtacggcaatgccgtttccctgtttggccgggactgttctatccaacgccgccaccagaaaatcgtcgaagaggcccctgcaacgattgcacctttagcaatcttcgaatttatggagcagtgcgccatccgcttggcaaagacagtgggatacgtttcggcagggacagtggagtacctgtattcccaggatggtagttttcacttcctggagcttaatccacggcttcaggtggagcacccttgcacagagatgattgccgatgtgaacctcccagccgcacagcttcagatagccatgggcgtcccgctgcatcgcctgaaggatatccgactcctgtacggagaatcaccgtggggtgtgactccgatctcattcgagacaccttcgaatcccccacttgccagaggtcatgtgatagctgcacgcattacatccgagaacccagacgaaggctttaaaccaagttccggaacagtgcaagaattgaactttagatcctcaaaaaatgtctggggttacttttccgtggccgccacgggaggtttgcacgagttcgcagattctcagttcgggcactgcttctcctggggtgagaaccgggaggaggctatcagcaacatggtcgtggccctgaaggagctgagtatccggggggactttagaacgaccgtcgagtacctcattaatcttttggaaaccgagtcgttccagaacaatgacattgacaccggctggctggattacctcatcgccgaaaaggtgcaagctgaaaaacctgatataatgctcggggtggtttgtggagctcttaatgtggccgatgctatgtttcggacatgcatgactgacttcctccattctctggagaggggccaggtactgccggccgatagcctgctaaatctggtcgatgtggaactgatctatgggggcgtcaagtacatactgaaagtggctaggcagtcacttaccatgtttgtcctcatcatgaacggctgccacattgagatcgatgcccatcgcctgaatgatggtggcctgctgctgtcctacaatggaaattcttatactacatatatgaaggaggaagtggactcatacagaatcacaataggaaacaagacgtgcgtgttcgaaaaggagaatgatcccactgttctgaggtcgcccagcgctggtaagttaactcaatataccgtggaggatggagggcacgtggaagctgggtcatcttacgctgaaatggaggttatgaaaatgatcatgacactgaacgtacaagagagggggcgcgtgaagtatataaagcgccctggtgctgtattggaggccggctgtgtcgtggcccgcctagagctggacgatccatcaaaggtccaccctgcagaacccttcacgggggagttacctgcccagcagacactgcccatactgggggagaaactgcaccaggtgttccactccgtgctggagaacctcactaatgtgatgtcaggattttgcctacctgagcccgtcttctcaatcaagctgaaggagtgggtgcagaaactgatgatgaccttacggcacccctctcttcccctgctcgagctacaagagatcatgacctctgtggcgggcaggatccctgctcctgtcgaaaaatctgttcggagagtaatggcgcaatacgcttccaatatcacttcagtgctctgccagttcccttcccagcaaatcgccactattctggactgccatgccgctactcttcagagaaaagccgatcgtgaggtattctttatcaatacccagtctatcgttcagttggtgcagcgttacagatctggcatacgcggatatatgaagaccgtcgtgctggacttgctgaggcggtacctgcgcgtggagcaccatttccagcaagctcattacgacaaatgcgttatcaaccttagggagcaatttaagcctgacatgagtcaggtccttgattgcattttctctcatgcccaagtcgctaaaaaaaatcagttagtgatcatgctgatcgatgaactctgtgggccggacccttccctctccgatgaactgatcagcattctgaacgagttaacccagttatctaaaagtgagcattgtaaggtggccctgagagccagacaaatcctgatcgcctcccatctgccctcctatgaactgagacacaaccaggtcgagtcgatctttctgagtgccattgacatgtatgggcatcagttttgtcctgagaatttaaagaagctgatactttcagaaaccacaatatttgacgtccttccgactttcttctatcacgccaataaggtggtgtgcatggcttctctcgaggtttacgttagaagagggtatatagcctacgaactaaattccctccaacaccgccagttgcctgacggaacttgcgtggttgagttccaattcatgctgcctagctcacaccctaaccgcatgactgttccgatcagtataaccaaccctgacctgcttcggcattccactgaactgtttatggattccggcttttcacctctctgccagaggatgggcgcaatggtcgcattcaggcgttttgaagacttcacccggaattttgacgaggttatctcatgttttgctaatgtccctaaggacactccactcttttccgaggcacgaacctcgctttattccgaggacgattgcaagagtttgcgggaggagcccatccatatcttaaatgttagcattcagtgcgctgaccacctcgaggacgaagcactggtccctatcctgaggacttttgttcaaagtaagaagaacattttagtcgactatggacttcggaggatcacgttcctcatagcgcaggagaaggaatttcctaaattcttcacttttcgagctcgcgacgaattcgccgaagaccggatatacaggcacctcgaaccagccctggcatttcagctagagttgaaccgcatgcgaaatttcgacttgactgctgttccgtgtgctaatcacaagatgcacctctatctcggtgctgcaaaggtgaaagaaggcgtggaggtgacagatcacaggttcttcatacgtgccatcatccgccacagtgatttaataacaaaggaggcaagcttcgaatacctccagaacgagggagagagactgctgctcgaagcgatggacgagctcgaggtggccttcaacaatacatccgtgaggactgactgtaaccatatttttctgaatttcgtgcctacagtgatcatggacccttttaagatcgaagagagcgtgcggtacatggtaatgcggtacggttctaggctatggaaactgagggtgcttcaggcagaggtgaaaatcaacattaggcagacaaccacgggatccgcagtccccatccgcctgttcatcactaatgaaagcggctattacctcgatatcagcctctacaaggaagtgaccgactcacgatccggtaacattatgttccattcctttggtaataagcaaggacctcagcacggcatgcttattaatacaccatatgtaacgaaggaccttctgcaggccaaaagattccaagctcagacactcggtacaacctatatctacgattttcccgaaatgttccgacaagccctattcaagctatggggaagcccagataagtatcccaaggacattttaacttacactgagctggtgctcgatagccaggggcagttagtcgagatgaatagattgcctggtggaaatgaggtgggcatggtggcgttcaaaatgcggtttaaaactcaagagtacccagagggtcgagatgtaattgttatcggcaatgacatcacattccgtattgggagctttggacccggggaggatttactgtatttgagagcatctgagatggcccgagctgaagggatccccaaaatctacgtcgctgctaacagcggagccaggatcggcatggctgaagagataaaacacatgtttcatgtggcgtgggtagatccggaagaccctcacaaaggcttcaagtatctctatctcacacctcaggattacacgcgtatctcatccctaaactccgtgcattgcaagcacatagaagagggcggagagtctcgatacatgatcaccgatataatcggaaaggacgatgggctgggcgtggaaaatctgcgcggcagcggcatgatcgctggagagagtagcctggcttacgaagaaatcgtgacgatatcgctggttacctgccgcgccatcggcatcggcgcatacctcgttcgcctgggtcagagagtcatccaggtcgaaaattcccacatcatccttactggggcctcggcactgaataaagtgctaggacgtgaggtatacacgtccaacaatcagctcggtggggtgcagatcatgcactataacggagtgtcacatattactgtgcccgatgactttgagggggtatacacgattttggaatggttatcctacatgccaaaggacaaccactctccggtaccgatcatcacgcctacagatccaatcgatagggagatcgagtttctgccctcccgtgcaccatatgacccacggtggatgttagccggccgtcctcaccccacactgaagggtacttggcagtccgggttcttcgaccatggttcatttaaagagatcatggcaccttgggcccagaccgtagtcacgggccgggcccgcctaggcggaattccagtaggtgttatcgccgtagaaacacgaacggttgaagtggccgtccccgccgaccccgccaacttggatagcgaggccaaaatcatacagcaggccggccaggtatggttcccagactctgcttacaagaccgcacaggccgtgaaagacttcaatcgcgagaagttacccttgatgatcttcgccaattggcgaggcttctccggagggatgaaagatatgtatgatcaagtgctgaaatttggtgcttacatcgtggacggactacggcaatacaagcagccaattttgatatacatcccgccttatgccgagctgaggggcgggtcctgggtggtaatagacgccaccattaaccctctctgtatcgaaatgtatgcggacaaagagagccgggggggggttctcgaacccgagggcaccgtagagattaaatttagaaaaaaagacctgattaagtctatgagacgcattgaccccgcctataagaaacttatggagcagctcggagaacccgatctgtccgacaaggatcggaaggaccttgagggacgccttaaagcccgggaggacctgctgctgcccatttatcaccaggtagccgtccagttcgccgacttccacgatacgccaggcagaatgcttgaaaagggagtgatctcagatatcttggagtggaagactgctcgaaccttcctctactggcgcctcaggcggttactgctggaggatcaggtgaagcaagagatcctgcaagcaagtggtgaactctcacacgtacacatccagtccatgctcaggcggtggtttgtagaaaccgagggagctgtgaaggcttatctgtgggataataatcaggtagtcgtccagtggctggaacagcactggcaggcaggggacggaccaagaagcaccattcgggaaaacattacctatctcaagcacgacagcgtgctcaaaaccatccgcggtctggtggaagaaaatcctgaagtagccgtggactgcgtgatctacctgagccaacatatctcccccgccgagcgcgcccaagtggttcatctgcttagcaccatggactccccggcctcgacctag

SEQ ID NO: 106805 - DNA, 7377 bp, Artificial Sequence
  Description of Artificial Sequence: Synthetic coding sequence
atggtgctcctgttgtgcctgtcgtgcctaatcttctcttgtctcacctttagttggttgaaaatctgggggaagatgacggatagtaaacccattactaagtccaagtcggaggccaacctcattccatctcaagaaccattccctgctagtgacaattccggtgagaccccccaacgcaacggtgaaggtcacacgctcccaaaaactcccagccaggctgagccagcctctcataaggggcccaaggacgctggaagaagaaggaatagtctgccacccagtcaccagaagccacctcgaaaccccttgagcagctcggatgccgctccttcacccgagctgcaagcaaacgggacagggacacaggggctggaggctacagacacgaacgggctctctagttctgctagaccccaaggacagcaggcgggttcaccatccaaagaagataaaaaacaggcaaatattaaacgccagctgatgacgaacttcattctcggaagcttcgacgactactcgtccgatgaagatagcgtcgccgggtctagtagggaatcaacccgtaaggggagtagggctagcttgggagccctctcccttgaagcttacttaactaccggcgaggcagagactcgtgtgccgaccatgcgcccatccatgagcgggcttcacctggtcaaaaggggccgagagcataaaaagctggatttacaccgcgacttcactgtggcgtctcctgccgagtttgtcactaggttcgggggggacagagtgattgaaaaggtactgatcgccaacaacggcatcgccgctgtgaaatgtatgagatcaattagaagatgggcgtacgagatgtttaggaatgagcgcgcaataaggtttgtggtgatggtgactcccgaggacttgaaagccaatgcagagtacattaaaatggctgatcactatgtgcccgttcccggaggacctaacaacaacaactacgccaacgtggaactgatcgtcgatatagcaaagagaatcccagttcaggctgtgtgggcaggttggggccatgccagtgaaaaccccaagctaccggaactcctctgtaagaatggggtggcttttcttggacctcctagtgaagctatgtgggcgctcggcgataaaatcgcctccacagtggtcgctcagactttgcaggtaccaactctgccatggtctgggagcgggctcactgtcgaatggacagaggatgatctccaacagggcaaaagaattagcgtcccagaagacgtatacgataaagggtgtgttaaagacgttgacgaggggctggaggccgccgagcgcatcggatttcccttaatgatcaaggcgtccgagggggggggaggaaagggaatcaggaaggctgagagtgccgaagactttccaatcctgttcagacaagtacagagtgagattccgggaagccctatctttttgatgaagctggcacagcacgcacgacatctggaggttcagattctggcggaccagtacggcaatgccgtgtcgctctttggacgtgattgtagcatacagcgccgccaccagaagattgtggaagaggcaccagctactatcgccccattggcaatatttgagtttatggaacagtgcgcgatcagactggcaaagacagttggctacgtatcagcaggaactgtcgagtacctctattcccaggacggatcttttcatttcctggaactaaaccccagattgcaagtggaacatccttgcacggaaatgattgctgacgtgaatctcccagcagcccagctccagatcgcaatgggggtccccctccataggctaaaagatataagactcctatacggcgagagtccatggggcgtgactcccatttctttcgagactccatccaaccctcccttggcccgggggcatgtgattgcagctcgaatcactagcgaaaaccccgatgagggttttaaaccgtcctccggcaccgttcaggagctgaacttccgttcatcaaagaatgtgtggggatactttagtgtagcagcaactggaggattgcatgagttcgcggacagtcagttcggccactgcttctcctggggcgagaatcgcgaggaggccatatccaatatggtcgtcgctctaaaggagctcagcataaggggagattttcgaacaacggttgaatacctcattaatctgctagagacagagtccttccagaacaacgacatcgataccgggtggctggattatctcatcgctgagaaagtccaggcggagaagccagacattatgctgggagtggtctgtggggcgctgaacgtggcggacgccatgttccgcacctgtatgaccgacttcctccattcactcgaacgaggacaagtgcttccagcagattccctgttaaatctggttgatgtcgaactgatctacggcggtgtgaaatatatcctgaaagtggcgcggcaatcattgactatgttcgttctgatcatgaatggctgccatattgagattgatgcccatcgactcaacgatggcgggctgttgttgtcttacaacgggaatagttacacgacctatatgaaggaggaagtggacagttatcgtattaccatcggtaacaagacctgcgtgtttgaaaaggagaacgaccctactgtgcttagatccccctcagcagggaaactgacccagtacacagttgaagatggaggccacgtggaggccggcagcagctatgcggaaatggaagtaatgaaaatgatcatgaccctgaatgttcaggaacgtggaagggtcaagtacataaaaaggccaggagctgtgctggaggccggatgcgtggtggccaggttggagctcgatgatccctccaaagtgcatcccgcagaaccgtttacgggggagctgcccgcccagcaaactctcccgatcttaggcgaaaagctgcatcaagttttccactcagtactggaaaatttgacgaacgttatgtccggcttttgcctccccgaaccagtattttccattaagttgaaggaatgggtgcagaagttaatgatgaccttacgtcacccgtcactaccactactggagcttcaggagatcatgacctcagtggccggacgaatcccagctcctgtggagaagagtgtccggcgtgtgatggcacagtatgcaagcaatatcacctctgttctttgccaattccctagccagcagatcgccacaatccttgactgccatgcagccaccctgcaacgaaaggccgatcgagaggtcttttttatcaatacccagagcatagtgcagttggtgcaacggtaccgatcgggaattcggggctatatgaaaacggtggtgctggacctcctgcggagatatctgcgcgtggaacatcatttccagcaagctcactacgacaagtgtgtcatcaatctgcgcgagcaattcaaacctgacatgagccaagtgctggactgcatattctcccatgcccaggtcgccaaaaagaaccagttggttattatgctcatcgatgagctctgtggccctgacccttctctatctgacgagttgatatctatcctgaatgagctcactcaactgtccaaatccgagcattgcaaggttgccctgcgcgcgcgccagatcttgattgcctcccatctgccaagttatgagttgcgacacaaccaggtagaatcgatctttctgtctgctattgacatgtatggccaccagttttgtcccgaaaacttaaagaaattaatcctgtctgaaaccactatattcgacgtattgccaacattcttttaccacgccaacaaggtggtgtgcatggccagtctggaggtatacgttagaaggggctacatcgcgtatgagttgaatagtctgcaacaccgacaacttccggacggtacctgtgtcgtggagtttcagttcatgctgccctcaagtcatcctaatcgtatgaccgtccccatttctattactaacccagatctgctgcggcattccaccgaactctttatggattcaggcttctcaccactttgccagcggatgggtgctatggtagcatttaggcggttcgaagacttcacgaggaattttgatgaggttatctcttgcttcgctaatgttcctaaagacacaccacttttctctgaggctcgtaccagcctgtattctgaggacgactgcaaaagtttacgcgaggaacccatacacatcctgaacgtgtcaatccagtgtgccgaccacttggaggacgaagccctggttcccatcctccgaacttttgttcaatctaagaagaatatactcgtagattacggcttacgtcggatcacattcctcatcgctcaggagaaagagttccccaaattcttcaccttcagggccagggacgaattcgcggaggatcgaatttatcggcaccttgaaccagccctggccttccagcttgagctgaaccgtatgagaaatttcgatttaactgctgtcccatgcgccaaccacaaaatgcacctgtatttaggtgccgcgaaggtgaaagaaggcgtggaagtgacagaccaccgattctttatcagagccataatccggcatagcgatctgatcaccaaggaggccagcttcgaataccttcagaacgagggagagagacttctgctggaggctatggacgaactggaggtggctttcaacaatacctccgtgagaacagactgtaatcacatcttccttaactttgttcctaccgtcattatggacccgtttaagattgaggaatctgttcgctatatggtaatgagatatggttcacgcctctggaaactgagggttctccaggctgaagtgaagattaatatacggcagactaccaccgggtcagcagtcccaatccgactctttattacaaacgagtccggctactatcttgacatcagcctctacaaagaggttacggatagccgttcaggcaatattatgtttcattcctttggcaacaagcagggcccacaacacggcatgctaatcaatacgccctatgtgaccaaagatctgctgcaggcaaaacgctttcaggcacagaccctgggcaccacctacatatacgactttcctgaaatgttccggcaggccctgttcaaactgtgggggagccccgataaataccccaaggatattctcacctatactgagctggtgctggacagccagggacaactggtggaaatgaacagattgcctggcgggaatgaggttgggatggtggccttcaaaatgcggtttaagactcaggaatatccggaagggcgggatgtcatcgttattgggaatgacattaccttccggattggctccttcggacccggggaggacctgctctatctccgggcctcagaaatggctcgggcagaggggatccctaagatttacgtggctgctaacagcggggcccggatcggaatggctgaggagatcaagcacatgtttcacgtggcctgggttgaccctgaggatccccataaaggcttcaagtatctgtacctcaccccccaggactacacgcgcatctccagcctaaacagcgtccattgcaagcacatcgaagagggaggggaaagcaggtatatgattacagatataattgggaaagatgacgggctcggggttgagaatctgcgcgggtctggaatgattgcaggcgagtcatcgctcgcttacgaagaaatagtgacgatttcactggtgacctgtagagccattggaatcggtgcctatttggtcaggctgggtcaaagggtgatccaagtggaaaatagccacatcatactgaccggagcctccgcattaaataaggtgctggggcgcgaagtgtatacctctaacaatcagctagggggcgttcagataatgcactacaatggcgtaagccatattaccgttcctgatgactttgagggagtgtacacaatactggaatggctgtcgtacatgccaaaggataatcactcaccagtgcctattatcactcctactgacccaatagaccgcgagatcgagttccttccttctagggctccatacgatccacgctggatgctcgctgggcggcctcaccccactctaaaaggcacatggcagtccggcttcttcgaccacgggtcttttaaagaaattatggccccctgggcacagactgtggtaacaggacgcgctcgcttgggcgggattcctgtaggagtaattgcagttgagacacgtacagttgaggtagccgtgccagccgatccggcaaatcttgatagcgaggctaagataattcagcaggccggccaagtttggttcccagacagcgcatacaaaaccgcccaggccgtgaaggacttcaatcgtgaaaagctacccctgatgatttttgcaaattggcggggatttagcggcggaatgaaggatatgtatgaccaagtgttgaaattcggtgcctacatcgttgacggactacgtcagtacaagcaaccaattctgatctatataccaccctatgccgaactgaggggtgggtcctgggtggtgattgacgccactataaatccactttgcatcgagatgtatgccgacaaggagtctagagggggggttctagagcctgaaggaactgttgagattaagttccgtaaaaaggatctcattaagtccatgaggaggatcgatccagcctacaagaaactcatggaacagttgggagagcccgacctcagcgataaggatagaaaggacctcgagggacgccttaaagcaagagaggatctactgctgccaatctatcatcaggtggcagttcagtttgctgattttcatgatactccaggtcgcatgttagaaaagggggtcatttctgacatcctggagtggaaaactgcccgcaccttcctgtactggcggttacgacgtttgctcctcgaggaccaggtcaagcaggaaattttacaggccagtggcgagctgagtcatgtccacattcaatctatgctccgaagatggttcgtggaaaccgaaggggccgttaaggcttacttgtgggataataaccaggtagtcgttcaatggcttgagcagcactggcaagccggggatgggcctcggtcaaccatcagggagaatatcacttatcttaaacatgactctgtcttgaaaactattcgcgggcttgttgaagaaaatcctgaagtggctgtggattgtgtgatatacctctcccaacacatctccccagcagagagagcgcaagtggttcacctactttccaccatggattcgccagcgtccacctag

SEQ ID NO: 106806 - DNA, 7167 bp, Artificial Sequence
  Description of Artificial Sequence: Synthetic coding sequence
atggtccttttactctgtctgtcttgcctcatcttttcttgcttaactttttcttggctgaagatttggggtaagatgaccgactcgaagcccattacaaaatcgaagtctgaagcaaatctgattcctagtcaagagccgtttcccgcttctgacaactcaggcgagacccctcaacgcaacggagaggggcatacactgcctaagacaccatcccaggccgaacccgcttctcataagggccctaaggacgctggcaggcggagaaactcattgcctccatctcatcaaaagccccctcgtaacccgctctcctcctccgacgcagctcctagcccggaactccaggcaaatggcaccggtacccaagggctcgaagcgacggacaccaacggactctccagctctgcgcggccacagggccagcaggctggtagtccatcgaaagaggacaagaagcaggctaatatcaaaaggcaactcatgactaatttcatcctgggcagtttcgatgactactcctccgatgaggatagtgtcgctggatcttcccgcgagtctacccgtaagggatcaagagcctctctgggcgctctatccctagaagcctacttgaccaccggagaagcagagacaagagtgccgactatgagaccttctatgagtggcttacacctcgttaaacgcgggcgggaacacaagaaactcgacttgcatcgtgatttcacagtggcctcccccgctgaattcgttacccgtttcggcggggatcgtgtgattgaaaaagtactgatcgcgaacaatggaatcgcggccgtgaaatgcatgaggtctatccgccgctgggcttacgagatgttcagaaacgaacgggccattagattcgtcgtgatggtgaccccggaagaccttaaagctaacgcagaatacatcaagatggcggatcattacgttccagtacccggggggccaaacaataacaattatgcaaacgtagagcttatagtggatatcgcaaagcggattcccgtccaagccgtctgggctggctggggacacgctagcgaaaatcctaagctgcctgaactattgtgcaaaaatggggtcgcgttcctgggcccgcccagcgaagctatgtgggccctcggagacaagattgcttctactgtggtcgctcagacactgcaggtacccactctgccctggagcgggagcggtcttaccgtagaatggacagaggacgatttacagcagggtaagcggatttctgtgcctgaagacgtgtatgacaaaggctgtgttaaggatgttgacgaaggcctcgaggccgcagagaggatcgggtttcctctaatgataaaagctagtgagggaggtggcgggaagggaatccgcaaggcagaaagtgctgaggacttcccaattctgttccgccaagtccagtccgagatccccggctcccccattttcctaatgaagctggcccagcacgcccgccaccttgaggttcaaatccttgcagaccagtatggaaacgccgtatcactcttcgggagagattgttccatccagagaagacaccagaagatcgtggaggaggcacctgccactattgcccctctggcaatttttgagttcatggagcagtgtgcgatcagactcgccaaaaccgtggggtacgtgtcagccggaactgtcgagtatctgtacagccaggatggctctttccatttcctggaactcaaccctcgtctccaagtcgaacatccctgtacagaaatgatcgcagacgtaaatttgccagccgcacaacttcaaatcgcaatgggagtgcccctccacaggctgaaggatatccgactgctgtacggcgagagcccttggggtgttacccctatctctttcgaaacaccatcaaaccccccactggctaggggacacgtgatagctgcaaggatcacaagcgagaatcccgacgagggattcaagcccagtagcggaaccgtccaggagctcaactttcgatctagtaagaacgtttggggctacttctccgtcgccgctactggaggcttgcatgagtttgctgatagccagttcggacactgcttcagttggggtgaaaacagagaggaagccatttccaatatggtggtagctctcaaggagctgtcgatccgaggggactttcgcactactgtggaatatctcattaacctgctggagacagagtctttccaaaacaatgatatagacactggctggctggattatctcatcgctgagaaggtccaggcagagaagcctgacattatgctcggcgtggtttgcggagccctgaatgtggctgatgccatgtttagaacctgcatgacggatttcctccactccctggagcgaggacaggtgctgcctgcagactcacttctgaacctagtcgacgtggagcttatatatggaggcgtcaagtatatactgaaggtggcgcgccagtcgctcacaatgtttgtgctgattatgaatggctgtcatatcgagatcgatgctcacaggcttaatgatggcgggcttcttctttcctacaatgggaacagttacacgacatatatgaaagaggaggtggactcataccgcattaccatcgggaacaaaacctgcgtatttgaaaaggaaaacgacccaacagtgctacgttccccttcggcaggaaaacttactcaatatactgtcgaggacggtggtcacgtagaggctgggtcctcttacgctgagatggaagtgatgaagatgattatgacattaaatgttcaggagagggggagagtgaaatacatcaaacggcctggcgccgtgctcgaggccgggtgtgtggttgctagactggagttggacgacccatccaaagttcacccggctgagccgtttactggggaattgcctgctcagcagactctccctatcctcggcgagaagttacaccaagtgtttcactctgtgctcgaaaatctgactaatgtgatgtcaggtttctgtctgcctgaaccagtgttcagcataaagctgaaggagtgggtgcagaaactgatgatgaccttgaggcaccccagtctgcctcttcttgaactgcaggagatcatgacctccgttgccggtagaattccagcccccgttgagaagagcgtgcggcgggtgatggctcagtacgcatctaacattactagcgtgctctgccagttccccagccagcagattgcgacgatcttagattgccatgcagcaaccctacagaggaaggcagaccgtgaagtgttcttcattaatacacagtcaattgtgcagctcgttcaatccaaggatgaactgtgcggtcccgatccttccttatctgacgaactcatcagcatactgaacgaacttacacaactctctaagagtgagcactgcaaggtagcactcagggcaagacaaatccttatagcaagtcaccttccttcctacgaactacgccacaatcaggttgaatctatttttctctcagccatagatatgtacgggcaccagttctgccctgagaatctgaaaaaactgattctatccgaaacaaccatcttcgacgtcctgcccaccttcttttaccatgccaacaaagtggtgtgcatggcaagcttagaagtgtatgttagacgcgggtatatagcatatgagctcaatagtctgcagcatagacagctgcccgatggaacctgtgtggttgagttccaattcatgctaccaagcagtcatccaaatcgtatgaccgtacccatcagcatcacgaaccccgatctgctgcgccactcgacggagctctttatggatagcggattcagccctttgtgccagcgcatgggcgcgatggtcgccttccgacgtttcgaagattttactaggaattttgacgaggtgatttcctgcttcgccaatgtccccaaagatacacccctcttctctgaagctcgaacatcgctgtactccgaggatgactgcaagagcctaagggaagagcctatccatatactgaatgtgtccatccaatgtgccgatcacttagaggacgaggcactggtccctatacttagaacatttgtccagagtaagaaaaatatactcgtggattacgggctgagacgcatcactttcctgattgcccaggagaaagagtttcccaaattctttacctttagagcccgagacgaatttgccgaggatcgcatttaccggcacttggaaccagccctggcatttcagctggaactgaaccgaatgcgtaattttgatcttaccgccgtgccttgtgctaaccacaagatgcacctatacctaggcgctgctaaagtgaaggagggcgtggaagttaccgatcatcgtttcttcatccgcgccatcatacggcactcggatctgattacgaaggaagcgtcctttgaatacctgcagaacgagggggaaaggctgctgttggaggccatggatgagttggaggtcgctttcaacaatacatccgtgagaaccgactgcaaccacattttcctgaatttcgtgcctacggtcattatggacccttttaagattgaggaaagcgtgaggtacatggtaatgagatacgggagcagactgtggaagctgagagtcctccaagcggaagtaaagatcaatatccgccagaccaccaccggctcggcggtgccgattaggctgttcatcactaatgagagcggatactacttggacatctctctgtataaagaggtcaccgatagtcgttcgggtaatatcatgtttcatagtttcggcaacaagcaaggcccacagcatggcatgctgatcaacaccccatatgtcactaaagacctcctacaagcaaaaagattccaggcccaaaccctggggactacctatatctacgacttccctgagatgtttcggcaggcactgtttaagctatggggctctccagacaagtatcccaaggatattttgacttatacagaattggtgcttgatagtcagggacagttggtggaaatgaatcgcttaccggggggtaacgaggtggggatggttgccttcaagatgcgcttcaaaacacaggagtaccctgaggggcgcgacgtaattgtgattggtaacgacatcacatttcgcataggaagcttcggaccaggcgaggacttgctctacctgcgggccagcgagatggcaagggcagagggaattcctaaaatctacgtcgctgctaacagtggagcacgcattggaatggcggaagagataaaacatatgttccatgtggcctgggtcgatccagaggatccacataaggggttcaagtatttgtacttgacccctcaggactacacacgtatttccagcttgaactccgtgcactgcaaacacatcgaagagggcggcgagtcccggtacatgattaccgacatcatcggcaaagacgatgggctgggcgttgagaatcttcgggggtcaggaatgatagcgggagagtcctccttggcttacgaggaaatagtcaccatctccctcgtgacctgcagggcaatcgggatcggcgcctatctcgtgcggcttggccagcgggtgatccaagtagaaaacagtcatatcatcctcacaggagccagtgcgcttaataaggttctgggacgggaagtctatacctccaataatcaattgggtggagtccagatcatgcactataatggggtcagtcacatcacagtgcccgatgacttcgagggggtatatacaatactggagtggctgtcctatatgcccaaggacaatcacagccccgttcctattatcaccccaacagaccctattgatcgcgaaatcgaatttctgccttctcgcgcaccctatgacccccggtggatgcttgcaggacgcccacacccaaccctcaagggaacttggcagtccggattctttgaccatggctcctttaaagaaataatggccccctgggctcaaacggtagtgactggacgggccagattagggggaataccggtgggggtcatcgcggtcgaaacccgaacagtggaagtggcagtgccggctgatccagccaatcttgatagtgaggcaaaaattatccagcaggccggccaggtttggtttcccgactctgcatacaagaccgctcaggcagtcaaggatttcaacagagagaaacttccactgatgatctttgctaattggcgcggattttcagggggaatgaaggatatgtatgaccaggtcctcaagttcggggcctacatcgttgacggcctgcgacagtacaagcagcctattctgatttatatacccccttacgctgagttgcgtggggggagttgggtggtgatcgatgccacaataaacccgctgtgcattgagatgtacgctgacaaggagagtaggggaggtgttctggaacccgagggaaccgtcgagattaaattccgcaagaaagacctgataaaatctatgagaaggattgatcccgcctacaaaaagctgatggagcagcttggcgaacctgatctgagcgacaaggataggaaagacctcgagggcaggctaaaagcccgcgaagatctgttgctccctatttaccatcaggtagctgtccagtttgctgattttcacgacacccccggccgtatgctggagaagggagttatctcagatatcctggagtggaaaacagcccgaacatttctgtattggcggctcaggaggctgttgcttgaagatcaggtgaagcaggaaattttgcaagcaagcggagagctttcacacgtgcatattcagtcaatgcttcgccgctggttcgttgaaaccgagggtgctgttaaggcctatctgtgggacaataaccaggtggtggtgcagtggctggagcagcactggcaggctggtgacggtcccaggtctacgattagggagaacataacttacctaaaacacgatagcgtgcttaaaacaatcaggggcctggtggaggagaatccagaggtggccgttgattgcgtcatctacttgtcgcagcacatctccccagccgagagagcgcaggtggtgcaccttctcagtactatggactctccagctagtacgtag

SEQ ID NO: 106807 - DNA, 5070 bp, Artificial Sequence
  Description of Artificial Sequence: Synthetic coding sequence
cttccattcctcctcaagccaccacagacactgccaagtcccgacgcgatgtttaggacgtgtatgaccgattttctgcactctctagagaggggtcaagtcctccctgccgatagcttgctcaatctcgtggatgtggagcttatttacggaggtgtaaaatatattctcaaagtcgcaagacaaagcctgactatgtttgtgctcatcatgaatgggtgccacatagaaattgatgcgcaccggttgaatgacgggggcctgctgctatcttacaatggaaacagttatactacgtatatgaaggaggaagtggacagttacagaattactatcgggaacaagacttgcgtgtttgagaaggagaatgaccctacagtgctgaggtcccccagcgcaggcaaacttacacagtacaccgtagaggatgggggacacgtggaggcaggttcttcctatgcagaaatggaagtgatgaaaatgattatgacattaaatgttcaggagcggggccgggtgaagtacatcaagcggccaggggccgtgctagaggctggatgcgtggtggcccggctggagctagatgaccctagtaaggtccaccccgctgaacccttcactggtgaactgccagcccagcaaacactcccaattctcggggagaaattacaccaggtgttccactccgtccttgagaacctgacaaacgtgatgtcagggttttgcttgcccgagcctgtatttagtattaagctgaaggagtgggtgcaaaaacttatgatgaccctgaggcaccctagcctgcctttgctggaactgcaggaaatcatgacatccgtcgcgggaagaatcccagctccggtggagaaatcagtgcgcagagtgatggcccagtacgctagcaacatcacctctgtcctctgtcagttcccctcccaacagattgcaacaatattagactgccacgctgccacattgcaacgcaaggccgaccgagaagtgtttttcatcaacacccagtccatcgtccagctggtgcagagatataggagcgggatccgcggatatatgaagactgtcgtgctggatttgctgcgacgatatctgcgtgtcgaacaccattttcagcaagctcattatgataaatgcgtgatcaatctccgagaacagttcaaaccagacatgtctcaggttctggactgtattttttctcacgcacaggtggcaaagaagaatcaactggtcatcatgttgatcgacgagctgtgcgggccggacccttcgttaagtgacgagctgattagcatcctgaacgaactgactcagctgagtaaatccgagcactgtaaagttgctctgcgggcgaggcagatcttaatcgcctcccacttgccgagttacgagctacggcataaccaagttgagtctatttttctctccgccatcgacatgtatggccaccaattctgtcctgaaaatctgaagaagcttatcctgagtgaaacgactatcttcgacgtgttgcccactttcttttaccatgccaacaaagttgtctgtatggcttccctcgaagtgtacgtgagacgtggctacatcgcttacgaactgaacagtctgcagcaccgccagctccccgatgggacatgcgttgtggaattccagttcatgctccctagctcacatccaaatcggatgaccgtgcccatatcaataaccaacccagatctcctgcgccactctaccgaactctttatggactccggctttagccccctgtgccagcgaatgggagctatggtggccttccggcgatttgaggactttaccagaaatttcgatgaggttatttcttgcttcgctaatgtgccaaaggatacaccactgttttcagaagcccgcacctccctttacagtgaggatgattgcaaaagtctaagagaagagccaatccacattctgaacgttagcattcaatgtgccgatcacttggaagatgaggcactagtccccatcctgcgcacctttgtacagagtaaaaaaaatatcctagtcgattacgggctacggaggattacctttctgatagcgcaagagaaagagttccctaagttctttacgttccgcgcacgagacgaatttgcggaagataggatatatcgtcacctggagccagccctggccttccaattagagcttaataggatgcggaattttgatttaaccgctgtgccttgcgccaaccacaaaatgcacctctacttgggtgctgccaaggtcaaagagggtgttgaggtaactgaccatcgcttcttcattcgggccatcatccgccacagtgacctcattaccaaggaggcaagcttcgaatacctccagaatgagggcgagcggctcctcctagaggcaatggatgagctggaagtggcatttaacaatacctccgtccgcacagattgcaaccatatctttttaaacttcgtgccaaccgtaatcatggacccattcaagatcgaagaatctgttcggtacatggtcatgcgttatgggagccggttgtggaaattgcgagtgctgcaagccgaagttaaaataaacattagacagacaacaaccgggagtgccgtcccaatacggctgtttattaccaatgagtccggctactatcttgacatttccctgtataaggaggtgactgattctcgtagcggcaatattatgtttcatagctttggcaataagcagggccctcagcatgggatgcttataaacacgccatacgtcacgaaagatctgttacaggccaagaggtttcaggctcagacattaggcactacatatatatatgacttcccagaaatgtttcggcaggccttgttcaagttgtggggttcaccagataagtaccctaaagacatcttaacctacaccgagctggtcctcgacagtcaaggacagcttgtggagatgaaccggctccccgggggtaatgaagtcggaatggtagccttcaaaatgcgctttaagactcaggagtacccagaggggcgtgatgtaatagtgattggtaatgatattacctttcgcattggcagttttggcccgggagaagatctgctctatttgcgtgcaagtgaaatggcgcgagctgaaggcatcccaaagatctacgtggcggcaaattcaggtgctagaatcggaatggctgaagagattaaacacatgtttcatgttgcatgggtcgatcccgaggacccacataaagggttcaaatacctgtatctgacaccacaagattatactcgcatcagcagtctgaactctgtacattgtaagcatatcgaggagggaggagagtcacggtacatgattacggatattataggcaaggatgacggacttggggtcgagaacctgagaggcagcgggatgatcgcgggcgagagtagcttagcttacgaagagattgtgaccatctctcttgtaacctgtcgtgccatcggcatcggcgcatatcttgtccgcctgggccagagggtaattcaagtggaaaactcccatatcatcttgactggagcaagcgctctgaacaaggtgctcggtcgcgaggtgtatactagcaataatcagctgggcggcgtgcagatcatgcactataatggggtcagtcatatcaccgtgccggatgactttgagggtgtctatacaatactggagtggctctcctatatgcccaaggacaaccactcaccagtacccatcatcacaccaaccgaccccatcgacagagaaattgaatttttaccttcaagagccccatatgatcctaggtggatgcttgcgggcagaccccatcctacgctgaagggcacctggcagtcgggctttttcgatcatggctcattcaaggaaataatggcaccatgggctcagaccgtcgttactggcagagcccggttgggggggatacccgtgggagtgatcgcagttgaaaccagaaccgtggaggttgctgtgcctgctgatcccgcaaacttggactctgaggctaaaattattcagcaggccggccaggtttggttccccgatagcgcttacaagacggcccaggccgtgaaggattttaatcgagaaaaattgccattgatgatattcgctaactggaggggcttttctggcggcatgaaagacatgtatgatcaggtgctgaagttcggggcttatattgttgatggactgcgacagtacaagcagccaatcttgatctacatccctccttatgccgagctaaggggaggatcctgggtagtaattgacgcaacgatcaatcctctttgcattgagatgtatgctgacaaggagtccagagggggtgtcttagagcccgagggcacagtggaaataaagttcagaaagaaagacctgattaagtccatgagaagaatagatcccgcatataaaaaactaatggaacagctcggggagcctgacctgtcagataaggaccggaaggatctggaggggagacttaaggcccgggaagatctgttgctacccatttatcaccaggtcgcagttcagtttgctgacttccacgacacacccggccgcatgctcgaaaagggcgtgattagcgatattcttgagtggaagacggctcgaaccttcctctactggagactgagaaggttgctgctagaagatcaagtgaagcaagaaatcctccaggcttctggcgaactaagtcatgtccatatccagagtatgctgcggagatggttcgtggagacagagggcgcagtaaaggcttacctgtgggacaataatcaggtggtggttcaatggcttgaacagcactggcaagcgggagacgggccgcgtagtaccatcagggaaaacattacctatttgaagcacgactccgttctgaaaacaatccgtggcctggtagaagagaaccccgaagtggccgtggattgcgtgatttacctgtctcagcatatctcaccagcagagcgcgcccaggtcgtgcatctgctgagcacaatggattcaccagcgagcacttag

SEQ ID NO: 106808 - DNA, 432 bp, Artificial Sequence
  Description of Artificial Sequence: Synthetic coding sequence
atgacagatagtaaacctatcacaaagtccaagtccgaagctaaccttatcccctcccaggagcccttccccgccagtgataatagtggagagaccccgcagcgcaatggggagggacatactctgcccaagaccccgagtcaagcagagccggcttcccataaaggcccgaaagacgccggtaggcgccgcaatagtcttccaccttctcatcagaaaccccctaggaatcccctgtccagcagcgacgctgcacccagtccagagctccaggcaaacggtacaggtactcaaggcctggaagccactgacaccaatgggttatcatcgtccgccaggccacaggggcaacaggcgggtagcccttctaaagaggacaaaaaacaggcgaacatcaagcgccagctcatgacgaactttatccttggctag

SEQ ID NO: 106809 - DNA, 2577 bp, Artificial Sequence
  Description of Artificial Sequence: Synthetic coding sequence
atgacagttcccatatctatcactaatccggatctgctcaggcattctactgaattgttcatggattcaggatttagccctctgtgccagcgaatgggggccatggtcgccttccggagattcgaagactttacgcgcaatttcgacgaggtcattagctgtttcgcgaatgtgcccaaggatactccgttgttttctgaggctcgtacttcactctacagcgaggacgactgtaaatccctacgcgaagaacccattcacattctgaatgtgagcattcagtgcgcagatcacctagaagatgaagcattagtgcccatactgcgcacgttcgtgcagtctaaaaaaaatatcctagtcgactacgggctcaggagaattacctttctgatagcacaggagaaggaatttcctaaattttttacattccgcgctcgggatgagtttgcagaagatcgcatttataggcacctggaacccgcccttgcgtttcagctggaactcaaccggatgaggaattttgatctcactgccgtgccttgtgccaaccacaagatgcacctctacttaggtgctgctaaagtcaaggaaggcgtcgaggtcactgatcacaggtttttcatccgggcgataattagacattccgaccttatcactaaagaggcatccttcgagtacctacagaacgagggcgaaaggctgctccttgaagccatggacgagctcgaagtcgctttcaacaacacctccgtccgaacagattgcaatcacatcttcctgaatttcgtgcccactgttattatggacccattcaaaatcgaggaatccgttcgatacatggtcatgcggtacggctcgcggctgtggaaactcagggtgctccaagcggaggtcaaaatcaacattagacagacaacaacaggctcagccgtgccaattcgtctctttatcacaaatgaatctggctattatctggacatctccctgtacaaggaggtgacggacagtcgctctgggaatataatgtttcactcatttgggaacaagcaggggcctcaacacggcatgctaattaataccccttatgtcacgaaggacctgctgcaagcgaaaagattccaggcgcagaccttaggtaccacatacatctatgactttcccgagatgttccgacaagcgctatttaagctatgggggtctcctgacaagtacccaaaggatatactgacttatactgagttagtcctggattcccagggtcaactggtggaaatgaataggctgcccggcggaaatgaggttggcatggttgcgttcaaaatgcggtttaagacccaagaatatccagagggccgggacgtaattgtgatcggcaatgatattacatttcggatcgggtcatttggtcccggagaagatctgctgtacctccgagcctcagaaatggcccgggcagagggcatacctaagatctacgtggcagcaaattccggtgcccgaatcggcatggcggaagagatcaagcacatgttccacgttgcatgggtcgacccggaagacccccacaagggatttaagtatttatacctcaccccacaggactacacaagaatcagtagcctgaattcagtacactgcaaacatatagaagagggcggagaatctagatacatgatcacagatataattggtaaggatgacgggctcggagttgagaatctccggggaagcgggatgatcgctggcgaaagcagcctcgcatatgaagagatcgttactatttcgctggttacctgcagagccatcggtataggcgcctacctggtgaggctaggccagcgggtgatccaggtagagaattcccatataattctgacaggagcgagtgctctcaataaagtgcttggccgggaagtatacacaagcaataatcaactcgggggagtacaaattatgcactacaacggagtgagccacattacggtcccagatgacttcgaaggggtctatacaatactcgaatggctgagttatatgcccaaggacaaccacagtccagtgccaattatcacacctactgatcccatagatcgcgaaatagaattcctcccttccagagccccttatgatcctcgttggatgctggcaggccggccccatccaaccctgaaaggcacatggcaatctgggtttttcgatcacgggagtttcaaggagatcatggccccttgggcccagactgtggtcaccggccgcgctagactgggcgggatcccagtcggtgtgatcgctgtggagacacggacggtagaagtggctgtccccgctgatcccgccaacttggatagcgaagccaagattatccaacaggcagggcaggtgtggttccccgattccgcttataagaccgcccaggccgtgaaggattttaaccgggagaagttaccactgatgatctttgctaactggagaggattttcaggtggcatgaaaggttgcctcgggacgtggcgcgatgtctcctggtggaagatcagagcaatgctgccaatgcatataggggagggtagtgtctag

SEQ ID NO: 106810 - DNA, 1038 bp, Artificial Sequence
  Description of Artificial Sequence: Synthetic coding sequence
atgggatcttccgaggaccaggcctatcgccttctaaacgactacgctaacggcttcatggtgtcacaggtcctgtttgcagcctgtgagctaggcgtgtttgatttgctggcagaggctccaggtcctctggatgtggccgctgtagcggcgggtgtgcgggccagcgctcacggcacggaattgctgttggacatttgcgtgagcctgaaacttcttaaggtggaaacccgcgggggaaaggctttttatcggaataccgagctctcttctgattacctaaccactgtctccccaacttcccaatgcagcatgctcaaatatatgggacgcacaagctatcgctgttgggggcacttggcagacgcagtacgcgaaggacggaaccagtacctggagacctttggggtccccgcagaagagctctttactgcaatatacagatccgaaggggaaaggcttcagttcatgcaggctttgcaggaagtctggtcagtcaacggccggtccgtgctcaccgctttcgacttgagcgtcttccccctgatgtgtgatctgggaggaggcgccggggccctcgccaaggagtgcatgagtctctacccagggtgtaaaataacagttttcgacattccggaggtggtgtggaccgcaaagcagcacttctcgtttcaggaggaagagcaaattgactttcaggagggcgatttctttaaggatcctttgccagaggccgatttatatatcctcgcacgggtacttcacgactgggccgacggaaagtgttctcacctgctggagcggatctaccatacttgcaagccgggaggaggaatattagttattgagtctctccttgatgaagatcggaggggacccctgttaacacagctgtacagcctgaacatgcttgttcagacggagggtcaggaaaggaccccaacccactatcatatgctgcttagctctgcgggatttcgcgactttcagtttaagaagacaggcgcgatatacgatgctatcttagcccgtaaatag

SEQ ID NO: 106811 - DNA, 897 bp, Artificial Sequence
  Description of Artificial Sequence: Synthetic coding sequence
atgggctcttccgaggaccaggcgtacaggctgcttaatgattatgctaatggcttcatggtgtcgcaggtcttgttcgctgcttgcgaactgggcgtgttcgacctgttagcagaggcgccaggccccctggacgtggccgccgttgccgccggggtaagagcgtcggcccacggtaccgagctgctcctggatatttgtgtctcgttgaaactgctcaaggtggaaacccggggcggaaaagccttctaccgcaacactgaacttagcagcgactatttgacaaccgtatctcccacttcccagtgcagtatgctgaagtatatgggccggacatcttatcgttgttgggggcaccttgccgacgcagttagggagggacgcaaccagtaccttgaaactttcggagtgcctgctgaggagttatttacagccatctatcggtctgaaggagagcggctgcagttcatgcaggctctgcaagaagtctggtccgtcaatggtaggagtgtactgacagcattcgacttatctgtgttccccttgatgtgcgacctgggcggcgatttttttaaggatccactgcccgaggcagacctgtatatactggcaagagtcttgcacgattgggccgacgggaagtgtagccaccttctggagagaatttatcatacatgcaagccaggaggtgggattcttgtcatagagtccctgcttgatgaggacaggaggggaccgctgttgacacagctgtattctctcaacatgctcgtgcaaacggaaggccaggagcggacgccaactcactaccatatgctgttgtcctccgcaggttttcgggactttcagttcaagaagaccggtgctatatacgatgctattcttgcaaggaagtag

SEQ ID NO: 106812 - DNA, 1122 bp, Artificial Sequence
  Description of Artificial Sequence: Synthetic coding sequence
atgggctcttctgaggatcaggcctatcggctgttgaacgactacgctaatggatttatggtgagccaggtcctgttcgccgcttgcgagctgggtgtctttgacttactcgccgaggctccagggcccctggatgtggcagccgttgcagcaggagtaagagccagcgcgcacggtacggagctcctgctggatatttgtgtgtccctgaagctgctgaaagtggaaacaagagggggcaaggctttttataggaacacagagttgtcctcagattatctaaccactgtttcgcctacatctcagtgctccatgctgaagtacatgggacggacatcatatcgatgttggggccatctcgccgatgccgtgcgagaaggtagaaaccaatacttagaaacatttggcgttcctgcagaagaactcttcacagccatttacagatcagagggcgaaagactacaatttatgcaggccctacaggaggtatggagtgtaaacggtcgctcagttcttaccgcttttgatctgagcgttttcccgctgatgtgtgacctgggtgggacctggataaaattggagacgattatcttaagcaagctgtcgcagggccagaaaaccaaacatagggttttcagcttgattggaggtgcaggcgccctcgccaaggagtgtatgagcttgtaccctggatgcaaaatcacagtgttcgacattccagaggtagtgtggacagccaaacagcactttagttttcaagaagaagagcagatagattttcaagaaggggacttcttcaaggacccacttcctgaggctgacctgtacattcttgctcgagtgctccacgactgggccgacggaaaatgtagccacttgctcgagcggatatatcacacttgcaaacctggtggcggaattttggtaatcgaaagcctgctggacgaagatcgtagaggacctctccttacacagttatactcccttaacatgctcgttcagaccgagggacaggaacgaacaccaacccactatcacatgctcctgtcctccgcgggatttcgcgactttcagttcaaaaagacaggagccatatacgatgctatccttgctcggaagtag

SEQ ID NO: 106813 - DNA, 375 bp, Artificial Sequence
  Description of Artificial Sequence: Synthetic coding sequence
gattgtcgcttaacctccgtatgtctaccgtgcgtaccaggagatttcttcaaggaccctcttccagaggcggatttgtatatcctggcaagagtcctccacgattgggccgacggaaagtgcagccacttgctggagcgtatctaccacacctgcaagccgggtggtggcattctggtaatcgagagtttgctcgatgaggacaggaggggaccgctgctgacccaattatacagcctgaatatgctggtccagaccgaaggacaggagcgcacgccaacccactatcatatgttgctgtcttccgccggatttcgggatttccagtttaaaaagaccggggccatttatgacgccattctggccagaaagtag

SEQ ID NO: 106814 - DNA, 711 bp, Artificial Sequence
  Description of Artificial Sequence: Synthetic coding sequence
atggagtctagcgccaagatggaaagcggaggggccggccaacagccccagccccagcctcagcagcccttcttacctccagccgcctgtttctttgctacagctgccgcagcagccgcagctgccgctgcagcagcggcccagtcagcccaacagcaacagcagcaacagcagcagcagcaacaagccccccagctgcggcctgccgccgacgggcagccatctgggggcggacataaatccgctcctaagcaggttaagagacagcgctcttcatcgcccgagttgatgcggtgtaaaaggaggctaaacttctccgggttcggttactctttaccccaacaacaacctgctgccgtcgcacgccgtaacgagagggaaaggaaccgtgtgaaacttgttaatctgggattcgcaaccctgcgggagcacgttcccaatggggccgccaacaaaaagatgagcaaggtggagacgcttcggagtgcagtggaatacatccgggccctccagcagctgttggatgagcatgacgcggtatctgcagctttccaggcaggggtacttagccccactatttccccaaactacagcaatgatctgaatagtatggccggcagtccagttagttcttatagctcggacgaaggctcatacgacccactcagcccagaagagcaagagctgctcgacttcacaaactggttctag

SEQ ID NO: 106815 - DNA, 582 bp, Artificial Sequence
  Description of Artificial Sequence: Synthetic coding sequence
atggacgggggcacgcttccacggagtgccccacctgctccacccgtgccggttggatgtgccgccagacggaggcccgctagtccggaacttcttaggtgttccaggcgcagacgccctgctaccgctgaaacaggagggggggccgcggctgtggcaaggcggaatgagcgggaacggaaccgcgttaaattggtgaatctcggattccaggctttgcgccagcacgtcccacacggaggggcaagcaagaagttaagtaaggtcgaaaccctccggtctgctgtggaatacattagagccctccagcgcctcctggctgagcacgacgctgtacgtaatgcactcgcggggggccttaggccgcaagctgtgagaccgtctgctcccagggggccccccgggactaccccagtcgccgctagccctagtcgggccagctccagtccaggccggggtggtagcagtgagccgggctccccgcgatcagcatattcctccgacgacagcggatgcgaaggggcgctctcacccgccgagagagaactgctggatttcagtagctggctgggaggatattag

SEQ ID NO: 106816 - DNA, 1542 bp, Artificial Sequence
  Description of Artificial Sequence: Synthetic coding sequence
atgtgtagccttggactgttccccccacccccgccacgtggccaggtgacactgtatgagcacaataacgagctagtgactggctcctcttatgaatctccacctcctgacttcagaggccagtggatcaatctccctgtgttgcaactgaccaaggaccccctgaagactccaggcagattggatcacggcacgagaaccgcttttatccaccacagagagcaggtatggaagcgctgcatcaacatttggagagatgtggggctgtttggagtgctgaacgaaatagctaattccgaagaggaagtgtttgagtgggtgaagacagcaagtgggtgggcgttagccttgtgtcgatgggcaagtagtctccatgggagcctgtttccacatttgagcctgagatctgaagatctcatcgctgaattcgcccaggtcacaaattgtactattgtgccatcgctcaaacatcgcctgcaaagaaacgtcgccagcctggcctggaagcccctctctgctagtgtgctcgcggtggcatgccagagctgcatcctgatttggacattggacccaacgagcctgtctacacgtccgagtagtggctgtgcacaggtcttaagtcacccaggacacaccccagtgaccagcttggcctgggctcccagtggcggcagactcctgtcagcatcaccagtggacgctgctattagggtctgggatgtatccacagagacgtgtgtccctttgccatggttccggggaggcggtgtaacaaacctgctctggtcccctgacggcagtaagattttggctactactccttcagctgtgttccgggtgtgggaagcacaaatgtggacttgtgaacgttggcccaccctgagcggaagatgccagacgggctgctggtccccagatggctctcgcctgttgttcacagttctcggtgagccgctcatatactctctgagctttcctgagcgctgtggtgaggggaagggttgcgtgggcggcgcaaagtcagccaccattgtcgccgacctttctgagacaacgatacagactcctgacggagaagaacgactcggaggcgaagcccacagcatggtttgggatcccagcggcgagcggctcgctgtcctcatgaaaggaaagccacgcgtgcaggatggcaagcccgtgatcctgctgttccgaacccgtaacagtccagtctttgaactgctgccatgcgggattattcaaggcgaaccaggcgctcagccacagctgatcactttccacccgtcctttaataagggcgccctgctgtccgtcggatggtcaactggcaggatagcccacattcctctttatttcgtcaacgcacagtttccaaggtttagtcccgtattaggtagggcccaggaaccaccagcaggaggtggggggtcgatacacgatttaccgttgtttaccgagacttctccaacgagcgccccttgggatcccctaccggggcctccgccagtgctgccacactctcctcactcccatctctag

SEQ ID NO: 106817 - DNA, 1683 bp, Artificial Sequence
  Description of Artificial Sequence: Synthetic coding sequence
atgccgcagacaagaagtcaagcacaggcaaccatatctttcccaaaaagaaagctgtcacgcgcactgaacaaagctaaaaactcttctgacgccaaactggagcctactaacgtgcaaacagtaacctgttcaccacgggtgaaggccctccctctgtccccacgcaagagattgggagacgataacctttgcaatactcctcacctgcccccttgctctcctccgaagcagggcaaaaaggaaaatgggcccccccactctcacacgctgaaggggaggcgtttagtgttcgataatcaactgacgatcaagtctccaagtaaacgcgagctggccaaagttcaccagaacaagatcctgtctagtgtgagaaaaagccaagaaattacaaccaattctgagcagaggtgtccactgaagaaggaatctgcttgcgtgcgtttatttaagcaggaaggcacatgttaccagcaggccaagctggtgctgaataccgctgtgccagacaggctccccgctcgggaaagggagatggacgtgataagaaatttcctccgcgagcatatttgtggaaagaaggcggggtccttgtacctgtccggcgctccaggtacggggaagacggcctgtctttcccgcatcctccaggacctgaagaaagaactgaaaggcttcaaaacaattatgctcaactgtatgagccttcgcacagcccaggcagtgttccctgcaatcgcacaggaaatctgccaggaggaagtgtcacggcctgctggaaaggacatgatgcgcaagctggagaaacacatgacagccgagaaagggccaatgatcgttctggtgctggatgagatggaccagttggatagtaagggacaggatgttttatataccctgtttgagtggccttggctgtctaattcacacttagtactgattggcatagccaatacactggatctcactgatagaatcctgccaagactccaagcccgcgaaaaatgtaaacctcagctcctgaatttccccccttacacaaggaatcaaattgttacaatcttgcaggatcgcctgaaccaggtttcacgagaccaagtcctggacaatgccgccgtgcagttctgtgcacgtaaagtatcagctgtgtccggggacgtgagaaaagccttggacgtgtgcaggcgagccatagaaatcgtagaatccgacgtgaagtctcaaaccatactgaagcccctttcagaatgcaagagccctagtgaacctttgatcccaaaaagggtaggcctcatccacatttcccaagtgatctctgaggtcgacggcaaccgcatgaccctgtcccaagagggcgcccaagacagcttcccactacagcagaagatcctggtgtgctcattgatgctgctcatcaggcaactgaaaattaaggaggtcaccctgggtaagctgtacgaagcctatagtaaggtctgcagaaagcagcaggtagctgccgtagatcagagtgagtgtttaagcctgtctgggttgcttgaggcaagaggcatccttgggcttaaaagaaacaaggaaaccagactgaccaaggtcttcttcaagattgaagaaaaggaaatcgagcatgccttaaaagataaggctcttattggcaatatcctggccaccggtctgccttag

SEQ ID NO: 106818 - DNA, 339 bp, Artificial Sequence
  Description of Artificial Sequence: Synthetic coding sequence
atggccgaacaggctaccaaaagcgtactcttcgtctgccttggaaacatttgcaggtctcctattgcggaggccgtattcaggaaattagtcactgaccagaacatctcagagaattggagagtggatagcgctgccacatccgggtatgaaatcggaaaccccccagattatagggggcagtcttgcatgaaaagacacgggattcccatgtcccatgtggcgagacaagtcccaagcctggacctgaagctttgcgtactttgcttttccgggagcctgacagctgtactgtttcttactggcacatgggccgggccccagacccaggagctgtag

SEQ ID NO: 106819 - DNA, 477 bp, Artificial Sequence
  Description of Artificial Sequence: Synthetic coding sequence
atggctgagcaggcaacgaaatccgtactgtttgtgtgtctcggcaacatttgcaggtccccaatcgcagaggcagtgtttcgaaagctcgttactgaccagaacatatccgaaaactggcgcgtggacagcgccgccacgagcggctacgaaattggaaatccccctgattacaggggacagagttgtatgaaacgccacgggatccctatgagccatgtcgccagacagataactaaggaggactttgctaccttcgattacattttgtgcatggatgagtcaaacctccgcgacttaaatcgcaaatctaaccaggtgaaaacctgtaaagcaaagatagagttactgggttcctatgaccctcagaaacaactgatcattgaagacccatattacggaaatgacagcgactttgagaccgtgtatcagcagtgtgttaggtgttgtagggccttcctcgagaaggcccactag

SEQ ID NO: 106820 - DNA, 477 bp, Artificial Sequence
  Description of Artificial Sequence: Synthetic coding sequence
atggcggaacaagcaactaagtcggtactcttcgtatgcctaggaaatatctgccgctcacctattgccgaagcggtattcaggaaactggttaccgaccaaaacatctccgagaattgggtgattgattcgggggccgtgtctgactggaatgtggggagaagcccggatcccagggccgtatcttgcttgcggaatcatgggatccataccgcccacaaggcccgccagatcactaaagaggatttcgctactttcgattacatcctttgtatggacgaatctaatttgcgtgatctcaaccgaaagagtaatcaggttaagacctgcaaagctaaaatcgagctgctggggagctacgaccctcagaagcaacttatcatagaggatccatattatggcaacgattcagactttgagactgtttaccagcagtgtgtgaggtgctgcagagcctttctcgaaaaggcacactag

SEQ ID NO: 106821 - DNA, 219 bp, Artificial Sequence
  Description of Artificial Sequence: Synthetic coding sequence
atggcggaacaggctacaaagagcgtgctgtttgtgtgcctcggtaatatatgcaggtcccccatagctgaagcagtttttagaaaactcgtgaccgaccagaacatttccgagaattggcgcgtggactcagccgctacaagcgggggaagtctcactgccgtgctttttctcaccggaacctgggctggcccccaaacgaagagctgcgcggcctag

SEQ ID NO: 106822 - DNA, 483 bp, Artificial Sequence
  Description of Artificial Sequence: Synthetic coding sequence
atggcaggcaaacgaagcggctggtctcgggccgccttgctccagctcttgctcggagtaaacctcgtcgttatgcccccaaccagagcaaggagcctgcgcttcgtcaccttgctgtacaggcacggcgacaggtctcctgtcaaaacgtatccaaaagatccatatcaagaggaggagtggcctcagggctttggccagctgaccaaggagggcatgctgcagcactgggagctcggtcaggcacttagacagaggtaccacggctttctaaatactagctatcataggcaggaggtttatgtgaggtcaactgattttgaccgcactctcatgtcagcggaggctaacctggctgggctttttcctcccaacggaatgcagcgttttaaccccaacatcagctggcagcctattcccgtccatactgtgcctataacggaggacagggtccgcgttgccagcccgtccctgggatggtag

SEQ ID NO: 106823 - DNA, 1272 bp, Artificial Sequence
  Description of Artificial Sequence: Synthetic coding sequence
atggccggaaaacgatcagggtggtcaagggccgctctgctgcagctgctgttgggagtcaatctcgttgtaatgcctcctacccgagctaggagcctgagatttgtaactctgctttatcgccacggggaccggtctccagtcaaaacgtatccgaaagacccataccaggaggaagagtggccacagggcttcggacagctgactaaagaagggatgctgcagcattgggaattgggacaggcgctgcggcagcgctaccatgggtttcttaacacgtcttatcatcgccaggaagtgtacgtgcgcagcaccgatttcgacagaacattaatgtctgcggaagcgaatttagccgggttgttcccccccaatgggatgcagagatttaacccaaatatctcctggcagccgataccagtgcatactgtccctattaccgaagacagactcctgaaattcccactcggtccttgcccacgttacgaacagctccagaacgagacacgccagacccctgagtaccagaatgaaagctctaggaatgcccagttcttagatatggttgccaacgagaccgggttgacggacttaacactggaaaccgtgtggaatgtttacgacacccttttttgtgagcagacccatgggctgcgtttgccgccctgggcgagcccgcagaccatgcaacggctatcccgcctgaaagacttcagttttcgcttcctgttcggcatctatcaacaggcagaaaaagcacgcctacaggggggtgttctgctggctcagattcgtaagaatctgacactcatggccacaacctcacagctccccaagctgctcgtctatagtgctcacgatacaacactcgtcgctctgcagatggcactcgacgtgtacaatggggaacaggcaccttacgccagctgtcacattttcgaactgtaccaggaagactctggtaatttttctgtggagatgtatttccgaaatgaaagcgacaaggcaccttggcccctgtctctgcccggatgtccacaccgttgccctctacaggatttcctgcgactcacggaacccgtcgtccccaaagattggcagcaggagtgccagctggccagcggaccggccgacacggaagtcatagtcgccctggcagtgtgcggaagtattttgttcctgctgattgtgttgttactgaccgtgctattccgaatgcaggcccagcctcctggttacagacatgtggctgacggcgaggaccacgcatag

SEQ ID NO: 106824 - DNA, 1176 bp, Artificial Sequence
  Description of Artificial Sequence: Synthetic coding sequence
atggctggaaagcgctcgggatggtcgagagccgcactgttgcagctgttactcggcgtgaatctggtggtgatgccccccacccgggcaaggagccttagattcgtaacccttgagggcatgctgcagcactgggaactgggccaagccctgaggcagcgatatcacggttttctcaacacgtcctatcataggcaagaagtgtacgtacgatccacagattttgatcggactctgatgtctgccgaagccaacttggcaggcctttttcctcctaacggcatgcagaggttcaaccccaatatcagctggcaaccaatccccgtacacacagtgcccatcacagaggaccggcttttgaagttccccctgggcccctgcccgcgatatgagcaactgcaaaacgagaccagacaaacccctgaatatcagaatgagagctcaaggaatgctcagttcctcgatatggtggccaacgagacgggcctgactgacttgacccttgagacggtgtggaatgtgtacgatacgctgttttgtgaacagacacatggattaaggttaccaccctgggcctccccacagaccatgcagagattgtcacgcctcaaagacttcagcttcaggtttctcttcggcatctatcagcaggctgaaaaggctcggctgcagggaggcgtgctcctggctcagattagaaaaaatttgacgttaatggccacaactagccagctgcctaagttgcttgtgtattctgcccatgacaccaccctggtggccctgcagatggcactggacgtctacaacggggaacaggctccttatgcttcttgtcatatctttgaattgtatcaggaagatagtgggaatttctcagtggaaatgtactttaggaatgagtcagataaagccccctggcctttgtcccttccaggttgtcctcaccgctgtccgctccaggactttttgcggttgaccgaacccgtcgtaccgaaagactggcagcaggaatgtcagctggcatcgggccccgctgatactgaggttattgtggctctggccgtgtgtgggagtatactcttcctgttgattgtgcttcttcttaccgtcttatttcgcatgcaagcccaaccacccggctatcgccacgtggcagatggagaagatcatgcctag

SEQ ID NO: 106825 - DNA, 711 bp, Artificial Sequence
  Description of Artificial Sequence: Synthetic coding sequence
atggtggccaacgaaacaggcctaacggatctgacgttggagacagtttggaatgtttacgataccctcttctgtgagcagacacacggcttaaggctgcccccctgggcttctccccagactatgcagcgtctatcccgtctcaaagatttcagttttcgcttccttttcgggatctatcagcaagccgaaaaagccaggttacaaggcggtgtcctgttagcccagataaggaaaaacctgaccctgatggccacaacctcccagctgcccaagctccttgtctactcagcccatgataccaccctcgtggcactgcagatggccctggatgtatacaacggcgagcaggctccttacgcgtcatgtcatatctttgagctctaccaggaagatagcggcaatttctctgtcgagatgtatttcagaaatgagtcggataaggccccgtggccactcagtctgccgggatgcccccatcggtgtccccttcaggacttcctgcggttaacagagcccgttgtgccaaaggactggcaacaggagtgtcagctcgcctctgggccagctgatacagaggtgatcgtggctctagcggtgtgtgggagtattctcttcctactgatagtactcctgctgaccgtcctgtttcgaatgcaggcccagcccccagggtatcggcatgttgctgatggggaggaccacgcttag

SEQ ID NO: 106826 - DNA, 1242 bp, Artificial Sequence
  Description of Artificial Sequence: Synthetic coding sequence
atggcaggcaaaagaagcggttggagcagagccgccctgcttcagcttcttctcggcgtgaacctcgtagtgatgcctcctactcgcgctagatcgctgagatttgtgaccctattgtacagacatggagaccgaagccctgtgaaaacctaccccaaagacccctaccaagaggaggagtggccacagggtttcggccaactgaccaaggagggcatgctgcagcggtaccacggctttctaaataccagttaccatcggcaggaagtgtatgtccgctccactgatttcgatcgcactcttatgagcgcggaggccaacctcgctgggctcttccccccaaatggcatgcagagattcaatcccaatatttcctggcagccaattcctgtccatacagtccctattaccgaagatcggctgctgaagtttccactggggccttgccctcggtacgagcagcttcagaacgaaactcgccaaacgccagagtatcagaatgagtcaagccggaacgcccagttcctggacatggtagctaatgaaaccggactgactgatttaacactggaaacggtttggaacgtgtacgacaccctgttttgcgaacagacacacggcctgagactccccccatgggcatcccctcaaaccatgcagaggctctcacgtttgaaggactttagctttagattcttgtttggcatctaccagcaggccgagaaggcaaggcttcagggcggagtcctgctcgcgcagatcaggaagaacctaactcttatggctaccacgtcccagttacctaagctcttggtatacagcgcgcacgacactactttggtggcacttcaaatggccctggacgtgtacaatggcgaacaagccccttacgcgagctgccacatttttgagttgtatcaggaagacagcggcaatttctccgtggagatgtattttcgaaacgaatcagataaagcgccttggcctctcagcctgccaggatgccctcacagatgccccctacaggattttcttcggttgaccgagcctgtggtccctaaagattggcagcaggaatgtcaactcgcctcgggaccggctgacaccgaggtgattgtggccctggctgtgtgtgggtccatcctctttttactgattgtgctcctgctgactgttttatttcgcatgcaagcccaaccgcctggctatcggcacgtggctgacggcgaggaccacgcttag

SEQ ID NO: 106827 - DNA, 978 bp, Artificial Sequence
  Description of Artificial Sequence: Synthetic coding sequence
atggatatgtggactgcactgttaattctgcaagcattactcttgccaagcctggcagatggggctactcccgcgttgcgatttgtggcagttggggactggggtggagttccaaacgctcccttccacaccgcaagagagatggccaatgcaaaagagatcgcccgaacagtccagattctgggcgctgatttcatacttagcttgggcgataacttttacttcactggcgttcaggatatcaatgataagcgcttccaggaaactttcgaggacgtgttcagcgaccgctccctgcgcaaagtcccatggtacgtactggcaggcaaccacgaccatctaggaaacgtgagtgctcagattgcttactccaagatatctaagcgttggaacttcccatcccctttctaccgtctgcatttcaagattcctcaaacgaacgtttccgtggccatttttatgttggacacagtaacgctctgcggaaatagcgatgatttcctgtcccagcagcctgagcggccaagagatgtgaagctggcaaggacccaactctcctggctcaaaaagcagttggccgccgcccgggaggactatgttttagtcgcgggtcattatcctgtgtggtccatcgctgaacacgggcccacacactgtcttgtgaagcagctgcgccccctgctggccacgtacggcgttacggcctacctgtgcgggcatgaccacaacctccagtatcttcaggacgagaatggggtgggctatgtactctccggagccggtaactttatggacccttccaagcggcaccagagaaaggttcctaacggctaccttcggtttcactacggcactgaggattctctgggcggcttcgcttacgttgaaattagctctaaggagatgacagtgacctatatagaggctagcggaaagtccctgttcaaaacacgtctgcctagacgcgcacggccctag

SEQ ID NO: 106828 - DNA, 1239 bp, Artificial Sequence
  Description of Artificial Sequence: Synthetic coding sequence
atgggctccccctggaacggcagtgacggcccagagggtgctagagagcccccatggcctgcccttccgccctgtgatgagcgccgatgttctcccttccccctgggcgcattggtgcccgtgacggccgtctgtctgtgtctgtttgtggtcggtgtaagcggcaatgtagttaccgtcatgctgattggcagatacagagacatgcgtaccactactaatctctatttgggttctatggcagtgtctgacctcctgatcttactcggtcttccttttgatctttaccggctctggagatcccgaccttgggtgtttgggcctctcctgtgcagattatccctgtatgtaggtgaaggatgtacatatgccactctattacatatgaccgcactgagcgtggaacgttacctagccatttgtcggcccttaagagctagagtcctcgttacccgaagacgggttcgcgccctgattgccgtcctctgggctgtggccctgctgtctgcagggcccttcctcttcctggtgggcgtcgagcaggaccccggaatatccgtggtgcctggcctcaatggtacggccagaatcgcatcaagtccactcgctagcagccctccactgtggctctccagggcgccccctccttctccgcctagcggccctgagaccgcagaggccgcagctctcttctcccgcgagtgcagaccatctccggcacagctgggtgccctgcgagttatgctctgggtgactaccgcgtacttctttctcccattcctgtgcctatccattttgtacggacttattggacgagagctctggtccagtcggcgccctctgcggggaccagcggcatccgggagagagagaggacatcgccagacagtgcgcgtccttttagttgtggtgcttgcattcataatatgttggcttccatttcacgtgggacgaatcatctacataaataccgaggactccagaatgatgtacttttctcagtatttcaatattgtggccctgcaactgttctacctgagcgccagtatcaatcctatcctgtataacttgatttccaaaaaatatagggctgcggctttcaagctcttattagctaggaaatctcggccgaggggattccataggtccagagataccgcgggtgaagtggccggcgacactgggggagacaccgtgggctataccgagacatcagctaatgtgaagacaatgggctag

SEQ ID NO: 106829 - DNA, 978 bp, Artificial Sequence
  Description of Artificial Sequence: Synthetic coding sequence
atggatatgtggacagccttgctgatcctccaggccctgctgttgccatccctagccgatggggccacccccgctttaagattcgtcgctgttggggattgggggggtgtgccgaacgccccatttcatacggcacgtgagatggctaacgcaaaagagattgcccgaacggttcagatattgggagcagatttcatcctgtccctgggggataacttctactttaccggcgtgcaagatataaacgacaaaagatttcaggagacgtttgaagatgttttctccgatcgtagcttaagaaaagttccttggtatgtgctcgctggcaaccacgatcatttaggaaacgtgagtgcacagattgcatactccaagatctctaagcggtggaactttcccagccctttctacaggctccactttaaaataccacagacaaacgtgtctgttgccatcttcatgctggacactgtcactctttgtggaaattcagacgatttcctgtcgcagcagcccgaacgcccccgagacgtgaaactggcacgcacccaactcagctggttaaagaagcagctcgccgcggctcgcgaggactatgttttagttgctggtcactatccagtctggtctattgcagagcatgggcccacacactgcctcgttaagcaactgagacccctgctggcaacttacggagtcacggcttatctttgtgggcacgatcacaacctccaatatctacaggacgagaatggggtcggatacgttctctctggcgccgggaatttcatggaccccagtaagagacatcagaggaaagtaccaaatggatacctgcgctttcactacgggaccgaggacagcctgggcggcttcgcttacgtagagattagcagtaaagagatgacagtgacatacatcgaggctagcggcaaaagcttgtttaagacccgcctccctaggagggctaggccttag

SEQ ID NO: 106830 - DNA, 978 bp, Artificial Sequence
  Description of Artificial Sequence: Synthetic coding sequence
atggatatgtggacagcccttctgatactacaggcgctactactgccatcgctcgcagatggtgctacacctgcacttagatttgtcgctgtaggcgactggggcggagtgccaaacgcccctttccatacagctagagagatggctaacgcgaaggagattgctaggactgttcaaatcctgggggcagactttatcctgtctctgggggacaacttctactttacaggggtccaggacatcaatgacaagagatttcaagagacttttgaggatgttttttcagatcgatcgctgcgaaaggtgccttggtacgtgctggccgggaaccacgatcatctaggcaacgtgagcgcccaaattgcctactcgaaaatatccaaacgatggaattttccctccccattctatagactgcacttcaaaatcccccagaccaatgtatctgtggctatttttatgctcgacacagttaccctttgtggtaattcagacgacttcctatcacagcaacccgaaagacccagagacgttaaacttgcccgaacacagctgagttggctcaagaagcagctcgccgcagctcgcgaagactacgtgctggttgccgggcattatccagtgtggtcaattgctgagcatgggccgactcactgcctcgtgaagcagctacgccctctgctggctacctacggtgtcaccgcttatctgtgtggtcacgatcacaatctccagtacctccaggacgagaatggcgtggggtatgtgctctctggagcgggcaacttcatggacccatctaaacgccatcagaggaaggtgcctaatggctaccttcggtttcattacggcaccgaggatagtctcgggggcttcgcttatgttgaaatctccagcaaggagatgaccgttacatatattgaggcctcaggaaaatcactctttaaaacccgactgccaagaagagctagaccgtag

SEQ ID NO: 106831 - DNA, 1161 bp, Artificial Sequence
  Description of Artificial Sequence: Synthetic coding sequence
atgcgagccgcgccactgctgttagcaagagccgcgagcctctcgcttggtttcctctttctcttgttcttctggctggaccggtcagttctggccaaggaactcaaatttgtcacactggtgtttcgacatggagatcgctcacccattgacacattccccactgatccaatcaaagaaagttcctggccccaaggcttcgggcagttgactcaattgggaatggagcagcactacgaactgggggagtacatccggaagcgctaccggaaattcttgaacgagtcctataaacacgaacaggtgtacatcagatctacagatgtagaccggacattgatgtccgcgatgactaatctggctgccctgtttccccctgaaggtgtgagcatctggaatcctattctcttatggcagcccattcctgtccatactgtgcctctgtccgaggaccaactactgtacctgcccttcagaaactgtccacgttttcaggagctggagagcgagaccttaaaaagcgaagaatttcagaagcgactccatccttataaggactttattgctacacttggaaagctgagcgggctgcatggccaggatcttttcggcatctggtctaaggtgtatgatccactgtactgcgagagcgttcataatttcactctcccctcgtgggcaacagaggatacaatgacgaagcttagagaacttagtgagctgtctctgctctccctctacggtatccacaagcagaaagaaaagtcccgcctgcagggtggtgttctggttaatgagatcctgaatcacatgaagcgagcaacccagattccctcttataagaaattgatcatgtattcagcccatgataccaccgtctcgggactccaaatggctctggatgtatataacggacttttgcccccatacgctagctgccacttgactgagttgtacttcgagaagggcgaatacttcgtggagatgtactacaggaacgagacccagcacgagccttatcctttgatgctccctggatgtagtccgtcgtgtcccctcgagaggtttgcagagctggtcggacccgtaatcccgcaggactggtctaccgagtgcatgactacaaatagccatcaaggaacagaggactcaacggattag

SEQ ID NO: 106832 - DNA, 1257 bp, Artificial Sequence
  Description of Artificial Sequence: Synthetic coding sequence
atgcgcgcagctcccctacttcttgctcgcgcagcttccttgtcactagggttcctatttctcctgttcttttggctcgacaggagcgtgcttgccaaagagttaaagttcgtcaccttggtgttcaggcacggcgaccgaagccctattgacacattccccactgaccctataaaagagagttcctggccgcagggctttgggcagctgactcaacttggcatggagcaacactacgagctgggagagtatattaggaagcggtaccgcaaattcctgaacgaatcttataagcacgagcaagtttacatcagaagcaccgacgtcgatcggaccttgatgtccgctatgactaaccttgccgccctgttccctcctgagggcgtgtcaatctggaaccccattcttctgtggcagcctataccagtgcacactgtgccccttagtgaagatcagctcttgtacttgccatttagaaattgccccagattccaggaacttgagtccgagaccttgaaatccgaggagttccaaaagcgattacacccttataaggacttcatcgctacactggggaaactgtctggactgcacgggcaggacctctttggaatttggagcaaggtgtacgatccgctgtattgtgagtccgtgcataatttcacactcccatcatgggctacagaggacaccatgacaaagctgcgggagctatctgaactgagcctgctaagcttgtatggcatccacaaacagaaagagaaatctagactgcagggcggtgttctggtcaacgaaatcctcaaccatatgaagagagcaacccaaattcccagttataaaaaattgatcatgtattctgctcacgacaccacggtgtctggcctacagatggccttggatgtgtacaatggcctcctccctccatatgcatcctgtcacctcaccgaactgtacttcgagaagggagagtatttcgtcgaaatgtactacaggaacgagacacaacacgaaccctatccactgatgctgccaggttgcagcccttcttgccctttggagaggttcgccgaattagtgggccccgttattcctcaggactggagcactgagtgtatgaccacgaatagccaccaagttttgaaggtcatttttgctgtggccttttgtctgatttcagcagtgctcatggttctcttatttattcacatccggcgtggcttgtgttggcaaagagagagttatggtaacatctag

SEQ ID NO: 106833 - DNA, 1281 bp, Artificial Sequence
  Description of Artificial Sequence: Synthetic coding sequence
atggcaggactcggcttttgggggcaccccgctggtccgctgttgctcctcctgctgttagtcctgccacctcgggcgcttcccgagggcccactggtgttcgttgcactggtcttccgacacggagaccgggcgcccctcgcctcttatccgatggacccccacaaggaagtagcctccactctttggccgagaggattaggacagctgaccaccgaaggggtacgtcagcagttggagctgggacgcttcctgagatctcgatatgaagccttcctctccccagaatatcgaagagaagaagtctatatacgtagcaccgactttgaccgaacactggagtcagcccaggcaaatctggccgggctttttcctgaggccgccccaggatctccagaggcaaggtggcgtccaatccctgtgcatacagtgcctgtagcagaggacaaactgctgcggtttcccatgaggtcttgcccgagatatcacgagctcttgagagaggccacagaggctgccgagtatcaggaagccctcgaaggatggaccgggttcctctcacgcctggaaaactttaccggcctctcactggtgggcgagcccctgagacgggcctggaaggtgctcgacactctcatgtgtcagcaggctcatggactgcctttacctgcgtgggcttcccctgatgtgctgcggacactggctcagattagcgcgttggacattggagcccatgtgggaccacccagagctgccgagaaagcccagctgactggcggaatactgctgaatgccattctcgccaacttctccagggtgcagagactgggcctaccacttaaaatggtgatgtattcagcccatgattctactctgctggccctgcagggggcactggggctctacgacggacatacaccaccttatgcagcctgtctcggatttgagttcaggaagcatcttgggaatccagctaaggacggtggtaatgtcacagtgtccctcttctaccgcaatgacagtgcccatctgcctctgcctctgtctctgcctggctgtccagctccctgtcctctcggcagattttatcagctgaccgcaccagcaaggcctccagcccacggcgtatcctgtcatggaccttatgaggctgctatcccccctgctccagtagtgccactgctggctggcgctgtcgcagtactggtggcgctgagcttggggctcggtttactggcctggaggccaggctgcctgagagcccttggcggtcctgtttag

SEQ ID NO: 106834 - DNA, 1002 bp, Artificial Sequence
  Description of Artificial Sequence: Synthetic coding sequence
atggccgggctggggttctggggccaccccgcaggacctctcctgctgctcctgctgcttgtgctcccacctcgagcactgcctgaaggacccctggtttttgtagccttggtcttccggcatggggatcgcgcacccctagctagctatcccatggaccctcataaagaggttgcttctacactgtggccccgtggtctaggacagctgacaactgaaggcgtccggcagcagctggagcttgggcgattcctcagatcccgatacgaaggctttctcagccgactggaaaacttcactggactctctctggtgggagagcccctgagacgggcctggaaagtccttgatacactgatgtgccagcaggctcacggactccctcttcccgcctgggcatccccagatgtgctacgcacccttgcacagatatccgctctcgacattggagcacatgtcggacccccgcgggcagcagagaaggcccagttgaccggaggcatccttctaaacgccattctggcaaatttctcgcgggtacagaggcttggactgcctctgaaaatggtaatgtactctgctcacgattccaccctgttagccctacagggagcactaggactatatgacggacataccccgccgtatgcagcgtgcctgggattcgaattcaggaaacacctaggcaatcccgcgaaggacggagggaacgtgaccgtgagcttgttctatcgcaacgacagcgcacatcttccactgcccctgtcactgcccggatgtcctgctccatgccccctgggccggttttaccagctgacagcccctgccagaccgcccgcacacggcgtgtcttgtcatggtccgtacgaagcagctattcctcctgcccctgtggttcccctactcgcaggagcagtcgccgttctggttgccctgtctctgggcctgggactgttagcttggcgtcctggatgcctaagggcacttgggggtccagtgtag

SEQ ID NO: 106835 - DNA, 633 bp, Artificial Sequence
  Description of Artificial Sequence: Synthetic coding sequence
atggaaatgggacggcgcatccacctcgaattgcgcaacagaacgccctccgacgtgaaggagctagttttggacaattcacgatcgaatgaaggcaagttggagggtctgaccgatgaatttgaggagcttgaatttctgtcgactattaatgtcgggctgacatctattgccaacctacccaaattgaacaagctgaaaaagctagagctgagtgacaatcgggtctccggtgggctcgaggtgctagctgaaaaatgcccaaacttgacccatctcaacctgtccgggaataagatcaaagacctgtcgaccatagagcctttgaagaaattggaaaaccttaagtcactggatctttttaattgcgaagtcaccaacttgaatgattaccgcgaaaatgtgttcaagctgctgccccagctcacttacctcgacgggtacgatcgggatgataaagaggcacctgattcagatgccgaaggctacgttgaggggcttgacgatgaggaagaggacgaagacgaggaggaatatgatgacgaggagggctacaatgacggagaggtggatgacgaagaagacaagaagaagaagaagaaaaagaaaaagaaaaaaaagaagaagaaatag

SEQ ID NO: 106836 - DNA, 750 bp, Artificial Sequence
  Description of Artificial Sequence: Synthetic coding sequence
atggaaatgggaagaagaatccacctcgagcttcgaaatcggacacctagtgacgtcaaagagctggtactggacaatagcagaagtaatgagggtaaactggaggggctgacagatgagtttgaggagttagaatttctaagtaccatcaatgtgggtttaacttcgattgctaatctgcctaaactcaacaagttgaagaaattagaattgagcgataatagggtctcaggtggattagaggttctggccgaaaagtgtcccaacctcactcacctgaatctcagcggaaacaagatcaaagatctgagtacaatagagccacttaaaaagctggagaacctcaaatccctggatttgttcaattgcgaggtaactaacctgaacgattacagagagaatgtctttaagcttctgccccaactgacctacctcgatggctatgaccgggacgacaaggaggccccagattccgacgcagaaggatatgtggagggcctcgacgacgaagaggaagatgaggatgaagaagagtacgatgaagatgcccaggtggtggaggatgaggaagatgaagacgaggaagaagagggcgaagaggaggacgtctctggtgaggaggaggaagatgaagaggggtacaacgatggagaggtggacgacgaggaggacgaggaagagttgggggaagaggagcgaggccagaagcgaaagcgagagcctgaagatgaaggagaggacgacgactag

SEQ ID NO: 106837 - DNA, 396 bp, Artificial Sequence
  Description of Artificial Sequence: Synthetic coding sequence
atggagatgggtaagtggatccatctggagcttaggaaccggacccctagcgacgttaaggagctcttccttgacaacagccagagcaacgagggtaaactcgagggcctcaccgatgaatttgaggagttggagctcctcaacaccatcaatattggcctgacttccatagccaatctgccaaagctgaacaaacttaaaaaactggaactgagcagcaacagagcctcagtcggactggaagtgctagcagagaaatgccctaatcttattcacctgaacctctccgggaacaagatcaaggacctcagtacaatcgagccactgaagaaactggaaaacctggaatcccttgatctctttacctgtgaagttacaaatcttaacaattactag

SEQ ID NO: 106838 - DNA, 807 bp, Artificial Sequence
  Description of Artificial Sequence: Synthetic coding sequence
atggaaatgaagaaaaagatcaatttggagctgcggaatcgtagtcccgaggaagtgaccgaactggtgttggacaattgcctctgcgtcaatggcgagatcgagggtctgaacgacacattcaaagagctcgaatttctgtctatggcgaatgttgaactaagctctttagccaggcttccctcactgaacaagctccgtaaactcgagttgagcgataacattatatccggaggcctggaggttctcgcggagaaatgtccaaatttgacttacttgaatctgagcggtaataagatcaaggatctgtctactgtggaggcactccaaaaccttaaaaacctaaagagtttggatctcttcaactgcgagataactaaccttgaggattacagagaatctatttttgaactgctgcagcagataacatacctggatggttttgatcaagaggataacgaagcccctgactccgaggaagaggacgatgaggacggggatgaggatgacgaggaggaggaagaaaatgaagccgggcccccggagggttatgaagaggaagaggaagaggaggaagaagaggatgaagacgaagacgaggacgaagacgaagcaggtagcgagctcggcgagggagaagaggaagtgggcctctcctacctgatgaaggaggagatccaagatgaggaagatgatgacgattatgtggaagagggagaagaggaagaagaggaagaggaagggggtctgagaggagagaagcggaagagagacgccgaggacgatggggaagaggaagacgactag

SEQ ID NO: 106839 - DNA, 411 bp, Artificial Sequence
  Description of Artificial Sequence: Synthetic coding sequence
atggaaatgaaaaagaaaatcaatctagagttacggaaccgctctcccgaggaagaggataacgaggccccagatagcgaggaggaggatgacgaggacggggacgaggacgacgaggaggaagaggaaaacgaagcgggccccccagaaggttacgaagaagaggaggaggaggaagaagaggaggatgaagacgaggatgaagatgaggacgaagccggctcggagctgggtgagggcgaggaggaggttggacttagttaccttatgaaagaggagatccaagatgaagaagatgacgacgattacgtggaggaaggcgaggaggaggaagaagaggaggaaggtggtcttcgtggagaaaaaagaaaacgtgacgcggaagatgatggtgaggaggaggatgattag

SEQ ID NO: 106840 - DNA, 663 bp, Artificial Sequence
  Description of Artificial Sequence: Synthetic coding sequence
atggctaacgtggaactgagcagtttagccaggctgccttcgttaaacaagttgaggaagctggagctatctgacaatattatttctggaggtctggaagtacttgccgaaaaatgtccgaacctcacttatctcaatttgtctggtaataagataaaagacctgtcaacggtagaggccttgcagaatctgaagaacctgaagtccctagacctcttcaattgcgagattactaaccttgaagattatcgtgaatctatattcgaactactgcagcagatcacatatttagatggattcgaccaggaagataacgaggcaccggattccgaggaggaggatgatgaagatggtgacgaggatgacgaagaagaagaagagaacgaggccggacctccagagggatacgaggaggaagaagaggaggaagaggaggaagatgaggatgaagacgaagacgaagacgaagcagggagcgagctgggagagggtgaggaggaggttggcctctcgtacctgatgaaggaagaaatccaggacgaagaagacgatgacgactacgtagaggaaggagaggaggaggaagaagaggaggaaggcggcctgaggggtgaaaagagaaaacgggacgctgaggatgacggagaagaggaggatgactag

SEQ ID NO: 106841 - DNA, 684 bp, Artificial Sequence
  Description of Artificial Sequence: Synthetic coding sequence
atggaaatgaagaagaaaatcaacctcgagctcagaaatcgttcacctgaggaggtgacagaactagtactggacaactgcctgtgcgttaatggcgaaattgagggccttaacgatactttcaaagagctggagttcctaagcatggcgaacgtggagttgtcaagcctggccagactcccgtcccttaacaagttaaggaagcaaaaccttaagaaccttaagtcgctggatctgtttaactgcgagatcaccaacttagaggactacagggaaagcatcttcgagctgctgcagcaaattacgtatcttgatggtttcgatcaggaggacaatgaggcaccagatagcgaggaagaagatgatgaagatggggatgaggatgacgaagaagaagaagagaatgaagcaggacctcccgaaggttacgaggaagaggaggaagaggaggaagaggaagatgaagacgaggatgaagatgaggacgaagccggttctgaactgggcgagggcgaagaggaagtggggctttcctacctcatgaaggaagagatccaagatgaagaggacgacgacgactatgtggaagagggggaagaagaagaagaagaagaagaggggggtctccgtggcgaaaagagaaagcgcgatgctgaggatgacggtgaggaggaggatgactag

SEQ ID NO: 106842 - DNA, 2076 bp, Artificial Sequence
  Description of Artificial Sequence: Synthetic coding sequence
atggacgggtgcaaaaaggagctgcctagactgcaggagccagaagaggatgaggactgttatattctgaacgttcaatcttcatccgatgatacaagcgggagctccgtggcccggcgagcacccaagaggcaggcaagctgcattctgaacgtgcagtcgcgcagtggggacacctctggatccagtgtggcacgaagagcacccaaacggcaggccagttcggtggttgtgattgacagcgatagcgatgaagaatgtcatacgcatgaggaaaagaaagctaagctgctcgaaatcaactccgatgacgagagtcctgagtgttgccacgtgaaaccagctattcaagagcctcccatcgtcataagtgatgatgataatgacgatgacaatggaaacgacctggaggtgcctgacgataactccgacgattcggaagcacctgatgataattcagatgattctgaagctcctgacgataacagtgacgattccgaagcaccagacgacaacagcgacgactctgaggcacccgacgacaactctgatgactctgatgtccccgatgacaacagcgacgactcatcggatgacaattcggacgactcctctgatgacaatagcgatgattcagacgtgcctgatgacaaatccgacgactctgatgtgcccgatgactcctctgatgattcggatgtgccggatgatagtagtgacgatagcgaagccccagatgattcatctgacgattctgaggcacccgacgacagctcagatgacagtgaggctccagatgactccagcgacgactctgaggctccagatgatagctccgacgatagcgaagcctctgacgatagcagtgatgacagcgaggcgagcgatgactccagtgacgatagtgaagcccccgacgataagtccgacgattctgatgttccagaggacaagtctgacgatagtgatgtccccgacgataattcagacgacctggaggttcctgttcccgctgaggacctctgtaatgaggggcaaatcgcctcagatgaagaagagctggtggaggcagccgcagcagtgtctcagcatgactcatctgacgacgcaggggagcaagatttgggggagaacttatcgaagccaccttccgaccccgaggccaacccagaggtaagtgaaaggaagctgcccaccgaagaagaaccagcaccagtggtggagcaatctggcaaacgcaagagcaagacaaagacaattgtggaacccccacgtaagcggcagacgaaaacaaagaacattgtggaaccacctcggaagagacagacaaagactaagaatatcgtagagcccctgaggaaacgtaaagcgaaaaccaagaacgtgtcagtgaccccaggccacaagaaaagggggcctagcaaaaaaaaaccaggcgcagctaaggtggaaaagcgaaagacaaggactcccaaatgtaaagttcctggatgtttcctccaggatcttgagaagagcaagaagtacagcggcaagaacttgaagcgtaacaaggacgaattggttcagcgtatctacgacctgtttaaccgtagcgtgtgtgacaaaaagttgcccgaaaaactacgtattggatggaacaacaaaatggttaagacagccgggctttgcagcactggggaaatgtggtaccctaagtggcggaggttcgccaagatacagattgggctgaaggtatgtgactccgcggacaggataagggacacactgatccatgaaatgtgtcatgctgcatcttggctcatcgacggtatccacgatagccatggcgacgcttggaagtactacgcccggaagagcaatagaattcaccccgagctaccccgcgtcactcgatgtcacaactataagattaactacaaggttcactatgagtgcacaggttgcaagacccgaattggctgctacaccaaatccctcgatacaagccggtttatctgcgcaaaatgtaaaggcagcctggtaatggtaccccttacacagaaggatggaacccgtatcgtcccacacgtgtag

SEQ ID NO: 106843 - DNA, 2076 bp, Artificial Sequence
  Description of Artificial Sequence: Synthetic coding sequence
atggatgggtgcaaaaaggagcttccgaggcttcaggaaccagaggaagatgaggactgctatatcttgaatgtgcaatcttctagcgatgacacgtctggctcctctgtggccaggagggcccctaaaaggcaggccagctgtatcctcaacgtgcaatcgagaagtggagatacaagcgggtctagcgtggcacgtagagcacctaagaggcaagcctcatcagtggtggtaattgactccgactctgacgaggaatgtcatacacacgaggaaaaaaaggctaaactgctggagataaacagcgatgacgagagcccagagtgctgtcacgtgaaacctgctatccaggagccgcccatcgtgatttctgatgacgacaatgatgatgacaacggcaatgacttagaggtgcctgatgacaatagcgacgacagcgaagcccccgatgataacagtgatgatagcgaagctcctgacgataatagtgacgacagtgaagcacctgatgacaactcagacgattctgaggccccagatgataacagcgacgattccgatgtgccagatgacaactctgacgactcctctgatgacaactccgatgatagcagcgatgacaattccgacgactcagatgtccctgacgacaagagcgacgactctgatgtccccgatgacagcagcgatgatagcgacgtgcctgatgactcttctgacgattctgaggcgccagatgattcctctgacgacagcgaagcccctgatgattccagcgacgattcggaagccccagacgactccagtgatgattcagaagctccggatgacagtagcgacgacagcgaggcgtcagacgactcctcagatgactcagaagccagcgacgactcctccgacgattctgaggctcctgacgataagtctgacgactcagatgtccccgaagataagagcgatgactctgatgtgcccgatgacaattctgacgatttggaggtccccgttcctgccgaagacctttgtaatgagggtcagattgcttccgatgaagaggagctggtcgaagctgctgctgccgtgtctcagcacgactcctccgatgatgctggagagcaagatctcggcgaaaacttatccaagccaccgagtgatccagaggctaaccctgaagtctcagagaggaaactgcccacagaggaggagcctgcccctgtggtggagcagagtggtaaacgaaagagtaaaactaaaacaattgttgaaccgcctcgcaagcgccagacgaagactaagaacatcgtggaacccccacggaagcggcaaacaaagactaagaatatcgtggaaccactgcgaaaaagaaaggccaaaacgaaaaacgtgtccgtcactccaggtcataaaaaacgaggacccagtaagaaaaagcctggcgccgctaaagtggagaagaggaaaacgcgcaccccgaagtgtaaggtgccaggatgctttcttcaggaccttgaaaagagcaagaaatacagcggaaaaaaccttaaacggaataaggacgaactggtccagcgaatttacgaccttttcaatcgttcagtgtgtgataaaaaactgcccgaaaagcttaggattggatggaacaataaaatggtcaaaaccgccgggctctgttccacaggcgaaatgtggtaccccaagtggcgccgcttcgccaagatccagatcggactcaaggtttgcgactcagcagacagaattcgagataccctcatccacgagatgtgccacgcggcaagttggttgatagatggcatccatgattcccatggtgacgcctggaagtattacgcccgcaaatctaaccgaatccatcctgaacttcccagagtcacccgttgccacaactacaaaatcaactataaagtccattacgaatgtacagggtgtaagacacgtatcggttgctatacaaaaagcctggacacttcccgctttatatgcgccaaatgcaaaggaagcctggtgatggtgcccctaacacagaaggacggcactagaattgtcccacacgtttag

SEQ ID NO: 106844 - DNA, 540 bp, Artificial Sequence
  Description of Artificial Sequence: Synthetic coding sequence
atggtgcaggcctggtacatggacgacgctcctggagatccccgccagccacaccgccccgaccctgggcggcccgtggggctcgagcaattgcggagactgggggtcctctattggaagctggacgcagacaaatacgagaacgaccccgagttggagaaaatccgcagggagcgcaattactcctggatggacatcatcactatttgtaaggacaaattaccaaactacgaggagaaaataaaaatgttctacgaagagcatttacacctggacgacgagattaggtacatcctggacgggagtgggtactttgacgtgagagacaaagaagatcagtggatcagaatcttcatggagaagggcgacatggtgactctgcctgccgggatctaccatcgattcacggttgacgaaaagaattacacaaaggcaatgcgcctcttcgtgggagagcccgtgtggacagcctacaaccggccagccgatcactttgaagcccgcgggcagtacgtaaagttcctggcccagactgcttag

SEQ ID NO: 106845 - DNA, 2670 bp, Artificial Sequence
  Description of Artificial Sequence: Synthetic coding sequence
atgtccaacccatttgcgcatctagccgagcccctggaccccgtccaacctggtaagaagttttttaacctgaacaaactggaggattccaggtatgggcgactgccattctcaattagggttttgcttgaagccgctatcaggaattgtgatgagtttctggtgaagaaacaagacatcgagaacatacttcactggaacgtgacacaacacaaaaacatcgaggtaccatttaagccagcacgggtcatcctgcaagacttcaccggggtgcccgccgtggtagatttcgctgccatgcgggatgctgtaaagaaactcggtggcgacccagaaaaaatcaacccagtttgtcctgcggaccttgtcatcgaccattcaatccaggtggacttcaaccgccgcgcggattctttacaaaaaaaccaggacttagaatttgagaggaaccgcgagaggtttgaatttctgaaatggggaagccaagcattccacaatatgcggattatcccccctggatccggcatcatccatcaggtgaaccttgagtacctagcgcgcgtggtcttcgatcaggacggctactattaccccgatagcctggtgggaacagattcccacaccacaatgatcgatgggctgggtatccttggctggggcgtgggcggaatcgaggctgaagctgtcatgctgggacagcccataagcatggtgttgccgcaggtgattggctatcggctgatgggcaaaccccatccactggtgacatctaccgacattgtgctaacaattaccaagcacctcaggcaagtcggagtggtcggcaagttcgttgaattcttcgggcccggtgtcgcgcagctgtctatcgcggacagagccaccatagccaacatgtgtccagaatatggagcaactgcagctttttttccagtggatgaggtgtcgatcacctacctcgtgcaaaccgggcgcgacgaagaaaagctgaaatacatcaaaaagtatctgcaggccgtgggcatgttcagagatttcaatgacccctcccaggatccagacttcactcaggtggtagagctggacttaaagaccgtggttccatgctgcagtggtcctaagcgaccccaggacaaagtggcagtgagtgatatgaagaaggatttcgagtcatgcctgggcgccaaacaggggttcaagggcttccaggtggctcccgagcaccataacgaccataaaacgtttatatacgacaacactgaatttacgctcgcccatggctcagtggttatcgctgccatcaccagttgcaccaatacctcaaacccaagtgttatgctcggggcaggcctgcttgcaaagaaggctgtcgatgccggtctcaatgtgatgccatacatcaagacctcactcagccccggatctggtgtcgtgacctattatctgcaggagtctggtgttatgccctacctctcccagctgggcttcgatgtggtggggtatggctgcatgacttgtattggtaacagcggccccctgcctgagccagtggtcgaggcgattacccagggagatctcgttgctgttggagtattgagtggcaacaggaatttcgaaggcagagtccatcctaacactagagcgaactacctggcctctccgcctcttgtcatcgcttacgcaatcgcaggtaccatcagaattgactttgagaaggaaccactgggcgttaacgctaaaggtcagcaggtgtttcttaaggatatatggcccaccagagacgaaatccaggctgtcgagagacagtatgtaatcccagggatgtttaaagaagtttatcagaaaatcgaaaccgtcaatgaatcttggaatgcattggcgactccttcagataagctgtttttttggaactctaaatccacctatatcaaatctcccccctttttcgagaatcttacccttgatctgcagccacctaaatctatagtagacgcctacgtgctgttgaatctgggcgactcagttactactgaccacatatcacctgctgggaacatagcccgaaactcccctgcagctagatatctcacaaaccgcggcctgaccccccgcgagtttaactcctacggttcccgtcgaggcaacgacgccgttatggcaagagggacctttgcgaacatcaggcttctcaaccggtttctgaacaagcaagctccccagacgattcacctgccctcaggagagattctggacgtgttcgatgctgctgagcggtatcagcaagcagggcttccacttatagtcctggccggcaaggagtatggcgcaggctcgagtcgggactgggcggctaaagggccatttcttctcggaattaaggccgtgctggctgaaagttacgaaagaattcaccgcagcaatctcgtgggcatgggagtcatccccttagagtatctgcccggagagaatgctgacgctcttgggctgaccggacaggaacgctacactattatcatcccggaaaatctaaaaccacagatgaaggtgcaagtgaagctagacactgggaaaaccttccaggcagtcatgcgttttgatactgacgtcgagctcacatactttctgaacggcgggatactcaattatatgattcgcaaaatggcgaaatag

SEQ ID NO: 106846 - DNA, 1305 bp, Artificial Sequence
  Description of Artificial Sequence: Synthetic coding sequence
atgtccaatccctttgcacacctcgctgaaccactggatcccgtccaacctgggaaaaagtttttcaacctgaacaaattggaggacagtcgctacggccggctgcccttctcgatcagggtactgctggaagcggccattcggaattgtgatgaatttcttgtgaagaagcaagatattgagaatatcttgcactggaacgtcactcagcacaaaaatatcgaggtgcccttcaagccggctcgggtgatcctgcaggacttcacgggcgttccagcagtggtagactttgcagccatgagagacgcagtgaaaaaacttggcggggaccccgagaaaattaatcccgtttgtcccgcagatctcgtgatcgaccactcaatacaagttgatttcaacagacgggcagattcattgcagaaaaaccaggatctcgaatttgaacgcaatcgggagaggttcgagttcctgaagtggggaagccaggctttccataatatgcgtattatcccacctggcagcggcataattcatcaagtgaatcttgagtatctggcacgtgttgtttttgaccaggatggatattactatccagattcgctcgtgggcactgacagccataccacgatgatcgacgggttggggattctgggctggggcgtcggcggaatcgaagcagaagctgtcatgctgggtcaacccatttcaatggtgctcccacaagtgattggttacaggttgatgggcaagcctcaccctcttgtgacctccacagacatcgtgctgaccatcaccaagcacctgcgacaagtgggcgtggtcggaaagttcgtagaattttttgggcccggcgtcgctcagctttctatcgctgatagggccactatcgctaacatgtgtcctgaatacggcgcaaccgcggcatttttccctgtcgacgaggtctccataacctacctcgtacagactgggagggatgaagagaaactgaagtacataaagaagtaccttcaagccgttggcatgtttcgggactttaatgatccatcacaggatcctgattttacgcaagtggtggaactagacctgaagactgtagttccgtgttgtagcggtcctaagaggccccaagataaagtggctgtcagcgatatgaaaaaggatttcgagtcttgcctgggcgcaaagcaagggttcaagggatttcaagtagctcctgagcatcataacgaccataagactttcatttacgacaatacagaatttactctcgctcacggttcggtcgtaatcgccgctttgtag

SEQ ID NO: 106847 - DNA, 2670 bp, Artificial Sequence
  Description of Artificial Sequence: Synthetic coding sequence
atgtctaacccatttgctcatcttgctgaacccctggacccagttcagccaggcaagaaatttttcaatctaaacaaactggaagattcccgatacggcaggcttccctttagtatcagggtgttactagaggccgcaattcggaactgcgatgagttcctggtcaagaagcaggatatagagaacatcctccactggaatgtaacccagcacaagaatattgaggtcccattcaagcccgccagggtcatactgcaagattttacaggcgttccagctgtcgtggattttgccgcaatgagagatgcggtcaagaaactgggtggcgaccctgagaagattaatcctgtgtgtcctgcagaccttgtgatagatcacagtatccaggtggattttaatcggagagccgactctctccagaagaaccaggacctcgagtttgagcgcaatagggagagatttgaattcctgaaatggggaagccaggcctttcacaacatgcggatcatccctccaggtagcgggatcattcatcaagtaaacctggagtacctggcacgcgtggtgtttgatcaggatggctactattaccctgatagtctcgtcggtactgattcccacactactatgatcgatgggttagggattttgggctggggcgttggaggcatcgaagcagaggccgttatgctcgggcagcctataagcatggttctcccacaagtgatcggatatcgcctgatgggtaaacctcatccgctggtgacctcgacggatatagtgctcacaatcaccaaacatctccgccaggttggtgtggtcggtaagtttgtggagtttttcggcccgggagtcgcccagctctcaattgctgacagagctaccatcgcgaatatgtgccctgagtatggagcaaccgctgcttttttccccgtggatgaggtttcaattacctacctggtgcagactggtcgggatgaggagaagcttaaatacattaagaagtatttacaggctgtgggcatgtttcgggatttcaatgaccccagccaggatccggatttcacgcaggtcgtggagctggacctcaaaactgtggtaccgtgttgcagtggaccaaaacgcccgcaggataaagtcgctgtcagtgacatgaagaaagacttcgaatcgtgtcttggggccaagcaaggcttcaagggtttccaggtggcccctgaacaccataatgaccataagacttttatttatgacaataccgaattcacgctggcgcatggctcagttgtaatcgcagcgattaccagctgcacaaatacttctaatcccagcgtgatgctgggagcgggattactcgctaagaaagctgtggacgccgggctgaatgtgatgccatatattaagacatccctgtcaccgggaagcggtgtggttacatattacctccaagagagtggagtgatgccatacttgtctcagctcggattcgatgtcgtaggctatggctgcatgacctgtatcggaaatagcggcccccttcctgaacctgtcgtggaagccatcacacagggcgaccttgtcgctgttggagtgctgtcgggtaataggaatttcgagggacgagtgcaccctaacacgcgcgcgaactacttagccagccctccactcgttatcgcatacgctattgctggcaccatcaggattgattttgaaaaggagccactaggggtcaacgcgaaaggtcaacaggttttcctgaaagacatctggccaaccagggacgagatccaggctgtggagcgacaatatgttattcctggcatgttcaaggaggtgtaccagaaaattgagaccgtcaacgaaagctggaatgccctggccaccccgtctgacaagctcttcttctggaacagcaaaagcacttacatcaagagcccccccttttttgaaaacttgaccctcgacctacagcctcccaagtctattgtcgacgcctacgttctgctaaacctcggcgactcagttacaaccgatcacatctctcccgctgggaacattgcccgaaacagccccgcagctaggtatctgaccaatcggggactcactccacgtgagttcaactcttacgggtccagaagggggaacgatgcggtcatggctcgcggcaccttcgctaatattcggctgttgaacaggtttttgaataaacaggccccacagaccatccaccttccttccggggaaattctggatgtttttgatgccgccgaacgataccagcaggctgggcttcctctcatcgttctcgctggaaaagaatacggggcagggagttcacgggattgggcggccaagggcccttttctcctggggatcaaagcagttctggcagagtcatatgaacgcatccaccggagcaacctcgtcggaatgggcgtcatacctttagagtatctgcccggcgagaacgccgatgcactggggctcactggacaggaaaggtacacaattatcatccctgagaatcttaagcctcaaatgaaagttcaagtgaagctggatacaggaaaaaccttccaagccgtgatgaggtttgacactgatgtagaactgacctacttcctcaatggcggtatcctgaattacatgattcggaagatggccaaatag

SEQ ID NO: 106848 - DNA, 2346 bp, Artificial Sequence
  Description of Artificial Sequence: Synthetic coding sequence
cagttagagcctaggtctgctcgcgaaagagtgccccttttaggatctggatccccggtagctggtgcccctccatgtagtcggcggaatacatggccctccgttataatgtccaacccatttgcacacctcgcagaacctctggacccagtccagcctggaaagaaattcttcaatctgaacaaattggaagacagtcggtacggcaggcttcctttctctattcgggtgctgttggaggccgctatccgaaactgtgatgagttccttgtgaaaaagcaggacatcgagaatatattgcattggaacgttactcagcacaagaacattgaagtgccttttaagcctgctcgggtgatcctccaggacttcaccggtgtgcccgcagtggtcgactttgctgccatgagggacgccgttaaaaagctgggcggggaccccgagaaaatcaatccggtgtgccctgctgacttggtcattgatcacagcatacaagtggactttaatcggcgcgccgattcactgcagaagaatcaggacctcgagtttgagcgcaacagggaaaggttcgagtttctcaagtggggaagtcaagcgttccacaacatgcggatcatacctcctgggagtggaataattcatcaggtgaatctggaatatctagcaagagttgtctttgaccaggacgggtactattaccctgattctctggtgggcactgatagccatacgacaatgattgatggccttggaattctgggctggggcgtgggtggaattgaagctgaggctgtgatgctggggcagccaattagtatggtgctgcctcaggttattggatatcggctcatggggaaacctcatcctctggtaacgtccaccgatattgtgctcaccatcactaagcatctgcggcaagtgggagtggtggggaagtttgtggagttcttcgggcctggggttgcccaactgagtatagccgatcgtgcaacaatagccaacatgtgtcccgaatacggtgcgacagccgccttcttccctgtggacgaagtgtccatcacttacctggtacagacaggacgagatgaagagaagctcaagtacatcaagaaatacctgcaggctgttggtatgttccgcgactttaacgacccttctcaggatccggattttacacaggtagtggagctggacctgaagactgtggttccttgctgtagcgggccgaaaaggcctcaagacaaggtggccgtctcagatatgaagaaagactttgaatcctgccttggtgccaagcagggctttaagggatttcaggtggctccggaacaccacaacgaccacaagacctttatctatgataatacagaatttacactcgcccatggaagcgtagtgatagccgccattacatcttgcactaataccagcaatccctctgtgatgcttggcgctggattgcttgccaagaaagctgtggacgccgggttgaacgtgatgccctacatcaagactagtctgtctcccggcagcggggtggtgacctattacctgcaggaaagcggcgttatgccgtaccttagccagctgggctttgacgtcgtaggatacgggtgcatgacatgcatcgggaactctggcccactgccagaaccagtcgtggaagctatcacacagggtgacctggttgcagttggggtcctctctggcaataggaatttcgaaggacgcgtacaccctaacaccagggccaactatctcgcctctcctcccctggtaattgcctacgcaattgctgggacaattaggatcgactttgagaaagaaccactgggcgtcaacgccaaggggcagcaagtattcctgaaggatatttggcccacaagggacgagattcaggctgtggagcgccagtacgtgatccctggcatgttcaaagaagtctaccagaagatcgagacagtcaatgagtcgtggaatgccttagctacaccttccgataaattattcttttggaactcaaaatctacatatatcaaatccccccctttcttcgagaatctgacacttgacctgcagccacccaagtccatcgtggacgcttatgttttacttaacctgggagacagtgtcacaaccgaccatatctcccctgctgggaacatcgcacgtaacagtcccgctgctaggtatttaaccaacagaggatttgagaggcaactgacccaggagaacacagacttgtgtcttagcccacctctcttgacttctctcagctctccccttaaactgtggggccagctattctgtcacggcgagcagtgcctgggggacctggaaaagtag

SEQ ID NO: 106849 - DNA, 2373 bp, Artificial Sequence
  Description of Artificial Sequence: Synthetic coding sequence
atgagggatgccgtcaagaagcttggaggagatcccgaaaagatcaatccagtgtgcccggccgatctagtgatcgaccacagtatccaggtcgattttaacaggcgcgctgattctctccagaagaaccaggacctggaatttgaacggaatagggagaggtttgaatttctaaaatggggtagtcaggcatttcataatatgaggataattcctcccggtagcgggattattcaccaagttaatttagaatatctggcacgggtcgtgtttgatcaagacggatattactaccctgactcactagtgggaacggacagccacacgacaatgatagacggcctaggcattctgggatggggtgtgggcgggattgaggctgaagccgtaatgctgggccagccaattagcatggtcctgccacaggtgatcgggtaccgtctgatgggaaagcctcatcccctggtaacatccacggacatcgtgttaacaatcaccaagcacttacgtcaggtgggggtcgtgggtaagttcgttgagttttttggaccgggagttgcacagttatcaatcgcagaccgcgcgaccatcgccaacatgtgtcccgagtatggcgcaacagctgcttttttcccagtggacgaggtgagcattacatacttagtgcagaccggacgggacgaagaaaagttaaagtatattaagaagtacttgcaagcagttggtatgttccgagacttcaacgaccctagtcaggaccccgactttactcaggtagtggagctcgacttgaaaacggtggtaccttgctgttccggcccaaaacgaccgcaagataaggtcgccgtgagcgacatgaaaaaagacttcgagagctgtctgggagctaagcagggctttaaagggttccaggtcgcaccagagcatcataacgatcataagacttttatatacgataacaccgagttcaccttggcacacgggtcagtcgtgatcgccgcaatcacgtcctgcaccaacacaagtaacccttccgtgatgttgggcgcgggactactggctaaaaaagctgtggatgccggactcaatgtcatgccttatattaaaacttcattgtcccccggttccggggttgttacttactacctgcaagaatcgggagttatgccctacctcagccagctggggttcgacgtggttggatacgggtgtatgacctgtatcggtaatagcggccctctgccagagcctgtggtcgaagccattacacaaggggatttggttgccgtcggtgtgctgtccggaaatcggaatttcgaggggagagtccaccccaatactagagccaattacctcgcctcccctcccctggtaatcgcatacgccatcgcaggcacaatcaggatcgattttgaaaaagaaccactgggcgtgaatgctaaaggccagcaggtgttcttaaaagatatctggcccacccgggatgagatacaggctgtggaacggcaatacgtcattcccggcatgtttaaagaagtttaccagaagatcgaaacagttaatgaaagttggaatgctctcgccacacctagcgataaactgttcttctggaactccaaatccacttatattaagagcccgcccttttttgaaaatctgactctggatctgcaaccccccaagtctattgtagatgcctacgtgttgctgaacctcggggactccgtcaccaccgaccacattagcccagccgggaacatcgctcgcaactcccccgctgcccggtaccttacgaatcgggggctgaccccaagagagttcaactcctacggctcacggagggggaatgatgctgtgatggcaaggggaaccttcgccaatattcggctgcttaataggtttctcaataaacaggcccctcagacaatccatctgcccagcggcgaaattttagacgtgtttgacgccgcagaacggtaccagcaggctgggctcccacttattgtcttggcaggaaaggaatacggtgctggcagttccagagactgggcagcaaagggcccatttctcttgggaatcaaggccgtcctggcggagagctacgagcgcattcacagatccaatcttgtggggatgggcgtcatcccactcgaataccttcctggggagaacgccgacgctttggggctgactggccaggaacgttacaccattatcattccagagaacctgaagccacagatgaaggtgcaggtgaagctggacaccggtaagacctttcaggcagtgatgagattcgacaccgatgtcgagctgacctactttctgaatggaggcattctcaactatatgattaggaagatggccaagtag

SEQ ID NO: 106850 - DNA, 333 bp, Artificial Sequence
  Description of Artificial Sequence: Synthetic coding sequence
atggcaaagcaccaccctgatctgatcttttgcagaaagcaggccggcgtggccatcggtaggctctgtgagaagtgtgacgggaagtgcgtcatctgtgactcctacgtgagaccatgcactctggtgagaatctgcgacgagtgcaattatggatcataccagggacgttgtgtgatttgcggcggccccggagtgagcgatgcatactattgtaaggaatgtaccatccaggagaaagaccgggacggatgccccaaaattgtcaatcttggctcttcaaagacggaccttttttacgaaaggaaaaagtatgggttcaagaagaggtag

SEQ ID NO: 106851 - DNA, 2418 bp, Artificial Sequence
  Description of Artificial Sequence: Synthetic coding sequence
atggctccttatagtctgctggtgacacgtctgcagaaggctctgggggtccgacagtatcatgtggcctctgtcttgtgtcagagagcaaaagtcgcaatgagccactttgagcctaacgagtacatacattacgacctcctcgagaagaatattaacatcgtgcgaaaacgattaaaccggcccttgacactaagtgaaaagatcgtgtacggccatcttgatgacccggccagtcaggaaatcgagaggggcaaaagttacctgcggctgcgcccagaccgcgtcgcaatgcaggacgcaactgcccaaatggcgatgttacagtttatttcgagtggtttaagtaaagtggctgtcccaagcacaatccactgtgatcatctgatcgaggctcaggtaggaggcgagaaggatctaagacgggccaaggacattaatcaagaggtttacaattttctggctaccgctggggcgaagtatggcgtcggtttctggaagccaggaagtgggatcattcaccaaattattctggaaaactatgcataccccggggtccttttgatagggacagattctcatacccctaatggcggcggtttaggaggcatctgcatcggtgtcggcggcgccgatgcggtggacgtgatggcggggattccttgggaactgaagtgcccaaaagtaataggggtgaagttgaccggttcactgtctggctggtcctcaccaaaggatgtcatccttaaggtagcaggaattcttaccgtaaagggggggaccggggctatcgtggagtatcacggcccaggggtcgacagcatatcatgcaccggggaagaggggggacaggctacgtggccattaccctgcgccggtcccgatgggtcccctgtcggcagtagatcggggatggcaaccatctgtaacatgggagctgaaattggagctaccacttccgtgttcccttacaaccaccgcatgaagaaatatctgagtaaaacggggcgagaggacatcgctaacttggctgatgagttcaaggaccatctggtgcccgacccaggatgtcattacgaccaactaattgaaatcaatctgagcgaactgaagcctcatatcaacggtcctttcacacccgatcttgcacaccccgttgctgaagtcgggaaagtcgccgagaaggaagggtggccattggatatccgggttggactgatcggttcttgcacaaactcgagttacgaagacatgggccggagcgctgctgtggccaaacaggcactggcacacggcctcaagtgtaagagccagttcactatcactcccggcagtgaacaaatcagagccaccatagagagagatgggtatgctcaaattctccgcgatctgggcggtatcgttctggcgaacgcatgcggcccatgtattggccagtgggatcggaaagatattaagaaaggggaaaagaacactattgttacttcttacaatcgcaacttcaccgggaggaatgacgccaatccggagacacacgcttttgtcacaagtcccgaaatagtgactgctctggccatcgccggcacactgaagttcaaccccgaaactgactaccttacaggtaccgacggaaagaaatttcgactggaagctccggacgctgatgagctgcctaaaggcgaatttgatccaggacaggatacctaccagcaccctcctaaagactcgtcgggccagcatgttgacgttagccctacctcacagcgactgcaactcctggaaccttttgacaagtgggacggcaaggatttagaggacctacaaattcttataaaggttaaaggtaaatgtacaactgatcatattagcgccgccggcccatggttgaagtttcgcggacatctcgacaacattagtaataaccttctgatcggagcaataaatatcgaaaacggcaaagccaatagcgttagaaacgccgtcactcaggaatttggccccgtgcccgatacagcccggtattacaagaaacacggaatacgctgggtggtcataggcgatgagaattatggtgagggcagcagcagggagcacgctgctctggaaccccgccacttaggagggagagcaatcattacaaaaagcttcgccagaattcatgagactaacctgaagaagcagggcctgcttccactgaccttcgcagatccagcagattataacaagatccatccagtggataagctgaccattcagggtctgaaagacttcactcctgggaaacctttaaagtgcattattaagcacccaaacggcacgcaagaaacaatcctgcttaaccacacctttaacgagacccagattgaatggttccgcgcaggatccgcgctgaatcggatgaaggagttacagcaatag

SEQ ID NO: 106852 - DNA, 1506 bp, Artificial Sequence
  Description of Artificial Sequence: Synthetic coding sequence
atggccactatttgtaacatgggggcagaaatcggtgcaactacatctgtttttccatataatcataggatgaaaaaatatctgtcaaagacaggccgtgaagatatcgccaacctggcagatgagtttaaggaccatctggtacctgaccccggctgccactacgatcagttaattgaaataaatctgtctgagttaaagccccacattaatgggcctttcacccccgacctggcccacccagtcgcggaggtaggaaaggtggccgagaaggaaggttggcctcttgacattagggtgggcctgatcggaagttgtactaatagctcatacgaagacatgggtcgcagcgcggcagtggccaaacaggctctggctcacggactgaagtgcaagtcccagtttacaatcacccctggcagcgaacagatcagagccactatcgaaagggatggatatgcacagattctgcgggatctggggggaatagtcctggctaatgcctgcggcccgtgcatcggtcagtgggaccggaaggacatcaagaagggcgagaagaatacaattgtcacttcttacaatcggaattttacgggccggaacgatgctaatcctgagacccacgctttcgttacaagccccgaaatagtcactgccttggccatagcgggaaccctcaaattcaacccagaaacagactatctgacgggtacagacgggaagaaattccgcctggaggcacccgacgctgatgagctgccaaaaggggagttcgaccccggacaagatacttaccaacacccccccaaggacagcagtggacaacatgtcgacgtgtcaccaacgtcccagcggcttcagttgctggagccttttgacaaatgggacggaaaggacctggaggatctgcagattctgatcaaagtgaaagggaagtgcaccaccgatcacatctccgctgccggaccatggttgaagttccggggtcacctcgacaacatttcgaacaacctgctgatcggggcaatcaatattgagaacggcaaggccaattcagtgaggaacgcagttacccaggaattcggccccgtcccagataccgctcgatactataaaaagcacgggatcagatgggtcgtgataggtgatgagaactacggggaggggtcgtcaagagaacacgctgccctggaaccacgacacttagggggccgggctatcatcactaagtcctttgctcgcatccacgagactaaccttaaaaaacaaggtttacttcctctgacgttcgctgatcccgcagactacaacaagatccacccagtcgataagctgacaattcagggtctgaaggattttaccccgggcaaacctctgaagtgtattatcaagcacccaaacggcacccaggagaccattcttctgaaccacaccttcaacgagacacagattgagtggtttcgagctggctccgcccttaaccgcatgaaggagctgcagcagtag

SEQ ID NO: 106853 - DNA, 2286 bp, Artificial Sequence
  Description of Artificial Sequence: Synthetic coding sequence
atggcaccgtattccctgctggtgaccagattgcagaaggctctcggcgtgcggcagtatcacgtcgcttccgtcctctgtcagagggccaaagtggctatgtcccacttcgagcccaatgaatatatccactacgacctgctggagaagaatatcaacattgttaggaaacgcctcaaccggcctttgacactctctgagaagattgtttatggccacctggacgacccagcatcacaggaaattgagcgtgggaaaagctatcttagattaaggccagaccgggtggcgatggtcgccgtgccctccacaattcattgtgatcatcttatcgaggcccaggtgggcggggagaaggatttaagacgcgcaaaagatataaatcaggaagtgtataacttcctggccacagccggcgccaaatatggcgtaggcttttggaaaccaggaagcggaatcatacaccagatcatattagagaactatgcctatccaggggtcttactgatcggcaccgattcacacacgcctaacgggggtggactcggggggatatgcatcggcgtgggcggtgcagatgccgtcgacgtaatggccggaatcccgtgggagctcaaatgccccaaggtgattggcgtgaagctgaccggctctctatctggatggtcctccccaaaggacgttatactgaaagtggccggaatcctcaccgtcaagggcggcacgggcgcaatagtggaatatcatggcccaggcgttgattcaatttcctgtacaggcatggctacaatttgtaatatgggcgcggagattggagccacaaccagcgtgttcccatacaaccacagaatgaagaagtacctgagtaagaccggtcgcgaggatatcgccaatctggccgacgagtttaaggaccatctggtgccggatccaggctgccactacgaccagctcattgagatcaatctgagcgaactgaagcctcacatcaacggcccatttacaccagacctggcacaccccgtggcagaggtgggcaaagtcgcagagaaggagggctggccattggacatccgcgtgggcctcataggctcatgtactaatagcagctacgaggacatgggacgcagtgctgctgtggcaaaacaagccctcgcccatggtctgaaatgtaaaagccagtttacgatcacacccgggtcagaacagattagagccactatagaacgcgacggctatgcccaaattctcagggatttaggggggatcgttcttgccaatgcctgtggtccctgcataggtcagtgggaccgcaaggacattaagaaaggcgagaagaacacgattgtgacctcatacaaccgaaactttacaggtcgcaacgacgctaaccccgagactcacgcatttgtgacctctccagaaattgtgacagccctggctatagctggtacactgaaatttaatcctgagactgactatttgacaggcacagacggcaagaagttccgtcttgaggctccagatgccgacgagctgcctaagggcgagtttgatcccggtcaggacacttaccagcaccctcctaaggactcttctggccagcatgtcgatgtgtcacctacttcccagcgtctccaacttcttgaacccttcgacaaatgggacggtaaggacctggaagatctgcagattcttatcaaggtgaagggtaagtgtacaactgatcatattagcgctgccggcccctggcttaaattccggggccacctcgataatatctccaataatctgcttatcggcgccatcaacatcgagaacggtaaagccaatagcgttagaaatgcggtaacgcaagaatttggcccagtcccagacactgcccggtattataaaaaacatgggattcgctgggtggtcatcggcgacgagaattacggagaaggctcctcacgggagcacgcagctctcgagccacgccatctcggtggccgagccattatcaccaagtctttcgctaggatacacgaaacgaacctgaagaagcagggacttctccctctgaccttcgcagacccggccgattacaacaaaattcatcccgtcgataagctcacaattcaagggctgaaagacttcacgcctggtaagccattgaaatgtatcatcaagcatccgaacgggacccaagagacaatactgttgaaccacacatttaatgagactcagatagagtggtttagagctgggagcgccctgaatcgcatgaaagagctgcagcagtag

SEQ ID NO: 106854 - DNA, 756 bp, Artificial Sequence
  Description of Artificial Sequence: Synthetic coding sequence
atggagttaagcgccataggagaacaggtgtttgccgtcgagtctatcaggaaaaagcgtgtcagaaaaggtaaagtggagtatcttgtcaagtggaagggctggcctccaaagtactcaacatgggagccggaggagcacatattagatccccgcctcgtgatggcctacgaagaaaaagaagaaagggacagggcctccggctacaggaagcgaggacctaaacctaaaagactcctcctccagcgcctgtacagtatggacctgaggagcagtcacaaggctaaggggaaagagaaattatgttttagcctgacgtgcccccttggttccggatccccagagggggtggtcaaagcaggggcacccgagcttgtggataaaggccctctggtccccacactgccgttcccgctgcggaagcctcgaaaggctcataaatatttgagactgtctagaaagaaattccccccacggggccctaatctggagtcccattctcacagaagagaacttttcctgcaggagccacccgcacctgacgttttacaagcagctggtgaatgggagcccgctgctcagccacccgaagaagaggccgatgcagatctcgcagagggccctccgccttggactcctgccctgcctagctccgaagtaactgtaacggacattactgccaactccataacagtaactttccgagaggcccaggcagcagaaggcttcttccgggacaggtcagggaagttctag

SEQ ID NO: 106855 - DNA, 633 bp, Artificial Sequence
  Description of Artificial Sequence: Synthetic coding sequence
atgaaccgcttcctgttgttgatgagcctatatctcctgggctcggcaagaggcacctcctcccaaccaaatgaactgtcaggttctattgatcatcaaacgagcgtccagcagctcccaggagagccagccgccacagagcacgcagagggcgagcataccgtgggggagcagcctagtggcgagcagcctagcggtgaacatttgtcaggtgagcagcctctgagcgagctggaatccggagaacagccatctgatgaacagccaagcggcgagcacgggtcaggagagcaacccagcggcgaacaggccagtggagaacagcccagcggtgaacatgcctctggtgaacaggcgagcggcgcccccatctcctcaacttccacaggtaccatcctgaactgttatacttgtgcctacatgaacgaccaaggaaaatgcctgaggggagagggaacttgcatcacccagaacagccagcagtgcatgctgaagaagattttcgagggtggaaaactccaattcatggtgcagggttgcgaaaatatgtgtccctccatgaatctattcagtcatgggactcgtatgcagatcatctgctgtcgtaatcagtcgttttgcaacaaaatctag

SEQ ID NO: 106856 - DNA, 741 bp, Artificial Sequence
  Description of Artificial Sequence: Synthetic coding sequence
atgaatcggtttctcctgttgatgtccctgtacctgctcggaagcgctagaggcactagctcccagcctaatgaactgagcggaagtattgaccatcagactagcgtgcagcagctgcctggagagtttttttctctcgagaatccttccgatgccgaggctctctacgagacttcttcgggcctcaacaccctttctgaacacggaagctcagagcatgggagttccaagcacacagtggctgaacacaccagcggcgagcatgccgaaagcgaacatgccagtggagagcctgccgctaccgagcatgctgagggcgaacacaccgtgggcgagcaaccttccggcgagcagccaagtggagaacatttaagcggcgagcagcccctgtctgagctggagtctggagagcaaccttctgacgagcagccatctggtgagcatggcagcggggagcaaccatcaggcgaacaggcgtctggtgagcaaccctcaggcactatcctcaactgctacacatgcgcatacatgaacgatcagggcaaatgtctgagaggcgaggggacgtgtatcacgcagaactcccagcagtgtatgctgaaaaaaattttcgaaggcgggaaacttcaatttatggtgcaggggtgcgagaacatgtgtccctccatgaatttgttttcccacggcacgaggatgcaaatcatttgctgcaggaaccagagtttctgtaataaaatctag

SEQ ID NO: 106857 - DNA, 468 bp, Artificial Sequence
  Description of Artificial Sequence: Synthetic coding sequence
atgaacagattcttgctgcttatgagtctctatttgctgggatcggcaagggggacctcctcccagcccaatgaactgtctggaagtatagaccaccagacctctgtacagcaactgccgggagagcagcccagtggagagcagccctccggggaacatctgagcggagagcaacctctgtctgaactggagtctggggagcaacccagtgatgagcagccgtctggtgaacacggcagcggagaacagccatctggtgaacaggcatcaggggagcagccatccggagaacatgcttcgggcgagcaggcttctggcgcaccaattagttctacctcaacaggcggcaaacttcagttcatggtgcaggggtgcgagaacatgtgcccgagcatgaacctcttctcacatggaaccagaatgcagatcatttgttgcaggaaccagagtttctgtaacaagatctag

SEQ ID NO: 106858 - DNA, 498 bp, Artificial Sequence
  Description of Artificial Sequence: Synthetic coding sequence
atgaacagatttctgctgctgatgtccctgtacctgctcggcagtgctaggggtacttcctcacagcccaacgagttgtccggttcaatcgatcatcagacctccgtgcagcagcttcccggggaaccagccgccacagagcacgcggaaggagagcacaccgtgggggagcaaccttccggcgaacagccatcgggagagcacgcctccggtgagcaagcttcaggtgctcccatatccagcacgagcacaggaacgatcctgaactgttacacttgcgcttacatgaatgaccaggggaagtgtctgcggggtgaagggacttgtataacccaaaattcccagcaatgcatgctcaagaagatatttgaaggagggaaactacaattcatggttcagggctgcgaaaatatgtgtccctcgatgaacctattttcccatggcaccaggatgcagatcatatgctgcaggaaccagtcgttttgtaacaaaatttag

SEQ ID NO: 106859 - DNA, 246 bp, Artificial Sequence
  Description of Artificial Sequence: Synthetic coding sequence
atgaacagatttctcctgctcatgagtctttatcttttggggagcgccagaggtactagtagtcagccaaatgagctctctggttctattgatcaccagacctccgtgcaacagctccctggtggtaagctgcagttcatggtccaaggctgcgagaacatgtgccctagtatgaacttgttcagccatgggacccggatgcagattatctgttgtcgaaaccagtcattctgtaacaaaatatag

SEQ ID NO: 106860 - DNA, 366 bp, Artificial Sequence
  Description of Artificial Sequence: Synthetic coding sequence
atgaacagatttctcctgttgatgtctttgtacctgctaggatccgcaagggggactagcagccaaccaaacgagctgagtggtagcattgatcatcagacgtctgtccagcagttacccggcaccatcctgaattgctatacatgcgcctacatgaacgaccaggggaaatgcctgcgaggagagggcacatgtatcacgcaaaacagtcagcagtgcatgctgaaaaaaatttttgagggtggcaagctacagttcatggtgcagggatgcgagaacatgtgcccttccatgaacctgttttcccacgggaccaggatgcaaattatctgttgccggaaccagtctttctgtaataagatttag

SEQ ID NO: 106861 - DNA, 588 bp, Artificial Sequence
  Description of Artificial Sequence: Synthetic coding sequence
atgaacaggttcctccttctcatgagcctgtacctgctcggaagcgcaaggggcacttcatcgcagcctaatgagctcagtggatcaattgaccatcagacatccgtccagcagcttccaggtgagcagccctctggagagcagccgagtggcgaacatctctcaggggaacagcctctgtccgaattggagtctggcgagcaaccctccgacgagcaaccatctggtgagcacggttccggcgagcagccaagcggagaacaggcttctggggagcagccgagtggagaacatgcctctggggaacaggcctctggagctcctatatcctctacctctacgggcactatcctgaactgctatacgtgtgcatacatgaacgaccagggaaagtgcttgcgcggcgaaggtacttgcatcacacagaacagccagcagtgtatgctgaagaagatttttgaaggagggaagttacagtttatggtccaaggatgtgaaaacatgtgcccatctatgaatctgtttagtcatggcaccagaatgcagattatctgctgtcgaaaccagtctttctgtaataaaatctag

SEQ ID NO: 106862 - DNA, 741 bp, Artificial Sequence
  Description of Artificial Sequence: Synthetic coding sequence
atgaaccgattcctgctgttaatgagcttatatctgttggggtctgctagaggaacttcctcccagcctaatgagcttagcggtagtatagaccaccaaacatctgtccagcagctgccgggcgagttcttttctttggaaaatcctagcgatgccgaggcgttgtatgagacttccagcggacttaataccctatccgaacatgggtcctctgaacacgggtcatcaaaacacacagtggccgagcatacctccggagagcatgctgagtctgagcacgcttctggagaacccgccgccaccgaacatgcggagggggagcataccgttggagagcaaccctctggggagcagccttctggggagcatttgtcgggtgaacaacccttaagtgagctggagagtggagagcagcccagcgacgagcagccatcaggtgaacacggatcaggggagcagccttccggtgaacaagcctctggggaacaaccatccggaaccattttgaattgttatacatgtgcctacatgaatgatcagggaaagtgtttacgtggagaggggacatgtattacgcagaacagtcagcagtgcatgttaaagaagatctttgaaggcgggaagctccagttcatggtacaagggtgcgagaacatgtgcccatccatgaatcttttcagccatgggacccggatgcagatcatatgttgccggaatcaatcattctgtaataaaatttag

SEQ ID NO: 106863 - DNA, 513 bp, Artificial Sequence
  Description of Artificial Sequence: Synthetic coding sequence
atgaacaggtttctcttgttaatgtcattatacctgctgggctccgccagagggacgagctcccaacctaatgaattgagtggtagtattgaccatcaaacatccgtgcagcaactgccaggggagcaaccgtctgatgaacaaccctccggcgaacacggtagcggtgagcagccatctggggaacaggccagtggcgaacagccatctggagaacacgcctccggcgagcaggctagtggggcacccatttcgagcacaagcactgggacaattctcaattgttatacctgtgcttatatgaacgatcaaggaaaatgcctgcgaggagaggggacttgcataacgcagaattcacagcagtgcatgttgaaaaagatcttcgagggaggaaaattgcagtttatggtgcagggatgcgagaacatgtgcccgagtatgaacctcttcagccacgggaccaggatgcagattatttgttgcagaaaccagtccttttgtaacaagatatag

SEQ ID NO: 106864 - DNA, 531 bp, Artificial Sequence
  Description of Artificial Sequence: Synthetic coding sequence
atgaatcgttttttactgcttatgtcactgtatctgctgggttccgctcggggcacttcgtcacagccaaacgagttgtccggctcgatagaccaccaaaccagcgttcagcagcttcccggagaacaaccatccggcgagcagccctccggagaacacctttccggagaacagcccctcagtgaactggaaagcggggagcagccatcagacgagcagcctagcggtgaacacggctccggtgagcagcccagcggagagcaggcttcaggtgagcagccgtctggcacaattctgaattgttacacatgcgcctacatgaatgaccaagggaaatgccttcgtggcgagggaacatgcatcactcaaaattcgcagcagtgtatgctgaaaaagatctttgaaggcggaaagctgcaattcatggtgcaggggtgtgagaacatgtgtcccagtatgaatttgttttcacatggcacacgaatgcagatcatttgctgtaggaaccaatcattttgcaacaagatttag

SEQ ID NO: 106865 - DNA, 588 bp, Artificial Sequence
  Description of Artificial Sequence: Synthetic coding sequence
atgaaccggtttctgctgttgatgtcactgtacctgctaggcagtgcccggggcacctcaagtcagccaaacgaattgagcgggtccattgatcatcagacttccgtgcagcagctccctggggagcagccatcaggcgagcagccaagtggcgaacatttaagtggcgaacaacccctctccgagctagaatcgggcgagcagcccagcgatgaacaaccatccggcgaacatggctccggcgaacagcccagcggcgagcaggcttcgggtgaacagccctccggagagcatgcatccggcgagcaggcgtctggggcccccatctctagcacttctactggcactatcctaaattgttatacctgtgcctatatgaacgaccagggtaagtgcttgaggggggaaggcacctgtattacacagaactctcagcagtgcatgctcaagaagattttcgaaggcggcaaactccagttcatggttcagggatgcgaaaatatgtgtccgtccatgaatttattttcccatggcaccagaatgcagattatatgctgtagaaaccagtcattttgtaataagatctag

SEQ ID NO: 106866 - DNA, 633 bp, Artificial Sequence
  Description of Artificial Sequence: Synthetic coding sequence
atgaaccgctttctgctgctcatgtccttgtaccttctgggatccgcaagggggacttcgagtcaaccaaacgagctgtccgggagtatcgaccatcaaacgagcgttcaacagctgccaggagaaccggcggccaccgagcacgccgagggcgagcacaccgtcggcgaacagccatctggagaacaaccatctggagagcatttgtccggggaacaacctttgagcgaactggagtcaggagaacagcccagtgacgagcaaccgagcggagaacatgggagtggggagcaaccatcaggcgaacaggcatccggggaacagccctcaggcgaacacgcctcaggggagcaggcatccggagccccaatttcttctaccagtaccggcaccatcctcaattgctatacctgcgcttacatgaatgaccaaggaaagtgtctacggggtgagggaacctgtatcactcagaatagccaacagtgtatgctgaagaagatcttcgagggcggaaaacttcaatttatggtacagggttgtgaaaacatgtgtccgtcaatgaatctgttttcccatggtacacggatgcagatcatttgttgccgcaaccaaagcttttgcaataaaatctag

SEQ ID NO: 106867 - DNA, 798 bp, Artificial Sequence
  Description of Artificial Sequence: Synthetic coding sequence
atgaatcgttttctgctgctcatgagcctatacttgttaggaagtgcccgcgggactagctcccagcctaatgaactgagcggcagtatagatcaccagacgtctgtacagcagctgccgggagaattcttttctctcgaaaacccctcagatgcagaagcgctttacgaaaccagcagcgggttaaatacgctgtcagagcatggcagttctgagcacggaagtagcaaacacaccgtggcggaacacacttccggcgaacacgctgagtctgagcacgcatccggcgagccggcggctacagaacatgccgagggcgaacacaccgtcggggaacaaccatcaggcgagcagccctccggggagcatctgtctggagagcaacccctgtccgagttggagtctggagagcaaccatctgacgagcagccttcgggcgagcacggctccggtgaacaaccttccggggaacaggcctctggggagcaacccagtggcgagcacgcctctggagaacaggcctcaggggcccccatcagctccacatccacagggaccatattgaattgctatacctgtgcctacatgaatgaccaaggtaagtgcttgagaggtgagggcacctgtatcacccagaactcacagcagtgcatgcttaagaaaattttcgagggggggaagctgcagtttatggtacagggctgcgaaaacatgtgtccaagcatgaacttgttttcacatggcaccaggatgcagattatttgttgtcggaaccagtccttctgtaacaagatttag

SEQ ID NO: 106868 - DNA, 1722 bp, Artificial Sequence
  Description of Artificial Sequence: Synthetic coding sequence
atgtctgccgttagccagccccaggcagccccttctcctctcgaaaaaagtccatctactgcgatcctctgtaatacgtgtggcaacgtgtgtaagggcgaggtcctccgcgtacaggacaaatacttccacataaaatgttttgtgtgtaaagcctgcggatgcgatttggcagagggcggcttttttgtgaggcaaggtgagtacatctgcactctggactaccagcggttgtatgggacacgctgtttctcctgcgatcagttcatagaaggcgaggtggtgagcgcactcggcaaaacctaccaccctgactgtttcgtgtgcgcagtgtgccggctacctttcccccccggggaccgcgtgacctttaacgggaaagagtgcatgtgccaaaaatgctccctgccagttagtgtgggttctagcgcacacttgagccaaggacttcggtcctgtggtggctgcggcactgaaattaagaatgggcaagcccttgtggcacttgacaagcattggcatttgggctgttttaaatgcaagagctgtggcaaactcctgaatgcagagtacatctcaaaggatggacttccttactgcgaggcagattatcacgcaaagttcgggattagatgtgattcgtgcgagaagtatatcacaggccgggtgctcgaggccggcgaaaagcactaccatcccagctgtgcgttgtgtgtcaggtgcggacagatgttcgcagagggggaagaaatgtacctacagggctcctcgatctggcatcctgcatgccgtcaagccgcccggactgaagatagaaataaagagacccgaacatcctccgagagtataattagtgtgcctgcctcctctacttctggtagtccctcgagagtgatatacgccaagctgggaggcgagatattagactaccgggatctggctgcgctgccaaaatcaaaggcaatttacgatatcgacagacccgatatgatcagttattccccttatatctcgcatagcgccggagaccgacagtcctatggggagggcgaccaagacgaccgctcttataaacagtgtcgcactagcagcccctcttcgaccggatctgtttcactgggaagatacacacccaccagtcgctcaccgcaacactatagccgtcccggcagcgaatccggacggtctacgcctagcttgtcagtgctgtccgatagcaaacccccaccgagcacgtaccagcaggcccctcgccactttcatgttcccgacacaggcgttaaggataatatatatagaaagccccccatatatcggcaacacgccgctcggcggtcagacggtgaggatggcagccttgaccaagataataggaagcagaagagcagctggctcatgcttaagggcgacgcagatactcgtacaaacagtcctgatctagacacccaatctctgagccatagttcagggacagatcgcgaccctctccagaggatggccggagacagctttcactcccgcgagaagatctatccttatgattcactgatcgttaccaatcgcatcagggttaagctgccgaaggatgtagatcgcacaaggctggagagacacctctcacccgaggaattccaggaagtgtttggtatgagcattgaggagttcgacagattggctctgtggaagcgaaacgatctaaaaaaaaaagcgctgttgttctag

SEQ ID NO: 106869 - DNA, 1041 bp, Artificial Sequence
  Description of Artificial Sequence: Synthetic coding sequence
atgttcgctgagggtgaggagatgtatttgcaggggtcaagtatatggcatccagcctgcaggcaggccgccagaacagaagaccgtaacaaagaaactcgcaccagttccgagtccatcatcagtgtgccagctagtagcactagcggctcgccttcccgagtgatatacgccaagctaggcggggaaatcctagactacagggacctggccgcccttcctaaatctaaggcaatttacgacattgaccggcccgatatgatttcttattcaccctacattagccattcggccggagacagacagtcctacggagagtccccacagctcctgagcccaacaccaaccgaaggagatcaggatgatagatcctataagcagtgccgcacctcatctccttcttctaccggcagcgtgtctctaggtaggtatacaccgacttctcgctctccacagcattattctaggcccgataccggggtgaaggacaacatttaccgcaaaccccccatttacagacaacacgccgccagaagatccgatggagaggacggtagccttgaccaagacaaccgtaaacagaaatcatcatggttaatgctgaagggtgatgccgatacacgcaccaactcccccgaccttgatacacagtcgctttctcactcatctggcaccgacagagatcccttgcagcggatggctggcgattcgttccacagtcgtttcccttactctaaatctgacccactgcccggtcacggaaagaatggtctagatcagcggaacgcgaatctggccccgtgtggggcggacccagatgccagttggggaatgcgcgagtataagatatacccatatgactcccttattgttaccaacaggattcgcgtaaagctacctaaagacgtggataggactagactagagcggcacctgtccccagaggagttccaggaggtcttcggaatgtccatagaggaatttgaccgcctggcactgtggaagaggaacgacctgaaaaagaaggctctgttgttctag

SEQ ID NO: 106870 - DNA, 1836 bp, Artificial Sequence
  Description of Artificial Sequence: Synthetic coding sequence
atgtctgcggtgagtcagccacaggcagccccttctccgttggagaagagcccttcgactgcaattctctgcaacacatgcggcaacgtatgtaagggggaggtgctgagggtgcaggacaaatattttcacataaagtgttttgtttgcaaggcctgcggctgtgacttagcagaaggggggttcttcgtcagacaaggtgaatatatttgcaccctcgattaccagcggctgtatggtacgcggtgcttctcctgtgaccagtttatcgagggagaagtggtcagcgccttgggcaaaacttaccatccagattgttttgtttgtgcggtttgccgactgccattcccacctggtgaccgtgtgacatttaacggaaaagaatgtatgtgtcagaagtgttcactgccagttagcgtaggttcatcagcccatctgtctcaaggcttgcgctcttgtggcggctgtggaactgagatcaagaatggacaggcactggtcgctctcgataagcactggcacctgggttgttttaaatgtaaatcctgtggtaagctgctgaacgccgaatacattagtaaggacggcttgccctattgcgaagcagactaccacgcaaagttcggcatacggtgtgattcctgcgaaaagtacatcactgggcgtgtcctcgaggctggcgagaagcattatcaccctagttgtgccttgtgtgtacggtgcgggcaaatgttcgctgagggcgaggaaatgtatctgcaaggtagctcgatctggcatcccgcctgtagacaggctgccaggacggaggaccgcaacaaagagacccggaccagcagcgagtccattatctcagtgccggcatcatctacgtccggctcgccgtccagagtgatatacgcaaagctcggcggcgaaattcttgactacagggatctcgccgctttgcccaaatccaaggccatttacgatatcgatcgccccgatatgatttcttacagcccctatatctcccatagtgctggcgaccgacaatcctacggggagggcgaccaggacgatcgttcatacaaacaatgtagaactagcagtccatctagtacagggagcgtgagtcttgggagatatacaccaacaagcaggtctccacaacattactccaggcccggctctgaaagcggtcgctctaccccttcattgtccgttttaagcgatagtaaacccccgccatcgacttatcagcaggccccccgtcattttcacgtccccgacactggagtgaaggacaacatttatcggaagcctcccatctaccggcagcacgcagctcgaagaagcgatggggaggacggaagtctggaccaggacaacaggaaaaagtccagttggctgatgctaaagggagacgccgataccaggacgaacagcccagaccttgatactcaatcactttcacactcatccggcacggacagagaccctctgcagcgaatggctggcgactcgttccatagccgattcccttactctaaatcagaccctctacctgggcacggaaaaaacggtctagaccaacgaaacgccaatttggccccatgtggcgcagatcctgatgcgtcctgggggatgagagagtacaagatatacccctacgattccttgatcgtgactaacagaatcagagtcaagctacccaaagacgtggatcggaccagacttgaaaggcatctttctccggaggagtttcaggaagtattcggcatgagcatagaggagtttgaccgcctggccttatggaaacggaacgatctcaaaaaaaaagcgctgctcttttag

SEQ ID NO: 106871 - DNA, 1719 bp, Artificial Sequence
  Description of Artificial Sequence: Synthetic coding sequence
atgtcagccgtgagtcagccacaggccgctccatctcctcttgaaaaaagcccgtccactgcgattttatgcaacacatgcggaaacgtgtgcaagggtgaagtgcttagggtccaggataagtactttcacattaagtgttttgtgtgcaaagcttgtggctgtgatctggccgagggaggattttttgtcaggcaaggggaatacatatgcacactggactatcagaggctgtatggcactaggtgcttctcttgcgatcagtttatcgaaggcgaagtggtcagtgccctggggaagacatatcatccagactgtttcgtttgcgccgtgtgcaggttgcccttccctcctggcgatcgcgttacttttaacgggaaagaatgcatgtgtcaaaaatgcagtttgcctgtgtcagtcggatccagcgctcacctatcccagggactgagaagctgtgggggttgtggaaccgagattaaaaatgggcaggctcttgttgcacttgacaaacactggcatttaggctgcttcaagtgtaagagctgtggtaaacttttgaacgccgagtatatctcaaaggatggcctgccatactgtgaagcggactaccatgcgaagttcggtattaggtgcgactcgtgtgagaagtacatcaccggccgggtcctcgaggctggggaaaagcactatcatccctcttgcgctctctgcgttcgctgcggccagatgttcgcagagggggaagaaatgtatctacagggtagcagcatttggcaccctgcatgtcgacaagcagcccggaccgaggaccgaaataaggaaacacgtactagctccgaatcgataatctctgtcccagcaagttctacgagcggctccccctcccgagtgatttacgccaaactcggaggcgaaattctggattacagagacctggccgccctgcccaaaagcaaggctatctacgacattgatagacctgacatgatttcttatagtccgtatatatcccattccgcaggcgaccgacaaagttatggcgagggtgatcaagacgatcggtcatacaaacagtgccggactagttcgccatcatctactggaagcgtttccctgggcagatatactccaaccagtcgttcaccacagcactactcacgacctggctccgagtctgggagatccacaccctctctctccgtgctgtccgacagtaagccgccaccttctacttaccagcaagcgcctcgacatttccacgtgcctgacactggcgttaaggataacatttatcggaagcctcccatatatcggcagcacgctgccagacgttccgacggggaggatggctccctcgaccaggataaccgcaaaaaaagttcatggttgatgttaaaaggagatgctgatactagaactaacagccctgatctcgatacccagagcctttcccactcatccgggaccgaccgtgacccactgcagcggatggcaggggattccttccacagtcaatataaaatctatccctatgactctctcatcgtgaccaacagaatacgggtgaagttgccgaaggacgtcgataggaccagactggagagacacttgtccccggaagagtttcaagaggtcttcggcatgagtatagaagaattcgaccgcctagccctgtggaaacgaaatgacctcaagaagaaggcattgctattctag

SEQ ID NO: 106872 - DNA, 1596 bp, Artificial Sequence
  Description of Artificial Sequence: Synthetic coding sequence
atgagtgctgttagccagcctcaggccgctccctctcccctggagaaatccccaagcacagccatcctgtgcaatacatgcgggaacgtgtgtaaaggggaagtgctgcgcgtgcaggataagtactttcatataaagtgcttcgtctgtaaggcctgtggctgtgatctagccgagggaggcttctttgtgaggcaaggggaatatatttgtactctcgactaccaacgtctgtatggcaccagatgttttagctgtgaccagttcatagagggagaagtggtgtcagcattgggtaagacgtaccaccccgactgcttcgtctgcgctgtgtgtaggctgcccttcccacccggagatagagtcacctttaatgggaaagagtgtatgtgccaaaaatgtagcctgcctgtgtctgttggctcatcggcccacctgagccagggtctacgctcatgcggaggctgtggcacagaaatcaagaacggccaggccctggttgccttagataaacattggcacctgggatgtttcaagtgtaagtcctgcgggaagttactcaacgcggagtatatctctaaggacggcctgccgtactgtgaagctgattaccacgccaaattcggtataagatgtgactcttgtgagaaatacattacaggaagggtgctagaagccggagagaagcactatcacccaagttgtgccctatgtgtgagatgtggtcaaatgtttgcagaaggggaggagatgtacctgcaggggtcatctatctggcacccagcatgcagacaggcggctcgcactgaggatagaaataaggagacccggacttcaagcgagtcgataattagcgtcccagcatcaagtacgtccggctcaccctctagggtgatctacgccaagctcggaggggaaatcttggactatagggacctggctgcccttccaaaaagcaaggccatttacgacattgaccgccccgatatgatttcgtattcaccgtatattagccattcagccggcgacagacaatcctacggcgagtccccccagctcttgagcccaacccccacagagggggaccaggacgatcgcagttacaagcagtgccggaccagcagcccaagctccaccggctctgtgtcccttggccggtatacccctacttcacggagtccacaacattactctcgtcccgcggccagacgatccgatggtgaggacgggagccttgaccaagacaacagaaagaaatcttcctggctgatgcttaagggggacgcagatacaaggaccaattctcctgacttagacacacagagcctatcccacagttcaggtacagacagagacccacttcagaggatggcaggagacagctttcactctcagtacaagatttatccttacgacagcctgattgtgacaaaccgtattcgggtgaagctgcctaaagacgtggatcgaacacggcttgaacgacacctgagcccagaagagtttcaggaggtatttggtatgtcgattgaggaattcgaccgattagccctgtggaaacgcaacgatctcaagaaaaaggcccttttgttttag

SEQ ID NO: 106873 - DNA, 1935 bp, Artificial Sequence
  Description of Artificial Sequence: Synthetic coding sequence
atgtccgccgtttcccagccccaggcagctccatcccccctcgagaaatccccaagtactgctatcctgtgcaatacttgtgggaacgtctgtaaaggggaggtgttacgcgttcaagataagtactttcacatcaaatgctttgtgtgcaaagcctgcgggtgtgacctagccgagggaggcttctttgtccgccagggtgaatacatttgtacactggactaccagagactgtatgggactcgatgtttcagctgcgatcagttcattgaaggggaagtggtttctgcactcgggaaaacttaccacccagactgttttgtctgtgctgtttgtcggctgcctttcccaccgggagacagagtaacattcaatggtaaggagtgcatgtgccagaaatgtagtctacccgtgtccgtaggcagctcagctcatctatcccagggcctcaggtcctgcggaggatgtggaactgaaattaaaaatggtcaggccctggtagccctcgataagcattggcatctggggtgcttcaagtgcaaatcctgcggcaagctcttgaatgccgaatatatttcgaaggatggactgccctattgcgaggccgattaccacgccaagttcggaattcggtgtgattcttgtgagaagtacattacaggaagagtcctcgaggctggagaaaagcactatcatccaagttgtgcactgtgcgtcagatgcgggcaaatgttcgctgaaggggaggaaatgtatctgcagggttcctcgatatggcatccagcctgtaggcaggctgccaggactgaggatcggaacaaagagaccagaacgagtagtgaaagcatcatctctgtgccggcaagcagtacttcaggcagcccctcacgagtgatctacgctaagttgggaggcgaaatcttagattacagagacctcgctgcactacctaagagcaaggctatctatgatatagatcgccccgatatgatttcttactccccgtacatctcccacagcgctggtgaccgccagagttatggagagggcgaccaagatgaccgcagctataagcagtgcaggacttcttctccctctagcaccggcagtgtgtccctcgggcgctataccccaaccagcagaagcccccagcattattcaaggcctgctggaacagtcagcgtaggaacctcgtcatgtttgtccctttctcagcacccttcccccacaagcgtgttccgacatcattacatcccatattttaggggttccgagtcgggaagatcaacaccttcactcagcgtgttgagtgattctaagccacccccacccccaacatctcgccatctggctacacatgtccccgatacaggcgtgaaagacaacatttataggaagccgcccatctatcgtcagcacgcagcccgcaggagtgacggagaagacggctccctggaccaggacaatcggaagcagaagagtagctggctgatgctgaagggcgatgccgacacccgaactaattctcccgacctggacacacagtcattgtcccatagttcagggacagacagggatcctctacagagaatggcgggggactcctttcatagcaggttcccctacagcaagtctgatcccctgcccgggcatggaaaaaatggactcgaccagcggaatgcaaacttggccccctgcggtgcagatccggacgcttcttgggggatgcgggagtataagatttatccttacgattcacttatagtcacaaaccggattcgggtaaaactgcctaaagatgtggatcggactaggttggagcggcacttaagcccagaggaatttcaggaagtgtttgggatgtccatcgaagagtttgaccgcttggccttgtggaagaggaatgaccttaaaaagaaggctctgctgttctag

SEQ ID NO: 106874 - DNA, 1566 bp, Artificial Sequence
  Description of Artificial Sequence: Synthetic coding sequence
atgtccgccgtctctcagccacaggccgcgccctccccactagagaagagtcctagcaccgcgatactgtgtaatacctgcggtaatgtctgcaaaggcgaggtattgcgtgtgcaggacaagtacttccacatcaaatgcttcgtctgcaaagcctgtggttgtgatctggctgaggggggattcttcgtccgccagggcgaatacatctgtaccctcgactaccagagactctacgggacacggtgcttcagctgcgatcagttcatagagggcgaagtcgtctccgctttaggcaagacttaccaccctgactgcttcgtgtgcgccgtgtgtcgactgcctttccccccaggcgatcgggtgacgtttaacggcaaagagtgcatgtgccagaagtgctcactcccagtctctgtagggagctctgcacatctttcacagggcctgcgcagctgtgggggttgtggtacagaaatcaagaacgggcaggccctcgtggctcttgacaagcattggcacctaggctgttttaagtgtaaaagctgcgggaaactcctcaatgctgaatatatttccaaagacggtttgccttattgcgaggctgactatcatgctaagttcggtatacggtgtgactcctgcgagaagtacataactgggagagttcttgaggcaggtgagaagcactatcatccgagctgcgccctgtgcgtgaggtgcggccaaatgtttgccgaaggggaggaaatgtatcttcagggcagctcaatctggcatccggcctgccgtcaggcggctcgaactgaggacagaaataaagaaactcgcacttcctctgagagtatcatttcggtgcctgcgtcttcgacttctggatctccatcccgggtaatctatgctaagttaggaggcgagatcctcgactatcgggatctggccgcgctacccaaatccaaggccatttacgatatcgacaggcctgatatgatctcctattccccatatatctctcactcagccggcgaccgtcagagctacggcgaaggagaccaggacgaccgatcctataagcagtgccgcacctctagccccagttctaccggctctgtttctttaggtagatataccccaacaagccgaagtccacagcactattcacgccccgcagcaaggcgttctgacggagaggacgggtccctagaccaggataacagaaagcaaaagtcttcttggctcatgcttaagggagacgccgacaccaggaccaatagtccggacctggacacccagtccctcagtcacagcagcgggactgaccgggacccgcttcagcgcatggcaggggacagctttcacagccaatacaagatctacccatacgactctctgatcgtcacaaatcgtatccgcgtgaaattgcctaaggatgtcgaccgaaccagactggagaggcatctctcacctgaggagtttcaggaagtattcggaatgagcatcgaagagttcgatcggctggcgctgtggaaaagaaatgacctgaaaaaaaaagccctgctgttctag

SEQ ID NO: 106875 - DNA, 1413 bp, Artificial Sequence
  Description of Artificial Sequence: Synthetic coding sequence
atgagcgctgtgtctcagccccaggccgctccgagcccacttgaaaagagccctagcacagccatactgtgcaacacttgcggcaatgtttgcaagggcgaggtactgcgggtgcaggataagtacttccacataaaatgttttgtttgtaaagcatgtgggtgcgatctcgcggaggggggtttttttgtgcggcaaggcgaatacatctgtaccttggactaccagcggctctacggaaccaggtgctttagttgtgatcagttcatcgagggggaggtagtctcagcactggggaagacttatcatcccgactgttttgtgtgtgccgtgtgcaggctcccattccccccaggtgaccgggtcacatttaacgggaaggagtgtatgtgtcagaaatgttccctgcccgtgtccgtgggaagctctgctcacctgtctcagggacttaggtcatgcggggggtgcggcactgagataaaaaacggccaagcactcgtggccctggataaacattggcatcttggatgcttcaaatgtaaatcctgcgggaagctgctgaacgctgagtacattagtaaggacggtttgccttactgcgaggccgactatcatgcaaaatttggcattaggtgcgacagctgcgaaaagtatatcacaggaagggttctggaggccggggagaagcactatcatccaagttgtgccttgtgtgtgcgctgcggacagatgttcgctgaaggagaggaaatgtaccttcaaggcagttcaatctggcaccctgcgtgtagacaggccgccagaacagaagaccgcaataaagagaccagaacgtcctcagaaagtatcatttccgttcccgcaagctctacttcgggcagcccttctagagtgatctacgcgaaattaggtggagagatcctggactaccgagacctagcggctctcccgaagtcgaaggcaatttatgacattgaccgacctgatatgatctcgtacagtccttacatctctcacagcgcaggcgaccgtcaatcatacggagaatccccccagcttttgagccctacacccaccgagggggaccaagacgaccgaagttataaacagtgtaggacctcctcaccttcaagtactggctcagtgagcctgggccggtacacccctacaagccgttcccctcaacattactcccgcccagcagcgagacgcagtgacggcgaagacgggagcctggaccaggataatagaaagcagaagagtagctggctaatgcttaagggtgacgctgacacaagaaccaacagccctgatctggatacccagtctttgtcccacagttccgggacagaccgagaccccctgcagcgcatggctggagatagcttccactcccgtgaatggttcttctag

SEQ ID NO: 106876 - DNA, 1938 bp, Artificial Sequence
  Description of Artificial Sequence: Synthetic coding sequence
atgtccgccgtgtcccagccccaggctgcgccttcaccgttagaaaagagccccagtacggcaattctgtgcaatacctgcggaaatgtgtgtaagggggaagtcctgcgagttcaagataaatacttccacatcaagtgcttcgtgtgtaaggcatgcggctgtgacttagctgagggcggattcttcgtcaggcagggggaatatatatgtacacttgattaccagaggctctatggtactcggtgcttctcttgtgaccaattcatcgagggggaagtagtctccgcgctgggcaagacctaccaccccgactgctttgtgtgcgccgtttgtcggctgccattccctcctggcgatagggtgacgtttaatggaaaggagtgcatgtgccaaaagtgcagtttgccagtcagcgttggctcttccgcccacctctctcaaggactgcgaagctgtggcgggtgcggtactgaaatcaaaaacggccaggcactggtggcattggacaaacactggcacctgggctgtttcaaatgcaagtcatgtggtaaattactcaacgcggagtacataagcaaggatggtctgccatactgtgaggcagactatcatgcaaagttcggcatcaggtgcgactcctgcgaaaaatacattacagggagagtgctggaagcaggcgagaaacactaccacccgtcctgcgctctgtgcgtccgctgtggacagatgtttgcagagggtgaggagatgtacctccagggatcaagcatctggcaccctgcctgcaggcaggcagccaggaccgaggatcgcaataaggagacaagaacctcttcggaatccatcatttctgttccagcaagctcaacgtctgggtcaccttcccgcgtgatatatgctaaactgggaggcgagatcctcgattatagagatctggcggctctccccaagagcaaagccatatacgatatcgataggccggacatgattagctattccccttatatttcccactcagcgggggacagacagtcttatggtgagggtgaccaggatgatcgatcttataaacagtgcagaacgtccagtccatcttccactgggtctgtctctttaggccgctataccccaaccagcaggtctccgcagcattactcccggccggctgggaccgtaagtgtcggcacaagcagttgtcttagcctcagccagcacccttctccgacctctgtgtttagacaccattacataccctatttccggggatctgagtccggccgctctaccccatccctctctgttttatcggatagcaagccaccccccagtacttaccagcaggccccgcgacattttcacgtccctgataccggagtaaaagacaacatctaccgcaaacctccgatatatcgccagcatgcagcgagacgatctgatggcgaggacggcagccttgatcaagacaataggaagcagaagtcttcatggctgatgctgaagggcgatgctgacactcgaacaaattcccccgacctggacactcaatctctgtctcacagttccggtacagatagggatcctctccaacggatggccggcgattcatttcactcccgatttccttactccaaaagcgacccacttcccggacacggaaagaacggtctggaccagcgaaacgcgaatctggctccctgcggcgctgatcctgacgcgtcatggggcatgcgggagtacaagatttatccctacgatagcctgattgtgactaatagaatccgggtgaagcttcctaaagatgtcgaccgaactaggctggaacgccacctgtcgccagaagagttccaggaggtgtttggaatgtctatcgaggagttcgacaggctcgcgctgtggaaacgtaatgacctcaaaaaaaaggctctcctcttttag

SEQ ID NO: 106877 - DNA, 1680 bp, Artificial Sequence
  Description of Artificial Sequence: Synthetic coding sequence
atgtcggccgtgtcacagccacaggccgccccaagtcctttagaaaagagtccatccactgcaattctgtgcaatacttgtggcaatgtttgcaaaggagaggtgcttagggtgcaggacaagtacttccacattaagtgttttgtgtgcaaggcctgtggttgtgacctggccgaaggaggttttttcgtccgtcagggcgagtatatctgcacactcgattaccagaggttatacggtactagatgcttctcctgcgatcagtttatagaaggcgaggtggtgagcgcactaggcaagacatatcatcccgattgcttcgtgtgcgctgtctgcaggctgccatttccacctggggatcgagttacttttaacggaaaagaatgcatgtgccagaagtgctctctcccagtctcggtcggaagttcagcccatctgtctcagggcctcaggtcatgcggcggttgcggcaccgagataaaaaatgggcaagcactagtggccctcgataaacattggcatctcggctgttttaagtgtaagtcgtgtggaaaattattgaacgccgaatacatatcaaaggatggcctgccctactgcgaggctgattaccacgctaaattcggaatccgatgcgatagttgcgaaaaatatattacaggccgtgtgctcgaggcgggagagaaacattaccatccgtcctgcgccctgtgcgtgaggtgtggccaaatgttcgctgagggagaagaaatgtacctgcagggatcaagtatctggcaccctgcctgcaggcaggcagcccgaactgaggatcgaaataaggaaacgagaacctcctctgagtctatcatcagtgttccagcctccagtaccagcgggagcccttcccgtgtcatctatgcaaaactgggaggcgaaatactggactaccgagatctcgctgctttacccaagtccaaagccatctatgatattgatagaccagatatgatatcttactccccgtatataagccattcggccggtgaccggcagtcctatggggaaggcgaccaggatgacagatcatacaaacagtgtagaacttcatctccttccagtaccggttccgtcagcctggggcggtatacccctacctcaagaagcccacaacattactcaaggcccgccgccagacggtcggatggtgaggatggcagtctggatcaggataatcgcaagaagagctcctggctcatgctgaagggcgacgcagacactagaacaaacagtcccgatctcgacactcagtcactctctcatagcagtggaacagatcgagaccccctccaacgcatggccggcgattcctttcactccagatttccctactcaaagagtgaccctctccccggccacgggaagaatggacttgaccaacgaaatgcaaacctggcaccttgcggagcagacccggatgcctcatggggcatgagagaatacaaaatatatccatacgattctctaatcgtcaccaatcggatccgcgtcaagctccctaaggacgttgacaggacaaggctagagagacatctgtcccccgaagaattccaagaagtgttcggcatgagcatagaagagttcgatagactggccctatggaaaagaaacgacctcaagaaaaaggccctgctgttctag

SEQ ID NO: 106878 - DNA, 1041 bp, Artificial Sequence
  Description of Artificial Sequence: Synthetic coding sequence
atgttcgctgagggcgaggagatgtacctgcagggaagctcgatttggcacccagcatgcagacaggcagcgagaactgaggacagaaacaaggagactcggacctcttcggaatccattatcagcgtaccggcgagctccacatcaggcagccccagccgggttatctatgccaaactagggggtgaaatattagattatagggatctagcggctcttccaaaatccaaagccatttacgatatcgatcggccggacatgatatcgtactcaccctacatctcacactcagctggcgaccggcagagttacggggagtcacctcaattactttcccctacccctaccgaaggagatcaagacgatcggtcctacaagcagtgcaggacctcatccccgtctagtaccggatcagtcagcctgggccgatacactcccacctctaggtcaccacagcattacagccgtccagacactggtgttaaagacaatatatacaggaagccaccaatctatcgccaacacgccgctcgccgtagtgatggcgaagacgggtccctggatcaggacaacaggaagcaaaagtcctcatggctgatgttaaagggcgacgcagacacgcgaaccaacagtcccgatctcgatacacagtccctgtcccattcttccggcacggaccgggatcctttgcagcgcatggctggagatagcttccacagtcgattcccttatagcaaatctgacccgttaccgggccatggaaagaacgggttggaccaaagaaacgccaatctcgccccttgtggcgcggacccagatgcctcttggggaatgagagagtataaaatctacccatatgacagcctgattgttaccaaccggattcgtgttaagttacccaaggacgtcgataggacacgattagagcggcacctatctcctgaggagtttcaggaggtgttcggtatgtcaattgaggagttcgatagactggccctttggaaacggaacgacctgaaaaaaaaggccttgctgttttag

SEQ ID NO: 106879 - DNA, 1716 bp, Artificial Sequence
  Description of Artificial Sequence: Synthetic coding sequence
atgtccgcagtgtctcagccgcaggcggctcccagtccactggaaaagtccccgtctacagctatcctgtgtaacacctgcggcaatgtatgtaaaggcgaagtccttagggtgcaggacaagtattttcatatcaagtgttttgtatgtaaggcttgtgggtgcgacttagctgaaggcggttttttcgtgagacagggggaatacatctgtactctcgactatcagcggctgtatggtacaagatgcttttcttgtgaccagttcatcgaaggcgaagtggtgtctgcactgggcaagacctaccaccctgactgtttcgtgtgcgcggtgtgcaggttgccttttccccctggagaccgggtcactttcaatgggaaggaatgcatgtgtcagaaatgtagtctgcccgtgagcgtcggtagctctgctcatctgagtcagggtctgcgcagctgtggaggctgtggcaccgagattaagaatggacaggcactcgttgccctcgataaacactggcatctgggctgcttcaagtgcaaatcttgtgggaagctcctgaacgcagagtatatcagcaaggatggactgccgtactgcgaagcagactaccacgcaaagtttgggatccggtgcgactcatgtgagaaatatattacagggagggtgcttgaggccggcgagaaacactatcaccccagttgcgccttgtgcgttagatgcggacagatgttcgctgagggcgaagagatgtacttacaggggtctagcatatggcatcccgcctgtcgccaggccgctcggaccgaagatcgcaataaggaaacccgcacttcctcagaatccataatatcggtacctgccagtagcacctccggctcgcctagccgcgttatctatgccaaactaggtggtgagattcttgactatagagacctggctgcactccccaagtctaaagctatatatgatatcgataggcccgacatgatctcctactcgccgtatattagtcactctgccggggaccggcagagctacggcgaaggcgaccaagatgaccggtcctataaacagtgcaggactagtagcccatccagtaccgggtcagtgtccctcggccgttacacacctacaagccgtagtccccagcattatagccggccgggctctgagtctggtcggagcaccccttccctttctgtgctatcggactcaaaacctcctccatctacatatcagcaggctcctcgtcactttcacgtgcccgataccggtgtgaaggacaacatctaccggaagcctcccatctaccgtcaacacgctgcccgcaggtctgatggcgaggacggtagtctcgaccaagataatcgaaaaaagagctcgtggttaatgctcaagggagacgctgacacaagaacaaacagcccggacctggacactcagtcactgtcccactcgtcaggaaccgaccgggatcctttacagcggatggccggcgactcttttcatagccagcagatctatccatacgactcattaatcgtaacaaacaggattcgggtcaaactacccaaggacgtagaccgcaccagattggaaaggcatctaagtcctgaggaattccaggaagtttttgggatgagcatagaagagttcgatcgcctggccttatggaagcgtaatgacctgaaaaagaaagctctgctgttctag

SEQ ID NO: 106880 - DNA, 1596 bp, Artificial Sequence
  Description of Artificial Sequence: Synthetic coding sequence
atgtcagctgtgagtcagcctcaggcagccccatctccactggagaaatctccgtccactgcaatcctgtgcaacacctgtggcaatgtgtgtaaaggagaggttcttagggttcaggacaaatatttccatattaaatgtttcgtctgtaaggcctgtggatgcgacctagctgaggggggcttttttgtccggcaaggagaatacatctgtacccttgattatcaacggctgtacgggacccgctgcttcagctgtgaccagttcatcgagggagaggtcgtgagtgctttgggtaagacttatcaccctgactgctttgtgtgcgctgtctgtaggttgccctttccgccaggtgacagagtcacctttaacggcaaggagtgtatgtgccagaaatgcagcctgcccgtttcagttgggagctctgcacatctgtcccaggggctccgcagttgcggggggtgtggcacggaaataaaaaatgggcaggctttagtggcactggataagcactggcacctggggtgcttcaaatgcaaatcgtgtggaaagctgctcaatgccgagtacatctctaaggacggattaccctactgtgaggccgactaccacgcaaagtttggaatcagatgcgactcttgtgaaaagtacatcacgggacgcgtgctagaagccggggaaaagcactatcatccgagttgtgctctctgtgtgcgatgtgggcagatgtttgccgagggcgaagaaatgtaccttcaaggctccagtatttggcaccctgcttgtaggcaggcggcccgaactgaagacaggaacaaggaaacacggacttcctccgaaagtatcatcagcgttcccgcctctagtacctccggctccccgagcagggtcatctacgcgaaactcggcggggaaattctcgactacagagatctggccgccttacctaagagcaaggccatctacgatattgacaggccagatatgatctcttattcaccatacatatcccattctgccggagacagacagagctacggcgagagtccccaactcctttccccaacacctactgaaggtgatcaggacgataggtcctataaacagtgccgcacctcatctccatctagtacaggatccgttagcctcggcaggtatacccccactagtaggagtcctcagcattattccagacccgcagcccggcgttcagacggcgaagacggctccctcgaccaagataaccgcaaaaaaagttcctggcttatgctgaagggcgacgctgacacccgcacaaatagcccggacctggacacacagagcttatcccactccagtggcacggatagggatcccctccagcgtatggctggagattcattccactcacgtgaacagatttacccatatgattctttgatagttactaatagaatacgcgtcaagctgccaaaggacgtggatcgcacacggcttgagcgccatttgtcacccgaggaattccaggaggtgtttggcatgagtattgaggagttcgacagactggcgttgtggaagaggaatgatctgaagaagaaggccctccttttttag

SEQ ID NO: 106881 - DNA, 2193 bp, Artificial Sequence
  Description of Artificial Sequence: Synthetic coding sequence
atggaagagctgatagtggagttgagactttttctggagctgctcgaccatgagtatctcaccagcaccgtgagagagaagaaagcggttataacgaacatactcctccgcatccagtcctctaagggcttcgatgtgaaagatcatgcacaaaagcaagaaaccgccaattcactccctgcacccccacagatgcctctgccagagatcccccagccatggttaccaccagacagtggacccccgcctctgcctacctcttctctgccagaagggtactacgaagaggccgtgccactctctcccgggaaagctcctgagtacatcacctctaactatgatagcgacgccatgagcagctcgtatgaaagctatgacgaagaggaggaggacgggaagggtaagaagacaagacatcagtggccatcagaggaagccagcatggacctggtcaaggatgccaagatttgtgcttttctcctccgcaaaaaacgatttggccagtggactaaactcctatgtgtgatcaaggacacgaaactgctttgctataagtcctccaaggatcagcagcctcagatggagctcccactacaaggatgcaacattacctacatccccaaagacagcaaaaaaaaaaaacatgaattaaagatcacacaacaagggacagatcctctggtgttggcggttcagagtaaggagcaagccgagcagtggctgaaggtcatcaaggaggcttatagtggatgtagcggaccggtggatagtgagtgcccccctcctcctagcagccccgtacacaaagcggagcttgagaaaaagctctcgagcgagcgcccaagtagtgatggcgagggagtggtggagaatggaattaccacatgtaacgggaaggagcaagtaaaacggaaaaaatcgagcaaatctgaggctaaaggcaccgtatcaaaggtgaccggtaagaaaatcacaaagatcatttcgctgggcaaaaaaaagcctagcacagacgaacagaccagcagcgccgaggaggatgtccctacctgcgggtacctgaatgtgctatccaattctaggtggagggaaaggtggtgcagggtgaaggataataagttgatttttcacaaggatcggactgaccttaaaactcacatcgtttccattccattgcgcggttgtgaagtgatcccaggactggattctaaacacccactgacctttcgactgttgaggaacggtcaggaggtggctgttttagaagcaagctcctccgaggacatgggacgatggattggcatcctgctcgccgaaaccggctcttcgactgacccagaggctctgcactatgactacattgatgtggagatgtctgcctctgtcattcagactgctaaacagacattttgcttcatgaaccgccgcgttatctcagcgaacccttacctcggtggcacaagtaacgggtacgcccatccaagtggcaccgcgcttcactatgacgacgtgccctgtattaacggtagtctaaagggaaagaaaccaccagtagctagcaacggagttaccggcaaaggcaagaccctgtcttctcagcccaagaaagctgatccggccgcagttgtaaagaggaccgggagcaatgctgcacagtataaatacggcaaaaaccgggtggaggcagacgctaagagactgcaaacaaaagaagaggagctccttaagcggaaggaagccctgcggaacagactcgctcagctgaggaaggagcggaaggacctgagggcagctatagaggtgaatgcaggccgcaagccgcaggccatactggaggagaagctcaagcagcttgaagaagagtgtagacagaaggaggctgaaagagtgtctttggagctggagctgactgaagtcaaggaatctctaaaaaaagcactcgctggaggggtgaccctgggactggctatagagcccaagagtggaacttccagtcctcaaagccctgtattccggcataggaccctcgagaactctcctatctctagctgcgatacatcagatactgaaggcccagtgcctgtgaatagcgccgcagtcctgaagaaaagccaagctgcccctgggtctagcccatgcagaggccacgttcttagaaaggctaaggagtgggagctgaagaacgggacatag

SEQ ID NO: 106882 - DNA, 2193 bp, Artificial Sequence
  Description of Artificial Sequence: Synthetic coding sequence
atggaagagttgattgttgagctgcgcctgttcttagagctgctcgatcacgaatatcttacaagcaccgtgcgagagaaaaaggctgttatcactaacattctcctaagaattcagtcgtccaaagggtttgacgtgaaggaccacgcccaaaagcaagagaccgctaactccctccctgccccaccccaaatgcctctgccagagatacctcaaccctggctgcccccggatagcggcccacccccgctgccgactagctcactgccagagggctattacgaagaagctgtccctctgtctcccggcaaagcccctgagtacatcacgtccaactatgatagtgacgccatgtctagctcgtacgagagttacgacgaggaggaggaggatggcaaaggcaaaaagacccgacaccagtggccttccgaggaggcgtcaatggatctcgtgaaagacgccaaaatctgtgcttttctccttcggaagaagaggttcggtcaatggacgaagctgctatgtgtgatcaaggataccaaacttttatgttataagtcttctaaggaccaacagcctcagatggaactgccattgcaaggctgtaacattacttatattccaaaagactccaagaagaagaaacacgaactcaaaataacacaacagggcactgaccccctggtgctggcagttcagtccaaggagcaggctgagcagtggctaaaggttattaaggaagcctattctggttgtagcggccccgtcgatagcgaatgccctccccctccttcatccccagtacataaggctgagctcgaaaagaagctgagcagcgaaaggccaagctccgatggtgagggcgtagttgagaacggcataaccacgtgcaacggcaaggaacaggtgaaacgaaaaaagtcaagtaagagtgaagccaaagggacagtctccaaggtgaccggaaagaagatcaccaagatcattagcctcggaaagaagaaacctagtactgacgaacagacctctagtgccgaagaagatgttcccacctgtgggtacttaaacgtgctgtccaatagcaggtggcgggagaggtggtgcagagtcaaagataacaagttaatatttcacaaggaccggactgacctaaaaacacacatagtgtctatccccctgcggggatgcgaggtgatccccggcctggacagcaagcaccccctgacctttagactgcttcggaatggacaagaagtggcagtgttggaggcgtcaagctccgaggacatgggtcgctggatcggcattctgctggccgagacgggcagtagcactgatcctgaagctctgcactatgattacatcgacgtagaaatgtctgctagcgtcatccagacagccaaacagacattttgttttatgaacagaagggttatctcagcaaacccctatctgggaggaacaagtaatgggtacgctcaccctagtggtactgcactgcattatgacgacgtcccgtgtattaatggttccttgaaggggaaaaaaccacccgtggcctccaatggcgtgaccggtaaaggaaagacactatctagtcagcctaaaaaggcggaccccgcagctgtggttaagcgaaccggctccaatgctgctcaatacaaatatggtaaaaatcgcgttgaagcggacgctaagcgactccaaaccaaggaagaggagctgcttaagagaaaggaggccctgcggaataggttggcgcagctgagaaaggagagaaaagacctcagagccgccatcgaagtgaacgccggcaggaagccacaagctatcctggaggagaaactaaaacagttagaagaggaatgcaggcagaaagaggccgagcgagtcagcctagagctagaactaacagaagtcaaagagtccctgaagaaggccctcgcaggcggagtcaccttgggtctagctatcgaacctaaaagcggcactagctctccacagtctcctgtgtttcggcacaggacactcgaaaacagccctatttcgagttgtgatactagtgacacagaaggcccagtcccagtaaattccgcagcggttctcaaaaaatcccaggctgctcctggcagcagcccatgtaggggacacgtgctccggaaagccaaggagtgggaactcaagaacggcacatag

SEQ ID NO: 106883 - DNA, 2445 bp, Artificial Sequence
  Description of Artificial Sequence: Synthetic coding sequence
atggaagagttgatcgtggaactgagactgtttttggaattgttagatcacgaatacctgacttccacagtgagggaaaagaaggccgtgattacgaatatactcctcagaatccagtcttccaaagggttcgacgtgaaggatcacgcccagaagcaggagacagctaactctctgcctgcccctccacagatgccgctgcctgaaatcccgcagccctggttgcccccagacagtggcccacctccccttcctaccagcagcctgcctgaaggatactacgaggaagctgtgccactttcgcccggcaaggccccggagtatattacatcgaattatgactccgatgcgatgagtagttcatatgagagttatgacgaagaagaggaagatggaaagggtaaaaagactcggcaccagtggccctccgaggaagcgagtatggacctcgttaaagatgccaagatttgcgcatttcttttacggaagaaaagattcggccagtggacaaaactgctatgcgttattaaagacactaaactgctctgctacaagagctctaaagaccagcaaccgcagatggaactgcccttgcagggctgtaacatcacgtatatccctaaagatagtaaaaagaagaaacacgagctgaagatcactcagcagggaaccgacccacttgtgctcgctgtgcaatccaaggaacaggccgaacagtggttgaaagtcattaaagaggcatacagcggttgtagcgggcccgtggatagcgaatgcccacccccaccttcatcgcctgttcacaaagcagagttagaaaaaaaactgtctagtgagaggccctccagtgacggagagggagtggtcgaaaatggcattactacatgcaacggtaaggaacaggtgaaacggaaaaaatcttccaagtcagaggcgaaagggaccgtcagcaaagttaccggcaagaaaatcacaaagataatttctcttggaaagaaaaaacccagcactgatgagcagaccagtagcgcagaggaagacgtgcctacctgtggttacctaaatgtattgtctaactccaggtggcgtgagcgatggtgccgcgttaaggataataaactgatttttcataaggatcggactgacctcaagacccacattgtgtctatcccccttagaggctgcgaagtcattcctggactggactccaagcatcccctgacattcaggctgctgaggaacggccaagaggtggcggtgctagaagccagtagcagtgaggacatgggccgttggatcggcattctgcttgccgagaccgggtcatctaccgaccctgaggcactgcattacgactacatcgatgtggagatgtcggcttccgttattcagaccgctaagcaaaccttctgtttcatgaataggagagtaatatccgcaaatccctatctcggagggacctcaaacgggtacgctcacccatctggaacagctctgcactacgatgacgtaccatgcatcaacggcagttgggagcccgaagacggattcccagcttcatgtagccgaggcctcggtgaggaggttctctatgacaatgctggattatacgacaatctccctcctcctcacattttcgcccgctatagtccggccgatcgcaaggcgtcccggctttcagcagacaagctgtcttctaatcattataagtacccggcgtcagcccaatcagtcactaatacctcctccgtcggaagagcctccttaggcttaaactctcagctgaagggaaaaaagcctcctgtcgcatcgaacggggtgacaggaaaaggtaaaacactaagctctcagcctaagaaagcagatccggctgcagtcgtaaagcggactggatccaatgcggcacaatataagtatgggaagaatcgagtagaggccgatgccaagcggctgcagacaaaagaagaagagctccttaagaggaaggaggctttgcggaaccgtctggcacagctccgtaaggagcgcaaagacctacgtgcagcaatcgaggttaacgccgggcgcaagcctcaggcgatcttggaggagaagctgaaacagcttgaagaagagtgtcggcagaaggaggccgagcgcgtgagtctggagctggagctgactgaggtcaaagagagtttgaagaaagccctggcaggtggagttacactagggcttgcaatcgaacctaagtctggtacctcgtcaccccagtcgccagtgtttaggcatcgaacgcttgaaaacagccctatatctagttgtgacactagtgatacggagggcccagtccccgttaattccgccgcagttctcaaaaaatctcaagccgcgcccggctccagcccttgtcggggccatgtgctgcgaaaagctaaagagtgggagctgaaaaacggcacatag

SEQ ID NO: 106884 - DNA, 2307 bp, Artificial Sequence
  Description of Artificial Sequence: Synthetic coding sequence
atggatcgaggacaggtgctggaacaactattaccagagctcaccgggctgctctctctactcgatcatgagtatctttccgacaccacgctggagaagaagatggctgttgccagtattctgcagagcctccaaccactgccagccaaagaagtgagttatctgtatgtgaacaccgccgatctccactctggacctagcttcgtcgagtccctctttgaagaattcgattgcgacttgagcgacttgcgggacatgccagaggacgatggagagccatcgaaaggagccagtccggagttggccaagtcacctagattgcgaaatgctgctgatctgccacctccccttccaaataaacccccgcccgaggattattacgaggaagcactgcccctgggccccggaaaatcacctgagtacatttccagccacaatggatgcagcccctcccactccattgtcgatggctactacgaggacgcagactcttcataccctgctaccagggtaaacggcgaactgaagagcagctacaatgattccgatgccatgtcctcatcttacgagagttatgatgaagaagaagaagaaggtaagtcgcctcagccccggcatcagtggccatcagaggaggcaagcatgcacttggttcgtgagtgtaggatctgcgctttcctgctccggaagaagcgcttcgggcagtgggcaaaacagctaactgttatccgggaggaccagctgctttgctacaaaagctccaaggatcggcagcctcacttgagactggcattggacacctgcagtatcatatacgttccaaaggatagtagacacaaaagacacgaactgcgtttcacacagggagctaccgaggtgctagttctcgccctgcagtcaagagaacaggcggaggagtggctgaaagtgattagagaggtgagtaaacccgtcgggggcgcagaaggggtcgaagtccccagatctcccgttctgctttgcaagttagacttggacaagcggctgagtcaggaaaagcagacctctgactccgatagtgtcggggtgggggataactgcagcaccttagggaggagggagacttgtgatcatggaaagggtaagaagagcagtctcgctgagcttaaggggagtatgtcaagagcggcggggcgtaaaatcacccgcatcatcggtttctccaaaaagaagaccttggctgatgaccttcagaccagctcaaccgaggaggaagttccatgttgtggctatctgaatgtgcttgtgaaccagggctggaaggagcgctggtgccgtctaaagtgtaataccctgtatttccataaggaccatatggacttacgaacccatgttaatgcaatcgctctacaaggttgcgaggtggcccctggctttgggccacggcatccattcgcctttcggatccttaggaaccggcaggaagttgccattttggaggcttcttgttccgaggacatggggagatggcttgggctactgctagtggagatggggtcccgcgttactcccgaggccctgcactatgactacgtggacgtagagactcttacgtctatcgtgagcgctggacggaactctttcctatacgctcgctcatgccagaatcagtggcccgagcctcgcgtctatgatgatgtcccctacgagaaaatgcaggatgaggaaccagaaagacctactggcgctcaggtgaaaagacatgccagcagctgcagcgaaaaaagccaccgcgtcgaccctcaagtcaaggtgaagagacacgcttcaagtgctaaccaatacaaatatggcaaaaatagagctgaggaggacgcgagacgctacctggttgagaaggagaaacttgaaaaggagaaggaaactattcggacagagctcattgcactgagacaggaaaagagggaattgaaggaggcaatcagatcttcccctggtgccaagctgaaggccctagaggaggcagtggctaccctggaggcacagtgtcgggcaaaagaagagaggagaatcgatctggagctcaaactggttgccgtgaaggagcgactgcaacagtccttggccggcggacctgcgctaggcttgagcgtttcctcaaagccaaagagcggagagactgccaacaaaccacaaaacagtgtcccagagcaaccactgccagtgaactgtgtgtccgagctgcgcaagagaagtccatcaatcgttgctagcaatcagggcagagtgttacagaaagccaaagagtgggagatgaagaagacatag

SEQ ID NO: 106885 - DNA, 2178 bp, Artificial Sequence
  Description of Artificial Sequence: Synthetic coding sequence
atggatcggggccaggtattggaacaactgctacccgaactgacagggctgttaagtttgcttgatcatgagtatctgtccgatacaactttggaaaagaagatggcagttgcatcgattctacagtccttacaaccactgcccgctaaagaagtcagctacctctatgtaaacactgcggatctacatagtggtcctagctttgtggaatcgttgttcgaggaatttgactgcgatttgtcagatctgcgggacatgcctgaagacgacggcgaaccatccaaaggggctagtccggaacttgctaagtcccctcggctgagaaatgccgccgacctcccacctccactccctaacaaacccccacctgaggactattacgaagaagcgttacctttaggcccgggcaaatcacccgagtacatcagcagccataatggttgctccccctctcactcaatagtcgatgggtattatgaggatgccgacagcagctatcctgccactcgagtaaatggtgaactcaaatcctcctacaacgactctgacgcaatgtccagctcatacgagtcttatgacgaagaagaagaagaaggtaagagcccccaaccccgtcaccagtggccttccgaggaggcctccatgcacctcgtgcgtgagtgcagaatatgcgccttcctgctgcgaaaaaagagatttggacaatgggcaaagcagttaaccgtaatcagggaggatcagctactttgctacaagtcatctaaagaccggcagcctcacctccggttggcgctcgacacatgttcgatcatttatgtccccaaagatagtaggcacaaacgacacgaactcaggtttacccagggtgccaccgaggttttggtcctggccttacaatcacgtgagcaggcagaagagtggctcaaagtgatcagggaagtgagcaaaccggtcggcggagctgaaggcgtggaggtccctcgttcaccagtgctgctctgcaaactggatctggataaaagattgagtcaggagaaacaaacctcggattcagactctgtgggtgtcggagataactgcagcactctgggtaggcgggagacctgcgatcacggaaaaggcaaaaagagctcactggccgaactgaaaggctctatgtctcgggctgctgggcggaagatcacaagaattatcggcttctcgaaaaagaagacccttgctgacgatctgcagactagctccaccgaggaagaagtgccatgctgcggctacctcaacgtacttgtcaaccaaggatggaaggaacggtggtgtagactgaaatgcaatacactttatttccataaggatcacatggatctgagaacccacgttaatgctattgctctgcagggctgcgaggtcgcccccggatttggcccacggcatccctttgctttcaggatcctgcgaaataggcaggaagtggccatcttggaggcctcgtgtagcgaggacatggggcgctggctgggccttctgttggtggagatggggtcccgcgtgacccctgaagccttacactacgactacgtggatgtggagaccctgacctccatcgtgtctgctggacgcaattctttcctatatgccagatcatgccagaatcagtggcctgaaccacgcgtgtacgatgacgttccttacgagaagatgcaggatgaggagccggaacgacccacgggagcgcaagtcaaacgtcacgcctctagctgttccgagaagtcacatcgtgtcgacccccaggtgaaggtaaaaagacatgccagcagtgccaatcagtacaagtatggaaagaacagagcagaggaagacgccagaaggtacctggtagaaaaggaaaagcttgaaaaggaaaaagagacaatcagaaccgaactcattgcccttcgccaagagaaacgcgagctcaaggaagccattcgaagctctccgggggcaaaattgaaagctctggaggaggccgtcgccacgctggaagcacagtgccgcgctaaagaggaacggcgcatagatcttgagctgaaacttgtggcggtgaaggagagactgcagcaatccctagccggcggtcctgcattgggtctgagtgtttccagcaagcctaaaagcggtgagtgggagatgaagaagacctag

SEQ ID NO: 106886 - DNA, 2457 bp, Artificial Sequence
  Description of Artificial Sequence: Synthetic coding sequence
atggagagatataaggcactggagcagttgctcacggaactggacgactttctgaagattctcgaccaggagaacctttcttctacggccctcgtgaaaaagtcctgcctggccgagctgttacgcctctatacaaaaagttcaagctccgacgaggaatatatttacatgaacaaggttaccattaacaagcagcagaacgcggagtctcaggggaaagctcctgaagaacaggggctgctacccaacggggagccgtcgcagcattcctccgctccacagaaatcgctcccagacctcccccccccaaagatgatcccggagcggaagcaactggctattcctaagaccgagtcacccgaggggtactacgaggaggccgagccatacgatacgtcactcaatgaggatggagaggcagtgtcctcctcttacgagtcttatgacgaggaggacgggtcaaaaggaaaatccgctccttatcaatggccatcccccgaggcaggtattgaattaatgcgggacgcacgaatttgcgcttttctgtggagaaagaaatggcttgggcaatgggccaagcagttgtgtgtgatcaaggataacaggcttctgtgctacaaatcaagtaaggatcatagccctcagctggatgtaaatctgttaggctcttcagtgattcataaggaaaaacaggttcgcaagaaagagcacaagctgaagatcacgcccatgaatgctgatgtgatcgtcttgggcctgcaaagcaaagaccaggccgagcaatggttaagggtgatccaggaggtgtccggcctcccatccgagggtgctagtgagggaaaccagtatacccctgatgcacaacgttttaactgccagaaaccagacattgccgagaagtacttgtctgcctcagaatatgggtctagtgtggacggccacccggaggtgccggagaccaaggatgtaaaaaaaaagtgttcagccggactcaaattatcgaatctgatgaacttaggtagaaagaaaagcaccagcttggagcctgtggaaagatcactcgaaacgtctagttacttgaatgtcctcgtcaacagccaatggaaaagccgctggtgtagtgtgagagacaatcatttgcatttctaccaagatcgaaatagaagtaaagtggcccaacagcccctgtccctggtggggtgtgaggtagttccggacccttcccccgatcatttgtattcgtttaggatcctgcataagggggaagaactggccaaactggaggcgaaaagttccgaagagatgggccattggttggggttacttctgtccgagagcggtagcaagaccgacccggaggaattcacgtacgactatgtggatgccgaccgagtaagctgcatcgtctcggccgctaagaactcgctgctccttatgcagagaaaattttcggaacccaacacatatattgacggcctgcctagccaggatcgccaggaagagctgtatgacgacgtagatctctccgaactgaccgctgcagtagaaccaaccgaggaggcaacaccagtggccgatgacccgaatgagagggagtctgaccgagtctatctggatttgactcccgtcaagtcattcctgcacggcccaagttctgcccaggcccaagcaagcagcccaactctgtcgtgcctggacaatgcaacagaagcattgccagctgactctggccccggacccaccccagacgagccatgcatcaagtgtccagagaatcttggtgagcagcagctggaaagtctggagcctgaggatccatctctgaggataacaacagtcaagatacagacagaacaacagcgaatcagttttcctccatcctgtccggatgcagtcgtagctacacctccaggcgcaagcccacccgtgaaagatcggctgcgagttacctcagccgagattaagctgggcaagaaccgaacagaggccgaggtcaagcgatacacagaggagaaggagcggctggagaagaagaaagaggagatcagaggtcatcttgcccagctccggaaagaaaaacgggaacttaaagagacccttctgaaatgcaccgacaaggaagtgctggccagcctggagcagaagttaaaggaaattgatgaggagtgcaggggcgaagagtcacgcagggtggatctcgagctgtccatcatggaggtgaaggataatttgaaaaaagcagaggcggggcctgtgaccctgggtacgaccgtggacaccacccatctggaaaacgtaagtcccaggcccaaagccgtgacgcctgccagtgctccagactgtacgcctgtcaattcggctactactctgaaaaaccgcccgctgtctgtggttgtgacagggaagggtacagttttgcagaaggcgaaggagtgggaaaagaagggtgcgtcttag

SEQ ID NO: 106887 - DNA, 2445 bp, Artificial Sequence
  Description of Artificial Sequence: Synthetic coding sequence
atggagaggtacaaagccctggaacagttgttaacggagctggacgacttcctcaagatcctggaccaggaaaacttaagttcaacagccctggtaaaaaaaagttgccttgccgaactgctccggctttacaccaaaagtagctctagcgatgaggagtacatttacatgaacaaagtgactattaacaaacagcaaaacgctgaatcgcaggggaaagctccagaggaacagggactcctgccaaatggtgagcccagtcagcacagtagcgcccctcagaagagtttgcctgatctaccaccccccaaaatgattcccgagaggaaacaactggctattccaaagacagaaagccccgagggatactatgaggaagccgaaccatatgatacctccctcaacgaggacggagaagctgtgtcatcctcctacgagtcatacgatgaggaggatggcagcaaaggcaaatccgccccttaccagtggccatcacctgaagctgggatcgagcttatgagagacgctcggatctgcgcctttctgtggagaaaaaaatggctcggccagtgggctaagcagctatgcgtaatcaaggataatagactattatgttataaaagcagcaaagaccacagcccgcaattagacgtgaacctattggggagttctgtgattcacaaggaaaagcaggtgcgcaaaaaggagcacaaacttaagataacacccatgaatgccgatgttatcgttctcggcctccaatcaaaagatcaagcagaacagtggctgcgagttatccaggaggtctctgggctgccatctgagggagcatctgagggaaaccagtacacacctgacgcacagcggttcaattgccagaagcccgacattgcagagaagtacctgtccgcatccgagtatggttcctccgtggacggacatcccgaggtacccgagactaaagacgtgaagaaaaaatgctctgcagggttaaaactgtcaaacttgatgaatctcggccggaagaagtctaccagcctggagcctgtcgagcgatccctcgaaacgtcgtcatatctgaatgtcctggttaatagtcagtggaaatcgaggtggtgctctgttagggacaaccatctccacttctatcaggaccgcaacaggtctaaggtggcacagcagcccctatccctggtggggtgtgaggtggttccggatccctctcccgaccatctgtactcttttaggatcttacacaagggtgaggaactggctaagctggaggctaagtcatcagaagagatgggacattggctgggtcttttactgagcgagagcggcagtaagaccgatcctgaagaatttacctacgactacgtcgatgccgacagagtttcttgcattgtgtctgcagccaaaaacagtctccttctgatgcagcgaaaattctcggagcccaatacatatatagacggccttccttctcaggatagacaggaggaattgtacgatgatgtggatctatctgagctcactgcggctgtggaacccacagaagaggccactcccgtggcggatgaccctaacgagcgggagagcgacagagtctatctcgatctgacacccgttaagtctttcctgcacggtccctcatcagctcaggctcaggcctcctctccaacactgtcttgtctggacaacgccacagaggcactccccgctgatagcggccccgggcccacgcccgacgaaccatgcattaagtgtcccgagaacctaggtgaacagcagctcgaatctcttgagccagaggacccgagtctgcgcattacaaccgtcaagatacagaccgaacaacaaagaatcagcttcccaccatcgtgtccggacgccgtcgttgccactccccccggtgcaagccctccagttaaagatagactaagagttactagcgcagaaattaagctaggaaaaaaccgcactgaggcagaagtcaagaggtatactgaggaaaaagaacggctcgagaagaaaaaggaggagattcgagggcacttggcacagctgcgaaaggagaagagagaactgaaagagaccctgctgaagtgcactgataaagaggttctggcctccctggaacagaaactgaaggagattgacgaagagtgccgcggagaagagagcagacgcgtggacctcgagttaagtatcatggaggtgaaagataacttgaaaaaagctgaggctgggccagttacacttggcactaccgtggacactacccacctggagaacccaaaggctgtgacaccagcctcagcgcccgattgtacgccagttaattcggccacgaccctgaaaaacaggccgctctcggtggtggtgacaggaaaaggtaccgttctgcagaaagccaaggagtgggagaaaaaaggagcaagctag

SEQ ID NO: 106888 - DNA, 2526 bp, Artificial Sequence
  Description of Artificial Sequence: Synthetic coding sequence
cagcgtgttcgggctctggaacagcttctcactgagttggatgacttccttaagattctcgaccaggagaacctgtccagcacagcattagtcaaaaaatcctgtctggctgagctactaaggctgtacactaaatcgtcctcgtctgacgaggagtacatctacatgaacaaagtgactattaacaagcagcagaacgcggaaagtcagggaaaagcccctgaggaacaggggttgctacctaacggtgagccttcccagcattcatccgccccacagaagagcttgccagacttgccaccacccaaaatgatccccgagagaaagcagttagcgatccccaagacagaatctcctgaaggctactatgaggaggccgaaccatatgatacatccttgaatggacatagcgggggatttctccctaccggggtgccccggtgggtgcaagtccctgagggtgtcatttacgcgaccataactttggaggatggtgaggctgtttcaagcagttacgagtcttatgacgaagaggacggctcgaaaggaaagtctgcgccctatcaatggccgtccccggaggctggaatagaactgatgcgagatgctaggatctgcgcttttctttggagaaagaagtggctgggccagtgggccaagcagctctgcgtgattaaagacaataggcttctatgctataaatcaagcaaagatcacagtccacagctcgacgtgaatctgctaggctcgagcgtcatccataaagaaaaacaggttcgaaagaaggagcacaaattgaaaataacgcccatgaacgccgacgtgatcgtactcggcttacagtccaaagaccaggcagagcagtggctgcgtgtcatccaggaagtaagcgggctcccctcagagggtgcaagtgagggcaatcagtataccccagacgcccagaggtttaattgccagaaaccagacatcgccgaaaagtacctgtccgcaagcgaatatggcagcagcgtggatgggcatcctgaagttcccgaaactaaggacgtcaaaaagaagtgtagtgcagggctcaagctgagtaatttgatgaacttaggccggaaaaagtctacttcccttgaacctgtggagaggagtcttgagaccagcagctacctgaacgtgcttgtcaattcacagtggaaaagccgttggtgcagcgtgcgcgacaaccacctccacttttatcaggacagaaatcggtccaaagtcgcacagcagcccctgtctctggttggttgtgaagtcgtgcctgatccctcccctgatcacctgtatagttttcgcatccttcacaagggcgaggaactggctaaactggaggctaaaagctctgaagagatgggtcactggctcggcctgttgctgagtgagtctgggagtaaaacagacccagaagagtttacctatgactacgtggacgcagatcgggtttcctgtatagtgtccgccgcaaaaaattccctgctgctgatgcaaaggaagttttcggagcccaacacctatatcgatgggctccccagtcaggaccgacaagaagaactgtacgatgatgtggatctgtccgagctgactgccgccgtggaaccaaccgaggaggccacgccagtcgcggatgatccaaacgaaagagagagcgaccgcgtttacttagacctgacccctgtcaagagtttcctccacgggcccagttctgcacaggcccaagcctcctctccgacactgtcgtgcctggacaacgccaccgaggcactgccagcagacagcggccccggccccacccccgatgagccctgtatcaagtgccctgaaaacttgggggagcaacagctggagtccctagagcccgaggaccccagtttgcgcataacaacagtgaagattcagacggagcagcagcggatatctttccccccctcctgtcccgacgcggttgtggccacccctcccggagcctccccgcctgtgaaagatcgcctgagggtgacttcagccgagataaaactggggaaaaaccgtaccgaggccgaagtgaaaagatacacagaagaaaaagagcgattagaaaaaaaaaaagaagaaattcgcggacatctcgcgcagctgagaaaggagaaaagggagctaaaggagaccctgctcaaatgtacagataaagaggtactggcatccctggagcagaagctcaaggaaattgacgaggaatgtcggggcgaggagtcgcggcgcgtggacctcgaactgtcgatcatggaggtgaaggacaatcttaagaaagctgaggccggcccagtgacattaggcactactgttgacactacacaccttgagaaccccaaggctgtaacccccgcatccgcccctgactgtacacccgtgaactccgccaccaccctgaagaatcgccctttgtctgtagtggttacgggaaagggcaccgtgctccagaaagcaaaagagtgggaaaaaaaaggcgcgtcatag

SEQ ID NO: 106889 - DNA, 939 bp, Artificial Sequence
  Description of Artificial Sequence: Synthetic coding sequence
atggagaggtacaaagcccaggggtgttgttgtcttgtggtacagaggaggattcgccaggtctccgcatccttggaacagctgctgactgaactggatgattttctaaaaattcttgaccaagaaaatctgtccagtaccgctctagttaagaagtcgtgccttgcggagctgctcagattgtacaccaaatcctctagtagcgacgaggagtacatttacatgaacaaagtgacgattaacaaacagcagaatgctgagtctcaggggaaggcccctgaggagcagggccttttgcctaacggagagccctctcagcatagctcagccccacagaagtccctccctgacttgcccccacccaaaatgatcccggagcggaaacagttggccatcccaaaaaccgagagtccggagggatattacgaggaggctgagccttatgatacatccttaaacgaggatggagaggcggtgtcaagcagctacgagtcttatgatgaagaagacgggagtaaagggaaatctgccccgtatcagtggccatctcctgaggctggaattgagctcatgcgcgatgccagaatttgtgcattcctatggaggaagaagtggctgggccaatgggctaagcagctgtgtgtgatcaaggataacaggctgttgtgctacaagagtagtaaagatcattcaccgcagcttgacgtcaatttgcttggatcttccgttatacataaggagaagcaagtgcggaagaaggaacacaaactcaagatcacacccatgaacgccgatgtcatcgtgctggggctgcaaagtaaggaccaagccgaacaatggctacgggttatccaggaggtgagtgggctgccttctgagggggccagtgagggaaaccagtacactccagatgcccagaggttcaactgtcagaaatag

SEQ ID NO: 106890 - DNA, 939 bp, Artificial Sequence
  Description of Artificial Sequence: Synthetic coding sequence
atggagcggtacaaggcccagggatgctgttgcctggtcgtccagcggagaatccggcaggtatctgcctccttggaacagctgctcacagagctcgacgattttctgaaaattttggatcaggagaatttatcttccaccgccctggtgaagaaaagctgtctcgctgaactgctgagactctatactaaatctagctccagcgatgaggagtacatctatatgaacaaggtcactatcaataagcagcagaacgcggagagccagggaaaggctccagaggagcagggcctccttccaaatggcgaacccagtcagcactcatctgcaccgcagaagagtcttcctgatttgcctcctcctaaaatgatacctgaacggaagcagctcgcaattcccaagaccgagagccccgaaggatattacgaggaggcagagccctacgacacatctctgaatgaggatggggaggccgtgagcagctcgtacgaatcctacgatgaggaggatgggtctaagggcaaaagtgcgccctaccagtggccttcacctgaagccggcattgaacttatgagagatgctcggatctgtgccttcctttggcggaaaaagtggctaggacagtgggccaaacagctgtgcgttattaaggataaccggctgctttgttataagagtagtaaagatcactctccgcagctggacgtcaatttactgggttccagcgttatacacaaagagaaacaggtgcggaagaaagaacacaagctgaaaatcacccctatgaatgccgacgtgatcgttctggggctccagagcaaagaccaggccgaacaatggctgagagtcatacaggaggtgagcgggctcccgagtgaaggtgcctctgaggggaaccaatacaccccagacgcccagcggtttaattgccagaaatag

SEQ ID NO: 106891 - DNA, 2616 bp, Artificial Sequence
  Description of Artificial Sequence: Synthetic coding sequence
atggagagatacaaagccctggagcagttgctgacagagttggacgacttcttgaagatcctggaccaagaaaatttgtcctcgaccgcactagtgaagaaaagttgcttggctgagcttctgagactctatacaaagtcctcatcctcagatgaagaatacatctatatgaataaagtgaccattaataagcagcagaatgcggagtcgcaaggaaaggccccggaagagcagggccttcttccgaatggtgagccatcacaacattcctccgctccccagaaatcacttccagacctgcccccacccaagatgcgtatcctgacgctggggcagatttcaggagctcagtctttttctcctgacgggacgcacctgacagggacagagttcttggggggctggtcctggcgcccatctcaaattcgtctgatgagcccaggcacccactggggcgatctcaccgcaaccgagatacctgagaggaagcagctggccatccccaagactgagtctccagaagggtactacgaagaagcagagccttacgacacgagcctgaatgaggatggagaagcggtgtcaagcagttacgaaagttatgacgaggaagatgggtctaaaggcaaatcggctccttatcagtggccatcccctgaggccggtatcgaactgatgcgggatgctcggatctgcgcgttcctctggagaaaaaaatggctaggacaatgggccaaacagctctgcgtaatcaaggataacagactgctttgttataagtcatctaaagaccactctccacagcttgatgttaaccttttggggagttccgtgattcataaagagaagcaggtgcgcaaaaaggagcacaagcttaagattactccgatgaacgccgacgtcatcgtgctagggctgcagtccaaggatcaggccgaacagtggttaagggtgattcaggaggtatctggactgccttccgagggggccagcgagggcaatcaatatacgcccgacgctcagcgcttcaattgccagaagcccgatattgccgagaaatacttgtccgccagcgagtacggctcctcagttgacggccatcctgaggtgcctgaaacaaaagatgttaagaagaagtgctccgctgggctgaaactgagcaacctgatgaacctcggccggaagaagtcaaccagcttggaaccagtcgaacgcagcttagagacaagctcctacttgaatgtactcgttaactcccaatggaagtcccgatggtgctcggtgcgtgacaatcatttgcacttttaccaggacagaaaccgtagcaaggtggctcagcagcccctttctctagtaggctgtgaagtagtccctgatccatctcccgatcacctatactcttttagaatattgcacaagggcgaagagctcgccaagctggaagcaaagtcctcagaagagatgggtcattggcttgggctcttgctctcggaatcaggatccaagaccgatcccgaagaatttacgtatgactacgttgatgcagacagggttagctgcattgtgtctgctgccaagaactctctgttgctcatgcaacgaaagtttagcgaacctaacacatacatcgacggtctcccctcacaagaccgccaggaagaactatacgacgacgtggatctctccgagctgactgctgctgtggaacctactgaagaggctacccccgtggctgacgaccctaacgaacgggagagcgatagggtttacctggatttgacgcccgtcaagtctttcctgcacggtccttcctccgcccaggctcaggcaagtagccctactttatcctgcctagacaatgctactgaggcgcttcccgcagactcaggaccgggaccaactcctgacgagccgtgcatcaaatgcccagaaaacctcggggaacagcagctagagtcacttgagcccgaagatcccagtctccggataaccaccgtgaagatccaaaccgagcagcagcggatctctttcccaccgtcttgcccagatgctgtcgtagccacacctcccggagcttctcctcccgtgaaggatcgtctcagggtcacttccgccgaaattaagctcggaaagaaccgcaccgaggccgaagtgaagcggtacacagaagaaaaggagaggcttgaaaaaaagaaagaggagattaggggccacctggcccagttaagaaaggagaaaagagaactgaaggagaccctgctaaaatgcaccgataaggaagtactcgctagcctggagcaaaaactgaaagagattgacgaggaatgccgaggcgaggagtctagacgagtcgatcttgaactaagcatcatggaagttaaagacaatcttaaaaaggccgaagcaggtcccgtgactctcggcaccaccgtcgataccacccaccttgaaaacgttagccccagaccgaaggctgtgacaccagcaagtgccccggattgcacaccagttaattcagcgacgacccttaaaaacaggccattatctgtggtggtcactggcaaagggacggtgttacagaaagccaaagagtgggaaaagaagggagcaagttag

SEQ ID NO: 106892 - DNA, 1002 bp, Artificial Sequence
  Description of Artificial Sequence: Synthetic coding sequence
atgtgtgaggaagaaacgaccgccctggtgtgtgacaatggctctggtctgtgcaaggcaggctttgcgggagatgatgctcctcgggcggtctttcctagtatcgtgggccgcccgcgacaccagatctggcatcattccttctacaacgaattgagagtcgcccctgaggaacaccccacattattgaccgaggctcctctgaatccaaaggccaaccgcgaaaagatgacccagataatgtttgagacttttaatgtccccgctatgtatgttgctatccaggcagtcctttccttatatgcaagcggacgcacaacgggtatagtcctcgatagcggcgatggcgtgactcacaacgtgccgatctatgagggatacgcgctgccacatgctatcatgcggctcgatctcgcggggcgggatcttaccgattatctgatgaaaatcttgacagagagagggtactccttcgtgacaacagccgaacgcgagattgtgcgcgacatcaaagaaaagttgtgctacgttgcgctggactttgaaaatgagatggcgacagcagcgtcctcctccagtctggagaaaagctatgagttgccagacggccaggtgatcactatcgggaatgagcgttttcgctgtcctgagacactgtttcagccctcgtttataggtatggagtccgcgggaatccacgaaacaacatataacagcatcatgaaatgtgacattgacataagaaaagatttgtacgccaataatgtactgagcggtggaactacaatgtatccgggtatcgccgaccggatgcagaaggaaattacagctctagccccaagcacaatgaagataaaaataatcgcccctccagagaggaaatattcagtctggattgggggctctatcctggcctccctttctacgttccagcaaatgtggatttccaaacccgaatacgacgaagcaggtccatctatagtacacagaaagtgcttctag

SEQ ID NO: 106893 - DNA, 1113 bp, Artificial Sequence
  Description of Artificial Sequence: Synthetic coding sequence
atgtctcttcaccaattcctcctggagccaatcacttgccacgcctggaatagggaccgtacgcagatcgcactttctcccaacaatcacgaggtgcatatttacaaaaaaaacggcagtcagtgggtaaaagcccatgagctcaaggaacacaacggacatataacaggcattgactgggcgcctaagagtgatagaattgtgacatgcggagcggaccgcaacgcgtacgtgtggagccaaaaggacggtgtgtggaaacctactctggttatactccggataaacagagcggccacatttgttaaatggtcccctctcgaaaacaaattcgctgtgggcagtggcgcccgactgatctctgtctgctacttcgaaagtgagaatgattggtgggtgtcaaagcacattaaaaagcctatccgctcaactgtcctcagtctggattggcacccaaacaatgttctgcttgctgccggctcatgcgatttcaaatgcagggttttcagtgcttacattaaggaggtagatgagaagcctgcttccacgccttggggcagcaagatgccattcgggcagctcatgtcggagttcggcggaagcggtactgggggatgggtgcacggggtgagcttcagcgcttctggaagccggcttgcttgggtgagccacgatagtaccgtatcagtcgccgatgcctccaagagtgtgcaggtcagcacactcaaaacggagtttctgccgctcttaagcgttagctttgtgagcgagaacagtgtagtcgccgccggacacgactgctgtcctatgttattcaactacgatgataggggttgtttgactttcgtctccaagttggatattcccaaacagtccatccagcgtaatatgtcagctatggagcgatttagaaacatggacaagcgggccaccacagaggacaggaacactgctttagagactctgcaccagaatagcatcacccaagtgtctatctacgaggtcgataaacaggattgcaggaaattctgcacgacgggtattgacggggctatgaccatatgggactttaaaactctggaatctagcattcagggactccggatcatgtag

SEQ ID NO: 106894 - DNA, 1038 bp, Artificial Sequence
  Description of Artificial Sequence: Synthetic coding sequence
atgcacgagaggtttattcactgcttctgcattgactgggcccctaagagcgatagaatagtcacttgcggtgccgaccgcaatgcatacgtgtggtcccaaaaagatggagtgtggaaaccgactctggtcatcttgcgaatcaaccgagccgccactttcgtcaagtggagccccctcgagaacaaatttgcagtcggaagcggcgctcgcctgatctcagtgtgctattttgagtctgaaaacgactggtgggtgagtaaacacatcaaaaagcccatccgatccaccgttctctctctggactggcaccccaacaatgtcttacttgcagcaggctcatgtgattttaagtgtagggtttttagcgcatatataaaagaagtagatgagaagcccgcctccactccctggggctccaagatgcccttcggtcagctcatgtctgaattcggagggagcgggacggggggctgggtccacggcgtgtccttcagcgccagcgggtcacgactcgcatgggtgtctcacgacagcacggtttctgttgctgacgcatcgaagtctgtgcaggtctccacactcaagactgaatttctcccgctcttgtcagtgtccttcgtcagcgaaaactcggtggtggcagctggccatgactgctgccctatgctgtttaactacgatgataggggatgccttaccttcgttagtaagctggatatccccaaacagagtatccaacggaatatgtccgccatggagcgttttagaaacatggataaacgagctactaccgaagatagaaacaccgctctcgaaactctccaccaaaactctatcactcaggtgtcgatttatgaggtcgacaagcaggactgccgcaaattctgcactaccggcatcgatggcgccatgaccatttgggattttaaagaaccttcaaggcacggactgccccagctccctggtggggcacatcagctgcctaggttagagcagggccctcaccctgattgtcacctccctcagcagccttag

SEQ ID NO: 106895 - DNA, 1119 bp, Artificial Sequence
  Description of Artificial Sequence: Synthetic coding sequence
atggcttaccattcattcctagtggagccaataagctgccacgcctggaacaaagatagaacacagatcgctatatgccctaacaaccacgaagttcatatttatgaaaagagtggcgccaaatggacaaaagtgcatgagctgaaggaacacaatggacaggtgactggtattgattgggcgcccgaatctaacaggattgtcacttgcggaactgatagaaacgcctatgtttggactttaaagggcagaacatggaagcccacactcgtgattctcaggattaaccgggctgccagatgcgttagatgggcacctaatgagaataaatttgccgtggggagcggaagccgggtgatttctatttgttatttcgagcaggagaacgactggtgggtgtgtaagcatataaagaagccaatccggtcaactgttctcagcctcgattggcacccaaacaatgtactcctggccgccggttcctgtgattttaaatgtagaatattctcagcatacattaaagaggtcgaagagcgcccggcccctaccccctgggggagcaagatgccctttggcgaactgatgttcgagagctcaagctcctgtgggtgggtgcacggcgtgtgtttctcagcctccggctctcgagtcgcctgggtgagccacgacagcactgtgtgtcttgcagacgccgataaaaaaatggccgtcgccactttagcctctgaaacgttgccccttttagctctgacatttatcaccgacaatagtctggtggcagcaggacatgattgcttccctgtgttgtttacttacgatgcggccgctggcatgctgtcattcggaggaagactggatgtccccaagcaaagcagccagcgaggactgactgcccgcgaaaggttccagaacctagacaagaaggcctccagtgagggcgggactgctgccggtgctggcctggactcattgcacaaaaactctgtatcccagatttcggtgctcagcggaggtaaggctaagtgctcccaattctgtaccaccggcatggatggaggaatgtccatttgggatgtgaagagcctggaatccgctctgaaagaccttaagattaagtag

SEQ ID NO: 106896 - DNA, 309 bp, Artificial Sequence
  Description of Artificial Sequence: Synthetic coding sequence
atggcataccacagttttctcgtggaacccattagctgtcacgcgtggaacaaagatcgtacccaaatcgccatttgtcctaacaaccacgaggttcacatttatgagaaatcgggagctaagtggaccaaagtgcacgagttgaaagaacacaacgggcaagtgacagggatcgactgggcccccgagtctaaccgcatcgtgacctgtggcaccgatcggaatgcctacgtgtggacactcaaggggcggacctggaaaccgactcttgtcatattgcgcatcaatcgggccgcacgatgcgtctag

SEQ ID NO: 106897 - DNA, 393 bp, Artificial Sequence
  Description of Artificial Sequence: Synthetic coding sequence
atggcatatcactcttttctggtcgagcccatttcttgtcacgcctggaataaagatcgtacacagatcgccatctgtcctaataaccatgaggtgcacatctatgagaagtccggagccaaatggacaaaagtgcacgaattgaaggaacacaatgggcaggtgacaggtatcgattgggccccagagagcaaccgaatagtcacgtgtgggaccgatcggaacgcttacgtctggaccctcaaaggcaggacctggaagccaacactggtgattctgagaattaatagagcagcccgatgtgtgcgatgggctccaaatgagaataaattcgcagtgggcagtgggagtcgagttatctccatttgctacttcgaacaggagaatgattag

SEQ ID NO: 106898 - DNA, 252 bp, Artificial Sequence
  Description of Artificial Sequence: Synthetic coding sequence
atggcctaccactccttcctggtggagcctatttcatgtcacgcctggaataaggacagaacacagatcgctatctgtcccaataaccatgaggtgcatatttatgagaaatcaggcgccaagtggacaaaagtccacgaactgaaggagcacaacggacaggtaacaggcatagactgggcgccagaaagcaaccggatcgtgacttgtgggaccgatcggaatgcctatgtatggacactgaaggggtag

SEQ ID NO: 106899 - DNA, 402 bp, Artificial Sequence
  Description of Artificial Sequence: Synthetic coding sequence
atggcatatcactctttcctggtcgaacccatcagttgtcatgcctggaataaagatcgaactcagattgccatatgtcctaataaccacgaagtccatatctacgagaaatctggggccaaatggacgaaggtacatgagctgaaggaacataacggccaagtgacgggcatcgactgggcccctgagagcaaccggatcgtcacatgtggcactgaccgaaacgcttatgtttggacattgaagggacgcacatggaagcccacattagtgattctaagaatcaaccgggctgcccgctgcgtgcggtgggcccccaatgagaacaagttcgccgtgggaagcggtagccgagtgattagtatatgttattttgagcaggaaaacgactggtgggtatag

SEQ ID NO: 106900 - DNA, 66 bp, Artificial Sequence
  Description of Artificial Sequence: Synthetic coding sequence
atggcttatcactcatttctcgtggagcccattagttgccatgcctggaacaaggacagaacatag

SEQ ID NO: 106901 - DNA, 402 bp, Artificial Sequence
  Description of Artificial Sequence: Synthetic coding sequence
atggcttaccacagctttctggtggagcctatttcatgccacgcatggaacaaagatcggacccagattgctatttgtcccaacaaccatgaggtacacatctacgaaaaatcaggggcaaaatggaccaaggtgcacgagctaaaagaacacaacgggcaagtgacaggtatcgattgggctcctgagagcaacaggattgtcacatgtgggaccgatagaaacgcttatgtttggactctaaaaggacggacctggaaaccgacgttagttatcctaagaataaatcgagccgccaggtgtgtgaggtgggcaccaaacgagaacaagttcgctgtcggctcaggcagccgcgttatttccatttgctacttcgagcaggagaacgattggtgggtctag

SEQ ID NO: 106902 - DNA, 327 bp, Artificial Sequence
  Description of Artificial Sequence: Synthetic coding sequence
atggcctatcatagttttctggtcgagcccatctcttgccacgcctggaacaaggatcgcactcagatagcaatctgccctaataatcatgaggtccatatttacgagaagtcaggagccaaatggaccaaggtgcacgaactcaaagagcacaacgggcaagtcacaggaatagactgggcaccagagagcaataggatcgtgacttgcggcacagatcggaatgcttatgtatggacgctgaagggtcggacttggaaaccgacactggtgatcctgcggatcaacagggccgcacggtgtgtgaggtgggcacctaatgagtag

SEQ ID NO: 106903 - DNA, 1119 bp, Artificial Sequence
  Description of Artificial Sequence: Synthetic coding sequence
atggcctaccattccttcctcgtggaacccataagttgtcatgcttggaataaagatcgcacccagattgccatttgccctaacaaccatgaagtacatatttatgaaaaatcaggcgcaaagtggactaaggttcacgagctgaaagaacataatggccaggtgacaggcattgattgggctcccgagtctaacagaatcgtcacatgcggaacagatagaaacgcttatgtgtggacgctgaaaggaaggacttggaagccaaccttagtgattctccgtattaacagggctgctcggtgcgtacggtgggcccctaatgagaacaaattcgcggtaggcagtggctcccgcgtgatcagtatatgctacttcgagcaggaaaatgattggtgggtgtgtaagcacattaagaagcctatcaggtccaccgtcctcagcctggattggcacccaaataatgtcctcctagccgccggttcctgtgactttaagtgccgaattttctctgcatacatcaaagaagtggaggaaaggcctgcacctacgccttggggctccaaaatgcctttcggggaactgatgttcgaatcctctagctcttgcgggtgggtgcacggcgtgtgcttctcggctagcggctctcgggttgcctgggtgtcacacgattctactgtttgcctggccgacgccgacaagaagatggccgtcgctaccctggcaagcgaaactctccccctcctcgcgttaacattcataaccgataattcgctggtcgccgccggacacgactgttttcccgtgctgtttacatacgatgctgcagccggaatgctctcatttggaggacgactggatgtgcctaagcagagttcccagcgcggactgaccgccagggagcggtttcaaaacctggacaagaaggcttcctccgagggaggaactgccgcaggagccggcttagacagtctccacaagaactccgtttctcagatatctgttctgtccggcgggaaagctaaatgctctcagttctgtacaaccgggatggatggaggaatgtcaatctgggacgtgaaatccctggagagcgcgctcaaggatctgaagattaagtag

SEQ ID NO: 106904 - DNA, 387 bp, Artificial Sequence
  Description of Artificial Sequence: Synthetic coding sequence
atggcctatcactcatttcttgtggagccgatctcctgccatgcttggaataaagatcggacccagattgccatttgtccaaataatcacgaggtgcacatatacgagaaatcaggagcaaagtggacgaaggtccacgaactgaaggagcacaacggccaagtgaccgggatcgactgggcccctgaaagtaacagaatcgttacttgtgggacagatcgaaacgcctatgtctggactctaaagggcagaacttggaaacccactttagtgattctcagaattaaccgagccgcccgctgtgtgcggtgggcccctaacgaaaacaagttcgccgttggctccgggagtagagtcatttctatttgctacttcgaacaggagtag

SEQ ID NO: 106905 - DNA, 402 bp, Artificial Sequence
  Description of Artificial Sequence: Synthetic coding sequence
atggcttaccactcttttcttgtagagccaatatcatgtcatgcctggaataaggatagaacacagattgcaatttgcccaaataatcatgaggtgcacatttatgaaaagagcggggccaagtggactaaggtgcacgaacttaaagagcataacggacaagtcactggcattgattgggcaccagaaagcaatagaattgttacctgcggaacggataggaacgcttatgtttggactctgaagggccgaacgtggaagcccaccttagtcatcctgagaattaatagggcagccaggtgtgtgaggtgggctcctaacgaaaataaattcgccgtggggtcaggaagtcgtgtcatctcgatctgttacttcgagcaagaaaacgattggtgggtgtag

SEQ ID NO: 106906 - DNA, 903 bp, Artificial Sequence
  Description of Artificial Sequence: Synthetic coding sequence
atgatattactcgaagtgaacaacagaatcatcgaggagactctcgcactgaagttcgagaatgccgccgcgggaaataaaccagaggctgtggaagtcaccttcgccgactttgacggggtgttgtatcatatctcgaatcctaacggggacaagactaaggtgatggtgtctattagccttaagttctacaaagaactccaggcccacggggccgatgagttattgaagcgggtctatggaagttttctagtgaaccctgagagtgggtataatgtcagtttgctctatgatttggagaatctcccagcaagcaaggactccatcgtgcaccaggccggcatgcttaaaagaaattgcttcgcctccgtgttcgaaaagtactttcagttccaggaggagggcaaagaaggagaaaaccgcgccgttattcactatagagatgacgaaaccatgtatgtcgagagcaagaaggatagggtgacagtggtgttttcaactgtcttcaaagacgatgatgacgtcgttattggcaaggtctttatgcaggagtttaaagagggcagaagggcctcccatacggctccccaagtcctgttctcccatcgcgagccacctctggagcttaaagataccgacgctgctgtaggagataatatcggctatattacatttgtgctctttccgcggcacacaaatgcctcagcgcgcgataacacaataaacctcattcacactttccgggactatctgcattatcacattaagtgttccaaggcctacatccatacacgtatgcgcgcaaagacatctgactttctcaaggttttaaacagggcaagaccagatgccgagaaaaaggaaatgaaaacaatcaccggcaagaccttctccagccgttag

SEQ ID NO: 106907 - DNA, 903 bp, Artificial Sequence
  Description of Artificial Sequence: Synthetic coding sequence
atgatactcttggaagtaaacaatcgaattatcgaggagacactggcgctaaaattcgaaaacgccgccgctgggaataagcccgaagcagtggaggtcacattcgcggattttgatggagttctttaccatatcagtaaccctaatggagataagacgaaagtaatggtgagcatttcgttgaagttttataaagagctgcaggcgcacggcgccgacgagctgttaaaaagagtgtatggctctttcttggtgaaccctgagagcggctataatgtctccctgctgtacgatctagagaatctgcccgcatcaaaagatagcatcgtgcaccaggcgggcatgcttaagagaaattgtttcgcgtctgtgttcgaaaagtatttccagtttcaagaggaaggcaaagaaggcgagaaccgggcagttattcactatagggatgatgagacgatgtacgttgaatccaagaaggatcgcgtgaccgtggtttttagcactgtgtttaaagacgatgatgatgtggtgatcggcaaagtcttcatgcaggaatttaaggagggaaggagagcatcccacacagccccccaggtgctgttctctcaccgggagcctcccttagagctgaaggataccgacgccgcagtgggagataacatcggctacattacctttgtgctgttcccgagacataccaacgctagcgcccgggacaatactatcaacttaattcataccttcagggactacctccattatcatatcaaatgcagtaaggcttatattcacacccgaatgagggctaaaacgtccgactttctcaaggtcctgaatagggcccggccagatgccgaaaaaaaagagatgaagactatcactggcaagaccttctccagtagatag

SEQ ID NO: 106908 - DNA, 273 bp, Artificial Sequence
  Description of Artificial Sequence: Synthetic coding sequence
atgatcttactagaagtgaacaatcgtattatcgaggagacattggcgctcaagtttgaaaacgccgccgcaggaaataagcctgaggccgtcgaagtgacatttgccgacttcgacggcgtgctgtatcacatcagtaacccaaatggtgacaaaactaaagtcatggtgagcatttcccttaagttctacaaagagctccaggcacatggggcagacgagctgctgaagcgcgtttatggctcattcctggtgaacccggagtccggatag

SEQ ID NO: 106909 - DNA, 864 bp, Artificial Sequence
  Description of Artificial Sequence: Synthetic coding sequence
atgtgtgatgaggacgaaaccaccgctctagtttgcgataacggctcaggcctggtgaaggccggcttcgctggggatgatgcaccgagagcggtgttcccctccatcgtcgggcgaccaagacatcaaggcgtcatggttggcatgggacaaaaagactcctacgttggggacgaggcacagagcaagagaggtatactcaccctgaagtatcctattgaacacgggattattactaactgggatgatatggaaaagatctggcaccacaccttctacaatgagctccgtgtcgccccagaggaacaccccaccttgcttaccgaggcccccctcaatccaaaggcaaatcgcgaaatcgtacgggacataaaagagaagttatgctacgtggccctagactttgagaatgagatggctaccgctgcctcttccagttcattagagaaaagctacgagctaccggacggccaggtgataacgataggaaacgagaggttcaggtgccccgaaactctctttcaacctagctttatcggaatggagtctgctgggattcacgaaactacctataacagcatcatgaagtgcgacatcgacattcgtaaagacctctacgcgaacaacgtcatgtctggggggacaacaatgtatcctggaatagccgatagaatgcagaaggagatcacagccctggcccccagcactatgaaaatcaagataatcgccccacctgaacgaaagtactccgtctggattggaggctccattttggccagcttgtcaactttccaacagatgtggatcacgaagcaggaatatgacgaggctggccctagtatagttcaccggaagtgtttttag

SEQ ID NO: 106910 - DNA, 765 bp, Artificial Sequence
  Description of Artificial Sequence: Synthetic coding sequence
atgtgcgacgaggatgagaccactgccctggtgtgcgacaacgggtctggactcgtgaaggccggctttgcaggcgatgatgcgccccgagctgtgttcccttctatcgtgggaagacctcggcaccagggtgtgatggtgggcatgggccagaaggactcttacgttggggatgaagcacaatccaaaagagggattctgactctgaagtacccgattgaacacggtatcattaccaattgggacgatatggagaaaatctggcatcataccttctacaatgagctcagagtggcacctgaggaacaccctactctcctgacagaggctcctctaaacccaaaagcaaatagggaaaagatgacacagataatgtttgaaaccttcaacgtgccagctatgtatgttgccattcaagcagttctgagcttgtacgcttccggccgtaccacagggattgtgctggacagcggagatggtatcatgaagtgtgacattgatatccgtaaagacctctacgcgaacaatgtaatgtctggggggactactatgtatccggggattgctgaccgaatgcagaaagagatcactgctctggctcctagtactatgaagattaaaatcatcgcgccaccagaacggaagtatagtgtgtggatcggcggatcaattctggcttccttgagcacatttcagcagatgtggataacaaaacaggagtacgatgaggctggcccatctatcgtccatcgcaaatgtttctag

SEQ ID NO: 106911 - DNA, 1029 bp, Artificial Sequence
  Description of Artificial Sequence: Synthetic coding sequence
atgtgcgacgaggatgaaaccacagctcttgtatgcgataacggatctgggctcgtcaaggccggatttgcgggcgatgacgctcctcgagcagtgtttccatccattgttggaaggcccaggcaccagggcgtgatggtggggatgggtcagaaggattcttatgtcggagatgaggcccaaagcaagcgggggatcctgaccttgaaatatcccatcgagcatgggatcatcacgaaggcaaacagagaaaaaatgactcaaatcatgttcgaaacctttaacgtccctgcgatgtacgtggctatccaggccgtgctgtctctctatgccagcggacgtactactggaatagtgctcgacagcggagatggggtgacacacaacgtgcctatctatgagggctatgctctgccacatgccatcatgagacttgatttggcgggtcgggacctgacagactatttgatgaaaattttgacagaacgaggttattcgttcgtgacgacagctgagcgagagatagtccgagatattaaggagaaactttgctatgtcgcgctggacttcgagaatgaaatggcaacagccgcttctagttcatccctggaaaaatcctacgagctaccggatggacaagtcatcactattggaaacgaacggttccgatgcccggaaaccctgtttcagcctagcttcataggcatggagagcgccgggatccacgagacaacctacaattctattatgaagtgcgacatcgacatacggaaagatctttatgccaataatgtgatgagcggtgggacaacgatgtacccgggcatcgcagatcgtatgcaaaaggaaattactgcgctggcgcctagtactatgaaaattaagattatcgcgcccccagaaagaaagtacagcgtctggatcggcggctcaattcttgctagcttatcaacgttccagcagatgtggatcacaaaacaagagtatgacgaagcagggcccagcatcgtccatcggaaatgcttttag

SEQ ID NO: 106912 - DNA, 870 bp, Artificial Sequence
  Description of Artificial Sequence: Synthetic coding sequence
atgtgcgatgaagacgagacgaccgccctggtgtgcgacaacggctctggtctcgtgaaggccggctttgcgggcgacgatgcccccagagccgtgtttccgtcaattgtgggaaggccgcggcatcaaggggtcatggtggggatgggacagaaggacagttacgtgggcgatgaggcccaatccaaacggggaatattgactttgaagtaccccatcgaacacggcataattactaactgggacgatatggaaaagatttggcaccacaccttctacaatgagctccgcgtagctccggaggaacatcccactctgcttacagaggctcctctgaatccaaaggccaatcctgaacgtgaaatagtgcgagatataaaggaaaaactgtgttatgtggctctggattttgagaacgagatggcgaccgcagcatcatcctcttcccttgagaaatcttacgaactgccagatggccaggttatcacaatcggcaatgaacgtttccggtgtcccgaaacgctctttcaaccatccttcataggcatggaaagcgcgggtatccacgagacaacctacaacagcatcatgaagtgcgatattgatatccgaaaggacttgtatgcaaacaacgtgatgtctggtggcactaccatgtatcccggcatcgcggatcggatgcaaaaagagatcaccgctctcgcgccatctaccatgaagatcaagattattgccccccctgaacgcaagtattctgtttggattggggggtccatcctggccagcctttccacatttcaacagatgtggatcacgaagcaggaatatgatgaagccggtccaagtatcgttcaccggaagtgcttctag

SEQ ID NO: 106913 - DNA, 1134 bp, Artificial Sequence
  Description of Artificial Sequence: Synthetic coding sequence
atgtgtgacgaagatgagaccactgccctggtgtgtgacaatggtagcgggctggtgaaagccggattcgctggtgatgacgcccctcgcgccgtgttccccagtatagtgggtagaccacgccaccagggcgtaatggtcggcatgggccagaaggatagctacgtgggcgatgaggctcaaagcaagaggggaattctgactctgaaataccctattgaacatggtatcataacgaactgggatgatatggagaaaatctggcaccacacattttataatgagctgcgcgtcgcacctgaagagcatcccaccctgcttacagaagcgccactaaatcccaaggcgaaccgggaaaaaatgactcaaatcatgtttgaaactttcaacgtccctgccatgtacgtggcgatacaggccgtgctctccctctacgcaagcggccgaaccaccggaatcgttctggatagtggggacggcgtgacccataatgtgccgatttatgagggatacgctttacctcatgcaatcatgagactggacttggcagggagagacctgactgactacctcatgaaaatcctcactgaacgaggttattccttcgtgaccacagccgagcgggagatagtgcgggacatcaaggagaagttatgttacgtcgctttagactttgagaacgaaatggccaccgcagcttcttctagctccctggagaagtcgtacgaactgcctgatggccaggtcattacaatagggaacgagagattccgctgtccggaaaccttattccagccttcctttattggtatggagagtgcaggtatccacgaaacaacatataattccattatgaaatgtgacatcgatatccgcaaagatctgtacgcgaataatgtgatgtccggcgggacgacgatgtatccagggattgcagaccgaatgcaaaaggagattactgcactcgcccctagtacgatgaagatcaaaattatcgcacctcctgagaggaagtacagcgtttggatcggcggcagcatcctggcatctctgtctacgttccaacaaatgtggattaccaaacaggaatacgacgaggccggaccttctatagtgcaccggaaatgtttttag

SEQ ID NO: 106914 - DNA, 1146 bp, Artificial Sequence
  Description of Artificial Sequence: Synthetic coding sequence
atggctccaggcgagaaagaaagcggggaaggcccagcaaagtccgcacttcgcaagataagaaccgctacgctggtgattagtctcgctcggggttggcaacagtgggcaaacgagaactctattaggcaggcacaggagcccactgggtggctccctgggggcacccaagactccccacaagctccaaaacctattacaccccctacatcccaccagaaggctcagtccgcgcccaagagtccacctcgcctccctgaagggcatggtgacgggcaatcatcagagaaggctccagaagtgtctcacattaagaaaaaggaagtatccaaaactgttgtgtcaaagacctacgaaagaggaggagacgtctctcacctctctcacagatacgaaagggacgccggggtgctcgagcccggccagcccgaaaatgacattgatagaatcctccattcccatggaagccctactcgtcgtagaaaatgtgcgaacctggtcagcgagctgactaaaggttggcgcgtgatggaacaggaagaacccacctggcgatccgatagcgtggatacggaagatagtggctatggtggcgaggcagaagagagaccagagcaggatggcgtgcaggtagcggtggtgcggatcaagcggcctctgccgagtcaagttaacagatttaccgagaaacttaattgcaaggcccaacagaagtactctccggtgggcaacctcaagggacggtggcaacaatgggctgatgaacacatccagtctcagaaacttaatcccttctctgaggaattcgactatgagcttgccatgagcaccagactgcataagggagatgaaggttacggaagacccaaggaaggtacaaagactgctgaacgtgccaaacgggcagaggagcacatttatcgagaaatgatggatatgtgctttattatttgtaccatggctcgccataggcgagatggcaaaattcaggtgaccttcggtgacttgttcgatagatacgtccgtatatccgataaggtcgttggcattttaatgagagccaggaaacatggcctcgttgattttgaaggcgaaatgctctggcaggggcgcgacgaccacgtggtgattacactactcaagtag

SEQ ID NO: 106915 - DNA, 2685 bp, Artificial Sequence
  Description of Artificial Sequence: Synthetic coding sequence
atgaaccagatagaacccggtgttcagtataattacgtgtacgatgaggacgagtacatgattcaggaagaggaatgggacagagatcttctgctggatcccgcgtgggagaaacagcagcgcaagacctttaccgcttggtgcaacagccatctgaggaaggccggaacacaaatagagaacatcgaagaagatttccgcaacggcctgaaactgatgttgttgttggaggtcatcagcggcgagaggttgcctaagccagaccgcgggaagatgcgttttcacaagattgctaacgttaacaaagcccttgattacattgccagcaagggggtgaaactggtgagtatcggggctgaagaaattgtggacggcaacgtaaagatgacactcgggatgatctggacgatcatcctgcggtttgctattcaggatatcagtgtagaagaaacatcagccaaagagggccttttgctatggtgtcagcgaaaaaccgccccatacagaaacgtaaatatccagaattttcatacatcgtggaaggatggcctggggctgtgcgccctgattcatcgacacaggcccgatctgatcgactactctaaactaaacaaagatgacccaatagggaatattaatcttgccatggagatcgcagaaaaacacttagatatccctaagatgctcgatgccgaggacatcgtgaatactcccaaaccagatgagcgcgctattatgacctacgtgagttgtttctaccatgcgtttgccggagcagaacaggccgagaccgcggctaacagaatctgcaaagtacttgctgtgaaccaagagaatgagaggctgatggaggagtacgaacgattggcttctgagctgctggagtggattagaaggacaattccttggcttgaaaaccggacaccagagaagaccatgcaggctatgcagaagaagctggaagacttcagggactatagaagaaagcataaaccccccaaagtgcaggagaagtgccagttagagatcaattttaacactctgcagaccaagctccgaatcagtaacagacccgcctttatgcctagcgagggaaagatggtgtcagacatagcgggagcgtggcagcgcctggagcaggctgaaaagggatatgaggaatggctactgaatgagatacgcaggctcgaacgcttggaacacctggctgaaaagtttagacagaaagcgtcaacccacgaaacctgggcctatggcaaagaacaaatcctgctacagaaggactacgaatctgccagtctgaccgaagtgcgcgccctgctgagaaagcatgaggcttttgagagcgatctggctgctcaccaggaccgagtagaacaaatcgctgctattgctcaggagttaaacgagctcgattaccatgacgcagttaacgtcaatgatcgctgccaaaagatatgcgatcagtgggaccgattaggcaccctgacacaaaagcggcgcgaagcactggagcgcatggagaagctgctcgaaacaatagatcagctccaccttgaattcgccaagagagctgcgcccttcaacaactggatggagggtgcaatggaggatttgcaggatatgtttatagtgcacagcatcgaggaaatacagagcctaattactgcacacgagcagttcaaggctacactcccggaggccgacggtgagcgccagtctatcatggcaattcagaacgaggtcgaaaaggtgatccagtcctacaatatacgcatttcctcatccaatccctacagtaccgtgaccatggatgagcttcgaaccaagtgggataaagtcaagcagctggtgcctatccgggatcagtccctgcaagaggagctggcgcggcagcatgcgaatgagcggctccgcaggcaattcgccgcgcaggcgaacgcgatcggcccttggattcagaataaaatggaggagattgcaagatcaagcatccagatcactggagcgctcgaggaccagatgaaccagctgaagcagtatgagcacaacatcataaactataagaacaacatcgataaacttgagggcgaccaccagctgattcaggaagcgctggtcttcgataataagcatactaattataccatggaacatatacgtgtgggctgggagctactcctcaccactatcgccagaacaataaatgaagtcgaaacacagatcctgacacgggatgcaaagggaattacccaggaacagatgaacgagttcagggcctcatttaatcactttgatagacgaaaaaatgggttaatggaccatgaggatttcagggcatgtttaatttccatgggctacgatcttggagaagctgaattcgctagaattatgactcttgtggaccccaacggccaaggaacagttacgtttcagagctttattgattttatgacccgcgagacagctgacacagacacggctgagcaggtgatagcaagcttccgaatcttggcctctgacaagccttatattttggccgaagaactgagacgagagctcccacccgatcaggcccaatactgcattaagcggatgcctgcctactctgggcctgggagtgtgccaggggccctggactacgccgctttttccagcgctctgtacggagagagcgacctatag

SEQ ID NO: 106916 - DNA, 2685 bp, Artificial Sequence
  Description of Artificial Sequence: Synthetic coding sequence
atgaatcagatagaacccggggtccagtacaactacgtgtacgacgaggatgaatatatgatacaggaagaagagtgggaccgcgacctcctgctggaccccgcctgggaaaaacaacagcggaaaacctttacagcctggtgcaactcgcacctacggaaagctggtacccagatcgagaatatcgaagaggatttccggaacgggttgaaattgatgctacttctggaagtgatatctggcgagaggctgccaaagcccgacaggggtaaaatgcggttccataagattgccaacgtaaataaagctctcgactatatagcctctaagggggtgaaattggtctccatcggcgcggaagagattgtggacggtaacgtgaaaatgaccctcgggatgatatggacaattatcctgagatttgccattcaggatatctcagtggaggaaacgtctgcaaaggaaggcctgctgttatggtgccaaagaaagaccgctccctaccgcaacgttaatatccagaattttcatacctcttggaaggacggtctggggctctgcgccttgattcatagacaccgtcctgatttgatcgactactcgaagctgaacaaggacgaccctatcggcaacatcaatttagccatggaaattgcagaaaagcacctcgatatcccaaagatgctggatgccgaggacctcgtgtataccgcgagaccggacgagagggctatcatgacttatgtgagttgttactaccacgctttcgccggggcccagaaggcagagaccgctgctaacagaatctgtaaagttctcgccgtgaatcaggaaaatgaacggttgatggaagaatacgaaagactggccagcgagttgctggagtggatccgaagaaccattccttggctggagaacaggacccctgaaaagactatgcaggctatgcagaaaaagctggaggatttcagggattaccggcggaagcataaacctccaaaggtgcaggagaagtgccagctagagattaatttcaacacgctgcagacaaaactgagaatctccaaccgccctgcattcatgccctcggaaggcaagatggtgtccgatatagcaggtgcctggcaaagactggaacaggccgagaaaggatatgaggagtggctgctgaacgagatccgaaggctcgagcgattggaacatttggcggagaagtttagacaaaaggcgagtacgcatgagacctgggcctacgggaaggaacagatactgcttcagaaggactacgagtcagctagcttgacagaagttcgtgcgcttctgagaaagcatgaggcatttgagtctgatttggccgcccaccaggaccgggttgaacagattgctgctattgcccaggagttgaacgaactggattatcacgacgctgtgaatgtaaatgacaggtgtcagaagatatgcgaccagtgggataggctcgggaccctaacccagaagcggcgcgaggccctggagagaatggaaaagttgctagagactattgaccagctccacctggaatttgcaaaaagggcagctccttttaataactggatggaaggcgccatggaagacctccaggatatgttcattgtgcactccattgaggagatccagtctctgattactgcccacgaacagtttaaagccacgttgccagaggctgacggcgaacggcagagcataatggctattcaaaatgaggttgaaaaggtaatacaatcatacaacatccgcatatccagctcaaacccctattctactgtgacaatggatgagttgcgcactaagtgggataaagtgaagcagctggtgcctatcagagatcagagcctgcaggaggagttagccaggcaacatgccaatgaaagactcagacgacagttcgcagcgcaggctaatgccatcggtccttggatacaaaacaagatggaggaaatcgcacgcagttccatacagattacgggcgctctcgaagatcaaatgaatcagctgaagcagtatgagcacaatattatcaactacaaaaacaatattgacaagctggaaggtgatcatcagttaatccaggaagcattggtgtttgacaacaaacataccaattatacaatggagcacatacgtgttgggtgggagctgctcctgaccactattgccagaaccataaacgaggtggagacccaaatattaacaagagacgcaaagggcattacacaagaacagatgaatgaattccgcgcttcttttaatcattttgatagacggaaaaatggactgatggaccacgaagactttcgggcttgtctaatctccatgggatacgatctcggcgaagctgagtttgcgaggatcatgaccttggttgatccaaacggacaggggaccgtgacatttcaatccttcatcgactttatgacaagggaaacagctgacacggatacggcagagcaggtcattgcttcctttaggatactagcctcagacaagccatacattctggcggaagaacttcggagagagctgcctcctgaccaagcccagtactgcattaaaaggatgcccgcatatagcggtccaggctccgtgcccggggccctggactacgctgcgttctcgtcggcgttatatggcgagtcagatctgtag

SEQ ID NO: 106917 - DNA, 1992 bp, Artificial Sequence
  Description of Artificial Sequence: Synthetic coding sequence
agcaccctgtctagcgtggaaggaccaccggagtccagtacttgcagctatcaagagatgcgacgctcatctgtgaatagcagcgccatggctgagactgccgccaaccgcatttgcaaggtgctggcagtgaaccaggaaaatgagagactgatggaagagtatgaaaggctggctagcgagctgctggagtggatacggcgcaccatcccgtggctagagaataggactccggaaaaaactatgcaggcaatgcaaaagaaactcgaagatttcagggattacagaagaaagcataaaccaccaaaggttcaagaaaagtgtcagctggagatcaactttaatacgctgcagacaaaactccgtatctccaatcgtcctgctttcatgccctcagaagggaaaatggtatccgatattgcaggggcctggcaacgtctggagcaagctgagaaaggttatgaggagtggttactgaatgagatccgccggctggaacgcctcgagcatctggccgagaagttcaggcagaaagcatctacccacgaaacatgggcttacgggaaagagcagattctgctacagaaggactatgagtctgcctccctgactgaagttcgggcgttactgagaaaacatgaagcctttgagtccgatctagcagcccaccaggaccgggtggagcagattgctgcaatagcccaagaactgaacgagctagactatcacgatgcagttaacgtgaacgaccggtgccaaaagatctgcgatcagtgggatcgcctaggcaccctgacacagaagcgccgtgaggccctggagagaatggagaaactgttggaaactatagaccagctccatttagagtttgcaaagcgggccgcaccgttcaacaattggatggaaggtgccatggaagaccttcaggatatgttcatcgtacactccatcgaagagattcagtctctcattacagctcacgagcagttcaaggccactctgcccgaagccgacggggagaggcagagtatcatggccattcaaaacgaggtcgagaaagtgatccagtcttacaacattcgcattagctccagcaatccatacagcactgttactatggatgagctgagaacaaaatgggataaggtcaaacagctggtacccatccgcgatcaatctctgcaggaggagcttgcccgtcagcatgcaaatgagagactcagacgacagtttgctgcacaagccaacgctatcggcccctggatccagaacaaaatggaggaaatcgcaaggagctctatccaaattaccggagcactggaagaccaaatgaaccagctaaagcagtacgagcacaatataatcaactataagaacaatatagacaaattagaaggggatcaccagctcatccaggaagctctggtcttcgacaataaacacactaactacaccatggaacacatcagagtggggtgggaacttctcctcacgaccattgctcggaccatcaacgaggttgagacccagattctcacacgcgatgcaaaggggattacccaagagcagatgaacgagtttcgagcttcattcaaccatttcgaccgccgcaaaaatggtctgatggatcacgaagattttcgtgcctgtctgatttcaatgggatacgacctcggcgaggctgaatttgcccggatcatgacactcgttgatccaaacggccagggcacggtcacatttcaatctttcattgattttatgaccagggaaacagcagacacagatacagcagagcaagtgattgcaagctttcgtattctagcctctgacaagccctacatactggctgaagagctcaggcgggagttgcctccagaccaggctcagtactgcataaaaagaatgcccgcctattcgggccccggaagtgtgcccggagctctcgattacgctgcctttagctctgctctttacggcgaatctgacttgtag

SEQ ID NO: 106918 - DNA, 1167 bp, Artificial Sequence
  Description of Artificial Sequence: Synthetic coding sequence
atggaaaagctgctggagactatcgatcagctccatttagagttcgctaagcgggcagcccctttcaacaattggatggaaggggcaatggaggatttgcaggacatgtttatcgttcactctattgaagaaatccagtcattgataacagctcacgagcaattcaaggcaacattacccgaggctgacggtgaacggcaaagcattatggcaatccagaatgaagttgagaaggttatacagtcttacaacattcggataagctctagtaacccctacagcacagtgaccatggatgaactcaggaccaaatgggacaaggtgaagcagctggttcctatcagagatcaatccctgcaggaggagttagcccgccagcatgcaaacgagcgcctccggcggcagttcgcagcccaggcgaatgcaataggcccctggattcaaaacaaaatggaggaaatcgcacggagtagtatacaaataacgggagcactggaggaccaaatgaaccaactcaaacaatatgagcacaacatcatcaactataaaaataacattgataaattggaaggcgatcatcagctgatccaggaggctttggtgtttgacaacaagcacacgaattatacgatggagcacattagggtgggctgggagctgctattgaccactatcgcgagaacaatcaacgaggtggagacccagattcttacacgtgatgcgaagggtattacacaggagcagatgaatgaattccgggcttcctttaatcattttgatcggcggaaaaatggtctaatggaccacgaggattttcgcgcttgcctgatctctatgggatatgacctaggcgaagctgaatttgctcggatcatgacactggtcgaccccaacggacagggaaccgtgaccttccagagctttatagattttatgactagagagaccgctgatacggacacagcggaacaggttatcgcgtctttccgtatcctcgcgtctgataaaccatacattctggccgaggaattgaggcgcgagctgcccccggaccaggcccagtactgtatcaagcgcatgcccgcatactccgggcccggctcagttcccggcgcccttgattacgccgcctttagttcagcactctatggggaaagtgatctgtag

SEQ ID NO: 106919 - DNA, 1131 bp, Artificial Sequence
  Description of Artificial Sequence: Synthetic coding sequence
atgtttaatcctcacgccttagacgtgcctgctgtgatctttgataacggatctgggctgtgtaaagccggtctttctggggagatcggtcctcgacacgtgatctccagtgtgcttggtcattgcaagttcaacgttcccctggcgaggttgaatcaaaagtatttcgtcggacaggaagcattgtacaaatacgaggcactacatcttcactacccaatagaaagaggcctagtgaccggttgggacgatatggagaagctgtggaaacatcttttcgagcgcgaactgggggtcaagccctcccagcagccggtgctcatgaccgagccctctctgaacccgcgcgagattagagagaagctggctgagatgatgtttgagacattcagtgtgccgggcttctacctctcaaaccacgcggttgctgctctgtatgcttcagcgtgcgtaaccggactcgtggtggactccggggacggcgtgacatgcaccgttcccatctttgaaggttattcgctccctcacgctgttacaaaactctgcatggcagggcgcgacatcacggaacacttaaccagactactgttcgcatctggatttaattttccttgcattttgaataaagcggttgtcaacaatataaaggagaagctgtgttatatcgccctggaaccggaaaaagagttacggaagtcgaggggggaagtacttggcgcctacagactgcccgatggccacgtcattcatttcggagacgagctgtaccaagtgcctgaggtgctgttcgctccagaccaacttggaatccactcacctgggctgtctaagatggtgtcatcctccatcatgaagtgcgacaccgacattcagaacaagttgtatgcagacatcgtgctgtctggaggcaccaccctcttaccaggtctggaggagcgcctaatgaaagaggtcgagcagctcgccagcaaggggacaccaattaaaataacagccagccccgacaggtgctttagtgcttggatcggagcctccattatgacatctatgagtagtttcaaacagatgtgggttacgtcagccgacttcaaggagtacggaacatcagtcgtacagagaagatgtttttag

SEQ ID NO: 106920 - DNA, 1134 bp, Artificial Sequence
  Description of Artificial Sequence: Synthetic coding sequence
atgttcaaccctcacgctctagattccccggcagtcatctttgacaacggatccggcttttgtaaggctgggctctctggggagtttggcccgcgccacatggttagctcaatagtaggacacttaaagtttcaagcaccatctgctgaagccaaccagaagaaatacttcgtgggcgaggaggcactttataaacaggaggcccttcagctgcattcccctttcgaacgcggacttattaccgggtgggatgacgtggagcggttatggaagcacctgtttgagtgggaactcggagtgaaacctagcgatcagcctctcctcgccaccgaaccttccctcaatcccagggagaatcgagaaaaaatggctgaagtgatgtttgagaacttcggcgtgcccgcgttctacctatcagatcaagctgtccttgccctgtatgctagtgcctgcgtgacagggctggtcgttgatagcggagatgcagtaacatgcacagttccaatctttgaagggtattcactcccacacgcagttacaaaactgcacgtcgctgggcgcgacatcactgagctgctcatgcagctcctgcttgcatccggtcacacttttccgtgtcagctcgacaagggcctggttgatgacattaaaaagaagctgtgttacgttgcactggaaccggagaaggagttatcaaggcgcccagaggaggtcctgcgcgagtataagctgccagacggtaacatcattagcctgggtgatcccttgcaccaggcccctgaagccctgttcgtaccacaacagctaggatcccagagccccggcctttctaatatggtgtctagctcaattaccaagtgcgatacagatattcagaagattttgttcggggaaatagtcctgtccggcggcaccacgttattccacgggctcgatgataggctgctcaaggaactggagcagttggcctcaaaagatacacccattaaaataaccgctccaccggatcggtggtttagtacttggattggagcttccatagtgacgtccctttcctctttcaagcaaatgtgggttacagccgctgatttcaaagagttcggcactagcgtggtgcagcggcggtgtttctag

SEQ ID NO: 106921 - DNA, 987 bp, Artificial Sequence
  Description of Artificial Sequence: Synthetic coding sequence
atgtttaatccccacgctctggattctcctgctgtgatcttcgataatgggagcggattctgtaaggctggcctgagcggcgagtttgggcctcggcacatggtcagttccatcgtgggtcaccttaagtttcaagctccctccgcagaggcgaatcaaaagaagtattttgtgggcgaagaggcattgtacaaacaagaggctcttcaattacactcacccttcgagagagggttgattacaggttgggatgatgttgagcgtttgtggaaacacctgtttgagtgggagctcggcgtgaagccctcagatcaacctctgctggcgactgagccttctctcaatccaagggagaaccgcgagaagatggccgaggttatgttcgagaacttcggcgtgcccgctttctatcttagcgatcaagcggtgctggcattatacgcctctgcctgtgtgactggtcttgtggtagacagcggtgatgccgtcacctgcaccgtccccatcttcgaagggtattcccttccccatgctgttactaagttgcacgtagctggccgcgacattacggagctgttgatgcagcttctccttgcatcagggcacacatttccgtgtcagctcgataaaggattggtcgacgatattaaaaaaaagctgtgttacgtggcgctggaaccagagaaggagttgagtagacggcctgaagaggtcctgagggaatacaagctacccgatgggaatatcataagtttaggggaccccttgcaccaggctccagaggcattgtttgtgccccagcagttgggctctcagagtccagggctctcaaatatggtcagctcttcaattactaagtgtgatacagacattcagaagatcctcttcggtgaaattgtgctcagtggaggcactactctttttcatgggctggacgatcggctgctccatctggattggtccctgcacagacacctgtcggaatag

SEQ ID NO: 106922 - DNA, 1752 bp, Artificial Sequence
  Description of Artificial Sequence: Synthetic coding sequence
atggaatctaagggcgcctcctcctgtaggctgctgttttgcctcttgataagtgccactgtattccgccctggtttggggtggtacactgtgaactcggcctacggtgacactattatcatcccctgtcgacttgacgtgcctcaaaatctgatgttcggtaaatggaaatacgagaagccagacgggtcccccgtctttatcgctttccggagctcaacaaaaaagagtgttcagtatgacgacgtgcctgagtataaagatagactcaatctgagcgagaattacacgctctcaatttccaatgccaggatctccgacgagaaaagattcgtctgtatgctcgttactgaagacaacgtttttgaggcaccaaccatcgtgaaggtcttcaaacagccttcaaaaccagaaatcgtgtcgaaagctttgtttctggaaacagagcagctgaagaagctgggggactgcatttcagaagactcgtatcctgatggcaatataacgtggtaccgcaatgggaaagtgcttcatccactggagggagcagtcgtgatcatcttcaaaaaggagatggatcctgttactcagttgtacacaatgacgtccacgctcgagtacaaaaccaccaaagccgacattcagatgccattcacctgtagtgttacttactacggtcccagcggtcaaaaaactatccacagcgagcaagcagtgttcgacatctactaccccaccgaacaagtgaccattcaggtactcccgcccaagaacgccatcaaagaaggcgataacattactttaaagtgcttgggcaatggcaatcctcctcctgaggagttcctgttctacctaccaggtcagcccgaaggcattcgttcttctaacacctacactctgacagatgtgcgcagaaatgcaactggagactataaatgctccctgatcgataagaaaagtatgatagctagcacagcgatcaccgttcactacctggatttgagcctcaacccttctggagaggtcacccgccaaattggggatgccctgccagtttcgtgtacaatctccgcgtccaggaatgccacagtagtttggatgaaagacaatatacggctgagatcgtccccttcattttcctccctgcactaccaagacgctgggaactacgtgtgtgagacagccctgcaggaggtcgagggtctcaaaaagcgtgagtcactgaccctgatcgtagaaggcaagccgcagatcaagatgaccaagaaaacagacccctcgggcctcagtaaaacaattatctgtcatgttgaaggttttcctaagccagccatccagtggacgatcaccggctccgggtctgtgataaaccaaacagaggaaagtccatatattaatgggagatattactctaagataatcattagcccagaggagaatgtgaccttgacatgcaccgccgaaaaccagctagaacggacggtgaattcacttaacgtatcagctatctcaattcctgaacacgacgaggctgacgagatctcggacgagaatagagaaaaagtgaacgatcaggctaaactcatcgtcgggattgtcgttggtttgcttctggccgccctcgtggcgggcgtggtatattggctctacatgaagaaatccaaaactgcctctaaacatgtaaacaaagacctgggtaacatggaagagaacaaaaagctggaggagaataatcataagacagaggcatag

SEQ ID NO: 106923 - DNA, 918 bp, Artificial Sequence
  Description of Artificial Sequence: Synthetic coding sequence
atggatccggtgacccagctctataccatgacctccacactggaatacaaaaccactaaggctgatattcaaatgccattcacatgctcggtaacatactacgggccatcgggtcagaaaaccatacatagtgagcaggcagtgttcgacatctattacctggaccttagcttaaacccctcaggggaagtaacaaggcaaatcggagatgcactgcccgtctcttgtacaatctcagcgtccagaaatgccactgtcgtgtggatgaaagacaacatccgactccgatcaagtcccagcttctcttcactgcactaccaggacgccgggaattatgtgtgcgagacagccttgcaagaggttgagggtctgaagaagcgcgaatcactgacactcatagtggagggaaaaccccagatcaaaatgactaaaaagaccgacccatcagggctcagcaagaccataatctgccatgtggagggcttccccaagcccgccatccagtggaccataactggttcggggtcagtgattaaccagacggaggagtctccctacatcaatggccgctactattctaagatcatcatcagtccagaggagaatgtgaccctgacatgtacggcagagaaccaacttgaacggaccgtcaatagcctcaacgtgagcgccatcagcatccccgagcacgacgaggccgacgaaatttctgacgagaatagagagaaggttaacgaccaagcaaagctgattgtcgggatcgtcgttggccttctgctggccgcactagtggcaggcgtggtgtattggttgtatatgaagaaatccaagactgcgtccaagcatgtgaacaaggacctgggaaatatggaggaaaacaagaagttggaggagaataatcataagacagaggcttag

SEQ ID NO: 106924 - DNA, 1035 bp, Artificial Sequence
  Description of Artificial Sequence: Synthetic coding sequence
tgacttggagattgtatcagtgaggattcttatccggacggaaatatcacctggtacaggaatgggaaagtcctccatcctctcgagggtgcagtcgtgattatatttaagaaagaaatggaccccgtgacgcagctctacactatgacatccactctcgagtataagacgacgaaagctgacatccaaatgccctttacatgcagcgttacctattatggaccgagcggacagaaaaccattcattctgaacaggccgtcttcgatatttattatctagacctgagcctaaacccaagcggagaggtcactcggcagattggcgatgcgctaccggttagctgcaccatctccgcttcaaggaatgccacggtggtgtggatgaaggacaatatccggcttaggagtagtcctagtttcagttcccttcactatcaggacgcaggcaactatgtctgtgagactgctctgcaagaggtggaaggtctgaagaagagagagtctctaaccctgatcgtcgaaggcaagccccagatcaagatgacaaagaaaaccgatccctctggcctatcgaagactatcatatgccacgttgagggtttcccaaagcccgccatacaatggacaatcacagggtcggggtctgttatcaaccagacagaagaatctccgtatatcaacggccgctactactccaaaattataattagccccgaggaaaacgtgactctgacatgcacagcggagaatcagctcgaaaggacagttaatagtctgaatgtgagtgcgatcagcataccagagcatgatgaagccgacgaaatttcagacgaaaatcgcgagaaagtgaacgaccaggcaaaactgatcgtgggaatagtcgttgggctgctactggccgctctcgtcgccggcgtggtgtattggctgtacatgaagaagagcaagacagctagcaagcatgtcaataaggacttgggtaacatggaagagaataagaaactagaagaaaataatcacaagaccgaagcatag

SEQ ID NO: 106925 - DNA, 1713 bp, Artificial Sequence
  Description of Artificial Sequence: Synthetic coding sequence
atggaaagcaagggagcgagcagctgcagactcttgttttgcctcctgatatcagcgacggtattcaggcccggactgggatggtacaccgttaactcagcgtatggcgatacaatcatcataccctgcaggctggatgtgccccagaatttgatgtttgggaagtggaaatacgagaaacctgatgggagccctgtatttatcgcttttaggagcagtacaaaaaaatccgttcagtacgatgatgtacccgagtataaggatcgtctgaacctgagtgagaattacacactgtccatcagcaatgctaggatatccgatgagaaacgattcgtctgcatgcttgtgacagaagataacgtgttcgaagcccctaccatcgtgaaggtattcaagcagccatctaagccggaaatagtgagcaaggcccttttcttggaaaccgagcagctgaaaaagctgggagattgtatatctgaagatagctatcctgacggaaatattacttggtaccgcaacggcaaagtccttcacccgctagaaggggccgtggttattatctttaaaaaggagatggacccagtaacccagctttataccatgacatcgaccctcgagtacaagaccactaaggcggacatccaaatgccatttacatgttccgtgacttactacggtccaagtgggcaaaaaacaattcacagcgagcaagcggtgtttgatatctattaccccactgagcaagtgacgattcaagtacttcctcccaagaacgctattaaggaaggcgataacattacgcttaagtgcctgggaaacggcaacccgcctcccgaagagtttcttttttatcttccaggacaacctgaagggattcggtctagtaacacgtataccctcaccgacgttcgccgaaacgccaccggcgattataaatgtagccttattgacaaaaagtcaatgattgctagcactgctattactgttcattacttggatctctcattgaatcccagcggagaggttacgcgccagatcggagacgccctgccagttagctgtacaatttccgcctcacgaaacgcaacagtggtctggatgaaagacaacatcaggctgcgaagcagcccaagcttctcttccctgcattatcaagacgccggcaattatgtctgcgaaacagccctccaggaggtcgaggggctgaagaagagagaaagtctgaccctgatcgtcgagggaaaaccccaaataaaaatgactaagaagaccgacccaagtggcctctctaaaactatcatatgtcatgtggaagggttccctaaacctgccattcaatggacaataactggatccggcagtgttatcaatcagacagaggagtcgccatacataaatggtagatactactcaaagattatcatcagtccagaggaaaacgtaaccctcacttgcacagctgagaaccagctagaaagaaccgtcaacagccttaacgtctcagcaaacgaaaaccgcgagaaagtgaacgaccaggctaaactgattgtgggcattgttgtcggactgctccttgccgccctcgtggcaggcgtggtgtattggctctatatgaaaaagtcaaaaaccgcttcaaaacatgtgaataaggatcttggaaatatggaggaaaataagaaacttgaggaaaacaatcataagacagaggcctag

SEQ ID NO: 106926 - DNA, 1074 bp, Artificial Sequence
  Description of Artificial Sequence: Synthetic coding sequence
atggaagtgctgcgcccacagcttatcagaattgacggtcgtaattatcgcaaaaaccccgttcaggaacagacataccagcacgaagaagacgaagaggatttttaccagggtagtatggaatgcgccgacgagccatgcgatgcctatgaggttgagcaaaccccccaaggcttccgtagtaccctccgcgctcctagtctcttatacaaacacatagtagggaaacggggggataccaggaaaaagatcgagatggagaccaagacatccatctctattccaaaaccgggccaggacggtgaaattgtgataacaggtcagcacaggaatggcgttatctccgccagaacacgcattgacgtgctgctggacacattccggcggaagcagccctttacacatttccttgcattttttcttaacgaggtggaggttcaggagggctttctgagattccaggaggaagtcctcgcaaaatgttccatggaccacggggtggactccagtatattccagaacccgaagaaattacacctaaccattgggatgctggttttactctcggaggaggaaattcaacagacctgtgaaatgctgcagcagtgcaaagaggaatttatcaacgacatctccggagggaagcccttggaagtggagatggctggaatagaatatatgaacgatgatccaggcatggtcgacgtcctttacgccaaggtgcatatgaaagatggcagcaataggctgcaggaactagtagatcgtgtcctcgaacgctttcaggcatctggcctcatagttaaggagtggaacagcgtgaagctccacgcaacagtcatgaatacactgttccgaaaggatcccaatgccgaagggcggtacaatctgtacaccgctgaagggaaatatatcttcaaggaacgtgagagctttgacggacgaaacatcctgaaactctttgagaatttctacttcggaagcctgaagcttaattctattcatatatcacaaagatttacagtggattctttcggaaattacgcatcctgcggccagatagacttctcatag

SEQ ID NO: 106927 - DNA, 1074 bp, Artificial Sequence
  Description of Artificial Sequence: Synthetic coding sequence
atggaggtcttacggcctcagttgatccgtattgatgggagaaactatcggaagaatccagttcaggagcagacctaccaacacgaggaggatgaggaggacttttatcagggctcgatggaatgcgcagatgagccctgcgacgcgtacgaagttgaacaaacaccacaaggcttccgctccacactgagggccccttccttgctgtacaagcatatagtgggcaaaagaggagatacccggaaaaagattgaaatggaaactaaaacaagtataagtataccaaagcctggccaggatggagaaatcgtaatcactggacagcatagaaacggcgtaatttcagcaagaactcgtatcgatgtcctgttggacacgttcaggaggaaacagcccttcactcattttctagccttcttcctcaacgaagtcgaggtgcaagagggcttcctgcgatttcaggaagaggtactcgcaaaatgtagcatggaccacggcgttgacagcagcatttttcagaatccaaagaagctgcatctgaccattggtatgctggtcctgctatccgaggaggaaatacagcagacctgcgagatgctacagcaatgcaaagaagagtttatcaacgatatctctgggggcaagcccctagaggtggagatggccggaattgaatacatgaatgatgatcctgggatggtggatgttctctatgcgaaagtgcacatgaaggacggatccaaccgtctgcaggagctcgtggatcgtgtgctggaacggttccaggcaagtgggcttatcgttaaggagtggaatagtgttaagcttcacgccaccgtgatgaacaccttgtttcggaaagaccccaacgctgaaggccgatacaacctgtacaccgccgaggggaaatacatcttcaaagaacgggaatcttttgatggacgtaacatattgaagctatttgagaacttttattttggatccctgaagctaaactcaatccatatatcccagagattcactgtagatagctttggcaattatgcctcctgcggccagattgatttctcctag

SEQ ID NO: 106928 - DNA, 1203 bp, Artificial Sequence
  Description of Artificial Sequence: Synthetic coding sequence
atggaggtgctgagaccacagttgatacgtatcgatggtcgaaactacaggaaaaatccagttcaggagcagacctatcagcatgaggaggatgaggaggacttttaccaagggagcatggaatgcgccgacgagccctgtgacgcctacgaggtcgaacagaccccccagggcttccgatccaccctgcgagccccatcacttctgtacaacttgatccatttgaacacttcaaatgattgtggattccaaaagataactttggactgtcagaacatctacacctggaagagcagacatatcgtgggcaaacgaggggatacccgaaagaagattgagatggaaactaagacctccattagtattcctaaacccggacaagatggcgaaatagttatcaccgggcagcaccgtaatggcgtgatatcagctaggacaagaattgacgtgcttctggatacgttcagaaggaaacagccatttactcattttctggccttttttctgaacgaggtcgaggtgcaggaggggttcttacgcttccaggaggaagtgctcgccaagtgctcaatggaccacggagtggattcctccatttttcagaatccaaagaaattgcatctgacaattggcatgctggtcctgctgagcgaggaagaaatacaacagacttgtgaaatgttacaacagtgtaaggaagaatttattaacgatataagcggggggaagcccttggaagtcgagatggccggcattgagtacatgaacgatgatcctgggatggtagacgtcctttacgcaaaagtgcatatgaaggatggtagtaacagattgcaggaacttgtcgatagagttctcgagcgctttcaagccagtggacttattgtgaaagagtggaatagtgttaaactccacgctacagtgatgaacaccttattccggaaagatccaaacgcagaaggccgctacaacctttatacagccgagggtaagtacatattcaaggaaagggaatcattcgacgggaggaacatcctgaagtcattcgctctcctccctcgcctcgaatataacgatgccatctcagctcattgcaatttatgcctccccggttcctccgatagtccagccagcgcatcgcaagtagcaggcattacgggggtctcagacgcttactcccagtcgctgcccgggaaatcgtag

SEQ ID NO: 106929 - DNA, 1074 bp, Artificial Sequence
  Description of Artificial Sequence: Synthetic coding sequence
atggaagttctccgcccccagctaatcagaatagacggacgaaattatcgaaaaaatccggttcaagagcagacttatcagcatgaagaggacgaggaagacttctaccaaggctcaatggagtgtgccgacgagccctgtgacgcctacgaagtggagcaaaccccacaggggtttcggtctacattgcgcgccccatcgttgctctacaaacatatcgtgggaaagcgcggggacacacgtaagaagatcgagatggaaacaaagacatccatcagcatccccaaacccgggcaggacggtgagatcgtaatcaccggacagcaccgtaacggagtgatttccgctcgaactagaatcgacgtcctgctggatacgttccgccggaaacagccctttacccattttctcgcctttttcctgaatgaggtagaggttcaggaaggctttctgcgctttcaagaggaggtgttggctaaatgtagcatggaccatggcgtcgactcctcaatcttccaaaacccaaaaaagctgcatcttacaatcggaatgctggttctcctgtccgaggaagagatccaacagacctgtgagatgttgcagcagtgtaaggaggagttcatcaatgacatttctggcgggaagcctctggaggtggagatggccggcatagagtacatgaacgacgacccaggtatggttgatgtgctatatgctaaagtgcacatgaaagacggctcaaatcgactgcaggagctggtggatagggtgcttgagaggttccaggctagtgggttgatcgttaaagagtggaactccgtcaaactgcacgctaccgtgatgaatacactttttcggaaggaccccaacgctgaggggagatataacctgtatactgccgaaggaaagtacatcttcaaggagcgggaaagcttcgacgggcggaacatcctgaaacttttcgaaaacttctatttcggtagtctaaagttgaactcaattcacatcagtcagagatttaccgtggattcattcggtaactacgcgtcttgcgggcagattgattttagctag

SEQ ID NO: 106930 - DNA, 1203 bp, Artificial Sequence
  Description of Artificial Sequence: Synthetic coding sequence
atggaggtgttacggccacaactcatccggattgatgggaggaattaccgaaaaaacccggttcaggagcagacatatcagcatgaggaagacgaggaggacttctatcaggggtcgatggagtgcgccgacgagccctgtgacgcttacgaagtggaacaaaccccacagggctttcgtagtactttacgcgctccctcgttgctctataacctcatccatctgaacactagcaatgactgcggctttcagaaaatcactcttgactgtcaaaacatctatacatggaagagtcgacatatagtgggaaaaaggggcgatacccgtaagaagattgagatggagactaagacttcgatttctataccaaagcctggccaggacggggagatcgtgatcactgggcaacatcggaacggcgttatctccgccaggactaggatcgatgtgctgctcgacacattccgtcgtaaacagccctttacacattttctggccttcttcttgaatgaggttgaggttcaggaagggtttttacggtttcaggaggaagtgttggccaagtgcagtatggatcatggggtggacagctctatctttcaaaaccccaaaaagctgcacctgaccatcggcatgctggtgctgctaagcgaggaagagatccaacagacctgcgagatgctgcagcaatgtaaggaggagtttattaatgatatttctggtggtaagccgctagaggtcgaaatggccggtatagaatacatgaacgacgaccccgggatggtagacgtgctgtacgccaaggtgcacatgaaagatggctctaacaggctacaggaactcgttgatcgtgtgcttgaacgtttccaggctagtggcctgatcgtaaaagagtggaactcagtgaagctgcacgccaccgtgatgaatactctttttaggaaggaccctaacgccgagggcagatataatctttacacggccgaaggaaaatacatctttaaggaacgcgagagctttgatggtagaaacattcttaaatcattcgcactattgccaagactggagtataatgacgccatctctgcacactgcaatctgtgcttgcccggcagtagcgactcccctgcctcagcatcgcaggtggctggcattaccggtgtgagtgacgcatatagtcagtctctccccggtaagagctag

SEQ ID NO: 106931 - DNA, 1074 bp, Artificial Sequence
  Description of Artificial Sequence: Synthetic coding sequence
atggaggtgctccgccctcagctgatacgaatcgatgggcggaattataggaagaaccctgtgcaagaacagacgtatcaacacgaagaggacgaagaagacttctaccaagggagtatggaatgcgccgacgagccctgcgacgcctacgaggtcgaacagactccacagggcttcagatccaccttgagagctccttcgcttctctataagcatattgtagggaagagaggcgataccagaaaaaaaatcgagatggagactaaaacctccatcagtattcccaagccgggccaggatggggagatcgtgataactggacagcaccgtaatggggtgatctcagctcggactagaattgatgtgctcctggatacctttcgccggaagcagcctttcactcatttcttggccttctttctcaatgaggtcgaggtgcaggagggatttctgaggtttcaggaggaagtactcgccaagtgctcaatggaccacggcgtggactcatccatttttcagaatcctaagaagctccacttaactataggcatgctagttctcctctctgaagaagagatccaacagacatgcgagatgcttcaacagtgtaaggaagaatttatcaatgatattagcgggggcaagccgctggaagtcgagatggctggaatcgagtatatgaatgacgatcccggcatggtcgacgtgctttacgccaaagtccatatgaaagacgggagtaacagactccaggagctcgttgaccgggttctcgaaagatttcaggccagcggcctcatagttaaggagtggaatagcgtaaaactgcacgctactgtgatgaacaccttgtttaggaaggatccgaatgccgagggccgatacaacctgtacacagctgaggggaagtatatcttcaaggagcgggaatcttttgacggccgaaatattttgaaactgtttgagaacttctacttcggcagcctgaagctaaactccatccatatcagtcagcgttttacagtcgatagttttggaaactatgccagctgtgggcaaatcgatttttcttag

SEQ ID NO: 106932 - DNA, 879 bp, Artificial Sequence
  Description of Artificial Sequence: Synthetic coding sequence
tgatacaaacacattgtgggaaaaaggggagatacccgcaagaaaattgaaatggagaccaagacaagtattagtatacctaagcccggccaggacggggaaattgtcataacaggacagcatcgcaacggcgtgattagtgcgcgcacccgcatcgacgtcctgctggataccttcaggcgcaaacaaccattcacccactttctcgcttttttcctgaatgaggtggaagtgcaggaaggttttctccggtttcaagaggaggtgctagccaaatgttccatggaccacggggttgattcatcgatcttccagaatcccaagaagctgcaccttaccattggtatgctggtgctcctgagcgaagaggagattcaacagacttgcgagatgctgcaacagtgcaaggaggagttcataaatgacataagcggaggaaagcccctggaagttgaaatggctgggattgagtatatgaacgacgatccaggcatggttgatgtgttgtacgccaaagttcatatgaaggatggttctaatagactacaggaactagtcgatcgcgttcttgaacgttttcaggcgagcgggctgattgtcaaagaatggaatagtgtcaaactccatgctaccgtaatgaacacgctgttcagaaaggaccctaatgcagaaggaagatataacctctatacagctgaaggaaagtatatattcaaagagcgtgagtcattcgacggcaggaacattctgaagtcatttgcgctgctgcctaggctggaatacaacgacgccatttcagcccactgtaatctgtgtctgccgggaagctcagactcacctgctagtgcatcccaggttgctggtataacagttgtgtag

SEQ ID NO: 106933 - DNA, 828 bp, Artificial Sequence
  Description of Artificial Sequence: Synthetic coding sequence
atggaaacaaaaacgtccatatctattccaaaaccaggccaggacggggagattgtgataactggccagcaccggaacggagtgattagcgctcgtacacggatcgatgtcttattggacacttttagacgcaagcagccttttacccactttttggccttctttctcaacgaggttgaagttcaggaaggattcctgcgtttccaagaggaggtgctggctaagtgtagtatggatcacggggtggactcctctatatttcagaatcctaaaaaattacatctgacaattggcatgttggttttactctcagaagaggagatacagcagacgtgtgagatgttacagcagtgcaaggaggagtttattaacgacatctcaggcggaaagcccctcgaggtggagatggccggtatcgaatacatgaacgacgatcccggcatggtggatgtgctgtacgccaaggtccacatgaaagatggatccaacagactacaggagttggtcgatcgcgtgctcgagcggttccaggcctcagggctgattgttaaagagtggaatagcgtgaagctgcacgccaccgttatgaacaccctgtttcgcaaagaccctaatgctgagggaaggtataacctgtacactgcggaggggaagtatatctttaaagagagagagtcatttgatggccgcaatatactcaaatcatttgcgttattgcctcgactcgaatacaatgacgccattagcgcccattgcaacctctgtttgcctggatcatctgatagccccgccagcgcatcacaagtagctggcatcaccgtggtatag

SEQ ID NO: 106934 - DNA, 372 bp, Artificial Sequence
  Description of Artificial Sequence: Synthetic coding sequence
atggaggttctccggccccagctgatccgcattgatggccggaattatcggaagaatccagtgcaggagcagacgtaccagcacgaagaagatgaggaagatttctaccagggctcaatggagtgcgccgacgagccctgtgatgcttatgaggtggaacaaactccacagggattccgaagtaccttaagagcgccctccctcctttacaagcacatagtgggtaagcgtggggacacaaggaaaaagatcgagatggaaaccaaaacttctatttctattccaaagcctggtcaagatggtgaaatcgttatcacgggccagcacaggaacggagttatctccgctcggactcggattgatgtgctttag

SEQ ID NO: 106935 - DNA, 312 bp, Artificial Sequence
  Description of Artificial Sequence: Synthetic coding sequence
atggaagtgctgaggcctcagttgatacggatcgacggtcgcaattaccggaaaaatcctgtgcaggagcaaacctatcagcatgaggaggacgaggaagacttctaccagggatccatggagtgtgcagatgagccttgtgacgcctatgaggtagagcagacccctcaaggattccggagtacactaagagctcccagcctcctgtacaaacatatcgtagggaagcggggagacaccagaaaaaagattgagatggagacaaagacttcaatctcaatcccaaagcccggacaggacggcgagatttag

SEQ ID NO: 106936 - DNA, 459 bp, Artificial Sequence
  Description of Artificial Sequence: Synthetic coding sequence
atggaggtgctccggccccagctgatcaggattgacgggcgtaattaccgcaagaaccctgtccaggaacagacgtaccagcacgaggaggatgaagaggacttttatcaagggagtatggaatgtgccgatgagccgtgtgatgcgtatgaagtggagcagactccacaaggcttccggagcaccttacgagctccaagcctcctgtacaaacatatcgtcggtaagcgcggtgacacacggaagaaaatcgaaatggagactaagacgtcaatcagcatccctaagcccgggcaagacggcgagatagtaatcaccgggcagcaccggaacggcgtgatctcagcccgaactcgcattgatgtcctgctcgatacctttcgccgaaaacagcccttcacacactttctagctttcttcctgaatgaggttgaggttcaggagggattcttgcgctag

SEQ ID NO: 106937 - DNA, 171 bp, Artificial Sequence
  Description of Artificial Sequence: Synthetic coding sequence
atggaggtgctccgcccgcagctcatccgtatcgatgggagaaattaccgaaaaaaccccgtacaggagcagacttaccagcacgaagaggacgaggaggatttttaccaaggcagcatggagtgtgcagacgagccttgtgatgcctatgaagtagaacagacaccgtag

SEQ ID NO: 106938 - DNA, 1140 bp, Artificial Sequence
  Description of Artificial Sequence: Synthetic coding sequence
atgatgaagtatccagggacctggccctgtcagggtatcattgggatcagtttcggcgagtctgtaatggaagttctgaggcctcaactgattcgcattgatggcaggaactatcgaaaaaaccctgtccaggagcagacatatcaacatgaggaggacgaagaggacttttaccagggatccatggagtgtgccgacgaaccatgtgatgcatacgaagtggagcagacgccccagggatttcgatcgacgctcagggcaccttctctgctgtacaagcacattgtggggaagcgaggggacactcgaaaaaaaatcgaaatggaaacgaagacatccatatccattcccaaacctggccaggacggagagattgtgatcactggacagcacagaaacggagtgatctccgcacgcacgcggatcgacgtgcttcttgacactttccggcgtaaacagccattcactcactttctcgccttctttctgaacgaagtggaggttcaagagggtttcctgagattccaggaggaggtgttagcaaagtgctcaatggatcacggcgtggattcttccatatttcagaacccaaagaagttacacctgacaatcggaatgttagttctgctctctgaagaggaaatacaacagacctgcgaaatgctccaacaatgtaaagaggaatttatcaacgatatctcgggtggcaagcctctggaggtagaaatggcaggcattgagtatatgaacgacgaccccgggatggttgatgtgttgtatgccaaagtgcatatgaaggacggcagtaatagactgcaggagctggttgatcgagtgctcgaacgttttcaggcaagtggtctcattgtcaaggagtggaattcagttaaactgcacgcaaccgtcatgaatacacttttcagaaaggacccaaacgccgagggcaggtacaatctttacaccgctgaaggaaaatacatctttaaggagagagagtcattcgatggtaggaacatcttgaagctcttcgagaatttctatttcgggagcctgaaactgaactcaatacatatctcccagcgctttacggtggacagttttggaaattacgcgagttgtggccagatcgactttagctag

SEQ ID NO: 106939 - DNA, 2274 bp, Artificial Sequence
  Description of Artificial Sequence: Synthetic coding sequence
atgcccgccctacccctggaccagttgcagatcacccacaaggatccaaagactggcaaacttcggacttctcctgccttgcaccccgaacagaaagccgaccgctacttcgtactgtataagcccccacctaaggataatatcccagcactcgtggaagagtacttggaacgtgcaactttcgtggccaatgatttggactggttgctggccttgccacacgataaattctggtgccaagtgatcttcgatgagacgctgcagaaatgcctggacagctacttgcggtacgtgcctcgaaaattcgatgaaggggttgcatctgctccagaagtggtggacatgcaaaaacgcttgcaccgatcagttttcctgacctttcttcgtatgtcaactcataaggagtctaaggaccatttcatctcacccagtgcgttcggagagattctctataataatttcctgttcgacattcccaagatcctggatctctgcgtcctgtttggtaagggtaatagtccactactgcagaagatgataggcaacatttttacccaacagcccagttactatagcgacttggacgaaactttacccacgattcttcaggtgttttctaacatcttgcagcactgcggcctacagggtgacggcgctaatacgacaccacagaagcttgaagagcgcggccgactgaccccaagtgatatgccactccttgagctgaaggatattgtgctgtacctttgcgatacctgcactacgctttgggctttccttgatatcttcccactggcgtgccagacatttcagaagcatgatttctgttatcggctggctagtttttacgaggccgctatccccgagatggagtccgcgataaaaaagagacgccttgaagactctaaacttcttggagacttgtggcagagattgagccactctcgcaagaaacttatggaaatctttcacattatactgaatcagatttgtcttctccctatactggaatcctcatgcgacaacatccagggctttatagaggaattcttacagatctttagcagcctgctacaggagaaacgttttctaagggattatgacgccctgtttcccgtggctgaggacatttctctcttgcaacaggcctcaagtgtactggatgagacccggactgcatatattttacaagcagttgaatctgcttgggagggagtggataggaggaaagctacagatgcgaaggatccaagcgtgatagaagaaccgaatggcgagccaaacggagtgaccgtgactgccgaggctgtgtcccaggccagttctcatcctgagaattctgaggaggaagaatgcatgggcgctgccgctgctgtgggccctgccatgtgtggtgtagagttggactccctcatcagtcaagtgaaggacctccttccagatcttggggaggggttcatattggcttgcctagagtattatcactacgacccggaacaggtgattaataacatcctcgaggaacggctggcacctaccctgtcccagctcgacaggaatctggatagagagatgaaaccagatcccactccactgctgacctctagacacaacgtgttccaaaatgatgagttcgacgtttttagcagggattccgtggacctgtctagagtgcataaggggaagagcacgcggaaagaggagaatacgaggtctctgttgaacgacaaaagggccgttgcagctcagcgccaacgttatgagcagtattccgttgtcgtcgaggaagtccccctgcaaccgggtgagtcacttccatatcacagtgtgtattacgaagacgagtatgatgacacttacgacggcaatcaggtgggggctaatgacgccgacagcgacgatgagctgatctcccggaggcccttcaccataccccaggtgcttaggactaaagtgcccagagaggggcaagaagaagatgatgatgatgaagaagatgacgcagacgaggaagctcctaagccagatcattttgtgcaggatccggccgtgctgagagagaaagccgaagcgagacgaatggcattcctggcaaagaagggctacaggcacgacagctctacagctgttgccggctcgcctcggggccatggccaaagtcgggaaaccacacaggagaggcgcaaaaaggaagccaataaagcaactagagctaatcacaaccgtcgaaccatggccgatagaaagcggtctaaggggatgataccatcttag

SEQ ID NO: 106940 - DNA, 2274 bp, Artificial Sequence
  Description of Artificial Sequence: Synthetic coding sequence
atgccggctctcccactcgaccaattgcagatcactcacaaggatcctaagactggaaagttaaggaccagccccgctctgcatcctgagcagaaagctgatcgctactttgtgttgtacaaacccccgccaaaagacaatattcccgctctcgtggaagagtacctggaacgggcaacgttcgtggctaacgatctggactggctccttgctctaccccacgacaaattttggtgccaagtgatattcgatgagactcttcagaagtgcctcgacagctatctccgttacgtcccacgcaaattcgatgaaggcgtcgcatcagcccctgaggtggtcgacatgcaaaagcgcttgcataggtctgtcttcctcacgttcttacgcatgtcaacgcacaaggagagcaaggatcattttatctctccctctgcctttggggagatcttatacaataactttttattcgacattcctaaaatactcgacttgtgtgtgctgttcggcaaaggcaatagcccgctgctccaaaagatgattgggaatatattcactcagcaaccgtcctactactccgatctggacgagactcttcccactattctgcaggtcttttccaatattctacagcattgcggcttgcagggcgacggcgcaaataccaccccccagaaactcgaggaaagagggaggctaaccccatcagacatgccattacttgagctgaaagatattgtgttgtatctgtgtgacacatgtaccacactgtgggccttcttggatatttttcctctggcatgtcagacttttcagaagcatgacttctgctacagattggccagcttctacgaagcggccattccagaaatggaaagcgccatcaaaaaacgccgtctggaagacagtaaattacttggggacctctggcaaaggctaagtcactccaggaaaaagttgatggaaattttccacattatcttaaatcagatttgtctactccccattctggagagtagctgcgataacattcagggctttatcgaggagttcttgcagatcttttcttccctccttcaggagaaacgattcctgcgcgactacgatgctttgtttcctgtggccgaagatatttccctgttgcaacaggccagctccgtcctcgacgaaacacgcacggcctatatcctacaggccgtggagtccgcgtgggaaggcgtcgaccgccgcaaggcaaccgacgctaaggacccttcggttatcgaagagccgaacggcgaaccgaacggcgtcactgtgacagctgaagccgtgtcacaggccagctctcacccagaaaacagtgaggaagaggagtgtatgggcgccgccgccgcggtgggcccagccatgtgtggggtggaactcgacagtctgatcagtcaggtcaaagacctcctaccagacttgggcgagggattcatcctggcatgccttgagtattaccattacgatccagaacaggtaatcaacaacattctggaggagagattggcacctacgctctcccagcttgataggaacctggaccgagagatgaagcctgaccctacgcccttgttaacatctaggcataatgtattccagaatgacgaatttgacgtgttttcccgcgattcagtcgacctgtcacgggtgcataagggaaagagcaccagaaaagaggagaatactaggtccttgctcaacgataagcgagccgttgctgcccagagacagaggtatgagcagtatagcgtcgttgtagaagaggttcctctgcaacccggcgaatccctgccataccacagcgtttactacgaagacgagtacgacgacacttatgacggtaatcaggtgggcgcaaacgatgcagattccgatgatgagctgatttctaggaggccattcacgatcccccaggtccttcgcacgaaagtcccaagagagggccaggaggaagacgacgatgatgaggaggacgacgccgacgaggaggctccaaagcccgatcactttgtccaagacccagctgtactccgtgaaaaagcagaggctcgaagaatggccttcctcgctaagaaggggtaccgtcatgattcaagcacagcggtagccgggagccctagaggccacgggcaaagccgtgagacaacacaggagcgacgaaaaaaggaggctaataaagccacaagggccaaccataatcggcgcaccatggctgaccgtaagcgctcgaaggggatgatcccatcgtag

SEQ ID NO: 106941 - DNA, 723 bp, Artificial Sequence
  Description of Artificial Sequence: Synthetic coding sequence
atgccggcacttccactggatcagctccagattacacacaaggatcctaaaaccggcaaactcaggacgagtcctgctctgcaccctgagcaaaaagcagatcggtattttgttttgtataaacctcccccaaaagataacatacctgcgcttgttgaagaatacctcgagagagcaacattcgtggccaatgatcttgactggctactagcgttaccccacgacaagttttggtgtcaggtgatatttgatgagaccctccagaaatgtcttgatagctacctaagatacgtgccccgaaaattcgatgaaggagtcgcctccgctcccgaggtggtggatatgcaaaaacgcctgcatagatcagtgttcttgacattcctgcgcatgagcacccataaagaaagtaaagatcattttatctccccgtctgcgttcggagagattctgtacaataattttctgttcgatattcctaagattctggacctgtgcgtactgtttggcaagggcaactcccctttactccagaagatgatagggaacatctttacccagcagccgtcgtattactccgatttggatgaaaccttacccaccatcctccaggtctttagcaacattttgcagcattgtggcctgcaaggcgatggcgccaatacaacaccgcagaaattggaggagcggggacgtctaaccccaagtgatatgccgctactctag

SEQ ID NO: 106942 - DNA, 2046 bp, Artificial Sequence
  Description of Artificial Sequence: Synthetic coding sequence
atgcccgcccttcccctggatcagctgcagattacccacaaggatcccaagactgggaaactacggacctcacccgccctcgtcatcttcgacgagaccttgcagaagtgcctggattcttaccttaggtacgtccctcgcaagttcgacgagggcgtggcttctgccccagaagtcgtggacatgcagaagcgcctgcaccgctcagtttttctgacatttctgagaatgtctacacataaagagtctaaaatattggatctctgcgtgctgtttggcaaaggtaatagtccattattgcaaaaaatgatcgggaacatcttcacccagcagccctcgtactatagcgacctcgacgaaacactgcccacaatcctccaggtctttagtaacattcttcaacattgtgggttgcagggggatggcgctaatacaaccccccagaaactcgaggaacgtggtcgtctgactccatccgatatgcccctcttggagttgaaagacatcgtcctgtacctttgcgacacatgtaccacactgtgggccttcctggacatctttcccctggcctgccagacctttcaaaaacatgatttctgctatcgcctggcatccttctacgaggctgcgatccccgagatggaatcagccataaagaaaagaaggctcgaggactctaagctgcttggggatctgtggcaacgtctgtcacattcacggaaaaaactcatggagattttccacattatactgaaccagatctgtctgctgcctatccttgaatctagttgcgataatatacaaggtttcatagaggaattcttgcaaattttttcttccttactccaagaaaagaggtttctgcgcgattatgatgcactctttccagtggctgaggatatctctctgctccaacaggcaagctccgttcttgatgaaacccggaccgcatacatactccaagccgtggagagtgcctgggagggtgtggaccggaggaaggctaccgatgctaaggatcccagcgtcatcgaagaacccaacggcgagcccaatggcgtaactgttactgcggaagcagtgagtcaagcctcaagtcacccagaaaactctgaagaggaggagtgcatgggtgccgccgcggccgtgggaccagctatgtgtggcgtggagttggattccttaattagccaagtgaaggatctccttcccgacctcggtgagggtttcatcctcgcatgtctggagtactaccactacgacccagagcaggttattaataacattctggaggaacgattggccccaactctgtctcagctcgataggaacctggacagagaaatgaaacccgacccaaccccactgttaacgtctaggcacaacgtgtttcagaatgacgagtttgatgtgttctccagagattccgtggacctgtcccgcgtgcataaaggcaagtccactcggaaggaggaaaatacaagaagcctattgaatgataaacgggccgtagctgcccagagacagcggtatgaacaatacagcgtggtagtcgaagaagtgcccttgcagccaggcgagagcttgccttatcatagcgtgtactatgaggatgaatatgatgacacatacgatggcaaccaagttggagctaatgatgcggactcagatgatgaactgatttccagaaggccatttaccatccctcaggtgctcagaactaaggtcccccgcgaagggcaggaagaagacgatgacgacgaggaggacgacgcggatgaggaagctcctaagcctgatcactttgtgcaggatcctgcagtgctgcgtgagaaagccgaggcgcggcgaatggctttcttagccaagaaggggtatagacacgattcgtcgacggccgttgcaggctcccccaggggacatggtcagtcccgggagaccacacaggagcgaaggaaaaaagaagccaataaggccactagggccaatcataaccgtaggacgatggccgatcgaaagcgcagcaaaggtatgattcccagctag

SEQ ID NO: 106943 - DNA, 531 bp, Artificial Sequence
  Description of Artificial Sequence: Synthetic coding sequence
atggctctgccgcggctgacaggagcactgcggagcttctcgaatgttacaaagcaagacaactataacgaggaagttgctgaccttaagatcaagaggtccaagcttcacgaacaggtcctcgatctggggttgacctggaagaaaatcattaagttcctgaacgaaaagctggagaaatccaagatgcagagcatcaatgaggaccttaaagacatcctacatgctgctaagcaaattgtgggcacagacaacgggagggaggctatcgagtcgggcgctgcattcctgttcatgacgttccatctgaaagactcagtcggccacaaggagaccaaggccattaagcagatgttcggacctttcccctcttcttctgctaccgcagcctgtaacgctacaaataggattatttcacactttagccaagacgacctgaccgcgctcgtgcagatgaccgaaaaagaacacggagacagggtgttttttgggaaaaatctagctttctcgttcgatatgcatgatctgtag

SEQ ID NO: 106944 - DNA, 336 bp, Artificial Sequence
  Description of Artificial Sequence: Synthetic coding sequence
atggccctgcccagactgaccggagcactcagatcattctctaatgtgaccaagcaggataactacaatgaggaggtcgcggacctgaaaattaagagaagtaagctgcacgagcaggtgctggatctcggcctaacatggaagaaaattattaagttcttaaacgagaagttggagaaatctaaaatgcaatccataaacgaagatcttaaggatattttgcacgcagccaagcaaatcgaagtgaactgccccttccagaaacgtcgactggatggaaaagaagaggacgaaaagatgtctagggcctccgatcggttcagagggctgcgttag

SEQ ID NO: 106945 - DNA, 6609 bp, Artificial Sequence
  Description of Artificial Sequence: Synthetic coding sequence
atggcccttcccagactgacaggagctctcaggtcctttagcaatgtcaccaagcaggacaactataacgaggaggtggccgacctgaaaatcaagcgaagtaagctccacgagcaggtgttggatctaggtctgacttggaaaaaaatcatcaagttcttaaacgagaagctggaaaagagtaagatgcagtctattaacgaggacttgaaagatatcctgcacgctgccaaacagattgtgggaactgataacggtcgtgaggcaatagaatccggagccgcttttttgtttatgactttccacctcaaagatagtgtgggtcacaaggagacaaaagctatcaaacaaatgtttggtccttttcccagcagcagcgcaactgccgcttgcaatgcgacgaataggattattagccatttctctcaagatgacttaacagccctagtgcagatgacagagaaggagcatggagatagagtattcttcgggaaaaacctcgcattcagcttcgacatgcatgatctggaccattttgatgaactaccaatcaatggcgaaacgcagaagacgatcagcttagattataagaagttcctgaacgagcatcttcaagaagcttgtacgccagaactgaaaccagtggaaaagacaaatggttcctttctgtggtgcgaagtggaaaagtacctgaactcaactttgaaggaaatgaccgaagtgccccgtgtcgaggatctctgctgtacactgtatgacatgctggcatcaattaaatctggagatgagctgcaagatgagctgtttgagctcctgggtcccgagggcctggagctgattgagaaacttctgcagaacaggatcaccatcgtcgataggttccttaacagctccaacgaccatcgctttcaggctctgcaagacaattgcaaaaaaatcctgggcgaaaacgcgaagcctaattatggatgccaagtcactatccagtccgagcaggaaaagcagttgatgaagcagtaccggcgcgaggaaaagcgaatagctaggcgcgagaaaaaagccggagaggacctggaggtcagcgagggtctgatgtgtttcgatccgaaggaactaaggatccagagggagcaggctctactgaatgcccggtcagttccaatcctctcacgccaaagagacgctgacgtggagaaaattcattatccccacgtttatgattcgcaagcagaggccatgaagacttctgcctttatcgccggcgccaaaatgattttacccgaggggattcaacgagaaaacaacaagctctatgaggaagtacggattccatacagcgaaccgatgccactgtctttcgaagagaagcctgtgtatatccaggacctcgacgagatcgggcagcttgcttttaaaggcatgaagcgcctgaaccgtattcagagcatcgtgttcgagacagcttataacaccaatgagaatatgcttatctgcgcccctaccggtgcaggcaagacgaacattgccatgctcacggtactccacgaaataaggcaacatttccagcagggggttataaagaagaatgagttcaaaattgtttatgtggccccaatgaaagctctggcggcagagatgactgattattttagccgaaggctcgaaccattgggcattatcgtcaaagagctcacaggagacatgcagttatctaaaagtgaaatattgaggacgcaaatgctagtaacgacccccgagaaatgggatgttgttacgagaaaatccgtcggagatgttgcactgagtcagattgtgcgcctactcatcctggatgaagtgcacctgcttcatgaggatagagggcccgtactcgagagtatcgttgctagaacgctgcgtcaagtggaaagtacccagagtatgatcaggatcctgggcctgtcagcaacactacccaactacctagacgtagcgacatttctacatgtaaacccgtacatcgggctgttctttttcgacgggaggttcagacccgtacctttggggcagacgtttctcggcataaagtgtgctaataagatgcagcagctcaacaatatggatgaggtgtgttacgagaacgtgctcaaacaggtgaaggcgggccaccaagtgatggtattcgtccatgcccgaaatgcaaccgtgagaactgccatgtccttgattgaaagggcaaaaaattgcggacacatacctttcttttttcccacccagggccatgactatgtcctggcggaaaagcaagtccagcgatcccgcaataagcaggtccgtgagcttttccccgacggattttctattcaccacgccggcatgttgagacaagaccgtaatctcgtggagaatctgttttctaacggccatattaaagttctggtgtgtacagctactcttgcctggggcgttaacctgcctgcacatgccgtgataatcaagggcacacaaatctacgccgcaaagagagggagcttcgtagatctgggtatattagatgtgatgcaaatatttggacgtgccggacggccacaattcgacaaattcggtgagggcatcatcataactacccatgacaaactttcccactacctaactcttcttacccagcgtaatccaattgagagtcagtttcttgaaagcctggccgacaacctgaacgccgaaatcgcccttggcacagtgactaacgttgaagaggctgtgaagtggattagctatacatacttatatgtgagaatgcgagctaatcctctagcatatgggatcagccataaggcctaccaaatcgatccaacacttagaaagcatcgtgagcagctggtaatcgaggtcgggaggaaattagacaaggcccagatgattagattcgaggagcgcactggatatttctcgtcaacagacctcgggaggaccgcctcacactactacattaagtacaacactattgagactttcaacgagctcttcgatgcccataagaccgagggggatattttcgccattgtgagtaaggccgaagaatttgaccaaatcaaggtcagggaagaggaaatcgaggaactcgatactctccttagcaatttctgtgaactgtctactccaggtggcgtcgagaattcttatggaaagatcaatattctgcttcagacttacatctcacgcggggaaatggattccttcagccttatctccgattccgcctacgtagcccagaacgctgcacgcatcgtccgcgctctgttcgaaatcgctctgagaaaaagatggcccactatgacttatagactgctgaacctgtctaaggtgattgataagcgactgtggggctgggcatctcccctcaggcagttttctattctgcctcctcacatactgaccagactggaggagaaaaagctgactgtggataagctcaaagacatgcgcaaagacgaaattggacatattctgcatcacgttaatatcggactaaaagtgaaacaatgtgtccaccaaattccgtcggtgatgatggaggcatccattcagcccattaccaggacagtgctgcgggtcacgttgtcaatctacgccgactttacatggaatgaccaggttcatggaaccgtgggggaaccctggtggatttgggtcgaggaccccaccaacgatcacatctatcatagtgaatattttctggccctcaagaagcaggtgattagtaaggaagctcagctccttgtcttcactataccaatctttgaacccctgccgtctcagtactatattagggccgtgtccgacagatggctgggcgcggaggcggtatgtataattaatttccagcatcttatactaccggagcgacacccaccccacactgaattattggatctccaaccactgcccatcactgcgctgggctgtaaagcatacgaagcactttacaatttttcgcacttcaacccagtgcagactcagattttccacaccctctaccacaccgactgtaacgtgctgcttggggcgcccacgggctcaggaaaaacggtggctgctgagcttgctatttttagggtattcaacaagtatcctactagtaaagctgtttacatcgctcccctgaaagccctagtgagggaacggatggatgactggaaggtgcgcatagaggagaaattagggaagaaagtcattgaattaacgggagacgtgacgcccgatatgaagtcaatcgcaaaagcggatctcatcgtaaccactcctgagaaatgggacggtgtgtcaaggtcttggcagaaccgaaactatgtgcagcaggtgacaattctgatcatagacgaaatacatctgcttggggaggagcgcggtccagtgctggaagtcattgtgtcccgcacgaactttatctccagccacacggaaaagccggtgcgcattgtcggcctcagcaccgccctcgccaatgcccgggatctggcagactggctaaacattaaacagatgggcctgttcaactttcgaccctctgttagaccagtaccgctggaagtgcacatccaggggttccccggtcaacactattgccccagaatggcctccatgaataagcctgccttccaagccattagatctcacagccctgccaagcccgtgctgatctttgttagttccagacggcagacaaggctgaccgctctcgaactgatagccttcctggctacggaggaggaccctaagcagtggctcaatatggatgagagagaaatggagaatatcatcgctaccgtcagggattccaatttgaagttgacattagcgtttggaattgggatgcaccacgccggtctacacgaacgtgatcgaaagaccgtcgaggaattgttcgtgaattgcaaggtccaagtcctgattgccacctctacactagcttggggtgttaactttcccgcccacctcgtaattatcaagggtaccgagtattacgacggcaaaactaggcgatacgtggacttccctattactgacgtcttgcagatgatgggccgcgcgggccggccccaattcgacgatcaaggcaaggccgtgatcttggtgcacgacataaagaaggatttttacaagaaattcctctacgagccatttcccgtcgagtcaagcctcctcggggtgttgtctgaccacctgaatgcggagatcgctggagggactatcacttccaagcaggatgctttggactacattacgtggacatattttttccggaggctgatcatgaatcccagctactacaatctcggcgatgtctcgcatgattcggtaaacaagttcctctcccacctgattgaaaaaagcctcatagagcttgagttatcatattgcatcgagattggagaagataaccggagtatcgaaccgttgacatacggccggatcgctagttactactacctgaaacaccaaacggtgaagatgtttaaagacagactgaagcctgagtgcagcacagaggaactgctgtcaattctgtcggatgctgaggagtacaccgacctcccagtgagacataacgaagaccatatgaacagcgagctggccaaatgcctgccaattgaatccaatcctcactcattcgactcgccacacactaaggcccacctgctgctccaagcccacctttcccgagcgatgctaccttgtcctgattatgacaccgatacaaagacagtgcttgaccaggctctgcgcgtgtgccaggccatgttagatgtggctgctaatcagggttggctggtcaccgttctgaatatcacaaacctgatccagatggtcatacaaggcaggtggcttaaggactcttccctcctgactctaccaaacatcgagaaccaccacctccatctcttcaagaagtggaagccgatcatgaaaggcccccacgcgcgaggcagaacttctattgagtccctgcctgagttgatccatgcctgcgggggcaaagatcacgttttctctagcatggttgaaagtgagcttcacgccgcgaaaaccaagcaagcctggaatttcctctcacatcttcctgtcattaatgtggggatctcggtaaagggctcatgggacgacctggtagaaggacataatgaactttctgtttcgactctgaccgctgacaaacgcgatgacaacaagtggatcaaactgcatgccgatcaggagtatgttctacaagtaagtctccaacgggtacactttggttttcacaagggtaagccagaatcgtgtgcagtgacacccaggtttccgaaaagcaaggacgagggctggttcctgatcttaggggaagtggataaaagggagctcatagcccttaagcgtgtcggctatattagaaatcatcacgtcgcgagtctcagtttctacactccggaaattccaggacgttatatatatacgctgtatttcatgtccgattgctatctgggcctggaccagcaatatgatatatacctgaatgtgacgcaggccagcctgagcgcccaggtgaatactaaagtgagcgactccctgacggatttggctctgaaatag

SEQ ID NO: 106946 - DNA, 816 bp, Artificial Sequence
  Description of Artificial Sequence: Synthetic coding sequence
atggaagattcccataaatccaccacatccgagactgccccacagccaggttctgctgttcagggcgcacacatatcccatatcgcccagcaggtctcaagtctgtccgaatctgaggagtctcaggattcttccgacagtatcgggtcatcacagaaggctcacggtatcctagctagacgtccaagctaccgcaagatcctgaaggatctgtcgagtgaggacaccagaggccgcaagggcgatggcgaaaactctggggttagtgcagccgtgactagtatgagtgttcccacccctatttaccagactagctcaggccagtacatcgccatcgctcccaatggtgcactgcagctggcatcccccggcacagacggcgtccaaggccttcagactttaaccatgacaaattccggatcaacccagcaggggaccactatccttcagtacgctcagaccagcgacggacagcagatcctggttcccagcaaccaggtggttgtccaaacggcgtcaggagacatgcagacttatcagattagaaccactccttctgcaactagtcttccacagacagtcgtgatgacatcacctgtcacactaaccagtcaaaccacaaagacagatgatccgcagcttaaacgggagattaggttgatgaaaaatagggaggcagctagggagtgtagacgcaaaaagaaagagtatgtaaaatgtctggagaacagggtcgctgtgttagaaaaccagaataaaacactgatagaggagctcaagactctgaaagacctatacagtaataagagcgtgtag

SEQ ID NO: 106947 - DNA, 411 bp, Artificial Sequence
  Description of Artificial Sequence: Synthetic coding sequence
atgactaactctggaagcacccagcagggaaccacaatcctgcagtacgcacaaacctccgacggccagcagatcctggtgccttccaatcaggtggtggtgcagaccgccagcggggacatgcagacctatcagattcgtactactccaagcgcgacaagtttgccgcagaccgtggttatgacgagtccagtcactttaacttcccagacaactaaaactgacgacccccagctgaaaagagagatccgtctgatgaaaaaccgggaggctgcacgggagtgcagacggaaaaaaaaggagtacgtaaaatgccttgagaatcgtgtggcagtacttgagaatcaaaataagacactgatcgaagagctgaaaactttaaaggacctttatagtaataagagtgtatag

SEQ ID NO: 106948 - DNA, 603 bp, Artificial Sequence
  Description of Artificial Sequence: Synthetic coding sequence
atggaggattcccataaatccactacctcagaaacagctccacagcctggatcggctgtgcagggggcacatatctcccacattgcacagcaggtaagcagtctcagtgaaagtgaagaaagccaggacagcagcgatagcatagggtcttcccaaaaagcacacggcatactggcccggcggccgtcatatcgtaagattctgaaagaccttagttccgaggataccagggggcggaagggcgacggcgaaaattcgggcgtttccgctgctgtaacttccatgtctgtgcccacgcctatctatcagacaagtagtggacagtatattgccattgcaccgaacggagccctacaactggcctccccgggcaccgacggagtgcagggccttcagaccttgacaatgacaaactcaggcagcacccagcagggaacaactatactgcaatacgcccaaacaagcgatggtcagcagatcctggtgccatccaatcaggttgtggtgcagacagcctccggggacatgcagacctaccaaattaggactacaccatctgcaacttcacttcctcagaccgtggtgatgacctctcccgtctag

SEQ ID NO: 106949 - DNA, 513 bp, Artificial Sequence
  Description of Artificial Sequence: Synthetic coding sequence
atggaagattcccacaagagtacgacctcggagaccgcccctcagcctggctccgcagtgcagggagctcatatctcacatattgcacaacaggtttctagcctcagcgagagtgaagaatctcaggacagctcagattcaattgggagttctcagaaggcacacgggattttggccaggcgccccagctaccgcaaaattctgaaggacctcagctctgaggataccagaggccgcaaaggggacggcgagaattcaggagtctccgccgccgtgacatcgatgtcagtgcctactcccatttatcagacttcttccggtcaatacatagctatcgccccaaatggcgcgctgcaattagcttctcccggtacggacggagtccagggcttacagactctgacaatgactaattccggatcaacacaacagggcacgaccatactgcagtacgctcagacaagtgacggtcaacagattctagtgccttccaaccaggtcgtggtccagtag

SEQ ID NO: 106950 - DNA, 321 bp, Artificial Sequence
  Description of Artificial Sequence: Synthetic coding sequence
atgatgctccagcatcccggacaggtgtccgcatccgaagaggagcttcgtttcgcaatccagaataaacatctgtgtcataggatgtcaagtgctttggagtccgtgacggtgtcagacaggccgctcggcgtcagcataaccaaagctgaggtagcaccagaagaggatgaacggaaaaagcggaggcgcgaacggaataaaattgcagctgccaagtgccgaaacaagaaaaaggagaaaacagagtgtctgcagaagctgcctagaccattctgggttcagaaaacctgcatttgggccgtggacagctgcaagtag

SEQ ID NO: 106951 - DNA, 546 bp, Artificial Sequence
  Description of Artificial Sequence: Synthetic coding sequence
atgatgctacagcaccctggccaggtgtcggcctcagaagtgagcgcctcagccatcgtcccttgcctgagtccaccaggctctctggtgtttgaagacttcgctaatctcacaccctttgtgaaggaagagctgagatttgcaattcagaacaaacacctgtgtcacaggatgtcttccgccctcgagtccgtgaccgtgagtgatcgtccgctaggcgtttctatcaccaaggccgaggtggccccagaagaggacgaacggaagaagaggagaagagaacggaacaagatcgccgccgcgaagtgccgaaataaaaagaaggaaaaaacagaatgcctccagaaagaatcagaaaaactggagtccgttaatgcagagctgaaggcacagattgaagagctgaagaatgagaagcagcaccttatctacatgctgaaccttcataggccgacatgcattgtgagggcacagaacggtaggactccagaggatgaaagaaatctcttcatccagcagattaaggaaggtacactgcagagttag

SEQ ID NO: 106952 - DNA, 528 bp, Artificial Sequence
  Description of Artificial Sequence: Synthetic coding sequence
atgatgttacaacacccagggcaagtatcggcttctgaggtctctgcttcagcgatagtgccctgcctgtcaccacctggttcactcgtgtttgaggattttgccaacttgacaccctttgtgaaggaggagttacgtttcgccatccagaataaacatctgtgtcacagaatgagttctgccttggagtctgtgactgtgtcagaccgccctcttggggtgtcaataacgaaagcagaagttgcacctgaggaggatgagcggaagaaacgaagacgggaacgaaacaaaattgcggctgctaaatgtcggaacaaaaaaaaggagaagacagagtgcctccaaaaagaatcagagaaactcgagtctgttaatgctgagctgaaggcacaaatcgaggagctcaagaatgaaaaacagcatctgatctatatgttaaaccttcaccggcccacgtgcattgtccgcgcccaaaacggacggaccccggaggatgagcgcaatttgttcatccagcaaataaagtag

SEQ ID NO: 106953 - DNA, 408 bp, Artificial Sequence
  Description of Artificial Sequence: Synthetic coding sequence
atgatgctccagcaccccgggcaggtgagtgccagcgaggtttctgctagtgccattgtgccttgtttgtccccaccagggtcccttgtgttcgaggacttcgctaatctaactccttttgtgaaagaggaacttcggtttgctatccagaacaagcacttgtgtcaccgcatgtcatcagcgttggagtccgtgaccgtgtccgaccgacccctgggtgttagtatcacgaaggccgaggtggccccagaagaagacgagcggaagaagagaaggcgcgagagaaataaaatcgccgccgcgaagtgccgaaataagaaaaaggagaagaccgagtgcttgcagaaactaccccgccccttttgggtgcaaaagacatgtatttgggcagtcgattcttgcaagtag

SEQ ID NO: 106954 - DNA, 375 bp, Artificial Sequence
  Description of Artificial Sequence: Synthetic coding sequence
atgagctctgcactggagagtgtcacagtgtctgacagaccgctgggcgtcagtattaccaaagccgaggtcgcacccgaagaagacgagcggaagaagcgaaggcgcgagaggaataagatagcagctgccaagtgccggaacaaaaagaaagagaagactgagtgtctgcaaaaggaaagtgaaaagctggaaagcgtgaatgctgagttgaaggctcaaatcgaggagctgaaaaatgaaaagcagcaccttatttacatgctcaatctgcatcggcctacctgcatagtgcgagcacagaatggacgtacgcccgaggatgaacgcaacctcttcattcaacagattaaggaagggaccttacagtcctag

SEQ ID NO: 106955 - DNA, 546 bp, Artificial Sequence
  Description of Artificial Sequence: Synthetic coding sequence
atgatgctgcagcaccccggccaggtttccgcctcagaagtgagtgccagcgcaattgtcccctgcctcagtccgcccggaagcctggtcttcgaggacttcgcaaatctaaccccgttcgtcaaagaagaactcagattcgctattcagaataagcatctgtgtcatagaatgtctagtgccttggagtccgtgacagtgtccgatcgacccctcggagtttcgattactaaggccgaagtggctcccgaggaggatgagcgcaagaagcgcaggcgggagcgaaataagatcgctgctgcaaaatgccgcaacaaaaagaaggagaagacagaatgcctgcagaaggaaagcgagaaactagagtccgtgaatgccgaacttaaagctcagatcgaggagctgaaaaacgaaaagcaacacctgatctacatgctgaatcttcaccggcccacgtgcatcgttcgcgcacagaatggacgtacacccgaagacgagcgtaatctctttatccagcaaatcaaggagggaacgctgcaatcgtag

SEQ ID NO: 106956 - DNA, 408 bp, Artificial Sequence
  Description of Artificial Sequence: Synthetic coding sequence
atgatgctccagcaccctggacaggtgagcgccagcgaagtgtctgcctcagctattgttccatgtcttagccctcccggttccctcgttttcgaggatttcgccaacctgactccgtttgtaaaggaggaactgcgttttgccatccagaacaaacatctgtgccatcgcatgagtagcgccctggagagcgtgacagtctcggaccgcccgttgggcgtcagcatcacgaaagcggaagtagcccctgaggaagacgagcgcaaaaagcggagacgcgagcgaaataagatcgctgctgctaagtgtaggaacaagaaaaaagaaaagaccgagtgccttcagaagttgccccgcccattctgggtgcagaagacatgtatatgggccgtggactcttgcaagtag

SEQ ID NO: 106957 - DNA, 1056 bp, Artificial Sequence
  Description of Artificial Sequence: Synthetic coding sequence
atgaccgaaatgtcctttctcagtagcgaagtgctcgtcggggacctaatgtctccatttgatcagtcagggctaggggccgaggaatcactaggtcttcttgatgactacctggaagtggccaagcattttaagcctcatggcttttcctctgacaaagccaaagctggttcctcagagtggctggcagtggatggccttgtgagcccctcaaataatagtaaggaggacgcctttagtggaaccgattggatgctggagaaaatggacttaaaggaatttgatttggacgccctgctcggtatcgatgacctggagactatgccggatgatcttctgaccacccttgatgatacatgtgacctttttgcacccttggtacaggagacaaataagcaaccaccgcagacagttaaccctatcggccaccttcccgagtctctcacaaaaccagatcaggtcgctccatttacctttctacagccgctccccctgagcccaggagtactgtcttctacaccggatcactccttctcattagaactcgggtcagaggtggatattacagaaggggatagaaagcccgattacactgcatacgtggccatgatcccacagtgcattaaagaggaagacaccccctctgataacgattctggtatatgtatgtcccccgagagctacctgggcagcccgcagcactccccaagtacacgaggcagccccaatcgcagcttgccgtcacccggcgtcctttgtggatctgcaagaccaaagccatatgacccccctggagagaaaatggttgcagctaaagtgaaaggggaaaagctggataagaaactcaaaaagatggagcagaataaaacagccgccacgcggtatcgccaaaaaaaacgcgccgaacaagaagccctgaccggcgagtgcaaggaactggagaagaaaaatgaggcgttaaaggagcgtgccgattctctggccaaagaaatccagtacctgaaagatcttatcgaagaggtgagaaaggcacgagggaaaaagagggtcccttag

SEQ ID NO: 106958 - DNA, 1056 bp, Artificial Sequence
  Description of Artificial Sequence: Synthetic coding sequence
atgaccgagatgagcttcttgtcaagcgaggtgttggtcggcgatctaatgtccccatttgaccagtcagggctgggggctgaagagtcactcggcctcctggacgactatctcgaagtggccaagcacttcaagccacacggtttcagctcggacaaggccaaggctgggtctagcgagtggctggccgtggatggcctcgtttcccctagcaataacagcaaagaggatgcgttcagcggaacagattggatgttggagaagatggatcttaaggaattcgatctggatgcactgctgggaattgacgatctggagacaatgcctgatgacctactcacaactctggacgacacatgcgatcttttcgcacctctcgtccaggagactaataaacaacccccacagactgttaatcctatcggtcatttgccggaaagcctgaccaagcccgaccaggtagcgccgtttaccttcctgcagccgctacccctctccccgggggtgctgtcttcaacccctgatcacagcttctccctcgaactgggctctgaggtggacatcactgaaggggacaggaagcccgactataccgcctatgtggctatgatcccccaatgcatcaaagaagaggacactccttccgacaacgactccggtatctgtatgtcccctgaatcttacctgggctctcctcagcacagtccttctacccgtggttctcctaacagatctctgccatcccccggcgtgctgtgtgggtctgcaagaccgaagccttatgatccgccaggtgagaagatggtggctgccaaagttaagggcgaaaaactggacaaaaaattaaaaaagatggagcagaataaaacggccgcgacacgctaccgccagaagaaaagggctgaacaggaggctctgactggtgaatgtaaggagttagaaaagaagaatgaggctttaaaggagagggctgactccttggctaaggagatccagtacttgaaagatctgatcgaagaagtgcgcaaagcacgggggaaaaaaagagtgccttag

SEQ ID NO: 106959 - DNA, 1056 bp, Artificial Sequence
  Description of Artificial Sequence: Synthetic coding sequence
atgacagagatgtctttcttatcttctgaggtgctagtgggcgatcttatgagcccatttgaccaaagtggactgggcgcagaagaaagtttaggattgttggacgactacctggaggttgctaagcacttcaaaccacacgggttcagctcagacaaggcaaaagccggctcctcagaatggcttgcagtcgacggtttagtgagtccgagcaacaactcgaaggaagacgccttttcaggcaccgattggatgttggaaaagatggaccttaaggaattcgacctcgacgcccttcttggtattgacgacttagaaactatgcccgatgatcttctcaccacgctggacgacacttgtgatctctttgcccccctggttcaggagactaataagcagcccccccagactgtaaatcccatcgggcacctgcctgagtctttgaccaaacccgaccaggttgcccccttcacattccttcagccactccccctgagcccgggggttctgagctccacaccggaccactcttttagcctcgagctggggtccgaggtagatatcaccgagggcgatcgcaagcctgactacaccgcttacgtggctatgatccctcagtgtattaaggaagaggacactccttctgataatgacagcggtatatgtatgtctcctgaaagttatctcggcagtccgcaacactcccctagcacgcgcggaagccctaatcgatctctgcctagtcctggggtcttatgtggatcggcccgccccaaaccatacgaccccccaggcgagaaaatggttgccgcgaaagtgaagggcgagaaactggataagaagctgaaaaagatggagcagaacaaaactgcggcaacccgttacaggcagaagaagcgggccgagcaggaggccttaaccggcgaatgtaaggagctcgaaaaaaaaaacgaagcactgaaagaacgggcagactcacttgccaaagagatccagtatctaaaagatcttattgaagaggtcagaaaagcacgaggaaagaaacgggtaccatag

SEQ ID NO: 106960 - DNA, 849 bp, Artificial Sequence
  Description of Artificial Sequence: Synthetic coding sequence
atgagcctactcgctacactgggactagagctggatcgggccctcctgcccgctagcggcttgggatggcttgtggattatggtaaacttccccctgctcccgcccctttggccccctatgaagtgctagggggggctttagaggggggcctgcccgttgggggcgagccgctcgcgggggatggcttcagtgactggatgacagaacgagtagatttcacggcactcttgccactggagccaccccttccccctggcaccctcccacagccttcacccacaccccctgatctggaagcaatggcttcgctcctcaagaaagaattggagcaaatggaggacttcttcctggatgctccccctctcccgccccccagccctccacccctgcctcctcctccactccctccggcaccatccctcccgcttagcctgccctcatttgatttgcctcaacctcctgtcttagatactctggacctgttggccatttattgtaggaacgaggcagggcaggaagaggtgggcatgcccccattacctcccccacaacaacctcctcccccgtccccaccccagcccagccggctggcaccctatccacaccctgctacgaccaggggtgataggaaacagaaaaaacgtgatcagaataaaagcgccgccttgcggtatcggcaacggaaaagggccgaaggggaggccctcgagggggaatgccagggcctggaggcccgcaatagggagcttaaggaaagggctgaatccgtggaaagggaaattcagtacgttaaagacctcttaatcgaagtttataaagcccgctctcagcgaacaagatcttgctag

SEQ ID NO: 106961 - DNA, 2013 bp, Artificial Sequence
  Description of Artificial Sequence: Synthetic coding sequence
atgggagagcccgctggcgtcgccgggactatggaaagtcccttttcacccggactttttcaccgactggacgaggactgggactccgcactgtttgctgaattaggctactttaccgacacagacgagctgcagctcgaggcggctaacgaaacctatgagaataactttgacaatctcgactttgacctggacttgatgccttgggagtcagatatttgggacataaacaatcagatttgcactgtcaaagatattaaggcagaaccccagccgctgtctcccgcctcgtcctcatactccgtctcttccccccgtagcgtggattcatactcaagtacccagcacgtgcccgaagaattagacttaagttcctccagccaaatgtctcctctgagcctgtacggagagaacagtaatagccttagctctgccgagcctctgaaggaggacaagccggtaactggacctaggaacaagaccgagaacggattaacccccaagaagaaaattcaagttaatagtaagccttctattcaacccaaacctcttctgctgccggccgctcccaagacccagactaactcttctgtcccggccaagaccattattattcagactgtgcccactttgatgccattagccaaacagcagccaataatttctttgcaaccagctccgacaaagggacagaccgtgctactcagccagccaacagtcgttcaattacaggcccccggggtgctgccctctgctcagcctgtactggcagtcgcaggtggggtgactcagttgccaaatcacgtcgtgaacgtggtgcccgcaccaagcgccaattcccctgtcaacgggaaactaagtgttacgaaacctgtgctgcaatccacaatgagaaacgtggggtctgacattgccgtcctgagaaggcaacagaggatgatcaagaaccgggagagcgcttgccagtcaagaaaaaagaagaaagagtacatgttagggttagaagcccgcctaaaggctgccctaagcgagaacgaacagctcaaaaaggagaatggaacactcaaacgccaattggacgaggtcgtgtcggagaatcagagactcaaagtacctagtcccaagcgcagggtggtgtgtgtaatgatcgtactggctttcatcatcctcaattacggaccaatgtccatgttggaacaggatagtaggcgcatgaatccaagcgtgagccccgccaatcagaggcggcatttgttaggattcagcgccaaggaggctcaggacacgagcgacgggattatccagaagaatagttaccgctacgatcattcagtgagtaatgataaagctctcatggtgctgaccgaggaacccctactgtacatccccccacctccctgtcaaccactgattaatactacagagtctctgcgcctgaaccacgaactcaggggttgggtacaccggcacgaggtcgagcgaaccaaatctaggcggatgacaaataaccaacagaagactaggattctgcaaggtgccctcgagcagggatccaactcccagctgatggctgtgcaatataccgagaccacctcaagtatttcaaggaatagtggtagtgaattgcaggtatattacgcctctcctagatcctatcaggacttttttgaggccattaggagaagaggtgatacgttttatgttgtcagctttagaagggatcacctgctgctccctgcaacgactcacaacaagaccactcggccaaagatgagcattgtgctacccgcaatcaatattaacgaaaatgttattaatggtcaggattacgaggtgatgatgcagattgattgtcaggttatggatactagaattctgcatataaagagcagcagcgtgccaccatatctgcgcgaccaacagcggaaccagacgaatacgttttttggctctccacccgccgctactgaggcaactcacgtggtgtctacgatccctgagtccctccagtag

SEQ ID NO: 106962 - DNA, 2112 bp, Artificial Sequence
  Description of Artificial Sequence: Synthetic coding sequence
atggccgaactaatgctactcagcgagatcgctgaccctacccgtttttttacagataacttactgtcaccagaagactggggattacagaactcaacgctatactccggcctcgacgaggtagcggaagagcaaactcagctgtttcgctgtcctgaacaggacgtgcctttcgatggctcatcactggatgtaggcatggatgtcagcccatctgaacccccctgggagttactgccaatttttccagacctacaggtcaagagcgagccttcgtcgccgtgctcatcttctagtttatcttccgaaagcagccggctatcaacagagccatccagcgaggcgttaggcgtaggggaggttctgcacgtgaaaaccgagagtctggctcctcccctctgtctcttgggcgatgaccctaccagtagttttgaaactgttcagattaatgtaatccctacaagtgatgacagcagtgatgtgcagaccaaaattgagcccgtcagcccttgctctagtgtcaatagcgaagcatcgctgctctcggctgattcctcgtcccaggcctttattggggaggaggtccttgaagttaagacagaatcactgtcacccagcgggtgtctgctttgggacgtgccggctccaagcttaggagcagtgcaaatttccatgggtccctccctggacggctcaagcggcaaggccctgcctactcgcaagccaccactccagcctaagcccgttgtgctcactaccgtaccaatgccaagtcgggcagttccaccaagcacaacggtgctgcttcaaagtttggtgcagccaccccctgttagtccagtcgtactgattcagggggctatccgggtgcagccagagggacctgcgccctccctgcctaggcccgagcgcaagtccattgtgcctgcccctatgcccgggaacagctgtccgcctgaggttgatgcgaagcttctcaagaggcagcagcggatgattaagaatcgcgagtcagcatgccagtctcggagaaagaagaaggaatatctgcagggcttagaagctcggctccaggccgtgctcgcagataaccagcagctgcgcagggagaatgccgccctgcgccgccgacttgaggctttactggcagagaacagcgaactcaaactggggagcggcaataggaaggtagtgtgtatcatggtattcctgctctttatcgcgtttaactttgggccagtcagcatctcagagcccccatctgctcctatcagcccgcgaatgaacaaaggcgagccacagcctcgccgacatcttctgggattttcagagcaagagccagtacagggggtcgagccactccaaggcagctcacagggaccgaaggagcctcaacctagtcccacagaccaaccatctttctctaatcttacagcgtttccaggcggggccaaggagctccttctgagagatctcgatcagctcttcctgtcaagcgactgtaggcatttcaataggactgagtcgttacggctagcagacgagctttcaggctgggtccagagacaccaaagaggaagacgtaagatacctcagagagcccaggaaagacagaagtctcagcctagaaaaaaatctcccccagtaaaggccgttcccattcagcccccggggcctccagagagagactccgtcgggcagctgcagctgtacaggcaccctgatcgtagtcagcctgcctttctcgatgcaattgataggcgagaagacaccttctatgtcgtcagcttcaggagggaccatctgcttctgccagctatctcacataataagacctccaggcctaagatgtctctcgtgatgcccgctatggcgcctaatgagacactttctggcagaggggcacccggagactacgaggagatgatgcaaatcgaatgtgaggttatggacactagagtgatacatattaaaacttccactgtcccacctagcctgcgcaaacagcccagtcctacccccggaaatgcgacaggcggacctcttcccgttagcgcagcctcccaggcccaccaggcaagtcaccagccattatacctgaaccacccttag

SEQ ID NO: 106963 - DNA, 669 bp, Artificial Sequence
  Description of Artificial Sequence: Synthetic coding sequence
atggcggaactcatgctgctgtctgaaattgctgaccccacccgcttttttaccgacaatctcctctcacccgaagattggggacttcaaaactctacgctgtattctggattggatgaggtggcagaagaacagacccagctctttagatgtccagagcaggacgtgccattcgacggatcctcgctcgatgtgggcatggatgtgtcaccaaccgaccaaccctcatttagtaacctgacagctttcccaggaggagctaaggaactgttgctgagggatttagaccaactgtttctaagcagcgactgcagacactttaatagaacagagagccttcgattagccgatgaattgtcgggttgggttcagcggcaccaacggggacgcagaaaaattccgcagcgcgcccaggaacgccaaaagtcccagccacgcaagaagagtcctcccgtgaaggctgtgcccattcagccgcctgggcctccagagcgtgactcagtcggccaactgcagctatatagacaccctgaccgttcacaaccagccttcctcgacgccatcgatcgtcgcgaggatactttctacgtggtgagcttcaggagaaccacatgttgttcccagccgagcgctactacaaggcccccaggaccacggtgcccctggtag

SEQ ID NO: 106964 - DNA, 2103 bp, Artificial Sequence
  Description of Artificial Sequence: Synthetic coding sequence
atggccgaactgatgctcctcagtgagattgccgatcccacacggttcttcaccgataatttgctgtcccctgaagactgggactctaccctgtactctggacttgatgaagttgccgaggaacagacccagctgtttaggtgcccagagcaggatgtgccctttgacgggtccagtttagatgtagggatggatgtcagtccatcagaaccaccttgggagctgcttcctatattccctgatctccaggtgaaaagtgaaccatcgtcgccatgctctagctcttctctgagcagtgagtcatcccggctttctactgagccttcttccgaagcattgggcgtcggtgaagtgttgcacgtaaagaccgaaagcctggcaccccctctctgcctgctcggagacgatccaacctccagcttcgaaactgtgcagattaatgtcatccctacttccgacgattctagtgatgttcaaactaagattgaacctgtgtccccctgtagctccgtaaactccgaggcgtccctattgtcagccgattcgtctagtcaagcttttatcggcgaggaggtgttagaggtgaaaactgaaagtctgtccccgtcaggctgcctcctctgggacgtgcctgcccctagtttaggggccgtacagatctctatgggtcctagtttagacggaagctccggcaaggccctgcccactagaaaacccccactgcagccaaaacctgtcgttctcaccactgtcccaatgcccagccgggccgttccaccctctacaactgtcctgctccagtcactcgttcagccacctcccgtttcccccgtggttctgatccaaggggcgatcagggtacagccggaaggtcctgccccatctcttccaagacctgaacgcaagtcaatagtgcctgcccccatgccaggcaactcctgtccgcctgaggtagatgccaagctgctgaagcggcagcagaggatgataaagaatagagagagcgcttgccagtcccgccgtaagaagaaagagtacttacaggggctggaggcacgtttgcaggccgtgttggccgataatcagcagctgcgccgagagaatgcggcactcagacggcgactagaggctctgttggcagagaactctgaattgaaactaggtagcggcaacaggaaggttgtatgtattatggtgtttctgctattcatagcattcaatttcggtcccgtcagcatcagtgagccgccttctgcccctatctccccgagaatgaataagggtgagcctcaaccaaggcggcatctgttgggattctccgaacaagaaccagtgcagggagtggaacccttgcaaggatcaagccaaggccctaaggagccccagccgagtcctactgaccagccatctttttcgaacctgacagccttccctggaggcgccaaggagctgctgcttcgggatctcgaccagttgtttctcagttcagactgccggcactttaaccggacggaatccctgaggctcgccgatgaactttctggctgggtacagcggcatcagcgtgggcggaggaaaataccccagagagcacaggagaggcaaaaaagccagcctaggaagaagtcaccccctgtgaaggctgttcctatacagcctcccggcccccccgagcgtgatagcgtcgggcagttgcagctgtacagacatccagatagatctcagccggccttcctggacgccatagaccgcagagaggacacattttatgtggtgagtttcaggcgcgaccacctgctgttgccggctatctctcataataagacttcaagacccaaaatgagcctggttatgccagccatggcccctaacgaaacgctgagtggacggggagcccccggggattacgaggaaatgatgcaaatcgagtgtgaggtgatggacacccgcgtgattcacatcaaaacctccacagtgccacccagtctgaggaagcaaccaagccccacccccggaaatgctacaggcgggcctctccccgtttccgcagcaagccaggctcatcaggcctcccaccagccactgtatctgaaccacccatag

SEQ ID NO: 106965 - DNA, 2112 bp, Artificial Sequence
  Description of Artificial Sequence: Synthetic coding sequence
atggccgagctcatgctactttctgagatagccgaccccacccggttttttacagataatctgcttagcccggaggactggggcctgcagaattcaacgctctattctgggctggatgaagtagccgaagagcagacacaattgtttagatgcccagaacaagacgtcccattcgatgggtccagtctcgatgtgggcatggatgtgagcccaagcgagcccccttgggaactgctgccgatttttcccgacctgcaggttaagagcgagccatcatcaccctgctcttccagttccctatcatcggagtccagccggttgtctaccgagccttcgtccgaggctctcggcgtgggcgaggtcttgcacgtgaaaacagagtcactggcccctcctctgtgtctcttaggtgacgacccgacaagctcgttcgagacagtccagataaatgttatccctacatccgatgattcatcggatgtgcaaacaaagatcgagccggtgagcccatgttctagtgtgaacagcgaagcttcgctgttatcagccgacagttccagccaggctttcataggcgaggaagtattagaagtaaagacggaatcactgagcccctctgggtgtctcctgtgggatgtcccagctccttcactaggcgctgtacagattagcatgggtcccagcctggatggatcctctggaaaggcccttcccaccaggaaaccccccctccaaccgaaacccgtggtactaactacggtgcctatgccatcacgggccgtccctccttctactacagtcctgctgcagtctctggtgcagccaccgcccgtttctccagtcgtcctgatacaaggagccatcagagtacaacccgagggccctgcgcctagcttaccgaggccggagaggaaatcaattgtccccgcacctatgcccggtaacagctgtccgcctgaagttgatgcgaaattgctcaagcgtcagcagaggatgataaagaaccgggagtctgcctgtcagtcccgcaggaagaaaaaggagtatctgcagggcctcgaggcacggttgcaagccgtccttgctgacaatcagcagttgcgcagggaaaatgcggctctgagaaggcgactggaagccctattggctgagaattcggagttgaagctcggcagcgggaataggaaggtggtctgtattatggtatttctgctcttcattgctttcaattttggccctgtaagcattagcgagcctccctctgctcccataagccctcgcatgaacaaaggcgaaccacagccccgtcgccatcttctcggattctcagaacaggagcccgtccagggagttgagccactgcagggatcctcccagggcccaaaggagccccagccctccccaactgaccaaccttcattctcaaacctcaccgcgttccctgggggagctaaggagctgcttctcagagacttggatcagctcttcctttcgagcgactgcaggcattttaatagaaccgagtcactaaggttagccgacgagctgagcggttgggtacagagacatcaacgcgggaggcggaaaataccacagagggctcaggagagacaaaagagccaacctcgcaaaaaaagcccccccgttaaggccgtaccaatccagccaccggggccccctgagcgcgactccgtggggcagctgcaactataccggcaccctgaccgtagccaacctgcattcctcgacgccatcgacagacgggaggacactttttacgtggttagcttccggagagatcacttgctcctacctgccatttctcataacaagacatctaggcccaaaatgtctctggtgatgcccgccatggctccaaatgaaactttgagcggcagaggcgctccaggcgactatgaagaaatgatgcagattgagtgtgaggtaatggacacccgggtcattcacatcaaaacatccacagttcctccctccttacggaagcagccctctccgacccctggcaatgctactggaggacccctgcctgtctccgccgcctctcaagcgcatcaagcctctcatcagccgctctacctgaaccatccatag

SEQ ID NO: 106966 - DNA, 2103 bp, Artificial Sequence
  Description of Artificial Sequence: Synthetic coding sequence
atggcggagcttatgctgttgtcagaaatagctgatcctacccggttcttcacggataatcttctgtctccggaggactgggatagcacgctgtactcaggtcttgacgaggtggctgaggagcagacccagttgtttaggtgccctgagcaggatgtgccctttgacgggtccagtttggatgtgggaatggacgtttctccatccgaaccaccgtgggagctcctgcctattttccctgatctccaggtcaagagcgagccttctagcccatgctcctcaagttccctgtcgtcagagtccagtcgactgtccacagagccttcctccgaggccctgggtgttggggaggttctccacgtcaaaacggaaagtttggcacccccactgtgccttctgggtgacgatcccacatcatctttcgaaaccgttcagattaacgttatccccacctcggacgatagttcagatgtccaaacaaaaatcgagcctgtttcaccatgttcctctgtaaacagtgaagcgtccctgctttcagccgactctagctctcaggctttcatcggcgaggaggtcttggaggtgaaaactgagagcctttcaccatccggttgtctgctctgggatgtacctgctccaagtctgggagcagtccagatttccatggggccgagtttggacggctcctcaggaaaggctctgcccactcgcaagcccccactccagcctaaaccagtagtgctgaccacagtcccaatgccgtcccgcgcagtgccgccatccaccaccgtacttttacagtcccttgtgcagccaccaccggtctccccagtggtcctgatccagggcgcaatccgtgtacagcccgagggtcccgccccctctctgccccggcccgagcggaagagcatcgtccctgcccctatgcctggcaactcttgccccccggaggtggacgccaagttacttaagagacagcagaggatgatcaaaaatcgggaatccgcgtgccagtctagacggaagaagaaagagtatttgcagggtcttgaggcccggcttcaggccgtacttgctgacaaccagcaacttaggcgggagaacgctgcgctgaggcgcaggctcgaggcgctgcttgccgaaaactctgagctcaagctaggctcaggtaatcggaaagttgtgtgtatcatggtttttcttctgttcattgcttttaactttggacccgtgagtataagcgagcctccaagtgcacccatttctcctcggatgaacaagggtgaaccccaaccacgccgccaccttttaggcttctccgagcaggaacctgtgcaaggcgtggaacctctccagggtagttcccaggggccgaaagaaccccagccctccccaacggaccagcccagctttagcaacctgactgcctttcccgggggtgccaaagaattacttctcagagacctggaccagctttttcttagctccgactgccggcattttaaccggacggaatctctgcggctcgcagatgagctgtcaggttgggtccaacggcatcagcgaggaagaaggaaaatcccccagagagcccaggagcggcaaaaatctcagccccggaaaaagtcccctccagtgaaggcggtgccaatccaaccccctggaccgcctgaaagagattcagtcggccagctgcagctgtaccgccatcctgatcgctctcagccagctttcctggatgccatagaccgtagagaagataccttttatgtagtgagcttccgtcgggaccaccttctcctgccagccatttcccacaacaagactagccgaccaaagatgtctctcgtgatgcctgcaatggcacccaacgaaaccctcagcggtcggggggctccaggtgattacgaagagatgatgcaaattgagtgtgaggtgatggataccagggttatccatatcaaaaccagcactgttccaccgagtcttagaaagcaaccatcacccacgcccggcaatgccaccggcggtccgctgcctgtctccgccgcaagccaggcacaccaggctagccatcagccgctgtacttaaatcacccatag

SEQ ID NO: 106967 - DNA, 429 bp, Artificial Sequence
  Description of Artificial Sequence: Synthetic coding sequence
tgacaaccttcacctacagaccagccatcgtttagcaaccttaccgcttttcccgggggtgctaaagagctgcttctccgggacttggaccagttattcctgtcttccgactgtcggcattttaaccggactgagagcctgaggctagctgacgaattgagcggctgggtgcagcgccatcagcgcggcagacggaagattcctcagagggctcaggagagacaaagcctggacacctcaccttcacgttcactctcccacggaaggagccacctgcaattgaggcagagccccagcaacccactggacccccaaaagggtatcctctgggccagctgtaactacatcgctacgcagactgtgagaagtcagcacagctggatgcagcttaccgacggaaagacccacttcatgctgtcactgtcttag

SEQ ID NO: 106968 - DNA, 429 bp, Artificial Sequence
  Description of Artificial Sequence: Synthetic coding sequence
tgacaaccatctcccacagaccaaccgtctttctcaaatctgacggccttcccagggggcgcaaaagagctcttgctgagggacctagaccagctgtttctgtcatcagactgtcgccacttcaaccggaccgagtctctccgcctggctgatgaattgtccgggtgggtccaacgacatcagcgcgggagaagaaagatccctcaaagagcacaggagcggcagagtctggacacaagccccagcagatccttgtctcacggccgctcccatctgcagttaagacagtctccgtctaatccgctggacccccagaaaggcattttgtgggcctcctgcaactacatcgccactcagactgtacgcagtcaacactcatggatgcaactgactgatggtaagacccactttatgttatcgctctcatag

SEQ ID NO: 106969 - DNA, 2112 bp, Artificial Sequence
  Description of Artificial Sequence: Synthetic coding sequence
atggccgagctgatgctcttatcagaaatagctgatcctacacgatttttcaccgataatctgctctcgcccgaggactggggactccagaattcaacactgtatagtggattggacgaggttgctgaagaacagactcagttatttcgctgtcctgagcaggatgtcccttttgacggatcttcacttgacgttgggatggacgtgagtcctagcgagcctccttgggaactgctgccgatcttccctgaccttcaggtgaaatctgaaccctcatccccatgctccagctcctccctctcatctgagtccagtagattgagcactgagccgagtagcgaggccctcggtgttggcgaagtgttacatgtgaagaccgagtctctcgcgcctcctctgtgcttgcttggtgatgatcccactagcagttttgagaccgttcaaattaatgtgattcctacatcagatgattcatccgacgttcagacgaagattgaaccagtgtcaccttgttcctcagttaatagcgaagcatccttacttagtgccgactcgagttcacaggcctttatcggggaagaagtcctcgaggtgaaaacagagtccctgtcaccttcaggctgcctcctttgggatgttccggcgcccagcctgggggcagttcagatctctatgggaccaagtctcgatggatcttctgggaaagccctccctacgagaaagcccccactccagccgaaacccgtagtgttgactactgtgcctatgcccagtcgggcagtgccaccctcaacaacggtactcctacagtcactagttcagcctcctccagtgagcccagtcgtactcattcagggggctattcgtgtgcaacctgaaggcccggccccatcactgccacgcccagagaggaagagcatcgtaccggcaccaatgccaggcaactcttgtccgccagaagtagatgcaaaactgttgaagcggcaacagcggatgattaagaatcgcgaatccgcttgtcaatcaagacggaagaaaaaagagtatctccagggactcgaagctcggctgcaggcagtgctggccgacaaccagcagttgcggagggagaatgccgccctcagaaggcggctcgaggctctgctcgccgagaacagcgaactgaaactgggatccggcaatcggaaagttgtatgtatcatggtgtttttactctttattgctttcaactttggaccggtctcaatcagtgagcctccaagtgccccgattagtccaaggatgaataagggggagccacagccacggagacacctgctgggatttagtgagcaagagccagtgcagggagtggagccactacagggtagttcccaagggccgaaagaaccccaaccaagcccaaccgaccagccctcctttagtaacctgacagcttttccgggcggcgccaaagaactcctgttaagagacctcgaccaactgtttctgtccagcgattgtcgccacttcaacagaacagaatcactgcgcttagcagatgagttgagcgggtgggttcagcgacaccagcgcggacggcgcaaaataccacagcgggctcaggagcgccagaagagccagcctcgaaaaaagagtccacctgtgaaggccgtcccgattcagcctccggggccacccgaacgggatagcgttggccagcttcagctgtacaggcatcctgacagatcccagcccgcgttcctcgatgccatcgacaggagggaggatacattttacgtcgtgtcttttcggcgtgatcacctcctgctgccagctattagccacaataaaacttctcgccccaagatgtctctagtgatgcccgccatggctcctaacgagacactgtccggaaggggcgctcctggcgactacgaggagatgatgcagattgagtgtgaagtaatggacacaagagtgattcacattaagacatctactgtgccacctagtctgaggaagcagcccagccctactcccggaaatgccacaggcggacccctaccagtgagcgccgcatcccaagcccatcaggcgtcccatcagcctctgtacctcaatcacccttag

SEQ ID NO: 106970 - DNA, 2112 bp, Artificial Sequence
  Description of Artificial Sequence: Synthetic coding sequence
atggccgagcttatgctcctgtctgaaattgccgatccgactcgtttcttcaccgacaacctgctctcaccagaggattgggggctgcagaactccactctgtattccgggctggatgaggttgccgaggaacagacacaacttttcaggtgcccagagcaggatgtgcctttcgacggctcttccttagatgtaggaatggatgtgagtccctccgagccaccttgggagctgcttcccatctttcccgatctgcaagtgaagagcgaacccagttcaccgtgcagctcctcttctctctcctccgagtcctccagactgtctacggaacctagcagtgaagccctgggcgtgggggaggttctccatgtgaagaccgaatctcttgctcctcccctgtgtctgctgggggacgatcccacctcctcctttgagaccgtacaaattaatgtcattcccacctcggatgattcatccgacgtgcagactaaaatcgaacccgtttctccttgttcctctgtcaactcagaggcgagtcttctgtcagccgacagcagcagtcaggcgttcataggggaagaggtgctggaagtaaagaccgagtcactcagtccttcaggctgcttgctgtgggacgtgcctgcaccatcccttggagccgtgcaaatctccatgggtccctccctcgatgggtcatcgggaaaagcattgccgacaagaaaaccgcccctgcaacccaagcccgtggtattgaccactgttcctatgccgagcagggcagtacccccgtccacgaccgtgttgctgcaatccttagtacagcctccgcccgttagcccggtggtgcttatccagggagccattagagttcagccagagggaccagctcctagcctccccaggcccgaacgcaaatcaatcgtgcccgctccgatgccaggaaactcctgcccccccgaagtggatgccaaactactaaaaaggcaacagcggatgattaaaaacagggagagtgcctgccagtccaggcgcaaaaaaaaagagtacctccagggattggaagctaggctgcaagccgtgcttgctgataaccagcagctgcgtcgcgagaacgcggcactgagacgacgcctcgaagctttactggctgaaaattctgagttgaaacttggctctggtaacagaaaggtcgtgtgcattatggtttttctcctcttcatagcctttaatttcgggcccgtctccatctccgaaccaccatcagctccgattagccccagaatgaataagggggagcctcagccaaggcgacacctgctaggattttctgagcaggagccagtgcagggcgtggaaccgttgcaagggagctcgcaaggtcctaaggaaccccaaccctctcccacagatcagccctcgttttcgaacctcacagctttccctggtggagctaaggagctattactgcgtgaccttgatcagctgtttctgtccagcgactgtcgccattttaataggaccgagagtcttcggctggctgatgaattgagcggctgggttcaaaggcatcagcgcggcaggcggaagatacctcagcgggcccaggagcgtcaaaaatcacagccacggaaaaagtctccgcccgtgaaagcagtgcccatccaacccccaggccctcccgagcgggactccgtgggtcagctgcagctctaccggcatcctgacaggtctcagccagcttttctcgacgccattgatcgacgggaagatacattctacgtcgtttccttcagaagggatcaccttctactcccagccatcagccacaacaaaacatctaggccaaaaatgagtcttgtcatgcccgcgatggccccaaacgaaaccttgagtggaagaggcgcaccgggggactacgaggagatgatgcagatcgagtgcgaagtcatggataccagagtgattcacatcaagacatcaactgtgcccccaagtttgaggaaacagccttctcctacccccggtaacgctactggcggcccactccccgtgagcgctgcatcccaggctcatcaagcctcacatcagccactttatctgaaccacccatag

SEQ ID NO: 106971 - DNA, 2103 bp, Artificial Sequence
  Description of Artificial Sequence: Synthetic coding sequence
atggccgaactgatgctcctttctgaaattgctgatccaaccagatttttcaccgacaatcttctgagcccagaggactgggattccaccttatactctgggcttgatgaggttgcagaagaacagactcagctgtttcgatgtcccgaacaggatgtgcctttcgacgggtcatcactcgatgtaggtatggatgtgagtccatcggagccgccgtgggagctcctccctatcttccctgacctgcaggtgaaaagtgaaccgagtagcccttgttcctccagcagcctcagttccgagtcatcacggctgtctacagagccaagtagcgaggccctcggagttggcgaggttttgcacgtgaaaacggaaagcctggcacccccactttgtctactcggagatgaccctaccagttccttcgaaactgtacaaattaatgtgatcccaacaagtgacgactccagcgatgtacagaccaagatcgaacccgtgtccccatgtagcagtgttaactctgaggcgtccctgttatctgccgactcatcaagtcaggccttcattggcgaagaggtgctggaagtgaagacagaatcactttcaccaagcgggtgcctcctgtgggatgtgcccgcgccaagcctgggggccgtccagatctccatggggcccagccttgacggatcctcaggtaaagccctgccgactcggaaacctccattgcagcctaagcctgttgttctgaccactgttccgatgccgtctagagcggttcccccgagcactaccgtccttctgcaatctttagttcagccgccaccagtgtcccctgtggtcctaatccagggtgcaataagggttcagccagaggggcctgcccccagcctgcctcgccccgaaagaaaaagcatcgtccctgctccgatgcccgggaattcctgtcctcccgaggtggacgctaaactgctgaaacgccagcaaagaatgatcaaaaaccgggagtccgcctgccagagcagacggaagaaaaaagaatacctgcagggcttagaggcacgcctccaagccgtgctggccgacaatcaacagctgcgtagggagaatgcagccctgcgcaggcgattggaggccctgttagccgagaatagcgaattaaagctcggaagtgggaatcgtaaggtcgtatgcataatggtcttcctactctttatcgcgttcaatttcgggcctgtgagcataagcgagcctccttctgcccccatttctccacgcatgaataagggcgaaccccagccccgtcgacacctgctggggttctccgagcaggagcccgtccaaggggtcgagcccctacaaggctcctcccaaggtccaaaggaaccacagcctagccccacagaccagcctagtttctctaatctgacagcttttccaggtggcgcaaaggaactgctcctacgggatctggatcagcttttcttatcaagcgactgccgccatttcaaccgcaccgagagcctgcgactggccgacgagcttagtggctgggtccagagacaccagagaggccgccgtaagatcccccaacgtgcccaagaacgccagaagagtcaaccccgcaagaagtctcctcctgtgaaagcagttccgattcagcctcccggaccaccagaacgagattcagttgggcagcttcagctgtaccggcacccagacagatcccagccagcattcctcgatgcaattgatcgccgcgaagacaccttttatgtcgtatcattcagacgggaccacctgctgctgcctgccatctctcataacaagaccagcaggcccaagatgtcccttgtcatgcccgcaatggcccccaacgaaaccttgagcgggcgcggcgctccaggcgactatgaggagatgatgcagattgagtgcgaggtaatggatacccgggtgatccacatcaaaacaagtactgtgccaccatccttaaggaaacagcctagcccaacaccaggcaacgctaccggcggcccccttccagtgagtgcagcgtcacaggcccatcaggccagtcatcagcctctctacctgaaccatccttag

SEQ ID NO: 106972 - DNA, 429 bp, Artificial Sequence
  Description of Artificial Sequence: Synthetic coding sequence
tgacagccaagcccaaccgaccagccatccttcagcaacttaaccgcctttcccggaggcgcaaaggagctgcttctgagagacttggaccagctgtttcttagctccgactgccgccattttaatagaacggagtccctgagacttgccgacgagctgagcggctgggttcagaggcatcagcgcgggcgcagaaaaatccctcagagggcccaggaaagacaaagcctggatacttctccatctaggtctctgagccatgggaggtctcacttacagctgcggcaaagtccatccaacccactggacccacaaaagggtatcctctgggcttcctgtaattatatcgctacccaaactgtcagatcacagcatagctggatgcaacttacagacggaaaaactcactttatgttgagtctgagctag

SEQ ID NO: 106973 - DNA, 2103 bp, Artificial Sequence
  Description of Artificial Sequence: Synthetic coding sequence
atggccgaactgatgttgctctctgagatcgctgacccaacaaggtttttcacagataacctgctaagccctgaagattgggattctacgctctatagtggtctcgatgaagttgctgaggagcagactcagcttttccgatgtcctgaacaggacgtgcctttcgacggatcttcactggacgtaggcatggatgtctcaccttcagagcctccatgggagttgctgcctattttcccagacctgcaagtgaagtccgagccgtcctctccgtgtagctcatcatccctgagctccgaatcctcacgcttaagtactgaaccaagcagtgaagccctgggagtgggggaagtgcttcacgtgaagacggaatcactcgctccacccctttgcctgctcggtgatgaccctacatcatcgttcgagaccgtacaaattaatgtgattcctactagcgacgacagctctgatgtgcagacgaagatcgaacccgtgtcgccatgctccagtgtgaattctgaggcaagtctcttaagcgcagatagcagtagccaagcgttcatcggagaggaggtactggaggtaaagaccgaaagcctctctccatccggatgccttctgtgggacgtccccgccccgtccctcggtgccgtccagattagtatggggccctcactcgacgggagcagcggcaaggcactccctacacgtaagccccctctgcagcctaagcctgtggtgcttacaaccgtcccaatgccttctcgagccgtcccaccaagcaccacggttctgctgcagtccctggtgcagccaccaccagttagccccgtggttttgattcagggagcaattcgggtacagcccgaaggccccgcccctagtctcccacgccctgagaggaaaagcattgttcctgcacccatgcccgggaacagctgtcctcccgaagtggacgccaagttactgaaacgccaacagagaatgatcaagaatcgggagagcgcctgccagagccgtcgcaaaaagaaagagtacctgcagggactggaggctagactgcaggctgtgcttgcagataatcagcagctccgaagggaaaacgccgccctgcgcaggaggttagaggccctccttgccgaaaatagtgagctcaagttaggctcgggcaataggaaggttgtctgtatcatggtattcctgctctttatagcctttaacttcggtccagtgagtatctctgaacccccttctgctcctatcagtcctcgcatgaacaaaggcgagcctcagcctcggcgtcacctactgggcttctccgaacaagaaccggtgcagggcgttgagccactgcagggatcttcgcaggggcccaaggaaccccagccctcccctactgaccagcctagcttcagcaatctgaccgctttccctggaggagcaaaagagcttttactaagggatcttgatcagcttttcttgagctcagactgtcggcacttcaacaggacagagagcttacgtcttgcagatgagttgtccggctgggtccagaggcatcagcgtggtaggcggaaaatcccacagcgggcccaggagagacagaagtcccaaccccggaaaaaatctcctcctgtgaaggcggttccaatccaaccccccggacctccagagagagactccgttggacagcttcagctgtaccgccaccctgatcgctcccagcctgccttcctggacgccattgataggagagaagatacattctatgttgttagctttagaagggaccatttgctcctgcccgcaattagtcataataaaacgagccggccaaagatgtccctggtgatgcccgccatggccccaaatgagacactatcagggcgaggagcgccaggggactatgaagaaatgatgcagatagagtgcgaggttatggatactcgtgtcattcacatcaagacgagcacagtgccccctagcctgcgtaaacagcctagcccaacgcctgggaacgctacaggcggacctttgcccgtctcggccgcttctcaggcccaccaggcatctcatcaaccattgtatctgaatcatccctag

SEQ ID NO: 106974 - DNA, 429 bp, Artificial Sequence
  Description of Artificial Sequence: Synthetic coding sequence
tgacagccgtcacccactgaccaacccagcttctcaaatcttacagcctttcctggaggggcaaaagagctcttactccgcgaccttgaccagctgtttctcagctccgactgccgacacttcaaccgcaccgagtccctgcggctggcagatgaattatccggctgggtgcagcggcaccagcgcggccggagaaagatacctcaacgcgcacaagagcggcagtctctggacacctcaccttcgagatccctgtctcacggtaggtcacatctgcagcttcgacagtcccctagcaacccactggacccacaaaaggggatactgtgggctagctgtaattacattgctactcagaccgtcaggagccagcacagctggatgcagctaactgatggaaagacgcattttatgctgtcactcagctag

SEQ ID NO: 106975 - DNA, 669 bp, Artificial Sequence
  Description of Artificial Sequence: Synthetic coding sequence
atggccgaattgatgttgctgagcgagatcgcagacccaacccggtttttcactgataatcttttatcacctgaagattggggcttgcagaatagtactttgtactcgggcttagatgaggttgctgaggaacaaacacagctgttcagatgccccgaacaggacgtgcccttcgacggatcaagcttggatgtaggtatggatgtgtcaccgaccgatcagccctctttcagcaacctgacggcgttcccaggaggcgccaaggagctgcttctgcgggacttagaccagctctttctatcaagcgattgtcgccactttaaccggacagagtccttacggctggcagatgagctcagtggctgggtgcagcgtcatcaacggggaagacgtaaaattccacagagggctcaggagcgtcagaaaagtcagccccgtaaaaagtctccacccgttaaagccgtgccaatccagccacctggacccccggagcgcgactctgtgggccaactgcagttatatcgccatcctgataggtctcagccagcgtttctggacgccatcgacaggagggaagacaccttttacgtagtaagcttccggcgcactacatgttgttcccaaccatctgccacaacgaggcccccaggtccacggtgcccctggtag

SEQ ID NO: 106976 - DNA, 669 bp, Artificial Sequence
  Description of Artificial Sequence: Synthetic coding sequence
atggctgaactgatgttgttgtcagagatcgctgatccaacaaggttcttcacagataatcttctctcccccgaagactggggtctacagaactccactctgtattccggactggacgaggtcgcagaggagcagactcagctttttcgctgtccggaacaggacgtcccattcgatgggtcctccttggacgttggcatggatgtcagccctactgatcaaccctccttttccaacctgacagccttccccggaggagctaaggaactgttactcagggatctcgaccaactgtttttgagtagcgactgtaggcactttaatcgcacagagtccctgagattagccgacgagctgtccggatgggtgcaaaggcaccagagaggcaggcggaagattcctcaacgggcccaggagaggcagaaatctcaacctcgcaagaaatccccccctgtgaaggctgtgcccatacagcctcccggcccacctgagcgcgacagcgtcggacagctgcagctgtaccgccaccctgaccgatctcagccagctttccttgacgctatcgatcggagggaggacactttctatgttgtgagctttagacgaactacgtgttgctcacagccttcagccacaactcgtcctcctggacctcgctgtccatggtag

SEQ ID NO: 106977 - DNA, 669 bp, Artificial Sequence
  Description of Artificial Sequence: Synthetic coding sequence
atggccgaactcatgctgctctcagaaattgcagaccctacacggttcttcacggacaacttactgtcgcctgaagactggggcctgcagaatagcactttgtactccggactcgacgaagtggctgaagagcagacacaactgttcaggtgtcccgagcaagacgtcccctttgatggctctagtttagacgttggtatggacgtgtcaccgactgatcagcccagtttttctaacctcaccgccttccctgggggtgctaaggagctcctgcttcgggatctagaccaactgtttcttagcagcgactgccgccattttaatagaactgagagcctacggctggctgacgagctgagcggctgggtacagaggcaccagcggggacggcgcaagatcccccagagagctcaggaaagacagaagtctcaaccccgcaaaaagtcccccccagtcaaggcggtacctatccagccaccaggaccgcccgagagagattccgtgggccagctgcagctgtatcgccatccagataggtcccagccggcctttctggacgcaatagataggcgcgaggatacgttctatgtggtgtccttccgacgcactacatgttgctcccaaccaagcgccaccacccgcccccctggaccacgttgcccttggtag

SEQ ID NO: 106978 - DNA, 924 bp, Artificial Sequence
  Description of Artificial Sequence: Synthetic coding sequence
atgggggatgaccgcccttttgtttgtaacgcccctggctgtggccaaaggttcacaaatgaagaccatctggctgtgcacaagcacaaacatgaaatgaccctgaaatttggccccgccagaacagattctgtcattattgcagaccagacccccacaccgaccaggttcctcaagaattgcgaggaagtcggactgtttaatgagctggcatctagcttcgaacatgagtttaagaaagccgcggatgaggacgaaaaaaaagcagccgcagggccgctggatatgagccttccttcgacccctgacatcaagattaaggaggaggagcccgtagaagtggatagttcacctcccgattcgccggccagtagcccctgctcccccccactgaaggagaagtcgcccgcccagcccaccccctccacggggggacgcaggaggcggaccgtagatgaggacccagatgagaggcgccagaggttcctagagcggaatcgtgcggctgcatctaggtgtcgacaaaagaggaaactttgggtgtcttcattggaaaaaaaggccgaggagctcacctcccaaaacatccaactgtctaacgaagtgaccctcctgagaaacgaggtggcacagcttaagcagctactactagcgcataaggactgtcccgtaacagccttgcaaaaaaagactcaggggtatctggagagtcccaaggaatccagcgaaccaacaggcagcccagcccccgtcatccagcattcctctgcaacggccccgagcaacggactttctgtgcgaagtgccgccgaagcagtggccacctcagtcctgacccaaatggcctcgcagcgcaccgaactgagcatgccaatccagtcacacgtaattatgactccccagtcgcaatccgcgggaagatag

SEQ ID NO: 106979 - DNA, 1485 bp, Artificial Sequence
  Description of Artificial Sequence: Synthetic coding sequence
atgggcgatgatcgaccgttcgtgtgcaacgccccagggtgtgggcagaggtttaccaacgaagaccatctcgcagtgcacaagcataaacacgaaatgaccctgaagtttggcccagccaggaccgattcggttatcattgcagatcagacaccaacgcccactcgattcctgaagaactgcgaggaagttggcctcttcaacgagctggcaagcagctttgagcatgagtttaagaaggccgcggatgaagacgagaaaaaagcacgaagtcggactgtcgcaaaaaaactggtggccgctgccgggccccttgacatgtctttgccctcaaccccagacatcaaaatcaaggaggaagaacccgtggaagtcgattcctcacctcccgatagcccagcatcgtcaccctgctctccacccttgaaggaaaaggaggtcacccctaaaccagttcttatttccacacccacgcccacgatagtgcggccaggctcgctcccccttcaccttgggtatgaccccctccaccctacccttcccagccctacctccgtgattacccaggctcctccctccaacagacagatggggtctcctacaggaagcctccccctggtgatgcacctggctaacggccagacaatgcccgtgctgcctgggccaccagttcagatgccctccgtcatctcactcgcaaggcctgtatcaatggtgccgaatatacccggaatccctggccccccagtcaatagctctggcagcatctctccttcgggccacccaatcccctccgaagccaagatgaggctgaaagcaacgctgactcaccaggtgtcatctatcaatggtgggtgcgggatggttgtcggcactgccagtactatggtaacagcacgaccagagcagagccaaatccttatccagcaccccgacgccccatcccccgcccaaccccaggtgtctcctgcccaacccaccccaagcaccggcgggcggaggaggcgcaccgtggacgaggatcctgatgaaagacgtcagcgattccttgagaggaatcgtgctgctgccagcaggtgtcgacaaaaacgcaaactctgggtctcaagcctcgaaaagaaggcagaggaactgaccagtcagaatatccagctgagcaacgaagtcactctccttcgcaacgaagtagcccagcttaagcagctcctcctcgcacacaaggattgcccggtgaccgctctccaaaaaaaaacccagggttatttggaaagtcccaaagaaagcagtgaacctaccggcagtccagctcctgtaattcagcacagtagtgcaactgccccctcgaacggcttatcggttaggtccgccgccgaggcagtcgctacttctgttctcactcagatggcctctcagcgcactgaactcagcatgcccattcaaagccacgtgatcatgaccccccagtcacagtcggccgggcggtag

SEQ ID NO: 106980 - DNA, 1389 bp, Artificial Sequence
  Description of Artificial Sequence: Synthetic coding sequence
atgggtgacgatcggcccttcgtgtgtaatgcccctggctgtggccaaagatttactaatgaggaccatctcgccgtgcacaagcataagcatgaaatgacactcaagtttggccctgcgaggacagactcggtgattatcgcagatcagactcctacgcccaccaggttcctcaaaaattgcgaagaggtggggctgttcaatgagctcgcttcgagctttgaacacgaatttaagaaggccgcggacgaagacgagaaaaaggctgcagcaggtccactggatatgtctttgccctcaacccccgatataaaaattaaggaggaggagcctgtcgaagaagttacacccaagcctgtgctgatcagtactcctacacccactattgtgcgccccggttcactgccattgcatctcggatatgatcctctgcatcccacactcccctctcccacatccgtcatcacgcaggcgcccccctccaataggcagatggggtcccccaccggaagtctgcctctggttatgcatttggcaaacggccagaccatgcctgtcctcccaggcccccctgtgcaaatgccctccgtcatatctctggccaggccagttagtatggtccctaatatccctggcatcccagggcctccagtgaatagctccggaagtattagtccaagtggacatcctatacctagcgaagctaagatgagactcaaggccacgctgactcaccaggtgtcaagtatcaatgggggatgcgggatggtcgtaggcacggcttctactatggtgaccgctagacccgagcagagtcagatcctgatacagcatccagacgctccaagcccagctcagccccaggtgagccctgcccagcccacccccagcaccggggggaggcgccgccgaaccgtcgacgaggatcccgacgaacgaagacagaggtttctcgagcgcaacagggcagccgctagcagatgtcgccagaagcgaaaattgtgggtatccagtttggagaagaaagccgaggagttgacttctcaaaacatccaactctcaaacgaagtcaccctcctgcgcaacgaggtcgcccagttaaagcagctattgctcgctcacaaagactgtccggtaactgcattgcagaagaaaactcagggatacctggagtctccaaaggaatcgtcagagcccaccggatcaccagcacctgtgattcagcattctagtgcaacggcaccttcaaatggcctcagcgtgcgctccgcagctgaggcagtcgcaacgtcagtgctaacacagatggccagccagcgcacagagttgtctatgccaatacagtcccatgtcataatgacaccacagtcacaaagtgccggaagatag

SEQ ID NO: 106981 - DNA, 1452 bp, Artificial Sequence
  Description of Artificial Sequence: Synthetic coding sequence
atgggggacgacaggccgttcgtttgtaacgcgcccgggtgcggccagagattcactaatgaggatcatctggctgtccacaaacacaagcacgagatgacactaaaattcggccccgcaagaaccgacagcgtgatcatcgcagaccagacacccacgccaacccggttcctcaaaaactgcgaggaagtcggccttttcaatgaacttgcctccagtttcgaacatgagttcaaaaaagccgcagacgaggatgaaaaaaaagctgctgccgggcccctggacatgtctctcccttctacccccgatattaaaatcaaagaggaagagccggtcgaggtggactcatcccctcctgactcaccagcctcatctccatgcagccctcccctaaaagaaaaagaagtgactcctaagcccgtgttgatatcgacccccactccaacgatcgtaaggccaggcagtcttccccttcatctcggttatgatcctctgcacccaactttgccatcccctacctctgtgattacccaggcacccccctcaaaccgccagatgggaagtcctacaggctctcttccacttgtcatgcatctcgcaaacggacaaaccatgccagtcctgcccggtccacctgttcaaatgccctccgtaattagcctcgctcgtcctgtgtctatggtgcccaatattcctggaattccagggccccctgtgaacagcagcgggtccatttcaccaagcgggcaccctatccctagtgaggccaaaatgcgactgaaggctacactgacccaccaggtgtcatccattaatggggggtgcggtatggtcgtcggcaccgcctccacaatggtaaccgcccgccccgaacaatcccagatattgattcagcacccggatgcgcctagtcccgctcagccccaggtctcccccgcccaaccgaccccaagtaccgggggccggaggaggaggacagtggacgaagacccagacgagagacgccagcgcttcctggagcgaaacagggctgctgcgtccagatgccgacagaaacggaaactgtgggtcagctcactggagaagaaggcggaggaactgacctcacagaatatccagctttctaatgaggttactctgcttcgaaatgaagtggcccagttgaaacagctactgcttgcacacaaggattgccccgtaactgccctgcaaaagaaaacacagggttacttggagtcaccaaaggaatcttctgaacctactggatccccagcccccgtaatacaacatagctctgcaactgccccgtcgaacggccttagtgtgcgcagtgcagctgaggctgtcgcaacttcagtgcttactcagatggccagtcagcgaaccgagttgagcatgcccatccaatcccacgttatcatgaccccccagtcacaatcagccgggaggtag

SEQ ID NO: 106982 - DNA, 1452 bp, Artificial Sequence
  Description of Artificial Sequence: Synthetic coding sequence
atgggcgatgacagaccattcgtgtgcaacgctccagggtgtgggcagcgattcaccaatgaggaccatctcgccgtacacaagcataagcacgagatgaccctgaaatttggtcccgccagaaccgacagcgtgataatcgctgaccagacacccacccccactagatttttaaaaaattgcgaggaagtcggtttgttcaacgagctggcctccagcttcgagcacgaattcaagaaggctgctgatgaggatgaaaaaaaggcagctgctggtccgctggatatgtccctgccatccacacctgacattaagataaaggaggaggaaccagttgaagtggatagtagtccacctgacagccctgcctccagtccttgctctccgccactgaaagagaaagaagtgacccccaagccggtgctgatttccactcctacgcccacaatcgtacgtccaggttcactgccacttcacctagggtatgaccctctgcacccgacactccctagtcctaccagcgtcatcactcaggcacccccctctaatcggcagatgggatccccaaccgggtctcttcccctggtgatgcatctagccaatggtcagacaatgccagtcttaccaggcccccctgtgcagatgccatcagtgatcagcctggctcgaccggttagtatggttcccaatattcctggtattccgggtccgcccgtaaactcatccggatcaatctcccccagtggtcacccaatcccttctgaagccaagatgcgcctgaaagctacactgacccatcaagtctcgtctattaacggcggctgtggtatggtggtcggaaccgcctccaccatggtgacagcacgaccagagcagtcccagatcctgatacagcatccagacgccccgagcccagcacagccccaggtctctccggcccagcccacccctagcactggtgggaggcgtaggcggaccgtggatgaagatccagacgaaaggaggcaacgctttctggagaggaatcgcgctgcagcgagcagatgtcggcaaaagcggaaactatgggtttcatctctggaaaaaaaagcagaagagcttacttcccagaacatccagctctctaatgaagtaacactccttcgcaacgaagtagctcagcttaagcagttattattggcacacaaggattgccccgtgaccgctctgcaaaaaaagacccaaggctatttagaatccccaaaagaaagcagtgagcctaccggctcaccagcgccggtaatacaacattccagcgccactgctcccagtaacggactgagtgtccggtccgccgcagaagctgtagccactagtgtcctaacccagatggctagtcagaggaccgagctgagcatgcccatccagtcccacgtgattatgactccccagtcccagtcagccgggcggtag

SEQ ID NO: 106983 - DNA, 1485 bp, Artificial Sequence
  Description of Artificial Sequence: Synthetic coding sequence
atgggggatgacaggcccttcgtctgcaacgccccaggctgtggtcagagattcactaatgaggatcacctcgcagtgcacaagcacaagcatgagatgacactcaaattcggtccagctcgtaccgatagtgtgattattgctgaccagacccccacacctactaggttccttaagaactgcgaagaagttggcctcttcaacgagcttgcctcatcttttgagcatgagttcaagaaagcagccgacgaagacgagaagaaggcgcgatctaggactgtggctaagaaactggtcgccgcagcaggaccactggatatgtccctgccgtctacacctgatattaaaatcaaagaggaagagcccgtcgaagtggattctagcccacccgactctcccgcatcatccccttgctctcccccattaaaggagaaggaagttactcccaagccagttctgatcagcacaccaacacctactatcgtgcgacccggatccctgcccctgcatctgggctacgaccctctccacccaaccctgccgtcaccaacctcagtcatcacgcaagcccctccaagcaatagacaaatgggttcccctaccggctctttgcctctggtgatgcatctcgccaacggacaaaccatgccagtgcttcctgggccccctgttcaaatgccttccgtgatctctcttgctcgtcccgtgtctatggtccctaacataccaggcatccccggtcctcccgtgaatagttctggctccatctctccatccgggcatccgattccatcagaggcgaaaatgaggctcaaggccacccttacacaccaggtttcctctataaacggcggttgtgggatggtcgtcgggaccgccagtactatggtgacagcccggcccgagcaatctcagatattaatccagcatccggatgcacctagccccgcccaaccccaagtcagtcctgctcagcccacaccttccacaggtgggaggcgccgccgcaccgtggacgaggatccagacgaaagaagacagcggttcctggagcggaacagggcggctgcaagtcgctgtagacagaagaggaagctgtgggtgtccagcctggaaaaaaaggccgaggagctaaccagtcaaaacattcagttatcaaatgaagtaacactgctaaggaacgaagtcgcccagctgaagcagctgctgctggcccacaaggactgtcccgtgacagctctgcagaagaagacgcaaggttacctcgaaagcccaaaggagtcttctgaacctacaggctcgccagctcctgtgattcagcactccagtgccacggctccttccaatggtctgtccgtgcggtccgcggccgaagcagtagccacctccgtgttgacgcagatggccagtcagcgaaccgaattgagcatgccaatccagagccacgtgatcatgacaccccaaagccaatccgcagggcgctag

SEQ ID NO: 106984 - DNA, 354 bp, Artificial Sequence
  Description of Artificial Sequence: Synthetic coding sequence
atgggggacgacaggccctttgtatgtaacgctcctggctgcggacagagatttaccaacgaagaccatctagccgtgcacaagcacaagcatgaaatgacactgaaatttggcccggcacggaccgactcagtgatcatcgctgaccagaccccaaccccaactagatttctgaagaactgtgaggaagtgggcctcttcaacgagttggcgtcttcattcgaacatgaatttaagaaagcagctgacgaggatgaaaaaaaggctcgcagtcgcactgttgccaaaaagttagtagtttttcggcctaggctgttcttgctctgcttcggcataatcttcctcattggctag

SEQ ID NO: 106985 - DNA, 354 bp, Artificial Sequence
  Description of Artificial Sequence: Synthetic coding sequence
atgggtgacgatcgaccttttgtgtgcaatgctcccggatgcggtcagcggttcactaatgaggatcacttagccgtgcacaaacataaacacgagatgacactcaagttcggacccgcccgtaccgactcagtgattattgctgaccaaacccccactccgactaggtttttaaaaaactgtgaggaagtcggattgttcaatgaattagccagttctttcgagcacgagttcaaaaaggcggccgatgaggacgagaagaaggctcgctcccggactgtagctaagaagctggtcgtgttccggccgcggctcttcttactctgcttcggcatcatttttctgatcggctag

SEQ ID NO: 106986 - DNA, 3813 bp, Artificial Sequence
  Description of Artificial Sequence: Synthetic coding sequence
atggatagcctagaagaacctcagaaaaaagtgttcaaggcgagaaaaaccatgcgagtatcagaccggcagcagcttgaggccgtctataaggtcaaggaagaacttttgaagacagatgttaagctgttgaatgggaaccatgaaaacggagacttagatccaacctccccactcgaaaacatggattatatcaaggataaagaggaggtaaacgggatcgaagaaatctgtttcgatcccgaagggtccaaggccgagtggaaagaaaccccatgcattctgtctgtgaatgtcaaaaacaaacaggacgacgaccttaattgcgagccgttatcgcctcacaacataaccccggagccagtgtcgaaattgcctgctgaaccagtctccggggatcccgcacccggagatttggacgcgggcgatccagcttctggtgtgctggcttctggggacagcacctccggcgatccaactagtagcgagccaagttccagcgacgctgcctccggggacgcaacgtccggggacgctcccagcggggatgtcagccccggagacgccacaagcggagatgctacagctgacgatttatcctcaggtgatcctacctcctccgatccaattccgggagaacccgtgcccgtcgagcctatttccggggactgtgcggctgacgatattgcttcttctgaaattacatcagtcgatctggcttccggtgcccccgcatcgaccgaccctgcttcggatgacttagcttcaggcgatctgagctcgagcgagctcgcttccgacgatcttgccactggcgaattagccagcgatgagctgactagtgaatccacgttcgatagaacatttgaaccaaagtccgtgcctgtttgtgaaccagtgcctgagatcgataatattgagccttcctcaaacaaagacgacgacttcttagaaaagaatggagccgacgagaagctcgagcagattcaaagtaaggacagcctggatgagaaaaataaggccgacaacaatattgatgccaacgaggaaactctcgagaccgacgacacaactatctgctcagacagacccccagagaatgaaaagaaggtcgaggaggatattataaccgagcttgccttaggcgaggatgcaatctcctcctctatggagatcgatcagggcgagaaaaacgaggacgagacatctgccgacctagtggaaaccatcaacgagaacgtaattgaagacaacaagtccgagaacatcctggagaacaccgactccatggagaccgacgagatcattccgatcctggaaaagctcgctccctccgaggacgagctcacctgtttttccaaaacgtcgttgctcccaatcgatgaaacgaaccccgatctggaggagaagatggagtcatcgtttggatccccgtctaaacaggagtcaagcgagagtcttcccaaggaggctttcttggtgctttcagatgaagaggacatatcaggagagaaagatgaaagcgaagtgatcagccagaacgagacttgttccccggccgaagtggaatctaacgaaaaggacaataagccagaggaggaggaacaggttattcacgaggacgacgaaaggccctccgagaaaaacgagttctcacgcagaaaaagatccaagtccgaagacatggacaacgtgcagtcaaagagaaggcggtatatggaagaggagtatgaagccgagttccaggtgaagatcactgcgaagggcgatattaatcagaagctccaaaaagtcattcaatggctgctggaagaaaaactctgtgcactccaatgtgcagtgttcgacaagaccctggccgaactgaaaactagagtcgagaaaatcgagtgtaataagaggcacaaaactgtgttgactgagttgcaagctaagatcgcacgtttgaccaagcgcttcgaagccgccaaggaggacctgaagaagaggcatgagcacccacccaacccaccagtgtccccgggaaagaccgtaaacgacgtcaattcaaataataacatgtcttaccggaacgcaggcactgtgagacaaatgcttgagagtaaacgaaacgtcagcgagtcagctcccccaagctttcaaaccccagtgaatacagtctcttctaccaacctggttactcccccagctgtagtgtcaagtcaaccaaagctgcaaactcctgtcacctctggctctctcaccgctaccagtgtgctgccagctccaaataccgctaccgtcgtggccacaacccaggttccatcgggaaaccctcagccgacgattagcctgcaacctctgccagttatcctgcacgttccggtcgccgtttcgagccagcctcaactcctccagagccaccccgggactcttgtcacaaaccagccaagcggcaatgtggaattcatttctgtgcagtctccccctaccgtttccggacttacaaaaaatcccgtcagtttaccgtcactgcccaaccctaccaagccgaacaatgttccatccgtgccaagcccaagcatccagcgaaatcccacagcatccgcagcgccattggggactaccttagccgtgcaagccgtccccaccgcccacagcatcgtgcaggctacgagaactagtttgcccaccgtgggaccttcaggactgtactctccctccaccaatcgagggccaattcagatgaaaatccctattagtgctttcagcaccagctccgccgccgaacagaacagcaataccactccacggatcgagaaccagacaaataagacgatcgacgctagcgtcagcaagaaagccgctgattccacttcgcagtgcgggaaagcaactggatccgactcctctggagtgatcgaccttactatggacgatgaggaatctggggcttcacaggatcctaaaaagctgaatcatacgcctgtgtccacgatgagttctagtcaacccgttagtcggccacttcagcccatccagccagctccacccctgcaaccctcaggagttccaacaagcggtcccagtcagactactatccacctgttgccaactgctcctaccactgttaacgtgacccacagaccggtgacacaggttacgactaggctaccagtgccccgtgccccagcaaaccaccaagttgtatacacaacactgccagcaccccccgcgcaggctccactgcggggaaccgttatgcaggcccccgccgtccgacaggtgaatccccagaacagcgtgacagtccgcgtgcctcagactacgacatatgtggtgaacaatggactcactctcggaagcaccggccctcaactcaccgtgcaccacagacctccacaagtacacacagaacccccccgccccgtgcatcccgcgcctttgcctgaggcgccccagccccaacgcctgcccccagaggctgcctctacctcactcccgcaaaagccacacctcaagttagctcgggtccagtcccagaacgggatagtgttgtcgtggagtgtcttggaggttgatcgttcttgcgccaccgttgattcttatcacctatatgcgtaccatgaagaaccctcagccacagtgccatcccagtggaaaaaaatcggagaggtgaaagctctaccactccccatggcatgtactcttactcagttcgtcagtggttcaaaatactactttgcagtcagggccaaggatatttatggccgctttgggccattttgtgacccccagtctactgacgtcatctcgagcacccagagttcatag

SEQ ID NO: 106987 - DNA, 1548 bp, Artificial Sequence
  Description of Artificial Sequence: Synthetic coding sequence
atggacagtctcgaggaaccccagaaaaaggtgtttaaggctagaaagacaatgcgggtttcagatcgacagcaactcgaggccgtgtacaaggtaaaggaagagctcctgaaaacagacgttaagttgctcaacggcaatcatgaaaacggggatttagaccccacctcaccactggagaacatggactacatcaaggacaaagaggaggtgaacggaatagaagagatctgtttcgatcctgaggggtccaaagctgaatggaaagagacaccttgcattctgtccgttaacgtaaagaacaagcaggacgacgatctgaattgcgagcctctgtcgccacacaacatcactcctgagccagtatctaagctaccagcggaaccagtgagcggagatcccgctccaggggatctagacgctggcgaccctgcaagtggagtgctcgcttctggcgatagcacatccggggatcccacctcaagcgaaccctcttcctcagacgcagcgtcaggtgacgctaccagtggagatgcaccctcaggcgacgtgagtccgggagacgcgacttcaggcgatgctacagcagatgacctctcctccggcgatcctacgtctagcgatcctatccctggagaaccggttccagtcgagccgatctccggagactgcgccgccgacgatattgctagcagcgagattaccagcgtggacctggcaagtggcgctccagccagtaccgaccctgcgtctgacgacctagctagtggggatctgtcttcttccgaactcgcttccgatgatctggccacaggcgagctggcctctgacgaattaacgtcggaatctacgttcgataggacctttgaaccaaaatccgttcccgtgtgcgaaccagtcccggagatcgataacattgaaccatcctccaataaggatgacgacttcctggagaagaatggcgctgatgagaaactggagcaaattcagtctaaggattctctggatgaaaaaaacaaagccgataataatattgatgcaaacgaagaaacactggagactgacgatacaaccatttgctctgaccgccctcctgagaatgagaaaaaagtcgaggaggatatcataactgaactcgcgctaggcgaagatgctatcagctctagcatggagatagaccagggagaaaagaatgaagatgaaacctccgctgatcttgttgagacaattaacgagaatgttattgaggataacaaatccgagaatattctcgagaacaccgatagcatggagaccgacgaaatcataccaattttggagaaacttgcacctagcgaagatgaactcacctgtttttccaaaaccagcctgctccctatagacgagactaatccggacttagaggagaaaatggagtcctcctttgggagcccatctaagcaggagtccagcgagtctcttccgaaggaggcctttctggtcctgtcggacgaggaggacataagcggcgagaaggacgagagcgaggttatttctcagaatgagtag

SEQ ID NO: 106988 - DNA, 378 bp, Artificial Sequence
  Description of Artificial Sequence: Synthetic coding sequence
atggacagccttgaagaaccgcagaagaaggtgtttaaagcccgaaagactatgagagtgagtgaccggcagcaactagaggccgtatacaaggtgaaggaagaacttctaaagactgacgtcaagctgttgaacgggaatcacgaaaacggagacctcgaccccacctcccccctggagaacatggactatattaaggataaagaagaagtgaatggaatcgaggaaatctgcttcgaccccgaggggtcaaaagccgagtggaaggagacaccctgcattctgtccgtgaacgtcaagaacaagcaggacgatgatctaaattgcgagccactgagccctcacaacattacgccagaaccagtgtccaagttgtag

SEQ ID NO: 106989 - DNA, 459 bp, Artificial Sequence
  Description of Artificial Sequence: Synthetic coding sequence
atggatagcttggaagagccacagaaaaaggttttcaaggctagaaagaccatgcgggtatcagaccggcaacagctcgaggctgtgtataaagtaaaagaggaactgttaaagaccgatgtgaagctgctgaacggcaaccatgagaatggtgacctggaccctacttcaccactggaaaacatggactatatcaaagacaaggaagaagttaatggaatcgaagagatctgtttcgaccctgagggtagcaaagctgagtggaaggagaccccatgtattttatcggtcaacgtgaagaacaaacaggacgatgatctgaattgtgagccacttagccctcacaatatcacacccgagcccgtgtcaaagcttcctgcagaacccgtctcaggagatcctgcaccaggggacctggatgctggagaccccgcctccggagtgctagcatcaggttag

SEQ ID NO: 106990 - DNA, 312 bp, Artificial Sequence
  Description of Artificial Sequence: Synthetic coding sequence
atggactccctcgaggagccacagaagaaggtgtttaaagcacgaaagaccatgcgggtatccgacagacagcaactggaggcagtgtacaaagtaaaagaggagctgctgaagactgatgtgaaattgctgaacgggaatcacgagaatggtgacctggatccgacttcacccttggagaatatggactacatcaaagacaaggaggaagttaatggcattgaggagatctgcttcgaccctgaagggtcaaaagcagaatggaaggagaccccctgcattctgagcgtgaacgtgaagaacaagcaatag

SEQ ID NO: 106991 - DNA, 270 bp, Artificial Sequence
  Description of Artificial Sequence: Synthetic coding sequence
atggatagcttagaagagccacagaagaaagtgtttaaggcaaggaagaccatgcgcgtgagtgataggcagcagctggaggcggtttacaaggtgaaggaggagctcttaaaaactgacgtgaagctcctgaacgggaatcacgagaacggagacttggaccctacttccccactcgaaaacatggactatatcaaagacaaagaagaggtgaatggcatagaagaaatatgtttcgacccggaggggagcaaagccgagtggaaatag

SEQ ID NO: 106992 - DNA, 534 bp, Artificial Sequence
  Description of Artificial Sequence: Synthetic coding sequence
atggatagtttagaggaaccacagaagaaggtgtttaaggccaggaagaccatgcgggtgtcggaccgtcagcagctggaagctgtgtacaaggtcaaagaagaactccttaaaaccgatgtgaagctgcttaacggcaatcacgaaaatggcgatttggatcctacatctcccctcgaaaacatggactacattaaagacaaggaggaagtaaacgggattgaggaaatttgctttgaccctgagggttccaaagcggagtggaaagaaacaccttgtatactcagcgtaaacgtcaagaataaacaagatgacgaccttaattgtgaacccctttcaccccataacatcacacctgagccagtgtccaaacttccagctgaacccgtttctggggaccccgcgcctggtgatttagacgccggggatccggcctccggcgtcctggcctctggggacagcaccagtggagatccaacgtccagcgagccgtcttcctcagacgccgctagtggagatgcaacctcaggatag

SEQ ID NO: 106993 - DNA, 3813 bp, Artificial Sequence
  Description of Artificial Sequence: Synthetic coding sequence
atggacagcctggaagagccacagaagaaagtgtttaaggcaagaaaaaccatgcgggtgtctgatagacaacagttagaggcagtgtacaaggtgaaggaggagcttttaaaaaccgacgtcaaacttctgaatgggaatcatgagaatggcgatctggatcctacgagccccctagaaaacatggattatattaaggataaggaggaggtgaatggtatcgaggagatctgcttcgatccggaaggatccaaggccgagtggaaggaaaccccttgcattctgagtgtaaacgtcaagaacaagcaggatgacgatctgaattgtgaacccttgtctcctcataatatcacacccgaacctgtcagcaagctgcccgcggagccagtcagtggagacccagcaccgggggatctggatgcgggtgaccctgcatccggcgtgctggcctccggagatagtacatcgggtgatccaactagctccgagccctcatcctcggacgctgcatccggcgatgcaacgtcgggagatgcccccagcggagatgttagtccaggggacgccacgtctggtgatgcgaccgctgacgacttgtcgagcggagacccaacctcctctgaccctatccccggagagcccgtgcctgtggaacccatttcaggggactgcgccgccgacgacatcgcttcatccgaaatcacgtcagtggatttggcctcgggtgcccccgcgtccaccgatcctgcctccgatgatttagccagcggggacctcagctctagcgagctggcctccgacgatctcgcaacaggggaactggcatctgatgagctaactagtgaatctacatttgatagaacctttgagcccaaaagtgtcccagtctgtgagccggtccctgagatcgacaacattgaaccctcctccaacaaggatgatgactttctcgagaaaaacggtgctgatgaaaagctggaacagattcaaagcaaggattccctcgatgagaaaaacaaggcggataacaatattgatgcaaacgaggagacgctggagaccgacgacactaccatctgttcagatcggccacccgagaacgagaaaaaggtagaggaggacattattactgagttggcactgggggaggatgccatcagctccagcatggaaatcgatcagggcgagaaaaatgaagatgaaacctccgcggacttggtagaaacaataaacgagaatgtgatcgaagacaataagtcagagaatattcttgagaataccgactctatggagaccgatgaaatcattcccatactcgaaaaattggctccaagcgaagatgagctgacttgttttagcaagacgtccctgctccccattgacgagactaaccctgacctggaagagaagatggagtcctcctttggctctccaagcaaacaagaatccagcgagtctcttcctaaggaagctttcttggtactcagtgacgaggaggatatctcaggggagaaagatgagtccgaagtcattagccagaatgagacatgctcccctgccgaagtggaatctaatgaaaaagataataaacccgaggaggaggaacaagttatccacgaggatgacgaacggccaagtgagaaaaatgagttttccaggaggaaacgcagtaagtccgaagacatggacaacgtacagagcaaacgccgtagatatatggaggaagaatatgaagcagaattccaggtgaaaattacggcaaagggagatattaatcagaagcttcaaaaagttattcagtggttgctggaagagaagctgtgcgccctccagtgcgcagtgttcgataaaacgctggccgagttaaagacacgcgttgagaagatagagtgtaacaagcgccacaaaacggttctgacagaactccaagcaaagattgctcggctcaccaagaggttcgaggccgctaaggaggatctgaaaaagagacatgagcaccctccgaacccaccggtctctccgggtaaaaccgtgaatgatgttaactcgaacaacaatatgagctaccgaaatgctggaaccgtgcggcagatgttggagagcaaacgcaacgtgtcagagtctgccccaccttctttccagacgccagtcaacacagtatcaagcactaacctcgtgacaccccccgccgtagtctcttcccagcccaagctgcagacccctgtgactagtgggagcctaactgctaccagcgtgcttcccgctccaaacacggctactgtggtcgccaccacacaggtgccctctggcaacccacagcccaccatttccctacagccccttccagtcattctgcatgtaccagtggcagtgtcaagtcaaccacaacttctgcaaagccaccccggtacactcgtcactaaccagccatctggaaacgtggaatttatcagtgtccaatctccccccacagtgtccgggctgacaaaaaaccctgtcagtctgccctcactgcctaacccaacaaaaccaaataatgtgccgtccgtcccatcgccgtccattcagcgcaatcctacggccagcgccgcgcccctgggaactacactggccgtacaggctgtaccaaccgctcattccattgtccaggccacaaggacatccctcccaaccgtgggcccttccggactatactcaccttctacaaacagaggtccgatccagatgaagatcccgatctcagccttctctaccagttcagccgcagaacagaacagtaacactacccctcggattgaaaaccagaccaacaagacgatcgatgcatctgttagcaaaaaggcagccgattcaaccagccaatgtggtaaagccactggctccgattccagcggagtgatcgacttgacgatggacgacgaggagagcggggcatcacaggaccctaagaaacttaaccataccccagtgtcaacaatgtctagctctcaacccgtaagtcggcccctgcaaccaatccagcccgctccaccactacagccgtctggtgtgccaactagtgggccgtctcaaacaacaatccatctgctgcctaccgcgcctactaccgttaatgttacccaccgtcccgtgacccaagtcacgacacgattgccggtgccaagagcccccgccaatcaccaggtggtttacacgaccctaccggctccgcctgcacaagcccccctccgcggtacagtcatgcaggccccggctgtcagacaagtaaacccccagaattcggtcacagtgcgggtccctcagaccaccacatatgtggttaataacggactcacattgggcagtaccgggccacagcttacagtgcaccaccgtccaccacaggtgcataccgaaccacctagacccgtgcacccagctcccctgccagaggcccctcagccacagcgcctgccccccgaggctgcatccacttcactacctcagaagccacacctgaagctcgcccgtgtacagagccaaaatgggatcgttctgagctggtccgtgctggaggttgacagaagttgtgccaccgtagattcgtaccatttgtacgcctatcatgaggagccctccgccaccgttcccagtcaatggaaaaaaatcggggaggtcaaggcactgcctttgccaatggcctgcactttaacccagttcgtcagtgggtccaaatactactttgcagtccgggcaaaagatatctatggcaggttcggcccattctgtgacccccaatcgacagacgtaatctctagtactcagtcttcgtag

SEQ ID NO: 106994 - DNA, 510 bp, Artificial Sequence
  Description of Artificial Sequence: Synthetic coding sequence
atggattcattagaggaaccccagaagaaagtctttaaagccaggaagaccatgagggtcagcgacagacagcagctcgaggcggtttataaggtcaaggaggaacttttgaaaaccgatgttaagctcctgaatgggaaccacgagaacggggatttagacccgactagccccttagaaaatatggattacatcaaagacaaggaggaagtgaatggaatcgaggaaatctgcttcgatcccgagggctccaaggccgaatggaaagagacaccatgcatcctctctgtcaacgttaagaacaagcaggatgacgatctgaactgcgagccactaagcccccacaatattacacccgaacctgtatccaagctgccagccgagccggtaagcggggaccctgcccctggggatctggatgctggcgatccagccagcggggtgctggcaagcggcgatagtacctcgggggatcccacttctagcgaacctagcagtagcgatgcttag

SEQ ID NO: 106995 - DNA, 99 bp, Artificial Sequence
  Description of Artificial Sequence: Synthetic coding sequence
atggacagtctcgaggaacctcaaaagaaggtcttcaaagccaggaagacaatgagggtcagcgaccgccagcaactggaggcagtctataaggtgtag

SEQ ID NO: 106996 - DNA, 399 bp, Artificial Sequence
  Description of Artificial Sequence: Synthetic coding sequence
atggactctttggaggagccccagaagaaggtgtttaaggcgcgaaagacaatgagggtgtccgaccggcagcaactggaggccgtgtacaaagtgaaggaggagcttctcaagacagacgttaagctgttaaacggcaaccacgaaaacggcgatctagacccaacctcccctttggagaatatggactatattaaagataaagaggaggtgaacggaattgaagagatatgctttgatcctgaggggagcaaagccgaatggaaagagacaccttgcatcctgagcgtcaatgtgaaaaacaaacaagatgacgatcttaactgcgagcccctgtcgccgcacaatattactccagaaccagtgagcaaactgcccgccgaaccagtcagcggctag

SEQ ID NO: 106997 - DNA, 531 bp, Artificial Sequence
  Description of Artificial Sequence: Synthetic coding sequence
atggatagccttgaggagccccagaagaaggtgttcaaggctcgaaagacaatgcgcgtatccgatcggcaacagcttgaagctgtctacaaagtaaaggaggagcttctgaaaaccgatgttaagctgctcaacggcaaccacgaaaatggggacctggaccccaccagccctctggagaatatggactatattaaggacaaagaggaggtcaacgggatagaagagatctgctttgatcctgagggatccaaggccgagtggaaggagacaccgtgtattttatctgtgaacgtgaaaaacaaacaagacgacgatcttaattgtgaacctctttctcctcataatattaccccagaacccgtgtctaaacttccagcggaaccggtttcaggagatcccgcccccggcgatttagatgctggagaccctgcttctggggtgcttgcttcaggagactctaccagcggggatccaacctcctctgagccatcttcttctgatgctgcctcaggcgacgctacaagttag

SEQ ID NO: 106998 - DNA, 180 bp, Artificial Sequence
  Description of Artificial Sequence: Synthetic coding sequence
atggattcattagaagagccccagaagaaagtcttcaaggctcggaagaccatgagggtttccgacaggcagcagcttgaggcagtatataaggttaaagaagagttgctgaaaactgatgttaagctgcttaatggaaatcacgagaacggagatttggatcccacttcgcccctctag

SEQ ID NO: 106999 - DNA, 3318 bp, Artificial Sequence
  Description of Artificial Sequence: Synthetic coding sequence
atggatagcttggaggagccacagaaaaaggtcttcaaggccaggaagactatgcgggtcagcgatcggcaacagttggaagccgtgtacaaggtgaaggaagagttgctgaagaccgacgttaagttgctgaacggaaaccatgaaaacggagacctagaccccacctcacctctggagaacatggattacatcaaagataaagaagaagtgaacggaatcgaggagatctgctttgatcctgagggcagcaaggccgaatggaaagaaactccctgcatcctatctgttaatgttaaaaacaaacaggacgacgacctgaattgtgaacccctgtccccacacaatatcacacctgagcccgtctctaagctgccagccgaacctgtgtcgggagaccctgctcccggggacctcgacgccggcgacccagcatctggagtcctggcgagtggtgacagcacctctggcgacccgacttccagcgagccttccagcagtgatgcagcaagcggagacgctacctctggcgacgccccaagtggggacgtatcgcccggcgatgccacatcaggggatgctactgccgatgacctgagctctggagaccccacttctagtgaccctatcccaggggaaccagtgccagtagagccaattagtggggattgcgcagccgatgacattgcatcttctgagatcacttcagtagacttagcttccggggcacctgcatcaaccgatccagcaagtgacgatctggcgtccggtgatctgtcatcatcagaactggcatcagatgatctggccacgggggagcttgcctccgatgagctaaccagcgagagcaccttcgatagaacgttcgagccgaaatccgttcccgtgtgtgaacccgtacctgaaatcgacaacatagagccatcgtcgaacaaagacgatgatttcctcgaaaaaaatggcgcagatgaaaaactggagcagatccagtctaaagattccctggacgagaagaataaagccgataataacatagacgccaatgaggaaacgctggaaactgatgacaccaccatttgttcagataggcctccagagaatgagaagaaggttgaggaggacatcatcacggaactggccttgggagaagatgccatcagtagctccatggaaatcgatcagggggagaaaaacgaggatgagacaagcgctgatctggtagagactatcaacgagaatgttatcgaggacaacaagtctgagaatatcctggaaaacactgacagtatggaaactgacgagatcatcccaattttagaaaaactcgcaccctccgaggacgagctaacatgtttctccaaaacctctttactgcctatcgatgagaccaatccagacctagaggaaaagatggaaagtagctttggatcaccatctaagcaggagtcttccgagtccctccctaaggaggctttcctggtcctgagcgacgaagaagacatctccggagagaaggatgaaagtgaggtgattagccagaatgaaacatgctctccggaggtcgaatccaacgaaaaagataataagccagaagaggaagagcaggtgattcatgaggacgatgaacggccttcggaaaagaacgagtttagccgtaggaaacgctctaaatctgaagatatggacaatgtgcaatccaagaggagacgttacatggaggaggagtatgaggccgagttccaagtcaagattactgcaaaaggcgatataaatcagaaattacaaaaagtgatccaatggctgctcgaggaaaaactttgcgctcttcagtgtgccgtgttcgataagacactggcagaactcaagacacgggtggagaagatcgagtgcaacaagaggcacaagaccgttcttaccgagttacaggctaagattgctagactaacaaagcgttttgaggctgccaaagaagatttaaagaaaaggcacgaacaccctccgaatccacccgttagtccaggcaagactgtgaacgacgtcaactctaacaataacatgtcctacaggaacgccggtaccgtgaggcaaatgctggagtctaaaagaaatgtgagtgaatccgcccctccttccttccaaacccccgtgaataccgtcagctcaacaaacttggttaccccccccgcggtggtcagcagtcagcctaagcttcagactccagtgacctcgggctccctgactgctacctcagttctgccagcacccaatacagccacagtagtcgccactactcaagtgccgtcgggcaatcctcagcccaccatttctctgcaacccttacccgttatcctgcacgtgcccgtcgctgtcagcagccagcctcaactgctgcagtcacaccctgggaccctcgtgaccaatcagccatcaggaaatgtggagttcatttctgtgcagagtccccctaccgtctcagggctgacaaagaaccctgtgtccctgccatctctgccgaacccgaccaagcctaataacgtaccctccgtgccgagcccatccattcagcggaaccccacggcatccgccgccccactgggcacaacactggcagtgcaggcagtgccgacagcccactccatagtgcaggctacacggacgagcttgcccaccgtagggccgtccgggctgtattcacccagcacgaaccggggccctatccagatgaagatccctatttccgccttcagtacttccagcgctgccgaacaaaatagcaacactaccccgcgaatagagaatcagaccaacaagaccatcgatgcctcggtatccaagaaggctgcggacagcacctctcagtgtggtaaggctaccggaagcgacagtagtggggtgatcgacctgaccatggacgatgaggagtctggcgcgtcccaagacccaaaaaagctgaaccacactcctgtgagtaccatgagttcatcccagccagtttcgagacccctgcaaccgatccagccagcacctcctctgcagccatcaggcgtgcccacttccggtccttcacagacgactatccacctccttcccactgcccccactacggttaatgtgactcatcggcctgtgacccaggtgacaactcggctccccgtacctcgggctcctgctaaccaccaggtggtgtatacgaccctacctgctcctccagcccaagccccactcaggggaactgtcatgcaagccccagcagtgcgccaggttaaccctcagaatagcaagcggttcttcttgtacatggctccacggtatatgtag

SEQ ID NO: 107000 - DNA, 3837 bp, Artificial Sequence
  Description of Artificial Sequence: Synthetic coding sequence
atgcatcaggaccagagattcaggatggacagcttagaagagccgcagaagaaagtttttaaggccagaaaaactatgagggtatctgaccgacagcagctggaagctgtgtacaaagttaaggaggaactgcttaaaactgacgtcaagttgctgaacggaaaccacgagaacggagatctcgatcccacctctccactcgagaacatggattatatcaaggataaagaagaggtgaatggtatcgaagagatttgtttcgatcctgagggctcaaaagcggagtggaaagagacaccatgcattctttcagtgaacgtgaagaacaagcaggatgacgacctaaattgcgagcccctgagtccacataacattactccggaacccgtatctaagctccccgctgagcccgtgtcaggagatcctgcaccaggagatctagatgctggagatcccgcttccggagtcctggcttctggtgatagcacctcaggcgatccgaccagctccgaaccgtcaagctctgatgcagcttcaggtgatgccacgtccggggatgcgccttcgggagatgttagccccggggacgctaccagcggcgacgccaccgcagatgatttgtcatctggcgatcctacatcctctgatcccattccaggggaacccgtgcccgtcgagccaatctcaggggattgtgccgcagacgatatcgccagttccgagattacatcagtcgacctcgccagtggggcgcctgcctccacagaccctgcctctgatgacctcgcctccggcgatttaagctcctcggagctggccagtgatgacctggcaacaggcgagttagcatccgatgagctcaccagcgaaagtaccttcgatagaacattcgaaccaaagtctgtgcctgtttgcgagccggtgcctgagatcgataatatagagcctagttctaacaaggatgacgatttcttggaaaagaatggcgcggacgagaaactggagcagattcaatccaaggattccctcgacgagaaaaataaggccgacaacaatattgatgctaacgaggagactttggagaccgatgatacgacaatttgctccgatcggcctcctgagaatgaaaagaaggtggaagaggacattattactgagttagcccttggcgaagacgccataagctcctccatggaaattgaccagggagaaaaaaatgaggacgagacctctgccgacttagtggaaacaattaacgagaacgtaatcgaggacaataagagcgagaacatcctggagaacactgacagcatggagacagacgaaattataccaatcctggaaaaacttgcaccatccgaagatgagttgacatgtttttctaaaaccagtcttctgcctattgacgaaacaaatccagatctggaggagaaaatggagtcatcctttggtagcccatcgaagcaggaaagctcagagagcctacctaaggaggctttcctggtgttgtcagatgaggaggacatctcaggcgaaaaggatgaaagtgaggtgatatctcagaacgagacctgctcccctgctgaagttgaatccaacgagaaagacaataagcccgaagaggaggagcaagtcatccatgaagacgatgagcggcctagcgaaaaaaatgagttttcacgaagaaaacgctctaaaagtgaggacatggacaacgttcaaagcaaaagacgccggtacatggaggaagagtatgaagcggaatttcaggtcaagataactgctaagggcgatattaatcaaaagctgcaaaaagtgatacagtggcttctggaagaaaagctgtgcgcccttcagtgtgctgtctttgataagaccctggccgagttgaagacccgcgtggaaaagattgaatgtaacaagaggcacaagacagtgctgaccgagctgcaggcaaaaattgcccgcttgacaaagagatttgaggcggccaaagaagaccttaagaaacgccacgaacatccaccaaacccaccggttagtcccgggaagaccgtgaacgacgtgaacagtaacaacaatatgtcttaccgcaatgccgggacggtccgccaaatgcttgagtctaaacgtaatgtgagtgaatcagcccctccctctttccagacgcccgtgaataccgtctcgtccaccaaccttgtaacaccccccgcagttgtgagctcccaaccaaagctgcagaccccagtgacaagtggctccctcacagcgacgtccgtgctccccgcacccaacacggccacggtagtagcaacaactcaggtccccagtggaaatcctcagccaacaataagtctccagccgctgcccgtgatcctccatgttccggtagcggtctcaagccagccccagctgctgcagagccacccagggactctggtaacaaatcagccttctgggaacgtggagttcatctccgtgcaatcaccacctactgtgtcagggctgactaagaaccctgtgagcctcccgagtttgccgaacccaacgaagccaaacaacgtgccgagcgttcccagcccctccattcagcgcaaccctactgcatccgcagccccgctgggaacaactctggcagtgcaggcagtgccaaccgctcactccatcgtacaagccaccagaacaagcctcccgaccgtgggacccagtgggctttatagtccctccactaatagaggccccatccagatgaagattccaatcagtgcattcagtacttccagtgccgcggagcagaattcaaacacaacgccaaggattgaaaaccagacgaataagaccatcgatgcttctgtaagcaagaaggcggctgattcaacatcccagtgtggcaaggccacgggcagcgactcttccggtgtcatagacttaaccatggacgatgaggagagtggcgcctctcaggatcccaagaagttaaatcacaccccggtgtccaccatgtcctcttcccagccagtctcacggcctcttcagccaatacagcctgccccaccgttgcaaccgagcggcgtgcctacatccggaccatcccaaacaactattcatctccttcctactgccccgactaccgtaaacgtgacgcaccggcctgtcacccaggtgactacccggcttccagtaccgcgtgcccccgccaaccaccaagtcgtgtatacaaccctgccagctcctcctgcacaggcgcctctgcgggggactgttatgcaggccccagccgtcagacaggtgaatccgcagaattcagtcacagtcagagttccccagacaaccacctacgttgtcaataacggacttacattggggagcaccggcccccagcttactgtgcatcacagacctccacaggtccacaccgaacctccccgccctgtccatcccgcaccgctgccggaagccccccaaccgcagagactccctcctgaggctgcctctacttccctcccccagaagccccacctcaaattggctcgtgtgcagagccaaaatgggattgtgctgtcttggtcagtgctcgaggttgataggtcctgtgccaccgttgactcctatcacctctacgcttatcacgaagagccgtcagcaacggtaccttctcagtggaaaaagattggggaagtcaaagcactaccgctccccatggcgtgtacactgactcagtttgtctctggcagcaagtactacttcgctgtgagggcaaaggatatctatgggaggttcggccctttttgtgaccctcagtccaccgacgtgatttctagcacacagtccagttag

SEQ ID NO: 107001 - DNA, 510 bp, Artificial Sequence
  Description of Artificial Sequence: Synthetic coding sequence
atggacagtctcgaagagccccaaaagaaggtgtttaaggcgaggaaaactatgagagtctccgatcgccagcagcttgaggcggtctacaaagtgaaggaggaactactcaagacagatgtcaagttgctcaacggcaatcacgagaatggtgacctggaccccaccagcccgctcgaaaatatggactacattaaggataaagaagaggtgaatggcatcgaagaaatttgcttcgatcctgaaggaagcaaagcagagtggaaggaaaccccatgtatcctcagcgtgaacgtcaaaaataaacaggacgatgacctcaattgtgaacctctttccccccataatatcacccccgaacctgtatcaaaactgccggccgaacctgtgtccggcgaccccgcccctggcgatcttgatgcaggggatccagcttcgggagtgctggctagcggggattcaactagcggtgatccgacctccagcgaaccctcttcttccgacgcttag

SEQ ID NO: 107002 - DNA, 1632 bp, Artificial Sequence
  Description of Artificial Sequence: Synthetic coding sequence
atggcaagtccggatcggtccaagcgaaagatcttgaaggccaaaaaaactatgcccctatcctgccggaaacaggttgaaatgctcaacaagtcccggaatgtcgaggcccttaaaacagccatcggctccaacgtccccagcggcaaccagtctttctcgccatctgtaataacccgcactacggaaattactaagtgctctccctccgaaaacggagccagctcactggacagcaataaaaatagcatctccgagaaatctaaagtattcagtcagaattgtattaaaccagtagaggagatcgtgcattcggaaacaaaactggagcaagtagtgtgcagctaccaaaagccttccaggaccacagaaagtccctccagggtgtttacagaagaagcgaaggactcactcaatactagcgaaaatgacagcgagcaccagacaaacgtcacacgctctttatttgaacacgagggtgcctgtagcctcaagagttcttgttgccctccctccgtcttgtcaggcgtagtgcagatgccggaatccaccgtcaccagcacggtgggcgacaagaaaaccgatcaaatggtgttccatctggagactaattccaactcggaatcccatgacaagcggcagtctgacaatatattgtgttctgaggatagtgggtttgtgcctgttgagaagaccccgaacctggtgaacagcgtgacctccaataactgcgccgatgacattcttaagacggatgaatgctcccgaacctccatttccaactgcgagagtgctgactctacatggcagtctagtctggataccaacaacaacagtcattatcagaaaaagcgaatgttttcagagaatgaagaaaacgtgaaaagaatgaagacttcggagcagataaatgagaatatctgcgtgtcgctggagcgccagacagccttcttggagcaggtaagacatctgatccagcaggaaatctattccattaattacgagctgtttgacaagaagctaaaggagctcaatcagcggataggcaaaaccgagtgccgtaacaaacacgagggtatcgctgacaaactcctcgcaaaaatagccaagctccaacgacggattaagacagtcttactgtttcagagaaactgccttaaacctaacatgctcagcagcaatggggcctccaaggtggccaatagcgaggccatgatcctggataagaatcttgaatctgtcaacagccctatcgaaaaaagttcagtaaattacgagccgtctaatcccagcgagaaagggtccaagaagatcaatctgagcagtgaccagaataagtctgtcagcgaatctaataatgatgacgttatgctgattagcgtcgagagcccaaacttaaccactcctataacctccaatccaacagacacaagaaagatcacctctggaaacagcagcaattcccctaatgcagaggtcatgaaagtgcagtaccccccttggtcgcacattcgcaaactgctgcaaacacagaggaagcagccgcattggcacaagatgcagtctagattcctgtcaccactgagtacctgccacctctctcagaaccaccaacaccactatctgaactag

SEQ ID NO: 107003 - DNA, 2049 bp, Artificial Sequence
  Description of Artificial Sequence: Synthetic coding sequence
atggcatcccccgacagaagtaaaaggaagatcctcaaggcgaaaaaaaccatgccactgagttgcagaaagcaggtagagatgttaaataagtcccgaaatgtggaggcactaaaaactgccattggcagcaatgtacccagcggaaaccaatcattttcgcctagcgtgatcacgagaactacagagattacaaagtgtagcccctctgagaacggggccagtagtctggattccaacaaaaattcaatttccgagaaatccaaagtattcagccagaattgtataaagccggttgaggagatcgtgcacagtgagaccaagttagagcaggtcgtttgtagctatcagaaacctagtcgtaccactgagtctccaagtcgcgtattcaccgaggaagccaaagactccctgaatacttctgagaacgactccgaacatcaaactaatgtgacccgctccctgttcgagcatgaaggcgcctgcagcctgaaatcaagctgctgtcccccgtctgtcctgtctggggttgtgcagatgccagagagcaccgtaaccagcaccgtgggcgataaaaaaactgatcagatggtctttcatcttgagaccaactcaaatagtgagagccatgataaacgacaaagcgacaacattctgtgttccgaggactccggatttgtgcctgttgagaaaacacctaacttagtcaactctgtaacctccaacaactgcgcagacgacattttgaaaactgacgaatgcagcagaacctccattagcaattgcgagagcgcagactctacatggcaatcttctctggatactaacaacaattctcactatcaaaaaaagaggatgttctcggagaacgaggaaaacgttaaaagaatgaagaccagcgagcaaattaacgagaacatctgtgtgtctctcgagcggcaaacagcttttcttgagcaggtcaggcacctgatccagcaggagatatacagtataaactacgagttattcgataagaaactcaaggagctgaatcaacgtattggtaagaccgaatgccgcaataagcacgaaggaatcgcagacaaactactggctaaaatagcgaagctccaacgccggatcaaaaccgtgcttctgttccagagaaactgtctgaagcccaatatgctcagttctaacggtgcaagtaaagtcgccaacagtgaagccatgatacttgataagaacctggagtctgtaaattcccctattgaaaagtccagtgtgaactacgaaccatcaaatccctcggagaaagggtctaaaaagattaatctttcgtcagatcagaacaaaagcgtgtctgaatccaacaacgacgacgtgatgctgatatcggtggagagccctaacctcactacccccattacttccaaccctaccgacactcgtaagattactagtggtaattcctccaacagccccaacgcggaggtaatggctgttcagaagaaactggacagtattatcgacctgaccaaggagggactgtctaactgtaatacggaaagccccgtatctcctctggagtcacattcaaaggctgcgtcaaattcaaaggaaacaactcctctggcccagaatgcagtccaggtgccagagtcatttgagcacctgcctccgttgccggagccaccagctccactacccgaactggtggataaaaccagagatacattgccaccacagaagcccgagctgaaagtcaagcgagtcttccgaccaaacggaatcgctttgacgtggaatatcaccaaaattaaccccaagtgcgcaccagtggagtcttaccatctgttcctgtgccacgagaatagcaataacaaactgatctggaagaagattggcgaaataaaggccctgcctctaccgatggcttgcacacttagccagtttcttgcatccaaccggtactacttcacagtgcagtccaaggacatcttcggaaggtatggccccttttgcgacatcaaatcaattccaggctttagtgagaatttgacatag

SEQ ID NO: 107004 - DNA, 1632 bp, Artificial Sequence
  Description of Artificial Sequence: Synthetic coding sequence
atggcttctccagaccgttcgaagaggaagatcctcaaggccaaaaaaacgatgcctttgtcttgccgtaagcaagtggaaatgctgaataagtctagaaacgtggaagctctgaagaccgccatcggcagtaatgtccctagcggcaatcaatctttttcaccttctgtgattaccagaaccacagaaattaccaagtgctccccctccgaaaatggcgcttcctctcttgattctaataagaactccatttctgagaagagtaaggttttcagccaaaactgtatcaaacctgtcgaagagatcgtgcatagcgaaactaaattggagcaggtcgtgtgttcttatcagaagccttctagaactaccgagagtccctctcgtgtgttcacagaggaagccaaagatagcttgaacacctccgagaatgattctgaacaccagactaacgtgaccaggtctctgttcgagcacgaaggggcctgttccctaaagtcgtcatgttgtcccccctctgtgctctccggggtggtacagatgcctgagtctacggtgaccagtacggtgggggataaaaagaccgatcagatggtgttccacctggaaacaaattcgaactccgaaagccacgacaagcgacagtcggataacatcctgtgttccgaagacagtgggtttgttccagtcgagaagacccctaacctcgtaaatagcgttacctccaacaattgcgctgatgacatcctgaagaccgacgagtgttcccgaacgagcatctcaaattgcgagtcagccgatagcacgtggcagagttccctggacactaataacaactcccactatcagaaaaaaagaatgttttccgaaaatgaggaaaatgttaagaggatgaagaccagcgagcagattaatgaaaacatctgcgtgtcactagaacgacagaccgccttcctggagcaggtgagacatctgatccaacaggagatttactcaattaactacgaactgtttgataagaagctgaaggagttgaatcaacgcataggtaaaactgagtgtaggaataagcacgaggggatcgctgataaactgctggctaaaatcgctaaactgcagcggcgcatcaagaccgtgcttctgttccagcgaaattgcctaaagcccaacatgctctcatccaatggtgcttcaaaggttgccaatagcgaggctatgattcttgacaaaaacttggaatctgttaattcccctattgagaaatcatctgtgaactacgaaccatctaaccccagcgaaaaaggttccaagaagattaatctatcatcagaccaaaataaaagcgtaagtgaatccaataatgatgacgttatgctgatctccgttgagtcccctaacctgaccacacctataacctccaaccccacagatacccggaagattacgagcggcaactcgagcaatagtcccaatgcagaggtgatgaaggtgcagtacccaccttggtcccatattcggaagctgctgcagacccagaggaagcaaccccattggcacaagatgcagagcagattcctcagcccgctatctacctgccaccttagccaaaatcatcagcaccattatttgaattag

SEQ ID NO: 107005 - DNA, 2049 bp, Artificial Sequence
  Description of Artificial Sequence: Synthetic coding sequence
atggcgtcgcccgacaggtccaagagaaaaatcttgaaggccaagaaaaccatgccactgtcctgccgaaaacaagtggaaatgctgaacaagtccaggaatgttgaggcgctgaagacagctatcggctctaatgttccatccggaaatcagtccttttctccctcggtgattacacggaccaccgagattactaaatgtagtccttccgagaatggcgcttccagccttgacagcaacaaaaactcgataagtgaaaaatctaaagttttctcgcagaattgtatcaaacctgtggaagaaatcgttcactccgagaccaagctggagcaggtggtgtgctcataccagaaaccctcgcgcacgacagaaagccctagccgcgtttttaccgaagaagctaaggacagtctgaatacaagcgaaaacgactctgagcaccagaccaatgtgacccgctccctgttcgagcatgaaggcgcctgttcactcaagtcttcttgttgccctccttctgttctctctggagtagtccagatgcctgagtctaccgtgactagtactgtgggtgacaagaagaccgatcaaatggtgttccacctcgaaacaaactctaactcggagtcccatgacaaaaggcagagcgacaacatcctctgtagtgaagattctggcttcgtcccagtcgagaagaccccgaatcttgtgaactccgtcacctccaataactgtgcggacgacattctcaagacagacgagtgctccaggacgtccatatcgaactgcgaatccgcggatagcacttggcagagctccttagacacaaacaataactcccactaccagaagaaaagaatgttttcagagaacgaagaaaacgtgaagagaatgaaaaccagcgagcagatcaacgagaacatctgtgtttcgctagagcgtcagaccgcattcctcgagcaggtgcgccacctcattcaacaggagatatattccatcaactacgagctgttcgataaaaagctgaaagagttaaatcagcggattggcaaaactgaatgtcggaataaacacgaggggattgcagataagctgctagccaagatcgccaagctgcagaggcgcataaaaacggttctccttttccagagaaattgcctcaagcccaacatgttgtctagcaacggagcttctaaggttgccaactccgaagcaatgatactggataagaatctggagtccgttaattcacctattgagaagtcaagcgtgaattacgagccctcgaacccctccgagaagggatctaaaaagatcaatctgagcagcgaccagaacaagtctgtatctgagtccaataatgatgatgttatgttaattagcgtggagagccccaacttaaccactcctataacctccaacccgactgatacacggaaaataaccagcggaaatagcagtaattcccccaacgccgaagtgatggctgtccagaagaaactcgacagcatcattgatttgaccaaggagggactcagcaattgcaacacagaaagccccgtgagtcccttggaatcccattcaaaggccgcttctaactctaaggaaactaccccccttgcccaaaacgcagtacaggtacctgaaagtttcgagcacctgcctcccctacccgaaccccccgctcccttacccgaactggtggacaaaactcgggatacccttcccccccaaaagcccgagctcaaagtcaaaagggtgtttcgacctaatggcatagctttgacctggaacattacgaagatcaatcccaagtgtgcccctgtggaatcctaccatctcttcctctgtcatgaaaatagtaataacaaactcatctggaagaagataggcgaaatcaaagccctgcccctgcccatggcttgcactctctctcagtttctggcatctaaccgctactacttcacagtgcagtccaaggacattttcgggagatacggcccgttttgtgacatcaaatcaatccctggcttttcggagaatctaacctag

SEQ ID NO: 107006 - DNA, 1278 bp, Artificial Sequence
  Description of Artificial Sequence: Synthetic coding sequence
atggcctcccctgaccggagtaaaaggaagattcttaaagcaaagaaaaccatgcctctgtcttgcagaaaacaggtggagatgctcaacaagagtagaaacgtggaggctctgaagaccgctatcgggtccaacgttcccagcggaaaccagagctttagccctagcgtgatcacccggacgaccgaaatcactaaatgctccccatctgagaatggcgccagtagtctcgacagcaacaagaactccatcagcgaaaaatccaaggtgttttcacaaaactgtataaaaccagtggaagaaatagtacattccgaaacaaaattggaacaggtggtctgttcttatcaaaagccgagcagaacaaccgagagccccagtagagtgttcacggaggaggccaaggactcacttaatactagcgaaaacgattccgaacaccagactaacgttactcggtctctgtttgagcacgaaggcgcctgctctttaaaaagcagctgttgccccccatcagtgctcagcggcgtggtacagatgcccgagtctactgtgacctccaccgtgggcgacaagaaaaccgatcagatggtatttcacctggagacaaatagcaattccgagtcccacgataaacggcaatctgacaacatcctctgcagcgaggattccgggtttgtgccggtagaaaaaactcccaacctggtgaatagcgttactagtaacaattgcgccgatgacatcctgaaaacagatgaatgtagccgtacatcaattagcaattgtgagtctgcagactcgacctggcagtcctcactggacacaaataataacagtcactaccagaaaaaacgcatgttttccgagaatgaagagaatgtaaagcgtatgaagacatctgagcagataaatgaaaacatctgtgtttccttagagcgccagaccgcctttctggaacaggtacgacacctgatccagcaagagatctacagcattaattacgaactgtttgacaagaagctcaaagaactaaatcagcgcataggtaaaacggagtgcagaaacaaacacgaggggattgccgacaagctcctcgccaagatcgctaaactccagcgaaggatcaaaactgttctactgttccagaggaactgtctgaaacccaatatgcttagctcaaacggcgcctctaagattccagagaaactccatcaggagatcttggccattctgcccatgttgaaattatggctctaccgccgtaacttgatcctctag

SEQ ID NO: 107007 - DNA, 681 bp, Artificial Sequence
  Description of Artificial Sequence: Synthetic coding sequence
atgctgattagcgttgagagcccgaatctgactactccaattacctcaaacccgaccgatacccggaaaataacctccggcaacagttccaactctcccaacgctgaagtgatggctgttcagaagaaacttgactccatcatcgacttgaccaaagaaggactgtcaaactgcaacaccgagagtccggtgtctccattggaaagccattcaaaggccgcgtccaactctaaagaaacaacaccgttagcccagaatgccgtgcaagtgccagagagcttcgagcatctgccgcctctgccggagcctccagctcccttgcctgaactggtggacaaaacccgggacacgctcccaccgcagaagcccgagctcaaagtgaagagagtcttcagacctaatggaatagctttgacatggaatatcactaaaattaaccctaaatgcgcgccagttgaaagttaccacctgtttctatgtcatgaaaattcaaacaacaagctcatttggaaaaaaatcggcgaaatcaaggccttgcctcttcctatggcctgtactctctctcagttcctggcgtcaaatagatactacttcactgtgcagtcaaaagatatctttggcaggtacgggccattttgtgacattaagtctattcccggctttagtgagaacttgacatag

SEQ ID NO: 107008 - DNA, 714 bp, Artificial Sequence
  Description of Artificial Sequence: Synthetic coding sequence
atgacatccgagatcacatatgcagaagtccgtttcaaaaacgagttcaagagtagcggaattaacaccgctagcagtgctgctagcaaggaacgaaccgcccctcataaatccaacacagggttccctaagctcttgtgcgctagtcttctcatcttcttcctgctgctggccattagtttcttcatagcattcgtaatcttctttcagaagtattcccagctgttggaaaagaagactacaaaggaattggtccatactacccttgaatgcgtgaaaaaaaatatgccagtagaagagactgcatggagctgctgccccaaaaattggaagtcattcagcagtaactgctatttcatctcaaccgagtctgccagttggcaggactccgagaaagattgcgcacgaatggaagcacacttgctcgtgatcaacacccaggaagaacaggactttatcttccaaaacctccaggaagagagtgcttactttgttggattaagcgatcccgaggggcagaggcactggcaatgggtggaccagaccccctacaacgagagtagtactttctggcacccgcgggagcctagtgaccctaacgagagatgcgtggtcctgaattttcggaagagtcccaagcgatgggggtggaacgatgtgaactgcttgggtcctcagcgatccgtttgtgagatgatgaagatccacctttag

SEQ ID NO: 107009 - DNA, 2469 bp, Artificial Sequence
  Description of Artificial Sequence: Synthetic coding sequence
atggaagaagaggaggaagccatcggactgctggataaggtcctggaggacgaagatgtttttttactcgaggaatgcgagctcggtacaccaacaagccctggaagtggcagtccgtttttagtggccgttaaagtggaagccggaaaaggcctggagatgaggaaactagttctttccgggtttctggctagcgaggagatctacattaaccagcttgaggcgttgctgctgcccatgaaacctctgaaagccactgccacgacttctcagccggtcctgactatccagcaaatcgaaacgattttttataagatacaagatatctacgaaatccacaaggagttctacgacaacctgtgtccaaaagtgcagcagtgggactcccaggtaaccatgggtcatctgttccagaagctggcctcccagttgggcgtctacaaagcatttgtcgataactacaaagtcgcccttgagacagccgagaagtgcagtcagtcgaataaccaatttcagaagatctccgaagagctgaaagtgaaaggccctaaagatagtaaagatagccatactagcgttactatggaggccttactgtataagccaattgacagagttacacgcagtaccttggtgctccacgatctgctcaaacacacaccagttgaccatcctgattatcccctactgcaggacgccctgcgtatttcccaaaatttcctcagtagcatcaacgaggatatcgatccacgtcggacagcagtcaccaccccgaagggcgaaacccggcagttggtgaaggacgggtttctggtcgaggtgagtgaatcgtccaggaagctgcgccacgtcttcctgtttaccgatgtccttctctgtgcaaaactgaagaaaacctctgctggaaaacaccaacagtatgattgcaagtggtacattccactagctgatctggtgtttcccagccccgaggagagcgaagccagccctcaggtgcaccccttccccgaccatgaactcgaggatatgaaaatgaagatttctgctctgaaatcggagattcagaaggagaaggcgaataaggggcagagcagggccattgaacggctgaagaagaagatgtttgagaatgaatttctactcctcctaaacagcccaacgataccctttaggatccacaataggaatgggaagtcatacttgtttcttttatcttctgactacgagagatctgagtggagggaggctatccagaagttgcagaaaaaggatctgcaggcctttgtgctcagctcggtggagcttcaggtccttaccggttcctgttttaagctgcgaacagttcataatattccagtcacatcaaacaaggatgatgatgaaagccccgggctctacggcttcctgcacgtgattgttcactctgccaagggttttaagcagtccgctaatttatactgcaccctggaggtcgatagctttgggtactttgtctctaaagccaaaactagagttttcagggacactgccgagcctaaatgggacgaagaattcgagattgagttagagggttcccagagtctgcggattttgtgctatgagaaatgctatgataagacgaaggtgaataaagacaataacgagatcgtggataagatcatgggcaaaggccagattcagctggaccctcagactgtggagacaaagaattggcatacagacgttatagagatgaatggcataaaagtggaattcagcatgaagttcacctccagggatatgagcctgaagaggaccccaagtaagaaacagacaggcgtgttcggcgtgaaaatatccgttgtcactaagcgggagagaagtaaagttccatacatagtgagacagtgtgtagaagaagtggagaagagggggattgaggaggtcgggatttacaggatcagcggagtggccactgacatccaggctctcaaggccgtgttcgatgctaacaacaaggatatactgctcatgctttcagatatggatatcaatgcaatcgccggcactcttaagttgtacttcagagaactaccagagcccctgctaaccgatcgactgtatcctgcgttcatggagggaatcgccctgtcggaccccgcagccaaagagaactgcatgatgcaccttcttcggagcctaccagacccgaatctgatcacctttctgtttctgctggagcatttgaagagagtcgccgagaaagagcccatcaacaagatgagccttcacaacctggccaccgtgttcggtcccactctactgcgcccctcagaagtggagtcgaaggcccatctcacctccgcagccgacatctggtcgcatgacgttatggcgcaggtgcaggtcctgctatattatctgcagcatccccctataagttttgcagagctcaaaagaaacactttatacttcagtacagacgtttag

SEQ ID NO: 107010 - DNA, 2580 bp, Artificial Sequence
  Description of Artificial Sequence: Synthetic coding sequence
atggaacctctctctcacaggggccttcccaggctgagctggattgacacgctctacagcaactttagctacggcacagacgagtacgatggagaagggaacgaggaacagaaagggccacctgaaggatcagagacaatgccatacattgacgaaagccccacaatgtcccctcagctcagtgcccggtctcagggggggggggatggggtcagtcccacaccgccagagggactggccccgggtgtggaggccggtaagggactcgagatgcgcaaacttgtactgtcaggcttcctagcttccgaggagatttacattaatcagctggaggcgttgctgctccccatgaagcctttaaaggctaccgccacaacttctcaaccagttcttactattcagcagatcgagaccatcttctataagatccaggatatctatgagatccacaaggagttctatgacaacctgtgcccaaaggttcagcagtgggactcacaggtgactatgggccacctctttcaaaaacttgctagtcagctgggggtgtataaggcctttgtggacaattacaaggtcgccctggaaacagctgagaaatgtagccagtcaaataatcagtttcagaaaatttctgaagagctgaaggtaaaaggccctaaggattctaaagactctcatactagcgtgaccatggaagctttgctgtataagcccatagatagggtgacccggtccacccttgtcttgcatgatctgcttaagcataccccggtggatcacccggattaccccctactgcaggatgcgcttcggatcagtcagaatttcctttccagcattaacgaagacatagaccctagacgtaccgccgtaactacgcctaagggggagacccgtcagctcgttaaggacggatttctggtcgaagtgagcgagagctcacgaaagctcaggcacgtcttcttattcacagacgtgttactgtgtgccaagctgaagaaaacatcagccggcaaacatcaacaatatgattgcaaatggtacataccccttgcagacctggtctttccctcacccgaggagagcgaagcaagtccgcaagtccacccgttccctgaccatgagctcgaggacatgaagatgaaaattagcgccctgaagagcgaaatccaaaaagagaaggctaacaaaggtcaaagtcgtgccattgagcggctgaagaagaagatgttcgagaacgaattcttgctgctcctcaacagcccaacgatccccttccgtatccacaacagaaatggcaagagctacctgttcctgcttagctccgactacgagcggtcagagtggcgcgaagctatccaaaaattacagaagaaggatctccaggcattcgtgttgtcatcagttgaattgcaggtgctgactgggtcttgttttaaactaaggaccgtacacaatatacctgttactagcaacaaggatgacgacgaaagtcctggactgtacgggtttctgcatgtgattgtgcatagcgctaagggctttaagcagtccgcgaacctgtattgtacgctggaagtggattcctttggatatttcgtgtcaaaggctaagactcgggtttttcgcgatacagccgaaccaaagtgggatgaagagtttgagatcgagctcgagggtagccagagtcttaggatcctctgctacgagaaatgctatgataaaactaaagtaaataaggataataatgagattgtcgacaagattatggggaagggccagatacaactggacccccagacagtagagaccaaaaattggcacactgacgttatcgagatgaatggaattaaggtggaatttagcatgaaattcacaagccgggacatgtcattaaaaaggactcctagtaagaagcagaccggggtgtttggggtcaaaatctccgtcgttacaaagagagaacggtccaaggttccctatatcgtgaggcagtgtgtggaagaggtcgaaaagcgagggattgaggaagtaggtatttatagaatctctggggttgctaccgacatccaagcgttaaaggccgtctttgatgccaataataaagatatattactgatgttatctgatatggatatcaacgctatcgccggaacattaaagttatatttcagggagctgccagagccactcttgaccgataggttatatcctgcctttatggaaggcatcgccttgtctgacccggctgcaaaagaaaattgcatgatgcatttactgcggtctctgccagatcccaatctcatcacattcctattcctcctggaacacctgaagcgagtggctgaaaaagaacctattaacaagatgtccctgcataatctagccactgtcttcggacctactctgctccggccttctgaagtggagagcaaggctcaccttacaagcgccgctgatatctggagccacgatgttatggcgcaggtgcaggtcctcctttactacttacagcacccaccaataagcttcgccgagctgaaacgcaacaccctgtacttcagcacagacgtgtag

SEQ ID NO: 107011 - DNA, 1092 bp, Artificial Sequence
  Description of Artificial Sequence: Synthetic coding sequence
atgaagcctcttaaggccaccgccaccacaagccaaccagttctgacgatacaacagatagagacaatcttctacaagatccaagacatctacgagatccataaagagttttatgataacctgtgcccaaaggtccagcaatgggatagccaagttactatggggcacctcttccagaaactggccagccagctgggcgtatacaaggcctttgtcgacaactacaaggtcgccctcgagacggccgaaaagtgcagtcagtctaacaatcagtttcagaaaatctccgaggagcttaaggttaaaggcccaaaagactcaaaggatagccatacttctgtgactatggaggcccttctgtacaagcccatcgacagagttacgagatctacactggtcctccatgatctgctgaaacacacacctgtggatcacccagattacccactacttcaggatgcactgaggatctcccaaaattttctcagctccatcaacgaggatatcgatccacgcaggacagccgtgacaacgcccaagggcgagacccgccagcttgtaaaggacgggttcctggttgaggtcagcgaaagtagccgaaaactgagacatgtgtttcttttcactgacgtgctgctttgcgcaaaactcaagaagacctccgccgggaagcaccaacaatacgactgcaagtggtatattccccttgctgacttggtgttcccaagcccagaggagagcgaagctagtccacaagttcatccattcccagaccacgaactggaagatatgaagatgaagatcagcgccctgaagtccgagattcagaaagaagaagtggagaaacgcgggatagaggaggtgggaatttaccgcatctccggtgtggccacagacatccaagccttgaaggccgtgttcgacgcaaataataaagatattttgctgatgctctcagacatggatatcaacgccatcgctggcaccctgaaactttactttcgcgaattacccgagcctttgttaacggatcgacttagtccatgcccaacaccaactagttcaccaagctcatcttgctggaacacttag

SEQ ID NO: 107012 - DNA, 1926 bp, Artificial Sequence
  Description of Artificial Sequence: Synthetic coding sequence
atggagatcctcctgatcatcagattctgctgcaactgtacatatgcattactgtacaaacccatagatagagttacaagaagcacactggtgctgcatgaccttctaaaacacacacccgtggaccaccccgactatccactgcttcaagatgctctccgcataagccaaaactttctgtcttcgattaatgaagatattgatccacgccgcacagccgtaacaacccccaaaggtgaaacccgacagctggtgaaggacgggttcttggtggaagtcagtgaaagcagcagaaaattgagacacgtattcctgttcacagatgtgctgctatgcgctaagctgaagaaaacctctgctggcaaacatcagcagtatgactgtaagtggtatatcccattggctgatctcgtctttcccagtcccgaggaaagtgaggcttcacctcaggtccacccgttcccagatcacgaactagaggatatgaaaatgaagatatcagcactgaaatccgaaatccagaaagagaaagctaacaagggacagtcacgtgccatagagcgtctgaaaaaaaagatgtttgagaatgaatttctcctgctgctcaatagcccgacaattccgttcaggattcacaatcgcaacgggaagagctacctgtttctgctctctagcgattacgaacgatcagagtggcgggaggcaattcagaagcttcagaagaaagacctccaagctttcgtgttgtcctccgttgagctccaggtcctcacaggtagctgctttaaactgaggactgtccacaacatccccgtgacttccaataaagacgacgatgagagtccaggcttatacgggtttctgcatgtgatcgtccactccgcaaaggggttcaagcagtccgctaacttgtactgcactctggaagtggatagctttggctactttgtgtccaaggcaaagaccagagtctttagagacactgcggaacctaaatgggacgaggaatttgagattgaactcgagggatcgcaatctctgagaattctttgctatgagaaatgttatgacaaaacaaaggttaataaggataacaacgaaatcgtagataaaatcatggggaaggggcagattcagctggaccctcagaccgtggagacgaaaaactggcacacagacgtgattgagatgaacgggatcaaggtcgagttttcaatgaaattcacatccagagatatgtccttaaaaagaactccgtccaagaagcagaccggggtttttggtgtaaagatctctgtagtgaccaaaagggaacgttctaaagtgccatacatcgtgaggcagtgtgtggaggaagtggagaaacgaggtatagaggaggtcggcatctataggatatcaggggtggcaaccgacatacaggccctcaaggcagtgtttgacgcaaacaacaaggatattctgctgatgctgtccgatatggacattaacgctatcgcaggcactttgaagctctactttcgggaactgcccgagcctcttttgactgatcggctgtatcctgccttcatggagggcattgccctgtctgatcccgccgctaaagagaattgtatgatgcacttactgaggtccctcccggacccaaatctaattacctttctcttcttgctggagcatctaaaacgcgtggcagaaaaagagccaattaataaaatgagcctccacaaccttgctacagtttttggcccgactttgctacgaccgtctgaagtcgaaagcaaagcgcatctgactagcgctgccgatatctggtcacacgacgtgatggctcaggtgcaggtcctgctgtactatttacaacacccgcctatttcctttgctgaactaaaacgcaatactctctacttttctactgacgtgtag

SEQ ID NO: 107013 - DNA, 933 bp, Artificial Sequence
  Description of Artificial Sequence: Synthetic coding sequence
atgaccgatgtactgccgcaaccagactgtagtcctaaggctggaagagagcccctggctcttgaggaatctggctctaagcgcccccccaataccggggcacggctatgggggcgagtccggaataagctcctccgaaacaagctcgatccccagactgttgagacaaagaattggcatactgacgtgatcgaaatgaacgggatcaaggtggaattctctatgaaattcacctcccgcgatatgagcctgaaacggacaccttccaagaaacagactggcgtgttcggcgttaagatttccgtggtgaccaagcgagaacgatctaaagtgccgtacattgtaagacaatgcgtagaggaagtagagaagcgtggcatagaggaggtcggaatctatcggattagcggcgtagcaacagacattcaggctctgaaagctgtatttgatgctaataacaaagatatcttgcttatgctttctgacatggatataaacgcaatcgccggcaccctcaagctgtatttcagggaacttccagaacccctgcttacagataggctgtaccccgcattcatggaaggcattgctctgtccgacccagccgcaaaagaaaactgcatgatgcatctcctgaggtccctcccagacccgaatttgatcacattcctgtttctcctggagcatttgaaaagagtggccgagaaggaacctattaataagatgtccctgcataatcttgctaccgtcttcgggccaacacttctgaggccctccgaggtcgagtctaaagctcacctcacatctgctgcagacatctggtcccacgatgtgatggcacaggtccaggtgctcctctactaccttcagcatccgccaatttcatttgcggagctgaaacggaataccctgtacttttccaccgacgtctag

SEQ ID NO: 107014 - DNA, 2442 bp, Artificial Sequence
  Description of Artificial Sequence: Synthetic coding sequence
atgccgtacatcgacgaaagcccgaccatgtccccccagctgagtgcgagatcacaaggcggcggtgacggagtctcccctacacctcctgagggtctggcacctggcgttgaggctggaaagggactggaaatgagaaagctggtgctaagcgggttcctcgcttccgaggagatatacattaaccagctggaggctctgctccttcctatgaaaccattgaaggctactgcgacaactagtcagcccgtgctgacaattcaacaaatcgaaacaatcttctacaaaattcaggatatttatgaaatccacaaggaattctacgataacctgtgccctaaggtccagcagtgggacagccaagtgactatgggtcacctttttcagaagcttgcatcccagctgggagtgtataaagccttcgtggataattataaggtggcactggaaaccgccgagaaatgtagtcagtctaacaaccagttccagaaaatctccgaggaactgaaggtcaaaggcccaaaagatagcaaggattcacatacgagtgtaaccatggaggcacttctgtataaaccgatcgatagggttacaagatccaccctcgtcctgcatgatttgctgaagcacacccctgtggaccatcccgactacccactgctccaagacgccctgagaattagtcagaatttcttgagctcaataaacgaggacatagatcctcgccgcaccgctgtgaccactcccaaaggagaaaccagacagctcgttaaggacggttttctggtggaggtcagtgaatcatcccgtaagctacggcatgtgtttctcttcaccgacgtgctactgtgtgcgaagctaaagaagacctccgccgggaagcatcaacagtatgattgtaagtggtatatccccctggcagacctagtctttccttcccccgaggagagcgaagcttcgccccaggtgcatccctttcccgaccatgaactcgaagatatgaagatgaagatctcagcgctgaagtctgagatccagaaagaaaaagcaaacaaaggccagagccgggccatcgaaagactgaagaagaagatgttcgagaatgaatttctcctgctacttaactctccgacaattccattcaggatccataatcgtaatggaaaatcttacctgttcctgctctcttccgattacgagcgctctgagtggcgggaggccattcagaaactacagaagaaggaccttcaggcctttgtgctctcctcggtggagctccaagtcctgacaggatcttgttttaaactgcgcacagtgcacaacattcctgtaaccagcaacaaagacgatgatgagtctcctggcctctacggctttctacatgtcattgtccacagcgcaaaggggtttaaacagtcggctaacctgtactgcacactcgaggtagattctttcggctatttcgtgtctaaggcgaagacccgagtcttccgcgataccgcagaacccaaatgggatgaggagtttgagatcgagcttgagggttctcaatccctgcgcattctttgttatgaaaaatgctatgacaagactaaggtgaacaaggacaataatgaaatagtggacaagatcatgggcaagggacagatacagcttgacccccagacagtggagactaagaactggcataccgacgtcatagaaatgaacgggatcaaggtggaattttccatgaagttcaccagtagggacatgagcctgaaacggactcccagtaaaaaacagactggcgtttttggggtgaagataagcgtggttacgaagcgggagaggagtaaagtcccatacatagtgagacagtgcgtcgaggaagtggagaagagggggatcgaggaggtcggaatatatagaattagtggcgtagctacagacatacaggccctgaaggccgtgtttgatgcgaataacaaggatattctcttgatgctgagtgacatggatattaatgccattgccggcacactgaagctgtattttcgagaactacccgaaccattattaacggaccgattgtaccctgcctttatggaaggaattgccctgagcgacccagcagctaaagagaactgcatgatgcatctcttgcgttctcttccggatcctaacctgatcacattcctgttccttctcgaacatctgaaacgagttgctgagaaagaaccaatcaataaaatgtcacttcataacctggccaccgtctttggacctactcttcttaggccgagcgaggtggaatcaaaagcccacttgacttccgcggctgatatctggtcacacgatgtcatggctcaggtccaggtactgctttattatctgcaacatcctccgatctcctttgccgagctgaagcgaaacacactctacttcagcactgatgtgtag

SEQ ID NO: 107015 - DNA, 1332 bp, Artificial Sequence
  Description of Artificial Sequence: Synthetic coding sequence
atgttgacaaatggtaaggagcaggtgattaagtcatgcgtctcattgcctgagcttaatgcccaggtgttttgccatagcagcaacaacgtcactaaaacagagtgttgcttcacagacttctgcaataacatcacattgcatctgcccaccgccagccccaatgcccccaagctcggccctatggagctggctatcattataactgtgccagtatgtttgttgtccatcgcagctatgctgactgtgtgggcatgccaagggcgccagtgctcttacaggaaaaagaagcgccccaacgtggaggagccattgtccgaatgtaacctcgtcaatgccggtaaaaccctgaaagatctcatttatgatgtgaccgcctctggtagtggatctggtctccccctcctggtccagcggacaattgctcggacaattgttctccaagagatagtcgggaaaggaagattcggggaagtctggcacggccggtggtgcggagaagacgtggctgtcaagatcttcagttctcgcgatgagcggtcttggttccgcgaggctgagatctaccaaactgtcatgctgagacacgagaacatactgggctttatcgcggcggataataaagacaacgggacttggacgcagttgtggcttgtcagcgaataccatgagcagggctctctttacgactacctaaacaggaatatcgttacagtcgctggcatgatcaaacttgcactcagtatcgcgagcggcctggcacacctgcacatggagattgtgggtacccagggaaaacctgccatcgctcacagagacatcaagtcaaagaatatcctggtcaaaaagtgtgaaacatgcgcaatcgcagatctcggcctggccgtgaaacacgacagcattcttaacactattgacattcctcagaatcccaaagtcggaacaaaaaggtacatggcccccgagatgctggatgataccatgaatgtgaacatattcgagagttttaagagggctgatatctattcggtgggcctggtgtactgggagatagcccgcagatgctcggtaggaggtatcgtggaagagtatcagctgccttactatgatatggtcccgtccgatccttcgatcgaggaaatgcgcaaggttgtgtgtgaccaaaagtttagaccttccatccctaaccagtggcaatcatgcgaagcactgcgagtaatgggacgtattatgcgggaatgctggtatgctaacggggcagctaggctcactgcgctccgaatcaagaagactattagtcagctgtgtgtgaaggaggactgcaaagcttag

SEQ ID NO: 107016 - DNA, 1512 bp, Artificial Sequence
  Description of Artificial Sequence: Synthetic coding sequence
atgactttaggttcccctaggaagggtctgctcatgctcctgatggctctggtgacccagggcgaccccgttaagccttcacgaggtccactggtgacatgtacgtgcgaatcgcctcattgcaaggggccaacctgtcgtggggcatggtgcaccgttgttctggtgcgcgaggaaggccggcatccacaggaacacaggggatgcggcaatctgcaccgcgagctatgccggggtagaccaaccgagtttgtgaaccactactgttgtgactctcacctctgtaatcataatgtgagtttggtcctagaggccacacaaccaccatccgaacaacccggcacagatggccagcttgccctcatcctgggacctgtgttggccctgctggctctggtagctctgggagtgctgggcctgtggcacgtacggcggagacaggagaaacagagagggcttcactcagagctgggggagtcttcgctgatactgaaagccagcgaacagggtgatagtatgctaggggatttgcttgatagcgattgtacaacagggtccggatccggcctgcctttcctagtgcagaggaccgtggctagacaggtggcactggtggagtgcgtggggaagggcagatacggagaggtgtggcgtgggctgtggcacggggagtccgtggcggtcaagattttctcatcgagagacgaacagtcatggttccgggaaaccgagatctataataccgtcctgctccgccacgataatatattgggtttcatcgcaagcgacatgacgtcccgcaattctagcactcaattgtggctgattacccattaccacgaacacggatctttgtacgattttctccagcgacagacactcgaaccacatctagctctgagacttgctgtgtcagcggcatgcgggttggcccacctccacgtggaaatttttggcacacagggaaagcccgccatagcacaccgcgactttaaatcacgcaatgtcctcgtgaaatccaatctgcagtgctgcatcgcagacctcggactcgcggtgatgcactcacagggcagcgactaccttgacatcggaaataaccccagagtgggaacaaaacggtatatggctcctgaggtgctggacgaacagattcggacggattgcttcgagtcttataagtggactgacatctgggctttcggtctcgtcctgtgggagatcgcacgccggacaattgttaatggcatcgttgaggactaccggccacccttctatgacgtcgttcccaatgatcctagcttcgaggatatgaaaaaggtggtgtgtgtggatcagcaaaccccaacgattcccaatagactcgccgcagaccccgtgctgtcggggctggcacagatgatgcgggagtgctggtatcctaatccttcggctcggctgacagctctgcgaattaagaagactctacagaaaatttccaattcaccggaaaaacccaaagttatccagtag

SEQ ID NO: 107017 - DNA, 1512 bp, Artificial Sequence
  Description of Artificial Sequence: Synthetic coding sequence
atgacgctgggttccccaagaaagggactcctcatgctcctgatggccctggtgacgcagggagatcccgtgaagcccagtcgggggccattggttacctgtacttgcgagtctccccactgcaaagggccaacgtgcagaggcgcttggtgtactgtggtccttgtacgcgaagagggccgacacccccaggagcataggggatgtggaaacctgcaccgcgagttatgtcgcggccgaccaacggaatttgtgaaccattattgttgtgacagtcatctctgtaaccacaacgtgagccttgtgttagaggccacgcagcctcccagcgagcagcctggtacagacgggcagctggctctgatactgggcccagttctggcgctgttagctttggtggcactgggggtcctggggctctggcacgttcgtagaagacaggagaaacagaggggactgcacagcgagctgggggaaagctcattaattctgaaggcgtctgaacaaggcgactccatgttaggagatctgctggattctgactgcacgactggctctggatcagggttaccctttctggtacagaggactgtagctcgccaggtcgcacttgtcgagtgtgtgggaaaaggccggtatggcgaggtatggcgggggctgtggcatggcgagtccgttgccgttaagatatttagctcacgggatgaacaaagttggttccgcgaaactgaaatttataataccgtcctactgcggcacgacaacatactggggttcattgctagtgatatgaccagcagaaattcctcgacccaactgtggctaatcacccattaccacgaacacggttccctttacgacttcctgcagcgccagactctggaaccccatcttgcactcagactggcggtgtccgcagcctgcggactagcccacctccatgtggaaatattcgggactcagggaaagcccgccatcgcccatcgagatttcaagtcacggaacgtgctcgtcaaatccaatttacagtgctgtattgcggatctgggtctggccgtgatgcatagccaggggtccgactacttggacatagggaacaacccacgcgtagggacaaagcggtacatggctcctgaagtgctggacgagcagattcgcacagattgtttcgagtcctacaagtggacggacatctgggcattcggcttggtgttatgggaaattgcacgaagaactatcgttaatggtattgtcgaggattatcgaccaccattttatgatgttgtcccgaatgatccttcctttgaggatatgaagaaagtcgtgtgcgtggatcagcaaacaccaacgattcctaacagactggccgctgatccagtcctatccgggctggctcaaatgatgcgggaatgctggtatcccaatcctagcgcacgactgaccgcccttcgaatcaaaaaaaccctgcaaaagatttccaacagccctgaaaagccgaaggtgatccagtag

SEQ ID NO: 107018 - DNA, 990 bp, Artificial Sequence
  Description of Artificial Sequence: Synthetic coding sequence
atggcattgacaccacccttgctgctgctcagcgcggggacaatgacactgggcagtcctaggaaaggtctgctgatgctgctaatggccctggtgactcaggggaagggccgatacggcgaggtgtggcggggactgtggcacggagagtctgtcgcggtgaagattttttcctctagggacgaacagtcttggttccgcgagactgagatctacaatactgtcctgctcaggcatgataacatcctgggatttattgcctccgacatgacgagccggaacagctccactcagctctggctcataacccactatcacgaacacggtagtctgtatgattttctccagcggcagacactagaacctcacctggcactccggctggcagtgtccgctgcatgcggcctcgcacatttacatgtcgagattttcggaacccagggtaagccagcaatcgctcatcgagacttcaagtcccggaacgtgctagtgaagtcaaacttacagtgctgtatagccgatttaggcttggctgtcatgcatagccagggttctgattatctggatatcggtaacaaccccagagttggaacaaaacggtatatggcccctgaggtcttagacgaacagattagaactgactgcttcgagtcatacaagtggactgatatttgggccttcgggcttgtcttatgggaaatcgcaaggagaaccatcgttaatggcattgtggaagattaccgacctcccttctacgacgtggtacctaacgacccttcattcgaagacatgaagaaggtcgtgtgcgttgatcagcaaaccccaaccatcccaaataggctcgcagccgaccctgtcctgagcggactcgcccagatgatgcgcgagtgctggtatcccaaccctagtgcgagactgaccgctctaagaattaagaaaaccttgcaaaagataagtaacagccccgagaagcccaaggtgattcaatag

SEQ ID NO: 107019 - DNA, 480 bp, Artificial Sequence
  Description of Artificial Sequence: Synthetic coding sequence
atggctctaactcctccgttactcctgttgagcgcagggacaatgacactgggaagtccacgaaagggcctgcttatgctgctgatggccctggttactcagggggatcccgtcaaaccatccagaggcccccttgtaacttgcacgtgtgagtccccccattgcaaggggccaacatgcagaggcgcctggtgtactgttgtgctcgttcgcgaagagggccggcacccccaagagcatagagggtgcggaaatctccatcgtgagttatgcagaggccggcccactgaattcgtgaaccactattgttgcgattctcatctgtgcaaccacaatgtctctctggtcctggagggtaaaggccgttatggtgaggtttggagaggtctgtggcatggcgagtcggtggcggtaaaaattttcagctcaagagacgagcagtcttggtttagagaaacggaaatatataatacagtttag

SEQ ID NO: 107020 - DNA, 1554 bp, Artificial Sequence
  Description of Artificial Sequence: Synthetic coding sequence
atggcacttacaccccccctcctcctcctttccgccggcacaatgacgctcggaagcccacgaaaaggtctactgatgctacttatggcactcgtgacgcagggtgaccccgtcaaacctagccgcggcccactggtcacgtgtacatgtgaaagtccacactgcaaaggcccgacctgcagaggcgcttggtgcactgttgttctcgtcagagaggaaggaaggcatccgcaggagcatcggggctgcggtaacctccacagagagctgtgtaggggacgccccacagaattcgttaaccactactgttgcgactctcacctctgtaaccacaacgttagccttgtcctcgaggcaacccagcctccctccgagcagcctggcactgatggccagctggctctcatcttagggcccgtgctggctctgcttgcccttgtcgcactgggagtgctgggcttatggcacgtgaggcgcaggcaggaaaagcaaagaggcctccacagcgagctcggtgaatctagtctgattctgaaggcatccgagcagggggactccatgctaggcgacctgttggatagtgactgtacaacgggttcaggcagcgggctgccatttctggtgcaacgcaccgtcgcacgccaggtggcccttgtcgaatgcgttggcaaagggcgatatggcgaagtttggcggggcttatggcatggcgagtccgtggccgtgaagattttctcctcacgcgatgaacagagttggtttcgtgaaacggagatttacaatacagtccttctgagacacgataatattctcgggtttatagctagcgacatgacttcacgcaacagctctacacagttgtggttgattactcactaccatgagcacggaagtttgtacgactttctgcagcggcagactttggagcctcatcttgccctgcggctggccgtgtccgcagcatgcggactggcacacctgcacgttgaaatcttcggaacgcaaggtaagccggccattgcacaccgcgatttcaagtccaggaacgttttggtgaagtccaacctacaatgctgcatcgctgacctgggcctggctgtgatgcactcacagggctcagattacttagatatcgggaacaaccctcgggtggggactaaacgctatatggcacccgaagtcctggacgagcagatccggaccgattgtttcgaatcttacaaatggaccgatatttgggcattcggactcgtgctgtgggaaattgctaggcgcacgatagtgaacggcatagtcgaagattatcggccccccttttacgacgttgtcccgaacgatccgagcttcgaggacatgaaaaaagttgtatgcgtggaccaacagaccccaaccattccaaaccggctggccgccgacccagttctgagcgggctcgcacaaatgatgagagaatgctggtaccctaacccgtcagctagactgaccgcgctgagaataaagaagacattgcagaaaatctctaatagcccggagaaacccaaagtcattcaatag

SEQ ID NO: 107021 - DNA, 1530 bp, Artificial Sequence
  Description of Artificial Sequence: Synthetic coding sequence
atggtcgatggagtgatgatccttcccgtgctgatcatgatcgcactcccatctccctcaatggaggatgaaaagcccaaggtcaaccctaagttgtacatgtgcgtctgcgagggtctgtcctgcgggaatgaggatcactgcgagggccagcagtgtttctctagtctctcaatcaatgacgggttccatgtgtaccaaaagggctgctttcaggtgtatgaacaaggcaaaatgacttgtaaaactccgcccagccctgggcaggctgtagaatgttgtcaaggagattggtgtaatcggaacatcaccgcccagctgcctaccaagggcaagtctttccctggcacccagaattttcatctcgaagtaggcctgatcattctgagcgtcgtgttcgccgtttgccttttggcctgcctattaggcgtcgccctccggaaatttaaaagacggaatcaggagaggttgaatccaagagatgttgaatacggcacgatcgagggactcataacaaccaatgtgggggatagcacgctggccgatctcctcgatcactcatgcacctctggatccggaagcgggttgccgttcctcgtgcagaggaccgtggctcgacagatcactctattggaatgtgtgggaaaaggcagatatggtgaagtctggcggggttcttggcagggagaaaacgtcgcagtgaaaatcttttcttctcgtgacgagaagtcttggtttagagagacagaactgtataacacggtcatgctccggcacgaaaacatcttgggttttattgccagtgacatgacttcgagacattcatcgacccaactgtggctgatcacacactaccatgaaatggggagcctgtacgattacttacagctcactacacttgataccgtgagctgtttacgaattgtcctgagtatcgcttccggactagctcacttgcacatcgagatcttcggaacccaggggaaaccagcgatcgctcacagagacctgaagtctaaaaatatcttggttaaaaagaatggacagtgttgcattgccgacctgggcctcgccgtcatgcatagtcaatccactaatcagttagacgttgggaataacccaagggtcggcaccaagcgatacatggcgcctgaagtgctggatgagactatacaggtcgattgctttgattcatacaagcgggtagatatttgggcattcggtctcgtgctgtgggaggtcgccagacggatggtctcgaatggcatcgttgaagactataagccaccgttctatgatgtggtcccgaacgacccgtctttcgaggacatgagaaaggtcgtctgtgtggaccagcagcggcccaatatccccaaccgctggttttctgatcccaccctgactagccttgcaaaactgatgaaagaatgttggtatcaaaatccaagtgccaggctcaccgcattgaggattaagaagactctgactaaaattgataattccctggataagctgaagacagattgctag

SEQ ID NO: 107022 - DNA, 1530 bp, Artificial Sequence
  Description of Artificial Sequence: Synthetic coding sequence
atggtggacggagtcatgattttaccggtcctgataatgatcgcactacccagtccttcaatggaggatgagaagccaaaggtcaatcctaagctctatatgtgcgtgtgcgaaggattatcctgtggcaatgaagaccattgtgagggtcagcagtgcttttcgtcgctgtccattaatgacgggttccacgtgtaccagaaggggtgctttcaggtttatgagcaggggaagatgacttgtaaaacaccaccgagccctgggcaggccgtggagtgctgccaaggtgactggtgtaatcggaatatcacagcacaactgccaacaaagggcaagagctttccggggacacagaattttcacctggaagtgggactcattatactgtccgtggtgttcgcggtgtgtctattggcttgcctgctcggggtcgctctcagaaagttcaaacgtcgcaatcaggaaagactgaacccgcgggacgtcgaatatggaaccatagagggcctgattacgacaaatgttggtgattctaccctcgctgacttgttggaccatagctgcacctccggatctggatctggcttgccattccttgtccagcggacagtcgcccgacagatcacgctcctggagtgtgtaggcaaaggccggtatggcgaggtgtggcgcgggtcctggcagggcgagaacgttgctgtgaaaatattcagtagtagagacgagaagagctggttcagggagacggaactgtataatactgttatgctgcgacatgagaacatcttgggttttatcgccagtgacatgaccagtcggcactcttcgacccagctgtggctgatcacccactatcatgagatgggttcattgtatgattacctgcagctaacaactttggatacagtgtcctgcttaaggatagtcctgagtatcgcatcaggtctggcacacttacacattgaaattttcggtacccagggtaaacccgctatagcacaccgcgatttgaaaagcaaaaacattctggtgaagaaaaacggccaatgttgcatagcagacctgggtctggcggtcatgcatagccaatccacaaaccagctggacgtgggcaataatccccgtgttggaaccaaacgctacatggcccccgaagtcttagacgagacgattcaggttgactgcttcgacagttacaaacgtgtagacatatgggcattcgggctcgtgctttgggaagttgcaagacggatggtgtccaacggaatcgtggaagactacaagccccccttctatgacgtggtcccgaatgatccatccttcgaggacatgagaaaggtcgtttgcgtcgatcagcagcgccctaacatcccgaatcgctggttttctgaccccaccttgacgtccctggctaagctgatgaaggagtgttggtatcagaatccttcagcccgtttgacagcccttagaattaagaagaccctgaccaaaatcgacaattccctggataaactcaaaacggactgctag

SEQ ID NO: 107023 - DNA, 1530 bp, Artificial Sequence
  Description of Artificial Sequence: Synthetic coding sequence
atggtggacggagttatgatcttaccggtactgataatgatcgccttgccatcacctagtatggaagacgaaaaacccaaggtgaaccctaagctatatatgtgcgtgtgcgagggactgagctgtgggaatgaggatcactgcgagggacaacagtgcttttctagtctgagcatcaacgatggcttccatgtctatcagaagggatgttttcaggtatacgagcaagggaaaatgacctgtaaaacccccccctccccaggtcaggccgtggaatgctgtcagggcgattggtgcaaccgcaacattacagcccagctgccaacgaagggtaaatccttcccaggtacccagaattttcatttggaggtcggcctcataatactatcagttgtgttcgccgtgtgcctcttagcctgcctgcttggcgtagccctgcggaagtttaaacggcgcaaccaggagcgactgaatccccgcgacgtggaatatggcaccatcgaaggactgattaccacaaatgtgggggattccaccctggcggatcttctggatcatagttgtacctccggaagtgggtctggactaccatttttggtccagcggacagtcgccagacaaatcaccttgctcgagtgtgtcgggaagggccgatatggcgaggtttggcggggcagttggcagggggagaatgttgctgtcaagatcttctcatctagagacgagaaatcgtggttcagggagactgagctctataacacagtgatgcttagacacgagaatatcctcggatttattgcttcagatatgacctcaagacactcctctacccagctgtggcttattacccactaccatgaaatggggtcgctttacgattacctgcagttaacgacactggacacagtgtcatgtctgaggattgttctcagtatcgccagcggacttgctcatttacacatcgagatttttggcacccaagggaagcctgctatcgcccaccgtgatctgaaatctaagaatatccttgtgaagaaaaatggccagtgttgtattgccgatttaggcctcgctgtcatgcatagccaaagcacgaatcaacttgacgtaggtaataacccgagggtgggaactaaaaggtacatggccccagaagtattggatgagacaatacaggtagattgcttcgatagttataaaagggtcgacatttgggcttttggactagtcctgtgggaggtggcccgacgcatggtaagtaatgggatagtagaagattataagccacccttttacgacgtagtgcctaacgacccctctttcgaggacatgcggaaagtggtgtgcgtggaccaacagcgaccgaatatccctaatagatggttttcggaccccactctgacctccctggccaaactgatgaaagaatgctggtatcaaaacccctcagcaagacttactgcactgcggatcaagaagacccttaccaagatcgacaattctctggacaaattgaaaactgattgctag

SEQ ID NO: 107024 - DNA, 264 bp, Artificial Sequence
  Description of Artificial Sequence: Synthetic coding sequence
atggtcgatggcgtgatgattcttccagtgcttatcatgatcgctctgcctagtcctagcatggaagacgaaaagccaaaggtgaacccaaagttgtacatgtgtgtgtgcgagggcctgtcttgcggaaatgaggatcactgtgaaggtcagcagtgcttttcaagcctcagcattaacgacggcttccatgtgtaccaaaaaggttgtttccaagtgtatgaacagggcaaaatgacatgcaagacaccccccagcccctag

SEQ ID NO: 107025 - DNA, 66 bp, Artificial Sequence
  Description of Artificial Sequence: Synthetic coding sequence
atggttgatggggttatgatactcccagtcctaattatgatcgctctgccaagtcccagcatgtag

SEQ ID NO: 107026 - DNA, 216 bp, Artificial Sequence
  Description of Artificial Sequence: Synthetic coding sequence
atggtggatggagtgatgattttgcccgttctcattatgatcgctttgccgtctccttctatggaagacgaaaaaccaaaggtgaaccccaagctgtatatgtgcgtgtgcgaaggtctgtcctgtggcaacgaagatcactgtgaaggtcagcagtgtttttccagtctgtccataaacgacggcttccatgtgtaccagaagggctgcttctag

SEQ ID NO: 107027 - DNA, 1530 bp, Artificial Sequence
  Description of Artificial Sequence: Synthetic coding sequence
atggtggacggcgtaatgattctccccgtgttaataatgatcgccttaccctctcctagtatggaggacgagaagcctaaggtgaacccgaagttatacatgtgtgtgtgcgagggattgtcatgtggcaacgaggatcattgcgaaggtcagcagtgcttcagttcgctttcaatcaacgacggttttcatgtgtaccaaaaaggttgcttccaagtatatgaacaggggaagatgacctgcaaaacaccaccatcccctggacaggctgtggagtgctgtcagggggactggtgtaatcgtaacatcactgcccagctaccaacgaaaggaaagtcttttcccggaacccagaatttccaccttgaagtaggcttaattattttgagtgttgtgttcgccgtgtgtctgctggcctgcttacttggcgtggcacttcggaaatttaaacgaagaaaccaggaacgcctgaatccaagagatgtggagtacggaacaatcgagggcttaatcaccaccaacgtgggcgactcaaccctggcagatctgctcgaccactcctgcacttctgggagtggaagcggcctgcctttcctcgtacagcgaacagttgccagacaaatcaccctcctggaatgcgtgggcaagggaaggtacggcgaggtttggaggggttcctggcagggcgagaatgtggccgttaagattttttcctctagagacgagaaatcctggttcagggagaccgaactctacaacaccgtgatgctgcggcatgaaaatatactgggcttcatcgccagcgatatgacttccaggcatagcagcacacaactatggctgatcacccactatcatgagatgggatcactgtatgactacctccagctgactacccttgacactgtcagttgtctgcggatcgtcctgtctatcgcctcaggacttgcccaccttcacattgagatattcggtacacaaggtaagcctgctattgcacatcgggatctgaaaagtaagaacatattagtgaaaaagaatggccagtgttgtatcgctgacctggggttggccgtcatgcactcacagtctacgaatcagctggatgtgggcaacaatccacgcgtggggacaaagcgctatatggcccctgaagtcctcgacgaaactattcaggtggattgttttgacagctataagcgtgtcgacatttgggcctttggcctggtcctttgggaggtcgctaggcggatggtttcaaacggcatcgtggaggattacaaacctcccttctacgatgtcgtgcccaacgacccatccttcgaagacatgcggaaagtggtgtgtgtggaccagcaacgtccgaatatacccaatcgttggttcagtgaccccactctaaccagcctggctaaactcatgaaggaatgctggtaccaaaatccatcagcgagactcacagcactgagaatcaagaaaacccttacgaaaattgacaattccttggacaagctgaagaccgactgttag

SEQ ID NO: 107028 - DNA, 264 bp, Artificial Sequence
  Description of Artificial Sequence: Synthetic coding sequence
atggttgatggcgttatgatcctaccagtgctcataatgatcgctcttccatcaccatccatggaggacgaaaagcccaaggttaatccaaaactctacatgtgtgtctgtgagggtctgtcatgtggtaatgaggatcattgcgaagggcagcagtgcttttcttccctctctatcaatgatggcttccacgtgtatcagaagggatgcttccaggtgtacgagcagggaaaaatgacatgcaagacccccccctcaccttag

SEQ ID NO: 107029 - DNA, 222 bp, Artificial Sequence
  Description of Artificial Sequence: Synthetic coding sequence
atggtcgatggggtgatgattcttcctgtccttatcatgatcgccctgccatctcccagcatggaggatgaaaagcccaaggtcaacccaaaactttatatgtgcgtgtgtgagggactatcctgtgggaacgaagaccactgcgaaggccagcaatgcttctcctctttgagcattaacgacggcttccacgtgtaccagaaaggctgcttccaggtttag

SEQ ID NO: 107030 - DNA, 1518 bp, Artificial Sequence
  Description of Artificial Sequence: Synthetic coding sequence
atggccgagagcgcaggcgcatctagctttttcccactggttgtgctactgctggccggatcagggggctctgggccccggggagtgcaggctctgctgtgtgcctgcacaagctgcctccaggccaattatacatgcgagacagatggcgcctgcatggtttcgatatttaacctcgatggcatggagcaccatgtacggacctgcattccaaaggtggagctagtccctgcaggtaagcctttttattgtctgtcctccgaagacttaaggaatacccactgttgttacactgattattgtaatcggatcgacctgagagtgcccagcggccatcttaaggaacccgagcatccaagtatgtggggtccagtggagctggttggcataatagccggtcctgtgttccttctgttcctcattataatcattgtctttctggtgatcaattaccaccaacgggtgtaccacaatagacagcgtttggacatggaggacccaagttgcgagatgtgcctgtccaaagacaaaacgctgcaggacttggtgtacgacctgagtaccagcgggtccggatcaggtctgccactattcgtacagcggactgttgcacgaacaatagttctgcaggagatcatcggtaaaggccggttcggagaggtgtggagaggaagatggagaggtggtgatgttgccgtaaaaattttttcctcacgggaagagagatcctggtttcgcgaggccgaaatctatcagacagtgatgctgcgacacgaaaacattctcggcttcattgctgccgacaataaggacaacggcacctggactcaactctggctggtctccgattaccatgaacacggcagcctattcgattatttaaacaggtacaccgtgaccattgaagggatgatcaaactggcactgtccgctgccagcggcttagcacatttgcacatggaaattgtcggcacccagggcaaacccggcattgcccacagggacttaaaatctaaaaacatcttagtgaaaaagaatgggatgtgtgctatagccgatctgggcctggctgtgagacatgacgcggtaacagacacaatagacattgcgcccaatcagagagtcggcaccaagcgttacatggctcccgaggttctggatgaaactatcaatatgaaacactttgactccttcaagtgtgccgacatatatgctctgggactcgtatactgggaaatcgccagacgctgtaactctggaggcgtccatgaggagtaccagctgccatactacgacctggtgcctagtgatccatccattgaagagatgaggaaggtcgtgtgcgaccagaagctccgaccaaacatccctaattggtggcagtcctacgaggcacttagagtcatgggcaagatgatgcgggagtgttggtacgccaatggggctgcaaggctgactgcccttcgcattaagaaaacactttcacagctcagtgtgcaggaggatgtgaaaatctag

SEQ ID NO: 107031 - DNA, 1464 bp, Artificial Sequence
  Description of Artificial Sequence: Synthetic coding sequence
atggcagaatccgccggggcttcttccttttttcccctcgttgtgcttttactggccggatctgggggttcgggccctaggggagttcaagccttattgtgtgcctgtacatcttgcctccaggctaactacacctgtgaaactgatggggcgtgcatggtttcgatatttaacttagatggaatggagcaccacgtaagaacctgtatccctaaggtggagcttgtgcccgccggcaaacccttctactgtctcagcagtgaggacctgcgcaacacgcattgctgctacactgactattgcaatcggatcgatttgcgcgtcccttcgggacaccttaaagagcctgagcatccttcgatgtggggccctgtcgaactggtgggcataattgccgggcctgttttcttgctgtttctgatcatcattatcgttttccttgtgattaattaccaccagcgggtctatcataataggcagaggcttgacatggaggatccctcttgtgaaatgtgcctgtcaaaagataagacactgcaggacctagtgtacgatttgagtactagcggatcagggagcggattgcctctatttgtacagaggacggtcgcgcggacaatcgtgctgcaagaaatcataggcaagggcaggtttggggaggtgtggagagggcgctggcgcggcggcgatgttgccgttaaaatcttcagctccagagaggagagatcctggtttcgggaagcggagatataccagacagttatgctgaggcatgaaaacatactgggctttatcgcagccgacaataaagataatgggacctggacgcaactttggctggtcagcgactatcatgagcatgggtcattatttgattatctcaataggtacaccgtgactatcgagggaatgattaaactggcactatccgcagcctcagggcttgctcatcttcacatggagatcgtgggtacacaaggtaagcccgggatcgcccatcgtgacctcaagtccaaaaacattttagttaaaaaaaacggcatgtgcgcaatcgccgaccttggtcttgcggtgaggcacgacgcagtgacagatactattgatattgcccccaaccagcgtgtgggcaccaaaaggtatatggctcccgaggtgctagatgaaactatcaacatgaaacacttcgacagctttaaatgcgccgacatttatgcactgggtctcgtgtattgggaaatcgccagaagatgcaactccggaggcacattcctcttctgtctatgttcttatctgcccttccaggatgctggcagccctaaggccgtgctactgccgcccttcttcctgcagcccgttgggtgcttgcttccagagcctgagtcgtccttcaaggtcgctattaagggggtcgaagttgccgtgctgcgggtcagactgtttttcagagatcagttcgttgaatag

SEQ ID NO: 107032 - DNA, 1431 bp, Artificial Sequence
  Description of Artificial Sequence: Synthetic coding sequence
atggctgaatccgcaggcgcctcaagcttctttccactagttgtattgttactggctgggtccggtggatctgggcccaggggggttcaggccctcttatgcgcttgtactagctgtctgcaggcgaattacacgtgcgaaactgacggagcctgtatggtcagcatctttaatttggacggaatggaacaccatgtgagaacatgcatccccaaagtggagctcgttcctgccggcaagccattttattgtttgtctagtgaggacttgaggaatacacattgctgttatacagattactgtaacaggatagatctacgagtccctagcgggcacctgaaagagcctgagcatccctcaatgtggggtcccgtagagcttgtcgggatcatcgcaggtccagttttccttctgttcctgattatcatcatagtgttcctggtcatcaactatcaccagcgcgtctatcacaaccggcaacggttggacatggaagatccatcctgcgagatgtgcctctcaaaggataagaccctccaggatctggtgtatgatctgagtacctcgggttccggtagtggtctgcccttgtttgttcagagaacagtcgcaaggacgattgtgcttcaggagataatcggaaaaggcagatttggagaggtgtggagggggaggtggcggggcggtgacgttgcggttaaaatttttagctccagagaggagaggtcctggttccgcgaagctgagatataccaaacagtaatgttgaggcacgaaaacatattgggatttatcgccgcagataacaaagacaatggaacgtggacacaactatggctggtctctgattatcatgaacacggttcactgtttgactacctaaatcgctacactgtgacaatcgagggaatgattaaactggcgctgagcgcagccagcggtctggcccatctccacatggaaatcgtgggtactcaggggaaaccaggaattgcgcaccgggacctgaagtccaagaatatcctggtaaaaaagaacggcatgtgcgcaatagcagatctgggcctggccgttcgccatgatgccgtgactgacacaattgatattgcccccaaccagcgtgtgggcacgaagcgctatatggcccccgaagtcctggatgagactatcaatatgaagcactttgatagctttaagtgcgctgatatttacgccttaggcctggtgtattgggagatcgcccgcagatgtaattccggtggcgtgcacgaggaatatcagctgccatactatgatttggtgcctagtgatcccagcatcgaagagatgaggaaggtggtgtgcgatcaaaaactaagaccgaatatacccaactggtggcagtcctatgaagtccggagctggcccccagctgcctttccaagcgcctag

SEQ ID NO: 107033 - DNA, 1641 bp, Artificial Sequence
  Description of Artificial Sequence: Synthetic coding sequence
atggccgagagcgccggcgcaagttcattcttccccctggtggtactccttttagcgggcagtggcggctcaggccctaggggtgtgcaggcactgttatgtgcctgtacaagctgcctgcaagccaactatacctgcgaaacggacggtgcctgtatggtcagcattttcaaccttgatggcatggagcatcacgtgaggacatgcatacctaaggtagagctggtccccgccggcaaaccattttactgcctgagtagcgaggatcttcgcaatacccattgctgctacacagactactgcaacaggatagacctgagagtgccaagcggacacctaaaagaacctgaacatccatccatgtggggacctgtggagctggtgggaatcatcgctggcccagtatttctcctttttctgattatcatcatcgttttcttggtgattaactaccatcagcgcgtgtaccataaccggcagcggctggatatggaagatccgtcttgcgagatgtgcctgtctaaagataagactctgcaagatctcgtatacgatctgtcgaccagcgggtccggtagcggactgccactatttgttcagcgcaccgtggctaggacaatagtcctgcaggaaattattggaaagggaagattcggcgaagtctggagaggtcgctggcgtggcggagatgtagcagttaaaatattctcctctagagaggagcgtagttggtttagggaagctgagatttaccaaactgtgatgctgcgccacgagaacattttggggttcatcgcagccgataacaaggctgactgctcatttttaaccctcccctgggaggtagtcatggtctcggctgcccccaagctgaggtccttacggcttcagtacaagggcgggcgtggccgcgctcggtttttattcccactgaataatggaacttggactcagctgtggcttgtcagcgattatcacgagcacggctctttgttcgattacttgaacaggtacacagtaactatcgaaggaatgatcaagctggccctctccgccgcatctgggctggcccacctgcatatggagattgtcggcacacaaggaaagcctggcatcgcccatagggatctgaagagcaagaatatccttgtgaaaaagaatgggatgtgcgccattgctgatctaggattagccgtgaggcacgacgccgtgacagacacgatcgacatcgcccctaatcagcgcgtggggactaagcgttacatggctcctgaagtgctcgatgagaccatcaacatgaagcactttgactctttcaaatgcgcagatatctatgccctgggattggtttactgggagatcgcacggcgatgcaatagtggaggcgttcacgaggagtaccagctgccatactacgatttggttccttctgatccttctattgaagagatgaggaaagtagtgtgcgatcagaaattgaggcctaacattcccaactggtggcagtcctacgaggctctaagggtgatgggcaagatgatgcgagaatgttggtacgcaaacggcgctgcgcggcttaccgcactgaggattaagaagaccctgagccagctgtccgtacaggaagacgtgaagatttag

SEQ ID NO: 107034 - DNA, 1362 bp, Artificial Sequence
  Description of Artificial Sequence: Synthetic coding sequence
atggtgtcgatttttaatttagatggtatggaacaccacgttaggacctgcattcctaaagtggagttagtccctgcaggcaagccattctactgcctgagttcggaggacctgcggaacacacactgttgctatacagactattgtaacaggatcgaccttcgcgtgccttccggacacctgaaagaacctgagcacccgtctatgtggggccccgtagaactggtggggattatagcagggccagtcttcctcctattcctgatcataataatagtcttcctcgtgataaactatcaccagcgcgtttaccacaacaggcagaggttggatatggaggaccctagctgcgagatgtgcctgtccaaagacaagactctacaagatttagtctacgacctgtccacatctggttcaggttctggtcttccactcttcgtccaaagaaccgtggcccgtacaattgtgctccaggagattatcggaaaggggcgctttggcgaagtgtggcgcggtcggtggagaggcggcgacgtggccgttaaaatcttctcatctcgggaggaacgttcgtggtttcgcgaggccgagatctaccagacagtgatgcttcgacatgagaacattctgggattcatcgccgctgacaataaggataacggtacctggactcagctgtggttagtaagtgattaccacgagcacggcagcctttttgattacctcaaccgatatactgtcactattgagggcatgatcaagctcgcactgtccgccgcttccgggcttgcccacctccatatggaaattgttggaacacagggaaaaccgggcatcgcccaccgtgatctgaaatcaaagaatatcctggtgaagaaaaatggtatgtgtgcgatcgcagacctaggcctggctgtccgacacgatgccgtcacagatactatcgacatcgctcctaatcagcgtgtgggaacaaaacggtacatggccccggaggtcctcgacgagaccatcaacatgaagcactttgacagttttaaatgtgccgacatctatgctctagggctcgtgtactgggaaattgctagaaggtgcaacagcggcggcgtgcacgaagaataccagctcccttattatgatctcgtcccaagcgacccttctattgaagaaatgcgcaaagtggtgtgcgaccaaaaactccgcccaaatattccaaactggtggcagtcttatgaagccctcagagtgatgggcaagatgatgcgcgagtgctggtatgccaatggggcggccagattgaccgcgcttaggatcaaaaaaaccttgagccagctgtccgttcaggaggacgtaaaaatctag

SEQ ID NO: 107035 - DNA, 1482 bp, Artificial Sequence
  Description of Artificial Sequence: Synthetic coding sequence
atgactagggccctatgtagtgctctgagacaggcgctgctcctgctggccgcagcagccgagctgtctccagggctcaaatgtgtgtgcctcctatgcgatagttcaaacttcacgtgtcagacagaaggcgcatgctgggccagcgtcatgctcactaacggtaaggaacaggtaattaagtcgtgcgtgtcacttcccgaacttaatgctcaggtgttttgtcactcttcaaacaacgtgaccaagaccgagtgttgttttaccgatttctgtaacaacataactctgcatctgcctactgcgtccccaaatgcgcccaaactcggacccatggaactcgccattattatcaccgtgcctgtgtgtctcctatccatcgcagccatgctgacagtctgggcatgtcagggaaggcagtgctcctataggaagaaaaaaagacccaacgtggaggagccactgtcggagtgtaacttggttaacgcaggtaaaacactgaaagatctcatttacgatgtgacggcttctggcagtggctccgggcttcccctgctagtgcagcgcacaatcgcccgaactatcgtccttcaggagatcgtcgggaaaggtcgttttggagaagtctggcacgggcgctggtgtggcgaagacgtcgctgtcaagatcttctcttctagagacgagcggagctggtttagagaagctgagatctatcagacggtcatgctacgacacgagaatatcctgggatttatcgcagcggataataaggacaatgggacctggacccagctgtggctagtgagcgagtatcacgagcagggatcactctacgattatctgaatcgcaacatcgtgacagtggctggcatgataaaattggccttaagcattgcatctggactggcgcacctgcacatggagattgtggggacccaggggaagcccgctatcgcccaccgggatattaagtccaaaaatattctcgtcaaaaaatgcgaaacctgcgcaatagcagacttaggcctagctgtaaaacacgacagtatcttaaatacaatcgatatacctcagaacccaaaggtgggaaccaagaggtacatggcacctgagatgttggacgacacaatgaatgtgaacatttttgagagttttaagcgagccgatatttactccgtaggactagtatactgggaaatcgcgcgtcggtgctctgttgggggtatagttgaggagtatcagttgccgtactacgacatggtcccaagtgacccatctatcgaggagatgcgaaaggttgtttgtgaccaaaagttcagaccttctatccctaatcagtggcagtcttgcgaggctctgcgcgtcatgggcaggatcatgcgtgaatgctggtatgcaaatggagctgccaggttgactgcactgaggatcaagaaaacgataagccagctgtgtgtcaaggaggattgcaaagcctag

SEQ ID NO: 107036 - DNA, 1242 bp, Artificial Sequence
  Description of Artificial Sequence: Synthetic coding sequence
atgaccagagccctgtgcagtgcgctgcgacaagcccttctactactcgccgctgcagctgaactgtcaccgggcctgaaatgtgtctgcctgttgtgtgactcctccaattttacatgtcagacggagggcgcctgctgggcatctgttatgctgaccaacggcaaggaacaggtgataaagtcttgcgtgtcacttcccgagctgaacgcccaggtattctgccactctagcaataatgtaacaaaaactgagtgctgttttacagacttctgcaataatatcactttgcacctgccgaccggattaccattactggtgcaacgcactatcgctaggaccatcgtattacaggagatcgtgggtaagggcaggtttggagaagtatggcatggtcgctggtgtggcgaggacgttgccgtaaagatctttagtagcagagacgagcgtagctggtttcgggaggcagagatctatcaaactgtcatgctgcggcatgagaacatattaggctttattgcagctgataataaggacaacgggacttggactcagctttggctcgtgtctgaatatcatgagcagggttcattatatgactacttgaaccgaaacatagtgacagtcgcaggtatgatcaaactcgcgctgagcattgcgagcgggctggctcacctacatatggaaatcgtgggcacccaagggaaaccagcaattgcccaccgcgatattaagagcaaaaacatactggttaagaagtgcgaaacttgtgctatcgccgacttgggccttgccgttaagcatgactcgatactgaacacgatcgatattcctcaaaacccaaaggtcgggactaagaggtatatggctccagagatgcttgacgacacaatgaacgtgaatatattcgaatcctttaagcgggccgatatctattctgtgggtcttgtatactgggaaatcgcacggagatgcagtgtagggggcatcgtcgaggagtaccaactcccttattatgacatggtaccctcagatccctctatcgaggaaatgcgtaaagttgtttgcgaccagaagttccggccttccatcccaaatcagtggcagtcatgtgaggctctccgggttatgggccgtatcatgcgcgaatgctggtatgcaaatggggctgcgcggctgaccgccttgaggatcaagaaaaccatttcccaactgtgtgttaaggaagattgcaaggcttag

SEQ ID NO: 107037 - DNA, 1011 bp, Artificial Sequence
  Description of Artificial Sequence: Synthetic coding sequence
atgacccgtgccttgtgttctgccctgcgtcaggcactgctactcctggcagcagcagcagagctgagcccaggtcttaagtgtgtgtgcctcctgtgtgattcttcaaactttacatgtcagaccgaaggagcctgttgggcttccgtcatgctgaccaacggtaaagaacaggtaattaagagctgcgtgtctctcccagagctcaacgcccaggtgttttgccattccagcaacaacgtgactaaaacagagtgctgcttcaccgacttctgcaacaacatcacactccaccttcctactgataatggcacttggacacaattatggctagtgtcagagtatcacgagcaggggagcctctatgactacctcaaccgcaatatcgttacggtggccggaatgatcaaacttgcactgtctatcgcttctggtctcgcccatctgcatatggaaattgtgggcactcagggaaagcccgctatagcgcatcgcgatatcaagtccaagaacatcttggtaaaaaagtgcgaaacgtgcgctatagccgatctgggcctcgccgttaagcatgacagtatcctcaatacaatcgatatccctcagaacccaaaggtagggactaagcggtacatggcgccggaaatgctggatgacaccatgaatgtgaacatttttgagagctttaagcgagccgacatttactctgtgggccttgtatattgggagatcgctcgtagatgctcagtcggcgggatcgtcgaggaatatcagctcccctattatgacatggtccccagtgaccctagcatcgaagagatgaggaaggtcgtttgtgatcagaaatttcgtccaagcatccccaaccaatggcagtcatgtgaggctctgagagtaatgggacggataatgcgcgaatgctggtacgccaacggcgcagcccggttaaccgccctcaggatcaaaaaaaccatttcccagctgtgtgtcaaggaggactgcaaagcctag

SEQ ID NO: 107038 - DNA, 1542 bp, Artificial Sequence
  Description of Artificial Sequence: Synthetic coding sequence
atgggggccgcagctaagctggcctttgcggtgttcctgatcagctgcagctctggagccatactgggcagaagtgagacacaggagtgcctgttcttcaacgccaactgggagaaagaccggaccaaccagacaggcgttgaaccttgctacggtgataaagataaacggcggcactgttttgcaacctggaagaatattagcggtagcattgaaatcgttaagcagggatgctggcttgacgacatcaactgctatgatcgcacagattgtgttgaaaaaaaagactctcctgaagtatacttctgctgctgcgagggcaatatgtgcaacgaaaagttcagttatttccccgagatggaggtgacccagcctacaagtaatccagttacaccaaagccaccctactataatatccttttgtattcactggtgcctctaatgttaatcgcaggtatcgtgatttgcgctttttgggtgtatagacatcacaagatggcctatccccctgtgcttgtgccaacccaggatcccgggccccctcctccttccccactcctcggacttaagcctcttcagctgctggaagtcaaggcccgtggaaggttcgggtgtgtatggaaggctcagctattgaacgaatacgtcgccgttaaaatctttcccattcaagataagcaaagctggcaaaatgagtatgaggtttatagcctccccgggatgaagcacgagaacatcctccaattcataggtgcggaaaaaaggggcacttctgtggatgtggacctgtggctgatcactgcttttcacgagaagggctcgcttagcgattttttgaaggctaacgtggtctcatggaatgagctgtgccatatcgctgagaccatggcgagaggactggcctacctccatgaagatatccccggcctgaaagacggacataaacccgctatctctcacagggatattaaaagcaaaaatgtattgctgaagaataatctcacagcatgtatcgccgacttcggcttagctttaaaatttgaggctggtaagtccgctggggatactcatgggcaggtgggcaccaggcggtacatggccccagaggtgttggaaggagccattaatttccagcgggatgctttcctgagaatagacatgtatgcaatgggacttgtactgtgggaactggccagccggtgcacagccgccgacggacctgttgatgagtacatgctgccttttgaagaagagatcggacagcaccccagcttggaagatatgcaagaagtggtggtgcacaagaaaaaaaggcccgtgttacgggattactggcagaagcatgcggggatggcaatgctttgcgaaactatcgaggaatgttgggaccatgacgccgaagccaggctgtccgctggctgtgtgggcgagcgaatcacacagatgcaacgacttactaacatcataacaacagaggacatcgttacagtcgtgaccatggtcaccaacgtggacttcccacccaaggagtcgtccctgtag

SEQ ID NO: 107039 - DNA, 1542 bp, Artificial Sequence
  Description of Artificial Sequence: Synthetic coding sequence
atgggagctgcggccaaactggctttcgccgtgtttttaatttcttgttcgtctggagccattctcgggagatcagagacacaggaatgcctgttctttaatgcgaattgggagaaagacaggaccaaccaaacgggagtggagccgtgctatggcgataaggataagcggcgccactgtttcgcgacatggaagaatattagtggctcaatcgaaatcgtgaaacagggatgttggctggatgacatcaattgctacgatagaacagactgtgttgagaaaaaggattcaccggaggtatatttctgctgttgtgagggcaatatgtgcaacgagaagttttcttatttccctgaaatggaagtgactcagccaacctctaatcctgtcacccccaagccgccctactacaacatccttctttacagtttggttccgttgatgctgatagcaggaatcgtcatttgtgccttctgggtgtaccgacaccacaaaatggcgtatcctcctgtactggtcccaactcaggatcctggccctccacccccatccccgctcctcggcctaaagccgctccagttgctcgaggtgaaggcgcgcggaaggttcggctgtgtctggaaagcccaactgctgaatgagtacgtggccgtgaaaatcttccccattcaagataagcagagctggcagaacgagtacgaagtgtattctttaccgggcatgaaacacgaaaacattctgcagttcattggagccgaaaagagaggaacctccgtggacgtggacctttggctcattacagcctttcacgagaagggcagcctgagcgatttcctgaaggccaatgtggtcagctggaacgaactgtgccatatcgccgagaccatggctcgcggcctcgcatacctgcatgaggatataccaggcctgaaagacgggcacaagcctgccatatcccatcgcgatatcaagagcaagaatgtactcttaaaaaataatttaactgcgtgtattgccgactttggtctggcccttaaattcgaggccgggaagtccgcgggcgacacccatggccaggtcggaaccagacgatacatggcacccgaagtgctggaaggcgctatcaattttcagagggacgcattcttgcgtattgatatgtacgctatgggcctggtgctgtgggaactggctagccgctgcacagcagccgatggccctgttgacgagtacatgctcccgtttgaagaggagatcggtcagcatccatccctcgaggacatgcaggaggtggtggtacacaaaaaaaagcgccccgtccttagagactattggcagaagcatgcagggatggcaatgctctgcgagacgatcgaagagtgctgggaccacgacgcggaggcccgcctgtccgcaggatgtgtgggtgagcggatcacccagatgcagagactgaccaatattattaccacagaggatatcgtcaccgtggtcaccatggtaacgaatgttgatttccctcctaaagagtcatctctgtag

SEQ ID NO: 107040 - DNA, 1218 bp, Artificial Sequence
  Description of Artificial Sequence: Synthetic coding sequence
atgtgcaacgagaagtttagctactttcccgaaatggaggtgacccagcctacctcaaatcctgtcacgccaaagcccccctattataatatactcctgtactcgctcgtgcctctaatgctcattgcgggtatcgtcatctgcgctttttgggtgtaccgccaccataaaatggcgtacccccccgttctggtccccacccaggatcccggtcctccccctcctagcccgctgctgggcctgaagccgctgcaacttctcgaggtcaaggcccgcggccggtttggttgtgtgtggaaggctcagttgcttaacgaatatgtggctgtcaagatcttccccatccaggataaacaatcttggcagaatgaatacgaggtttattcgttgcccggaatgaagcacgaaaacattctccagttcattggggctgagaagcggggcacaagtgttgacgttgacttgtggcttattactgcctttcatgagaaagggtcccttagtgatttcttgaaggcaaacgtcgtctcttggaacgaactctgccacatcgcggagactatggctaggggacttgcgtatctgcatgaggatatacctgggttaaaagacggacataagcctgctatcagccaccgtgacatcaagtccaagaacgtgttactaaagaataacctgacggcctgcatagctgacttcgggttagcccttaagtttgaagctggcaagtcagcaggagacacccacgggcaggtgggcacccgccgctatatggcccctgaggtgctagaaggcgctatcaatttccagagagacgctttcttacgcattgacatgtacgccatgggcttagtgttatgggagcttgccagtaggtgcaccgcagccgatggtcccgtcgatgagtatatgttaccatttgaagaggagatcggccagcaccctagcctcgaggatatgcaagaagtggtggtccacaaaaagaaacggcccgtactgcgggattattggcagaagcacgccggaatggccatgctgtgtgagactatagaggagtgctgggaccatgacgctgaggcgcggctctccgcgggatgcgtgggagagagaatcacccagatgcagcgcctgacaaacatcattaccacagaagatatcgtcaccgttgttacaatggtgaccaatgtagacttcccccctaaggagtcgagtctctag

SEQ ID NO: 107041 - DNA, 1539 bp, Artificial Sequence
  Description of Artificial Sequence: Synthetic coding sequence
atgacagctccttgggtggccctggctctgctctggggctctctatgcgccggtagcgggaggggcgaggcagagactagagaatgcatatactataatgcaaattgggagttagagcggaccaaccagtcaggtctggagcgttgcgaaggtgagcaagataagcgtctccattgttacgcttcctggagaaacagttctggcacaatcgagctggtcaaaaagggatgctggcttgacgactttaattgctacgaccgtcaagaatgtgtcgcaacagaagaaaatccacaggtctacttttgttgttgtgaggggaatttctgcaacgaacgttttactcatctcccggaggccggcggccccgaagtgacctatgagcctccaccaacagcgcccactttactgactgtgctggcgtacagcctactccctattgggggcctgagcctgattgtcctgctcgccttctggatgtaccggcatcgcaagcctccctatgggcatgtggatattcacgaagacccaggacccccacctccgagccctctagtgggcctgaaacctctgcaactgctcgaaatcaaggcacgtggtcgtttcggctgtgtgtggaaagctcagctgatgaacgactttgtagcggtgaagatctttccgttacaggataagcagtcctggcagtcagagagggagattttcagcacgccagggatgaagcatgaaaacttgttgcagttcatcgcagccgaaaaacgaggaagtaaccttgaagtcgagttatggttaattaccgcattccacgacaaaggctcgctgactgactacctcaaaggaaatattattacctggaacgaactttgccacgtggcagagactatgtctcgcgggctcagttatttacacgaagacgtgccctggtgtagaggcgaaggtcacaaaccctcgattgcacacagggactttaagtccaaaaatgtgctcctgaaatccgacttaacagccgtgctcgccgactttggactggctgtgaggttcgagcccgggaaacccccgggagatactcatgggcaggtggggacacggcgatatatggcaccggaagttctcgagggtgccatcaactttcagagagatgccttcctgaggattgatatgtatgctatgggcttggtgctctgggaactggtgtctaggtgtaaagctgctgacggacccgtggatgaatacatgctgcctttcgaagaggagataggccagcacccctcactggaggaacttcaggaagtagtggttcataagaagatgcggcctaccatcaaagaccactggctcaaacaccctggcctcgctcaattgtgcgttaccattgaggagtgttgggaccacgatgcagaagcaagactctcagccggatgcgtagaggagcgtgtttccctcatcaggcgaagtgtgaatggcaccacaagcgactgcttagtgtctctggttacttcagtcaccaatgtggatttgccgcctaaagaatcgtccatttag

SEQ ID NO: 107042 - DNA, 1191 bp, Artificial Sequence
  Description of Artificial Sequence: Synthetic coding sequence
atggagctagaccaccggacttcaggaggcctgcatgcctatccgggcccacggggtggccaggttgcgaaacccaatgtgattctgcagatcggtaagtgccgggctgagatgctggagcacgtacgtcgtacccatagacatctcctggctgaggtctccaagcaagtggaaagagagctaaagggccttcatcggtctgtggggaaactcgaatctaacctggacggctatgtgcctacctctgactcacagcgatggaagaagtccattaaggcatgcctttgccgctgccaggaaactatcgctaacctggaaagatgggtaaaacgggagatgcacgtctggcgcgaagtgttttatcggctggagcggtgggctgacaggctagagtccactggggggaaatacccagtgggaagtgagtccgcaagacatactgtttctgtgggggtgggtggcccagagtcctactgtcacgaagcagatggttatgattacaccgtatcaccttacgccataaccccgccacctgccgctggagaactaccaggccaagaaccggccgaggcacaacagtatcaaccttgggttcccggggaggacgggcaaccttcgcccggcgttgacacgcagatattcgaagatcctagagagtttttgagtcaccttgaagagtatctgaggcaagtcggaggcagcgaagagtattggctgtcacagatacagaaccatatgaacggtcccgctaaaaagtggtgggaattcaaacagggctctgtgaagaattgggtggagttcaaaaaagagtttttgcaatactccgagggaactctatctagagaagcgattcagcgagagctggatttgccgcaaaagcagggggagccgttggaccagtttctttggcgcaagagagacttgtaccagaccctgtacgtagatgcagacgaggaggaaatcattcagtacgtcgtagggaccttgcaacccaagctgaagcggttcctgaggcacccgctgcccaagaccctggagcagcttattcaacgggggatggaggtgcaggacgatctggaacaagcggctgagcccgccggaccccatcttcctgtggaagacgaggccgaaaccctcactcctgcacccaactctgaatcagttgcttccgaccgaacccaaccagagtag

SEQ ID NO: 107043 - DNA, 1587 bp, Artificial Sequence
  Description of Artificial Sequence: Synthetic coding sequence
atggccgcagtgctcaacgcagagcggttggaggtctcagtagatggcctaactctatccccggaccccgaagagagaccaggtgccgagggagctcccctccttccaccccccctgccacctcccagcccacctggatcaggccgcggcccaggagcaagcggagaacagccggaaccgggcgaggctgcagccgggggagccgccgaagaggcgcgccggctcgaacaaaggtggggcttcggccttgaggagctctatgggctggccctgcgttttttcaaggaaaaggacggcaaagcattccatcccacttatgaggagaaactgaagcttgtggccttgcacaagcaggtgctcatggggccatataacccagacacttgcccagaggtgggcttctttgatgttctaggaaacgatagacgtcgggagtgggcagccctcgggaacatgagtaaagaagacgccatggtcgaatttgtgaaacttcttaatcgctgttgccacctcttttctacctacgtggcctcacataagatcgaaaaggaggaacaggaaaagaaacgcaaagaggaagaagagaggagaaggcgagaggaggaagaacgggaacggttgcagaaggaagaggaaaagagacggcgggaagaggaggagaggctaagaagagaggaggaggaacggcgacggatagaggaggagagactgagactcgaacagcagaaacagcagattatggccgccctgaattcacagactgctgttcagttccagcagtacgcagcccagcaatatcccggaaattacgaacagcaacaaattctgataagacagctgcaggaacagcattaccagcaatacatgcagcagttatatcaggtgcaattggcacagcagcaggctgctctgcagaagcaacaggaggtggtcgtggccggctcttccctgcccacgtcttctaaggtgaacgcgaccgtgccatccaacatgatgagcgtgaatggacaggccaaaacccatacagacagctctgagaaagaactggagcccgaagcagccgaggaggccctggagaacgggcccaaagagagcctacctgtcatcgctgcacccagcatgtggacacgcccccaaatcaaagatttcaaagagaagatccagcaagatgcagactctgtgattaccgtggggcggggcgaggtggttacggttcgagttcccacgcatgaagaaggcagctatctcttttgggagttcgccaccgataactatgacataggttttggagtctactttgagtggaccgatagcccgaatacagccgtctccgtacatgtgtccgagagtagcgatgatgacgaagaagaggaggagaacatcgggtgcgaggagaaggcaaaaaaaaatgccaataaaccgctgttagacgaaatagtgcctgtttaccgccgggattgtcacgaggaggtgtacgccggatctcaccagtacccgggcagaggagtgtacctacttaagtttgataactcttattcactctggcgctccaaatctgtatactatagagtttactacactcggtag

SEQ ID NO: 107044 - DNA, 2343 bp, Artificial Sequence
  Description of Artificial Sequence: Synthetic coding sequence
atgaagcccggggccactggcgagtcagatcttgcggaggtgttacctcagcataaatttgactctaagtctcttgaggcatacttgaatcagcacctgtccggatttggagctgagagagaggccactttgaccattgcacagtatcgagcagggaagtccaaccctactttttacctgcagaagggttttcagacttacgtgctgcggaagaagcccccaggatctctcctgcctaaggcccaccaaatcgacagagaattcaaggtccagaaggctttgtttagcatcggattccctgtgccgaagcccatcctgtactgctcggatacttccgtgatagggacagagttttacgttatggagcacgtccaaggtaggattttcagagacctcacaatccccggtctctctccagcagagcggagcgctatctatgtggcaactgtagaaaccctcgctcaactgcgcagccttaatatccaatcattacagctggagggatatgggattggcgccggttactgtaaaagacaagtgtctacttggactaagcagtaccaagcggctgctcatcaggatattccggcaatgcagcagcttagtgaatggctgatgaaaaacttgccagataacgataatgaagagaacctgatccacggcgatttccgcctcgacaatatcgtctttcaccccaaggagtgtcgtgtgatcgctgttttagactgggaactcagcacgatcgggcaccctcttagcgatcttgctcacttttctctgttctacttctggccccggacagttccgatgatcaaccaaggttcttattcagaaaacagcggtattcccagtatggaagaactaatcagcatctattgccggtgtcgtgggattaatagtatacttccaaactggaacttcttcctggcccttagctactttaagatggccggtatcgcacagggcgtctactccagatacttacttggaaacaacagctccgaggactcgtttctgttcgccaatatagttcagcccctggccgagacaggcctgcaactctctaagcgcaccttttctaccgtgctcccccagattgacactactggtcagcttttcgttcagaccagaaagggccaggaggtgctcatcaaggtgaaacactttatgaaacagcatatattgcctgctgagaaggaagtgacagagttctacgtgcagaatgagaacagcgtagataaatggggcaagcctctcgtcatagacaagctcaaagaaatggcaaaagttgagggactctggaaccttttcctccccgccgtaagtggattaagtcatgtggactacgctctgatcgccgaggaaaccggcaaatgcttcttcgcccctgatgtttttaactgccaggcaccagacactggtaacatggaggtactgcatttgtacggttccgaggaacaaaaaaaacaatggctggaacctttgctccagggcaatattacttcttgcttttgtatgactgagcctgacgtggccagcagcgacgctacgaacattgagtgctcaattcagagagacgaagatagttacgtgataaacggtaaaaagtggtggtcctcaggagctggcaaccctaaatgcaagatcgctattgtattgggcaggacccaaaataccagtctgagccggcacaagcagcactctatgattcttgtcccaatgaatacaccgggcgtgaaaatcatccgccctctgagcgtgtttggctataccgacaatttccacgggggccactttgagatacacttcaaccaggtcagggtgcccgccacaaacctgatccttggtgagggcagggggttcgagatttctcagggaagactgggtcctggccgcattcatcattgcatgagaaccgtgggcctggccgaacgggctctacagattatgtgcgagcgggctacacagcgcatcgctttcaagaagaagctgtacgcgcacgaagtggtcgctcattggattgccgaatcacggatcgcaatcgagaaaattcgcctcctcacattgaaggcagcgcactccatggacacgctggggtcagccggagcaaaaaaagaaatcgctatgattaaggtcgccgccccgcgggccgtctccaagatcgttgattgggcgattcaggtctgtggcggggccggggtaagccaggattatcctctggctaacatgtatgccattacccgagttctgcgactcgccgacggaccagatgaggttcatctttcagcaatcgcaacaatggaactacgggaccaggctaagcgactcaccgccaagatttag

SEQ ID NO: 107045 - DNA, 2031 bp, Artificial Sequence
  Description of Artificial Sequence: Synthetic coding sequence
atgaagcctggtgctacaggggagagtgacctggctgaggttctgccccagcacaaattcgactccaagagtcttgaggcgtatctgaaccagcacctatctggattcggggcagagagagaggccacgctcaccatcgcacagtacagggcaggaaagagcaatcccacattttatctgcaaaaggggtttcagacatatgtcttgaggaagaaacccccaggcagcctcctgccaaaagcccatcaaatagaccgtgagttcaaggtccagaaagccctgtttagcatcggcttccccgttcctaagccgatattgtactgcagcgacacctctgtcatcggaacagagttttacgtgatggaacacgtgcaggggcgcatttttagggatttgacgatcccaggtctgagtcccgctgaaagatccgccatttatgtggccactgtcgaaacccttgctcaattgaggtcactgaacatacagagcctgcagctggaaggatacgggatcggcgctggctactgtaaacgtcaggtgagtacctggactaaacagtatcaggcagcggctcatcaggatatcccggctatgcagcagttgtccgagtggcttatgaaaaacctgcccgacaacgataatgaagaaaacctgatacacggcgactttaggctggataacatcgtgtttcatcctaaagagtgtagagtaattgcagttctggattgggaattaagcaccatcggccaccccctgagtgacttagcgcactttagcctgttttacttctggcccaggaccgtgcccatgatcaaccaaggttcatactccgaaaactctggcatcccctctatggaagaattgatctccatttattgccgctgccgaggtattaacagcattttgccaaactggaacttcttcctggccctctcttacttcaagatggctggcatagcacaaggtgtctatagccgttatttgctgggcaacaattccagtgaagactccttcctgtttgccaacattgttcagcctctggcagagacaggccttcaattgtccaaaagaaccttcagcaccgtattgccgcaaatcgacacaacaggccagctctttgtgcagacaaggaaaggtcaagaagtgcttattaaggttaagcacttcatgaaacaacacatccttcccgcagagaaggaggtcaccgagttttacgttcagaacgagaatagtgtggataagtgggggaaaccactggtgatagacaaacttaaggagatggccaaggttgaaggcctgtggaacctgttcctgcccgcagtttcaggcttatcgcacgtagactacgcacttatcgctgaagaaacaggcaagtgttttttcgccccagacgtgttcaactgtcaagcccctgacaccggaaacatggaggtgctgcacctctacggatccgaggaacagaaaaaacagtggttggaacctctgctgcagggaaatatcacttcttgcttctgtatgaccgaacctgatgtagcctcctcggacgcgaccaacattgagtgttctattcaacgggacgaggactcttacgtgattaacggcaaaaaatggtggtcgagtggcgccggaaatccaaagtgcaaaatcgctatcgtacttggcagaacccagaacactagtctgagccgtgaagtcgttgcccattggatcgctgagagtaggattgcaattgagaagattcgcctgctaactttaaaagcagcgcattcgatggacaccctcgggagcgccggggccaagaaagagatcgccatgatcaaggtggccgccccacgtgctgtctccaaaatagtagactgggcaatccaggtgtgcggaggcgctggggtgagccaggactacccactggccaacatgtatgctatcactagagtcctgaggttagctgatggccccgatgaggtacatctgtctgccatcgctacgatggagcttagagatcaggccaaacggttgaccgccaagatttag

SEQ ID NO: 107046 - DNA, 918 bp, Artificial Sequence
  Description of Artificial Sequence: Synthetic coding sequence
atggaggtgctacacctctacggtagtgaagagcagaaaaagcagtggctggagccgcttctccaaggcaacataacgtcgtgtttttgcatgaccgaacccgatgtcgcatcatccgacgccacgaatatcgaatgtagcatccagcgggatgaagatagctatgtcatcaatggcaaaaagtggtggagctctggcgccggtaaccccaaatgcaaaatcgcgattgtcctcgggagaactcagaatacctctctgtccagacacaagcagcactctatgatactggttcccatgaatactcctggggtaaagattatcagacctttaagcgtctttggatatacagacaattttcatggtggtcatttcgaaatccattttaatcaagtaagagtgccggccacgaatctcatactgggcgagggccgcggctttgagattagtcaggggcgcctggggcccggccgcatccaccactgcatgcgtactgtgggcctggcagaacgggcccttcaaataatgtgtgaacgggccacccagcgcatcgcctttaagaaaaagctttacgctcacgaagtagtcgcccactggattgctgaaagtaggattgccatcgagaagattaggctactgactctcaaggcggcacactccatggataccctgggctcagctggtgcaaagaaggaaatagctatgataaaagtggccgccccccgggctgttagcaaaatcgtggattgggccattcaggtgtgtggtggggctggtgtgtctcaagattatccactagccaacatgtacgccatcacacgtgtactgaggcttgccgacggaccggatgaagttcatctaagcgccatcgccacgatggaacttagagatcaggctaaacgcctcactgccaagatatag

SEQ ID NO: 107047 - DNA, 1248 bp, Artificial Sequence
  Description of Artificial Sequence: Synthetic coding sequence
atgctttggtctgggtgtcgaagattcggagccagacttggttgtctgcccggtggcctgcgggtgctagtgcagaccggtcaccgaagcctgacatcctgtattgatccatctatgggtttgaatgaggaacagaaagaatttcagaaggtcgcatttgacttcgccgcccgcgagatggctccgaatatggctgaatgggatcaaaaggaactcttccccgttgatgtgatgcgcaaggccgcgcagctgggcttcggcggggtctacatccaaacagacgtcggaggatccggtctgtctcgcctcgacacttctgtaatattcgaagcgctcgcaacagggtgtacatcaactacggcctacatctcaatccataacatgtgcgcatggatgattgatagctttggcaatgaggagcaaaggcacaagttctgccccccgctttgcacaatggaaaagttcgccagctattgtctgacagaacctggctcaggaagtgatgctgctagtctgcttactagcgctaaaaagcagggggaccactacattttgaacgggtcaaaagcctttatttcgggggcaggggagtcagatatttatgtcgtgatgtgtagaaccggcggtcctggtcctaagggtatctcatgcattgtcgtcgagaaaggaacccctggactgtccttcggaaagaaagaaaagaaggtagggtggaactcccagcccacgcgcgctgtcatttttgaagattgtgccgtgcctgtcgctaatagaatcggatctgagggccaggggtttttgattgccgtgaggggtttgaatgggggacgcattaatattgcttcatgttcactgggtgccgcccatgcatctgtgatcctcactagagaccacctgaatgttagaaagcagtttggagaaccgctggcctctaaccagtatctccaatttaccctggccgatatggccacacggctggtagcagctcggctcatggttcgtaatgccgccgtggcgctgcaagaggagcggaaggatgccgtggccttatgcagtatggcaaagctgttcgccacagacgaatgttttgcgatttgtaatcaggctctgcagatgcatggcggctatggctacctcaaagattatgccgtacagcagtacgtacgcgattcccgagtacatcaaatcctggaagggagtaacgaggtcatgcggattctgatttcccgaagtctcctgcaggaatag

SEQ ID NO: 107048 - DNA, 1074 bp, Artificial Sequence
  Description of Artificial Sequence: Synthetic coding sequence
atgagaaaggcggcacagttggggtttggaggtgtctacattcaaacagacgtgggggggagtggcttatcgaggcttgacactagcgttatattcgaagcccttgcaactggctgtacatcaaccaccgcctacataagtatccacaatatgtgtgcctggatgattgattcctttggcaatgaggagcagagacataaattctgcccacctctatgcaccatggaaaaattcgcctcatattgcttgacagaacctggctcaggttccgatgccgcttcgcttttgacctcggccaagaagcagggggatcactatattctgaacggctccaaggcctttatctcaggcgcaggagaatcagatatctacgtggtcatgtgcagaaccggaggacccggtccaaagggaatttcatgtatagtcgtggaaaagggtacgcccggtcttagcttcgggaagaaagagaaaaaagtcggttggaactctcagccgacccgcgccgtcatatttgaagactgcgccgtgccagtggccaacaggataggatctgaaggacagggatttttaatcgctgtgcggggtctcaatggaggtaggatcaacatcgcatcctgctctctcggggcggcgcacgcatcagtaatcctgactagggatcatcttaacgttagaaagcaatttggggagccactggcctctaaccaatacttgcagtttactctggctgacatggccacgagattggtcgcagctagattaatggtgaggaatgccgccgtcgctttgcaagaggaaaggaaagacgccgttgctctgtgtagtatggcgaaattgttcgcaacagacgagtgctttgccatttgcaaccaggccctgcagatgcatggagggtatggctacttgaaggattatgcggtgcagcagtacgttcgcgattctagagtccatcaaattctggaggagttgttctggcaagggcccggtgtccagtcccgctcgttcgtccctttcggaggccctcagatcgctctgctgctcccgttctcttccggtgacctcagggaaggatag

SEQ ID NO: 107049 - DNA, 819 bp, Artificial Sequence
  Description of Artificial Sequence: Synthetic coding sequence
atgggccttaatgaggagcagaaagagttccagaaggtagcctttgacttcgccgcccgggaaatggcgcctaatatggctgagtgggaccaaaaagagttgttccctgtggatgttatgcggaaggcggctcagttaggatttgggggtgtgtacatccagaccgacgtcggcggcagcggcctgtcacgtctcgatacgtcagttatctttgaggccttagcaaccggatgcacctcaactactgcatacatctcaattcataacatgtgtgcctggatgattgattcctttggcaacgaggaacagcggcataaattttgccctcctctttgtaccatggaaaagtttgccagctactgtcttacagagcccggcagtggttccgatgcagcctccctgctgacttcagcaaaaaaacagggcgaccattacattctcaatggctcaaaagcctttatttcaggggcaggggagtccgatatatacgtcgtgatgtgcagaacgggtggtcccggccccaagggaatttcttgtatcgtagtggaaaaagggacacccggtctgagcttcgggaagaaagaaaagaaggttgggtggaattcccagcctacccgagcagtcatttttgaggattgtgccgttccagtagcaaatcggatcggctcagagggccagggatttttgatcgctgtccggggcttgaatggcggcagaatcaacatcgctagctgcagcctcggctgtccccgcctgtgccacccacaccctcgccctccccagtgtcctgaggccgtatggcgtgcttctggacagtag

SEQ ID NO: 107050 - DNA, 681 bp, Artificial Sequence
  Description of Artificial Sequence: Synthetic coding sequence
atgaagagcagaaagaactttaagaaatggcccctgactctcctgcctgagcggtggctgcagatatggcaatcgggcacacgaagcatgtgtgcctggatgatcgacagctttggaaacgaagagcaaaggcacaagttttgccctcccctatgcacgatggaaaagtttgcatcgtactgtctcaccgaaccaggatccggatccgatgcggcatcactcctcaccagcgccaagaagcagggtgaccactatatcttgaacggctctaaagcctttatttctggggcaggagagtctgacatttacgtggtgatgtgccgcacaggaggcccaggccccaagggaattagctgtattgttgttgagaaaggcactccgggacttagcttcgggaagaaagagaaaaaggtgggctggaatagtcagccaacacgagctgtaatcttcgaggattgtgccgtcccagtggctaacagaattgggagcgagggtcaaggttttctgattgcagtacgtggcctgaacggagggcgcattaatattgctagttgttcccttggcgctgcccacgcctctgtgatcctgaccagggaccatctgaatgtgcgtaagcagtttggagaaccactcgccagcaaccagaagaaacaggaaacgctgaaactgtggatcacttag

SEQ ID NO: 107051 - DNA, 1866 bp, Artificial Sequence
  Description of Artificial Sequence: Synthetic coding sequence
atgtctggatgtgggctgttcctgagaaccactgctgctgctcgagcctgtcgggggctagtggtaagcactgccaatagacgcctattgagaaccagccccccagtaagggccttcgccaaggaactgttccttggtaaaataaaaaagaaagaagtctttcccttcccagaagtgtcccaggatgaattgaacgaaatcaaccagtttttaggaccagtcgagaagttcttcactgaagaagtcgatagccggaaaattgaccaggagggtaagatcccagacgagacactggagaagctgaagagcttgggcttattcggtctgcaggtgcccgaggagtacggcgggctgggattttcaaacaccatgtactcccggctgggtgagatcatcagtatggatggctccatcactgtcacgctggccgcccatcaggcaataggcctgaagggcattatcctggcggggaccgaggagcagaaggccaagtacctgcctaagctcgccagtggggagcatatagcagcattctgcttgacagagcccgcctcaggctccgacgcagcctccattaggagtcgagccactctttccgaagataaaaagcactatatcctcaatggaagcaaggtgtggataacaaacggggggttggcgaacattttcactgttttcgctaagactgaagtggtggattccgacggatccgttaaggacaaaataactgcattcatagttgaaagggatttcgggggtgtgaccaatggcaaaccagaggataagctaggaattcgaggatcaaatacttgtgaagtccactttgagaacacgaagattcctgtggaaaacatactgggggaagttggcgacggctttaaggtcgcaatgaacatcctgaactctgggaggttcagcatgggcagtgtagtggccgggttactgaaacggttaattgaaatgacagctgagtatgcatgcacacgaaagcagtttaataaacgcctgtcagaatttggacttatccaggagaaatttgccctgatggcccaaaaagcttatgtgatggaaagtatgacctatctgacggcggggatgctggaccagcccggcttcccagattgctctatagaagcagccatggtgaaagtgttctcaagcgaagctgcctggcagtgcgtgtccgaggctctccagatcttaggcggcctgggatacacaagagattacccctatgagcgcattctgagggacacacggatcctcctcatttttgaaggcactaacgaaatactgaggatgtacatagctcttacaggactgcagcatgcgggcaggatactcaccactcgcatccacgagcttaaacaggctaaggtgtccactgtgatggacaccgtgggccgacggttgcgcgactccctcgggaggactgtggaccttgggttgacggggaaccacggcgtcgtccacccctctctggcggactccgctaataaatttgaagagaacacttactgctttgggcgcacagtagaaacattgcttttgcgattcggcaagacaatcatggaagaacagctcgtccttaagagagttgccaacatcctgattaacctttacgggatgaccgccgtgctttctagagccagtcgctccataagaatcggcctgagaaaccacgaccatgaagtcctgctagctaatactttctgcgtggaggcctacctgcagaatttgtttagcttatcacagctagacaagtacgctcccgaaaatctggatgagcagataaagaaggtctctcagcagattctggagaagcgggcatatatatgcgctcaccctctggacaggacctgctag

SEQ ID NO: 107052 - DNA, 1467 bp, Artificial Sequence
  Description of Artificial Sequence: Synthetic coding sequence
atggatggctctatcaccgtcaccctcgcagcgcatcaggcaattggactgaaggggataattttggccggtaccgaggagcagaaagccaagtatctccctaaattagccagcggcgaacacatcgccgccttttgtctgacggagcccgcaagcgggtcggatgctgcttccattcgaagtagagccacactgtcagaggacaagaagcactatatactgaacggcagcaaggtgtggattacaaacggcgggctggctaatatctttaccgtcttcgccaagaccgaggtcgtggattctgacggatccgtcaaggacaagatcacagcatttattgttgagagggacttcgggggcgtgaccaacggaaagcctgaggacaaactgggcatcagaggtagtaacacctgcgaggtgcacttcgagaacaccaagatccccgtggagaatatccttggggaagtgggcgatggattcaaggtcgccatgaatattctcaactctggacgcttctcaatggggtccgtcgtcgcagggctactcaagcgcctgatcgagatgacagccgaatatgcctgtacacgaaagcagttcaacaaacgtctgtccgaattcggccttatccaggagaagtttgccctgatggcacagaaggcttatgtaatggagtcaatgacctatcttaccgccggcatgttggatcaaccgggcttcccagattgcagcattgaagcagccatggtgaaagtgttctcttccgaggccgcttggcagtgtgtttccgaggccctgcagattctaggaggcttgggctacaccagggattacccttacgagagaattctgcgagatacacggatcctcctcatttttgagggtaccaacgagattctgcgcatgtatattgccttaactgggctgcagcatgctggaaggatactgacaacccgaatccacgagctcaagcaagcgaaagtgagtacagttatggacacagtagggcggcggctgcgggattctctgggtagaactgtcgatcttggcctcactgggaatcatggcgttgtccatccttcattagccgacagcgctaataaattcgaggagaatacttattgcttcgggcgtacagttgagacactcctgctgcgcttcggcaagacaattatggaagagcagctagtccttaagcgtgtggctaacatactgatcaatctgtacggaatgaccgcagtactcagccgcgcctcccgcagtattcgtattggcttacgaaatcatgaccacgaggtgttgctggccaataccttctgtgtcgaggcatatctgcagaatttgtttagcctgtcccaattggacaaatatgccccggaaaacctcgatgagcagatcaagaaagtgtcccagcagatcttggagaagcgcgcttatatctgcgcccatccactggacagaacttgttag

SEQ ID NO: 107053 - DNA, 507 bp, Artificial Sequence
  Description of Artificial Sequence: Synthetic coding sequence
atggaggagcagctggttctcaaaggtggacagcatccacaccaacccgtctggcatgacggtcgtgccgtggctggccagcctcttcatcctcattgggcaccacagccacgacctcgggggagtctcggccagcatctccttagaggtagcctgttggcagagagtctgcagcccttaagtgctggacaggtatgtagtaggaagccacgtagcagactcagaaaatgtcctagtaggagtctgaggtcagagcctattagcgtaccaacactctggaccggtcacgctgaacgagggcagtgtcctctgctcccacccgctccaacgcacggcccactgttggatgactgttatagcttttttaggcggctgggcctgtcccaggtgaagccttttgtacctaggctacacttaaagggttgtagactagcctgggagagcctcttccaagtgctgacatgccggcagtgcagcctcacaggcccaagccagctgctcaattag

SEQ ID NO: 107054 - DNA, 1239 bp, Artificial Sequence
  Description of Artificial Sequence: Synthetic coding sequence
atggctgccgcgctactggccagggcctcagggcccgcccggcgcgctctttgcccaagagcctggcgtcagttgcacacaatttatcagagtgttgaactacccgagacacatcagatgttgttgcaaacatgtagggactttgctgaaaaagagttgtttcctatagccgcccaagtggacaaagagcatctgttcccggccgcccaagtgaaaaagatgggcggtctgggattgctggcaatggacgtcccggaagagctgggcggcgccggactcgactaccttgcctatgccattgccatggaggagatctctcgggggtgcgcttccactggcgttatcatgtctgtgaataatagcttgtacctcggtccaatattgaagttcggatccaaagagcagaagcaggcttgggtgacaccattcacctccggagataagattggctgcttcgcactgtctgagccagggaacggatccgatgccggcgctgcaagcaccaccgcacgcgctgagggagactcttgggttttgaacggtaccaaggcatggattaccaatgcctgggaagccagcgccgccgttgtgttcgcatcaactgatcgcgccctgcagaataaaggaatctctgccttcctggtgccgatgcctacccccggattgacacttggcaagaaagaggataagcttggaatcaggggcagctcaacagccaacctgatatttgaagattgcaggatcccaaaggattcaatcctgggagaaccaggaatgggcttcaagattgcaatgcagactctcgatatgggacggatcgggatcgcctctcaagctctcggaatcgcgcagactgcactggattgcgccgtcaattacgctgagaaccgaatggccttcggagcaccgttaaccaaattacaagtgatacagtttaaactcgcggatatggccttggccctcgagagtgctaggctcctaacatggcgggctgcaatgctgaaggacaacaagaagccatttattaaggaggccgcgatggcaaagctggccgcgtctgaggccgcaaccgctattagccaccaggctattcagatcttaggaggaatgggttacgtcacggagatgccagcggagcgacattatcgggacgctcggatcactgagatatatgagggtactagtgagattcagagactggtaatcgccggacatcttcttaggtcctatagatcatag

SEQ ID NO: 107055 - DNA, 1365 bp, Artificial Sequence
  Description of Artificial Sequence: Synthetic coding sequence
atggctgcggggttcgggagatgttgtcgcgtgctgcgcagcatttcccgttttcactggcgaagccaacacacaaaagccaatcggcaacgggagcccgggctgggcttctcctttgagttcactgagcagcaaaaagagtttcaagccacagcacggaaattcgctcgggaggagataatcccagtggctgccgaatatgacaaaactggagaatatcccgtgccactaatcaggagagcttgggagttgggtctgatgaacacacacatccctgaaaactgcgactatagcgtgtgtcccctgctggaagcatgcacactgtacctcgacgctttcttccttttacttaccggatccaacctgaatttgcatctgaacctgggcggcttaggtttgggtacatttgatgcctgcctgatctccgaggaactagcctatggctgtaccggtgttcagacagccattgaggggaactcactggggcagatgcccattattatagccggaaatgaccagcaaaagaaaaagtatttggggcgtatgactgaagagccgctgatgtgcgcctactgtgtaacagaacctggcgccggctcagatgttgctggaattaagacgaaagcagagaagaaaggtgatgagtatataattaacggtcaaaaaatgtggattacaaacggcggcaaggctaattggtactttctcttggccaggtcagatcccgacccgaaagccccggcgaacaaggccttcaccgggtttatcgtggaagctgatacgcccgggatacagattggacggaaagagctgaatatgggacagagatgtagtgacacaagaggaatagtgtttgaggacgtaaaggtccccaaagagaatgtgctgataggagatggggcgggcttcaaggtggcgatgggggcctttgacaagactcgccctgtagttgcagcaggagctgtgggactggctcagcgggcgctcgacgaggccacgaaatacgcactcgagcggaaaacatttggcaaactgctggtggaacaccaggccattagctttatgctggcggagatggctatgaaagtggagctcgcaaggatgagttaccagcgagctgcatgggaggtggactctgggagacgcaacacctactacgcgagcattgccaaggcctttgccggcgatatcgccaatcaactggccactgatgctgtgcaaattctggggggaaacggatttaataccgagtacccggtggagaaactgatgcgcgacgctaagatttatcaaatctatgaaggcacatcccaaatacagcggctaatagtagcaagagagcacatcgataaatataaaaactag

SEQ ID NO: 107056 - DNA, 1266 bp, Artificial Sequence
  Description of Artificial Sequence: Synthetic coding sequence
atggctgccgggtttggacggtgttgtagggttttacgctcaataagccgtttccactggcgctcccagcacaccaaagcaaatagacagcgtgagcccggtttgggcttcagctttgagtttactgagcaacaaaaggaattccaagcaacagcccggaaattcgcccgggaggaaatcatccccgtggcagcagaatatgacaaaaccggagagtaccctgtgcccctgattcggagagcttgggaattaggcttgatgaacacccacatccccgagaattgcggagggctcggactcggtactttcgatgcatgtctcatatctgaggagctcgcatatgggtgcacaggagttcaaactgcaattgaaggaaattccctgggccagatgccgattatcatcgccggtaacgatcaacagaagaagaaatacttggggcggatgacagaggaacccctgatgtgcgcatattgtgtaaccgaaccgggagcggggtctgacgttgccgggatcaagactaaggctgaaaagaaaggcgatgagtatattataaacggtcaaaagatgtggattacaaatggaggcaaggcaaactggtactttctcttggcccgtagcgatcccgatcctaaagccccagcaaataaagcatttactggctttatcgtggaagccgacaccccaggcatacaaatcgggcggaaggagctaaatatgggccagcgttgttcggatacacggggcatagtgttcgaggatgtgaaggtccctaaggaaaacgtgctgatcggcgacggtgcaggcttcaaggtggccatgggcgccttcgataagacgaggccagtggtggcagctggagcagtgggtctcgctcagcgggcactagatgaagctaccaaatacgccctggaacgaaaaactttcggcaagcttctggtcgagcaccaggccatttcatttatgctggccgagatggcaatgaaggttgagctggcccgtatgtcctaccagcgggccgcctgggaagtcgattccgggaggaggaatacttattacgcatcaattgcaaaagcatttgctggagatattgctaaccagttggcgacagatgccgtccagattcttggggggaacgggttcaacacagagtaccctgtggaaaagctgatgagagatgccaagatctatcagatatacgagggtacctcacagatccagaggttgattgtggccagggagcacatcgacaagtacaagaattag

SEQ ID NO: 107057 - DNA, 1278 bp, Artificial Sequence
  Description of Artificial Sequence: Synthetic coding sequence
atggctgccgggttcggccgctgttgtcggtgctctcttcaggtgctgcggtccatcagtaggtttcactggcgctcccagcatacaaaagctaacaggcagagagaacctggcttgggctttagttttgaattcaccgaacagcagaaggaatttcaggccactgctagaaagtttgcacgcgaagaaatcatccccgtcgccgctgagtacgacaagaccggggaatatcccgtccctcttatccggcgcgcgtgggaactgggtctcatgaacacccacatccccgagaattgtggaggcctgggacttggcacatttgacgcttgtctcatcagtgaagagttggcatacggctgtaccggcgtgcaaactgcaatcgaaggaaacagtctcggccagatgcccatcataattgccggcaacgatcaacagaaaaagaaatacctgggacgtatgacagaagagcccctgatgtgtgcctactgcgtgaccgagccaggagccggaagtgacgtggcaggaatcaaaactaaagctgagaaaaagggggatgaatatattattaacggacagaagatgtggatcactaacggtggaaaggcgaattggtacttcctgttagctagaagtgatcccgaccccaaggccccagctaataaagctttcaccggctttatcgtcgaggcagacacgcctggaatccaaattggcaggaaggaacttaatatggggcagaggtgtagcgatacaaggggaattgtattcgaagacgtgaaggtacctaaagaaaatgtgcttattggagatggcgctggattcaaggtcgctatgggcgctttcgataaaacacggcctgtggtggctgccggagccgtgggactggctcagcgagctctggatgaggctaccaagtacgcgctggagcgtaagaccttcgggaagcttctggttgagcatcaggccatatccttcatgttagccgaaatggccatgaaggtagagctggctagaatgtcttaccagcgcgctgcctgggaagtcgactcaggcaggaggaacacgtactatgcttccatagcaaaggcctttgctggagacattgccaatcagttggcaaccgacgcagtacaaattctgggaggcaatggctttaacacggaatacccggtggaaaagcttatgagggacgccaagatttatcagatttacgaggggacaagccagatccagaggttgattgtggcaagggagcatattgacaagtataagaattag

SEQ ID NO: 107058 - DNA, 1158 bp, Artificial Sequence
  Description of Artificial Sequence: Synthetic coding sequence
atgctgcaagaattcaccgagcagcagaaggagttccaagctacagcgcggaagttcgcccgggaggaaattatccctgtggccgcagaatacgacaaaactggcgagtaccccgtccccctgattaggcgcgcatgggagctgggactgatgaacacacacattccagagaactgtggaggcttaggcctggggacctttgacgcctgtcttattagcgaagaactggcgtatggctgtaccggagttcagactgccatcgaaggaaatagcctaggccagatgcccattatcatagcaggaaacgaccaacaaaaaaaaaagtatctgggtcggatgacggaggagccccttatgtgtgcttattgtgtcaccgagcccggggcagggagtgacgtggccggcattaagaccaaggcggagaaaaaaggtgacgagtacatcattaacggccagaagatgtggatcaccaatggggggaaagcaaattggtacttcctattagctcggtctgatcctgatcctaaggcgcccgctaacaaggcattcaccggcttcattgtcgaggccgacacacccggcattcaaatcggccgtaaggaactcaatatgggccaacggtgtagcgacacaaggggtattgtgtttgaggatgtgaaagttcccaaggagaacgttctgatcggagacggcgcggggttcaaagtcgccatgggggccttcgataagacacgtcctgtggttgccgccggggctgtgggcctggctcagagggctttggacgaggcgacgaagtatgcgctagagagaaagactttcgggaagctgctggtcgagcatcaagcaatttccttcatgcttgctgagatggccatgaaggtggagctcgctcgcatgtcctatcagagggccgcttgggaagttgacagcggccggcggaacacttattatgcaagcatcgcaaaagcctttgcaggggacattgctaatcaactggccaccgacgccgtgcagatcttaggtgggaacggtttcaacacagagtaccctgttgagaagctgatgcgggacgcgaaaatttaccagatctatgaaggcacctctcaaatccagcgcctgatagtcgccagagaacacatcgacaaatataagaattag

SEQ ID NO: 107059 - DNA, 699 bp, Artificial Sequence
  Description of Artificial Sequence: Synthetic coding sequence
atgtggattacaaatggtggcaaggcaaattggtactttttactggcacggtctgacccagacccaaaagcccctgccaacaaagcttttaccggcttcatcgtggaagccgataccccaggtatccaaattggaaggaaggagcttaacatggggcaacgctgtagtgacactagaggcatcgtatttgaggatgtcaaggtcccaaaggagaatgtgctcattggggacggtgctggattcaaggtagctatgggcgctttcgataaaacccgtcccgtggttgccgccggcgccgtcggcttggcacagcgcgcactggatgaagctactaaatatgctctggagagaaagacctttgggaagcttttagtggagcaccaagccattagctttatgctcgccgaaatggcaatgaaggtggaattggcccgaatgtcttaccagagggccgcatgggaagttgacagtggtagaagaaacacctattacgcatccattgctaaggcgttcgcaggggacatcgccaatcagctggccaccgatgccgtgcagatactgggcggcaacggtttcaatacagagtacccagtggaaaagttaatgagagacgcaaaaatctatcagatctacgagggaacctcgcagatccagcggttaatcgtggccagggaacatatcgacaaatacaaaaactag

SEQ ID NO: 107060 - DNA, 1446 bp, Artificial Sequence
  Description of Artificial Sequence: Synthetic coding sequence
atggatggggcagtaatggagggtcctttgttccttcaaagccaacgctttgggacaaagcggtggcgtaagacatgggctgtgctgtacccagcctccccccacggagtggcacgccttgaattcttcgaccataaaggaagctcaagcgggggtggtcgcgggagctctcgaaggttagattgcaaggtcataaggcttgcagaatgtgtttccgttgccccagttacggtggaaaccccgcctgaacctggagctaccgcatttcggcttgacacagcccagagaagtcatctcctggccgccgatgctccatccagcgctgcctgggtgcagaccttgtgtagaaacgctttccctaaaggcagttggacactcgcccccacagataatcctcccaaactttctgccctggagatgctcgaaaactctctctattcccctacatgggagggttcccagttctgggtgactgtgcagcgcacagaagcagcagagcgctgtggcctgcatggctcctatgttctgcgggttgaggccgagcgcctgacccttcttacggtcggcgcccagtcccagatacttgagccactgctgtcttggccatatactcttttgaggaggtatgggcgcgataaggtgatgtttagcttcgaagcagggagacgatgtcccagcggacctggaacattcacattccagacagcacaaggaaatgacattttccaggcggtagagacggccatccaccgccagaaagcccaggggaaagcagggcagggtcatgacgtcctgcgggcggactctcacgagggcgaagtagcagaagggaagctacctagtccccctggaccccaggaacttctggacagtccacccgccttgtacgcagagcccctagatagtttgaggattgcaccatgtccgtcccaggattccctctatagcgatccactggattctacctccgctcaagcaggcgagggcgtgcagcggaaaaagcctctgtactgggatctgtatgaacatgctcagcagcaactactgaaggcaaaactaacagatcccaaggaggaccccatctacgatgagcctgagggactggctcccgtgccacctcagggcctgtatgatctgccccgcgagcctaaggacgcgtggtggtgtcaggcccgagttaaggaagagggatacgaattgccttataatccagcaactgacgactatgcagtcccaccgccccgcagcactaaaccgctactcgccccgaaacctcagggccctgcctttcctgaaccaggaacagccacagggagcggaattaaatcacacaattccgcgttgtattctcaggtccagaaatcgggggcaagcgggagctgggattgtggcttatcccgggtcggcaccgacaaaacaggggtcaagagcgaaggctccacttag

SEQ ID NO: 107061 - DNA, 1299 bp, Artificial Sequence
  Description of Artificial Sequence: Synthetic coding sequence
atggaggggcttgctgtgcgtcttctgaggggtagtcgtctgctccggcggaacttcctgacatgcctgagttcctggaagatccctccacacgtatccaagagctcacagtctgaggccttgctcaatatcacaaataatgggatccatttcgccccactccaaaccttcaccgatgaggaaatgatgataaagtcctcggtgaaaaagttcgctcaggagcaaattgctccactggtgtctactatggacgaaaattcaaagatggagaaatcggttatacaggggcttttccaacaggggttgatgggaatcgaagtggacccggaatacggggggaccggagcgtcctttcttagcaccgtgcttgtgatagaggagctcgctaaagtggatgccagtgttgccgtcttctgcgaaatccagaatactttgattaatacccttatcagaaaacatggaaccgaagagcagaaggctacttacctgccccaacttaccaccgagaaagtgggaagtttctgtctgtctgaagcaggcgctggatctgacagcttcgcactgaaaacacgggcggataaagagggcgattattacgtattgaacggatcaaagatgtggatttcctccgctgagcacgccggtctcttcttggtgatggctaacgtggaccccaccattggatacaaaggcatcacctcattcctggttgaccgggacacaccgggactccacatcggtaaacctgagaacaagttgggtctgagagcctcaagcacgtgccctctcacttttgagaatgtcaaagtgccggaagccaatattctcggtcaaataggccatggttacaaatacgctattggttcccttaatgaaggtcggatcgggatcgcagctcaaatgctgggactggcccaaggttgcttcgactatacaatcccttacatcaaggagaggattcagtttggcaaacggctctttgacttccaaggtctccaacatcaggtcgcacacgtggcgactcagttagaggccgcacgcctccttacgtacaacgccgccagactactcgaggcgggcaaacccttcataaaggaggcctcaatggctaagtattacgcttccgaaatcgcaggacagacgactagtaaatgtattgagtggatgggtggcgtgggttacactaaggactaccccgtggaaaagtactttcgcgacgctaaaattgggaccatctatgagggagcctccaatatacagctcaataccatcgctaaacacatcgacgctgaatactag

SEQ ID NO: 107062 - DNA, 993 bp, Artificial Sequence
  Description of Artificial Sequence: Synthetic coding sequence
atgggcattgaagtggaccctgaatacggaggaactggcgccagtttcctctctaccgtgctcgtgatcgaagagctggccaaggttgacgccagtgtggctgtattctgtgaaattcagaataccctcatcaataccctgatcagaaagcacggtaccgaggaacagaaagcaacgtacttgccacaacttaccaccgaaaaggtgggatcattctgtctatccgaagcgggggccgggtcggattccttcgcactcaagacccgtgcggataaggagggcgactactacgtactgaacgggtctaagatgtggatttctagcgctgagcacgcaggcctgtttttggtgatggccaatgtggaccctactattgggtataaagggatcacctcattcctggtcgacagagacaccccagggctgcacattggcaagcccgagaataagctgggccttcgcgcctcttcgacttgccccctcacttttgagaatgtcaaagtgccagaagcaaatatcttaggacagattggacacggctacaagtacgccattggctctttgaatgaagggaggattggcattgcagcgcaaatgctaggcctagcccagggatgttttgattacaccattccttatatcaaagaacgaatccagtttggcaagaggctgtttgatttccaaggactccagcatcaagttgctcatgtggctacacagttggaagcagcacggctgttaacctacaacgccgccaggctccttgaggcaggaaagcctttcattaaggaggcctccatggcaaaatattatgcctctgagatcgccgggcagacaaccagcaaatgcattgagtggatgggaggagtcgggtataccaaggattaccccgtggagaagtatttcagggatgctaaaatcggtaccatctatgagggcgcctccaatatccagttgaatactattgctaaacacatagatgccgagtactag

SEQ ID NO: 107063 - DNA, 1968 bp, Artificial Sequence
  Description of Artificial Sequence: Synthetic coding sequence
atgcaggcagcccgcatggcggcgagcctgggccgccagcttcttcgcctgggcggcggatcttctcgcctgacggccctgctcggccaacctaggccaggtcccgctcgacggccttacgcgggaggagccgcgcagctggctctcgacaagtcggactctcacccaagcgatgccctcacacgcaagaagcctgctaaggctgaatccaaaagcttcgctgttggaatgttcaaagggcagttgactaccgaccaggtcttcccatatccttctgtcttgaacgaggagcagacacagtttctgaaggagttggtcgagccggtctccaggtttttcgaagaagtgaacgatcctgctaagaacgacgcactggagatggtggaggaaactacctggcaggggctgaaggaactgggagcctttggactccaggtgccgtctgagttagggggggtgggcctgtgtaatactcaatatgcccgcttagtggagatcgtgggaatgcacgacctcggagtagggatcacattgggagcacaccagtcaattggcttcaaaggcattctcctgtttgggacgaaggcccaaaaagagaagtacctacccaagctggcaagcggggagacagtagcagccttttgcctcactgaacccagcagcggctcggacgccgcgagcattcgaacaagcgcagtgccaagtccgtgtgggaagtattatacactaaatggctctaaactttggatctccaacggaggcttggccgacattttcaccgtgttcgcgaagactccagttaccgaccccgctaccggggctgttaaagaaaagataacagcatttgtcgtcgagcggggcttcggcggtataacccacggtccgccagaaaagaagatgggcatcaaggcaagcaacactgccgaggttttttttgacggcgttcgagtgccttccgaaaacgtacttggtgaggtggggagcgggttcaaggtagccatgcacatcctcaataacggacgtttcgggatggccgctgctctcgcggggactatgagaggtatcatcgccaaggctgtggaccacgctaccaatagaacccagtttggagagaagatccataactttggcctgatccaggaaaagctggcaagaatggtgatgctccaatacgtgactgaaagtatggcctatatggtctccgccaacatggaccaaggggccactgactttcaaattgaggctgccatttcaaagatcttcggttccgaggccgcttggaaagtgaccgacgagtgtatacagatcatgggtggcatgggcttcatgaaggaacctggggtggagcgcgtgctccgggacctgaggattttccgaatatttgagggcacaaatgacatcctacggcttttcgtggcactgcagggatgcatggacaaggggaaggagctgtcaggccttggctccgcacttaaaaacccgttcggcaacgctggattgctcctaggcgaagccggtaagcagttgaggcgaagagcgggacttgggtctggactgtcactctctggattagtgcaccctgagttgagtcgttcaggggagctggctgtccgagccttggagcagtttgccaccgtggtggaggcaaaactcatcaagcataaaaagggaattgtcaacgaacagtttctcctccagcgcttggctgacggcgccattgacctgtacgccatggtagtcgtgctctcacgagcatcccgcagcttgagcgaggggcacccaacggcccagcacgaaaagatgttgtgcgatacctggtgcatcgaagctgccgccagaatccgagaagggatggctgcgctgcaatccgatccctggcagcaagagctctatagaaatttcaaatctatctcgaaagctttagtggagagagggggcgtggtcacaagcaatccccttggcttctag

SEQ ID NO: 107064 - DNA, 1902 bp, Artificial Sequence
  Description of Artificial Sequence: Synthetic coding sequence
atgcaggctgctcgtatggccgcatcactgggccggcagcttctccgccttgggggcggcagctctcggctaaccgcgctgttgggccagccccgtccaggtcctgcgcggagaccgtatgcaggtggtgcagcacaggagagcaagagtttcgctgtcgggatgtttaagggtcaactgacgaccgatcaggtcttcccctatccgtcagtgttaaatgaggagcagacccagtttttgaaggagctggtggaaccggtgagtcggttctttgaggaagtgaatgacccagccaagaacgacgcgctggaaatggtcgaggaaaccacttggcaagggttgaaggagctgggagcatttggcctgcaggtgccaagcgaactaggtggagttggactgtgtaatactcagtacgcccggttggtggaaattgtgggtatgcatgatctcggggtcgggatcaccctgggggcccaccaatcaatcggctttaagggaatccttctgttcgggaccaaggctcagaaggagaagtacctccctaagctcgccagcggcgaaacggtcgctgccttctgtcttacggagcctagctccggctctgatgccgccagtatcagaacaagcgcagtgccatctccttgcgggaaatattataccctgaatggaagtaaattgtggatttctaacgggggtctggccgacattttcacagtctttgcaaaaactccggtgactgaccccgcgaccggcgctgttaaggagaaaataactgcgtttgttgtagagagagggtttggcggaatcactcacggtcctcctgaaaaaaagatggggattaaagcttccaatacagccgaagtgttctttgatggtgtccgagtccccagtgagaacgtgctcggcgaagtgggctctggatttaaagtggctatgcatatacttaacaatggcagattcgggatggcagccgccctggccggcaccatgcgagggatcatcgccaaggctgtggaccacgccacgaacaggacacaatttggtgaaaaaatacataacttcggcctcattcaagaaaagttggcgcgcatggtgatgcttcaatacgtgactgaaagcatggcctatatggtgtccgctaacatggatcagggagcaaccgacttccaaatcgaagcagctattagcaagatctttgggtccgaggccgcatggaaggtcacagatgagtgtatccagatcatggggggtatgggtttcatgaaagaaccaggagtcgagagggtgctgagggatctgcgcattttcagaatattcgaaggtactaatgacattcttcgcctctttgtcgctttacaagggtgcatggataaggggaaggagctgtccgggttgggatctgccctcaagaacccattcggaaatgctggcctgctcctgggagaggccggaaagcagctacgtcgccgtgctggtcttggatcaggtctgtcactcagtggtctggtacacccagagctgtcccgaagtggcgaattagcggtgcgcgctctggaacagttcgctacagtggttgaggccaaactgatcaagcacaaaaaggggattgtcaacgaacagttcctcctgcagaggctggctgacggtgctattgacctttatgccatggtggtcgtgttgtcacgggcttcccgatctttgtccgaaggccacccaacagcccaacatgaaaagatgttgtgtgatacttggtgcatcgaggctgcagccaggatccgggaaggcatggcagccttgcagtccgacccttggcagcaggagctctatcgtaatttcaaatccatctctaaagccctcgtggaaagaggtggggtggttacatctaaccccctggggttttag

SEQ ID NO: 107065 - DNA, 2106 bp, Artificial Sequence
  Description of Artificial Sequence: Synthetic coding sequence
atgcccaggggcccccagccaagcgcagccagatgtaccgttgatgacgaatccggcctgggagcccccggcagggggagagcaggtagacagtcctgggtgcgcgctagggctagcggcgcccggcgcgactccgagatgcaagcggcacgcatggctgcgtccttggggaggcagctcctgaggctcggtggcgggagctcccgcctcacagccctgctgggacaacccagacctggccccgcccgtcgtccttacgcgggaggggcggcccagcttgctctggacaaatcagactcacatccgtctgacgctttaacaagaaaaaaacctgctaaggcagaatcaaagtcttttgctgtcgggatgttcaaaggccaattgacaactgaccaagtcttcccttacccatccgtgctgaatgaggagcaaactcagttcctaaaggagctggtggagcctgtttcacgtttctttgaggaagtgaacgatccagccaaaaatgatgcgctcgagatggtggaggagactacctggcaggggctgaaagagctaggagcttttggattacaggtaccgtcagagttgggaggcgtcggactttgcaatacccagtacgcaaggctggtggaaattgtggggatgcacgatcttggagtcggtatcaccctaggggcccatcagagcatcggcttcaaaggtattttgctctttgggactaaagctcagaaagaaaagtatcttcctaagttagcttctggcgagacagtggcggccttttgcctgacagagccctcttccggttctgacgcagcatctatccgaacaagcgccgtgccttccccttgtggaaaatattacactttaaatggatccaagctatggatttcgaacggaggtctggctgacatttttaccgtgttcgcaaagaccccagtgacagatccagccactggggccgtcaaagaaaaaatcacggccttcgtggtggagcgggggtttggaggcatcacccatggcccgcctgagaaaaagatgggaattaaggcgagcaatacagcagaggttttctttgatggcgtgcgcgtgcccagcgaaaacgtgttgggagaagttggatctggattcaaggtggctatgcatattcttaataatggacgattcggaatggctgctgctctagccggtacaatgaggggaatcatcgcgaaggctgtcgaccacgctactaatcggacacagttcggcgaaaagatacacaactttggtctgatccaggagaaactggcacgcatggtgatgctgcaatacgtgaccgaaagtatggcctacatggtgagcgctaatatggaccagggcgccaccgattttcaaattgaggctgccatctccaaaattttcggaagcgaggccgcctggaaggttactgacgagtgtatccagatcatgggcggcatggggttcatgaaagaacctggcgttgaaagggtgctgagggatctccgcatcttccgaatttttgaaggcactaatgacatactccggctgttcgtcgcacttcaagggtgtatggacaagggaaaggaactcagcggactcggctctgccctcaaaaacccttttggcaacgccggccttcttctgggagaggcggggaagcagctgaggagacgcgccggactcggcagcgggttgagtttgtccggtctggtgcaccctgaactttctcggtccggagagttagcggtgagagcccttgaacagtttgcaaccgtggtcgaagctaagctaatcaagcataagaagggtatcgtgaacgagcagttcttactgcagagattggcagacggagcaattgatctgtacgccatggtggtcgtgctgtcgagggcatcacgatcccttagtgagggacacccgaccgcccagcatgagaaaatgctttgcgatacatggtgcattgaggcggctgctaggattcgggagggtatggcggcgttgcagagtgatccttggcagcaggagttataccggaactttaagagcattagcaaagcgctcgtcgaacgagggggagtggttaccagcaatccccttggtttttag

SEQ ID NO: 107066 - DNA, 2106 bp, Artificial Sequence
  Description of Artificial Sequence: Synthetic coding sequence
atgcctcgcggtcctcagccgagcgctgctaggtgcaccgttgacgatgagtcaggactgggcgcgccagggaggggccgggccgggaggcagtcatgggttagggccagggcgtctggagctcgccgagacagtgagatgcaggctgcacgtatggccgccagtctggggaggcagctgctcagattagggggcgggtctagcaggctaactgctttacttgggcagccacgaccaggaccagccaggcggccatacgcgggaggggccgctcagctggccctggataagagtgacagtcacccctccgatgctctgacccgaaagaagcccgccaaagcagagtccaagagttttgcagtgggtatgttcaaaggccagttaacaacagatcaggtttttccttacccatccgtgcttaatgaggaacagactcagtttctaaaggaactggtggagcccgtctcacgcttctttgaggaggtaaatgatcccgccaagaatgacgctctggaaatggtagaggagacaacctggcagggactgaaggagttgggcgcattcggtctccaggtccctagcgaacttggcggggtcgggctgtgcaatactcaatacgctagactggtggaaatcgtgggaatgcatgatttgggtgtcgggattactctgggagcacatcagtccataggtttcaagggcatccttctgttcgggacgaaagctcaaaaagagaagtatctgcccaagctggcgagcggagaaactgtggctgccttctgtctcacggagcccagctccggtagtgatgccgcatctattagaacgagtgctgttccatctccatgcggaaagtattacacactgaatggaagtaaactttggatctcgaatggcggcctcgcagacatcttcactgtttttgccaagacaccagttacggatccggctaccggagcagtcaaggaaaagatcaccgccttcgtcgtcgagcgcgggttcgggggcattacccatggtcctccagagaagaaaatggggattaaggccagtaacacagccgaggtgttctttgacggtgttcgggtgcccagtgagaatgttctcggcgaggtaggttccggctttaaggtagcaatgcatatcctcaacaacggcaggttcggaatggcagcagctctagcgggtactatgcgcggcatcattgccaaagccgtcgatcacgctactaaccgcacgcagtttggcgagaagattcataattttggtctgatccaggagaaactagcgagaatggtaatgcttcagtacgtcaccgagtcgatggcctatatggtcagtgctaacatggatcaaggagcgactgactttcaaatcgaagcggccattagcaaaattttcggttcagaggcggcctggaaggtgaccgatgaatgcattcagattatgggaggcatgggattcatgaaagaacccggagtggagagagtcctgagagatctcagaatattccggatctttgaaggcactaatgatatcttgcggctgtttgtggctctacagggttgtatggataagggcaaggaactctccggcttgggaagcgctctaaaaaacccattcggcaatgcaggtttgctgctcggcgaagccggtaagcaactgcgccgccgcgcaggattagggagcggcctgagcctgtccggactcgtgcacccagagctctcccgcagcggggagctggccgtgagggccctagagcaatttgctacggtagtcgaggcaaaattgatcaagcataaaaaaggcatcgtcaacgaacagtttcttctgcaaaggctggcggacggagccattgatctctatgctatggtcgtagtgctctccagggcttcccgctctctatcagagggccatcctactgcccagcatgagaagatgctctgcgacacttggtgcatcgaagccgccgcccgcatccgtgaaggcatggccgccctacagtcagacccctggcagcaggaactgtacagaaattttaaaagcatctcaaaagcgctcgtggagagaggcggtgtggtgacttcaaatcctctgggtttctag

SEQ ID NO: 107067 - DNA, 2037 bp, Artificial Sequence
  Description of Artificial Sequence: Synthetic coding sequence
atgttggggggtcttgccgcggccgctgggacccgcataatgggaaaagagatagaagccgaagcacaaaggcccctgcgacaaacatggcggccaggccagccccctgccatgaccgctaagaccatgtcctctagactgactgctctcctcggtcagcctcgtcccggccccgcacgcaggccctacgctggcggagcagctcaactggctctcgacaagtccgactctcacccgtctgatgccctgactcggaaaaaacctgccaaagctgagagcaagagttttgccgtcgggatgttcaagggtcagctgacaactgatcaagtgtttccataccccagcgtcttgaatgaggagcaaacccaattcctgaaagaactggtggaacccgtgtctcggttctttgaggaagtaaatgaccccgccaagaatgacgcactggagatggtcgaggaaaccacttggcaagggctgaaggaactcggagccttcgggctccaggtgcctagcgaactgggcggcgtggggctctgtaatactcaatacgcgcgattggtggaaattgtcggtatgcacgatttaggggtaggcatcaccctgggagcacaccaaagtattgggttcaaagggatcctgctgttcggcactaaggcgcaaaaggagaaatacctccccaaactagcaagtggggagacagtggccgccttttgtcttacagagccatctagcggaagtgacgccgctagcatcaggacatccgcagttccatccccttgtggcaagtattacaccctgaatgggagtaaactgtggatttctaatggaggcctggctgatatcttcaccgtgttcgctaagacacctgtcactgatcctgccaccggcgctgtcaaagagaaaatcacagcattcgtggtggaaaggggttttggcggcattacccatggcccccccgagaagaaaatgggaatcaaggcaagcaataccgcagaagttttctttgatggtgtcagggttccatccgaaaatgtgctgggcgaggtgggctccggctttaaggtggccatgcatatcctgaataacggccggttcgggatggccgcagctttagcagggacaatgcgggggatcattgcaaaagccgtagaccacgctactaacagaacacagttcggtgaaaagatccacaactttggcctgattcaggagaaactggcccggatggttatgctgcagtatgtcaccgagtcaatggcctacatggtgtcagcaaacatggaccagggcgctaccgacttccagatcgaggccgctattagcaaaatcttcggaagtgaagcggcctggaaagtcacagacgaatgcattcagattatgggaggtatgggctttatgaaggagcccggagtggaacgcgtgttaagagacctgcgaatcttccgtatcttcgaggggaccaacgatatcctgcgcctgttcgtggccttgcaaggatgcatggacaagggcaaagagctgtcgggactgggcagtgcgctgaagaaccccttcgggaacgcggggctgctactcggcgaggccggaaaacagcttcgcagacgtgccggcctcggcagcgggctgagtttatcaggcctggtgcacccggagctgagccgctcaggtgaattggcagtgcgagctctggagcagtttgcaacggtcgtcgaggccaagctcatcaaacacaaaaaagggattgtgaatgaacaattcctactccagcgactggctgatggcgctatcgatctctatgctatggtggttgttctttccagagcttccagatccttgtccgaggggcaccccaccgcccagcacgagaaaatgttgtgtgacacttggtgtatcgaagccgctgcccgtattcgagagggtatggccgcgctgcagtctgacccctggcaacaagaactgtatcgaaactttaaaagcatctccaaggccttggtagagcggggaggcgtagtcacatcaaacccgttgggcttttag

SEQ ID NO: 107068 - DNA, 1983 bp, Artificial Sequence
  Description of Artificial Sequence: Synthetic coding sequence
atgaaccctgacctacggcgtgaacgggactcagcttcttttaaccccgagttgctcacgcacatccttgatgggagcccggagaagacaaggcgcaggcgcgaaattgagaacatgattctgaacgatccagacttccaacatgaagacctgaacttcctcacccgatcccagcgctatgaagtcgcggtgcggaagagcgcaatcatggtcaagaagatgagggaatttggaatcgctgacccagacgagattatgtggttcaagaattttgtgcaccggggcaggccagagccgctcgatctgcaccttggcatgtttctgccaacactgctccaccaggctaccgccgagcaacaagaacgattcttcatgcccgcttggaatttagaaattataggaacatacgcccagactgagatgggccacggcacccaccttcggggcctggaaaccactgcaacatacgacccagagacccaggagtttattttaaatagccctaccgtaacaagcatcaagtggtggccaggaggtttgggaaagacaagcaatcacgccatcgtgttggcccagctgattactaaggggaagtgctacggacttcacgcattcatcgtgcctattagggagatcggtacccacaagccgctgcccggaataaccgtcggggatatcgggcccaagtttggatatgacgagattgataacggttacctcaagatggacaaccaccgcatcccaagagagaacatgctgatgaagtacgctcaagtgaagccggatggtacttacgttaaacctctgagtaataaactcacgtacgggaccatggtgtttgtgcggtcctttttggtgggtgaggctgcacgagccctaagcaaggcctgcacgatagcaattaggtactccgcagttaggcaccagagcgaaatcaaacccggggagcctgaacctcagatactggacttccaaacacagcagtacaagctttttcctttactcgcaacagcgtacgcattccagtttgtgggagcctacatgaaggagacataccaccgcatcaatgagggaatcggacagggagacctcagtgaactacccgagctccacgctttgactgctgggctgaaggcattcacttcctggaccgcaaacacgggcatcgaggcgtgtcgaatggcttgcggaggtcatggttacagccactgcagcgggctgcctaatatatatgttaattttactcctagctgtaccttcgagggtgaaaacacagtcatgatgttacagacggctcggttccttatgaaatcttatgaccaggtgcatagcgggaaactggtgtgtgggatggtgtcctatctaaatgatctcccttctcagaggatacagcctcagcaggtggcagtgtggcctacaatggtggatattaattctccagaatcactgacagaagcttataagcttcgcgcagccagactagttgaaatcgccgccaaaaatctccagaaagaagtcatccacaggaagtctaaggaggtggcttggaacctgacatcagtggacctggtaagagcttcagaggcccactgccactacgtggtggtcaaacttttcagcgagaagctattgaaaatccaggacaaggcaatccaggcggttctgcggagcctctgtctgctctactccctgtacggcatctcacagaacgccggggactttctgcaaggttcaattatgacggagccccagatcacacaggttaaccagcgagtcaaagaactccttacactcatccgcagcgatgccgtagctttggttgatgctttcgactttcaggatgtgacattaggtagcgtcttagggcggtacgatggcaacgtctacgaaaatttgttcgaatgggccaaaaactccccactaaacaaggccgaagtccatgagtcttacaagcacctcaagtctctccagtcaaagttgtag

SEQ ID NO: 107069 - DNA, 1983 bp, Artificial Sequence
  Description of Artificial Sequence: Synthetic coding sequence
atgaacccggatcttcgccgggagagggatagcgcctccttcaatcccgagttactcacacatatcctggacgggtccccagagaagaccaggcgccggagagagatcgagaacatgatcctgaatgacccagattttcagcatgaggacctcaactttctgactcggagccagcgttatgaggtcgctgtcaggaagtcagccattatggtgaagaagatgcgggaatttggcatcgcagatcccgacgagatcatgtggtttaaaaaactccacctagtgaactttgtggagccagtggggcttaactactctatgttcatccccacactgctcaatcaggggactactgcacagaaagagaagtggctcttgtcctccaaaggactgcagatcatcggcacctacgcacagaccgaaatgggacatgggacacaccttaggggtctagaaactacagctacttacgatcccgagacccaggaattcatcctcaacagccctacagtgacatccattaaatggtggcctgggggcctgggtaagacatcaaaccacgctattgttctcgctcaactcatcaccaaaggcaagtgttatggtctacacgcctttattgttcccattagggaaatagggacccataaacccctgccaggcatcaccgttggcgacatcggtcccaagttcggatacgatgagatcgataatgggtacctaaaaatggataatcaccgcatccctagagagaacatgttgatgaagtatgcccaagtgaaacccgatggcacttatgtcaaaccattgtcaaacaagttgacttatggcaccatggtgttcgtaagatcattcctggtaggagaagccgcaagggccctgagtaaagcctgcactattgctattcgctacagcgccgtcaggcaccagtctgagattaaacccggggagcccgagccacagattctggatttccaaacccagcagtacaagctcttcccccttctggccacagcatacgccttccagtttgtgggggcttacatgaaggaaacttaccacagaatcaacgagggtataggccaaggtgatctgtcagaactgccagagctgcacgctttaaccgcgggcctgaaggccttcacgtcttggaccgccaataccggcattgaggcatgtcgcatggcctgtggaggacacgggtacagccattgctcagggcttcctaacatctacgttaatttcacacccagttgtacttttgagggggagaacacagtgatgatgctccagacggctcgcttcctcatgaagagttatgaccaagtgcattcaggaaagctggtttgtggtatggtgagttacttgaatgatctgcccagccagagaatccagccgcagcaagttgctgtgtggcccacaatggtggacattaactctccagagagcttaaccgaggcctataagctgagagcagccaggctggtcgagatcgccgcaaaaaatttacagaaggaggtcatccacaggaaatctaaagaagtcgcctggaatttgacatcagtggacttagtccgggcttctgaagctcactgtcattatgtggtggtcaaattgttttccgaaaaacttctcaagatccaagacaaggctattcaggccgtgcttagatctctatgtctgctgtactctctgtacggaataagccagaacgccggtgattttcttcaagggtccatcatgacagagccccagattacccaggtcaaccagagggttaaagagctgctgactttgattcgctcagacgcagtggccttggtggatgctttcgattttcaggacgttactctcggcagtgttttaggaagatacgacggcaacgtttacgaaaacctgtttgaatgggccaagaattctcctctgaacaaagccgaagttcacgagtcttacaaacacctgaagtcactgcagagtaagctctag

SEQ ID NO: 107070 - DNA, 1869 bp, Artificial Sequence
  Description of Artificial Sequence: Synthetic coding sequence
atgatcctgaacgatcctgattttcaacacgaggatttgaattttctaacacgttcacagcgctatgaagttgctgttaggaagtcagcaatcatggtcaagaagatgcgggaattcggaatcgcagatcccgacgagatcatgtggtttaagaatttcgtgcaccgtggcagacccgaacctctggacttacacctgggaatgtttttgcccaccctcctgcatcaggctaccgctgaacagcaagagaggttttttatgcctgcctggaatctggagatcataggaacttacgcccagacggaaatgggtcacggtacccacctgcgaggtctagagaccaccgctacatatgacccagagacacaggaattcattctgaacagtcccactgtgacatcaattaaatggtggcctgggggactgggaaaaacatctaaccatgcaattgtgcttgcccagctcataactaaggggaaatgttatggcctgcatgctttcattgtccctatcagagaaatcgggacccataaacccctaccaggaatcactgtgggcgatataggaccaaaattcggatacgacgagatcgacaacggataccttaagatggacaatcacagaattcctagggagaatatgctcatgaagtacgcgcaagttaagccggacgggacctatgtgaaacctctgagtaacaaactgacttacggaaccatggtctttgtccgatccttcctggtaggagaggccgcccgcgccctgagcaaggcttgcacaatcgcaatccggtactccgcagttcggcatcagtctgaaattaagccaggagagcctgaaccacagatcctcgattttcaaacacagcaatacaagttgtttccccttctggccacagcatacgcattccagttcgtgggggcctacatgaaagagacatatcacagaattaacgaaggaatcgggcagggggatttgagcgaactgccggagttgcacgccctgacagccggcctaaaagcctttacatcgtggacagctaatactggcatcgaggcttgccgcatggcctgcggaggacatggttattctcactgctccgggctgcccaacatctacgttaacttcacccccagctgcactttcgaaggagagaacaccgtgatgatgctgcaaacagcgcggtttctgatgaaaagttacgatcaggtgcactctggcaaactggtgtgcggaatggtcagctacctgaatgatctacccagtcaacgaatacagccccaacaggtggccgtgtggcctactatggtcgacatcaattctcccgagtcattaactgaggcatacaaactgcgcgctgcccgactcgtggaaatagctgctaagaatctacagaaggaggttatccataggaagtccaaagaagttgcctggaacctaacttctgtggacctggtgcgggctagcgaggcacactgtcattatgtcgtggtgaaactcttctcggaaaaactgctcaagattcaggacaaagccatccaggctgtactgaggtctctctgcctcctctactctctgtatggcatcagtcagaatgccggcgacttcctgcaagggtcaattatgacagagcctcagatcacacaggtgaaccagagagttaaggagctcctcacattgatcagaagtgacgctgtcgccctggtggacgcctttgattttcaggacgttaccctcggatctgtcctagggaggtacgacggcaatgtatatgagaatctgtttgagtgggctaaaaactcccctctgaacaaggccgaggtacatgagagttacaagcacttgaaaagccttcaatcaaagctgtag

SEQ ID NO: 107071 - DNA, 1779 bp, Artificial Sequence
  Description of Artificial Sequence: Synthetic coding sequence
atggccgctttcattcagagaaccccggataattggcacctcaggccagacggtaatggccctagatttgtgcataggggcagacctgagcctttggatctgcatttagggatgtttctgcccacactgctgcaccaggcgactgccgagcagcaagagcggtttttcatgcccgcttggaacctcgaaatcattgggacctatgcccagactgagatgggacacggaacacacctaagaggcctcgagacaacagctacttacgatccggaaacccaggagttcatcttgaacagtcctactgttacctctattaaatggtggccgggagggcttgggaagacatccaaccacgccatcgtgttggcacagttgattacaaaggggaaatgctatggcctgcatgctttcatagtaccaatccgggaaattggcacccacaaacccctgccgggtattaccgtgggtgatattggtcctaaatttgggtacgatgagattgataacggctacctgaagatggataaccatcggatccccagggagaatatgctgatgaaatacgcacaggtaaaacctgatggcacttacgtgaagccactatccaacaagttgacatatggcacaatggtctttgtgaggtcttttttggtgggtgaggctgctagagcgctgtccaaggcttgtactatagctattcgatattcagccgtgcgccaccagagcgaaattaagccgggagagccagagccacagatcctggactttcagacacaacagtacaaactcttccccctgttggcgacagcctacgccttccagttcgttggcgcctacatgaaggaaacctaccaccgtattaatgaagggatcggtcagggagatctgagcgaactgccagagcttcacgccctgacggccggtctcaaggcctttacctcctggacagccaataccggcattgaggcgtgtcgaatggcctgcggcggccatggctactcccactgctcaggtttacctaatatctacgttaactttacgccatcctgtacctttgagggggagaacactgtcatgatgctgcagacagccaggtttctgatgaagtcttacgatcaggtgcacagtggcaaactggtgtgcggtatggtgtcttaccttaacgatttgccatcgcaacgtattcagccccagcaggtcgccgtatggccaacaatggtcgacattaactcccctgagagcctaacagaggcttacaaacttcgtgctgcccggctagtcgagatcgccgctaagaatctccagaaggaggtcattcaccgcaagagtaaggaagtggcatggaatctgacctctgtggacctggtgcgggcctccgaagcacattgtcactatgtagtggtaaaactattctccgagaagctactcaagatacaggacaaggcaattcaggccgtgctccgctcgctctgcctcctctacagtctatatggaatctcgcaaaatgctggagatttccttcaggggtcaatcatgactgagccacaaataactcaagtaaatcagcgcgtcaaagagctgctgaccctcattcggtctgatgccgtcgccctcgtggacgcttttgacttccaggacgttacgctggggagcgtgctggggaggtatgacggaaatgtgtatgagaacttgttcgaatgggccaagaacagccctctgaataaggctgaagtacacgaatcttataagcacctgaagagcctacaatccaagctgtag

SEQ ID NO: 107072 - DNA, 1983 bp, Artificial Sequence
  Description of Artificial Sequence: Synthetic coding sequence
atgaaccctgatcttcgtagggagagggacagcgcatcattcaatccagaactactcacacacattcttgacgggtcaccagagaaaacaagaagacgccgagaaatcgagaatatgattctgaacgatcctgacttccaacacgaggacctgaattttttgactaggagtcagagatatgaagtggctgtgcgaaaaagcgccattatggtgaagaaaatgcgcgagttcggaatcgctgaccccgatgagatcatgtggtttaagaattttgtacataggggcagacccgaacccctcgatctgcacctcggaatgttcctgccgactctgctgcaccaggctaccgcggaacagcaggagagattttttatgccggcatggaatctggaaattatcggaacctatgctcagaccgagatggggcacggaacacacctgaggggactggagacaaccgcaacatatgatcccgaaacgcaggagttcatcctcaattccccgacagttaccagcattaagtggtggcctggcggccttggaaagacaagcaatcacgccatagtactcgcccaattgattaccaagggaaaatgttacggcctgcacgcctttatcgtacccatccgagaaatcggcacacacaaacctctccccggcatcaccgtaggcgatatcggcccgaagttcggctatgatgagattgataatggatacctaaagatggacaaccacaggattccgcgagaaaacatgctcatgaaatacgctcaggtgaagcccgacggcacttatgtcaaacccctaagcaataagctgacctatggcacaatggtgttcgtgcgaagtttcctcgtgggcgaggcagccagagccctcagtaaggcatgcaccatcgctatcagatacagtgctgtccggcatcagtcagagatcaagcccggggagcctgagccacagattctggacttccaaactcagcagtacaagctgttcccactgttggccacagcatacgccttccagttcgtgggtgcctatatgaaggagacctatcacagaattaatgaggggattggtcagggcgaccttagcgagctgcctgagctccatgctttgactgctggcttgaaagcttttacatcatggaccgccaatacgggaatcgaggcatgtagaatggcatgcggtggacatgggtactcccactgtagcggcttgccaaacatctatgttaactttactccatcgtgtactttcgaaggggagaacacagtgatgatgctccagaccgcgcgctttctcatgaagagctacgatcaggttcacagtggaaaactggtatgtggcatggtatcctatcttaacgatttgccatcccaacggatccagccacagcaggtcgccgtgtggccaactatggtggacattaactcacctgagagtcttactgaagcctacaaactacgcgccgcaaggctcgtggaaattgccgctaaaaatttgcagaaggaggtgatccacagaaaaagcaaagaggtcgcttggaatctgacaagtgtggacctggtgagagcgtctgaggctcactgccactacgttgtcgttaagcttttctctgaaaagctcctcaagattcaggacaaagcaatacaggccgtattgcgttctctctgtctgctttactcactttacgggatcagtcagaacgcgggggacttccttcagggttcaatcatgacagaaccacagatcacccaggttaaccagcgcgtcaaggagttgcttacccttatcagatctgacgccgttgctcttgtcgacgccttcgactttcaggacgttaccttagggagtgtgctgggccgttacgatgggaacgtatatgagaatttattcgagtgggcgaagaatagccctctcaacaaggcggaggtgcacgaatcttacaagcacctcaaaagcttacagagcaaactttag

SEQ ID NO: 107073 - DNA, 2046 bp, Artificial Sequence
  Description of Artificial Sequence: Synthetic coding sequence
atgggctcgccggtccaccgcgtgagcctgggggacacatggtcccgccagatgcatcccgatattgagtccgaaaggtatatgcagtcctttgacgtcgagcgcctgaccaacatcctggatgggggtgcacagaatacagctttaaggcgtaaagtggaaagtatcatacactcttatcctgagttttcctgcaaggacaactacttcatgacgcagaacgaacgttacaaggcggccatgcgaagagcatttcacataaggctcattgcacggcggctgggatggctcgaggatgggcgggagctagggtatgcgtaccgtgctctgtctggagacgtggcgctgaacatccacagagtcttcgtccgtgcacttcggagcctgggatccgaggaacagatcgctaaatgggaccctctatgcaaaaacatccagattattgcaacttacgctcagactgaactgggccatggcacttatctgcagggcttggagacagaggcaacatatgacgctgccacacaggagtttgtcatccatagccccaccctcaccgcgactaagtggtggcccggtgacctcggccgaagtgcaactcacgcccttgtccaggctcagctgatatgctctggcgctcggagaggcatgcatgctttcatcgtaccaattcggagcctgcaggaccacacccctctgcccggcatcattattggggatataggtcctaaaatggatttcgaccagaccgataatgggttcttgcagttaaatcacgttcgcgtccctagggaaaacatgttgagcaggttcgcccaggtgctgcctgatggtacttatgtgaaactcggtacggcccagtcgaactatctccctatggtggtcgttagggtggagcttctatcaggcgaaatcctcccgattcttcaaaaggcctgcgtaattgccatgcgatacagcgtgatccggcgccagagtcgactgcggccctcagaccctgaagctaaggtgttagactatcagactcagcaacaaaagctatttccccagcttgccatctcatacgccttccatttcctcgcagtatctcttctggagttttttcagcactcttatacggcaatattaaatcaggatttttcctttcttccagaactacatgcattgtctaccggcatgaaagctatgatgagcgagttttgtacccagggcgccgaaatgtgccgtagggcctgtggagggcatggatattctaagctgtcaggcctcccgtccctggtcacaaaactaagcgcatcttgtacttacgagggcgagaacaccgtcctttacctgcaggtcgcgagattcttggtcaagagctatttacagacccagatgagtccagggtctacgccgcaacgcagcctatctccgtccgtcgcatatctgaccgcgcctgaccttgccaggtgccccgcgcagcgcgcagctgatttcctgtgcccagaactttacactaccgcatgggcgcatgtggcagtgcgcctgatcaaggactccgttcagcatcttcagactctgacccagtcaggcgcagatcagcatgaagcatggaaccaaacaacagttatccatctccaggccgctaaggtacactgttactacgtaacggtcaagggtttcacggaagcactggagaagctggagaacgagcccgcaatccaacaggtccttaagcgactctgcgatttacacgctatccatgggatcctgacgaactcaggagatttcctgcatgacgcctttttatccggagctcaggtggacatggctcgtactgcctatctggatctgctcagactcatcagaaaggacgcaatcctgctcacagatgctttcgactttacggaccagtgtctcaatagcgccttgggttgttatgatggcaatgtttatgaacgcttgttccagtgggcccagaaatcgcctactaacactcaggagaatcctgcttatgaggagtacatccgaccacttctgcagtcctggagatcaaagttatag

SEQ ID NO: 107074 - DNA, 516 bp, Artificial Sequence
  Description of Artificial Sequence: Synthetic coding sequence
atgggatcccctgtccacagagtgtccctcggcgacacctggtctcgccagatgcacccggacatagagagcgaacgatatatgcaatcattcgatgttgagcgcctgacaaacatcttggatggcggtgcgcagaacaccgctttgaggcgcaaggtggagtctatcattcattcataccccgagttcagttgtaaggacaattattttatgacacaaaacgagcgatataaggctgctatgcgcagagcttttcacatccggctgattgctcggcgcctagggtggctagaggatggcagagagcttgggtacgcttatcgggctcttagcggggatgtggctcttaatatccatagagtctttgttcgtgcgttgcggtctctagggtccgaagaacagatagcaaagtgggaccccctatgcaagaacatccagatcattgctacatacgcccagacagagttaggacacgggacctacctgcaaggcctggaaacagaggccacctactag

SEQ ID NO: 107075 - DNA, 2103 bp, Artificial Sequence
  Description of Artificial Sequence: Synthetic coding sequence
atggcttcaactgttgaaggcggtgatactgcactacttcctgaatttccaaggggacccctggacgcctatcgtgccagagcaagttttagctggaaggaactggcattgtttacagaaggggagggcatgctccgtttcaagaaaaccatcttttccgctcttgagaacgatcccctatttgcccgctccccaggggctgacctgtccctcgagaaatatcgcgagctaaattttcttagatgcaaaagaatcttcgaatacgatttccttagtgtggaggacatgtttaagtcaccactcaaggtgccggccctgatccagtgcttgggtatgtacgactctagcttagctgccaaatacttgctccactctttggtatttggttcagccgtatattccagcggctccgagagacacctgacctatatccagaaaatttttcgcatggaaattttcgggtgcttcgcccttacggagctttcccatggctctaacacgaaggcgatcaggacaaccgcgcactacgatccagccacggaggagtttataatacactcacctgacttcgaggccgccaagttctgggttggcaatatggggaaaaccgcgacacatgccgttgtgttcgcaaagctgtgcgtgcctggtgaccaatgccacggactccatccgtttattgttcaaataagggacccaaaaactctgctgcccatgcctggtgtaatggtcggcgatattggcaaaaagctgggtcagaatggcctggataatggcttcgcaatgtttcataaggtacgtgtgccgcgccagagcctgctcaatcgcatgggcgacgtcactccggaaggaacttacgtcagcccgttcaaggatgtacgccagcgtttcggcgcaagtctcggctccttgtcatccggccgcgtctctatcgtctctcttgctattttaaatctcaaattagcggttgcaatcgctctccggtttagcgctacaaggcggcagtttggtcctacggaagaggaagagatccccgtgctggagtatcctatgcaacagtggcggcttctgccttacctggcggcagtttacgccctggaccacttttctaagagtttgttcctagatctcgtcgagcttcagaggggactggccagtggcgatagaagcgcccggcaggctgagctagggcgggagatccacgctctagcatcagcctcaaaacccctcgcatcttggacaacacaacagggcatccaggagtgtcgggaagcatgtggcggccacggatacttggcaatgaaccggctaggggtgctgcgcgacgataatgaccccaattgcacctacgagggggataacaacatactgctgcaacaaacttcaaattatcttctcggattgctcgctcaccaagtgcacgacggagcttgtttccgaagcccgctcaaaagcgttgattttcttgatgcttacccgggcatacttgaccagaaattcgaggtcagctcagtcgctgactgcctggatagtgccgtcgctctcgccgcctataagtggctggtctgctacttactgagagaaacttatcagaagttaaatcaggagaaacgctccggatcctctgatttcgaggctagaaataagtgtcaggtgagtcacggaaggcccctggctctagcattcgtggaactgactgtcgtccagcggttccatgaacacgttcatcagccctcggtgcccccctccctacgggcggtactcggccgcctgagcgctctgtatgccctctggtcattgtcccgacatgccgccttactctaccgcggaggctacttctctggtgagcaggcaggcgaggtcctggagtctgcagtgctggccctgtgtagtcagttgaaagacgatgctgtcgcgctggtcgacgtcatcgcaccccctgatttcgtcctggacagtccaatcggacgtgccgacggagagctgtacaaaaacctgtggggagctgtgttacaggagtcgaaagtgctggagcgcgcgtcctggtggccagaattcagcgttaacaagccggttatcggcagtctcaagtccaagctgtag

SEQ ID NO: 107076 - DNA, 1875 bp, Artificial Sequence
  Description of Artificial Sequence: Synthetic coding sequence
atggcctctactgtcgagggcggtgacaccgccctccttcctgagttccctcgaggccccctagacgcataccgggccagagccagcttttcctggaaagaactggccctgttcaccgaaggagagggaatgctgcgattcaagaaaacaatctttagtgcacttgagaacgaccccctcttcgcacgcagccctggggccgacctttcactggagaagtatcgggagctgaacttcctccgctgcaaacggatcttcgaatatgactttctgtctgttgaggacatgtttaagtcaccactgaaggtaccagctcttatccaatgtttgggcatgtacgactcttccctggctgcgaaatacctcctgcacagcctggtgtttggctccgcggtatattcctccggaagtgaacgccacctcacatatatccagaaaatttttaggatggagattttcggatgctttgccctgacggagttgtctcatggatccaacacaaaggctattcgtacgaccgcacattatgaccccgccacagaggaattcatcatacatagcccagacttcgaggctgcgaaattctgggttggtaacatgggaaaaacagctacccacgccgtggtgttcgccaagctctgtgtaccaggcgaccagtgtcacggtctacacccgttcatcgtgcagatccgggatcctaagaccctccttcctatgccaggggttatggttggagatatcggcaagaagctaggacagaacgggttagacaatgggttcgctatgtttcacaaggtgagagtgcccaggcagtctctgctgaataggatgggtgacgtcacgcccgaggggacctacgtttcaccttttaaggatgtccggcagaggtttggagcatctctcggaagtttatcctcaggtcgagtgtccattgtctccctggccatcctgaatttgaagctcgcagtcgccatagctctgcgcttctcagcaaccagaagacagttcggccctacagaggaggaagaaatccctgtgctggagtatcctatgcagcagtggcggctcctaccatatctcgccgctgtctacgcactagatcacttcagtaagagtttattcctggatctcgtggaactgcagcgtggtctggcttctggagatcggtccgccaggcaggccgagctcggtcgggagatccacgccctggcaagcgctagcaaacctctggcctcgtggaccactcagcagggcatccaggagtgccgggaagcttgcgggggacacggctatttggcgatgaaccgtctcggggtccttcgcgacgataacgaccctaattgtacctatgagggagataataatatcctgttgcagcagacaagcaattaccttttggggcttctggctcatcaagtgcacgatggtgcctgcttcaggtcccccttgaagtctgtggacttcttggacgcctaccccggaatactggaccagaaattcgaggtgagctccgttgcagactgtctagattccgcggtcgccctggccgcgtacaagtggctcgtgtgctacttgttgagggaaacctatcagaaattaaaccaggagaagaggtccgggtcctcggactttgaagcccggaataaatgccaggtgtcgcacggacggccgctcgccctcgcattcgtggagcttaccgtagtgcaacgatttcatgagcacgttcatcagccctctgtgccaccttcactacgggcggtgctgggtaggctgtcagccctctacgctctatggtccctgagcagacacgccgcgctcctatatcgggccgaaagacgctgttcctgtcccggcagacgggacaggtcatcttag

SEQ ID NO: 107077 - DNA, 2103 bp, Artificial Sequence
  Description of Artificial Sequence: Synthetic coding sequence
atggccagcactgtagaaggcggggatacggcactgctgccggagttccccagaggccctttggacgcctatcgcgccagggcttctttctcttggaaagagctggccctgttcacggagggtgaggggatgctgagatttaagaaaaccatttttagcgctctcgagaatgacccccttttcgcaagaagccccggcgcagacctgtcactagagaagtatagagagctaaactttctgaggtgcaagcgcatttttgaatacgacttcctgagtgtcgaggacatgttcaagagcccgctcaaggtgcccgcactgatccagtgtctaggaatgtacgattcaagtttggcggcaaagtacctgctgcattcactggttttcggtagtgctgtatattcttctggaagcgagaggcacctgacgtatatccagaagatatttcgcatggagatcttcggttgtttcgctctcacagagttatcccacggctcaaacactaaggctattaggacaaccgcgcactatgatcccgccaccgaagagttcatcatccatagtcctgactttgaggctgcgaagttttgggtagggaatatgggtaagactgccactcatgcagtggtgttcgccaagctctgtgtgcccggggatcagtgccatggtctccaccccttcatcgtccagatcagagatccaaaaacgcttctccctatgcccggggtaatggtgggtgacatcggtaagaagctcggtcagaacggactcgataacggatttgcgatgtttcataaagtacgagtacctcggcaatccttgcttaacagaatgggcgacgtcactcctgaggggacatatgtgtctccatttaaagacgtccggcagcgatttggggccagtttagggtccctgtcttccggacgggtctctatcgtgtcccttgctattctgaacctgaagctggcagtggctatagcgttgagattttctgccactcgccggcagtttgggcccactgaggaagaggaaatcccggttctggagtatcccatgcagcaatggcgactgctgccttatttggcagcggtgtacgctctcgaccatttttcaaagtcattgttcttggatctggtcgagttacagcggggcctggcctccggggaccgatctgccaggcaggccgaattaggtagagaaatccacgctttggcttcagcgtccaagcccctggcaagctggacaacccaacagggaattcaggagtgcagggaggcatgtgggggtcatggctacctagcaatgaaccgtctgggggttctaagagacgacaacgaccctaactgcacatatgaaggcgataacaacattttactgcaacaaacatcaaactacctgctgggtctcctagcacaccaggtgcatgacggcgcctgctttaggagccccctgaagagcgtagatttcttagacgcttatcctgggattcttgaccagaagtttgaggtcagctcagtcgccgactgtctagattctgcagtggcccttgccgcctataagtggctcgtgtgttacttgttgcgcgagacttatcaaaagctgaaccaggagaaaagatccgggagctccgacttcgaagcccgaaacaaatgccaggtgtcccatggacgccctctggcactagcttttgtggaactgactgtcgtgcagcgcttccacgaacatgtgcatcagccaagtgtccccccatctctgagggctgtgctggggagattatctgctctgtacgccctctggtcccttagcaggcatgccgcactgttgtaccggggaggttacttcagtggagaacaggcaggagaagtactggagtctgcagtgctggccctttgtagtcaactcaaggatgacgcggttgctttggttgacgtcattgcccccccagattttgtattggacagcccaattggaagggcggatggggagctgtacaaaaacctgtggggtgcagttctccaggaaagtaaggtcctagagcgggcttcatggtggcctgaattttctgtgaacaagcctgtgatcggctcgctcaaatccaaactttag

SEQ ID NO: 107078 - DNA, 2175 bp, Artificial Sequence
  Description of Artificial Sequence: Synthetic coding sequence
atgccacggaattctggtgccgggtacgggtgtccccatggggacccctctatgctcgactccagggagacaccgcaggagtcacgtcaggacatgatcgtgcggacgacccaagagaaattaaaaacatccagtctcaccgatagacagccactcagtaaagagagtctgaaccatgccctcgaactatctgttcctgaaaaggtcaacaacgcacagtgggacgcgcctgaggaagctctgtggacgacaagggccgacggcagggttagactccgcattgaccctagctgcccacagctgccctacaccgttcataggatgttttatgaagcactcgacaagtatggggacctgattgccttggggttcaagaggcaagacaaatgggaacatatctcttatagccagtattacctcctggccagaagagccgcaaaaggcttcttgaagctcggcctcaaacaagcacactccgtggccatcctgggcttcaattcaccagaatggttcttttctgccgttggcaccgttttcgctggtggcatcgtaactggcatatacacgacctcatccccagaagcctgtcaatacattgcatatgactgctgcgccaatgtcatcatggtggacacacagaaacagctggagaagatcttgaaaatttggaaacagctccctcacttgaaagccgtggttatctacaaggaaccaccacctaacaaaatggccaatgtttatacaatggaggagttcatggaactgggcaatgaggtgcccgaggaagctctcgacgccatcatagacacacagcagcctaaccaatgttgtgtgttggtatatacaagcggaacgactgggaatcccaagggagtaatgctgagccaagataacattacatggactgctaggtacggatcccaggcgggcgacatccgccctgccgaagtccaacaagaggttgtcgtgagctacctgccattgtctcatatagctgcccagatctacgacctgtggacaggaatccagtggggagcccaggtatgcttcgcggagccggacgccctaaaaggaagccttgtgaatacccttcgcgaagtggagccaacctctcacatgggagtccctcgagtgtgggagaagatcatggaacgcattcaggaagtggccgcacaatccgggtttatccgacggaaaatgctgttgtgggccatgagcgttacgttagaacagaatttgacgtgtcccggctccgaccttaaaccctttaccaccaggttggcagactacctcgtgcttgctaaggtgagacaggctctggggtttgccaaatgtcagaaaaacttctatggggctgcgcctatgatggccgaaacccagcactttttcctggggctcaacattaggctctacgcgggatacgggttaagtgagacttctggaccacactttatgtcgtctccttataactaccgtctctactccagcgggaagcttgtgccaggatgtcgggtcaaactggtaaatcaagatgcagagggtatcggagaaatctgcctgtggggcagaacaatctttatgggctatctaaacatggaggacaaaacgtgtgaggcgattgacgaagagggatggctgcacacaggtgatgccggcaggcttgacgctgatgggtttctgtacataaccggtcgcttgaaggaactgatcatcacggccggcggagagaatgtgccgccagtgccgatagaggaagcagtcaagatggagctgcccatcatctcaaacgcaatgctgatcggggaccagcgaaaatttctgtccatgcttctgaccctgaagtgcacactggatcctgacacttcggatcagactgacaaccttacagaacaagccatggaattttgccaacgggtgggaagtagagccaccacagtgtcggagattattgaaaagaaggacgaagccgtctatcaggcaatcgaagagggaatccgcagggtgaatatgaatgccgccgccaggccataccacatacagaagtgggctattctcgagcgggatttctcaatatctggaggggagctggggccgaccatgaagctcaagaggcttactgtactggaaaagtacaaaggcattatcgattcattctaccaggaacaaaagatgtag

SEQ ID NO: 107079 - DNA, 1449 bp, Artificial Sequence
  Description of Artificial Sequence: Synthetic coding sequence
atggccaatgtgtatactatggaagaattcatggaactcggcaatgaagttccagaggaagccctggatgctatcatcgacactcagcagcctaatcagtgttgcgttttggtttacacgtccgggaccactgggaatcccaaaggggtgatgctctcgcaggataacataacctggacggcccggtatggttcccaggccggagatatcaggccggctgaagtgcagcaagaagttgttgtctcgtatttgccactcagccatattgctgctcaaatctacgacctgtggacaggaatccagtggggggcccaagtttgttttgcagagccagacgccctgaagggttccttagtgaatacgctgagggaggtagagccgacctcacacatgggagttccgcgggtgtgggaaaagatcatggagcggattcaggaggtggcagcacaaagcggtttcatcagaaggaaaatgctgctgtgggcaatgtctgtaaccttggagcaaaacctgacctgcccaggcagcgatcttaaacctttcacaacccgcctcgcagattatctggtgctggccaaagtgcgacaagccttgggatttgccaaatgtcagaaaaacttctatggcgcagctcctatgatggccgagacccagcacttcttcctgggtctcaatatcagactctacgccggttacggcctgtccgagaccagtggaccacatttcatgagcagtccctacaactacaggctgtattcctcagggaagctcgttcctggttgcagagtgaaactggttaaccaagatgctgagggaatcggggagatctgtttatgggggagaacaatctttatgggttaccttaacatggaagataagacgtgtgaggccatcgatgaagagggctggttgcacaccggtgatgccggaagactggatgcagacgggtttctctacattaccgggagactgaaagaactgatcataaccgccggcggagagaacgtacctccggtgcccatcgaagaagctgttaaaatggagctgcctatcataagcaacgccatgctaatcggtgaccaaagaaagtttttgtcaatgctcctgactctgaagtgtacgctggacccagatacaagcgatcagactgataacttgaccgaacaggcgatggagttttgccagagagtgggatctcgtgcaaccactgtgagcgagataatagagaagaaggacgaggcggtatatcaagcaattgaggagggcattcgccgagtgaatatgaatgccgccgcgcgcccgtatcacattcagaagtgggccattctcgagcgggattttagcattagcggcggcgagctggggccaacaatgaagttaaagaggctcactgtcctggaaaagtacaagggcatcatcgacagcttctatcaggagcagaaaatgtag

SEQ ID NO: 107080 - DNA, 2001 bp, Artificial Sequence
  Description of Artificial Sequence: Synthetic coding sequence
atgaccggcaccccgaagacgcaggaaggggccaaagatctggaggtggacatgaacaagaccgaagtaactccaagattgtggacgacctgtcgcgatggcgaagtgctcctgagactgagtaagcatggccctggccacgagactcccatgactattcctgagttttttagggagtcagtgaataggtttggcacctatcccgccctcgcgtccaagaacgggaaaaagtgggagatactgaacttcaatcaatactatgaggcatgcaggaaggccgccaaatcacttatcaaactcggactggaacgcttccacggagtcggcattctcggattcaattctgctgagtggttcatcaccgccgtgggtgcaatccttgctggagggctgtgcgtggggatctatgctacaaattcagccgaggtttgccagtatgtcatcacgcacgccaaggttaacattttgctagttgaaaacgaccagcagctgcagaaaatcttgtcaatcccacagagctctctggagcccctgaaggcaatcattcaatatcggctgcccatgaagaagaataacaatctgtatagttgggacgactttatggaactcggacggtcaatccccgatacacaattggagcaggtgatagaatcacaaaaagccaaccagtgtgccgtgctgatctatacatcgggcactacaggcatcccaaagggcgtgatgctgtctcacgacaatatcacctggattgctggtgcagtcacaaaagatttcaagttaaccgataaacatgaaactgtggtcagctatctgcctctgtcacacatagcggcacagatgatggacatatgggtgcctattaaaattggggccttgacatacttcgcccaggctgatgctttgaagggtacactcgtgagcaccttgaaggaggtcaagccaacggtcttcattggtgtgccccaaatctgggaaaaaatccacgagatggtcaagaagaatagcgcgaagagcatgggtcttaaaaaaaaggcttttgtgtgggcaagaaacattggttttaaggtaaactccaaaaaaatgctgggcaaatataacactcctgtcagctaccggatggcaaagacactggtgttttctaaggtgaagacctctttgggcctagatcattgtcatagtttcatctccgggaccgctcctctcaatcaggagactgcggagttcttcctgagtctggacataccgatcggcgagctatacggtctgtcggaatcctctggtcctcacacgatcagcaaccagaataattacaggctactcagctgcggtaagatcttaaccggctgcaagaacatgctcttccaacagaataaggatggtattggcgaaatatgtttgtggggtcgccacatttttatgggctatctggaatcggagacggaaacgactgaagctattgatgatgagggatggttgcatagtggagatttaggccagctagacgggctggggtttctgtacgttaccggacacataaaggaaattctgatcacagccggcggggaaaacgttccacccatcccagtggagaccttggtcaaaaaaaaaatccctattatcagcaacgctatgctggtgggcgataaactgaagttcctgtcaatgctgctgactctcaaatgtgaaatgaaccagatgtcgggggagccattagacaaattgaatttcgaagctataaacttctgtcgcggcctgggatcacaagcctcaaccgtgaccgagattgtcaagcaacaggatcctctggtatataaagcgattcagcagggcataaatgcagttaaccaggaggctatgaataacgcacagaggatcgaaaagtgggtgatcctcgaaaaggacttctctatttacggaggggagcttggacccatgatgaagctcaagcggcattttgtggcacagaaatataagaagcagattgaccatatgtatcactag

SEQ ID NO: 107081 - DNA, 1848 bp, Artificial Sequence
  Description of Artificial Sequence: Synthetic coding sequence
atggccgtgtatgtgggtatgctccgtctcggtcgcctgtgtgcaggatcatcaggcgtgctgggagcccgggcagccctgagccggtcttggcaggaggcccgcttgcaaggagtccgctttctctctagcagagaagtggatagaatggtgtctactccgattggcggcttatcctacgtccagggttgcacaaagaagcacctaaattccaagaccgttggtcaatgcctggagaccactgcacaaagagtaccagagcgggaagcgttggtggtgctccacgaggatgtccggctgaccttcgctcaactcaaagaggaggttgacaaggctgcatcaggactgctttctatcggtctgtgcaagggagaccgcctgggcatgtggggacctaactcctacgcttgggtgctgatgcagttagccactgcacaggccggaattatccttgtatcagttaacccagcctaccaggccatggaacttgaatatgtgctgaagaaagtgggctgcaaggctctggtgttccctaaacagttcaaaactcaacagtattacaatgttttaaaacaaatctgcccggaggtggagaatgcgcagcccggcgctctgaagtcacagcgactgcccgacctgaccactgttatcagtgtcgacgcacctctacccggcacactccttctcgatgaggtcgtggccgccggctcaacgcggcagcacctggatcagctccaatacaatcaacaatttttgtcttgtcatgatccaatcaatattcagttcactagcgggaccaccggtagtccaaaaggagccactttgagccactacaatatcgtcaacaattcaaacatcctgggtgaacggcttaagctccacgaaaagactccagaacagttgcggatgattctacctaatccactgtatcattgcctggggagtgtcgctggaactatgatgtgccttatgtacggtgctacattaattcttgctagtccaatattcaatggcaagaaagcactagaggccatttcaagggaacggggcacattcctgtatggaacaccaaccatgtttgtcgacatcctcaatcagcctgacttctcttcttatgacattagcactatgtgtggcggcgtgatcgccggaagccccgcccctcccgaactgataagggccatcatcaacaaaatcaatatgaaagatttagtggtggcgtacggcaccactgaaaattccccagtgaccttcgcgcattttccggaagataccgtggagcagaaagcagagtctgtgggccggataatgcctcataccgaagccagaattatgaatatggaagctggaaccctcgccaagctcaatacccctggtgaactctgtatcaggggctactgcgtcatgttaggttattggggcgaacctcaaaaaacagaggaggccgtggaccaggataagtggtactggacaggggatgtggccactatgaatgagcaaggattttgcaagatcgtgggcaggagcaaggatatgatcatcaggggcggcgagaatatatatccagctgaattggaagatttttttcatacacacccaaaagtgcaggaagtccaggtggtgggcgtcaaagatgacagaatgggggaagaaatctgtgcctgtatcaggctgaaggacggggaggaaaccacggtggaagaaatcaaagcattctgcaagggtaaaatctctcactttaaaattcccaagtacatcgttttcgtcacaaactaccctctgaccatctccggaaagatccaaaagttcaaattaagggaacaaatggagagacacctcaacctgtag

SEQ ID NO: 107082 - DNA, 1923 bp, Artificial Sequence
  Description of Artificial Sequence: Synthetic coding sequence
atggctgtgtatgttggcatgctccgactgggcaggctgtgcgctggcagctccggcgtgctgggcgctcgggcagcgctttcccggtcatggcaggaggctcgcttgcagggcgtcaggttcctgagcgccaggggaggcatggaagctggccgccagcgtatctccgtcccgtcaagttttacagcaagcgccgctgcacactctcgcgaagttgacagaatggtgtcaacccccatcggagggctgagttacgtccaggggtgtacaaaaaagcacctgaattcaaaaaccgtaggacagtgcctggaaaccacagcacagcgagtccctgaacgcgaggcacttgtcgtcctgcatgaggacgtgcgcctgacattcgcacaactcaaggaagaggtggataaagctgcatccggacttctgagcatagggctgtgcaagggggacagattaggaatgtggggccctaactcttatgcatgggtcctaatgcaactggcaacagcacaagcaggcatcatcctggtttctgttaatcctgcgtatcaagccatggaactcgagtatgtccttaaaaaagtggggtgcaaggccctggtgtttcccaagcagttcaagactcaacaatattataacgtgttgaaacagatctgtccagaggtcgaaaatgcgcagccaggcgctctgaaatctcagcgattacccgacctgacaactgtgattagtgtggacgcacccctgcctggaaccctcttgctggatgaggtggtggcggccggttccacaagacagcatctcgatcagctacagtacaaccagcagtttttatcgtgccatgatcccatcaacattcaatttacttctggcacgaccggctctcctaagggagccaccctaagtcattacaacatagttaacaactcaaatatcttaggggagcgacttaagttgcacgagaaaacaccagaacagctgcgcatgattctccctaatcccctctaccattgcttggggtccgtagccggaacaatgatgtgcctgatgtatggagcaacgctgatactggccagccccatatttaacggaaagaaggccctggaggcaatctcacgggagagaggtacgtttctgtacggcacgccgaccatgtttgtcgatattcttaatcaacccgacttcagcagctatgacatttctaccatgtgcggtggcgtaatcgccggcagtccggcaccaccagaattgatacgggctatcataaacaagattaacatgaaagacctggtggtggcatacggcacaactgaaaattctcctgtaacttttgcacacttccccgaggatacggtggagcaaaaggctgagtcagtgggccggattatgcctcatacagaagcccgaattatgaatatggaggctggtaccttggctaagctgaatacacccggggaattatgtatcagaggctattgcgttatgctaggctattggggcgagccgcagaagaccgaagaagcagtggaccaggacaagtggtattggacaggcgatgttgcaactatgaacgaacaggggttttgcaaaatagtgggtcgctctaaggacatgataattaggggtggtgaaaatatatatcccgctgagctcgaggacttcttccacactcatccaaaggttcaggaagtccaggtcgtaggagtgaaagacgataggatgggcgaagagatatgtgcatgcatcagacttaaggacggcgaggagaccacggttgaggagatcaaggctttctgtaaaggcaagatctctcacttcaaaatccctaagtatatcgtgtttgtgactaactatcccttaacaatttcagggaagatacagaaattcaaactgagagagcagatggagcggcacctgaacctttag

SEQ ID NO: 107083 - DNA, 1809 bp, Artificial Sequence
  Description of Artificial Sequence: Synthetic coding sequence
atggcagtctacgtcggcatgttgaggttgggacgactttgtgccggaagctccggcgtcctgggcgcccgtgccgctctctctcgcagttggcaggaagctagactgcagggggtgcgctttctgagcagccgagaggtcgatcgcatggtgtcaacacccattggaggcctgtcatacgtacaaggctgtaccaaaaagcatctgaattccaagacagtcggtcaatgtctcgagacaacagcacagcgggtcccagagagagaagccctggtggtgctgcacgaagacgtgcgtcttacattcgcccaactcaaagaggaagtcgacaaagccgccagcgggttattgtccatcggcctgtgtaagggggacaggcttggaatgtgggggccgaactcctatgcatgggtgctgatgcaactggcaacagcccaggccatggagcttgaatacgtactgaagaaggttggttgtaaagctctggttttccccaagcaattcaagactcagcaatactataatgtcctgaagcagatctgtcccgaggtggagaatgcacagcccggtgctctgaagtcccaacgcctcccggatctcaccactgtgatttcagtagacgcacccttgcctggcactctcctattggacgaagtggtggccgccggcagcacgcggcagcatctggatcaactgcagtataaccagcagttcctaagctgccatgacccaatcaacattcagttcaccagtggtaccacaggaagtcccaagggcgctacattgtctcactataacatagtgaacaattcaaatattctcggcgaacgcctgaaattgcatgaaaaaacacccgagcagctgagaatgattctgcccaatcccctgtaccactgccttgggtctgtcgcagggacgatgatgtgtctgatgtacggcgcaacactgattttagcctctcccatattcaatggcaaaaaggctctggaggctataagtagggagagaggcacattcctgtatgggacacctactatgttcgttgatattctcaatcagcctgactttagtagttacgacattagcaccatgtgtggcggtgttatcgccggaagtccagctcctccggaattgataagagcgatcataaacaaaattaacatgaaagacctggtcgtggcgtatgggaccacagaaaactcccctgtgacattcgctcactttcccgaagacacagtggagcaaaaagccgaatcagtgggtagaataatgccacatactgaggccagaatcatgaatatggaggccggcaccctcgctaaactgaacacccctggagagctgtgcatcagaggttactgcgtcatgcttggatactggggtgaacctcagaaaaccgaagaggcagttgatcaggacaaatggtattggactggagatgtagctaccatgaatgagcaggggttctgtaaaattgtggggaggtctaaagacatgatcatacgcggaggcgaaaatatttacccggctgaactggaagatttcttccatacacaccctaaagtgcaggaggttcaggtggttggcgtgaaggacgataggatgggcgaggaaatttgtgcttgtatcaggttaaaagatggcgaggagacgaccgtcgaggagattaaggctttctgtaaaggcaagatcagtcattttaaaattcccaaatacatcgtctttgtcactaactaccccctaaccatttccggaaaaattcagaaattcaagctgagggaacagatggaacgtcatttgaacctctag

SEQ ID NO: 107084 - DNA, 1719 bp, Artificial Sequence
  Description of Artificial Sequence: Synthetic coding sequence
atggccgtgtacgtcggcatgctgcggctggggcggctgtgcgccgggtcatcgggggtgctgggggcccgagcagccctgtccaggtcctggcaggaagctcgtctgcaaggtgtacgattcctgtcatctcgggaggtggaccggatggtttcgacccccatcggtggactgtcatatgtccaggggtgtactaagaaacacctgaattctaaaaccgtgggccagtgcctggagaccacagcccagcgcgtccccgaaagagaagcattggtcgttcttcatgaggacgttagacttaccttcgcacagctcaaagaagaagtcagcgtgaaccccgcgtatcaggcgatggaactggagtatgttctgaagaaggtgggatgcaaagctctcgtcttcccaaagcagtttaagacacagcagtattataatgtgttgaagcagatctgccctgaagtggagaacgcccagccaggcgccctgaagagccagcggctgccggatctcaccaccgtcatctcagtcgacgcacccttgcccgggacactgcttctggatgaagtcgtcgcagccggcagcacaagacagcatctggatcagctgcagtacaaccagcagtttttgagctgtcacgatccaattaatatccagttcacctccggcactactggctctcccaagggagctaccctaagccactacaacattgtcaacaattcaaacatcctgggggagaggttgaagcttcacgagaaaacgcccgagcagttaaggatgatccttcccaatcccctttaccattgcctgggcagtgtggctggtactatgatgtgtctcatgtacggtgctacattgattttggccagccccatttttaatggaaagaaggcccttgaggcaattagccgtgaaaggggtacatttctctatggcactccaaccatgtttgtggacatactgaaccaacccgatttctctagttatgatatttctaccatgtgcggcggggtgattgcaggaagcccggccccaccggaattgattcgagcaatcattaacaaaattaatatgaaagacctggttgtcgcctacggcacaacagaaaactcacctgtgactttcgctcatttccctgaggatacagtagagcaaaaagctgaaagcgtgggccgtatcatgccccataccgaggctaggatcatgaacatggaggccggtacacttgcaaaactaaatacccctggcgagctctgcatacggggttattgtgtgatgctgggatattggggggaaccccagaaaactgaggaggccgtcgaccaggacaagtggtattggaccggggacgttgcaacgatgaacgaacagggcttttgcaaaatcgttggtcggagcaaagacatgataatacgcggtggcgagaatatctaccctgcggagctggaagatttttttcatacacaccctaaagttcaagaggtgcaggtcgtgggcgttaaggatgaccggatgggggaagagatatgcgcttgtattagactaaaggacggggaagaaaccaccgtggaagagataaaggcattttgtaaaggtaaaatctcacattttaagattcctaaatacattgtgttcgtgactaactacccccttacgatatccggaaaaatccagaagttcaagttgcgagagcagatggagagacatctgaatctgtag

SEQ ID NO: 107085 - DNA, 1368 bp, Artificial Sequence
  Description of Artificial Sequence: Synthetic coding sequence
atggagctggaatacgtcctgaaaaaggtcgggtgcaaagcgctcgttttccctaagcagttcaagacgcagcagtactacaacgtgctcaagcagatttgtcccgaggtggaaaatgcccagcccggggcactcaaatcccagagactcccagacctcacgacagtgatcagcgttgatgcaccactgccaggcacattacttctagatgaagtggttgcagcaggatctactcggcagcatctggatcagctgcagtacaatcagcagtttctgtcttgtcacgatccaatcaacattcagttcacgtccggcactactgggtctcctaaaggggcaacacttagtcactacaatattgtgaataactcaaatattctcggggagaggctgaagctgcatgaaaagacaccggagcaactccgcatgatactgcccaatcccctttatcactgccttggcagtgtggcgggtacaatgatgtgtttgatgtatggggctactctaattcttgcttcccctattttcaacgggaagaaagcgctggaagcaattagcagggaaaggggcacttttctgtatggcacacctactatgtttgttgacatcctcaatcaacccgacttctcaagctacgacatttccaccatgtgtgggggcgtcatcgcaggaagcccggcaccccccgaactaatacgcgctataattaataagatcaatatgaaggacctggttgtagcatatggcaccacggaaaactccccggttacctttgcacacttccctgaggataccgtggagcaaaaggcagaatctgtgggccggatcatgccacatacagaggccaggattatgaatatggaagcagggacccttgcaaaactgaatacaccgggggagctctgtatccgaggctactgtgtgatgctgggctactggggggagccacagaaaaccgaggaggcggttgaccaggataagtggtactggaccggggacgtcgccacaatgaatgagcaaggtttttgcaaaattgtgggtagatcgaaggatatgattatacgcgggggcgaaaatatttatcccgcagagctggaagattttttccatacacaccctaaagtacaggaggttcaggtggtgggcgtcaaagacgatcgtatgggcgaagaaatttgtgcatgcatccgcctgaaggatggcgaagaaactactgtggaggaaattaaagctttttgcaaagggaaaatctcccactttaagattcccaagtacattgtttttgtcaccaactaccctctaactatttcaggcaagatccaaaagttcaaactccgagaacagatggaacggcatctgaatctttag

SEQ ID NO: 107086 - DNA, 1731 bp, Artificial Sequence
  Description of Artificial Sequence: Synthetic coding sequence
atgctgccacacgtcgtgctcaccttccggcgactgggctgcgctctggctagctgtagactggccccagctcgacatagaggcagcggtctcctgcatacagcccctgttgccaggagcgaccggtccgctccagtgttcacgcgcgcactggcattcggagacagaatcgcgcttgtcgatcagcacggcaggcacacctatcgagagctctactctagaagcctacggctctctcaggagatatgcaggctttgcggttgtgtgggaggggatcttcgcgaggaaagagtgtcgtttttgtgtgccaatgatgcttcatacgttgtggcacagtgggccagttggatgagcggcggtgtggccgttcccttatatcggaagcaccctgctgcgcagctcgaatacgtaatctgcgattcgcagtccagcgtagtactcgccagtcaggagtacctggaactgctcagccccgtcgtgcggaagctgggtgtgcctcttctgcccctgaccccagccatttacacaggagccgtcgaggagcccgccgaagtccccgtaccagagcagggctggagaaacaaaggagccatgatcatctacacctccggtaccaccgggcgtcctaaaggggtgctctcaactcaccagaacatcagagccgtggtgaccggtctagtgcacaagtgggcctggactaaagacgatgtcattctgcacgtgctgcccctgcaccacgttcacggggtggtaaacgccctcctatgcccgctttgggtgggagccacatgcgtgatgatgcctgagttttcccctcagcaagtttgggagaagttcctcagctctgaaactcccaggatcaacgtgttcatggccgtcccaactatctacacaaaactcatggaatattacgacaggcacttcactcagccccacgcgcaggatttcctcagggccgtatgtgaggaaaagatccggctgatggtgtctggctcggcagcactgcccctgccggtgttggaaaagtggaagaatatcacgggccacacgctgctggagaggtacggtatgacagaaatcgggatggcattgtcggggccgctgactactgctgtacgcctgcccggctccgtgggcactcctctgccaggcgtgcaagtccgcatcgtcagtgaaaaccctcagcgtgaagcctgtagctatactatccacgcggagggcgacgagcgtggaaccaaggtgacacctggattcgaggaaaaagaaggagagctgctagtccgaggtccatccgtttttagagaatactggaataagccagaagaaaccaagtctgcatttactttggacggctggtttaaaaccggcgatacagtggtctttaaagacggccaatattggattcggggacgaacttccgtggacatcattaagactggaggatacaaggtgagtgctctcgaggtggaatggcacctattggcacatccctctatcactgatgtggcagttattggtgtacctgatatgacgtggggccagcgcgtgaccgctgtggtaacacttagagaaggccattccctttctcacagggaacttaaagagtgggcacggaacgtcctggcgccatatgccgtgccatccgagctggtgctggtggaggagattccaagaaaccagatgggaaaaatcgacaaaaaggccctgattcggcacttccacccctcttag

SEQ ID NO: 107087 - DNA, 1731 bp, Artificial Sequence
  Description of Artificial Sequence: Synthetic coding sequence
atgctcccccacgtggttctcacctttcggagactcgggtgcgcgctcgccagttgccgcctggccccagcccgccacagaggatccggcttgctgcacaccgcccccgtagccagatctgaccgttctgcgccagtcttcactcgtgcactggctttcggcgatcggattgcattggtggatcagcatggccgccatacatatcgagagttatattcacggtctctacggttgagtcaggagatctgtcgcctctgcggctgcgtgggcggagacctcagagaggagagagtatcgttcctgtgcgcaaatgacgcttcctatgtcgtggcccagtgggctagctggatgtcaggcggagtggcagtacctttataccgcaaacaccccgccgcgcaactcgagtatgtaatatgtgactcccagagctctgtggttctagctagtcaagaatacttggagttactgtcaccagtagtgagaaaattaggggtcccactcctccccctcaccccagcaatttacaccggagcagtggaagaaccagcggaggttcccgtgcccgagcaggggtggaggaataagggggccatgatcatttatacttccggcactacggggcggcccaaaggcgttctaagcactcatcagaacatcagggccgtagtcaccggcttagttcataagtgggcctggactaaagacgatgtcattctccacgtcctacccctgcatcatgtgcatggcgtggtaaacgccttgctatgccctctgtgggtgggagcaacctgtgtgatgatgcccgaatttagcccacagcaagtatgggagaaattccttagctcagagacccccaggatcaatgtttttatggcagtgccaaccatttacacaaaacttatggagtactacgaccgtcatttcacccaaccccacgcgcaggacttcttgcgtgcagtgtgtgaagaaaagattagattgatggtgtctggaagcgccgccttgccactgcccgtgctcgaaaagtggaagaacatcaccgggcacacactgctggaacggtatggcatgaccgaaatcggcatggccctttctggcccgctcactacggccgtacgccttccgggcagcgtgggaacgcctctccccggagtccaggtgaggatcgtgtcagagaacccccaaagagaagcatgttcatataccattcacgcggagggtgacgagaggggaaccaaagtcacacccggcttcgaggagaaggagggagagcttttggttcgaggcccttctgtctttagagagtactggaataaaccggaagagactaagtctgcattcacgctagatggatggtttaagacaggtgacacagtggtgttcaaggacgggcagtactggattaggggccggacatccgtggatattatcaagacaggtgggtacaaagtttcggcactggaagtggagtggcatctgctggctcacccatccatcacagacgtggccgtgatcggggtgcccgatatgacatggggtcagcgcgtgaccgctgtagttactctgagagagggacactctctgtctcatcgcgagttgaaggagtgggctagaaacgtgcttgccccctacgcagtgcctagtgagctggtgttggtggaggaaatcccccgcaatcaaatgggcaaaattgacaaaaaggccctaatcaggcacttccatccatcatag

SEQ ID NO: 107088 - DNA, 714 bp, Artificial Sequence
  Description of Artificial Sequence: Synthetic coding sequence
atgctccctcatgtggtcctgacttttagacggctcggatgtgccctagctagctgcaggttggccccagcccggcaccgtggaagtggactgttgcacactgctccagtcgccagaagcgaccgcagcgctccagttttcacccgagcattggcttttggagaccgcatcgcccttgtggatcaacacggccgacatacctatcgcgagctctactcccgctcactgagactgtcccaagagatttgccggctctgcggctgcgtcgggggagacctgagagaggaacgagtgtcgtttctttgcgccaatgatgcttcctacgtggttgctcaatgggcaagctggatgtccggaggcgtagccgtgcccctgtaccggaagcatcctgcggcccagctcgagtatgtaatttgcgattctcagtcttctgtggtgttagcgagccaggagtatcttgaattgttgagccccgtagttcggaagttgggagtaccactgctgccccttacccccgcaatctacactggagcagttgaagagcctgctgaggtgccagtgccggaacaaggatggcggaataaaggggccatgatcatctatactagcgggacaacaggccgccctaagggagtcctgtcgactcaccagaatattcgcgcagtggttactggcttggtgcacaagtgggcctggacaaaagatgacgtttag

SEQ ID NO: 107089 - DNA, 2097 bp, Artificial Sequence
  Description of Artificial Sequence: Synthetic coding sequence
atgcaggcccacgagttatttcggtactttagaatgcctgagctggttgatttcaggcagtacgtgaggactctgcctaccaacaccctgatgggcttcggggcttttgcggcattaacaaccttttggtatgccacccgccctaagcccctgaagcctccctgtgatctgagcatgcagtccgtggaggtggccgggtctggaggtgcaaggcgaagtgcactgctggactctgacgagcctctcgtctacttctacgatgacgtcactacgctttacgaaggcttccagcgcggtatccaagtgtcaaacaacggcccatgcctcggcagtcggaagcctgaccagccttatgaatggttgtcttataagcaggtggctgagctgagtgaatgtatcggcagcgcgctgatccagaaagggtttaagaccgcccccgaccaatttatcggtatttttgctcaaaatagacctgagtgggtcattattgagcaaggctgtttcgcctactctatggtcattgtgccattgtacgataccctggggaatgaagctataacctacatagttaacaaggctgagctctctctcgttttcgtcgataagccagaaaaagctaagctgcttttggagggcgtagagaacaaactcatacccggattgaaaattatcgttgtcatggacgcctatggatccgaactcgttgagcgcggccaacggtgtggggtcgaagtgacgagcatgaaagccatggaggatcttggtagggccaatcggagaaagccgaaaccgcctgctcctgaagacctggcagttatttgttttacctccggaactacgggcaatcctaaaggggccatggttacacatcggaatattgtgtccgactgttccgcgtttgtgaaggccactgagaacaccgtgaatccatgtccggatgacaccctgatttcttttctgcctctggcacatatgttcgaaagagtggtggaatgcgtaatgctctgtcacggagccaaaatcggtttctttcaaggggacatcagacttcttatggacgatctgaaggtgttgcagcccaccgttttcccagtcgtgccacgtcttctgaaccggatgtttgaccgtatctttggccaggcaaacaccacactcaaacgatggctattggatttcgctagcaagaggaaggaagctgaactcaggagtggcattatccggaacaattcactgtgggaccgattgatcttccataaagtgcagagctcccttggcgggagagtccggctcatggtcacaggcgcggcaccggtgtccgctaccgttctgacttttttgagggccgctctcgggtgtcaattctacgaaggttatgggcagaccgagtgcaccgcaggctgctgcctgactatgcccggggactggactgcaggccacgtgggtgctcctatgccatgcaacctgatcaaacttgttgatgttgaagagatgaactacatggccgccgagggggagggggaggtttgcgtaaaagggcccaatgtcttccagggctatctgaaggaccctgcaaagaccgccgaggctctggacaaggatggttggctgcacaccggcgatatcggcaaatggcttcctaacggcactctaaagatcattgatcgcaaaaaacacattttcaagttggcccagggagagtatatcgcccctgagaagattgaaaacatctacatgcgcagcgagcccgtggctcaggtctttgtccatggtgaaagcctacaggcctttctgatcgccatagtcgttcctgacgtcgagacactctgcagttgggcacagaagaggggcttcgaagggtctttcgaagagctgtgtcgaaacaaggatgtcaagaaagccatactcgaagacatggtcaggctgggcaaggactccggccttaagccttttgagcaggtgaagggcattactctgcaccctgagctgttctccatcgataacggtttgctcaccccaacgatgaaggcgaagaggcccgagctgagaaattacttccgcagccaaatcgatgacctctattctactataaaggtgtag

SEQ ID NO: 107090 - DNA, 1584 bp, Artificial Sequence
  Description of Artificial Sequence: Synthetic coding sequence
atggttatcgtccctctgtatgataccttaggtaatgaagccatcacctacattgtgaacaaagccgaactctcactggtgttcgtcgacaaaccagagaaagctaagctgttactcgaaggcgtggagaataaactcatacccggcctcaagatcatcgtcgttatggacgcttacggatctgagctggtagaaagaggccagagatgcggcgtcgaagtcacttccatgaaagcgatggaggatctcggacgggccaacaggcgtaagccaaagcctccggcccctgaggatctagcagtcatctgtttcacgtccggtaccactggcaatcctaagggagccatggtgacccataggaatatcgtatcagattgcagtgcatttgtgaaagccaccgaaaacaccgttaatccttgccctgatgataccctcatcagctttctgcccctcgcccacatgttcgagagagtcgtggagtgtgtgatgctgtgccacggggccaagattggattcttccagggtgatatacgactgcttatggacgatctcaaggtgctacagcctacggtgtttcccgtggtgccacgacttctaaatcgaatgttcgaccggatctttggtcaggcaaacacaaccctgaagcgctggttgcttgactttgctagcaaaaggaaggaggctgagcttcggtcaggcattatccgaaacaattccctgtgggatcgccttatctttcacaaggttcagtcatcgttggggggcagagtccgcctcatggtgacaggtgccgcacctgtctctgcgacagtgctgactttcctgcgtgcagccctgggatgtcagttctacgaagggtacgggcagactgagtgtaccgccggatgttgccttactatgccaggcgactggactgccggccacgtgggggccccaatgccatgcaacctgattaagctggtggatgtggaggaaatgaactatatggctgcagaaggcgagggtgaagtgtgcgtaaagggacccaacgtattccagggctatctgaaggaccccgccaagaccgctgaggcacttgacaaggacgggtggctccacaccggcgacatagggaagtggttgccgaatggcaccctgaagatcatcgatcgcaaaaagcatatctttaaattggcccagggagaatatatcgccccggagaagatcgagaatatctatatgaggtccgagccagttgctcaagttttcgtccacggggagagcctacaggctttcctgatcgctatcgtcgtaccggacgtagaaaccctctgctcctgggcccagaaacggggatttgagggttcttttgaggaactttgtaggaacaaggacgtcaaaaaagccatcctcgaggacatggtcaggctgggtaaagattctggactaaaaccattcgagcaggttaaaggcatcaccttgcatcctgaactgtttagtatagacaatggcctactgacgcctactatgaaggccaagagaccagagctgcgaaactactttcgctcgcagattgacgacctttatagcaccatcaaagtatag

SEQ ID NO: 107091 - DNA, 1584 bp, Artificial Sequence
  Description of Artificial Sequence: Synthetic coding sequence
atggtcatagtcccattgtatgacactctgggaaacgaggcaattacctacatcgtgaataaagcagagctctcgttggtgttcgtggataaaccagagaaggctaaattgcttctggagggcgtggaaaataagctgattcctggcttgaagattatcgtagtcatggatgcatacgggtctgagcttgtggagcggggccagcgctgtggcgtcgaagtgacatctatgaaagcgatggaagatttaggccgagctaatcgtcgtaaaccaaagccacctgccccggaagatcttgcggttatatgttttacaagcgggaccaccgggaacccaaaaggggctatggtcacccatcggaacatcgtctctgattgtagtgccttcgtgaaggcaactgagaatacggttaacccttgcccagatgatacactcatctcatttttgcccctggcacatatgtttgagcgcgtcgtggaatgtgtgatgttgtgccacggagccaaaattggctttttccagggcgacattcgcctgctgatggatgacctgaaggtactccagcctaccgtgttcccggtggtgccgcggctcctgaatcggatgtttgaccgtatctttggtcaagccaacaccacactgaaaagatggctgctagattttgcctcaaaaaggaaagaagcggaactgcgaagtggtatcatacgtaacaactctctttgggatcggctgatattccacaaagtgcagtcatcactgggtggccgcgtccgtctgatggtgaccggggctgcccctgtgagtgcaacagtcctgacctttttgagagccgccctgggctgtcagttctatgagggctatggacagacggaatgcactgccggctgctgcctgacgatgcctggagactggacagccggccacgtgggggccccaatgccttgcaatctcattaaactagtggacgtagaagaaatgaactacatggccgcagagggagagggtgaagtgtgcgtgaaaggcccaaatgtgtttcaggggtatctgaaagacccagctaaaacagccgaggctcttgacaaagatgggtggcttcacacaggtgatataggaaagtggcttcctaacggcaccctgaaaattatcgaccgtaaaaagcatatttttaaactggctcagggtgagtatattgccccagagaaaattgagaatatctatatgaggtcagaacctgtggcccaggtctttgtgcacggcgagtcactgcaggcatttctgattgctattgtggtcccggatgtcgagacgttgtgttcttgggcccaaaagagaggtttcgagggctctttcgaagaactgtgcagaaacaaagatgtcaagaaggcaatcctcgaggacatggttagattgggtaaggatagtggactgaaacccttcgaacaggttaaagggattaccctgcaccctgagctgttcagcatagacaacggcctgcttacacctacaatgaaagcaaagcgtcctgagctcaggaattattttagaagccagattgatgacctttacagcactattaaagtgtag

SEQ ID NO: 107092 - DNA, 2097 bp, Artificial Sequence
  Description of Artificial Sequence: Synthetic coding sequence
atgcaggctcatgagttgtttcgttactttaggatgcctgaacttgtggattttaggcagtatgttcgcaccctgccaaccaacaccctcatgggctttggcgcattcgcagcactcaccacattttggtatgctacaaggccgaagcccctgaaaccaccctgtgatctctctatgcagagtgtcgaggtggccggaagtggaggcgcacgaagatctgcgctgctggacagcgacgagccactggtctacttctacgatgacgtgactactctgtacgaggggtttcagagaggcattcaggtaagcaacaatgggccatgtttaggcagcagaaagcccgaccagccttacgaatggctgtcctacaagcaggtggccgagctgtccgaatgtatcggaagcgccctgattcagaaaggtttcaagacagcccccgaccaattcatcggtatctttgcccaaaatcgcccggagtgggtcattatagaacaaggctgtttcgcctactctatggtgatagtgccactatacgacacattgggaaacgaggcaatcacttacatcgtaaacaaagctgaactttcactggtgtttgtggataagcctgagaaagccaagttgctcctcgaaggcgtggagaacaaacttatccctgggctcaagattatcgtagttatggatgcgtacggtagtgagcttgttgagcgcgggcagcggtgtggtgtggaggtgacatcaatgaaggccatggaggaccttggtcgcgcaaataggagaaaacccaagccccctgccccagaagatctggcagtgatttgtttcacctcagggaccaccgggaaccccaaaggggccatggtaacacaccggaatattgtcagtgattgttccgccttcgtaaaagccacagagaacacagtcaacccttgtcctgacgataccctcattagttttctgccattagcgcacatgttcgagcgtgtcgtggaatgtgtgatgctgtgtcatggcgccaagataggcttcttccagggggacattcgcctgcttatggatgacctgaaggtgcttcagccaacggtgtttcccgtggtgccaagactgttgaaccgaatgttcgacagaatctttggacaagcgaacaccacattgaaacgatggctcttagactttgcatccaaaagaaaggaggctgagctcaggtcaggtatcatacggaataatagcttgtgggaccggctcatatttcacaaggtgcagagcagcctgggtggaagggtcaggctcatggttaccggagcagctccagtgagcgcaacggtcttgacatttctgcgggctgctttggggtgtcagttctacgaaggttacggccagactgaatgtaccgctggttgctgtcttaccatgcctggggattggaccgctggccacgttggagccccaatgccatgcaacctcatcaagctcgttgacgtggaggaaatgaattatatggcagctgagggcgagggcgaagtgtgtgtgaaaggacccaacgtgttccagggttacctgaaggacccagcgaagacagcagaggcgctagacaaggatgggtggttgcacactggcgacattgggaagtggctgccaaatggtacactgaaaatcatcgatcgtaagaaacacatctttaaactggcccaaggcgagtacattgctccagaaaaaatcgaaaatatctatatgagatcagagcccgtggctcaggtgtttgtgcacggagagagcctgcaggcattcctgatcgctatcgtggtgcccgacgttgagactttgtgcagctgggctcagaagagaggctttgaagggtcattcgaggagctgtgtagaaataaagatgtgaagaaggcaatccttgaagacatggtcaggttgggcaaggactctggcctgaagcctttcgagcaggtcaaggggattacactccatcctgagctgttctcaattgacaacgggctcctgactcctaccatgaaggctaagaggccggagttgagaaattactttaggagtcagatagatgatctctattctacaattaaagtgtag

SEQ ID NO: 107093 - DNA, 1995 bp, Artificial Sequence
  Description of Artificial Sequence: Synthetic coding sequence
atgcaggcccatgaacttttccgctactttcgcatgccggaattagtggacttcagacaatatgttaggacactccccacaaatactctgatgggattcggggcattcgccgccctgactacattctggtatgcaactagaccgaagccgctgaaaccaccgtgtgacctgagtatgcaatcagtcgaagttgccggctcaggtggggccaggagatctgccctgttggattccgacgaaccccttgtgtatttctatgacgacgtcactacactttacgaaggcttccagaggggtatccaagttagtaacaacggcccatgccttgggagccgcaaacccgatcagccttatgagtggctctcttataagcagtgggtaattattgaacagggttgttttgcctattcaatggttattgtccctctctatgatacactgggaaatgaagccattacctacatcgttaacaaggcagagctgagtcttgtgtttgtcgacaaacccgaaaaagccaaactgctgctcgaaggcgtggaaaataagcttatcccaggactgaagatcattgtcgtgatggacgcctacgggagtgagctggtcgaaaggggccaacggtgcggcgttgaggtgacgtccatgaaggcgatggaagatctgggaagggccaatcggcggaagcccaagccaccggcgccggaggatttggccgtgatctgcttcactagtggaacaacaggcaatccgaaaggcgccatggttacacacaggaacattgtaagtgattgctcagcatttgtgaaggccacagagaacactgttaatccctgtccagacgatactctcatctcattcttgcccctggctcacatgtttgaaagagtcgtggaatgcgtgatgctttgccacggtgcgaaaatagggtttttccagggtgacatcagactgctgatggacgacctgaaagtcctccaaccaacggtatttccagtggtgccccgtctgctcaaccgaatgttcgatcgcattttcggccaggctaacaccacgcttaaacgttggctgctcgattttgcatcgaaacggaaagaggccgagctgagaagcggcatcattcggaacaattccttgtgggatcgccttattttccacaaggtccagtcgtcacttgggggacgcgtgaggctcatggttacaggggcagcccctgtgtcagcgaccgtgttgactttcctcagagctgccctgggctgccaattttacgaggggtacggtcagactgagtgtacagccggctgttgcctgacaatgcccggcgactggacagccggccacgtgggcgcgcccatgccctgtaaccttataaagctggtggacgtggaagagatgaactacatggccgcagagggtgagggagaggtgtgtgttaagggccctaacgttttccagggctaccttaaagatcccgctaagaccgcagaggcactggacaaggacgggtggctgcacactggagatatcggcaaatggctgccaaatggaacgctgaaaatcatcgacaggaagaagcatatttttaagcttgcccagggcgagtacatcgcccccgagaaaatagaaaatatatacatgagaagtgaacccgtcgcccaggtgtttgtgcatggagaaagtctgcaagcattcctgattgcaatcgttgtaccagatgtagagaccctctgttcttgggcccagaaacgaggcttcgagggctcctttgaggagctgtgtcgcaataaagatgtgaaaaaggctatccttgaagatatggtccgccttggaaaggacagcggactaaagccctttgagcaggtgaagggcatcacactgcaccctgaactgttctccattgacaatgggttactcacaccaaccatgaaagccaaaaggccagagctgagaaattacttccgcagccagattgacgatctgtacagtacaattaaagtttag

SEQ ID NO: 107094 - DNA, 2097 bp, Artificial Sequence
  Description of Artificial Sequence: Synthetic coding sequence
atgcaagctcatgaattgttccggtacttccggatgccagaattagtggactttcgacagtatgtgagaactcttcccactaacactttaatggggtttggcgctttcgccgcccttactacattttggtacgcaacaaggcccaagcccctcaagcccccttgtgacctctcaatgcagtcagtcgaagtggcaggctccggtggggcccggagaagcgctctcctagattcggacgagccgttggtgtacttctatgatgacgtgacaaccctatatgaaggttttcaacggggcatacaggtgtccaataacggtccttgccttgggtctaggaagccggatcaaccttacgagtggctgtcctacaaacaggtggctgaattaagcgaatgtattggcagcgctctgattcagaaggggttcaagaccgctccagaccagttcatcgggatcttcgctcagaaccgtccagagtgggtgatcattgagcagggttgttttgcttactctatggtgatcgtcccactctatgacactctgggtaacgaggcaatcacatatatcgtcaataaagctgagctttccctagtgttcgtcgataaacccgagaaagctaaacttctgttagaaggagttgagaataaactcatcccaggcctgaaaatcatcgtggttatggacgcctacggtagtgaactcgtcgagcgcggccagcgctgtggtgtggaggtgacgtccatgaaggccatggaggacctagggagagccaaccggaggaaaccaaagcctcccgcacccgaggatcttgctgttatatgttttacatctgggacaaccggtaacccaaaaggagccatggtaacgcaccgtaatatcgtctcagattgctctgccttcgttaaggcaaccgaaaatacagtgaatccttgcccagacgacacactaatctcatttctgccattggcacacatgttcgagcgagttgtcgagtgcgtgatgctatgccacggcgcaaagatcggcttctttcagggtgacatccggctcctcatggatgacctcaaggtgttgcaacctacagtttttcccgtcgttccacgcttacttaatcgaatgtttgatagaattttcggacaggccaataccacactcaagcgatggctcttagactttgcctctaagaggaaggaagctgaacttagaagcggcataattcgtaataacagcctttgggaccgactgattttccacaaggtgcaaagcagcctgggcggaagagtccgcttgatggtcactggtgcagctcccgtgtccgctacggtgttaaccttcctgcgcgctgcattgggatgccagttctacgaaggctacggacagaccgaatgtaccgccggctgctgcttaacgatgcccggcgactggactgccgggcatgttggagctcccatgccgtgcaacttgatcaaacttgtggacgtcgaagaaatgaattacatggctgccgaaggagaaggagaggtctgtgtgaagggcccaaatgtcttccagggatacctgaaagacccagctaaaacagccgaagctctcgataaggacggctggctgcatacaggggacattggtaaatggttacctaacggcactttaaaaatcattgaccggaagaagcacattttcaagcttgcacagggagagtacatcgctcccgaaaaaattgagaatatctatatgagaagtgagcctgtagcccaggtgttcgtgcatggcgagagtctgcaggctttcctgatcgcaatagtggtgccagacgtagagaccctatgctcctgggcacagaaacgcgggtttgagggaagtttcgaagagctttgcaggaataaagacgtcaagaaagcaatcctggaggatatggttcgcttaggaaaggatagcggactgaagccctttgagcaggttaaggggattacactgcatcctgagctgttttctatcgacaacggcctcctaacacctacaatgaaggccaaacgtccagaactaagaaactacttccggtcccagatagacgatttatacagcacgattaaggtatag

SEQ ID NO: 107095 - DNA, 2163 bp, Artificial Sequence
  Description of Artificial Sequence: Synthetic coding sequence
atgaacaaccatgtcagctcgaaacccagtactatgaagctcaagcacaccatcaatcctatcctgttgtatttcatccacttccttatttctctgtataccatcctaacctacatacctttttatttctttagcgagagcaggcaagaaaagtctaatcgaatcaaagctaaaccagtgaatagtaagcctgatagcgcctacagatccgtgaactccctggatgggctggcctctgtcctgtacccggggtgcgacactttagacaaagtctttacctacgccaagaacaaatttaagaacaaaagactgctaggaaccagagaggtattaaatgaggaagacgaggtccagcccaatggcaaaattttcaagaaagtgatcctcggacagtataactggctaagctatgaagacgtctttgttcgggcatttaatttcgggaacggcctgcaaatgttagggcaaaagcccaagaccaacatagccattttttgcgaaacacgggcagagtggatgattgccgctcaagcctgtttcatgtacaacttccagctcgtgaccctgtacgctactctcggaggacccgccattgttcacgcgttgaatgagacagaggtcactaatatcattacatccaaagaactcctacaaaccaagctgaaggacatcgtgagtctagtgccacgccttagacacattattaccgtcgatggcaaaccccctacctggtctgagtttcctaaaggaatcatcgtgcatactatggccgccgtagaagccctgggcgccaaagccagcatggaaaatcagccccacagtaagcctctgccctcggacattgcggtgataatgtacacatcaggatctacagggctgccaaagggagtaatgatcagtcattcgaacattattgccgggatcaccggaatggcagagaggattcccgagctgggggaagaggacgtgtacattggctacctccctttggctcatgtcctggagttaagcgctgaactcgtatgcttgtcccacggctgccggattgggtactctagccctcagaccctcgccgaccaatcctctaaaattaaaaagggctccaagggagatacatctatgctgaagccaacgttgatggccgccgtacctgaaatcatggatcggatctacaaaaacgtcatgaacaaagtgtctgaaatgagcagttttcaacggaacctttttattctcgcttacaattacaagatggaacagatctccaagggccgaaacactcctctgtgcgattccttcgtgttcaggaaggtacgctccctcctcggcgggaatatcagactactcctgtgcgggggcgcccctctgtccgcaaccacgcagcgctttatgaatatttgcttctgttgccctgtcgggcaaggatacggtctgacagaaagtgcaggcgcagggactatcagcgaggtttgggactataataccggccgtgtgggcgctccattggtctgttgcgagatcaagctgaagaattgggaggagggagggtatttcaacactgataaaccccacccaaggggtgagattctgatcggcgggcagtctgttacaatggggtactataaaaacgaagcaaagaccaaggccgatttcttcgaggatgagaacggacagaggtggctgtgcacaggcgatatcggagagttcgaacctgacgggtgccttaagataatagacagaaaaaaagatctcgtcaagctgcaagccggcgaatacgtgtccttgggcaaggtagaagcagctttgaaaaacctgcccctggtcgacaacatatgcgcttacgcaaactcttaccacagctatgtgatcggatttgtggtaccaaaccagaaggaattgactgagctcgctcgtaagaaaggactcaagggcacctgggaagaattgtgcaattcctgtgaaatggaaaatgaggtgctgaaggtgctgagcgaagccgccatctcggcatctctggaaaagtttgagattcctgtgaagatccgcctgtcacccgagccttggacccccgagaccggtcttgtgaccgacgcattcaaactaaaaagaaaggagttgaagacacactaccaggccgacatcgagagaatgtatgggaggaagtag

SEQ ID NO: 107096 - DNA, 2163 bp, Artificial Sequence
  Description of Artificial Sequence: Synthetic coding sequence
atgaataatcacgtgtcaagtaagcccagtacaatgaagttaaagcataccatcaaccccattttattatactttattcacttcctcatttccctgtacaccattctcacctacatcccattttattttttttccgaatctaggcaggaaaagtccaatcggatcaaggcaaagcctgtcaattcgaagccggacagtgcatataggagcgtaaactccttagacgggctggcatctgttctgtaccctggttgtgatacactggataaggtgtttacatacgcaaaaaacaagttcaagaacaagcggctgctggggacaagggaggtgctgaatgaagaagacgaggtgcagccaaatgggaaaatttttaagaaggtgatacttggccaatacaattggttaagctacgaggacgtgtttgttagggccttcaattttggaaatggactgcagatgctgggtcagaaaccaaagacaaatattgctatcttctgtgagacgagagctgagtggatgatcgcagcccaggcatgtttcatgtataacttccagttggttacactgtacgccacactcgggggccctgccatagtgcacgcactgaatgaaaccgaggtgactaatattataacatctaaagaactccttcagacgaagctgaaagatattgtgagcctggtgcccaggctcaggcacattatcactgtggacgggaagccaccaacgtggagcgagtttcctaagggaatcattgtacacaccatggcggctgtagaggcgttaggggccaaggcctccatggagaaccagccacattccaagcccttgccaagcgacatcgctgtgataatgtacaccagcggctccaccggactgccaaagggcgtcatgatcagccactcaaacatcatcgccggcatcaccggcatggctgagcgcatccccgagctgggcgaagaagatgtctatatcgggtatcttcctctcgcacatgtcctagaactgtcggctgaactggtctgcctgtcccacggctgccgaattggatacagctcaccacagaccctggccgatcagtcctcaaagatcaagaaggggtcaaaaggagacacgtcgatgcttaaacctactttgatggcagccgtgccagagattatggaccggatttataagaacgtgatgaataaggtgtcagagatgagttcgtttcaacgaaatttattcatcctggcatataactacaagatggaacaaataagcaaggggcgcaataccccactgtgtgacagcttcgtcttcaggaaggtaagaagtctgctcgggggcaatatcaggctgctcctgtgcggcggcgctccgctgtccgccactacacaacgcttcatgaatatctgtttttgttgccccgtcggacagggctatggattgacagagagcgctggtgcaggaacaatctccgaagtgtgggactacaataccgggcgagtaggtgccccactggtatgttgcgagatcaagctgaagaactgggaggagggcgggtacttcaacactgataaacctcatcctaggggcgagatcctaataggtggtcagtccgtgacaatgggatactacaagaatgaggcaaaaaccaaggccgattttttcgaagacgagaacggacagcgttggctgtgcaccggcgatattggcgaattcgagcctgacggatgtctgaagattatcgatagaaagaaagacctggttaagttgcaggctggcgaatatgtgtcccttggtaaggtcgaagccgctttgaaaaacctccccctcgtggataacatctgtgcctacgcaaactcctaccacagctacgtgattggcttcgtggtgcctaaccagaaagagcttactgagctggctaggaagaagggcctgaagggcacctgggaggagctgtgtaattcctgcgagatggaaaacgaggtcctgaaggtattaagtgaggccgccattagcgcctccttggagaaattcgagatccctgtaaaaattcgtctttcacctgaaccctggacccctgaaactggactagtcacagatgccttcaaactgaagaggaaggagctaaagacacactatcaggccgatattgagagaatgtacggtaggaaatag

SEQ ID NO: 107097 - DNA, 267 bp, Artificial Sequence
  Description of Artificial Sequence: Synthetic coding sequence
atgaataatcacgtgtcttcgaagccgtctaccatgaagcttaaacatacaattaatcccatactgctgtattttatccactttctcatctccctctacaccatccttacttatattcctttctacttctttagcgaatcacgtcaggagaagtctaacagaatcaaagccaaaccagttaactccaaacccgacagcgcctaccgatccgtgaactcactggatggattagcgagcgtgctgtacccaggttgcgacacactttag

SEQ ID NO: 107098 - DNA, 288 bp, Artificial Sequence
  Description of Artificial Sequence: Synthetic coding sequence
atgaacaatcatgtgtcctctaaaccaagcaccatgaaactgaaacacacaattaatcccatcctgctttacttcatccacttcctcatatcgctgtacacaattctcacttatattcctttctattttttctccgaaagccgacaggagaaatctaatagaatcaaagccaaacctgtaaactctaagccagattccgcatacaggagcgtgaattctctcgacggacttgcctccgttctgtatccgggttgcgatacattggacaaagtgttcacctatgcatag

SEQ ID NO: 107099 - DNA, 2052 bp, Artificial Sequence
  Description of Artificial Sequence: Synthetic coding sequence
atgcttttcatcttcaactttttgttctcaccgctgcctacgcccgccctgatttgcatcctgaccttcggagctgcgattttcctttggcttatcacccggccgcaacctgtcctcccactcctggacctgaataaccagagcgtaggcattgagggaggtgcaagaaaaggggtgtctcaaaagaataatgatctgacaagctgttgtttctctgacgcaaagacaatgtatgaggtctttcagcgaggactggccgtgtctgacaacggaccctgtctggggtaccgaaaaccaaaccagccttaccggtggctgagttacaagcaggtctcagatagagcagaatatctgggctcttgcctcctccacaagggatataagtcttctcccgaccagtttgtaggaatttttgctcagaatcggccggagtggatcatctcagaacttgcatgctatacctactctatggttgcagtgcccctgtacgatacactcggaccggaggctatcgtacacatcgtcaataaggcagatatcgcaatggttatctgcgataccccgcagaaggccctggtactaattggtaacgtagaaaagggctttactccctctctgaaggtcatcattctgatggacccttttgatgatgacctgaagcaacgcggagaaaagtccggaatcgaaatcttatccctgtatgacgcggaaaacttaggcaaggaacacttccgaaagcctgtccccccaagtcccgaggacctctctgtcatatgttttacttctggcacaaccggtgatcccaaaggggccatgattacacatcagaatattgtgtcaaacgctgccgcattcttgaagtgcgtggagcatgcttacgagcccaccccagacgacgtggctatcagctacttgcccctcgctcatatgttcgagcggatcgtgcaggcagtggtgtacagctgcggggccagggtggggttttttcagggagacatccggctgctcgcagatgatatgaagacactgaagccaactctgtttcccgcggtcccacgactcctgaatcgtatttatgacaaagtgcaaaatgaggctaaaacaccactgaaaaaattcctactgaagttggcggtctcatcaaagttcaaggagttgcaaaaaggcatcatccgacatgattctttttgggacaagttaatcttcgccaagattcaggacagcttggggggtcgcgtgagggtgattgtgaccggagccgctcctatgagcacaagcgttatgacctttttccgcgccgccatgggatgccaggtctatgaggcctacgggcagacagaatgcaccggggggtgcacctttacactgcccggggactggacatccggccatgtcggagtgcctctggcatgcaactatgttaaactggaagacgtagctgacatgaactatttcactgtgaataatgagggcgaggtatgcatcaagggcaccaacgtgtttaaggggtacctgaaggatccagaaaaaactcaggaggcccttgacagcgatgggtggttgcataccggcgacatcgggaggtggctcccaaacggcactttaaaaatcatagaccgtaagaagaatatctttaagttagcccagggcgagtacattgcgcctgaaaagattgagaacatttacaaccggtctcagcctgtgcttcaaatctttgtacacggcgaatccctgaggtcctcactggtaggggtggtagtgccagatacagacgtgctgccatcttttgctgcaaagctgggggtgaagggctcttttgaggaattgtgtcaaaatcaggtagttagggaggctatcttggaggacctgcagaagatcggcaaggaaagcggccttaagacttttgagcaggtcaaagctatattcctacaccccgaaccatttagtattgaaaatggcctgcttaccccaactctcaaagctaagagaggggaactctcgaagtattttcggacacagattgattctctttacgagcatatccaggactag

SEQ ID NO: 107100 - DNA, 2052 bp, Artificial Sequence
  Description of Artificial Sequence: Synthetic coding sequence
atgttgttcattttcaattttctctttagtcctcttcccacgccggcactgatttgtattttaacctttggcgccgcaatatttttgtggttgataacccgtccacagcctgttctgccactcctagacctgaacaatcaatctgtggggatcgaaggcggggctagaaaaggagtctctcaaaagaacaacgacctgacaagttgctgcttttccgatgccaaaactatgtacgaggtcttccagcgggggcttgctgtgtctgataatgggccctgccttgggtaccgcaaaccaaatcagccttatagatggctctcctataaacaggtttccgatcgggctgagtatctcgggagttgcctcttgcacaaaggatataaaagtagcccagatcagttcgtcggaattttcgcccagaatcggccagagtggatcatctctgaactcgcctgctacacatattctatggtggcagtccctctgtacgacacgcttggcccagaagctattgtgcacattgtcaataaggctgacattgccatggtgatttgtgataccccacagaaggccctggtgttaatcggcaacgtggaaaaagggttcacaccctccctcaaagtcatcatcctgatggatccttttgatgatgatttgaaacagagaggagaaaagagtggtattgagatcctcagcctgtacgacgccgagaatttgggcaaggagcattttagaaagcctgtaccccctagccccgaagatctttctgtgatatgttttacatctggtactaccggagacccaaaaggagccatgataactcatcaaaatatagtgagtaatgctgcggcctttctgaagtgtgtagagcacgcctatgagcctactcctgacgatgttgccatctcctacttgccactggcccatatgtttgaacggattgtccaggccgttgtgtatagttgtggcgctcgtgtgggtttttttcagggcgatatacggctgctggctgatgacatgaaaactctgaaaccaactctctttcctgcagtccctaggttgctcaaccgcatatacgataaggtgcaaaacgaagccaaaactcccctaaagaagttcctgctaaaattggcggtctctagtaagtttaaggagctccagaaaggcatcatacgccatgactcattctgggacaagctgatattcgctaagatccaggatagtctgggcggaagggtcagggtcattgttacaggagcggctcccatgagtacttcggtgatgactttcttccgagcagctatgggttgccaggtttacgaggcatatggccagacagaatgcacaggcggatgcacgttcacgctgccaggagattggacttccggacacgtgggggtgccactggcctgcaattatgtgaagctcgaggacgtggctgacatgaattatttcacagtgaataatgagggcgaagtgtgcattaaaggcacgaacgtcttcaaaggatatctgaaggatccagaaaaaacccaagaagctcttgattcggatggatggctgcacactggcgacatcggcagatggcttcccaatgggacgctaaaaatcatcgaccgcaagaagaatattttcaagctcgcccagggggaatacatcgcccctgaaaagattgagaatatctacaacaggtcgcagcccgtcctgcagatcttcgtgcacggcgaaagcctccgttcatctcttgtgggggtggtggttccagatacagatgtattgcctagctttgcggccaaactcggcgtgaagggctctttcgaggagctgtgtcagaaccaggtagtcagagaagcaatactggaggatctgcagaaaatcggcaaggagtcaggattaaaaacttttgaacaagtgaaggccatctttctgcaccccgagccgtttagtatcgagaacgggctcctgaccccgacacttaaagcaaagcggggcgagctgtcaaaatactttcgtacacagatcgattcactgtatgaacatattcaggactag

SEQ ID NO: 107101 - DNA, 2220 bp, Artificial Sequence
  Description of Artificial Sequence: Synthetic coding sequence
atggatgcgctgaaaccgccatgtctatggagaaaccatgaacgcggtaaaaaagacagagattcatgtgggcgaaaaaattcggagccaggaagcccacatagcttggaggcccttagggatgccgctcccagccagggccttaatttcctcttactgttcaccaaaatgctgtttatattcaactttttgttctctcctctgcccacccccgcattgatctgtattctgaccttcggagccgccatttttctgtggttgattacacgaccacaacctgtgctccccttgctggacctgaacaatcagtctgtcggaattgaagggggtgccaggaagggggtttctcaaaaaaataacgatctcaccagctgttgtttttccgacgctaaaactatgtacgaagtgtttcagcggggcttggccgtgagtgacaatgggccatgccttgggtaccgcaaacccaaccagccctacagatggttgtcatacaagcaggtctctgaccgcgctgaatacctcggttcgtgtcttttacataaggggtacaagagcagcccagatcaatttgtcggaatctttgctcagaaccggcctgaatggatcatctctgagctagcctgttatacatattccatggtggccgtgcccctctatgatactctcggccccgaggctatcgttcacatcgtgaataaggctgatatcgcaatggtgatctgtgataccccacagaaagcactggtgctgatagggaacgtggaaaaagggttcactccatcactgaaggtcatcatcctgatggatccattcgacgatgatcttaagcagcggggcgagaagtccggaattgagatcctcagcttgtatgacgcagagaatctgggaaaggagcactttcggaaaccagtgcctccctcgccggaggacctgtctgtgatttgctttactagcggcaccaccggtgacccaaagggtgccatgatcacacaccagaacattgtgagtaacgctgcagcctttctcaagtgtgtggaacatgcctacgagccaaccccggacgacgtcgctatttcatatttgcctctggcccatatgttcgagcgaatcgtccaggccgtggtttattcatgtggggcccgggtggggttctttcagggcgacattaggctgcttgctgacgatatgaaaaccctgaaaccgaccttgtttcccgctgtgccccgactcctcaacagaatctacgataaggttcaaaacgaagccaaaactcctctcaaaaagtttctcctgaagctggccgtgtcaagcaaattcaaggagttacagaaaggcatcatcaggcatgattccttttgggataagttaattttcgccaagatccaggattccctgggaggccgagtacgggtgattgtgaccggggccgctccaatgagcacaagtgtgatgactttcttcagagccgccatgggatgccaggtgtacgaggcctacggccagaccgaatgcacagggggttgtactttcaccctgccaggtgactggacgtccggacacgttggcgtgccgctagcctgcaactacgtcaaactggaggatgtagctgacatgaactacttcactgtgaacaacgaaggagaggtttgcatcaagggaaccaacgtattcaaaggataccttaaggatccggagaaaacgcaggaggcgctcgatagcgatggctggctacacaccggcgatattggccgttggctgcccaatggcaccttgaagataatcgaccggaaaaaaaacattttcaaattggcccagggcgagtatatcgcccctgagaagatcgagaacatctataatagatctcagcccgtccttcagatttttgtgcacggcgaatctctgagatctagtcttgtgggggtggtcgtacctgacaccgatgtgctgccttcctttgctgcaaaactgggcgtgaaagggtctttcgaagagttgtgccagaaccaagtggtgcgggaagctatcctggaggaccttcagaaaataggaaaagaatccggcctgaaaacattcgaacaagtgaaggccatctttctacaccctgaaccattcagtattgagaacggcctgttgacacccacgttaaaggcgaagcgcggtgaactctcaaagtacttccgcactcaaatcgattccctatacgagcatatccaggactag

SEQ ID NO: 107102 - DNA, 1398 bp, Artificial Sequence
  Description of Artificial Sequence: Synthetic coding sequence
atgctttttcccggtgcctccatcgtgcctgagtgctggttgctggttctgattcagaacttaggaaaggagcatttcagaaaacccgttcccccttcccccgaggatctgagtgtgatttgtttcacctcggggactaccggcgatcccaagggtgcgatgattacgcaccagaacattgtgagcaacgccgcagcatttctcaagtgtgttgaacacgcctatgagcccactccagatgacgtggctattagctatctgccactggcccacatgttcgagaggatcgtgcaggctgttgtatatagttgcggtgcccgtgtgggtttcttccagggagatatccgcctgctcgcagatgatatgaagacacttaaacctacgttgtttcccgctgtcccaagattgctaaaccgaatttatgacaaggtccagaacgaagctaaaactccgctcaagaagttcctgctgaagctcgccgtgtcatctaaattcaaagaattgcagaaaggaatcatcaggcacgactcattctgggacaaactgatcttcgccaaaatccaagatagtctggggggcagagtgcgggtgattgtgacaggtgcagctcccatgagtacgagtgtgatgacctttttcagagcagctatgggatgtcaagtgtatgaggcctacgggcagaccgagtgtactggtggctgtaccttcacgttgcctggcgactggacaagcggccacgtgggagtgcctctggcttgtaattacgttaagttggaggatgtggctgacatgaattacttcaccgtgaacaacgagggagaagtttgtatcaagggtactaatgtgttcaagggctacctgaaggatcccgagaaaactcaggaggcattagactcagacggctggcttcacacaggtgacattggcagatggctcccaaatggtacactgaagataattgatagaaaaaagaacatttttaagctcgcacagggcgaatacattgctcctgaaaagatagaaaacatttacaatagatctcagcctgtcctgcaaatcttcgtccacggcgagagccttcgcagctccctcgtgggtgtagtcgtccctgacacagatgtcttgccgtcatttgctgccaagctcggtgtgaagggaagctttgaggaactgtgtcagaaccaggtggtgagggaagccattcttgaagatctgcagaagataggcaaggaaagcggactcaagacttttgaacaagtaaaggcgatttttctgcacccagagccattttcgattgagaacggcctgctcacacccacactcaaggctaagagaggggaactgtcaaagtacttccgcacccagatcgactccttatatgagcatatccaagattag

SEQ ID NO: 107103 - DNA, 2052 bp, Artificial Sequence
  Description of Artificial Sequence: Synthetic coding sequence
atgttgttcatttttaacttcctgttcagtcccctccctacaccagccctcatctgtatcctgacatttggagccgccatttttctgtggctgattaccaggccccaacccgtgcttcccctcctggatctgaataaccagtcagtggggatcgaaggcggcgcaaggaaaggcgtgtctcaaaagaacaacgatctgacctcttgttgtttttccgacgccaagactatgtatgaagtgttccagcgcgggctggccgtatccgacaatggtccctgtttggggtaccgcaaacctaatcagccgtacaggtggctaagttataagcaagttagtgacagggccgaatatttaggctcatgcttgctgcataagggatataagtcgagccctgaccagttcgtaggaatcttcgctcagaaccgccccgaatggattatatccgagctggcctgttatacgtattcaatggtggccgtaccactctacgacaccctggggcctgaggctatagtgcacattgtcaataaagcggacatcgccatggtgatttgcgacaccccacagaaggcgctggtgctgatcgggaatgttgagaaaggtttcacaccgtctctaaaagtgatcatcttgatggacccttttgatgacgatttgaaacagaggggcgagaagtcagggattgaaattctgagtctttacgatgctgagaatcttgggaaggagcacttccggaagcctgtcccacccagccctgaagacctcagtgttatctgcttcacttcaggcactacaggcgacccaaaaggtgcgatgattacccatcagaacatcgtgtccaacgctgcggcctttctaaagtgcgtcgaacacgcatatgaacccaccccagacgacgttgccatttcctatctgccccttgcacatatgttcgagagaatcgttcaggccgtagtgtatagctgcggagctagggtgggatttttccagggcgacattagactgctggcggacgatatgaagacactgaagcccaccctgttccccgcagtgccaagattactcaatcgaatctatgacaaagtgcagaacgaggctaaaactcccctgaagaagttccttctgaagctggccgtgtcttcgaaatttaaagagctgcagaagggaataatccgtcacgattccttttgggacaagcttatatttgctaaaattcaggacagcctagggggccgagtgcgagttatagttacaggggctgcccctatgtctacctctgtgatgacatttttcagagccgccatgggttgccaagtctacgaggcttatggtcagacggaatgtacaggaggttgcactttcacgctgcctggagattggacatccgggcatgtgggtgtgcctctggcctgcaactacgtgaagctggaagatgtcgccgacatgaattactttacggtgaacaacgagggagaggtgtgcatcaaggggaccaacgtttttaagggttacctgaaggatcctgaaaagacgcaggaagctttggatagtgatggttggctccacacaggagacataggcagatggctacccaatggcaccttgaaaatcatagacaggaaaaagaatattttcaagttagctcagggggaatacatagcacctgaaaagatcgaaaacatatataaccggagtcagccagtcctgcagatatttgtacatggagagagtctccgcagttccctggtaggcgtggtcgtcccagataccgatgtgctcccgagtttcgcagccaagcttggagtgaaaggatctttcgaggagctctgccagaaccaagttgtcagagaggccatcctggaggatctgcaaaagatcggcaaagagtccggattaaagacattcgaacaggttaaagccatttttctgcatcccgaacctttcagtatcgagaatgggctgctgacacctactctcaaagccaaacggggggagctttccaaatacttccgtactcagatcgacagcctctatgagcacatccaggattag

SEQ ID NO: 107104 - DNA, 1980 bp, Artificial Sequence
  Description of Artificial Sequence: Synthetic coding sequence
atgttattcatttttaattttttgttttctcccctgcccacgcccgcgctgatttgcattctgacattcggggccgctatttttctatggcttattacccggccacagccagtgttaccgctgcttgacctgaataatcaatctgttgggattgaaggcggagctcgcaagggtgtgtcacaaaaaaacaacgatctcacgagttgttgctttagcgacgccaagacaatgtacgaggtcttccagagggggctcgcagtctccgacaatgggccttgcctggggtacagaaaaccaaatcaaccataccggtggctgtcctataaacaggtctcggatagggcagaatacctcgggtcctgcctcctacacaagggatacaagtcgagcccagatcagttcgtggggatcttcgcccagaaccggccagagtggattatctctgagttagcatgctacacgtactccatggtggctgtgccactgtacgatacactagggccagaggcgatcgtgcacatcgtaaataaggccgacatcgctatggtcatttgtgataccccccagaaagcgttagttttgatcggaaatgtcgagaaaggattcacacccagcctgaaggttatcatcctcatggaccccttcgacgacgacctcaagcaaaggggagagaagtcaggaatagaaatactgtccctttacgatgccgaaaatttaggcaaagaacacttccgaaagccagtccccccgagccccgaggacctttccgtgatctgctttacaagcggtacaactggagatccgaaaggcgcgatgatcacacaccaaaatattgttagcaatgccgctgctttcctcaagtgtgtcgaacacgcatacgagccaacccctgatgatgtggccatttcatatcttcccctggcccacatgttcgaacggatagtgcaggccgtggtgtatagttgtggtgctcgtgttggattttttcagggagacattcgactcttggccgacgacatgaagactttaaagcccaccctttttcccgctgtgccaaggttgttaaatcgcatatatgataaggttcagaatgaagcaaaaacgcccctgaaaaagttcctgctgaaactggcagtcagttccaaattcaaagagctccagaagggcattatcagacacgactctttttgggataagcttatcttcgcaaaaatccaggatagtctggggggacgggtcagagtgattgtcaccggcgcagcccctatgtcaaccagtgtcatgaccttcttccgggccgccatggggtgccaggtgtatgaagcctacggccagaccgaatgcaccgggggctgcaccttcacactgccaggtgattggaccagcggtcatgtgggggttcctttggcatgcaattacgtgaagttggaggacgtggccgatatgaactatttcaccgttaacaatgagggcgaagtgtgcattaaaggcaccaacgtcttcaaggggtatctgaaggacccagaaaaaactcaggaggccctagattctgatggttggcttcacacgggggacataggacgctggctccctaatgggacactcaaaataattgaccggaaaaaaaatatcttcaagttagcccaaggcgagtatatagcccctgagaaaatcgaaaacatttacaaccggagtcaaccagttttgcagatattcgtccacggcgagagtcttcgcagttcactcgtgggtgtcgtagtgccagatacagacgtgctcccatcctttgccgctaagctcggtgtcaaaggatcctttgaggaactgtgccagaaccaggtcaaggcaatattcctccatccagagcccttttcaatagaaaacggtttactaacacccaccctgaaggccaagcgaggtgagctcagtaagtacttcaggacacagattgattctttgtatgaacatattcaggactag

SEQ ID NO: 107105 - DNA, 2169 bp, Artificial Sequence
  Description of Artificial Sequence: Synthetic coding sequence
atgctgacattcttcctagtgtcaggaggtagtctgtggttatttgtcgaattcgtactgagtctgctggagaaaatgcagacacaagaaatactgcggatactgcgtctccccgaactcggggaccttggacaattcttccgatctcttagtgctacaacactggtcagcatgggtgctctcgctgccatcctggcttactggttcacgcatcgccctaaagcattacagcccccctgcaatttgttgatgcagagtgaagaagtcgaagattctggaggagcaaggaggagcgtgatcgggtcggggccccagttgctcacacactattacgatgatgctcggaccatgtaccaagttttccgtcgcgggctgagcataagcggcaatgggccttgtttggggttcagaaagccaaagcagccatatcaatggctctcgtaccaagaggttgctgacagggcggagttcttggggagtggcctcctgcaacataactgcaaggcctgcaccgatcagttcatcggcgtcttcgcccagaaccgccctgaatggatcatcgttgaactggcttgttacacttatagcatggtcgtggtgcctctttatgatacgcttgggccaggggccattagatacattatcaatacagcggatatttcaaccgtgattgtggacaagcctcaaaaggctgtgctccttctggagcatgtagaacgcaaagaaacaccgggcctcaaattgatcatcctgatggatccattcgaagaggctctgaaggagcgcggtcagaaatgcggcgtggtaattaaatccatgcaggcagtagaggactgcggccaggaaaatcaccaggcgcccgtgcccccgcagcccgatgacttgtctattgtctgctttacctcaggaactaccggcaatccgaagggggcaatgctgacacacgggaacgtagtggccgacttcagtgggtttttgaaggtcaccgagagccagtgggcccccacttgcgcagacgttcatatcagctacctgccattagcccatatgtttgagcgcatggtgcaatcagtagtttactgccatggcggccgcgtcggattcttccaaggggacattagattacttagtgacgacatgaaagccctgtgccctaccatcttccctgttgtcccccgtcttttaaaccgtatgtatgacaagatcttttcacaggccaacacaccactcaagaggtggcttctagaattcgccgctaagagaaaacaagcagaggtcaggtctggtatcatcaggaacgactccatatgggacgaattgtttttcaataaaattcaggcctctctgggtggatgtgtaagaatgatagttacaggtgcagcaccagcctctccaactgtgctaggttttctcagagctgccttggggtgccaggtatatgaaggctatggtcagacagagtgtacggccggctgtactttcactactcccggcgattggacttcagggcatgtcggggcccccctcccttgcaatcatataaagctggttgatgtggaggaactgaactattgggcctgcaagggggagggcgaaatctgtgtcagaggaccgaatgtgttcaaggggtatttgaaggatcccgatagaactaaggaagcgctagacagtgatggctggctccacactggcgacattgggaaatggctacccgccggcactttaaagataattgaccgcaagaaacatatatttaagctggcccagggcgagtatgttgcccccgaaaagatcgagaatatctatatcagaagtcagccggttgcacagatctatgtgcacggagactcactgaaagcttttctggtaggcattgtggttccagatccagaggttatgccctcctgggctcagaagcgcggaatcgaaggcacctacgctgacctctgtacaaacaaggatctgaaaaaggctatccttgaggatatggtgcgcctgggaaaggagtctggactccacagcttcgagcaggttaaagccatccacatccatagtgacatgttcagtgtgcagaacggattgctcactcccacgcttaaggccaaaagacccgaattacgggaatatttcaaaaaacaaatcgaagagctatattccataagcatgtag

SEQ ID NO: 107106 - DNA, 1869 bp, Artificial Sequence
  Description of Artificial Sequence: Synthetic coding sequence
atgcagactcaggagatccttaggatcctgcggttgccagagctgggagatctcgggcaattttttagaagtctgtcagcaactacactagattctggaggagcaagaaggagtgtcattggaagcgggccccagctgttgacccactactatgatgatgcccggaccatgtaccaggttttccgacgcgggctgagtatctcaggcaatggcccgtgcctggggttccgcaagcccaagcaaccatatcagtggcttagctatcaggaggtcgccgacagggccgaatttctcggttcaggactcttgcagcataactgcaaggcttgcaccgatcagttcatcggcgtcttcgctcaaaacaggccggaatggatcatcgttgagctggcttgctatacctatagcatggttgttgtgccactgtatgatactctgggccctggcgcaatccggtatattatcaacaccgccgacatcagcactgtgattgttgacaaacctcagaaggccgtgttgctgctcgagcacgtggaaagaaaggagacccctggactcaagctcattatcctcatggatcctttcgaagaggctctgaaggaaaggggacagaagtgcggtgtcgtgatcaagagcatgcaggccgtcgaggactgcggccaagagaaccaccaggctccagtcccaccacagcctgacgacctctccattgtctgtttcacttccggaactaccggcaatccaaagggagctatgcttactcacggcaacgtcgtggcagacttttccggcttcttgaaggtgaccgagggcgacatacggctactgagtgatgacatgaaagccttatgtcctaccatctttcccgtcgtccccagacttctaaaccgcatgtacgacaagatcttttctcaggccaacacacccctcaaaagatggctattggaattcgctgccaaacgcaaacaagccgaggttagatcaggaatcatccggaacgattccatctgggatgagctgtttttcaataaaatccaggcctcattaggaggatgtgttcggatgatcgttactggagcagcaccggcgagtccgacggtgctgggatttctccgggccgcgttggggtgccaggtatacgaggggtacgggcagaccgaatgtacggctggatgtactttcacgacgcccggcgattggacgagtggtcacgtgggggccccgttaccatgcaatcacatcaaactggtggatgtggaagagctgaattactgggcctgtaagggagagggcgaaatatgcgttagaggccccaatgtgttcaagggttatttgaaagatcccgaccgtacaaaggaagccctcgactccgacggctggctacacaccggcgatatagggaaatggttgccagccggaacacttaagataattgatagaaaaaaacacatcttcaaactggctcaaggagagtatgtggccccagagaagatcgagaatatctatattcgtagccagccggtggctcagatctacgtgcatggcgacagcctgaaggcctttctcgtggggatagtagtgccggatccagaggtgatgccctcatgggcccaaaagcgcggcattgagggcacatatgctgatctttgcacaaacaaggacctgaagaaagcaattctcgaggacatggtgaggcttggcaaggaatccggcctccatagctttgagcaagtgaaagctatccacattcattccgacatgttctctgtccaaaacgggttgcttactcctactctgaaagccaagcggccggagctcagggaatatttcaagaagcagatagaagaactttatagtatatccatgtag

SEQ ID NO: 107107 - DNA, 2094 bp, Artificial Sequence
  Description of Artificial Sequence: Synthetic coding sequence
atgcagacccaggagatactccggattctacgcctcccagagctgggagacctgggccagtttttcaggtcactgtccgcaacgacccttgtatctatgggcgccctcgccgccattcttgcctattggtttactcaccgccccaaagccctgcagccaccctgcaatctgctgatgcagtccgaagaagtggaggatagtggcggcgcaagaagatcagtaatcggaagcgggcctcagctccttactcactattacgacgacgccaggacaatgtaccaggtctttaggcggggcctatcaataagtggtaatggcccctgcctgggctttcgcaaaccaaagcaaccatatcagtggctatcctaccaggaggtcgccgaccgcgctgaattcctcggcagcgggcttctccagcacaactgcaaggcttgtacagaccagttcattggcgtgttcgctcagaaccgtccagagtggattatcgttgaactcgcctgctatacttactccatggttgtagtcccgctctatgacacattgggaccaggagcaatccgctacatcatcaacaccgctgatatatccaccgtgattgtggataaaccacagaaggccgttctgctgctggaacacgtagagcgcaaggaaacccctggcctgaagttgatcattctaatggatcccttcgaggaggccctgaaggagcgcggacagaagtgcggggtagtaatcaagagtatgcaggcagtggaagattgcggtcaggagaatcatcaggcccccgtccctccacaacccgacgatctttcaatagtttgttttacatccggtacgacgggcaaccccaagggagccatgctaactcatgggaatgtggtcgcagatttctccgggttcctgaaggtcactgaaaaagttatctttccaagacaggatgatgtactcatctcatttctgccattggcccatatgtttgaacgggtcatccagtcagtggtgtactgtcacggggggcgcgttggatttttccagggcgacatcagactgctgtcagacgatatgaaagccctgtgccctacaatcttccccgtggtgccacgcctactaaacaggatgtatgataagatctttagtcaagctaacacacccttgaagcgttggttgcttgaatttgccgcgaagcggaagcaggcagaagtaagaagcggcatcataaggaatgactctatctgggacgagctattcttcaacaaaattcaggcgtccctcggcggatgcgtgcgaatgattgtcaccggggcagctcctgcttcccctactgtgctgggatttctcagagccgccctgggctgtcaagtgtacgagggctacggccaaacagaatgtactgctggttgtaccttcacaaccccgggcgattggaccagcggacatgtgggagcccctctgccgtgcaaccatatcaagttagtcgacgttgaggagttgaactactgggcttgcaagggagagggagagatatgtgtgcgagggccaaatgtgttcaagggctacctgaaggatccagacagaaccaaggaggccctggactcagacgggtggctccacacaggtgatatcgggaaatggctgccagctgggaccctcaagatcatcgatagaaagaagcacatctttaaactagctcagggagaatacgtggcaccagaaaaaatagagaacatatacatccgatctcagcctgtggcccaaatttacgtgcatggagattcactcaaagccttcctcgtgggcatcgtggtgcccgatccggaagtcatgccgtcctgggcacaaaaaaggggaatagaaggcacgtatgctgacctttgcactaataaagatctaaagaaggctatcttagaggatatggttagactgggtaaggaatcaggtctccacagcttcgagcaggtcaaagccatccacattcattccgatatgttttctgttcagaatggtcttcttacgccaacgctaaaagccaaaagacctgaactccgggagtactttaaaaagcagatcgaagaactatatagtatctccatgtag

SEQ ID NO: 107108 - DNA, 2094 bp, Artificial Sequence
  Description of Artificial Sequence: Synthetic coding sequence
atgcagacccaggagatcctgcgaatactgagactcccggagctcggtgacttgggccagtttttcagatctctgtctgccacaacattggtctccatgggagccttagcagctatccttgcttactggtttacacaccgaccaaaggccctccagcctccttgtaacctgttgatgcagtcagaagaggtcgaggattccggaggcgcacgcaggtcagtcattgggtcagggccacagctgctgacacactattacgacgatgcgcgcaccatgtatcaggtatttaggcgaggactctccatcagtggaaatggtccctgtctgggcttccgcaaacctaaacaaccctatcagtggctgtcatatcaggaagtcgccgacagggccgagttcctggggtccgggttactgcagcacaattgcaaagcatgtaccgatcagtttatcggtgttttcgcacagaacaggccagaatggattatagtggaactggcctgctacacttacagcatggtggtcgtgcctctatacgatactttaggacctggagccatcaggtatattattaacactgcggatatcagcactgtgattgtggataagccacagaaagccgtgttactcctggagcacgtggagcggaaggagactcctgggctcaagctgataatactaatggatcccttcgaggaggcccttaaggagagaggccaaaaatgtggtgtcgtgattaagagtatgcaagcagtggaggactgtgggcaggagaaccaccaggcgcccgttcctcctcagcccgacgacctgtctatagtctgttttacaagcggaaccacaggaaaccctaaaggagcaatgctgactcacggcaacgttgtcgctgacttttctggatttctgaaggtcaccgaatcacagtgggcaccaacctgtgccgatgtgcatataagctacctgccactcgcacacatgtttgagagaatggtgcagtccgtggtgtattgccacggagggcgcgtgggcttctttcagggcgatattcggcttcttagcgatgacatgaaggctctgtgccctacaatctttcccgtagtccccaggctgctcaaccgaatgtatgacaagatctttagtcaagctaacactcccctgaagaggtggctgctggagtttgccgcaaaaagaaaacaggctgaggtccggtccggaatcatcaggaacgacagtatctgggacgagctctttttcaacaaaatccaggcttctctgggcgggtgtgtacggatgatcgtaaccggggctgccccagcttctcctacagtgctagggttcctgcgggctgccctgggttgtcaggtgtatgagggatacgggcagacagagtgcacagccggttgtacgtttaccacccccggcgattggaccagtgggcatgtgggagctccactgccttgcaatcacataaaactggttgacgtggaggaactcaactattgggcttgcaaaggtgaaggagaaatttgcgtgcgtggcccgaacgtattcaaaggctatctcaaggatccagaccgtacaaaggaggccctggattccgatgggtggctgcacaccggagacatcggcaaatggctgccagccggaactctgaagatcatagaccgaaagaaacatattttcaaacttgcacagggcgagtatgtggcacctgaaaagatcgagaatatctacattagaagccagcctgtggctcaaatctatgtacatggagactcactgaaggccttcctggtgggcattgtcgtgcccgaccccgaagtcatgccctcctgggcgcagaaacggggcattgaggggacatacgcggacctgtgtaccaacaaagatttaaagaaagcgattctggaagacatggtgaggctgggtaaagaatccggcctccatagcttcgagcaggtaaaagctatccacatccactccgatatgttcagtgtacagaatggcttactgacacccaccttgaaagcaaaaagacctgagctgagagaatattttaaaaaacagatagaggagctgtattccatcagcatgtag

SEQ ID NO: 107109 - DNA, 2127 bp, Artificial Sequence
  Description of Artificial Sequence: Synthetic coding sequence
atgccagaatttgttttgtcgctccttgaaaaaatgcaaactcaggagattttacggatcctgagactaccagaactgggggacttgggacagttttttcgctcccttagcgccactactttggtgagtatgggcgcactcgccgccatcctggcctactggtttacacacaggcctaaagcgctccagcctccctgtaaccttttgatgcagtctgaggaggtggaggattctgggggggcgcgccgatccgtcattggctcaggcccccagcttctgacccattactatgatgacgctagaacaatgtaccaagtcttccgccgggggctctctatttctggtaacggcccgtgtttaggattccggaaaccgaagcaaccttatcagtggttgtcctatcaggaagtggccgatagagctgagtttctaggctctgggttgctgcagcacaattgtaaagcctgcacagaccaatttatcggtgtcttcgcacagaaccgaccagagtggatcattgtggaactcgcctgctacacctactccatggttgttgtgccactctacgatactctggggcccggggccattcggtatatcatcaacacggcggacatttcaacggtcatcgtggacaagcctcaaaaggcagtattgctactggagcacgtcgagaggaaagaaacacccggccttaaattgatcatactcatggatcctttcgaggaggctctgaaagaaagaggacagaagtgcggcgttgtaattaaaagcatgcaggctgtggaggattgtggtcaggagaaccatcaggcaccagttccacctcagcctgatgacctctctatagtctgtttcactagtgggacaacaggtaacccgaaaggggccatgctaacacatgggaatgttgtggccgacttcagtggctttttaaaagtcacagagaaagtcatttttccaaggcaggacgatgtgctgatatccttccttcctttggctcatatgttcgagcgcgtgatccagagcgtcgtgtactgccacggcggccgcgttggcttctttcagggagacatcagactgttaagcgatgatatgaaagctctatgtccgaccatatttccggtggtccctcggcttctcaaccggatgtacgataagattttctcccaggccaatactcctcttaagaggtggctgctggagttcgccgccaagcgcaaacaagccgaggtaagatccgggattattagaaacgacagcatctgggacgagctatttttcaataagatccaggcctccctgggtggatgcgtgcggatgattgtgacaggtgctgccccagccagccccaccgtattaggctttctgcgcgcggccctgggctgtcaggtgtatgaaggatacggccaaaccgagtgcacagccggttgtacttttactacacccggagactggacgagcgggcatgtgggtgcaccattgccatgcaaccatatcaagctggtggacgttgaagaacttaactattgggcctgtaagggtgagggcgagatttgtgtaagaggaccaaacgtttttaagggatatctcaaagatcctgacaggactaaagaagcattagactctgacggctggctgcatactggcgatatcgggaaatggctgcctgcgggtacgttgaagatcatagaccgtaaaaagcacattttcaaactcgcccagggggagtacgttgccccagagaaaatagaaaatatttatatccggtcccaacctgtcgcacagatttatgtgcacggagacagcctgaaggcctttttagtgggtattgtggtacctgacccagaggttatgcccagttgggctcagaaacgggggatcgagggaacctatgcggatttgtgcaccaacaaagacctcaagaaggccatcctggaagacatggtgcgcctagggaaagaaagcgggctgcactcattcgagcaagtgaaagccatccacatccacagtgacatgttcagtgtgcagaacggattgctgactcccacactcaaggccaagcggccggaactgcgggaatacttcaaaaaacagattgaggaactgtattcaatatccatgtag

SEQ ID NO: 107110 - DNA, 2004 bp, Artificial Sequence
  Description of Artificial Sequence: Synthetic coding sequence
atgcagacccaggaaattctacggattctacgccttccagagctcggtgacctcgggcagtttttcagatctctttcggccacgacgctggtatctatgggcgcactcgcggcaattctcgcatattggtttacacaccggccgaaggcactccaacccccttgtaatctgctgatgcagagtgaagaggtagaggacagtggaggtgcacgtcgctccgtgattggatcagggccccagcttttgactcactactacgatgatgctagaacgatgtatcaggtctttcgacgggggctctccatctcgggaaatgggccttgcctcggctttagaaagccaaaacagccgtatcagtggctgagttatcaggaggtcgctgatcgagctgaattcttgggttccggcctgctccagcacaattgcaaagcctgcaccgatcagttcattggtgtcttcgcacagaatcgccctgaatggataatcgtggaactcgcctgctatacatacagcatggtggtggtccctctgtatgatacccttggacccggtgcaatccggtacatcatcaataccgccgacattagcaccgtcattgttgacaaaccccagaaggctgtgctgctgctcgaacatgtggagaggaaggagacccctggcctgaaattgattatactgatggacccattcgaagaggctctgaaggagagggggcaaaagtgcggggttgtcatcaaaagcatgcaggctgtggaggactgcggccaggagaaccaccaggcccccgtgcctcctcaaccagatgacctgtccatcgtgtgcttcacaagtggcaccacgggtaatcccaagggggccatgcttacgcatggaaatgttgtggccgacttctccggatttctcaaagtaacggagtcccaatgggcaccgacgtgcgcggatgtacacattagttacttgccattggcccatatgtttgagagaatggtgcaatctgtggtgtactgtcacggcgggcgcgtggggttcttccagggagatattcgactgctctccgatgacatgaaggccttgtgtcccaccatttttcctgtggtgccccgcctactgaataggatgtacgataaaatattttctcaggcgaataccccattaaagagatggttgctagaattcgctgccaaaaggaaacaggctgaagtcagaagcggcataatccgcaatgacagtatctgggacgaacttttctttaataagatccaggcttctctcggaggctgcgtccgcatgattgtcaccggagctgccccggcttcccctacggtcttaggattcctccgagcggcgctcgggtgtcaggtttacgaggggtacggccaaacagaatgtaccgctggctgtacatttacaacaccaggggactggaccagcggacacgtaggcgcccccttgccttgtaaccacattaaactggtagacgtcgaggagctgaattattgggcatgtaaaggcgagggggagatttgcgtgcggggccctaatgtgtttaagggttatttgaaggatccagacaggacaaaggaggctctggatagcgatggatggctgcatactggtgatatcggtaagtggctgcctgctggcactctgaaaattattgatcgcaaaaagcatatatttaagcttgcccagggcgaatacgtggctccagagaaaattgagaatatctatattaggtctcagcccgttgcccagatctatgtgcatggcgacagcttgaaagcctttcttgtgggaatagtggttcccgatcctgaggtaatgccttcctgggcgcaaaagcgcggcattgaagggacctatgctgatctgtgtacaaacaaggacctaaaaaaggcaattctggaagatatggtccgcctcggaaaggagagtggcctgcactctttcgaacaggatttaccccagtgtttgatccaaatcaaagtgttcagcaagtattag

SEQ ID NO: 107111 - DNA, 2169 bp, Artificial Sequence
  Description of Artificial Sequence: Synthetic coding sequence
atgctgacctttttcctggtcagtggtgggagcctgtggcttttcgtagaatttgtcctcagtctgcttgagaaaatgcagactcaggaaatacttcgcattctcagacttcctgagctgggcgacctcggacagttcttccggtccctcagcgctactaccctcgtatccatgggggccctcgccgccatactggcatattggttcacccatagacctaaggcactgcagcccccatgcaatctcctgatgcagagcgaggaggttgaagattcaggaggagcgagaaggtccgttattgggagcggcccccagttgctcacacactactacgatgatgcgagaactatgtaccaggtgtttaggcgagggctgagtattagcggaaatgggccatgtttagggttcagaaaacctaagcagccttatcagtggctctcataccaggaagtcgctgaccgagctgagtttcttgggagtgggttgctccaacataactgcaaggcctgcaccgaccagttcataggcgtattcgctcagaacaggccggaatggatcatagttgagctagcttgttacacctatagcatggtggtggtgccgctgtacgacacgcttggccccggagcaattagatatataatcaatacagcagacatttctacagtcatagtggataaaccccaaaaggccgtgctgctgcttgagcacgtggagcgaaaggagactcccggtttaaaattgatcatcctgatggacccgttcgaggaggcactgaaggagaggggccagaaatgtggagtagtgattaagagtatgcaggcagtcgaggactgcggtcaagagaaccaccaggctccggtaccaccccagcccgatgacctgtccatcgtatgctttacatcagggaccacaggaaaccccaagggagcaatgcttactcatgggaacgttgtcgcagatttcagcgggtttctcaaagttactgaaaaggtgatatttccaaggcaagatgatgtcctcatttcgttcttgccgctggcacacatgtttgagagggtcatccagagtgtagtgtattgtcacgggggacgggtggggtttttccaaggggacatccgactgctgagcgatgatatgaaggccctatgtccaactatctttccagtcgtgccccggctattgaacaggatgtatgacaagatcttcagtcaggcgaacacccctctgaagcgatggttactggagtttgccgccaaaaggaaacaggccgaagtacgcagtggcattatacggaacgattccatctgggacgaactcttctttaacaagattcaggccagcttgggaggttgcgtgcgcatgatcgtcacgggcgcggccccagctagtcctaccgtgctcggtttcctgcgggcagctttgggatgccaggtctatgagggatatggtcaaacggaatgtacagccggatgtaccttcacgacgcccggtgactggacctctggtcatgtaggtgctccacttccgtgcaaccacattaagctggtggatgtggaggaactcaattattgggcgtgcaagggagagggtgaaatttgcgtcagaggaccgaatgtgtttaagggatatttgaaagacccggatcgcacaaaagaggctctggacagcgacggctggctccacacaggcgacatagggaagtggttgcccgcaggcaccttgaagataatcgataggaagaaacatatctttaaactcgcccagggcgaatatgtcgccccagagaaaatcgagaatatctacatcagaagccagcctgtggcccagatctatgtgcatggggacagcttgaaggcctttctggtgggaattgtcgtgccagaccccgaagtgatgccctcgtgggctcagaagcgcggaatcgagggcacatacgcagacctgtgtaccaataaggacttgaaaaaggccatcctggaagacatggtgcggctaggcaaggaatctggcctgcactcattcgaacaggtgaaagcaattcatatccactctgacatgttttctgtccagaacgggcttctcacgcctacattgaaggcgaaacggcccgaactgcgggagtactttaagaaacagattgaagaactgtactcaattagcatgtag

SEQ ID NO: 107112 - DNA, 2139 bp, Artificial Sequence
  Description of Artificial Sequence: Synthetic coding sequence
atgcagacccaggagattctgcgaatcctaaggctaccggagctcggggacctggggcaattcttccgatccctgagcgcaactacgctggtttccatgggggctctggccgctattctggcgtactggttcacacaccgtcctaaagcactgcaaccgccttgtaacctgctcatgcagtccgaggaggtggaagactccgggggagctcgccggagcgtcattggctcaggaccccagcttctcacgcattattatgacgacgctcgcaccatgtaccaagtgtttcgccggggcctgtcaattagcggcaacggtccttgcctggggttcaggaaaccaaaacaaccctatcagtggttgagctaccaagaggtcgccgacagagccgagtttctcgggagtggacttctgcagcacaactgtaaagcttgcacagatcaattcatcggcgtatttgcccaaaacaggccagagtggatcatcgtggagttggcctgttatacttattccatggttgtggttccactttatgatacgctcggaccgggcgcgattcggtatataattaataccgggttgtcctgccaggaaggagcttccgcaacggcctccactcaggcagacatcagtaccgtgatcgtagacaaacctcagaaggctgtgttgctgctggagcacgtggaacgaaaggagacccctggattaaagttgatcatccttatggacccattcgaggaagccttaaaagaaagagggcagaagtgcggcgtcgtcatcaagtctatgcaagccgttgaggattgtggacaagaaaaccatcaagcccccgtaccccctcagcctgacgatctgtccatcgtttgtttcaccagcggtactactggcaatcccaagggcgcgatgctaacacacggcaatgtggtggcagatttctctggctttttgaaagtcaccgaaaaggtgatctttccaaggcaggacgatgtgctgataagctttctaccacttgcgcacatgttcgagcgggtgattcagagcgtggtgtactgtcacggtgggcgggtcggattcttccagggggatattaggcttctcagtgatgacatgaaggccctttgcccaaccatctttcccgtggtgccaagacttctcaacaggatgtatgacaaaattttttcccaggcgaataccccgctaaagcgttggctgcttgaattcgctgcgaagcgcaaacaagctgaagtgcggtctggcattataaggaacgattccatatgggacgagctgttcttcaacaagatccaggcctctctcggtgggtgtgtcaggatgatcgtgacaggagccgctccagccagccccacagtgttaggttttctgcgcgctgcgctcggttgccaggtctacgaaggctacggccaaacagaatgtaccgccggatgtacattcaccacaccgggggattggacttctggacatgtaggcgcccctctcccttgcaatcacatcaagttggtggatgtggaggagctgaactattgggcatgcaagggcgagggcgagatctgcgtacgaggtcccaatgtgttcaagggctacttgaaagatccagaccggactaaagaggccctggattcagatgggtggttgcacacaggggacattggaaaatggctgcccgcgggcactctgaaaataattgataggaaaaagcatatattcaaactggcacaaggcgagtacgtcgcaccagaaaaaattgagaatatttacatccggtcccagcctgtggctcagatctacgttcacggcgatagcctgaaagccttcctagtcggcatagtggtgccagatccggaggtcatgccttcttgggctcaaaagaggggtattgaaggtacctacgctgacctgtgcacgaataaggatctcaagaaggcgatcctggaagatatggtgaggctgggaaaggaaagcggtcttcactctttcgagcaagtgaaagccatccatatacactccgacatgttctccgttcaaaacgggctcctgactcccacactcaaagccaagaggcctgagttgcgagagtactttaaaaagcagatcgaggaattgtacagcatcagcatgtag

SEQ ID NO: 107113 - DNA, 2094 bp, Artificial Sequence
  Description of Artificial Sequence: Synthetic coding sequence
atgcagacccaagagattctgcggatcctgcggctcccagaactcggggacctaggccagttctttcgctccctcagcgctacaaccctggtcagcatgggggccctggcagcgattctggcttattggtttacgcatcggccaaaggccctgcagcctccctgcaacttgctaatgcagagtgaggaggtggaggactctgggggtgccaggagatcggtcatcggaagtggaccacaacttcttacccattattacgatgacgcccgtactatgtaccaggtgttcaggagagggctgtcaatcagcggaaacggaccttgcctgggcttcaggaagcctaaacagccctaccaatggttaagctaccaggaggtcgcagatagggccgagttcctaggttctggcctgctccagcataattgcaaggcgtgcacagatcagttcatcggggtattcgcccagaatcggcccgagtggattattgttgagctcgcctgctatacctacagtatggtggtggtgcccctgtacgatacactgggaccaggagctattcgatatattatcaatactgcggacataagcacagtgatagtggataagccacagaaggcagtgctgctcttagagcatgtcgaacggaaagagacacctggactgaaactcatcatactgatggatcctttcgaggaagccctcaaagagcggggccagaaatgtggagttgtcattaaaagcatgcaagctgtggaggactgcggtcaggagaatcatcaggctcccgtgcctccccaaccggatgacttgagtattgtatgtttcacctcaggtacaaccggcaatcccaaaggagcaatgctgacacatggaaacgtcgtcgcggactttagcggcttcctcaaggttacagaatcacaatgggctccgacctgtgcagacgttcacattagctatctgcccctggctcatatgtttgaaaggatggtgcaatccgtagtgtattgccacgggggccgcgttgggttcttccagggggacatacgcttgctttctgatgacatgaaggccttatgtcccaccatttttcccgtcgtcccgcgcctgctcaaccgaatgtatgacaagatattttctcaagcaaacacaccgctgaagcgctggctgttggagttcgcagccaagaggaaacaggccgaggtgagaagtgggatcattcggaatgacagcatctgggacgagctgttctttaataagatccaggccagcctgggcggttgcgttcgaatgattgtgacaggcgctgcccctgccagccctacagtgctcgggtttctcagggccgcactcggttgtcaggtgtacgaaggatatggacagaccgagtgtacagccggatgtaccttcacaacccctggcgattggactagcggccacgttggtgcgccgttaccatgcaaccatattaaactagtggacgtggaagagctgaattattgggcctgcaagggcgagggcgaaatttgcgtacggggacccaacgtgttcaagggatatctgaaagaccccgatcgcaccaaggaagcactggactcagacggatggctccacacaggggatataggcaaatggctgcccgctggaaccctgaaaatcattgaccgcaagaaacacatcttcaagcttgctcagggtgagtatgttgccccagaaaagatagagaacatatatattaggagccagcctgtggcacagatttacgttcacggtgactctctgaaggcctttctggtcggcatcgtcgttcccgatcccgaagtgatgccttcctgggcgcagaaacggggcatagaggggacttatgccgacctgtgcactaataaagatctcaagaaggccatattggaggatatggtgcggcttggcaaggagtccggactgcatagctttgaacaggttaaggctatacatatccacagcgatatgttttcagtccagaacggacttttgacacccacactgaaagctaagcggccagagctcagagagtactttaagaaacagatcgaggagttgtatagtatcagtatgtag

SEQ ID NO: 107114 - DNA, 1821 bp, Artificial Sequence
  Description of Artificial Sequence: Synthetic coding sequence
atgtaccaagtgtttcgccggggtctgagtatcagcggcaacggcccatgtctcggatttcggaagcctaagcagccctatcaatggctgagctaccaggaggtggccgatagggcagagtttctcggctccggtctgttgcagcataattgcaaggcttgcacagatcagtttatcggagtgttcgcacagaaccggcctgaatggatcatcgtcgagctcgcatgttatacctatagtatggtggtggtgcccctgtatgacacgttgggtccaggagctataaggtatatcattaataccgcagacatctctaccgtcatcgtggataaaccacagaaagcggtgctgcttctggagcatgtggagcggaaggagaccccgggtcttaagctgatcattcttatggacccattcgaggaggccctcaaggagcgggggcagaagtgcggcgttgtgataaaatctatgcaggcagtggaagactgcggacaggagaaccatcaggctccggttccaccgcagccagacgaccttagcattgtgtgttttacatcagggacgaccggtaatcctaagggggccatgctgacacacggcaacgtggtcgctgacttctctggttttttgaaagtgactgagaaggtaatcttcccaaggcaagacgacgtgttgatcagtttcttgccactggcgcatatgttcgagagagtgatccagtccgttgtttactgtcacggtggcagggttggtttctttcagggagatattaggctgttaagtgatgacatgaaggccctctgtcctaccatctttcccgtggtgccccgcctgctgaacagaatgtatgataagatattcagccaggccaataccccattaaaaagatggctcctcgagttcgcggccaagcgcaaacaggctgaagtgcgctctggaatcatccggaatgattccatctgggatgagctgtttttcaataagattcaggcatccctgggtgggtgtgtgcgtatgatcgttactggcgctgcccccgcgtcacctacagtgttagggtttctgcgggcggcacttggatgccaggtgtatgagggatacggccagactgagtgcaccgccggctgcacatttaccactcccggagattggacgtctggccacgtaggtgcccccctcccctgcaaccacataaaactcgtggatgtggaggaactcaattactgggcttgtaaaggtgaaggtgaaatctgcgtaaggggccctaatgtgtttaaaggatatctgaaagatccagatagaacaaaggaggccctcgattcagacggatggctgcacacgggtgacatcggcaaatggctgcccgctggaaccttgaaaatcatcgatagaaagaaacatatcttcaaactggctcagggggagtatgttgcaccggagaagattgagaacatttacatccggtcacagccagtggcccagatatatgtccatggagacagcctgaaagcctttttggttgggattgtcgtgccggatcccgaagtgatgccgagctgggcccagaaaagaggtattgagggaacttatgccgacctctgcacgaataaggacctgaagaaagcaattcttgaagatatggtgagattgggcaaagagagcggccttcacagcttcgaacaggtaaaggcaatccacatacacagtgatatgtttagtgtgcagaatggtctcctcactcctaccctcaaagccaaacgccccgagcttcgcgagtacttcaagaaacagattgaggagttatattctatttcaatgtag

SEQ ID NO: 107115 - DNA, 1386 bp, Artificial Sequence
  Description of Artificial Sequence: Synthetic coding sequence
atgtcacgccaggtcgtccgcagtagcaaattccggcacgtgttcggccaacccgcaaaggccgaccagtgctacgaagacgtgagagtgtcccagacaacctgggatagcgggttctgcgccgtcaaccctaaatttgtagccttgatttgtgaggcaagcggtggaggcgctttcctcgtactccccctcggcaagactgggagagtggacaagaacgcccctaccgtgtgtggccatacggctcctgtgctcgacattgcctggtgcccacataatgacaatgtaatcgcatccggatccgaggactgtaccgtgatggtatgggaaatcccagatggcggcctcatgctccccctgagggaaccagtcgtgacacttgaaggtcacaccaagcgcgttggtatcgtcgcatggcacaccaccgcccagaacgtgctgctgtctgcaggctgcgacaatgttatcatggtttgggacgtggggaccggcgccgctatgctgaccttgggtcccgaagtccatccagataccatttattccgtggattggtctagagacggaggcctgatctgtacaagctgtcgggataagagagtgcgcattatcgagccacggaaagggactgttgtagccgagaaggatcgccctcacgaagggacccgcccagtcagagcagtttttgtgtcagagggtaaaatcttgacaaccggattttctaggatgtcagagagacaggtggctctctgggacactaagcatctggaagagcccttgagtcttcaggaactcgacacaagcagtggagtgttactacctttctttgacccagacactaatattgtctacttatgcggaaagggggactcgtctattcggtattttgaaatcacaagcgaagccccatttttgcactacctgagcatgtttagttccaaagaatcccagcgtggcatgggctacatgcccaaacgggggcttgaggtgaacaagtgcgagatcgcccgattttataaactgcatgagaggcgctgcgagccaatcgccatgactgttcccaggaaatcagatctatttcaggaggacttatatccaccaactgccgggccagatccagcacttactgcagaggaatggcttggcggtcgggacgcgggcccactactcatctcccttaaggacggatacgtcccacctaagagtcgcgaactaagggtgaatcgaggattggacacagggagaagacgtgccgctcctgaggcatccggcacacccagctccgacgccgttagtcgattagaagaagaaatgcgcaaactgcaggccactgtgcaagaactgcaaaagcgtctcgacagactcgaggagaccgtgcaggccaaatag

SEQ ID NO: 107116 - DNA, 1734 bp, Artificial Sequence
  Description of Artificial Sequence: Synthetic coding sequence
atgcagtggttgatgcgctttaggaccctgtggggaattcataaatcttttcacaatattcacccagcgccatcccagctcaggtgcagatccttaagtgaattcggggctccgagatggaacgattatgaagtgcctgaggaatttaattttgcctcctacgtgttggattactgggcacagaaggagaaggaagggaagcgaggtccgaaccccgcattctggtgggtgaacggacaaggggatgaggtcaaatggtcattccgcgagatgggggacttgactcggagagtcgcaaatgtcttcactcaaacctgtgggctgcaacagggagatcacttggctctgatgctccctagagtgccagagtggtggttggtggccgtggggtgcatgagaacaggaattattttcattcccgccactatcctgctgaaggcaaaagacattctgtaccgtcttcagctgagcaaggcaaaaggcatcgtcactatcgatgcgctggcttccgaggtggactccatcgcctcccaatgcccatctttgaagaccaagcttctcgtatcggaccattctcgggaggggtggctggacttcagaagcttggttaagtccgcttcccctgaacatacctgtgtgaagtctaagacccttgatcctatggttatcttctttacatccggtactacaggctttccaaaaatggccaaacactcccacggattagcactgcagccctcatttccgggatcccgtaagctgcggtcactgaagacaagcgacgtgagctggtgcctgtctgactcagggtggatcgtggcaactatatggacccttgtggagccatggacagctggttgcaccgtttttatccatcatctgcctcagttcgacaccaaggtgattatacagacactgctaaagtacccaataaatcacttttggggcgtctcttcaatttatcgcatgattctccagcaggatttcacttccatccggttcccagcactcgagcattgctatacagggggtgaggtcgtattacctaaggaccaggaggaatggaaacgccgcacagggcttctgctgtatgaaaattacggccagagtgagacgggcctcatctgtgccacgtactggggtatgaagatcaaaccgggcttcatggggaaggctactcctccatatgatgtccaggtgattgacgacaagggcagtatcctgcccccgaatacggaaggtaacatcggaattcggatcaagcccgtgcgtcccgtgtccttgtttatgtgctacgaaggtgaccctgagaaaaccgcaaaggtggagtgcggagacttctataataccggagaccgagggaagatggatgaggagggatacatttgttttcttggcaggtccgatgatattatcaacgcaagtggctacaggattggaccagctgaggtcgagtcagcactggtcgagcatcctgccgtggccgagtccgccgtggtggggagtccagaccctattcgcggggaagttgttaaagcattcatcgtcttgactccacaattcctgtctcatgataaggatcaactcaccaaggaactacaacaacacgtgaaaagcgtcactgcaccctataagtacccacgaaaggtggagtttgtatccgaactgccaaagacaattacgggaaagattgaacggaaagagctgcggaaaaaagaaaccggacagatgtag

SEQ ID NO: 107117 - DNA, 1734 bp, Artificial Sequence
  Description of Artificial Sequence: Synthetic coding sequence
atgcagtggctgatgcgattccggaccttgtggggcattcacaaatcatttcataatattcacccggccccctctcagctgcggtgtaggtctttatctgaatttggtgctcctcgctggaacgactatgaggttcccgaagaatttaacttcgcttcatatgtactggactattgggcccagaaagaaaaagaaggcaagcgaggtcccaatcctgctttctggtgggtaaacgggcagggcgacgaggttaagtggagcttccgggaaatgggtgacctcacgcgacgcgtcgcaaacgtctttacccagacgtgcggcctgcagcagggcgatcatcttgcactcatgctccctcgagttcccgagtggtggctcgtggcggtgggctgtatgcgcacagggattatcttcattcccgctaccattctgctgaaggcaaaagatatactgtaccgtctacagttatcaaaggccaaggggatcgtgacgatcgacgctctggcctcagaggtcgattctattgcctctcagtgcccttctttaaaaacaaagctgctcgtgtccgatcattcgagagaaggctggttggattttcgcagcctggtgaagtccgcaagtccagaacatacctgcgtgaaatccaaaacactggatcccatggtgatcttctttacatcaggaacaactgggtttccaaaaatggccaaacacagtcatggactcgcccttcaacccagcttccccgggtctaggaaactgaggagtctgaagacctctgacgtgagttggtgccttagcgactcggggtggattgtggccaccatctggaccctggttgagccttggacggcgggctgcacggtgtttatacaccacttacctcagttcgacaccaaggtgattatccaaacactgctcaagtatcctatcaaccacttttggggagtttcaagtatctaccggatgattctgcagcaggactttactagcatacggttccccgctctcgagcactgctacaccggcggagaggtggtgttgcctaaggaccaggaagagtggaagaggcgaaccggactccttctttatgaaaattacggacaatccgagaccgggttgatttgtgcgacttactgggggatgaaaattaaaccagggttcatgggcaaggcaacccctccatatgatgtgcaggtgatagatgataaggggagcatcctgccaccaaatactgaaggcaacatcggcattcgcattaaacccgtgcgcccagtgagtctgtttatgtgttacgaaggagacccagagaaaacggccaaagtagagtgtggagatttttataacaccggcgaccgcggaaagatggacgaggaggggtatatctgtttccttggacgttccgatgatattattaatgcaagtggatacagaattggtcccgctgaggtggaaagcgccctggtggagcatcccgctgtcgctgagagtgcagtcgtcggtagtccagatcccatcagaggggaagtggtcaaggctttcattgtactgacgccacagttcttaagccacgataaggaccagcttacaaaagagcttcagcagcatgtgaagagcgtgacggccccttataaataccctaggaaggttgagttcgtctccgaactgcctaagacaatcactggaaagattgagcgaaaggagttacgaaaaaaagagaccggccagatgtag

SEQ ID NO: 107118 - DNA, 465 bp, Artificial Sequence
  Description of Artificial Sequence: Synthetic coding sequence
atgcagtggctcatgcgcttccgtaccctatggggcatccataaatcttttcacaatatccaccctgcaccctcacagctccgatgccgctctctgtcagaatttggggccccccgatggaacgattacgaggtgcctgaagaattcaacttcgcatcctatgtgctggattactgggctcagaaagaaaaggaggggaaaagaggaccaaaccctgcgttctggtgggtaaacggtcagggtgacgaagtcaagtggtcctttagggagatgggggatttaacccgtcgagtggcaaatgtgtttacccagacgtgcggtctgcaacaaggtgaccacctggcactgatgctgcctcgcgtccccgagtggtggctagtggccgtgggttgtatgcgcactggtattatatttatccctgccaccatccttctgaaggccaaggatatcctgtacagactgtag

SEQ ID NO: 107119 - DNA, 1533 bp, Artificial Sequence
  Description of Artificial Sequence: Synthetic coding sequence
atgaggcctgggctgtcatttctgttagccctgctgtttttcctgggccaggccgcaggggacctcggtgacgtgggtcctccaattccgagtcctggttttagctcctttcctggcgttgactcttcaagctctttcagtagctctagcagatctggcagctcctcttctcgcagcttagggagcgggggtagcgtgtcacagctgtttagcaacttcaccggatccgtggacgatcgaggaacatgccaatgttcagtcagcttgcccgataccacatttccagtggatcgggttgagcggctcgaatttaccgcgcatgtgctttcccagaaattcgagaaggagctgtccaaggtgcgcgagtacgtccagctgattagcgtgtatgaaaaaaaactcctgaatctcactgtgagaatcgacatcatggaaaaagacactatttcttatactgaactggattttgagttaatcaaagtagaggtgaaggagatggagaagctcgtgattcagctcaaagaatcatttggcgggagcagtgagatcgttgaccagctggaggttgaaatccgaaatatgacgctgctggtggagaagctcgagactctcgacaagaacaacgtgctagccattagacgcgagatcgtggcgttaaaaacaaagctaaaagagtgcgaggcctctaaagatcaaaacactcctgtggttcacccgcctcccaccccagggtcctgcggccatggtggtgttgtgaacatttccaagccatccgtggtgcagctgaactggcgcggcttctcttatctgtatggcgcctggggcagggattattcccctcagcaccctaacaaggggctctattgggtggcgcctctgaatactgacggccggctccttgaatattatagactctataacaccctggatgatctcctgttatacatcaacgccagggaactccgcattacatacggacagggctctggcactgctgtgtacaacaacaacatgtacgtcaacatgtacaatacagggaatatcgccagggtgaacctgactaccaacacgatcgctgtgacccaaaccctccccaacgccgcctacaataatcgcttcagttacgctaacgtggcctggcaagatatcgacttcgcagtggatgagaacgggctgtgggtgatttattctaccgaagcttcaacaggcaacatggtaatctccaagctcaacgatacaactctccaggtgctgaatacatggtataccaagcagtacaaaccctctgcatcaaacgcctttatggtctgcggtgtgctgtatgcgacacgtacaatgaatacaaggaccgaggaaattttctattattacgacactaatacaggaaaggagggcaaactggatatcgtcatgcacaaaatgcaggagaaagttcagagtataaactataaccctttcgaccagaagctctacgtgtataacgatggatatctcctgaattatgatctgagcgtgctgcaaaagccgcagtag

SEQ ID NO: 107120 - DNA, 1734 bp, Artificial Sequence
  Description of Artificial Sequence: Synthetic coding sequence
atgcattggctgaggaaagtccagggactgtgtacactgtggggcacccaaatgtcctctcgaaccctgtacatcaattctaggcagctggtgtctctgcagtggggccaccaggaagtgcctgcgaagttcaactttgctagcgacgtgttagaccactgggccgacatggagaaagcgggtaaacggctgccatctcccgcactttggtgggtgaacggaaagggcaaggaactcatgtggaactttcgggagctgtctgagaacagccagcaggcggctaacgttctgtcaggcgcctgcggcctccaacgaggagatagggttgccgtcgtgctgccccgggttcctgagtggtggcttgtcattttgggttgcattagagccggacttatatttatgcccggtaccattcaaatgaagtcaacagacatcctttacaggttacagatgtcaaaggcaaaggccatcgtagctggcgatgaagtgatacaggaggtggacacggtggctagcgagtgtccatccctccgcattaagctgctagtctctgaaaaatcttgtgatggttggttaaatttcaagaaactgttgaatgaggctagcaccacacatcattgcgttgaaactggaagccaagaggcctctgctatctacttcacctctggcacctcaggtttaccaaaaatggccgagcacagctactccagtctcggcctgaaagccaaaatggatgccgggtggactggcctgcaggcctccgacatcatgtggacaattagcgacactggctggatcttaaacattctgtgctcattgatggagccatgggctctgggtgcttgcaccttcgtgcacctgctgcctaagttcgaccctttggtgatccttaaaaccctgagctcttatcccatcaaaagtatgatgggagctccaatcgtgtatcgaatgctcctgcagcaggacttatcctcatataaatttccgcatcttcagaattgtgttacagtgggggagtctttgctacctgaaaccctcgaaaactggcgcgcccagaccggcctggacatcagagagtcttatggccaaacagagacgggcttgacgtgtatggtgagtaagaccatgaagattaagccaggatacatgggaacagccgcatcctgttatgacgtgcagattattgatgacaaggggaacgtcctccccccaggaaccgagggggatattggcatccgcgttaagccgattaggccaatcggaatattttctggctatgtcgataaccccgataaaacagctgctaacattaggggagatttctggctactgggggaccggggcatcaaagatgaggacgggtacttccagttcatggggcgggccaacgacattattaattcaagcgggtataggattggcccatcagaggtggagaatgccttgatggagcatcctgccgtagttgagaccgcagtgatctcctcccccgacccagtccgcggggaggttgtgaaggcttttgtggtgctggccagccagtttctctctcacgaccctgaacagctcacaaaggaacttcagcagcacgtcaagtctgtgacagccccctacaaataccctaggaagattgagttcgtgctgaatctgccaaagacagtcacggggaaaattcaacgtgccaagctcagagacaaggagtggaaaatgagcgggaaggcccgggcccagtag

SEQ ID NO: 107121 - DNA, 1497 bp, Artificial Sequence
  Description of Artificial Sequence: Synthetic coding sequence
atgtggaactttcgggagttgtctgaaaattcacaacaggcagccaacgtgctgtcgggggcgtgtggcctgcagcgcggagaccgcgtagccgtcgtcctgcctcgcgtccctgagtggtggcttgtaattttgggatgtatccgggcaggactgatcttcatgccagggaccatccagatgaagtccactgacatactgtatagacttcaaatgagtaaggcgaaagcaattgtcgcaggggacgaggtgatccaggaagttgacaccgtagcttccgaatgcccttctctccgcattaaactgctagtctccgagaagtcctgcgacggctggttaaacttcaaaaaactcttgaacgaggccagtactacacaccactgcgtggaaacggggtctcaagaggccagtgctatatatttcacttccggaacctccggtctgcctaagatggctgagcatagctacagcagcctgggtctgaaagcaaagatggatgctggctggacagggttgcaagcttccgacataatgtggactatttccgacacaggttggatcctaaatatcctgtgctctctcatggagccttgggcattaggtgcatgtacattcgtccatttactccccaagtttgatcccttagttattttaaaaaccctctcgtcctatccaataaagtcaatgatgggggcgcccatagtatacagaatgctgctccagcaagatctgtcatcctacaaatttccacacctacagaactgtgtaaccgtcggtgaaagcttgctccctgaaacactggaaaactggcgggctcaaaccggcctggacatcagagaaagctatggacagaccgaaaccggcctcacttgtatggtatcgaaaacaatgaagataaagccgggctatatgggcacagctgcaagctgttatgacgtccagattatcgacgataagggaaacgtcctaccgcctggcacagagggtgacataggaattcgggtgaagccaattcggcctataggtattttctctgggtatgtggataatcccgacaaaactgccgctaatatacgaggcgacttttggctgctaggggatcgcggaatcaaggatgaagatggctactttcagtttatgggcagggccaacgatatcatcaatagctccggttatcgcatcggcccttcagaagtggaaaatgctctgatggaacaccccgctgtcgtggagacagcggtgattagctcacccgacccagtgcgcggagaggtggtcaaagcattcgtcgtcctagcctctcagttcctctcacatgacccggagcaactgacaaaggaactgcagcaacacgtgaaaagcgttacagctccatataaatatcctcggaaaatcgagttcgtgttaaacctgcctaagaccgtgaccggaaaaatccaaagggccaaactcagggataaagagtggaagatgagcggaaaggccagggcccaatag

SEQ ID NO: 107122 - DNA, 627 bp, Artificial Sequence
  Description of Artificial Sequence: Synthetic coding sequence
atgcactggctgaggaaggtgcagggcctttgtacactgtgggggacacaaatgagttcacggactctctacatcaacagtcgccaactcgtcagcctccagtggggacatcaggaagtgccggccaagttcaatttcgctagtgatgtcctcgatcattgggccgacatggaaaaagccggaaaacgtctgccatccccggccttgtggtgggtaaacgggaagggcaaggagcttatgtggaatttccgggagctcagtgagaacagccaacaggcagctaatgttctgtcaggagcgtgtgggcttcagagaggcgaccgggtagcagttgtgcttccacgggtgccggagtggtggctcgttattctcgggtgcatccgagcaggtctgatcttcatgcccgggactattcagatgaaaagcaccgacatcctctacagattgcagatgtccaaggcgaaagcgatagtcgctggagatgaagtcatccaggaagtcgatacagtagcaagcgagtgcccctcacttcggataaagcttttggtgtccgagaagtcctgcgacggatggcttaactttaaaaaactcctgaagtacaaagtaagacatcgggatgttaagtag

SEQ ID NO: 107123 - DNA, 1050 bp, Artificial Sequence
  Description of Artificial Sequence: Synthetic coding sequence
atgagacacccacctctaattacagtgtggcgccttgaagccaaaatggatgcagggtggaccgggctacaagcttctgatattatgtggacaatttcagacaccggctggatcctgaatatcttgtgcagcttaatggaaccctgggcactgggcgcctgtaccttcgtccatcttctgccaaaattcgatccccttgttatcctcaagactctgtcctcataccccattaagagtatgatgggcgctcccatcgtatatagaatgctgctgcagcaagacctgtctagttataagtttccccacctgcaaaattgcgttaccgtcggggaaagccttctgcccgagactctggagaactggcgcgctcagacaggcctggatatacgggagtcatacggtcagacagaaacaggtctgacctgcatggtgtctaaaaccatgaagatcaagcccggttatatgggcacagccgctagctgctatgacgttcagattatcgatgacaagggaaacgtgctgcctccaggcacagaaggagacatcggaatccgcgtgaagcccatcaggccaatcggtatcttttccgggtatgtcgacaaccctgacaagacagcagcaaacatcagaggagacttctggctattgggagatcgaggcatcaaggacgaggatggctactttcagttcatgggtcgagctaatgatatcataaacagttccgggtaccgcattggtcctagcgaggtcgagaacgctctcatggaacacccagcggtggtcgagaccgccgtgatttcttctcctgacccagtgcgaggtgaggttgtcaaggcctttgtggtgctggcctcacagttcctgtcgcacgaccctgagcagctcacaaaggagctgcaacagcacgttaagtccgtcaccgctccctataagtacccgcgcaagatagaattcgtcctgaacctaccaaagaccgtgactggaaaaattcagcgggctaaattgcgagacaaggagtggaagatgtccggcaaggcaagagctcagtag

SEQ ID NO: 107124 - DNA, 1734 bp, Artificial Sequence
  Description of Artificial Sequence: Synthetic coding sequence
atgcactggctgaggaaggtgcagggcctctgtactctctggggcacacagatgagctcccgaactctgtatatcaacagtcgccagttagtgagcctacagtgggggcatcaggaagtcccagccaagttcaactttgcgagtgatgtcttggaccattgggcagatatggagaaagccggcaagcggctgccatcacccgccctatggtgggtgaacgggaagggcaaagagttgatgtggaatttccgggaattgagcgagaacagtcagcaggcagctaacgtccttagtggagcttgcggcctgcagaggggagatcgcgttgcggttgtgcttcccagggtgcctgaatggtggttagtaatactagggtgcatccgggccggactgatcttcatgccaggtacaattcagatgaaatcaactgacatactttatcgcctccagatgtctaaggccaaggcaatcgtggctggagatgaggtcatccaagaagtggacaccgtcgccagtgagtgtccaagcctcagaattaaactgttagtgagtgaaaaaagctgtgacggctggctgaacttcaaaaaacttctgaatgaggcctcgaccacccaccattgtgtggagaccgggtctcaggaggccagtgcaatctattttacgagcgggacctccggactgcccaaaatggctgaacacagttattcatcactcggcctcaaggctaaaatggacgccggttggacaggactgcaggctagcgacatcatgtggacaatcagtgacaccggttggatcctgaatattctgtgctcccttatggaaccatgggctctgggcgcctgtactttcgtccatctcctgccaaaattcgaccctctggttatcctgaagacccttagcagttacccaatcaagagcatgatgggggcgccaatcgtctacaggatgctgctccaacaggaccttagctcatacaaattcccccatcttcaaaattgcgtgacggtgggggaaagtttactacctgaaaccctagaaaattggcgcgcccagacaggactcgatattagagagagttatgggcagaccgagacaggcctcacctgcatggtgtcaaagaccatgaagattaaaccaggctatatgggcactgctgcaagctgctatgacgtccaaatcattgatgacaaaggaaacgttctaccacccggtaccgagggcgacatcgggattcgtgtgaaaccaatccgccctatcggaatcttttctgggtacgttgataatcctgacaaaaccgcagccaacattaggggcgatttctggctccttggtgatagaggtatcaaggatgaggacgggtactttcagttcatgggaagagctaacgatatcataaacagtagtgggtataggatcgggcctagcgaagttgaaaacgccttgatggagcacccagcagtggtcgagacagccgtcatatctagtccagatcccgtccggggcgaggtggtgaaagccttcgtggttctcgcgagccagtttctgagccatgatcctgagcagctcaccaaagaactgcagcagcacgtcaaatccgtcacagctccctacaaatatccacgcaaaattgagtttgtgctcaatttgccaaaaacggttactggaaagattcagcgggctaagctgcgcgacaaggaatggaaaatgtccggtaaagcccgggcccaatag

SEQ ID NO: 107125 - DNA, 1734 bp, Artificial Sequence
  Description of Artificial Sequence: Synthetic coding sequence
atgcattggctgcgcaaggtgcaggggctctgtacactgtggggcacgcagatgagttcccgaactctatacatcaatagtcgccaactggtaagtctccaatggggccaccaagaagtgcctgcaaagtttaacttcgcgagcgacgtgctggatcactgggcagacatggaaaaggcaggcaaacggctaccctcgccagcgctgtggtgggtcaatggaaaaggcaaggagctaatgtggaacttcagagaactatcagagaatagtcaacaggccgctaacatcctgtctggagcgtgcggcctgcagagaggagaccgtgtagctgtaatgctgccgcgggtgccagagtggtggttggtgattcttggatgcattcgggcggggttgatatttatgccgggcactattcaaatgaaatctacggacatcctatatcggttgcagatgagtaaagctaaggcgattgtggccggtgatgaggttatccaggaagtggacactgtggcctcagaatgcccctccttaaggataaagctgctcgtgtctgaaaagtcctgtgacggatggctgaactttaaaaagctgcttaatgaagcatctaccacacatcattgtgtagagaccggaagtcaggaagcctctgcgatttatttcacatctggcacaagcggcctcccaaaaatggctgagcactcgtatagctctttgggcctgaaggcaaagatggacgcgggatggactggtctccaggcttctgatatcatgtggactatcagcgatactggctggattttgaacattctgggaagcctgctcgagtcctggactttgggcgcctgtactttcgtccacttactgcctaagtttgaccccctggtgattttgaaaaccctatcttcttatcccattaagagtatgatgggagccccgatcgtctacagaatgctgctacagcaggacctgtcgtcatacaagtttcctcacctccagaactgccttgccgggggcgagagcctgctgcccgaaacactcgagaactggcgggctcaaacagggctcgacatcagggagttctacggccagacggaaacagggctgacctgtatggttagcaagacaatgaagattaagccagggtatatggggaccgccgcaagttgttacgacgtccaggtcatcgatgacaaagggaacgtcctgccaccgggaacagagggagacatcgggataagggtgaagcccatccggcccatcggtatatttagtggatacgtcgagaaccccgacaaaaccgccgcgaacatcagaggtgatttctggctgctgggggatcgagggatcaaggatgaggacgggtactttcagttcatgggccgggccgatgacatcataaattcgtctgggtacagaatcgggcctagtgaagtggaaaatgcactgatgaagcacccagctgttgtcgagacagctgtcatttcctcccccgacccggtgaggggtgaagtcgtgaaagcctttgttatccttgcttcccagtttctgtcccatgatcccgagcaactgaccaaggaactgcagcaacatgtgaagtccgtcacagctccatacaaataccccaggaaaatcgaatttgtgttaaacctccccaagaccgtgacagggaagatccagaggactaagctgcgtgataaggagtggaaaatgtccgggaaggcaagagcccagtag

SEQ ID NO: 107126 - DNA, 627 bp, Artificial Sequence
  Description of Artificial Sequence: Synthetic coding sequence
atgcactggttgcgaaaggttcaagggttgtgcactctctggggaacccagatgtcttcacgaaccctgtacataaattcccgccagcttgtgtcacttcagtggggccatcaggaagttccagcaaagtttaactttgccagcgatgttcttgatcattgggcagacatggaaaaggccgggaagcggcttccgagtccagcactgtggtgggtaaacgggaaaggcaaagagctcatgtggaattttagagagctttccgaaaactcccagcaggcagccaacatcttgtccggtgcatgcggactgcagcgaggcgatcgggtcgccgtgatgctgccaagggtacctgagtggtggttagtgattctcggctgtattcgcgctggattgatttttatgccaggtacaatccagatgaagagcacagacattctctaccgactccagatgtccaaagccaaagccatagtggccggagacgaggtgatacaggaagtggacacagtggcttctgaatgccctagcttacggatcaaactgcttgtgtccgagaagagctgcgatggatggctgaactttaaaaaacttttgaagtacaaggtaagacaccgcgaggtcaaatag

SEQ ID NO: 107127 - DNA, 1761 bp, Artificial Sequence
  Description of Artificial Sequence: Synthetic coding sequence
atgctggcgagggtgacccgtaagatgctcaggcatgctaaatgttttcaacgtctggcaatttttgggtcagtccgtgctctgcacaaggataaccgcaccgctactcctcaaaacttctcaaattacgaatccatgaagcaggactttaagctgggaataccagaatatttcaactttgctaaggatgttctggatcaatggaccgataaggagaaagcaggtaagaaaccgagcaatcctgccttttggtggatcaaccgcaatggggaagagatgcggtggagtttcgaggaacttggaagtctaagcaggaagtttgccaacatactgagtgaggcatgctcactgcaacgaggagaccgggtaattctgattcttcctcgagtccctgagtggtggttagcaaacgttgcctgtttgagaaccggaaccgtgctgatcccaggcacaacccagcttacccagaaagatatcttatatcgactacagtcgtcaaaggcaaactgcattatcactaatgacgtgctggcaccagccgtagatgccgtggctagcaaatgcgaaaatctccattcgaaattaattgtctcagagaattcaagggaggggtggggcaatctcaaggagctaatgaagcatgcatctgactctcacacttgtgtgaaaacaaagcacaatgagattatggctatcttcttcactagtggaacctccggctatccaaagatgacggcccacacccattcctcctttggcctgggcttaagtgttaacggccgattctggcttgacctcacaccatctgatgtgatgtggaacacctccgacacaggttgggccaagtccgcttggtcctctgtattcagtccgtggattcagggtgcatgtgtcttcacccaccacctgccaaggttcgagcctacgtccatcctgcagacactgtcaaagtaccccattaccgtcttctgctcagcccccactgtgtatagaatgctagtgcagaatgacattacttcttataagttcaagtctctgaagcactgcgtctctgcaggggagccaatcactccagacgtgacggagaagtggcgcaataagaccggtttagacatttacgaaggctacggccagaccgagaccgtactaatctgtggtaacttcaagggcatgaagatcaagccaggcagcatgggaaagccctctcctgcttttgacgttaagatcgttgatgtcaatgggaacgtactcccacctggccaggaaggagatattggcatccaggttctacctaacagaccatttggtctgttcacccactacgtggacaacccctcaaagactgcttctaccctgaggggcaacttctacataaccggagaccgtggatatatggataaggacggctacttttggttcgtggccagggctgatgatgtcattcttagctccggttaccgcatcggtccattcgaggtcgaaaatgcgctgaacgagcacccgtctgttgctgagagtgccgtggtgagtagcccagaccccattcggggcgaagttgtcaaggcatttgtagtcctcaaccccgattataaaagccatgatcaggaacagctgataaaagagatccaggagcatgttaagaaaaccaccgctccctacaagtacccccgcaaggtggagttcatacaggaattgcctaagactatttcagggaaaactaagaggaacgagctgcgcaagaaagagtggaagaccatatag

SEQ ID NO: 107128 - DNA, 1317 bp, Artificial Sequence
  Description of Artificial Sequence: Synthetic coding sequence
atgttagcccgcgttacccggaaaatgttgcgacacgccaaatgcttccagagactggccatcttcggcagtgtgcgagcccttcacaaggacaatcggactgccacacctcaaaactttagcaattacgagagtatgaaacaggacttcaaactgggaattcccgaatatttcaatttcgcaaaggacgttttggatcagtggaccgacaaagagaaggctggtaaaaagcccagtaacccggctttttggtggattaacaggaacggggaagaaatgcggtggagtttcgaagaactcgggagtctctcccgcaagtttgccaacattttgtccgaagcctgttccttgcagcgcggggatcgagttatccttatccttcctagagtgccggaatggtggctcgccaacgttgcatgtttgcggacaggcacggttctgattccaggaaccacccagctaacccaaaaagatatcctatatcggttgcaatcttctaaggcaaactgtatcatcaccaatgatgtccttgcccccgcagtggacgcagtcgctagtaaatgcgaaaacctccacagtaagctcatcgtctctgagaacagtcgggaaggctggggtaacttgaaggaactgatgaaacatgccagcgattcacatacttgtgtgaaaacaaaacataatgaaatcatggctatttttttcacctcgggaacaagcggctaccctaaaatgaccgctcatacccactccagttttggcctcggcttgtctgtgaacgggcgtttctggttggacctcactccctctgacgtcatgtggaatacctcagataccggctgggcaaagtctgcctggagctccgtgttttctccatggatacagggggcctgcgtatttacccatcacttgccacggttcgagccgacatccattttacaaacgttatcaaagtatcctattactgtgttttgcagcgcccctacggtgtacaggatgctggttcagaatgatatcacctcctataagttcaagtccttaaagcactgcgtgagtgctggtgagccgatcacccccgatgtcacggagaagtggagaaacaagacgggtctcgatatttatgaaggatacggtcaaacggaaaccgtcctaatctgcggaaactttaaagggatgaagattaaacccgggagtatgggcaagccctctcccgcttttgacgtcaaggtgtgcacatctccttcacggcgcatgtttaacaaccctatttgtaccctgccgacttatagactgcccccttacaagttgagtttactgtag

SEQ ID NO: 107129 - DNA, 1737 bp, Artificial Sequence
  Description of Artificial Sequence: Synthetic coding sequence
atgaagcaggactttaaacttggtattcctgaatactttaattttgctaaggacgtgcttgaccaatggactgacaaagagaaggctggcaagaagccgtccaaccctgccttttggtggatcaataggaacggcgaagagatgcggtggagctttgaggagctcggctcgttgagccggaaatttgctaatattttgtccgaagcgtgcagcctccagaggggagatcgtgtgattttgattctgccaagagtcccagaatggtggctcgctaatgtcgcttgcctcagaaccggcaccgtgttaattcccggtaccacgcaactcactcaaaaggacattttgtaccggttgcagagctcaaaagccaattgcattatcaccaatgatgtcctagcacctgcggtagacgctgtggcttctaagtgtgaaaacctccactccaagctgattgtttccgaaaactctcgagaaggctggggcaatctgaaagaattaatgaaggtattcctctgtcaccctggttggtccacagtggcgaggtcttggctgacggccacttcaacatccctcgtccaggcaattctttcactcctcagttcatgggattacaggcacgctagcgactcacatacttgtgtaaaaacaaagcacaatgagatcatggctatcttttttactagtggtacaagcggatatcctaagatgacagcgcacacccactcatccttcgggttaggactgtcagtcaatgggcgcttctggctcgatctcaccccatctgacgtcatgtggaacacaagcgatacaggttgggcaaagtcagcctggtccagtgttttttcgccctggattcagggcgcatgcgtgttcacgcaccacctgccacgcttcgagcctacgagtatacttcagacactcagcaaatatcctataaccgtcttctgtagcgcacccacggtctacaggatgctggtgcagaatgatataacatcgtataaatttaagtctttgaagcactgcgtcagtgcaggtgaacccattacccccgacgtcacggagaaatggaggaacaaaactgggctggacatctatgaaggctatggccagactgagactgtgctcatctgtgggaacttcaaaggtatgaagatcaaacccggctccatgggtaagccttctcccgctttcgatgtaaaaatcgttgatgtaaacggcaacgtgttgcctccaggccaggagggagatatcggcatccaagtgttgccgaatcggccattcgggctgttcacccactatgtggataacccatccaaaacggccagcactcttcgcgggaacttctatattacaggggaccgaggctatatggataaagatgggtatttttggtttgttgccagggcagacgatgttatactctcatcagggtatcgtataggtccctttgaagtcgagaacgcactgaacgaacacccaagtgtagctgaatccgctgtggtgagttcccctgatccaatccgtggcgaggtggtgaaagccttcgtggttcttaatcccgactacaaatctcacgatcaggaacagctgataaaggagatccaagaacacgttaagaagactacggcaccctataagtatccccgaaaggtggagtttattcaagagctgcctaagactatctctgggaaaacaaaacgcaatgaactaaggaagaaggaatggaaaaccatatag

SEQ ID NO: 107130 - DNA, 1740 bp, Artificial Sequence
  Description of Artificial Sequence: Synthetic coding sequence
atgcgtccctggctgaggcacctcgttctgcaagcacttcgaaactcacgggccttttgtgggtcacacggcaaaccagccccccttcccgtaccacagaagattgtagcaacttgggaggctatcagcttggggcgccagctggtgcccgagtattttaatttcgctcatgacgtgctggatgtgtggagccgtttggaagaggccggacacagaccaccaaaccctgccttctggtgggtgaatgggaccggtgcagagatcaaatggagcttcgaggaattgggaaagcaatcccgcaaagcggccaacgtactcggtggagcctgtggtttgcagccgggcgatcggatgatgctggttttaccacgcttgcctgaatggtggctcgtgagtgtggcctgcatgcgaacaggcacagtcatgatacccggagtcacccagctgactgagaaggatttaaagtataggctccaggctagcagagccaaatctatcatcacttccgattccctggctccaagggtggacgcaatctcagccgagtgcccaagcttgcaaaccaagcttttggtgagcgacagcagtagaccaggctggctaaactttagggaactattgcgggaagccagcactgaacacaattgtatgaggacgaagtcacgggaccctttagctatatacttcacttccggaacaaccggcgccccaaagatggttgagcactcacaatcctcctatggactgggcttcgttgcctcagggcgaagatgggtggcgctcaccgagtctgatattttttggaacacaaccgataccggctgggtgaaggctgcttggaccctgttctcggcttggccaaacggaagctgcatctttgttcacgagcttcctagggtggacgccaaggtgatcttaaatactctgagcaagttcccaatcaccacgctatgctgcgtgcccactattttccgcctcttggtccaggaggacctgacccgctaccagtttcagtccctgcgccactgcctgacaggaggcgaagcccttaatcctgatgtcagagagaagtggaaacatcaaaccggcgtggaactttatgaagggtacggacagagtgagacagtggttatctgtgctaaccctaaggggatgaagattaaatccggctcaatgggcaaggccagtcccccatacgacgttcaaatcgtcgatgacgaggggaatgtgcttcccccaggggaggagggcaacgtggccgtgagaattcgacctacgcggccattctgtttctttaattgttatctcgacaatccagaaaagaccgccgcgagcgaacagggggatttttatatcaccggagatcgagcacggatggataaagacgggtacttttggttcatggggagaaatgatgatgtgatcaactccagctcttataggataggcccagtggaagtcgaatccgcgcttgcggagcacccggctgtgcttgaatctgccgtcgtttcaagcccagacccaatcagaggagaagtggtcaaagccttcattgttttaacaccggcttacagctcccatgaccccgaagcgctcacacgggagctgcaggagcatgtaaaacgcgtgacagcaccttacaaatacccaagaaaggtggcatttgtatccgagctgccaaagaccgtatctgggaagattcaaaggtctaaactccggtctcaagagtggggaaaatag

SEQ ID NO: 107131 - DNA, 2070 bp, Artificial Sequence
  Description of Artificial Sequence: Synthetic coding sequence
atggcagcgaggaccttgggtcgaggcgtgggacggctgctcgggtctctgagaggcctgtcgggtcagcctgcccgtccaccttgcggggtgtccgccccccgccgggccgcctcgggcccaagcggctctgctcccgccgtagctgctgcagcggcacagcccggttcatatccagccctttctgcacaggccgccagagaaccggccgccttctggggacccctcgcaagagacaccctggtttgggacaccccttaccacaccgtttgggattgtgatttctctaccggtaaaattgggtggtttttgggtgggcagcttaacgtcagcgtgaattgcttggaccaacacgttcgaaagagcccagaatctgtcgccctgatatgggaaagggacgagcctggcaccgaagtgcggataacttaccgggagctgcttgaaacaacctgcagactggccaataccctgaagcggcatggagtccaccgtggcgaccgagtggctatctatatgccagtttccccactggccgtggccgcgatgctggcctgtgcccgcattggagccgtgcatacagtcatcttcgccgggttcagcgccgagtctctggccggcagaataaacgacgctaaatgtaaagtggtgataacctttaatcaaggcctcagggggggtagggtggtagagttaaagaaaatagtcgatgaggcagtgaaacattgtccaactgttcagcacgtgttggtagctcaccgcaccgataataaagttcatatgggcgatctggatgtccccctcgaacaggaaatggcaaaagaggaccctgtgtgtgcccccgaatcgatgggttctgaagacatgctgttcatgctatacacgtccggatccactggcatgcccaagggcatcgtccatactcaagctggatacctcctgtacgctgccttgactcacaaactggtgttcgaccatcagccaggagatattttcggctgtgtcgccgatattggatggataactggccactcttatgtggtgtacggccctctgtgcaacggcgcaacttctgtgcttttcgagtctactccagtgtatcctaacgctggaagatattgggaaaccgtggagagattgaagattaatcagttctatggcgcgccaacagcagttaggctgctcttaaaatacggagacgcatgggtcaagaagtacgatagaagcagcctcaggacgctcggaagtgttggggagcccatcaattgtgaggcctgggagtggctgcacagggtggtcggagattcccgatgtacgttggtggacacttggtggcaaacagagaccggcggtatctgtattgccccacgtccaagtgaagaaggcgcagagattttgcctgcaatggccatgagaccatttttcggaatcgttccagttctgatggacgagaaaggttccgtggttgaggggagcaacgtgagcggagccctctgtataagccaggcttggccaggaatggcgcgcaccatttacggcgatcatcagcggtttgttgacgcgtacttcaaagcctaccctggttactacttcactggtgacggagcctatcggacagagggcggctattaccagatcaccggccgcatggacgatgtgatcaatatatcgggtcaccgactaggaaccgcagaaatcgaggacgcaattgccgaccacccagctgttccagagtcagccgtcatcggctacccgcatgacatcaaaggcgaggctgctttcgctttcattgtcgtgaaggatagcgccggtgattcggacgttgtggtccaggagctgaaatccatggtggccacaaagattgctaaatacgctgtcccagatgaaatattggtggtaaaacgattacctaaaactcgatcaggaaaagtgatgcgcaggcttctgcgaaagatcataacctctgaggctcaggaacttggagacaccactacactggaagacccctccataatcgccgagatcctatcggtgtaccagaaatgcaaagacaagcaggctgctgccaagtag

SEQ ID NO: 107132 - DNA, 462 bp, Artificial Sequence
  Description of Artificial Sequence: Synthetic coding sequence
atggctgcgcgaacactgggccgcggagtgggcaggttactggggtcactccgggggctatccgggcaacccgcccgtcctccctgtggcgtctccgctccacggagggctgcgagcggtccatctggttctgcaccagctgtggccgcagcagcagcacagcctggaagctatccagcgcttagtgcacaggccgccagagaaccagcggccttctggggtccactggcgagagatacacttgtgtgggacactccatatcatacagtctgggactgcgacttctcaaccggaaaaatcgggtggttcctcgggggccagctaaacgtatctgtgaactgtctggatcaacacgtcagaaagtccccagagtcagttgctttgatctgggagcgggacgaacccggcactgaggtccgaatcacttactccccctggctccaaatgccttgtggcccatag

SEQ ID NO: 107133 - DNA, 1455 bp, Artificial Sequence
  Description of Artificial Sequence: Synthetic coding sequence
atggccgcccgaactctggggagaggagtcggccgtctgctgggctctctgcgcggactttctgggcagcccgcacggccgccttgtggagtgagcgccccacgtcgcgcagcttcgggcccaagcggatccgcccctgccgtcgccgccgccgcagcgcagcctggctcttacccggccctgtccgctcaggctgccagagaacctgccgccttttggggaccgctcgcccgcgacacactggtatgggatactccatatcatacagtgtgggactgtgacttcagcacaggcaagattgggtggtttctaggaggccagcttaatgtcagtgtgaattgtctggatcaacacgtgaggaaatctccagaatcagtggctctcatctgggagcgggacgagcctgggacagaagtgagaattacatatagagaattgctcgagactacctgtagactggctaatacactgaaaaggcatggcgtgcatagaggggaccgagttgctatctacatgcccgtcagccctcttgccgtggccgccatgctagcctgcgcccggattggggccgtccacaccgttatctttgctggctttagtgccgaatctctagctgggaggattaatgacgttggcgagcccattaactgtgaagcctgggaatggctgcacagggtggtgggagattcccggtgcacactagtagacacctggtggcagacagagaccggtggtatctgtattgccccgagaccctcagaggagggcgcagaaatcttgcctgcaatggctatgcggccttttttcggcatagttcccgttctaatggatgagaaggggtcagtcgtcgaggggagtaatgtgagtggagccctgtgtatttcccaggcgtggccaggtatggctcggactatttatggtgatcatcaacggttcgtcgacgcatattttaaagcttatcccgggtactactttaccggtgacggcgcctacaggactgaggggggctactaccaaatcactggtcgaatggatgacgttatcaacatctcaggccacagactcggcacagcagagattgaggatgcgattgctgaccaccccgccgtgcccgagtctgccgtaatcggttatccacacgatattaaaggcgaggccgccttcgcgttcatcgtggtcaaagacagcgcaggagattcagacgtggtggtgcaagagttgaagtccatggtcgccaccaagatcgcaaaatatgccgtgccagacgagatcctggtagttaaacgtctgcctaagacgaggagtggaaaggtgatgagacgcctgctgaggaaaatcattacaagtgaagcccaggagctcggcgacactactacgttggaggacccatcaataattgctgaaatcttgagcgtgtatcaaaagtgtaaagacaagcaggctgccgccaagtag

SEQ ID NO: 107134 - DNA, 1728 bp, Artificial Sequence
  Description of Artificial Sequence: Synthetic coding sequence
atggccgcgagaaccctgggcaggggcgtggggcggctcctggggtctttacgcggtctgagcgggcagcccgcccgccctccttgcggggtttctgcaccccggagagcggcctcagggccaagcgggtctgccccagccgtcgctgcggcagctgcccaaccagggtcatatccggccctgagtgcccaggctgcgcgcgagcctgccgccttctgggggcccctggcgcgggacacactggtctgggacaccccctaccacactgtgtgggattgtgattttagtaccggaaagataggctggttcctggggggccagctcaatgtgtcagtgaactgcctggatcagcatgtgagaaagagtcccgagagtgtggccctgatctgggagcgggatgagcctggtacagaggtgaggattacctaccgggaattacttgagaccacctgccggctcgcaaacaccctgaaacgccacggagtgcatcggggtgacagggtggcaatatatatgcccgtgtcccctctggcagtagctgccatgctggcctgtgcacgtattggggccgtccacacggtgatcttcgctggatttagtgccgagtctttggccgggagaataaacgatgcaaaatgcaaagtagtcatcaccttcaaccagggcctgcgcgggggcagagtggtagagctgaagaaaatagtggatgaagctgttaaacattgtccaaccgtccaacacgtccttgtggcacaccggaccgataacaaggtgcatatgggagacctggacgtgcccctggagcaggaaatggcaaaggaggaccctgtttgtgcgcctgagagtatgggctcagaggacatgttatttatgctgtataccagcgggtccacagggatgcccaagggcattgtgcacacacaggccgggtatctcttatacgcagcgctgactcataagctggtgttcgaccatcagcctggggacatttttggatgtgttgcagacattggatggattacgggtcactcatatgttgtgtacggaccactgtgcaacggggcaaccagcgtgctctttgagtcaactccagtttatcccaatgccggaagatattgggagactgttgaaaggctgaaaatcaatcagttttacggcgcacctaccgccgtacggctgctgctgaagtatggtgacgcctgggtcaagaaatacgaccgcagtagtcttaggacattgggatcagttggcgagccaattaactgtgaagcatgggagtggctccacagagtcgtaggggatagtcgctgcaccctcgtggacacctggtggcaaaccgaaactggcgggatctgcatcgcgcctcgaccctctgaggagggtgctgaaattttgccagctatggctatgcggcccttttttggcatcgttccagtgctgatggatgaaaaagggtcagtggtggaaggaagcaacgttagcggcgctctatgtattagtcaagcatggcccggcatggcccgaaccatctatggcgaccatcaacgctttgttgatgcttacttcaaagcctacccggggtattactttacaggtgatggcgcctaccggacagagggtgggtattatcagattacagggcgcatggacgatgtcataaatattctgcaaatagttggattctttagggaggccattcgtaacagcggagatctgctggagcactag

SEQ ID NO: 107135 - DNA, 1821 bp, Artificial Sequence
  Description of Artificial Sequence: Synthetic coding sequence
atgctaaagaccttcttgtttctggagaaatacttcccttgtattaagtatagttccgcttgtttccctgggacaggcttggacgtctacgatatcaagtttgccgtcctcctccatccacagaccgccctccacttcggccctccccccagcctgatggcttttagctcgctgtgttgtagggaactgttggagaccacatgccgtctagccaatacactcaagcgccacggcgtccacaggggcgaccgcgtggcaatttacatgcccgtgtcgcctcttgctgtggctgcaatgctggcgtgcgcccgcataggagctgtccacactgtaatctttgctggtttttctgccgagtcgctcgccggccggatcaacgacgctaaatgcaaggtagtgatcacttttaatcagggcttgaggggcggacgcgtggtggaacttaagaagattgtcgatgaggccgtgaagcactgtcccaccgtgcagcatgtcttagtggctcaccgaacggacaacaaagttcacatgggtgatctggacgtcccattagagcaggagatggctaaggaagatcctgtatgcgcacccgagtctatgggctccgaagacatgctatttatgctgtacacctctggatctaccggcatgcccaaggggatcgtccatactcaggccggctacctgctgtacgcagccctcactcacaagctagtttttgaccatcaaccgggcgatatctttgggtgcgtcgccgatatcggatggatcaccggccactcctacgtcgtgtatggtcctctgtgtaatggggctacttccgtgctgtttgagtctactcccgtgtaccctaatgctggacgctactgggaaacggtggagcggttaaagattaatcagttttacggagcccctacggctgttcgattgctgttaaaatacggtgatgcatgggtaaaaaagtacgatcggtcctcgctgcgcacactgggatcagtcggcgagccaattaactgcgaagcctgggagtggttacatcgcgttgtgggcgacagccggtgcactctcgtggacacttggtggcaaaccgagacaggcggcatctgtatcgctccaaggcctagcgaggagggcgcagagatactgcccgccatggccatgcggccttttttcggcatcgtgcccgtgctgatggatgagaaaggatctgtggtggaaggatccaacgtgtccggagccctgtgcatcagccaagcatggccaggaatggctcggacaatttacggagaccatcagagatttgtggatgcttattttaaggcgtatcccgggtactactttaccggcgatggcgcgtatcgtacggagggagggtattaccagattaccggccgcatggacgacgtcattaacatttccggccaccggctgggtaccgcagaaatcgaagacgctattgccgatcatcccgctgtgcccgagtcggccgtgatcggctatcctcacgacatcaaaggcgaagccgcttttgcttttatcgtcgtgaaggactctgccggcgatagtgatgtagtcgtgcaggaactgaaaagtatggtggcaactaaaattgctaaatacgcagtgccggacgagatcctggtggtgaagcgtctacctaaaacccggtctggtaaggtgatgcggagactgctgaggaagatcatcacatccgaagcgcaggaactcggcgacactacaaccttagaggatccgtctatcatagccgaaatcctctccgtctaccagaagtgcaaagataagcaggctgctgctaagtag

SEQ ID NO: 107136 - DNA, 1707 bp, Artificial Sequence
  Description of Artificial Sequence: Synthetic coding sequence
atgcgtcgtaggaaggagcggcagccttgggaccggtttcatttcctgcactttgctccacacggccgcgagctgctggaaactacctgtagactcgccaacaccctgaagcgccacggcgtgcacaggggcgacagagtagcgatctacatgcctgtgagcccattagctgtggcagctatgttagcttgcgctcggatcggggcagtccacacagtgatctttgccgggttctccgcagagtctctcgcgggccgcattaacgatgccaagtgcaaggtggtgattactttcaatcaaggtttacggggaggaagagttgtggagctcaagaagatcgttgacgaggcagtaaaacattgtcccacagtgcagcatgtccttgtggcacacagaaccgataacaaggtccacatgggcgacctcgatgtccctcttgagcaggagatggccaaggaagacccagtgtgtgctcccgagtcaatgggctctgaagatatgctgtttatgctatataccagcggatccactgggatgccgaagggtattgtgcacacgcaggccggctatctcctgtacgctgccctcacacataaactggtgtttgatcatcagcccggagatatcttcggatgcgtggcagatatcgggtggatcacgggccactcatacgtggtttacggcccattgtgcaatggcgcaacctccgtgttgttcgagtcaacaccggtgtatcctaatgcagggaggtactgggagaccgttgaacggctaaaaatcaaccaattctatggcgccccaacagccgtgagactgcttttaaagtatggcgatgcttgggttaagaaatacgaccgctcctctctgagaacgctgggaagtgtgggagaacctattaactgcgaggcttgggaatggcttcatcgagtggtcggggactctagatgtacattggtggatacttggtggcagacagaaaccggagggatttgtatcgcacccagaccaagcgaggagggcgctgagatcctccctgccatggctatgaggcccttcttcggaatcgtgcctgtactcatggatgaaaaaggctccgtcgtggaggggtccaatgtttccggtgcactctgcatctcccaggcatggcctggaatggccaggaccatctatggggatcatcaacgctttgtcgatgcctatttcaaagcctacccaggttattacttcaccggagacggagcctataggaccgagggtggctactaccaaattaccggcagaatggacgatgttattaacattagtggacatcgcctcgggacggcggagattgaagacgcaattgctgatcatcccgccgtacccgaatcggccgtgattgggtatcctcacgatattaagggcgaagcagcatttgcttttattgtggtgaaggacagcgcgggagactctgatgtggtggttcaggaactgaagagcatggttgccactaaaattgctaagtatgccgtgcctgatgagattctggtcgtcaaaaggttgccgaagactcgctctggaaaagtgatgagacggttgctgcgcaaaatcatcacctctgaagcccaggagcttggggacaccactactctggaagacccatctattatcgcagagatcctgagcgtgtatcagaagtgcaaggacaaacaggcggctgccaaatag

SEQ ID NO: 107137 - DNA, 2145 bp, Artificial Sequence
  Description of Artificial Sequence: Synthetic coding sequence
atgggcttgcccgaggaaagagtacgcagtgggagtggaagtagaggacaggaagaggcgggcgctggtgggcgagcacgtagctggtcacccccaccagaagtgagtaggtccgctcacgtgccctctctgcagcggtatagagagttacacagaagaagcgtggaggaacccagggaattttggggggacattgcaaaagaattttattggaagaccccatgtcctggcccctttctgaggtataacttcgacgtgacaaaggggaagatcttcattgagtggatgaaaggagcaacaacaaatatatgctacaatgttctggatagaaatgttcacgagaaaaaactcggagacaaggtggccttttactgggagggcaatgaacctggcgagacgacacaaataacttaccaccaactgttagtccaggtatgccagttttcaaacgtgctcaggaagcaaggtattcagaaaggcgacagagtcgctatctacatgcccatgattcccgagttggttgttgctatgctggcatgcgcgcggatcggtgccctgcactccattgtgttcgctgggttctcaagtgagagtctgtgcgaacgcatcctggactccagctgtagtctgctgatcaccaccgatgccttctacaggggcgagaaactcgtgaacctcaaagagttagcagacgaagcactccagaagtgtcaagagaagggcttcccagtgaggtgctgcattgtcgttaagcacctcggccgcgccgagctgggaatgggtgatagtacaagccagtcaccccctatcaaacggtcctgccccgacgtacagggcaagctcaaggaaaaaagtaagcgggtgcagccccagatctcatggaatcagggtatagacctgtggtggcacgaacttatgcaggaagcaggagatgagtgcgaacctgagtggtgtgatgctgaggaccctctgtttattctgtatacttccggttcaactggaaagccgaagggcgtagtacataccgttggaggatacatgctgtacgtcgccacgacctttaagtacgtgttcgacttccacgcagaggacgtgttttggtgcacagccgacattggctggattactggtcacagctacgtgacttacggcccactcgccaacggcgcaactagcgttcttttcgaggggatccccacataccctgatgtgaaccgattgtggagtatagtagacaaatacaaggttacaaagttctacaccgccccaactgctattcgactcttaatgaaattcggagatgaacccgtgactaaacacagtagagccagcctccaggtgctggggaccgtgggggaacctatcaaccccgaggcgtggctctggtatcaccgggtcgttggcgcacagcggtgccccattgtggatactttctggcagacagagacaggcggccacatgctgacccccttaccaggagcgactcctatgaagcctgggtctgcgaccttcccctttttcggtgtcgcccctgcaattctgaatgaaagcggtgaagaactggagggggaagcagaaggatacttggtcttcaaacagccatggcctgggataatgcgcacagtttacggaaaccacgaacggtttgaaaccacctacttcaaaaagttcccgggctactatgtgacaggcgacgggtgccagagggaccaggacgggtactattggataactggccggattgatgacatgcttaatgtcagtggccacttgctttcgaccgctgaggtcgagagcgctctggttgagcacgaagccgtcgccgaagcagctgtggtgggccacccacaccccgtcaaaggcgagtgtctgtactgctttgtcaccctctgcgacggccacaccttctctcccaaattgacagaggagctcaagaagcagatccgcgagaagattggccctattgctacccctgattatatccaaaatgcaccgggactgccgaaaacccgaagcgggaagatcatgaggcgagtcctgcgcaagatagctcaaaacgaccacgacctaggggacatgagcaccgtcgctgatcctagcgtgatctcgcacctgttttcccatcggtgcctgaccattcagtag

SEQ ID NO: 107138 - DNA, 1956 bp, Artificial Sequence
  Description of Artificial Sequence: Synthetic coding sequence
atgatggtgagatgggcactcctctgcgagttctggggcgatattgcaaaggaattttactggaagaccccatgccccggacccttcttgcggtacaatttcgacgttacgaaggggaagatattcatagagtggatgaagggtgcaaccacgaacatctgttataacgtgctcgatcggaatgtgcatgagaaaaaattaggcgataaagtggcgttctactgggagggcaacgagccaggcgagacgacccagatcacctaccatcagttgttggttcaggtctgccagtttagcaatgtcctgcgcaagcaggggattcagaagggcgaccgagtagcgatctatatgcctatgatcccagagttggttgtggctatgcttgcctgcgcccgtatcggcgcgctgcattccatcgtgtttgccgggttttcttctgaatccctctgcgagaggatattggactcaagttgctctctgctgataactacagacgccttttaccgcggggagaaactggtgaacctcaaggaattggccgatgaagccctgcagaaatgccaggagaagggctttccggtgcgctgctgcatcgtcgtgaagcaccttggccgcgccgagctgggcatgggggactccacgagtcagagcccaccgattaaacggtcttgtcccgacgtgcagatttcttggaaccaagggattgatctgtggtggcatgaactgatgcaggaggctggcgacgagtgtgaaccagaatggtgtgatgctgaggatccactgtttatcctgtatacaagcggctccactggcaaacctaaaggtgtcgtccacactgttggagggtatatgctttacgtggccaccactttcaagtatgtctttgatttccatgcggaagacgttttttggtgcactgcagacatcggatggatcaccgggcacagctatgtgacgtacggtccactggcgaatggggccacttctgtacttttcgagggaatacctacctatccagatgtgaatcggctgtggagtatcgtagataaatacaaggtgacgaaattttacactgcccccaccgcgatccgcttgttaatgaaattcggtgacgagccagtaacaaagcatagtagagcaagtctgcaggtgctagggacagtaggagagcccatcaacccagaggcttggctatggtatcacagagtggtgggtgcccaacgctgccctatcgtcgatactttttggcagacagaaaccggaggtcacatgctaacacccctcccaggagccacccccatgaagcctggtagcgcaaccttcccctttttcggggtggcccctgcaatcctgaacgaatcgggggaggagctggagggagaggctgagggatatttagtatttaagcagccgtggccaggaatcatgcgcactgtttatggtaaccacgaacgatttgagaccacgtattttaaaaaattccccggttattacgtgaccggagatggttgtcagcgggaccaggatggctattactggataacagggcgcattgacgatatgctgaacgtatcaggtcatctattgtcaaccgccgaagttgagtccgcattggtcgagcatgaagccgtcgccgaggccgctgtcgtgggccacccacaccctgtgaagggcgagtgcttgtattgctttgtgactctctgcgacgggcacaccttcagtcccaagctcacagaggaactgaagaagcagattagggagaaaattgggcccattgctactcccgattatatacagaacgcacccggacttcccaaaacacgctctgggaagatcatgaggcgcgtgctgaggaagatcgcccagaatgaccacgatcttggggatatgtccaccgtcgcagacccttccgtcattagtcacctgttcagtcaccgctgtctcacaatccaatag

SEQ ID NO: 107139 - DNA, 2106 bp, Artificial Sequence
  Description of Artificial Sequence: Synthetic coding sequence
atgggcctccccgaggaacgcgtgagaagtggatctgggagtcgcggtcaggaggaagcgggcgccggcgggagggctagaagctggtccccccctcctgaggtgtctagatctgcacacgttccttccctgcagagatacagggagctgcaccgcaggagtgttgaagagcctagagagttttggggcgacatcgctaaagagttttactggaagactccctgtcccggccccttcctgcgctataattttgacgtaacaaaagggaagatatttattgaatggatgaagggagccacaacaaatatatgctataacgtgcttgataggaatgtgcatgaaaagaaactgggcgataaggtcgccttttactgggaaggcaacgagcctggggaaaccacacagataacttaccaccagctactggtgcaagtttgtcagttttccaatgtgctacgcaaacaaggcatccagaaaggcgacagggtggccatatatatgccgatgatcccagaattggtcgtggccatgttggcatgtgcgagaatcggggcccttcacagtattgtctttgccggtttctccagcgaaagcctctgtgagagaattctggattctagttgcagcctgctcataacgactgatgccttctaccgtggagagaaactggtgaacttgaaggaattggccgatgaggcattgcaaaagtgccaagagaaggggtttcctgtgcgctgctgcattgtcgtgaaacatctgggccgagccgaactgggcatgggggactccacctcccagtcacccccaatcaaaaggagctgccccgatgtacagatctcatggaaccaaggaatcgatctgtggtggcatgagctgatgcaggaggcaggcgatgagtgcgaacctgagtggtgcgatgccgaggaccccctgtttatattgtacacgtctggttctaccggcaagccaaaaggagtggtgcatactgttggtggatacatgctatatgttgctaccaccttcaagtatgtgttcgactttcacgctgaagatgttttctggtgcactgctgacatcggttggatcaccgggcactcgtacgtgacatatggaccccttgcaaacggggcaacaagcgtgctctttgaaggtatccccacctaccctgacgttaaccgcctgtggagcattgttgataaatataaggttactaaattctatacggccccaacagccatccgcttactcatgaagtttggcgacgagcccgtcactaagcactcgcgggcttcccttcaggtactgggcaccgtgggtgagcctatcaacccagaagcatggctctggtaccacagagttgtaggggctcagaggtgccctattgtcgataccttctggcagaccgagacaggagggcatatgctcacccccctccccggggcaacccctatgaaacctggttccgccacattcccctttttcggcgtggctcccgccatccttaatgagagcggtgaagagttggagggggaggcagagggttacttggtcttcaagcaaccttggcctggcattatgagaacagtatacggtaatcatgagcggttcgagacaacctactttaaaaaatttcccggatattacgtaaccggcgacggatgccagcgggaccaggacggttattactggataaccggaaggatcgatgacatgctcaacgtgagcggacatctgttatcaacagcggaagtcgaaagtgctctcgttgagcatgaagcagtggcagaagccgctgttgtgggacatccccatcctgtcaagggggagtgcctctattgttttgtgacgctatgcgacggacataccttttctccgaagctgaccgaagagttgaagaagcagatccgcgagaaaatcggacccattgccactccggattacatccagaatgcgcccggactcccaaaaactagaagtggaaaaattatgcgacgggtcttgcggaaaatcgctcagaatgatcacgatttgggagacatgagtacagtggcagacccatccgtcatcagccaccttttttcccaccgatgtctgaccatccagtag

SEQ ID NO: 107140 - DNA, 2100 bp, Artificial Sequence
  Description of Artificial Sequence: Synthetic coding sequence
atgggcctgcccgaggagcgagttagatccgggtcaggctctcgcggacaggaggaagctggcgctggaggcagagcgcgttcatggagcccacctcctgaggtgtcacgatctgctcacgttccgtccctgcagcgctaccgcgagcttcaccgaagatcggtggaggaacccagagagttctggggcgacattgcaaaagagttttactggaaaacaccctgcccaggcccatttttaagatataatttcgatgtgacaaaagggaagattttcattgagtggatgaagggtgcgacaaccaacatctgctacaatgtcttggaccgaaacgtacatgaaaagaagttgggggacaaggtggcattctactgggaaggaaatgaacccggcgagaccacccagattacttaccatcagcttctcgtgcaggtatgccaattcagcaatgtgctaaggaagcaaggaatacagaaaggtgacagagtagcgatttacatgccgatgatacctgagttagtggtggctatgctggcctgtgcgaggattggggctctgcattccattgtctttgcgggtttttccagtgagtctttgtgcgagagaatcctggactcgtcatgcagtctgctgattacaacggacgcattttaccgcggagaaaagctggtgaatttgaaagaattagccgacgaggccctgcaaaagtgccaggagaaagggttccccgtgaggtgctgcatcgtagtcaaacatttaggtcgcgccgagctgggaatgggtgatagtactagccagagccccccaataaaacggtcttgtcctgatgtgcagatttcctggaaccagggaattgatctgtggtggcacgagctgatgcaggaggcaggtgatgaatgtgaacctgaatggtgcgacgccgagcatagtagctcatgtactcccgtggccccacaagctaatccccgcgtgtggttcactcagttaggcgcaacttgttacgtggctactactttcaagtatgtgtttgactttcatgctgaggatgtcttttggtgcaccgcagacatcggatggatcactggacactcatacgtcacttacggacctttagcaaatggcgctacatctgtcctgtttgaaggtatcccaacatacccagatgttaacagattatggtctatcgtggacaagtacaaggtaacgaaattctacaccgcgccaactgccatcagactgttaatgaagttcggcgacgagccggttacgaagcactcccgggcaagccttcaggtcctcgggactgtcggggagccaattaacccagaagcttggctctggtaccatcgagttgtgggtgcgcagcggtgcccaattgtggatactttttggcagacagagacggggggacacatgttaactcccctgcctggggcgactcccatgaagccaggaagtgccacattcccattttttggggtggccccagccattctgaatgagagcggagaggaactagaaggggaagccgagggctatctcgtatttaagcagccttggccagggatcatgcggaccgtgtacgggaatcacgaacgttttgagaccacatattttaaaaaatttccaggctactacgtcactggggatggttgtcagagggaccaggacggctactactggatcaccgggcggatagatgacatgttgaacgtgagcgggcacttgctctccaccgctgaagtcgaatctgctttggtagaacacgaggcagtcgccgaagccgctgtggtaggccacccccaccctgtgaagggtgagtgcctgtattgtttcgtgacgttgtgtgatggtcacaccttctcccctaagcttaccgaagagcttaaaaaacagattcgtgagaaaattggcccgattgcaacccccgactatatccagaatgcccccggtttaccgaagacaagaagtggaaagatcatgcggagggtgctccgaaagatagcccagaacgaccacgatctcggagacatgagtactgtggcagatccttctgtaatatctcatttgtttagccaccggtgcctcaccatccagtag

SEQ ID NO: 107141 - DNA, 1230 bp, Artificial Sequence
  Description of Artificial Sequence: Synthetic coding sequence
atgcaagaagctggagacgagtgtgagcccgaatggtgtgatgccgaggatcccctgtttattctgtacacctccggctctacaggcaagcctaaaggcgtggtccacacagtaggcggctacatgctgtatgtcgccaccacgttcaaatacgtctttgatttccacgccgaagatgtgttttggtgcactgccgacatcggctggatcacaggccacagctacgttacatatggcccactggctaatggcgctacatctgtgctgtttgagggtataccgacgtatcctgacgtgaaccggctgtggtccattgtggacaagtacaaagtgacgaagttctacaccgcacccacagctatcagactgcttatgaagtttggtgacgagcccgtgaccaagcacagcagggcctctctgcaggtgctgggtaccgtgggggaacctattaaccctgaggcttggctctggtatcaccgggtcgtaggagctcaaaggtgcccgattgtggacacattctggcagactgagacaggaggtcacatgctgactcccttgcctggcgccacacccatgaagcctggatccgccaccttccccttctttggagtggcccctgctatcctcaacgagtcgggagaggagttggaaggagaggccgaaggttatttggtgttcaaacagccttggcccgggatcatgcggacagtgtacggcaatcatgagaggtttgagactacttacttcaagaagtttcctgggtactacgtgaccggcgatggctgccaacgtgatcaggacggatactactggatcacaggacgaatcgacgacatgctgaacgtcagtgggcatctactgtctactgccgaagtggagtccgccctggtggaacacgaggctgtggcagaagcagccgtggtcggtcacccgcatcccgtgaagggcgaatgcctgtactgtttcgtgactttgtgtgacggtcacacctttagcccaaaactgacagaggaacttaagaaacagatacgagagaaaatcggtcccatagccacgcccgactacatacagaatgcacctggcctcccaaaaacacggtccggcaagattatgcgacgggttctgcggaagattgcacaaaatgatcacgacctcggcgatatgtctaccgtggcagatccatctgttatctctcacctctttagccaccgctgtctgacaatccagtag

SEQ ID NO: 107142 - DNA, 114 bp, Artificial Sequence
  Description of Artificial Sequence: Synthetic coding sequence
atgatggtgcggtgggcccttctttgcggagaatgccggatcctgggacggcactgtcagggaattttgttggaggactctatgccgtggccaattcccagcgtgcagctgtag

SEQ ID NO: 107143 - DNA, 2061 bp, Artificial Sequence
  Description of Artificial Sequence: Synthetic coding sequence
atgaagcccagctggttacagtgtcggaaagtaacctccgccgggggcctggggggccctctgccagggagttcacccgccagaggcgccggtgccgctctgcgagcattggtggtcccaggaccccgaggaggcttagggggaagaggttgcagggccctgtcaagcgggtccggctcggaatataaaactcatttcgccgcaagcgtcactgatccagaaagattctgggggaaggcagcagagcagattagctggtacaagccatggacaaagacccttgagaataagcactcaccctcgacacgttggtttgtggagggaatgctgaacatctgctataatgcggtcgacaggcacatcgagaatgggaagggcgacaaaatcgccattatttatgactcaccggtgaccaacaccaaagcaaccttcacctacaaggaagtgctcgagcaggtgtctaaactggccggtgtactggtgaagcatggaatcaagaaaggcgatactgtcgtcatctacatgcccatgatccctcaagcaatgtacactatgttagcttgcgcgcgaattggagctatacattccctgatctttggcgggttcgcctctaaagaactatcaagtagaatcgatcacgttaagccgaaagtcgttgtcacggcctccttcggcatcgaacccggacggcgagttgagtatgtacctctcgtcgaggaagccctcaaaattggccagcacaagcctgacaaaattcttatctataaccgtcctaatatggaagccgtgccactcgcgcctgggcgcgacctggattgggacgaggagatggccaaagcacagtcacacgattgtgttccagtgctctccgagcatcccctgtatattctgtatacctcagggaccacgggcttgcccaagggagttatacggcccaccggaggctacgctgtcatgttgcactggtccatgagctccatatatggccttcagccaggtgaagtgtggtgggctgccagtgacctgggatgggttgtcggccactcatatatttgttatggccccctgctccatggcaataccactgtactgtatgaaggtaagccagttggtacacctgacgcaggcgcttattttcgtgtgctagcggaacacggcgtagccgccctcttcacagcccccaccgcaatccgcgccatcagacagcaggatcctggcgccgccctgggcaaacagtattctctgaccagattcaaaacactcttcgtggccggggagagatgtgatgttgagacactcgagtggtcaaaaaacgtttttcgggtacccgttctcgaccattggtggcagacagaaacgggaagcccaatcacggcttcatgcgtcgggctagggaatagtaaaaccccaccgcctggccaggccggcaagagcgttcccgggtacaatgtcatgatcctagatgataacatgcagaaactgaaagccaggtgcctgggcaacatcgtcgtgaagctgcctttgcctcctggtgccttttcaggactctggaagaatcaagaggctttcaagcacctctatttcgagaagtttcccggatattacgacacaatggatgcgggttatatggacgaggagggctacctgtatgtaatgagtcgcgtggacgacgtgatcaacgtggccggacaccgaatcagcgcaggcgccattgaggaatccattctgagccacggaaccgtagccgattgcgctgtggtcggcaaggaggacccgctgaagggacatgtgcccctggccctttgcgtgctccggaaggatatcaatgccaccgaggagcaggtgctggaggagatcgtgaagcacgtcagacaaaacattggacccgtggccgccttcaggaacgccgtgttcgttaagcagctgccaaagacgcgaagcggtaagatcccgaggagtgcattatcggcgatcgtcaatggaaaaccatataagatcactagtaccatcgaggacccaagcatttttggccacgtcgaagaaatgttgaaacaggcctag

SEQ ID NO: 107144 - DNA, 1107 bp, Artificial Sequence
  Description of Artificial Sequence: Synthetic coding sequence
atgctgcactggtccatgtcatcaatttatggactgcagccaggggaggtgtggtgggcagcgtcagacttaggttgggtggtggggcattcatacatctgctacggcccactgcttcacgggaataccacagtgctttacgagggtaaaccagtcggaacccccgacgcgggggcatattttcgagtgctggcggaacatggagtggcggccctttttactgcacctaccgccattcgtgctatccggcagcaggacccgggagccgctctggggaagcagtacagcttaacaagattcaaaacactctttgtggctggtgaacgctgtgacgtcgaaaccctcgaatggagtaagaacgtatttcgggtgcctgtgctggatcactggtggcagacagagactggatcgcctatcaccgcgagctgtgttgggttagggaatagcaaaacccccccaccaggccaagccggaaagagtgtgcctggctacaacgtcatgattctggatgataatatgcagaagcttaaagcaagatgtttaggaaatatcgtagtgaagctgcctctgccccctggcgctttcagcgggttgtggaagaatcaggaggccttcaaacacctgtatttcgagaagttccccggctactacgacactatggatgctggctatatggatgaagaaggttacttgtatgttatgagtagggtggacgatgttattaacgtagcgggccataggatctctgccggtgccatagaagaatccatactgtcgcatgggacagtggctgactgcgccgtggttgggaaggaggaccccctgaaaggtcatgtcccattggcactgtgcgtgctgcgaaaggacattaacgctactgaagagcaggtgctggaggaaatcgtgaagcatgtccgccaaaatataggccctgtggccgcctttagaaacgccgtcttcgtgaagcaattacctaagacccgttcgggaaaaatacctcgaagcgctttgtccgcaattgtaaatggtaaaccctacaagattacatctactatcgaagatcctagtattttcgggcatgttgaagaaatgcttaagcaggcatag

SEQ ID NO: 107145 - DNA, 1266 bp, Artificial Sequence
  Description of Artificial Sequence: Synthetic coding sequence
atggcagcaaccctgatacttgagccagctggcaggtgctgctgggatgaaccagtgaggattgccgtacgcggcctggcacctgagcagccagttacactgagagcttccctgagggacgagaaaggggcactgtttcaggcacatgccagataccgggctgatacactcggggagttggatcttgagcgggctcccgcactagggggatctttcgctggtttggaacctatgggtctgctgtgggccctcgagccagagaagcccttggttaggctggtaaagagagacgtccgaactcccctagcagtggaactggaagtcttggatggccacgatcccgatccagggcgcctgctgtgcagggtgaggcacgaacggtactttctgccaccaggcgtaagacgtgaacctgtgcgcgcggggagagtgcgaggaaccctcttcctgccccctgaaccaggcccttttcccggaatcgtggacatgtttgggacagggggcgggctgctagaatatagagccagccttttggctgggaaagggttcgccgttatggcactcgcatattacaactatgaggacttgcctaagaccatggagaccctgcacctcgaatactttgaagaggcggtgaactacctgttatctcaccccgaagtgaaaggtcctggcgtgggcctgctgggtatttcaaaagggggggagttgtgtttgagcatggcctcgttcctgaaggggatcacagccgctgtggtaataaatggatcagtcgcaaacgtgggcggaactctaaggtacaagggagagaccctgccgcccgtgggggtgaacagaaaccggatcaaggtcacgaaggatggatacgctgacattgtagatgtgttaaactccccccttgagggccccgatcaaaagtcttttatacctgtcgaacgagccgaatccaccttcttattcctagtcgggcaggacgatcacaattggaagagtgagttctacgccaacgaggcctgtaagagattgcaggcccacggccgacgcaagcctcaaatcatttgctatcctgagacaggtcattacatcgagcccccttattttcctctgtgtcgcgcatccctccacgcgttggtgggatcccctatcatctggggcggggaacctcgtgctcacgctatggcccaagttgatgcatggaaacagctgcagacattctttcacaaacatctgggcggccatgaaggaactattccatctaaggtgtag

SEQ ID NO: 107146 - DNA, 1785 bp, Artificial Sequence
  Description of Artificial Sequence: Synthetic coding sequence
atgatccagaatgttggtaatcacctgcgccgcggcttggcaagcgtgttcagcaatcgcacgagcagaaagagtgcattacgagcaggaaatgattctgcaatggctgacggggaaggatatcgtaatcccaccgaagtccagatgagccagcttgtgttgccttgtcatacaaatcagagaggagagttgtcagttggccagttattgaagtggatagacaccaccgcatgtctctccgccgagagacatgcggggtgtccctgcgtcaccgcctccatggatgacatctacttcgagcatactatatctgtcggccaagtcgtcaacatcaaggcaaaagtgaatcgcgcgtttaattcttccatggaagttgggattcaggtggcttccgaggacctctgtagtgagaaacagtggaatgtctgtaaagccctggctactttcgtcgcaaggcgggaaatcaccaaggttaaactgaagcagatcactccgagaaccgaggaggaaaagatggaacatagcgtggccgcagagaggaggcgtatgcgcctcgtttatgccgatacaatcaaggaccttcttgctaactgtgcaatacagggggatctggagagccgcgactgtagccgtatggttcctgccgaaaaaactagagttgagtcggtcgagctggtcttacccccccacgccaatcaccagggcaatacgtttggcggccaaataatggcttggatggagaacgtggccacaattgccgcatctcgtctatgccgcgcccaccccaccctgaaggctattgaaatgtttcacttccgcgggccttcccaggtgggagaccgcctcgtattgaaagccatcgtgaataatgccttcaagcattccatggaggtaggcgtgtgcgttgaagcttaccggcaggaagccgagacacaccgccggcacattaattctgcctttatgacgtttgtcgtgctggatgccgacgatcagccccagctgcttccgtggatccggcctcagcctggggatggggagcgaaggtatcgcgaagctagcgcccgcaaaaaaataagactggatcggaagtacattgtgtcttgtaaacagaccgaggtgcctctgtcagtaccctgggacccaagcaatcaagtttatctgtcatacaacaatgtttctagcctgaaaatgttagttgctaaagacaattgggtattatcctccgaaatcagccaggtccgactctataccttggaggatgacaaattcctttcatttcacatggagatggtggtacacgttgacgcagcccaggccttcttgttgctttccgatcttcggcaaaggcctgagtgggacaaacattaccggtccgtggaactggtgcagcaggttgatgaagatgatgctatttaccacgttaccagccccgcacttggggggcacacaaaaccgcaggacttcgtgatccttgctagtagaaggaaaccctgtgacaacggggacccttatgtgatcgccctgcgaagcgtgaccctacctacacatagagaaacgccagaatatcgccgcggggagaccctctgtagtggcttctgcctttggcgcgagggcgaccagctcacaaaagtgagctactacaatcaggccaccccaggcgtgctgaattatgtaaccactaatgtcgcaggactgtctagcgagttctacacgacattcaaggcctgtgaacagttcctgttggacaaccggaatgatctggctccatccctccagacactgtag

SEQ ID NO: 107147 - DNA, 1824 bp, Artificial Sequence
  Description of Artificial Sequence: Synthetic coding sequence
atgatccaaaatgtgggcaaccacctcaggcgcgggcttgccagcgttttttctaacagaacgtctcgcaaatccgcgctccgagcaggcaatgattccgccatggcagacggggagggctatcgtaacccaacagaggtgcagatgagccagcttgtgctgccatgccacacaaatcagaggggggagctgtccgtggggcagctgttgaaatggattgacaccaccgcctgtctgtccgccgagcgacacgccggatgcccctgcgtgactgcctctatggatgatatctactttgaacacacaattagcgtaggccaggtggtgaatatcaaagcaaaagtcaaccgggccttcaacagctccatggaagttggcattcaagtcgcctcagaggacctatgtagtgagaaacagtggaatgtgtgtaaagctctcgctacctttgtggcacggagagagattactaaggtgaagctcaagcagatcactcccagaaccgaagaagagaagatggaacattctgtggcagccgagcgtcgccgaatgcggctcgtgtacgccgacaccatcaaggacctgctcgccaattgcgcaatccaaggtgacctagagagtagagattgctctcgaatggtgccagccgagaaaacacgggttgaaagcgtagagctcgtgctgcctcctcacgcaaatcatcaaggaaacacatttggcgggcagataatggcctggatggaaaatgtcgcaacgatcgcagccagtagactatgtagggctcatcctacactgaaagcaattgagatgtttcacttccgtggcccttcacaagtaggggacaggctggttctaaaagccatcgttaacaacgcctttaagcacagtatggaagtgggcgtatgtgtcgaggcttatcggcaggaggccgaaacacacagacgacacataaattccgcattcatgactttcgttgtgctggatgctgatgatcagccacagctgctgccttggatcagacctcagcctggagacggcgaaaggcgttaccgagaggcatccgcacgaaagaagattcgcctagacagaaaatatattgtgagttgtaagcagacagaggtgcccctctcggtcccatgggaccccagcaaccaggtttacctgtcctataacaacgtgtcttctttgaagatgcttgttgccaaagacaactgggtgctaagctcggagatatctcaagtgcgtttatacaccttggaagacgacaagtttctctccttccacatggagatggtggtacatgtagatgcggcacaggcatttctcctgctgtctgacctccgacagagacccgagtgggataaacattataggagcgtcgagctggtgcaacaggtggatgaagacgatgcgatttatcacgttacctctcctgccctgggtggtcacaccaagccccaagattttgtgatcctggcttccagacgcaaaccttgtgataatggggacccctatgtgattgccctgcgaagtgtgaccctcccgacccatcgcgaaacccctgaataccgaaggggcgaaaccctgtgctcagggttttgtctttggagggaaggcgatcaactgacgaagtgctgttgggtgcgggtctccttgacagagctggtgtctgcttctggcttttacagttggggcctcgagtctcggtctaagggacgtagatctgacgggtggaacggtaagctggcaggaggccacctgtccaccctcaaggccattccagttgccaaaatcaattctcgattcggctatctgcaggacacatag

SEQ ID NO: 107148 - DNA, 1668 bp, Artificial Sequence
  Description of Artificial Sequence: Synthetic coding sequence
atggaaaggcctgcccccggagaggtcgtgatgtcccaggctatccagccggcgcacgccacagccagaggagagttatctgctggccagctgcttaaatggattgatactaccgcctgtttggcggctgaaaaacacgcgggtgtatcttgcgtcaccgcctcagttgatgacatacagttcgaggagactgctcgggttgggcaagtaatcaccatcaaggctaaggtcacacgcgcgttttccaccagcatggaaatcagcatcaaggtcatggttcaggatatgcttacagggatcgaaaagctcgtgtccgtagcctttagcactttcgttgcaaaaccagtcggcaaggagaagattcatctgaaaccagttacccttctcacggagcaggaccatgtagaacacaacctggctgccgagagacggaaagttagattgcagcacgaagatacgtttaataacctaatgaaggagtcttcaaaattcgacgacctcatattcgacgaggaagaaggagcggtgagcactaggggaacaagtgtccagtccatcgagctggtgttgcctcctcacgctaaccatcacgggaatacctttggcggacagatcatggcttggatggagacagtggctacgatcagtgcaagccgtctgtgttgggcccaccctttcctcaagtcagtggacatgttcaaattcaggggaccgtctaccgttggtgaccgactggtcttcactgccatcgtcaataacacattccagacctgtgtggaggtcggagtcagagttgaggctttcgattgtcaggagtgggctgaaggacgcgggcggcatatcaactcagcatttctgatctataatgccgccgatgacaaagagaacctgatcacttttccacgaatccaacccatatcaaaagatgacttccggcggtatcggggcgccatcgctagaaagagaattagattaggacgcaaatatgtcatatctcataaagaggaagttcctctgtgcattcactgggatatctcaaagcaggcctctcttagtgactcgaacgtagaggccttgaaaaaactagctgccaaaaggggctgggaggtgacctcaacagtggaaaaaattaaaatttataccctggaggagcatgacgtcctgagtgtttgggtggagaagcacgtgggttcacccgcccatctggcctataggctgttgtccgacttcaccaagaggcccctgtgggaccctcatttcgtgagctgtgaagtgatcgactgggtatcagaggacgatcagctataccacatcacctgtccaatcctcaacgacgacaagcctaaggacttggttgtgttggtctccaggagaaaaccactgaaagacggaaatacctacaccgtggcagtgaaatctgtgatactgccctcagtcccgccctctccacagtatatccgttccgagatcatctgcgcgggctttctcatccatgcgatagatagtaatagttgcattgtgtcctatttcaatcacatgagcgcttccattctgccatattttgcgggcaatctagggggctggtccaaatctattgaggaaacggccgctagctgcattcagtttctcgagaacccccccgatgacggatttgtatcaacattctag

SEQ ID NO: 107149 - DNA, 1452 bp, Artificial Sequence
  Description of Artificial Sequence: Synthetic coding sequence
atgtccaacaagttactctcaccccatccacattcagtggtgcttagaagtgagttcaagatggcttcctcaccggcggtgctgcgtgcttctcggctctatcaatggtctttgaaaagttccgcccagtttctcggcagcccacaactgcgccaagtgggacaaattatcagggttcccgctagaatggctgccacacttatccttgagcctgccggccgatgctgctgggatgagcctgtgagaatcgctgtgaggggactagcccctgagcagcctgttacactaagagcgagcctcagggatgagaaaggcgctttattccaggcccacgcccgataccgggccgacactctgggagagctcgacctggaacgagctcccgcactgggcggcagcttcgctggcctggaacctatgggacttttgtgggcactcgaaccagagaaaccccttgtcagattggtgaagcgcgatgttcgcacaccattagctgtggaactggaagtgctcgacggacacgatccagacccaggcagactattgtgtcagacgcgccatgagcgttacttcttgcctccaggggtgagaagggaaccagtgcgagtggggagagttaggggcactttatttctgcctcccgagcctggcccattccctggaatagtggatatgttcggaactggaggaggcctcctggagtaccgcgcaagtctcttggccgggaaaggcttcgctgtcatggctctggcctactacaattacgaggatttgcccaagaccatggaaaccctacacctggagtatttcgaggaggccatgaactatttgctgagccaccccgaggtgaagggcccaggagtggggctcctcggcatctccaagggtggtgagctatgtctgagcatggccagcttcttaaaggggattacggcggcagtagtcattaatggctcggtggccaacgtgggggggaccctccactataagggcgagactctgccccccgtgggagtgaataggaaccgcatcaaagtcactaaggacggatacgcggatatcgtggatgtgctcaattcccccctggaagggcctgaccaaaaatctttcattccagtagaacgggcagaaagtacgttcctgtttcttgtcggacaggatgatcataactggaaatcggaattttatgccaacgaagcgtgcaagcgtctgcaggcccatgggcgacgcaagccccagataatctgttatcctgaaactggacactacatagaacccccttactttcccctctgtcgcgcgtcattgcatgcgttggtgggatctcctattatttggggtggcgaaccccgagcccacgcaatggcccaagtcgatgcatggaagcaacttcaaactttcttccacaagcatctgggaggacacgagggaacaatacctagcaaggtgtag

SEQ ID NO: 107150 - DNA, 1266 bp, Artificial Sequence
  Description of Artificial Sequence: Synthetic coding sequence
atgtccgctaccctgatcctggagccacctggacggtgttgctggaatgagccagtgcggattgcagttcgcggattggcccccgagcagagagtgaccctgcgggccagcctgagagatgagaaaggcgcactttttcgggcccacgctcgatactgtgccgatgcacgtggagaactggatctggagcgcgcacccgctctcggcggatcattcgctggtttggagcccatggggctgttgtgggccctggagccggagaaaccattttggcgtttcctaaaaagggacgtacagatcccgtttgtcgttgagctagaagtgctcgacggtcatgaccctgagccgggcaggctattgtgccaggcccagcacgagagacacttcttgccccctggcgtgcgccgccagtcagtgagggctggtcgcgtgcgggccaccctttttcttcccccaggacctggaccgttccccggaatcatcgatattttcggcatcggcggggggttgctggagtaccgggctagcttactggctggccacggatttgccacccttgcattggcttattacaacttcgaggacctgcctaacaacatggataatatttcactggagtacttcgaggaagcagtgtgctatatgctccagcacccacaggtcaagggcccaggcattggcctactgggcattagcttgggagccgatatctgtctttctatggcatcgtttttaaagaacgtatcagcaactgtgtcaataaatggttcagggatttccggcaatacagcaatcaattacaagcacagcagcataccccccttggggtacgacctacgccgtataaaggtcgccttctccgggctcgtcgatatcgtcgacattagaaacgcgctggtaggggggtacaaaaacccatctatgataccgattgaaaaggcacagggcccaatcttactgatcgtaggtcaggatgatcataattggaggtcagagctgtatgcccaaaccgttagtgaacgtctgcaggctcatgggaaagagaagccccaaattatctgttacccaggcacggggcattatatcgagccaccatatttccctctttgcccggcgtctctgcacagactgcttaataagcacgtaatctggggcggagagccaagagcacacagcaaggctcaggaggacgcctggaaacagatcttggcatttttttgtaaacatctcggcgggactcagaagacagcagtccccaagttatag

SEQ ID NO: 107151 - DNA, 624 bp, Artificial Sequence
  Description of Artificial Sequence: Synthetic coding sequence
atgctacaacatcccaaagtgaaggggccttctatagcgttattgggtttcagcaagggtggggacctgtgcctgtccatggcctcatttctgaaaggaatcacggccacagtcctcataaacgcatgcgttgctaacaccgtggcgccactgcactataaagatatgatcattcctaagctggtggacgatctgggtaaagtcaagattaccaagtctggtttcctcacatttatggacacatggagcaacccattggaggagcacaaccatcagagcctcgtgccgctggagaaggcacaggtccctttcctgttcattgtggggatggacgaccaatcatggaagtcagaattttatgcacagatcgcatccgaaaggctgcaggcccatgggaaggaacgtccccagatcatctgctatcccgagaccggacattgcattgatccaccctacttccctccaagccgtgcttccgttcacgcagtgctcggcgaggccattttttacgggggcgaaccgaaggcgcatagcaaggcacaggtcgatgcctggcagcagatccaaacgttcttccacaaacacctcaatggaaaaaaatccgtgaagcattcaaaaatatag

SEQ ID NO: 107152 - DNA, 507 bp, Artificial Sequence
  Description of Artificial Sequence: Synthetic coding sequence
atgctgcagcatcctaaggtgaagggcccaagtatcgccctgctcggcttcagcaagggcggggatctgtgcctgtctatggcttctttcctcaagggaatcacggccacagtccttatcaatgcctgcgtggccaataccgttgcacccctccattacaaagacatgatcatcccaaaattagtggacgatcttggcaaggttaagatcaccaagagtggctttctcacctttatggatacctggtccaatcctctcgaggaacataatcaccaaagccttgtacctttggaaaaagctcaagttccttttctgttcatagtggggatggatgaccaatcctggaagagcgagttctacgcccagatcgcctctgagcgtcttcaggcccacggaaaagagcgtcctcagatcatatgttacccagagaccggtcattgcatcgatccaccttatttcccaccctcacgggcaagcgtccacgccgtccttggcgaggcaatttag

SEQ ID NO: 107153 - DNA, 1113 bp, Artificial Sequence
  Description of Artificial Sequence: Synthetic coding sequence
atggcacggccggggctgatacacagtgcacccgggctgccagacacttgcgctctgctgcaaccaccagccgccagcgccgcggcagccccctccatgagtggacccgatgttgagacgccatctgcaattcagatttgccgcatcatgaggccggatgatgccaatgtggccggcaacgtgcacggggggactattttgaaaatgatcgaggaagccggagccattatttccaccaggcattgtaacagccagaacggggaaaggtgtgtcgcagccttggccagggtcgagcggaccgatttcctcagccccatgtgcatcggagaggtggcgcacgttagcgctgagatcacctacacgtcaaaacactccgtcgaggtccaggtcaacgtgatgtctgagaatatactgactggagccaaaaaactaacaaataaggctacactgtggtacgtgcctctcagtctcaaaaacgtcgataaggttttggaagtgccccctgtggtttacagccgccaggagcaggaggaggaaggtaggaagagatacgaggcccagaagctcgagcgaatggagaccaaatggaggaatggagatatagtacagccagtgttgaaccctgaaccaaatacggtgagctacagccaatcatcattaattcatctcgttgggccatccgattgcacactgcacggtttcgtacacggaggcgtaactatgaagctgatggacgaggtcgccggaatagtcgccgccagacattgcaaaactaacatagtgacagcatccgtggacgccatcaattttcacgacaagatacgcaagggatgcgtcattaccatatccggaagaatgacatttacatcaaataaaagtatggagattgaagttcttgtggacgccgaccccgtcgtggatagctcccaaaagagataccgggcggcttctgcattctttacctacgttagtttgtcacaagaggggaggtccctcccagtgccacagctagttcctgaaaccgaggatgagaagaaacgcttcgaggagggaaaaggacgatatctgcagatgaaggcgaagcgacagggccatgccgagcctcagccttag

SEQ ID NO: 107154 - DNA, 990 bp, Artificial Sequence
  Description of Artificial Sequence: Synthetic coding sequence
atggcgttccagctttcccgtataatgcggcccgacgacgccaatgtcgctgggaacgtacacggcggcactatcttaaaaatgatagaggaagccggggctataatatcaactagacattgcaatagtcagaatggtgagaggtgcgtcgccgctcttgcacgggtggaacgcaccgatttcttgtcgcccatgtgcatcggcgaagtcgcccacgtctctgctgaaattacgtatacctccaagcatagcgtggaagtgcaggtcaatgtcatgagcgaaaatattctcaccggagccaagaagctaacaaataaggctaccttgtggtacgttccactcagcttgaaaaacgtggataaggtgctggaggtcccaccagtcgtttattctcgacaggagcaggaagaggagggaaggaagagatacgaggcccagaaattggaacgtatggaaacgaaatggcgaaacggagatatcgtgcagcccgttctgaatcctgagccgaataccgtctcttatagtcagagctcactcattcacctcgtggggccctccgactgtaccctacacggattcgtacacggcggcgttactatgaagctcatggatgaggtggccggcatcgtggccgcccggcactgcaagactaacatcgtcacagcaagcgtggacgctatcaatttccatgacaaaattagaaaagggtgtgtgattactatctccggaagaatgacctttacaagcaataagagtatggagatcgaagtgctcgtggacgcagatccggtggtcgatagttcccagaaaagatacagagccgcttcagcctttttcacctacgtgtccctctcccaagaggggcggtccctgccggtgcctcagttagttcccgagacagaggatgaaaaaaaaagatttgaggagggcaaaggccgctatttgcaaatgaaagctaagcgacagggccacgccgaaccacagccatag

SEQ ID NO: 107155 - DNA, 1053 bp, Artificial Sequence
  Description of Artificial Sequence: Synthetic coding sequence
atgctgctgctgcgtcggtcgctctctttgaatgtcctgcgtaaggaggttgaccgagcttgctttggtgaaaaagctaagcagattatgaggcccgatgatgctaatgtggcaggcaatgttcacggcggaaccatcctcaaaatgatcgaggaggcgggtgccatcatctcgaccagacactgtaattcacagaacggtgagaggtgcgtcgccgccctggccagagtggaacgaaccgactttctgtccccaatgtgtatcggggaagtagcccatgtgagcgccgaaatcacatacacatcaaagcattccgtggaggtgcaggtaaatgttatgtcagaaaatatcttgactggggccaaaaagctaactaacaaggctacactctggtatgttccactcagtctgaagaatgttgataaagtcttagaagtgcctcccgtggtgtactctcgacaagagcaggaagaagagggtaggaagaggtatgaagcacagaaactggaaaggatggaaaccaaatggaggaacggagacattgtacaacctgtcctgaacccagagcccaacactgtgtcttactctcagtcgagcctgatccatctggtcggcccaagtgattgtacattacacggctttgtgcatggtggggtcaccatgaaactgatggacgaagttgcaggcatagtggccgcccgacactgtaaaaccaatatcgtgaccgcttctgtggacgctattaatttccacgataagatccggaaaggctgcgttataaccatatctgggcgcatgacctttactagcaataagtccatggaaattgaggtgctcgtcgacgccgatcccgtggtcgacagtagtcagaagcggtaccgtgccgcgtctgctttctttacctatgtctcattgtcacaggagggcagaagcttacccgttccgcagctggtaccggaaactgaggacgaaaaaaaacggtttgaggaagggaaaggccgatacctgcagatgaaggcgaagcgccaagggcatgcggagccacagccgtag

SEQ ID NO: 107156 - DNA, 1143 bp, Artificial Sequence
  Description of Artificial Sequence: Synthetic coding sequence
atgaaactgctggccagagcattgcgcctgtgtgaattcgggcgtcaggcgagctctaggagactagtcgcaggacagggttgcgttggccctcggagaggatgctgcgcgcctgtacaggtggttggtcccagagcggatttgcctccatgcggagcatgcattaccggccgcattatgcgacctgacgatgccaatgtcgcaggaaatgttcatggaggtactatacttaagatgatcgaggaggcaggtgctatcattagcaccagacactgcaactctcagaatggagagagatgcgtggccgcattggctagagtggaacgtactgattttctctccccgatgtgcattggcgaagtggcgcacgtatctgctgagatcacgtacacatctaagcattccgtagaggttcaagtaaatgtgatgagcgagaacatcctgactggagctaaaaaactaacaaataaggcgactctttggtatgtaccactctcgctcaaaaatgtggataaagtattagaggtacctcctgtcgtgtattcccgacaggaacaggaggaggaaggcaggaaaaggtatgaagcccagaagttggaacgcatggagacaaagtggcggaacggcgatatagtccagcctgttctcaatcccgaacccaacactgtgtcttactcccagagtagtctgatccaccttgtcggaccttctgattgtacacttcatggtttcgttcatggaggggttacaatgaaactcatggacgaggttgccgggatcgttgccgcccgacactgtaaaacaaacattgttacggcctccgtcgacgcaatcaactttcacgataagatcaggaaggggtgcgtcataactatctccggccggatgacgttcactagtaacaaatctatggagatagaggtgcttgtggacgccgatcccgttgtggactcttcacagaaaagatatcgtgctgcttccgcattcttcacttacgtctccctgtcacaagagggtaggtctctaccagtcccacagttggtgcctgaaacagaagatgagaagaagagattcgaagaaggaaagggaaggtatcttcagatgaaggccaaaaggcaaggtcacgcagaaccccagccttag

SEQ ID NO: 107157 - DNA, 672 bp, Artificial Sequence
  Description of Artificial Sequence: Synthetic coding sequence
atgctgctgctacgacgatccctttcccttaatgtactgcggaaagaggtggaccgggcatgctttggagagaaggctaaacaaatcatgcgacccgatgacgctaacgttgccggcaacgtgcatgggggaactattctcaaaatgattgaggaagctggggccattatctccaccaggcactgcaacagccagaatggtgaacgatgcgtggccgcactggccagagtagagaggactgacttcctaagtcccatgtgcatcggtgaggttgctcatgtcagtgccgagataacctacacatctaaacacagtgtggaggttcaggtgaacgtgatgtccgaaaacatcctgacaggggcaaagaaactgacgaacaaagccaccctgtggtacgtccccttgtctctcaagaatgtcgataaagtactggaggtacctccagtggtctacagcagacaggaacaggaggaggagggacgcaagaggtacgaggcccagaaactcgagcgcatggagaccaaatggcggaacggcgacatagtgcagcccgtgcttaaccccgagccaaataccgtttcttattcacagagcagtctcatccaccttgtggggcccagcgattgtaccttgcatggatttgtgcatggcgggggggtcgatttccactag

SEQ ID NO: 107158 - DNA, 798 bp, Artificial Sequence
  Description of Artificial Sequence: Synthetic coding sequence
atgtgcattggggaagttgcacatgttagtgccgaaatcacatatactagcaagcatagcgtggaggtccaggttaacgtaatgtcagaaaatattcttacaggagccaaaaagctgactaataaagctaccttgtggtatgtacccctcagccttaaaaacgtcgataaagttctcgaggtgccccccgttgtttattcccgtcaggaacaggaggaggagggtcgcaagaggtatgaagcgcagaagctcgagcggatggagactaagtggcggaatggcgacattgttcagccagtgcttaaccccgagccaaacacagtgagttattctcagtcctctctgattcacctagttgggccttccgattgtaccctgcacggctttgtacatggtggcgtgaccatgaaactgatggatgaagtcgcagggattgtcgccgcacggcattgcaagaccaacatcgttactgcctccgttgatgcaataaatttccatgataaaatccgcaagggatgcgtgattacaatctcgggaagaatgacgttcacctccaacaaatctatggagatagaagttctggtcgatgctgatccagtggtggattcatctcaaaaacgctacagagccgccagcgcattttttacctatgtgagtctctcccaggagggccgatctttgcctgtcccacagttggtaccagaaacagaggatgagaagaaacgattcgaggagggcaaaggccgctatctccagatgaaggccaaaagacaggggcacgcggaaccacagccctag

SEQ ID NO: 107159 - DNA, 1308 bp, Artificial Sequence
  Description of Artificial Sequence: Synthetic coding sequence
atggccgcgcccctcgtgctggtgcttgtggtggctgtaacagtgcgcgcggccctcttcaggtcaagtctcgccgagttcatcagtgaaagggtggaggtggtgtcaccactgagttcttggaagagagtggtggagggcctctcccttctcgatttaggtgtatcgccatactccggagctgtgtttcatgaaaccccactaattatctaccttttccactttctaatcgactacgccgagctggtttttatgataactgatgccctgaccgcgatcgccctgtactttgccatccaggacttcaataaggtggtgttcaagaaacagaaactgttgctagagctggaccaatacgcacccgatgtcgctgaactgatccgcactccgatggagatgcggtatatacccttgaaggttgcgttattctatcttctgaatccctatacaatactttcgtgtgtcgcaaagagtacctgcgccatcaataatacgctgatagccttttttattctgactactattaaaggttcggcctttctgtctgctatcttcctggccctggccacataccaatctctttatccgttgacgctgtttgtgcccggactcctgtatctcctgcagcgtcagtatatcccagtcaagatgaagagcaaagccttctggatcttctcatgggagtacgctatgatgtatgtcggcagcttagtggttatcatttgtttgtccttcttcctattatcgagctgggacttcatccccgcagtgtatgggtttatcttgagcgtgcccgacctgacccccaatatagggctgttttggtactttttcgccgagatgttcgagcatttttccctgttctttgtttgcgttttccagatcaacgtcttcttctataccatcccgctggctatcaagctgaaggagcaccccattttcttcatgttcatccaaatcgccgttatcgcaatctttaagtcctatcctacagtcggagatgtcgcgttatatatggctttcttccctgtgtggaaccacctctacaggtttctacgcaacatcttcgtgttgacatgtatcattattgtgtgttctctgctctttcccgtgctctggcatctttggatttacgccgggagcgctaattcaaatttcttctatgccatcaccctcactttcaacgtcggtcagattctattaatcagtgattatttctacgcatttctgcgtagggagtactacttaactcacggcctgtacctgaccgctaaagacggaactgaggccatgctagtcctcaaatag

SEQ ID NO: 107160 - DNA, 342 bp, Artificial Sequence
  Description of Artificial Sequence: Synthetic coding sequence
atgtcaagccctcaggccccagaggatggtcaggggtgtggagaccgaggggatccaccaggcgatctgcgatctgtgctcgtaactaccgtgctgaaccttgagcctctcgacgaggatctgtttcgcggacggcactactgggtccccgccaaacgacttttcggggggcagatcgttggccaagcgctcgttgccgccgcaaaatcagtgagtgaggacgtccatgttcatagtctgcattgttactttgtgcgggccgaacagatgccaagctgcgttttaaggcgctcgcccgccgaaaagagtctctggaccttcactgtgtgcgacttgtactag

SEQ ID NO: 107161 - DNA, 1320 bp, Artificial Sequence
  Description of Artificial Sequence: Synthetic coding sequence
atgcggcgggccgcccttcgtctgtgcgccctcggcaagggacagcttacgcccggccggggtctgacccaaggcccacaaaaccccaaaaaacagggcatttttcacatccatgaggtcagggataagttgcgggagattgtgggagcgtcaacaaattggcgcgatcacgttaaggccatggaagagcgtaaattgcttcactcgttcttagccaagtctcaggacggcttgccccctcggcggatgaaggatagctacatagaagtgctccttcccctcgggtcagagcctgagctccgcgagaaatacctgactgtgcagaatacagttcggtttggaaggattctcgaggatttggacagtcttggcgttctgatctgctacatgcacaacaaaatacacagtgctaagatgtcccctctcagcatagtaaccgctttagtggacaaaattgatatgtgcaagaagagcttatccccagaacaggatattaaattttccggacatgtttcatgggtaggcaaaactagtatggaggtgaaaatgcagatgttccagctgcatggtgatgaattttgtccggtactggatgcaacgtttgtgatggtcgcacgggactcagagaacaaaggaccggccttcgtcaatccactgatcccggagtccccagaggaagaagaactcttcagacagggggaattgaacaaaggacgcaggatcgcctttagcagtactagcctactgaagatggcgccaagtgcggaggaacgtacaacgatccatgagatgtttttgagcaccctcgacccgaagaccatcagcttccgcagccgggtcttgccatcgaacgctgtgtggatggagaacagcaagctgaaaagtttggaaatctgtcaccctcaggaacgcaacatcttcaatcgtatatttggcggatttctgatgcggaaggcgtatgagttggcatgggccaccgcctgttcctttggtggttctcgcccttttgtggtggccgtcgacgatattatgttccagaagccggtggaggtgggctccttgctgtttctctcaagtcaagtttgttttacacagaataattatatccaggtaagagtgcacagtgaggttgcttctctgcaggaaaaacagcacaccacgacaaacgtgttccactttaccttcatgagcgagaaggaggtcccgctggtgttccccaagacgtatggagaaagtatgctctaccttgatggccagagacactttaatagtatgagcggtcccgccacattaagaaaagactacctcgttgagccctag

SEQ ID NO: 107162 - DNA, 1140 bp, Artificial Sequence
  Description of Artificial Sequence: Synthetic coding sequence
atggaggaaagaaaactgctgcatagcttcctggctaaatcccaggacggccttccgcccaggcgcatgaaagattcctatattgaggttctgctgcctcttgggtctgaacccgagctgcgagagaaatacctgacggtgcagaacaccgtgcggtttggtcgaatcctggaagacttagattccttaggggtgcttatctgttacatgcacaataaaatccactccgccaagatgtcacccctttccatcgtcactgcactggtggataaaattgacatgtgtaaaaagagcctctcccctgagcaagatattaagtttagtggacatgtaagttgggtgggaaagaccagtatggaggtgaagatgcagatgtttcagcttcacggggatgagttctgccccgttctcgacgccacatttgtgatggtggcacgagattcagagaataaaggacctgcctttgtcaaccccctgatccctgaaagcccagaggaggaggaacttttccgacagggggagctgaataagggaaggcgcattgctttctctagtacctccctgttaaagatggccccttccgcggaggagagaaccaccattcacgaaatgttcctctcaaccctggatccaaaaacaatttcttttaggtctcgcgtacttccttccaatgctgtctggatggagaactccaagcttaagtccctagaaatttgccatccccaggaacgcaacatcttcaatcggattttcggtgggttcctgatgaggaaagcctatgaattggcatgggccactgcttgttctttcggagggtcacggccctttgtggtggccgtggacgatatcatgtttcagaagcctgtggaagttggatcacttttgttcctgtcctctcaggtctgttttactcagaataactatatccaggttagggtgcactctgaagtggcttctctgcaagaaaagcaacataccacaaccaatgttttccactttacatttatgagcgagaaagaggtgcccctcgtgtttccaaagacctacggggagagtatgctctatctcgacggccagaggcactttaattctatgagtggcccggcaacgttgcggaaggactacctggtggaaccatag

SEQ ID NO: 107163 - DNA, 1347 bp, Artificial Sequence
  Description of Artificial Sequence: Synthetic coding sequence
atgagacgtgccgcgctgcggctctgtgcgctgggcaaaggccagctcacacctgggcgcgggctaacccagggaccacagaatcccaagaaacaggggattttccacattcacgaggcctgtagttcaatacatgtcaaccacgtgagagataagctaagagaaatcgtgggtgccagcactaactggcgggaccacgtgaaagcaatggaagagaggaaactgttgcacagtttcctggcaaaaagccaggacggactgcctcctaggcgcatgaaggattcttatatcgaggtccttctcccactcggaagtgagccagaacttcgggaaaaataccttaccgttcagaatacagtcagattcggtcggatactggaggacttggacagcttgggtgttctcatttgctacatgcacaacaagatccattctgccaaaatgtctcccttgtctatcgttactgcactggtggataagatcgacatgtgtaagaagtccctatcgcccgaacaggatatcaagttcagcggacacgtcagctgggtgggtaagacatccatggaagtaaagatgcaaatgttccagttgcatggagacgaattctgccctgtgttggatgctaccttcgtaatggtagcacgcgacagtgaaaataagggtccagcttttgtgaacccattgatcccagagagccctgaagaagaggagctgtttcggcagggtgagctaaataagggacggcgtatagcgttctcgtctacctcgttgctgaagatggctcccagtgccgaggagagaactaccattcatgagatgttcctgtctacactggatccaaagaccatatctttcagatccagggtgttaccctcaaacgctgtttggatggagaattcaaaactgaaatctctcgaaatatgtcaccctcaggagcgtaacattttcaatcggatttttgggggtttcctcatgcgcaaggcctatgaactcgcctgggctacagcctgctctttcgggggatcacggccttttgtggtcgcagtcgatgatatcatgtttcaaaagccagtggaagtggggtccctcctcttcttaagtagccaggtttgctttacacaaaacaattatatccaggtgcgggtgcacagtgaggtagcgagtctccaggagaaacagcatacaaccactaatgttttccattttactttcatgtcagaaaaagaggtcccacttgtgtttcccaagacgtacggcgagtcaatgttgtacctcgacggtcagagacattttaactccatgtccggtcccgctactctgcggaaggactatctagtagagccatag

SEQ ID NO: 107164 - DNA, 1269 bp, Artificial Sequence
  Description of Artificial Sequence: Synthetic coding sequence
atgacggtttttttcaagacactccgcaatcattggaaaaagaccaccgcgggcctgtgcctgctaacctggggaggccattggctatacggcaagcactgtgataacctcctgaggcgtgctgcctgccaagaggctcaagtgttcgggaaccagctgatcccccccaacgcccaagtcaagaaggccaccgtttttctaaacccggccgcttgtaagggcaaggcaagaactttgtttgagaagaatgcagcccccattctgcatttgagcggaatggacgtgaccattgtgaaaacagattatgaaggacaggccaagaaattactggagctgatggagaatacagatgtgattatcgtcgcaggcggtgatgggaccctgcaagaggttgtgacaggagtcctaaggcgcactgatgaggccaccttcagtaagattcccattggtttcatccctctgggggagacgtcaagcctgagccacacactgttcgccgagagcggcaacaaggtgcagcacattaccgacgctactctagcaatcgtcaaaggggaaacagtaccgctggatgtgctgcaaatcaaaggcgaaaaggagcagcctgtgtttgcgatgactgggctccggtgggggtcatttcgcgatgctggcgtgaaagttagtaagtactggtacttaggcccgctgaaaatcaaggcagcccacttcttttccaccctaaaggagtggcctcagacccaccaggccagcatcagctatactggcccaacagagcggcctcctaacgagccagaggagacacctgtgcagcggccttctttgtaccgcaggatcttgcggaggttagcaagttattgggcccagcctcaagacgcattgagtcaggaagtttctcctgaagtatggaaagacgtgcagctgtctacaattgaactgtctatcaccacgcgcaataaccagctggacccaacttctaaagaggacttcctcaatatttgtatcgagcctgatacaatctctaaaggcgactttatcaccattggctctcgaaaggtacgtaacccgaagttgcatgtggaaggcactgaatgcctccaggcttcacagtgtactctactgattcctgagggtgctggaggatcattctcgatagacagtgaggagtacgaagccatgccagtcgaagttaaactgctacctaggaagctgcagtttttctgcgacccccgaaagcgggagcagatgctgacgtctcccacccagtag

SEQ ID NO: 107165 - DNA, 198 bp, Artificial Sequence
  Description of Artificial Sequence: Synthetic coding sequence
atgaccgtattctttaaaacccttagaaaccactggaaaaagaccacagccggcctttgcctgctgacctggggagggcactggctctacggcaagcactgcgacaatctactgcgccgtgctgcctgtcaggaggctcaacactaccaggacgagtcacggtgggaacccactctgtccagaaccccgggaagctag

SEQ ID NO: 107166 - DNA, 198 bp, Artificial Sequence
  Description of Artificial Sequence: Synthetic coding sequence
atgacagtctttttcaagaccctgcgcaaccactggaagaagacaacagctggcctctgcctgcttacatggggcggccactggctatacggcaagcattgtgataacttgctgcgaagagccgcgtgccaggaggcacagcactaccaagacgagagccgttgggaacccaccttgtctagaactccaggaagttag

SEQ ID NO: 107167 - DNA, 735 bp, Artificial Sequence
  Description of Artificial Sequence: Synthetic coding sequence
atgactgtattttttaagacactacgaaaccactggaaaaagacgacagccggcctttgcctccttacttgggggggtcattggctctatgggaaacactgcgacaatcttctgcgacgagccgcctgccaggaagctcaggtgtttggtaatcagctgatcccaccgaatgcccaggttaagaaagctacagtgtttctgaatcccgcagcttgcaaggggacattgttcgagaagaatgccgcccccattctgcacctttctggcatggatgttacaatagtcaagacggattatgaaggccaggccaaaaagttactggaattgatggagaatacagacgttattattgtggccggaggcgacggaaccctgcaggaggtcgtaacaggcgtactgcgcagaacagacgaggctactttttctaaaatacccataggctttattccattaggagaaacttcatcattgagtcacaccctcttcgctgaatccggcaataaagtgcagcatatcactgacgccactctagccatcgtcaagggcgagaccgtgcccctcgacgttctgcagattaaaggagagaaggaacaacccgtttttgccatgacaggtctcagatggggcagcttcagggacgcgggtgtcaaagtaagcaagtactggtatcttggtcctctaaagatcaaggctgcacactttttctcgactcttaagccctttcctaaaagatag

SEQ ID NO: 107168 - DNA, 1728 bp, Artificial Sequence
  Description of Artificial Sequence: Synthetic coding sequence
atgcagtccccgtggaagattttgactgtcgctcccttattccttctgttgagtcttcaatcctccgcatccccagctaatgacgatcagagcaggccctcactttctaacgggcacacctgcgtgggatgtgtgctggtggtatcggttatcgagcagctggcccaggtacataacagcacggtgcaggccagcatggagcgattatgctcctatttacctgagaagctctttctaaaaactacatgttacctggtgattgacaaattcgggtctgacattataaaacttctgagcgctgacatgaacgccgatgttgtctgccatacccttgaattttgcaagcagaacaccggtcaacccctctgtcatctgtaccccctgccgaaggagacctggaaattcaccctccaaaaagcccgacaaatcgtgaagaaaagcccaatactgaaatactctagatctggcagcgatatctgctccctgccagtgctggccaagatatgtcagaagatcaaactggccatggagcagagcgtgccttttaaagatgtcgacagcgataaatatagcgtgttccccaccctgcggggatatcactggcgcggcagggattgcaacgatagtgacgagtctgtttaccccgggaggaggccgaataactgggatgtgcaccaggacagtaattgcaacgggatctggggtgtggatccaaaggatggagtcccttacgaaaaaaagttctgcgaaggtagccagcctcggggcattatcctacttggggactctgcgggcgctcacttccacatcagccctgagtggattacggcgagccagatgagtctgaattcatttataaatctacctacagctctgacgaacgaactcgattggcctcagctaagcggagcaaccggttttctcgattccacagtgggcattaaggaaaaatccatctatctgcgcctctggaagcggaatcattgtaaccatagagactaccagaacatttcaaggaatggcgcatcgagtcgaaatctaaagaaatttattgagtcactcagcaggaataaggtgttagactacccagcaatagtgatctatgccatgataggaaacgacgtgtgtagtggcaaatcagacccagtgcccgcaatgactacacccgagaaactgtactcgaatgtgatgcaaactctgaaacatctgaattcacatctccccaatggaagccacgtcattctttatggactccctgatgggacattcttgtgggataacttacataacaggtatcaccccttgggccagttgaataaggacatgacatacgctcagctgtattcttttttgaattgcctccaggtatctccttgccatgggtggatgagctccaataagaccttacggaccttaacctccgaaagggcagagcagctgtctaatacacttaaaaagattgcagcttctgaaaagttcactaattttaatctattctatatggacttcgcctttcatgaaatcatacaagagtggcaaaagaggggtgggcaaccatggcagctgatcgaacccgtcgatggcttccatcccaacgaggttgctctactgttactcgccgaccatttctggaagaaagtgcagctgcagtggccacagatactcggcaaggagaatccgtttaaccctcagataaaacaagtgtttggggatcagggggggcattag

SEQ ID NO: 107169 - DNA, 1632 bp, Artificial Sequence
  Description of Artificial Sequence: Synthetic coding sequence
atgcagtctccgtggaaaatccttacagtggcccccctcttcctacttctgtcgttgcaatcatctgccagtcctgcgaatgacgatcagtcccggccaagtctgagcaatggacatacctgcgtggagaagctctttctgaagacaacctgctatttggtgattgataagtttgggtccgacatcattaagctgttgtccgctgatatgaatgctgacgtagtgtgccatacactggagttttgtaagcagaatacaggacagccactgtgtcacctgtatcctcttcccaaggagacctggaaatttaccctccaaaaagctagacaaattgttaaaaagagtccgatcctcaagtactcccggtctggctctgatatctgttcacttcctgtcctggccaagatatgtcagaagatcaagcttgctatggaacagagcgtaccgttcaaagacgtggattctgataagtatagtgtgtttcctactctgcgggggtaccattggcggggacgtgactgtaatgactctgacgagtcggtgtatccaggacgccgaccgaacaactgggatgtgcaccaggactctaactgtaacggtatctggggtgtggaccccaaagatggagttccttatgaaaaaaagttctgcgagggatcacaaccgcgaggtatcattctgctgggcgactcggcgggagctcatttccatatcagccccgaatggatcaccgcctctcagatgagcctaaactcattcataaatctgcccaccgctctcaccaacgaactcgattggcctcagctatctggtgccacagggttcttggatagtaccgtagggatcaaggaaaaaagcatatacttgagactgtggaagcgcaatcactgcaaccaccgcgactatcaaaacatcagccgcaatggtgcttctagccggaaccttaaaaagttcatcgagtcgctgtcaaggaataaagtcttggattaccctgctatagtgatctatgctatgatcgggaacgatgtgtgcagcgggaagtctgaccccgtccctgcaatgacaactccagagaagttgtatagcaacgtaatgcagaccctgaagcacctcaacagccatctgcccaatggaagtcacgttattctttatgggctacctgatggtactttcctgtgggacaatcttcataacagataccaccctttgggccagctcaacaaggacatgacttatgctcagctatacagttttctaaactgcctacaggtcagcccatgtcacgggtggatgagctcgaacaagacactgcggaccctgactagcgaaagagcagagcagctcagtaatacattaaagaagatcgccgcgagcgagaaattcaccaatttcaacttgttctatatggacttcgcttttcatgagatcattcaggaatggcagaagcgtggcggacagccatggcaacttattgagccggtggacggattccacccaaacgaggtggcactactcctgctcgctgaccacttttggaaaaaggtccagctgcaatggcctcagatccttggaaaggagaaccctttcaacccccaaattaagcaggtgttcggtgatcagggcggtcattag

SEQ ID NO: 107170 - DNA, 894 bp, Artificial Sequence
  Description of Artificial Sequence: Synthetic coding sequence
atgaagctgaaaaattcattcatcaacctgcctacagcactgactaacgagcttgactggcctcaactgtcaggagctactggattcttagactcaaccgtgggaattaaggaaaagtccatttacttgcgtctgtggaagcggaaccattgtaaccaccgcgattaccagaatattagtagaaacggggcttcatccaggaatctcaaaaaatttatcgagtcgctctctaggaacaaagtgctggactaccccgcaatcgtcatttacgcgatgatcggaaatgacgtgtgctccggcaaatcagaccccgtgccagcaatgactacccctgaaaaactttattcaaatgtgatgcagactttaaaacacctcaactcccacctgcctaatgggtcacacgtgatactgtacggactgcccgacggtacttttctgtgggacaatctgcataaccgatatcacccgttaggccagctaaacaaggatatgacttacgcacagctatactcctttttgaactgcctacaagtcagcccgtgccatggttggatgtcctctaataagacactacggacacttacctcagagagggcagaacagctctcaaatacactgaagaagatcgcagcatcagagaaattcacgaatttcaatctgttttatatggacttcgccttccacgagattatccaggaatggcaaaagaggggagggcagccatggcaactgatcgagccagtggatgggttccacccgaatgaagttgccctgcttctcttggccgaccacttttggaagaaggtgcaactgcagtggccccaaattttgggcaaggaaaatccgtttaacccccagatcaagcaggtattcggcgaccaaggaggccactag

SEQ ID NO: 107171 - DNA, 2061 bp, Artificial Sequence
  Description of Artificial Sequence: Synthetic coding sequence
atgcagagcccgtggaaaattctcactgttgcacccctctttctgctgctgagtctgcagagctccgcgagtcctgccaacgacgaccaatcccgaccctccttaagcaatggacacacatgcgttggttgtgtcctcgttgtatcggtgattgagcaactggcacaggtccataactcaacggtccaggcttctatggaaagattgtgcagctatcttccagaaaaactgtttctaaaaaccacttgctacctggttattgacaagtttggcagcgatattataaaactcctgagcgcagacatgaatgcagacgtggtatgtcatactctcgagttctgcaaacaaaacacaggccagcccctatgccacctgtatccgctccccaaagaaacgtggaaattcactttgcaaaaggccagacaaatcgttaaaaagtccccaattctcaaatactcccgctcaggaagcgacatctgctctctgcctgtgctagccaaaatctgccagaagattaagctcgcaatggaacaatccgtgcccttcaaagacgtagattcagataagtacagtgtgtttcctacactgcggggttatcactggcgcggacgggattgcaatgactcggatgagtccgtttacccaggccgtagacccaataattgggatgtgcaccaagactccaactgcaacgggatttggggtgtcgacccaaaagacggtgtcccctatgaaaagaaattctgtgagggatcccaacctcgcggtatcatactgctgggagatagtgccggagctcacttccatatctctcctgaatggattacggcgagtcagatgagtttgaattctttcatcaatttgccaacagcacttacaaatgagttggactggccacagctgagcggggctaccggcttcctcgattccaccgtagggattaaggaaaagtctatctacctacgcctgtggaagcgcaaccattgtaaccatagggactatcagaacatcagccggaatggcgcaagcagccgaaacctcaagaagtttatcgagtctctgtccaggaataaggtcttagattaccccgccatagtgatatacgcaatgattggtaatgacgtttgcagcggaaagagcgaccctgtgccagctatgacaacaccagagaagctgtactctaacgtgatgcagacactcaaacatcttaattcccatcttcctaatggctcccatgtgattctgtacggcctacctgatggaacctttctctgggacaacctccacaacagatatcaccctttgggccagctcaacaaagacatgacttatgctcagctctacagttttctgaattgtcttcaggtgagcccatgccacgggtggatgtcctcaaacaagacactgaggaccttgaccagtgagcgggctgaacaactatctaataccctgaagaaaatcgccgcaagcgagaagttcacaaattttaatctcttttatatggatttcgccttccacgagataattcaggagtggcaaaagcggggcggtcagccttggcaactgatcgagccagttgatggctttcatcctaacgagaggaaaagcatcctgctgaaggggattctgatgactagccagaccctcgataatcaggagtggacccagcttacctcttggattaaggggaacctgacctgcgacagccgtacgcgggagtggctgtgctgttgttggagaatcatttctggaaaaaggtgctcgagtagtggccccaaatcatgggagcgcagaatcagaagcacacctcggcttaaccgatgtctcgagactaaggccggaacagaaccgttgcgtagcatgcatccatggggcgcccagggtggcaggggcctcggcaagctgatcccgcagctgtggggactgccacgtcatagacccaagggactttttttctcttcaatcttcaagtgcttgtcacttaatgaagagcacatttggacaactgtgcagtgttgcgtgttgcctggatcagtgacgctcccactgttcctgaagtag

SEQ ID NO: 107172 - DNA, 1992 bp, Artificial Sequence
  Description of Artificial Sequence: Synthetic coding sequence
atgcagagtccttggaaaatcctgactgtggccccccttttcctgctcctctccctccaatctagtgcctcccccgctaacgatgatcagtccagaccctccctgtccaatgggcatacctgcgtgggctgcgtcctggtcgtgagcgtaattgagcagctggctcaagtgcataactcaaccgtgcaggctagcatggagcggctctgcagttatctccccgaaaagctgttcctcaaaacaacatgctacctcgtcatcgacaagtttgggagtgacatcatcaaattgctgtcggccgacatgaacgctgacgtggtgtgccacaccttggaattctgcaagcaaaatacaggccaaccgctgtgccacctctacccgctccctaaggagacgtggaaatttacactgcagaaggccaggcagatcgtgaaaaaatctccaatccttaaatactcccgcagtgggtccgacatctgttctctgccagtgctggccaagatctgtcaaaaaatcaagctggccatggagcaatccgtgccttttaaagatgtagactccgacaagtatagcgtcttccccacccttagggggtatcactggcgcggcagagactgcaatgattcagacgagagcgtgtatcctggtaggaggccaaataactgggacgtccaccaagattcaaattgtaacggaatctggggcgtcgacccaaaggacggagtgccttacgaaaaaaagttttgtgaaggctcacagccacgtggcatcatattgctgggcgactcggcaggagcccatttccacattagccctgagtggatcactgccagtcaaatgagccttaactcctttattaacttacccacagccctgactaacgaactggactggcctcagctgtctggagcaacgggcttcctcgatagcacagttgggattaaagaaaaaagcatttacctcaggctgtggaagagaaaccactgcaatcatcgggactaccagaacatcagtcggaacggcgcatcatcgcgcaatctgaagaaatttatcgaaagtctcagcagaaataaggtcctggactaccctgccatcgtgatttacgccatgatcggcaatgatgtgtgcagcggaaaatctgatcctgtgcccgccatgaccactcctgagaagctctactcaaatgtgatgcagacactgaaacatttgaactcccacctgcccaacggatcacacgtgattctgtatggactgcccgacgggaccttcctctgggataatttgcataacaggtaccatcccctcggtcaattgaataaagacatgacctacgcacagttgtactcatttctgaattgcctccaggtctctccatgtcacggctggatgtctagtaacaagacactgaggactctcaccagtgaacgagccgaacagctgtctaataccctgaagaaaattgcagccagtgaaaagttcacgaacttcaacctgttttatatggactttgcattccacgagattattcaggagtggcagaaaagaggcgggcagccctggcaactcatcgaaccggttgatggcttccaccccaatgaacggaagagtatcctgctcaaaggaatactgatgacctcccagaccctggataatcaggagtggacccagctgactagctggattaaggggaacctgacgtgcgattcgagaacccgggaatggttatgttgttgttggcgtatcatttccgggaaaaggtgctcctcctccggccctaaatcttgggaaaggcggatccgtagtacaccccggctgaacagatgtttggagacaaaggccggcaccgagcctttgcgcagtatgcacccatggggagctcaggggggaagggggctgggtaagctgatcccccaaccttacggcggatgccacgtcacaggcccaaaggattctagttccgccgccagtctacaaatgagcttttcccagtag

SEQ ID NO: 107173 - DNA, 300 bp, Artificial Sequence
  Description of Artificial Sequence: Synthetic coding sequence
atggctgagggaaacacccttattagcgtagactacgagatctttgggaaggtgcagggtgtcttctttcgtaaacacactcaggctgaagggaagaagctaggtttagtcggctgggtgcaaaacacagatcgaggcacagttcagggacagctgcaggggcccatctcaaaggtcaggcacatgcaggagtggttggaaacaaggggaagcccaaaatcccatattgataaagcaaacttcaacaacgaaaaggtgatactcaagctggactactctgactttcaaattgtgaaatag

SEQ ID NO: 107174 - DNA, 168 bp, Artificial Sequence
  Description of Artificial Sequence: Synthetic coding sequence
atggccgagggtaatactctgatctccgtggactacgagatatttggaaaggtacagggggtgttcttcagaaaacatacccaggagatgacagtggagaaccgcatagctgagacacacagtaagtcctgcgtcccagtgagttttgcaacctcttatgccggctag

SEQ ID NO: 107175 - DNA, 300 bp, Artificial Sequence
  Description of Artificial Sequence: Synthetic coding sequence
atggccgagggcaacaccctcatttccgtggactatgagatattcgggaaggtgcaaggagtgtttttccgcaagcatacgcaggctgaaggaaaaaaattaggcctcgtcgggtgggtgcagaataccgaccgcgggaccgtccagggtcagttgcagggaccgatcagtaaagttcgccacatgcaggaatggcttgagaccagaggctctcccaaatcccatattgataaagcaaacttcaataacgagaaggtgattctgaaactggattatagcgattttcagatcgtaaagtag

SEQ ID NO: 107176 - DNA, 300 bp, Artificial Sequence
  Description of Artificial Sequence: Synthetic coding sequence
atgtctactgctcaaagtctgaaaagcgtcgattatgaagtttttggcagagtgcagggtgtgtgctttaggatgtacactgaagacgaagctagaaaaatcggagtggtggggtgggtgaaaaatactagcaagggcactgtgaccggccaggtgcaggggccagaggataaggtgaactctatgaaaagctggctgagtaaggtcggatccccatcaagtcgcattgataggaccaacttcagcaacgagaagaccattagcaagctggagtactccaacttctctattaggtattag

SEQ ID NO: 107177 - DNA, 294 bp, Artificial Sequence
  Description of Artificial Sequence: Synthetic coding sequence
atgtgccctctgcccttggccgctgcagcagttgcagcccctagagcaccactgaggcttctcaatcgaggtctcgccgcagctatgagcaccgcacagagccttaagtctgtagactatgaggtcttcggccgggtgcagggcgtgtgtttcagaatgtatactgaggatgaagccaggaagatcggagttgtcggttgggttaaaaatacgtcaaagggtactgtgaccgggcaggtgcaaggcccagaggacaaagtgaattcaatgctggaatgtagtggcttgatttag

SEQ ID NO: 107178 - DNA, 2247 bp, Artificial Sequence
  Description of Artificial Sequence: Synthetic coding sequence
atggtgttgctgagagtgttaatcctgttgctcagctgggctgcggggatgggcggtcagtacgggaaccccctgaataaatatatccgacactacgaaggtctgtcctataacgtggacagtctgcatcaaaaacaccagcgggcaaagcgcgctgtgtctcacgaagaccagttccttagactagacttccacgctcatggtcgacactttaacctccgcatgaagcgagacactagcctttttagcgacgagtttaaagtggagacctccaataaagttcttgattacgatacttcacacatttatacaggccacatctacggagaggaggggtctttctcgcacggtagcgttatcgacgggcgcttcgagggctttatacagacaagaggtggcaccttttacgtggagcccgcagaacgttacatcaaagatcggacacttcccttccactccgttatctaccatgaggatgatatcaactatccccacaagtatggcccacagggggggtgcgctgatcacagtgtgttcgagaggatgcgcaagtatcagatgactggtgtagaagaagtgactcagattccgcaagaagaacatgccgccaacggacccgagttattgaggaagaaaagaacaacatctgccgaaaagaacacctgtcaactgtacatacagaccgatcatttattcttcaaatactatgggacacgcgaagctgttatcgcacaaatcagttctcatgtgaaagcaatcgacacaatctaccagactactgacttttcaggaattaggaacatctcttttatggttaaacgcattagaatcaatacaactgcagacgaaaaagaccccacaaatcccttccggttccccaacattggggtggagaaattcctggaacttaactcagagcaaaaccacgacgactattgcctcgcgtacgtgtttaccgatcgcgacttcgacgacggcgtgcttggtctggcctgggtaggggccccctctggcagctcagggggaatatgtgagaaatccaaactctactccgatggcaaaaagaaatccctaaacaccggcattattacagtccaaaactacgggagccatgttccccctaaggtcagccacataacattcgcccatgaggtcggccataactttggatctccgcatgatagcgggaccgagtgcacccccggagagtcaaagaatctgggccagaaagagaatggcaactatatcatgtacgctagggctacctcaggagacaaactcaacaacaacaaattctccctctgttctatacgtaacatcagccaggtactggagaaaaagagaaacaattgtttcgtagagagcggtcagcccatctgcgggaacggcatggtagagcagggcgaggagtgtgattgtggatacagtgatcagtgcaaggacgagtgttgctttgacgcaaaccagcccgagggccgaaagtgtaaactgaaacccggtaaacagtgtagtccgtcgcaggggccctgttgcacagcgcagtgtgccttcaagtcgaaatctgagaaatgccgggatgactctgactgtgcaagagagggcatatgtaatggctttactgccctgtgtcccgccagcgatccgaagcctaacttcacagactgtaaccgtcacactcaggtgtgtatcaacgggcagtgcgccggctccatctgcgagaaatacggactagaggagtgcacttgcgctagcagtgatggaaaagacgataaggaactgtgtcacgtctgttgcatgaagaagatggacccatcaacctgcgcgagtacaggttcggttcagtggagtaggcatttcagcggcaggaccattacgttacaaccaggatctccgtgcaacgacttccgtggctactgtgacgtcttcatgcgttgtcgcttggtcgatgcagacggccccctcgcacgcctcaagaaagccattttttcaccggagctatacgagaatatcgctgagtggatcgtggcccattggtgggcagtgctcctgatgggaattgcactgatcatgctgatggccgggttcatcaagatttgttccgttcacaccccatctagcaacccgaagctgcctcctcccaagcctctgcccggcacgctgaagagaaggaggcccccacagccaatccaacagcctcagaggcagcgcccaagagagtcttatcagatgggccacatgagacggtag

SEQ ID NO: 107179 - DNA, 1344 bp, Artificial Sequence
  Description of Artificial Sequence: Synthetic coding sequence
atggtactcttacgggtattaatcctgcttctatcttgggccgctgggatgggtgaccgggacttcgatgatggcgtgctcggcctcgcctgggtaggcgctccttccggttctagtggcggcatatgcgaaaaaagcaaactgtacagtgatggcaaaaagaagagccttaacactggcattatcacagtgcaaaactacgggtcccatgttccgcccaaagtgagccacataacattcgcccatgaagtgggccataatttcggttctcctcacgatagcggcacggagtgcacaccaggggaatcaaaaaatttgggacagaaagagaatgggaattacatcatgtacgcaagagcgacaagtggcgacaaactaaacaataacaaattctctctctgttctatcaggaatattagtcaggtcttggagaaaaagcgaaataactgctttgtggagagtgggcagcctatctgcgggaacggcatggtcgagcagggtgaggaatgcgactgcggatacagcgatcaatgcaaggatgagtgttgctttgacgctaatcagccagaaggtcgcaagtgcaagctgaaaccaggcaaacagtgctcgccgagccagggcccgtgctgcactgctcagtgcgctttcaagtctaagtctgagaagtgccgagacgacagtgactgcgcaagggagggaatttgtaacggctttacggccctctgcccagcctccgatcctaagcctaacttcacagattgcaaccggcatacccaggtctgcattaatggacagtgtgcagggagcatctgcgagaagtatggattggaggaatgcacctgtgcatccagcgatggcaaagatgataaagaactgtgccatgtctgttgtatgaaaaaaatggatccttccacatgtgccagtaccggatctgtccagtggagccgtcacttttcgggtagaaccattactctgcagccaggaagtccatgtaatgacttccggggctattgtgacgtgtttatgcgctgccgactagtggacgccgatggcccactggcccgcctaaaaaaggcgatcttttcacctgagctctacgagaacatcgcggagtggatcgttgcccattggtgggccgtgctattgatgggtattgcattaataatgctgatggccggcttcattaaaatctgctctgtgcacactcctagtagcaatccaaaactccctccccccaagccgctccccggaacactgaagagacgaagaccacctcagccgatacagcagccgcaaagacagagaccccgggaatcttatcagatgggtcacatgcgtcgatag

SEQ ID NO: 107180 - DNA, 2310 bp, Artificial Sequence
  Description of Artificial Sequence: Synthetic coding sequence
atgaggctcttgcggaggtgggctttcgctgctctcttactgtctttattgccaaccccaggactagggacccaggggcctgccggcgccttgcgatggggcggcctgccacagcttggcggtcccggcgctccagaggtgaccgaaccctctagattagttagggagtcttcgggaggtgaggtgagaaaacagcagctggataccagagtgcggcaggagcccccaggaggcccccctgtgcacttggctcaggtgtcttttgtgatccccgcatttaactcaaatttcacattggatctcgagctcaaccatcacttgctttcaagccaatacgtcgagcgtcatttcagccgcgagggaactactcagcactcaacaggcgcaggagaccactgctactatcagggcaaactgaggggcaatccacattcgtttgccgccctgtccacttgccaaggcctgcatggggtcttcagtgatggcaacctgacctacatcgtagagccgcaggaggttgcgggaccatggggtgcccctcagggccctttgccgcacttgatctaccgcactcctctgctccccgatcccttgggctgcagagagcccggctgcttattcgctgtgcccgctcaatcagcgccgcctaataggccccggctcagaagaaaaagacaagtacgacgcggtcaccctaccgtgcacagcgaaactaaatacgtagagcttattgtgattaatgatcaccagctgttcgaacaaatgaggcaatcggtggtgctgacatcgaacttcgcgaagtcagtggtgaacctggcagacgtgatttacaaggagcagctgaacactcgtatcgtgctggttgccatggaaacatgggctgatggagacaagatccaggttcaagacgatcttctagagacactggcacgactcatggtgtacagaagagaaggcctgccagagccatctgatgcgacccacctgttttcagggaggaccttccagagtactagctccggcgccgcgtatgtcggcggcatttgcagtctgagtcatggcgggggcgtcaatgagtacggtaatatgggagctatggctgtgaccttggcacaaacgctgggccagaatctgggtatgatgtggaacaagcacaggtcaagcgccggagattgtaaatgccctgatatttggcttggttgcatcatggaggacacgggtttctatctgcctcgtaagtttagtcggtgcagtatcgatgagtacaaccaatttctgcaggaaggtggcggttcttgtctatttaataaacccctgaagctactggatccccccgaatgtggaaatggatttgtagaagcaggagaggagtgcgactgtggcagtgtgcaggagtgctcccgcgccggaggtaactgctgtaaaaagtgtacactgacacatgacgccatgtgcagtgacgggctgtgctgccgacgatgcaaatatgaaccaagaggcgtgtcctgtcgcgaggccgtgaacgagtgcgatatcgccgagacatgtacgggcgattcatcccagtgtccccctaatcttcacaagctcgacggctattactgtgaccacgagcaaggacgctgttacggaggaagatgtaagacgagagacagacagtgccaggtgctgtggggccacgctgctgccgaccggttctgttatgaaaagcttaacgttgaagggactgaacgcggttcctgcgggcgcaaaggctcagggtgggtgcagtgcagtaagcaagacgtgctgtgcggcttcctgctctgtgtgaatatctccggcgccccaagactgggggaccttgtgggggatatctccagcgttacattctatcatcagggcaaagagcttgactgtcgggggggccacgtacagctggccgacgggtccgacctgagttacgtggaagatggcacggcttgtggccccaacatgctctgtctggatcacaggtgcttaccagccagtgccttcaactttagcacctgtcccggttcaggcgagagaagaatttgtagccaccatggcgtatgctcaaatgagggaaaatgtatctgccagccagattggaccgggaaagactgcagcatccataaccccctgcccacttcacccccaaccggtgagacagagcgctataaaggcccctctggaacaaacatcattatcggctctatcgccggggccgttctggtggctgcgatcgtcctgggcggcacgggttgggggtttaagaacatccggagaggaaggagtggaggggcctag

SEQ ID NO: 107181 - DNA, 1572 bp, Artificial Sequence
  Description of Artificial Sequence: Synthetic coding sequence
tgctggggaagtggccacctgttgtcatcacagtatgtggagcgccatttctcccgggaggggacaacccaacattccacaggggccggggatcactgctattaccaaggtaagctgcgcgggaatccccattctttcgccgccctgagcacctgccagggccttcacggtgtcttctccgatggcaatctgacttacattgtggaaccacaagaggtggccgggccttggggcgccccgcagggcccgctccctcaccttatctacaggacaccacttctgcctgatccattgggatgccgggagcccggctgtctgttcgctgtgcccgcacagagtgctccacccaacaggcctagactgcggcgcaagcgccaagttcggcgtggtcaccctactgtacatagcgaaaccaagtacgttgagctgatcgtcatcaatgatcaccaactgtttgagcagatgcgacagtctgtggttctgacttccaacttcgcaaaatccgtggtgaacctcgccgatgttatatataaggaacagctcaatacaaggatagtgttggtcgctatggaaacctgggctgatggcgacaagatacaggtgcaggacgacctgctggagaccctagccaggctgatggtgtaccggcgggaagggttgcctgaaccctccgacgccacccatctgttcagcggccgcacgtttcagtctaccagctctggggccgcctacgtcggtggtatctgcagtctgagccacggcggcggggtaaacgaatacggtaacatgggtgctatggcggtgacattagcgcagactctggggcaaaacctcggcatgatgtggaataaacatagatctagcgctggggactgtaaatgtccagatatatggttaggttgtatcatggaggatacaggattctatctcccacgcaagttttccagatgttctatcgatgaatataaccagttcctgcaggaaggaggcggaagttgcctgttcaacaaacccctcaaactgttagatccacccgagtgtggaaacgggttcgtggaagcaggggaagaatgtgactgcgggagtgttcaggagtgttcacgggctggtggcaactgctgtaagaaatgtactctcacacacgatgcgatgtgctccgatgggctctgctgccgccgttgtaagtacgagccacgcggcgtgtcatgccgggaagcagtgaacgaatgcgacatagcggagacctgtactggagacagcagccagtgccctccaaacctacataaactggatggctattattgcgatcatgagcagggcaggtgctatggcggacgatgcaagacaagagatcgacagtgccaagtcctatggggccacgctgctgccgacagattctgctacgagaaactgaacgtggagggcaccgaaaggggcagttgcggacggaaaggttctgggtgggtccagtgcagcaaacagccccaacaggggagggccgtgtggctaccgccactgtgccagcacttatggagctcaagcgctagggggcccggcggccgtcatcagtag

SEQ ID NO: 107182 - DNA, 1710 bp, Artificial Sequence
  Description of Artificial Sequence: Synthetic coding sequence
atgcaagggaccaggcttcctgtatgctgcgcctgtccagtcggaagcagcaagccggcagaagccgaaaaggaaaaagttcgtagagggcacccgacagtccattctgagactaagtacgttgagctgatcgtgatcaatgatcaccagcttttcgagcagatgcgccagtccgtcgtacttaccagcaactttgccaagtccgtggtgaacttggccgacgtcatatacaaggaacagttgaacactcgtatcgtcctcgtggctatggagacttgggccgacggagacaagatccaggtgcaggacgacttactggagacgctcgcacgcctgatggtctataggagggaggggctaccagagccctccgatgcaacacacttattttcgggacgcacgttccagtctacaagttctggcgccgcctacgttggcggcatctgctcattgagccacggaggtggcgtaaacgagtacgggaatatgggggccatggccgttactttggcacagactctgggccagaatctgggtatgatgtggaataagcatcggagtagtgcaggggactgtaaatgtcctgacatctggctgggctgtatcatggaggacactggattctacctccctaggaaattttcccgttgttccatagacgagtacaaccagttcctccaggagggtggcggctcttgccttttcaacaagcctctgaaactcctcgatccacccgagtgcggcaatgggttcgttgaagctggcgaagagtgcgactgcggctcggtccaggagtgctcacgtgctgggggcaactgttgcaaaaagtgcactttaacgcatgatgctatgtgcagtgatggcctctgctgcagacgatgcaaatacgagccgaggggggtatcttgtcgggaagctgtaaacgagtgcgacatcgccgagacctgtacaggggactcatctcaatgtccaccaaacctacataaactggacggctactactgtgatcacgaacaaggcaggtgctacggggggagatgcaaaacgagggacaggcagtgtcaggtactgtggggacacgcggccgccgatcggttctgttatgagaaactgaatgttgagggtacagaacggggctcttgtggcagaaagggaagcggctgggtgcaatgctcaaaacaagacgtcttatgcggatttcttctgtgcgtgaatatcagcggcgccccaagactgggagatcttgttggcgatatttcttcagtaaccttttaccaccaaggcaaggaactagactgccgtgggggtcatgtacaacttgcagacggcagtgacttgagctacgtagaggacggtactgcctgtgggccaaacatgctctgccttgaccatcggtgccttccagcatccgcattcaatttttctacatgccccggtagcggggaaaggcggatctgttctcatcatggagtctgctctaatgaagggaagtgcatatgccagcccgactggaccgggaaggactgcagcatccataaccctctgccgaccagtccgcccaccggggagacagagcgctacaagggaccgtctggaaccaatattatcatcgggtcaattgctggggccgtgctggttgcagccattgtcctgggaggcactggttgggggtttaaaaacattcgaagaggcagaagtggcggggcgtag

SEQ ID NO: 107183 - DNA, 2217 bp, Artificial Sequence
  Description of Artificial Sequence: Synthetic coding sequence
atggctgccagaccactgcccgtgtcacctgctagggcgttgctgcttgccttggccggggcattattggccccctgtgaggccaggggtgtgagcctctggaaccagggcagagctgacgaagtggtcagtgcctctgtggggagcggtgacctgtggatcccagtcaagagcttcgatagcaagaaccatcccgaagtattgaatattagacttcaacgggagagtaaggagctgattatcaacttggagcgaaacgaggggctgatcgcatcctcctttacagagacccactatctgcaggatggcaccgatgtgtccctggcccgtaactacacagtgatcctagggcactgctactaccacggtcatgtacgcggttactctgattccgccgtgagcctgtccacatgttctggccttaggggactgatcgtgtttgaaaatgagtcatatgtactggagccaatgaaaagtgccaccaacagatataagcttttcccagccaagaaactcaagagcgttcgtgggtcatgtgggtctcaccacaatactcctaatctggccgccaagaacgtgtttcccccaccaagtcaaacttgggcacgtagacataagagagagaccctgaaagcaaccaaatatgtggaattggtgatagtggcagacaatcgggaatttcaaagacagggcaaagacctggaaaaggtcaaacaacgtctgatcgaaatagccaatcatgtcgataaattctaccgcccattgaatatacgcattgtgctggtgggagtggaggtgtggaacgacatggacaaatgtagcgtgagccaggatccatttactagcctgcatgagtttcttgactggagaaagatgaaactgctgccaaggaagtcacacgataatgctcagctggttagcggagtatattttcaaggcaccaccatcgggatggccccaatcatgagtatgtgtaccgccgaccagtctggaggaatagtgatggaccactcggacaaccccctaggcgccgctgtgacactcgcccacgagctaggacataacttcggtatgaatcacgatacattagataggggctgttcttgccaaatggccgtcgagaagggggggtgcatcatgaacgcatcaacaggatacccttttccaatggtgttctcctcctgctccagaaaggaccttgaaaccagtctggagaaaggaatgggggtctgtctgtttaatctgcccgaggttagagaatcatttgggggacagaagtgtggaaatagatttgttgaggaaggcgaagaatgtgactgcggggagccagaggagtgcatgaatcggtgttgcaacgccactacttgcacactcaagccagacgctgtgtgcgctcatggcctttgttgcgaagattgtcagctcaaacccgccggtaccgcttgcagggatagcagcaattcgtgtgacttgccagaattctgtaccggggcttctccccattgccccgccaatgtgtatctccatgacggccactcgtgccaagatgtcgacgggtattgctataatggcatatgtcagactcacgagcagcagtgcgtaacactgtggggacccggcgctaaacccgcccccggtatttgttttgagcgtgttaactctgcaggggacccatatggaaattgcggcaaagtcagcaagagctcattcgctaaatgtgaaatgcgcgacgccaaatgcggcaagattcagtgtcagggcggggcttccagacccgtgatcggcactaatgcagtgtcaatcgaaacaaacattcctttacagcagggcggccgcatcctttgtagggggacccacgtgtatttaggagatgatatgccggaccccggattggtccttgccggcacgaaatgtgccgatggcaaaatatgcctgaaccgccaatgccaaaacatttcagtttttggcgtgcacgagtgtgccatgcaatgccacggaagaggcgtttgcaataaccgcaagaactgtcattgcgaagcacattgggcgcctccattctgcgataaatttggctttgggggctcaacagattctggccccatcagacaagccgaggcacgacaagaggccgccgaatctaatcgcgagcgcggtcagggacaggagccagttggatcgcaagagcatgccagcaccgcttctctcacccttatctag

SEQ ID NO: 107184 - DNA, 2730 bp, Artificial Sequence
  Description of Artificial Sequence: Synthetic coding sequence
atggctgcgagacctctgccagtgagccccgcccgtgctctgcttcttgctctcgctggggcacttctggctccttgcgaggccagaggagtatccctttggaatcagggaagagcagatgaggttgtaagcgccagcgttggtagcggggacctctggattcccgtgaaaagcttcgacagcaagaaccacccggaagtattaaacattcgcctgcagagggagtctaaagaactgataatcaatctcgagcggaacgaaggcttgattgcgtcatcctttactgaaacacactacctgcaggatgggactgatgtgtcacttgctcggaattatactgtcatcctgggtcactgctattatcacggacatgtccggggctactcagactccgccgtttccctaagtacctgctctggcctgcgaggtctcattgtgtttgagaacgaaagctacgttttagaacctatgaagtctgcaacaaatcggtacaaattattcccagctaagaaactcaagtctgtgagaggaagttgtggtagtcatcacaacactcctaacctcgccgctaaaaacgtgttccccccccccagtcaaacatgggctcggcgtcacaagagggagacgttgaaggccactaagtacgtagagctagtcattgtcgccgacaatcgcgaattccaacgtcaggggaaggacttggaaaaggtaaagcagcggcttatcgaaatcgcaaaccacgtggataagttttaccgccctttgaacattcgcatcgtgctcgtgggagtggaagtgtggaatgatatggacaagtgttccgtctcacaggatcctttcacctccctgcatgagtttctggattggaggaagatgaagctcctgccccgcaaatcacatgacaacgcgcaactagtaagcggcgtttactttcagggtacaactatcggtatggccccaataatgtccatgtgtaccgccgaccagagcggcgggattgtgatggatcatagcgataatccgttgggggcggcagtgacattagcacatgaactgggtcacaacttcggcatgaatcacgacaccctggaccgagggtgctcttgtcaaatggccgtggagaagggagggtgcataatgaacgcctccacaggctacccattccctatggtcttctcctcgtgctcacgcaaagatctcgagacttccctggaaaagggcatgggcgtatgccttttcaaccttccggaagtgagggagtctttcggcggccagaaatgcggtaacagattcgtggaggaaggggaagaatgtgactgcggcgagcctgaggagtgtatgaataggtgctgtaacgccacaacttgcaccttaaaacctgatgcagtgtgcgcgcatgggctttgttgcgaagattgtcagttgaagccagctgggactgcatgccgcgactccagtaactcctgcgatctgcccgagttttgtacgggtgccagcccccactgtcccgccaacgtgtaccttcatgacggtcatagttgccaggacgtagatggatactgctataacggtatttgccagacacatgagcaacagtgtgtcaccctgtggggtccgggtgccaaaccagcccccggaatctgtttcgagcgcgtcaattcggccggcgatccctacggtaactgcggcaaggtgtcaaagagttccttcgctaagtgcgaaatgagagatgctaagtgtggaaaaatccagtgccaggggggagcgagcaggccggtgataggcaccaacgcggtatccattgaaactaatatcccgcttcagcagggtggcagaatcttatgtagggggacacacgtatacctgggggatgacatgcctgatcctggtcttgtcttggcggggaccaagtgtgccgatggcaaaatttgtctgaatcgacagtgccagaatatctctgtctttggagtccatgaatgtgctatgcagtgccatggacgcggtgtatgcaataaccggaagaactgccactgtgaggcgcattgggcacctcctttctgtgataagtttggctttgggggaagtactgacagcggcccgatcagacaagccgataatcaggggttgaccataggcattctcgtcaccattctgtgcctgctggctgcaggcttcgtggtctatctaaagcggaagactcttatccggctactctttactaacaagaaaacaacaatagaaaagctcaggtgcgtgaggccaagtaggcccccacgcgggtttcagccatgtcaggcacacctgggccacctcggcaagggcctcatgaggaaaccaccagacagctaccctcccaaagacaatcctcgcagattgttgcagtgtcaaaacgtcgatatatccagaccacttaacgggctcaacgttccacaaccccaatccacgcagcgtgtgctcccacccctgcatcgagcaccccgcgcgccaagtgtcccagcccggcccctgccagctaagcccgctcttcgccaggcacaggggacgtgcaaaccgaatcctccgcagaaacccttaccggccgatcccctcgcccgcacaacaagactcacgcacgccctagcccgtaccccaggtcaatgggagacagggcttcgactcgctcctctgaggcctgctcctcagtacccacatcaggttcctcggagcacccatacagcatacattaaatag

SEQ ID NO: 107185 - DNA, 837 bp, Artificial Sequence
  Description of Artificial Sequence: Synthetic coding sequence
atggcagcccgccccctcccagtgagtcccgcaagagctctgttattagctctcgcaggcgctttgttagcaccttgtgaggctagaggagtctcattatggaaccagggtcgagccgacgaagtggtttctgcgtccgtgggatcaggtgatctgtggatcccagtgaaaagtttcgactctaaaaaccacccagaagtcctaaacatccggctgcaaagagaatcaaaggagttaattattaacttagagcggaatgagggactcatagcctcctcgtttaccgagactcactatcttcaggacgggaccgacgtgtctcttgcgcgcaactatacggggcattgctactatcacggacacgtgaggggctacagcgactcggctgtgtctctctctacctgttcaggtcttcgaggcctcattgtgttcgaaaacgagtcttatgtgcttgaacccatgaagtcagccacgaatcgttataagcttttccctgctaagaaattgaagtctgttagaggctcatgcggatcccaccataacactccaaacctagctgctaagaatgttttccctcccccgagtcagacctgggcacgaaggcataaaagagagacgctcaaggccacaaagtatgtggagctcgttatcgtcgccgataaccgagagttccagcggcaaggaaaggacctggaaaaagtcaagcagcgcttaattgagattgccaaccatgtggacaagttctatagacctctgaacataaggatagtcctggtgggcgtggaagtctggaacgacatggataagtgttccgtctctcaggacccgttcacgtag

SEQ ID NO: 107186 - DNA, 2445 bp, Artificial Sequence
  Description of Artificial Sequence: Synthetic coding sequence
atgagactggcacttttatgggccctgggcttgcttggcgctggatcaccgttaccctcatggcccctccccaacatcggtggaaccgaggagcagcaggcagaatccgaaaaggcacctagagaacccctggaaccacaggttctgcaggacgacttgccgatttctctcaaaaaggtccttcagacatccctgcccgagccacttaggatcaaactagagctcgatggggactctcatatcctggaactcttacagaacagggaactcgtgcccgggcggccaacattagtatggtaccagccagacgggacgcgggtggtaagtgagggccataccctggagaactgctgctatcaaggaagagtgaggggttacgcaggcagctgggtgtctatttgtacgtgctccggtctgagggggcttgttgtactgacccctgagcgatcctacacccttgagcagggacccggtgatttgcaagggcccccaatcatcagcaggatccaagatctccacctgcctggacacacatgcgcactatcctggcgggagagcgtacacacacagaagccccccgaacaccccctggggcagcgtcacatccggcggagacgtgacgtggtgactgagacaaagacagtcgaacttgtcatagtggccgaccatagtgaggcccagaaatatcgggatttccagcacctgttaaatagaacactcgaggtggccctgctgctggatacatttttccggcctctgaacgtgcgagtagccctagtgggcctggaggcatggacccaaagagacctagtcgagatttctcccaatccagctgtaacacttgaaaacttccttcactggcgacgcgcccatctcctccctcgcctgccacatgatagtgcccagctggttaccggaacttcattctctgggccaactgttggaatggctatccagaacagcatatgttctcccgatttctccggaggtgtgaacatggaccacagcacatcaatcctgggagtggcttcttctattgcccatgaactggggcatagcttgggccttgatcacgacctacctggtaattcctgcccctgtcccgggcctgcaccagccaagacatgcatcatggaggcaagtaccgattttctgccaggcctcaatttttcaaactgtagccgacgcgccctggagaaggcattactggacggcatgggctcttgcctgttcgaacggctgccgtccctcccacccatggccgcgttttgcgggaacatgtttgtggagccaggtgagcagtgtgactgcggattcctggatgactgcgtggacccctgttgcgacagcctgacctgtcagcttagacccggggcccagtgtgcatctgacggtccctgctgtcaaaattgccaactgcgtccttcgggatggcagtgtagaccaaccaggggtgactgcgatctgcccgagttctgccctggtgactcatcgcaatgtccccccgatgtgtcactcggcgacggcgaaccatgtgccggcggccaggctgtctgcatgcatggaagatgcgcctcatatgcgcagcagtgtcagtccttatggggacctggagctcaacccgcagctcctctctgtctgcaaaccgcgaatactagggggaatgcgtttgggagctgcggaaggaatccaagcggcagttacgtgtcatgtaccccaagggacgctatttgtggccagctgcagtgtcagacaggcagaacacagccccttctcggtagcatccgtgacttactgtgggagacaatcgatgtgaatggtaccgagctgaattgcagctgggtgcatctcgatttggggtccgatgttgcacaacctctcctcaccctgcctggtaccgcttgtgggcctggactggtctgcattgaccatagatgccaacgggtggatctccttggcgcccaggaatgccgaagcaaatgccacgggcacggcgtctgtgatagcaacaggcactgttattgcgaggaaggctgggcgccccccgattgcactacccagctcaaggccacatcctcactcactacggggctcctgctgtcactgctcgttttgctagtgctggtaatgttaggcgcaagttactggtatcgagccagactgcaccagcggctctgccagttgaaaggtcccacatgccaataccgggctgcccaatcagggccatcagaacggcccggccctccacagagagccctgctggcaagaggcacaaagtcccagggcccagccaagcccccaccgcccaggaagcctttgcccgcagatccgcaagggcgctgcccaagtggagacctccctggaccaggagcgggcataccgcccctcgtagtaccatcccgacccgcccctcccccgccaaccgtctcttctctatatctctag

SEQ ID NO: 107187 - DNA, 2520 bp, Artificial Sequence
  Description of Artificial Sequence: Synthetic coding sequence
atgaggctggcactcctgtgggcactaggcctacttggtgccggcagccctctgccgtcatggcctttgcccaacattggggggactgaggaacagcaggccgagagtgaaaaggccccgagggaacctctagaaccacaagtcctgcaggacgatcttccaataagtcttaagaaggtgctgcaaactagcctcccagagccactgagaatcaaactcgaactagacggggattctcatattctggaactcctacagaacagagaacttgttccaggacggccgaccctcgtgtggtatcagcctgatgggacgagagtggtatctgaagggcacacacttgagaattgttgctaccaaggcagggttcggggctacgcaggatcctgggtctctatctgtacctgttcaggactcagagggctcgtagtcctcaccccagagaggtcttataccctggagcagggacctggcgatcttcagggcccccccatcattagcaggattcaggacttacacttacctggacatacatgcgctctgtcctggagggaatcagtacacactcaaaagcccccggaacatcctctgggacagcgtcatattcgtcgccgacgcgatgtggtgacagagaccaaaacggtggaactggtgattgtagccgatcacagcgaggcgcagaaatacagggatttccagcacctcctcaatagaacgttagaggtagcactgctcctagatactttcttcagacctttaaacgtcagagtcgccctggttggcctagaggcatggacccagcgggaccttgtggagatttctcccaacccggcagtaactctggaaaactttctccactggcggcgtgcccatctcctgccgcggctccctcacgattctgcgcagctcgtgacaggcacttccttcagtggtcccactgtcgggatggctatccagaactctatctgctccccagatttcagcggtggagtgaatatggatcattctactagtatcctcggcgtggcaagctccattgcgcacgagctcggccactccctagggctggaccacgatctccccggaaactcgtgtccatgtcccggccctgcgccggccaagacctgcatcatggaagcctcaaccgacttcctgccgggactgaacttcagcaattgcagccgccgtgctctggaaaaagctctgttggacggcatggggtcatgcctgtttgaaagattgccaagtctgcctccaatggctgccttttgcggtaacatgtttgttgaaccgggagaacagtgcgactgcggatttttagatgactgcgtagacccttgttgtgacagtcttacatgccagctgagaccaggcgctcagtgtgccagtgacggcccatgctgtcagaactgtcaattaagaccatccggatggcaatgccgacctaccagaggggactgcgacttgcccgagttctgtcccggtgatagctcccagtgccctccagatgtgtcccttggcgatggcgagccctgcgccggcggacaggcagtttgtatgcacggccggtgcgcgtcttatgctcagcagtgccaatcactctggggccccggtgcccagccagcggccccactctgtctgcaaaccgcaaacacccgtgggaacgccttcggcagttgcggaagaaatccttccggaagctatgtctcttgcaccccccgggacgcgatatgcggccaactgcagtgtcaaacaggcagaacccagcccctgctcggcagcatcagggatctgctgtgggagactatcgacgtgaacggcaccgagttgaattgtagctgggtccacttggatctaggaagtgacgtggctcagccactattaactctgccagggaccgcgtgtggacctggattggtgtgtatcgatcaccgatgccagcgcgtggatctgcttggagcccaggaatgcaggtcaaaatgtcatgggcacggtgtgtgcgatagcaatagacattgttattgtgaggaggggtgggccccgccggattgcactactcagctgaaggctacctctagccttaccaccgggctcctcttgagccttctagtgctgctggtcctggtgatgctaggcgctagctactggtaccgggctcgattacatcagaggctgtgtcaactgaagggtcccacatgtcagtacagggcagcccagtctggtccatccgaaagaccggggcctccacagcgcgccctgctggcaaggggcaccaagcaagcttccgccttaagctttcccgcacctcctagcagacctcttccccccgatcctgtgagtaaacggctgcagtcccaggggcctgcaaaacccccgccgcctcgcaaaccactaccggccgacccccagggccgctgccccagcggagaccttccaggccccggcgccggcataccaccattagttgttcccagccgccccgcccctccgcctccgactgtgagttccttgtacttgtag

SEQ ID NO: 107188 - DNA, 2592 bp, Artificial Sequence
  Description of Artificial Sequence: Synthetic coding sequence
atgcgtcttgctctgctctgggcattgggcctgttgggtgccggttcaccgctgccaagctggccgctcccaaacatcggcggaacagaggaacaacaagcagaatcggaaaaagcaccccgagaaccccttgaaccccaggtgttgcaggatgacttgccaatctcactcaagaaagtcctgcaaacttctctaccagagccgctccgtattaagctcgagctcgatggggactctcatatcttagagctgttgcagaaccgtgagctggtcccaggacgcccgaccttggtctggtaccagccagatggcacccgggtggtttccgagggccatactctggagaactgctgctatcagggacgcgtccgaggttacgctggctcctgggtgagcatttgcacctgcagcggcctccgagggcttgtggtgcttacacctgaacgatcctacaccctggaacaggggccgggcgatctgcagggtcctcctattatctcgcggatccaggatcttcatctgccaggtcatacttgcgctttgagctggagagagtccgtccacacccagaagccacccgagcatccactggggcagcgacatataagaagacgtagggacgtggtcaccgagaccaagacagttgagcttgtaattgttgccgaccatagcgaggcccagaagtatcgagacttccagcatttgctaaatcggaccctcgaagttgcgctcctcttggatacattttttcggccactcaatgtaagggtcgccctggtgggcttggaggcctggacccagcgggatttggtggaaatatcccctaatcccgcagtaaccctggaaaattttcttcattggagacgtgcccacctcttaccacgcctcccacatgattctgcacagcttgtgaccggcacttctttttcaggaccgacagtcgggatggctatccaaaactctatttgctcacccgatttctccgggggcgttaacatggaccattcaacgagtattctgggggtggcctcttctatagcccacgaactgggacatagcttagggctggaccacgacttgcccgggaactcatgcccttgtccagggcccgcccctgctaaaacgtgcattatggaggcctcgaccgactttttacctggtttaaatttttccaactgcagtagaagggcgctcgaaaaggccctgctggacggtatgggctcctgtctcttcgagcggttgccttcactgcctccaatggcggccttctgtgggaatatgtttgtggagcctggcgagcagtgcgactgcgggttcctggacgactgtgtagatccctgttgtgattcgctaacatgccaactgcgtccaggcgcccagtgcgcctcggatgggccctgctgccagaattgtcagttgaggccttccgggtggcagtgtcggccgacccggggcgattgtgatctgcctgaattctgccctggagatagcagtcagtgcccgcctgatgtatcgctgggcgacggtgaaccttgtgccggagggcaggccgtttgcatgcatgggaggtgtgcgtcctacgcacagcagtgtcagtcactgtggggccctggagcccaacccgcagcccctctgtgcctacaaaccgccaacactcgaggaaacgcatttggtagctgcgggagaaacccgtcaggttcttatgtgtcctgtacacctagagatgctatctgtgggcagctccagtgtcagaccggccgcactcaacctctgctcggtagcatccgcgatctcctttgggagaccattgatgtgaatggaactgagctgaattgctcttgggtccatctcgatctggggtcagacgtggcccagcctttgttgacactgcccgggacagcatgcggccctggactcgtgtgtattgaccacaggtgccagcgggttgatctgttgggagcccaagaatgccgttccaaatgtcacggtcacggcgtttgtgatagtaacaggcactgttactgcgaagagggatgggctccccctgactgcaccacacagctgaaagccacatcatccctgactactggcctgttgctgtccttactggtactcctggttttagtcatgctcggggcatcttattggtatcgtgccagattgcaccagagactatgccagctcaagggacccacatgccaataccgggctgcccagagcgggccgagcgaaaggccaggcccacctcagagagcgttgctcgcgagaggaactaagcaggcctctgccctgtccttccccgcccctcccagcaggccactgccaccggacccagtgagtaaacgcctgcaagctgagttggcggaccggcctaacccccctaccaggcctcttcccgctgacccagtggttcggtcccctaagtctcagggtcccgccaagcctccccccccccgcaagcctctgccagccgatcctcaggggaggtgcccaagtggggacctgcctggcccgggagctggtattccgccattggtcgtgccctccagaccggcccctccccctccaacagtttccagtctgtatctatag

SEQ ID NO: 107189 - DNA, 2517 bp, Artificial Sequence
  Description of Artificial Sequence: Synthetic coding sequence
atgcggctggccctgctgtgggccctagggctgctgggcgctggcagcccactcccctcctggcctcttcctaacattggtggaaccgaggagcagcaagccgagtctgagaaggcccctcgcgaacctctggagcctcaggtgctgcaggacgatcttcctatctcactgaaaaaagtgctgcagacttccctgcccgagccacttcgcataaagctcgaactggacggtgactctcacattttggaattgctccagaacagggaactggtgcctggcaggcctaccctggtttggtatcaacccgatgggaccagggtcgtgagcgagggccacactctggagaactgctgttaccagggtcgagttcgaggatacgcagggagttgggtgtcgatttgcacctgctcaggcttgagagggctggtggtcctgacaccagagagatcttacacccttgagcagggacctggcgacttgcaggggccccctattatctctagaatccaggatctccacttacctggtcatacgtgcgctttgtcatggcgtgagtccgtgcatacccagaagcctcccgagcaccccttgggacaacgacatatccgccgaaggagagacgtggttactgagacaaaaaccgtggagctggtcatagtcgccgatcacagcgaagctcagaagtatcgcgatttccagcacctgctgaacaggacactcgaggtcgccctcctattggataccttctttagacccctgaatgtgcgggtcgcattagtcggcctggaagcatggactcagagggacctggtcgagattagccccaaccccgcagttacattggagaattttcttcattggcggagagcacacctgttaccccggctcccccatgactcggcccagttggtgacagggacttctttcagcggcccgaccgtagggatggcgattcaaaatagtatatgttctccggattttagcggtggggtcaacatggaccatagcacaagtatcctgggcgtggcgtcctcaatagcccacgagcttgggcatagcctggggctagaccacgacctcccgggcaacagctgtccctgtcctggaccagctcctgcaaaaacttgcatcatggaggcatcaactgacttcctcccgggactgaatttctccaattgttctcgtcgggccttggagaaagctctcttggatggcatgggctcttgtctcttcgaacggttgccgagcctgccccctatggccgccttctgcgggaatatgtttgtggaacccggggagcagtgcgactgtggcttcctggacgactgcgtcgacccatgctgtgacagcctgacttgccagttgcgaccaggggctcagtgcgctagcgacgggccctgctgccagaactgccagctgcgacccagtgggtggcagtgtcgaccaacccgcggggactgcgacctcccggagttctgtcctggcgattcatcccagtgtccacccgacgttagcttgggtgacggggaaccttgcgccggcggccaggcagtttgtatgcacggacgctgtgcctcatatgcacagcaatgtcaaagcctatggggccctggagcccagcccgccgccccattgtgcctgcaaactgcgaatactagaggtaatgccttcggcagttgcggccgaaatccctcaggcagttacgtctcttgtactccgcgtgacgccatttgcgggcaacttcagtgtcaaacgggacggacccagcctctgcttggtagcattagggatttgctgtgggagaccatcgacgttaacggcacggagttaaattgctcctgggtccacttagatctgggaagcgacgttgctcagcctctccttacgctacctggcacagcctgtggccccggtttagtctgcatagaccataggtgtcaaagggtggatctgctcggtgctcaggaatgccgatcaaagtgccatggccacggggtgtgcgactccaatcggcattgctactgcgaggaggggtgggctcctccggactgtacgacacagctgaaagcgaccagctcactcaccacagggctgcttctgagcttgctagtactgcttgtactggttatgctcggggcctcctactggtatcgggcccgcctgcaccagagactgtgccagttgaagggtcctacctgtcagtatcgcgcagcccagtccggcccctccgagaggcccggacccccacagcgcgcccttctggcgcgaggcacgaaagcagaactcgccgaccggcccaacccccccacccgacctctgcccgctgatcccgtcgtacggagccctaaatcacagggccccgcgaaaccacctcctccacgcaagcccctgccggccgacccccaaggccgctgtccaagtggtgatctgccaggcccgggggccgggattcctccactcgttgtgccttcccgacccgccccacctccaccaactgtttcgagcttatacctgtag

SEQ ID NO: 107190 - DNA, 2319 bp, Artificial Sequence
  Description of Artificial Sequence: Synthetic coding sequence
atgcgactcgctctcttgtgggcccttggtctgctgggcgccggttcccctctcccctcttggcccctgcccaacatcggcggcacagaggagcaacaggccgaaagtgagaaggcccctcgagaacccttagagccacaggtgcttcaggatgatttgcctattagcctgaaaaaagtgctgcaaacgtctttacctgaaccactgcggatcaaactagagttggatggcgacagccacatcctcgaattgcttcagaaccgagaactcgtgccgggccggccaaccttggtttggtatcagcctgatggcacgcgcgtggtctccgaaggccatacgctggaaaactgctgctaccaggggagggtcagaggttatgccggatcatgggtttccatttgcacatgcagtggcctccgcggtcttgttgttctcacaccagagcgctcctacacactagaacagggaccgggagatctccagggaccacctattatatctcggatacaagatttacatctaccgggccacacctgcgccctgagctggcgggagtctgtccatactcaaaagccccccgagcatcctctgggccaacggcatattcggaggagacgtgatgtggtcactgagactaaaactgttgagttggtcatcgtagcagatcacagtgaggcccagaagtacagggactttcagcacctactgaatagaaccctcgaagtcgctctgctgctagacacctttttccggccgctcaatgtgagggtggctctggtcggcctggaggcctggacgcagagagatttggtagaaatctcaccgaaccccgccgtgacccttgagaacttcctccactggcgacgggctcatctcctaccacggctgccccatgatagtgcacaactggttaccggaaccagctttagtggtccaaccgtgggcatggccattcaaaactcgatctgctcccccgatttcagtggaggagtgaacatggatcactctacttccattctaggagtggcctcatcaatcgcccacgaactgggacactctttgggattggatcacgacctgcccgggaattcatgtccctgtccgggtcctgccccagcgaagacctgtatcatggaggcatctactgattttttacccggtctcaacttctctaactgctctcgaagggcccttgaaaaagccctgctcgacggaatggggagctgtttgttcgagaggctaccctctttgccacctatggccgccttttgtggaaatatgttcgttgagccaggcgaacagtgtgactgcggtttcttggacgactgcgtggacccgtgttgcgatagtttaacatgccagctgaggcctggggcacagtgtgcctctgatggtccgtgctgccagaactgtcaactcaggccctcaggttggcagtgccgacccacccgcggagattgcgacctacccgagttttgtcccggtgattcgagccagtgtccacccgacgtctcgctgggggatggcgaaccttgcgcggggggccaggccgtctgtatgcatggaagatgtgcatcatatgctcaacagtgccaatctctatggggaccaggcgcgcagcctgccgcgcctctgtgcttgcagactgccaacacaagagggaatgcctttggaagttgtggcagaaacccatccgggtcctatgtcagctgcacaccaagggacgccatctgtgggcagctacagtgccagactggccgcacgcaaccactcctcggcagcatacgagatctcctgtgggaaacaatcgatgtgaacggcaccgagctgaactgcagttgggtccacttggatcttggctctgatgtggcccaaccgctgctgacacttcccggcacagcatgtgggccaggtctggtgtgtatagatcataggtgccaacgggttgatctgctgggcgctcaggagtgtagaagtaagtgtcacggccacggtgtttgcgatagcaaccgtcattgctattgtgaggaaggctgggcccctcccgattgcaccactcagctgaaggctacttcgagtctgaccactggcctgctcctttctctgctcgtgctactggtgttggttatgctgggcgcgtcttattggtaccgtgctcggttacaccagagattgtgtcaactcaaagggcctacgtgtcagtactcacttcgcggccaaccttcaccccacccacaggggagccattgcctgcccaccccacgggcaggcgcacatagagtgacatgccccgcacagggactggaatcaagaccctag

SEQ ID NO: 107191 - DNA, 1563 bp, Artificial Sequence
  Description of Artificial Sequence: Synthetic coding sequence
atgcgtctcgcccttctttgggccctgggcttactgggagccggctctccactcccttcttggcctctgcccaacattggcggaaccgaagagcagcaggcggagtccgagaaggctccccgcgagcctctcgagccccaggttctgcaagatgacttgcctatttcactcaagaaagtgttgcagacctccttaccagaaccattgagaatcaaactggaactcgacggcgactcgcacatcctcgagttgctccagaaccgctcctttcttcccggcttgaactttagtaactgcagcaggcgggcactggagaaagcattgcttgacggaatggggtcctgtctatttgagcggctgcctagtctccctcctatggctgcattctgcggcaacatgtttgtcgagccaggggagcagtgtgattgcggattcttagacgactgtgtggacccatgctgcgacagcctaacctgtcagcttcggccaggagctcagtgcgcctccgatggcccctgttgccagaattgtcaactgaggccctccgggtggcaatgccgacccacacgtggcgactgcgatttacctgagttttgtcctggagactcaagtcagtgtccacctgatgtgtctctcggcgatggcgagccctgcgctggtggccaagccgtgtgcatgcacggaaggtgtgcctcctacgcccagcagtgccagtcactctgggggcctggagctcagccagccgcccccttatgcttgcaaaccgctaacacccgcggcaacgccttcggttcttgcggcagaaacccttccggcagctacgtaagctgtacgccccgggacgctatttgtggacaactccagtgccaaacaggcagaactcagccactactgggatccataagagatctgctgtgggagaccatcgatgtcaatgggactgaacttaactgttcatgggtgcacctggatttgggatctgacgtcgcccagcccttgctgacccttccaggtactgcctgcggcccaggccttgtgtgcatcgaccatcgctgccagcgtgtcgatttattaggggcccaggagtgcagaagcaagtgccatggacatggtgtttgtgactccaacagacattgttactgcgaggaggggtgggcaccccccgattgtaccactcaattaaaagccacgagtagcctaactacaggacttcttctgagcttactggtccttctcgtgcttgtgatgctgggagcatcctattggtacagggccaggctgcatcagcgactatgtcagctgaaaggccccacttgccagtatagagccgcccagtccgggccatctgagcgcccaggcccaccccagcgggcattgctggccaggggaacaaagagtcagggacccgccaaaccaccccccccaagaaagcctctccccgcagacccgcagggacgctgtccatctggcgacctgcccggccctggagccggaattccccccttggtggttccaagcagacccgccccaccaccccccaccgtctcctctctgtacttgtag

SEQ ID NO: 107192 - DNA, 2589 bp, Artificial Sequence
  Description of Artificial Sequence: Synthetic coding sequence
atgcggctagctctgctgtgggcattaggccttctaggggccgggtccccattgccctcttggcccctgcctaatataggtggtacagaggagcaacaggctgaatcggaaaaggcgccgcgggagccgttggaacctcaggtactccaggacgacctgcctattagcctgaaaaaggtgttgcagacaagcctgcccgagcccctcaggattaagctggaactcgatggcgatagtcatatccttgaacttttacaaaacagagaattagtgccagggcgaccaaccttagtttggtatcagcccgatgggactcgagtggtatccgaaggccatacgttggagaactgctgctaccagggccgcgttagaggctacgccggcagctgggtctcaatctgcacttgctctgggctgcgtggactagtcgtgctcacccctgagcgcagttacacactcgagcagggaccaggcgacctccaaggtccccccattattagcagaatacaggaccttcatctgccaggtcatacctgtgccctcagttggcgggagtcagtgcacacgcagaaacctcctgaacaccctcttgggcagcgacacattcgaaggagacgggacgtggtgaccgagactaagacagtggagctagtgatcgtggctgaccacagtgaggcccagaagtaccgagacttccagcacctccttaatagaacactggaggtggcgctgcttttggacacattctttagacctttgaacgtgcgtgttgccctggtgggtttggaggcttggactcagcgcgatctggttgaaatctcaccaaatcctgctgtaactctcgagaatttcctacattggcggcgcgcgcacctgctccctagactgcctcatgatagtgcacagttggtcacggggacctcatttagtgggcctaccgtgggcatggccatccaaaattctatttgtagccccgatttttccggcggggtaaatatggaccattccacatcaatcctgggcgtcgccagcagtatcgcccacgaactcggccactcgcttgggctggatcacgatcttccaggtaactcatgcccgtgtcctggtccagcccccgccaagacctgtattatggaagcaagcaccgattttctccctggactaaacttttccaactgttccagaagggccttagaaaaggccctgctggacgggatggggagctgtctctttgaaaggctaccaagcctgccgccaatggctgctttttgcgggaacatgtttgttgaaccaggagagcagtgcgactgtgggtttttggacgactgcgtcgatccatgttgtgacagccttacctgccagctgcgcccgggcgcccaatgcgcctccgatggtccgtgttgtcagaattgtcaactcaggcctagcggttggcagtgcaggcccacccgaggagattgtgacctcccagagttttgcccgggagacagctctcaatgcccacccgacgtcagtttgggcgacggcgaaccctgtgccggcggtcaggcagtgtgcatgcatggtcgttgtgctagctatgctcagcagtgtcagtctctgtgggggcctggagcccagcctgctgcaccactgtgcctgcagacagccaatactagaggcaacgccttcgggagctgtggccggaatcccagcggatcttatgtatcctgcacacccagagacgcaatctgtgggcagttgcaatgccagacagggaggacacagcccctgttaggatccattagggacttattgtgggagacgatcgatgtcaacggcaccgaactcaattgttcttgggttcatttggatcttggatccgatgtcgctcaacctctccttaccttgccggggaccgcctgtggcccagggctcgtctgcatcgatcaccgctgccaacgcgttgatctcctgggcgctcaggagtgccgtagtaagtgtcatgggcacggagtgtgcgacagcaacagacactgctattgcgaagagggttgggctccacccgactgtactacacagttaaaagccactagctcgttaacaactgggctgttactgtctcttctcgtgttgcttgtgctggtaatgctgggggcctcttactggtacagagcccgactgcaccagcggctgtgccaactaaaagggccaacctgccagtacagggcggcccaatcaggcccatccgaaaggcctggaccacctcagcgggctctcctggctagggggacgaaagcctctgccttgtctttccctgccccaccatcacggcccctgccccccgatcccgtgtcaaaaaggttgcaggccgagctcgctgatcgacccaatccgcccacgcgccccctccccgctgatcctgtggtgcgctcccctaagagtcagggccctgctaaaccaccccctccaaggaagccccttcctgctgatcctcaggggcgatgcccaagtggggatcttcccggacccggggccggtattccacctctcgtggtgccatctcgaccagcacctccaccaccaacagtaagcagcttatacctttag

SEQ ID NO: 107193 - DNA, 2391 bp, Artificial Sequence
  Description of Artificial Sequence: Synthetic coding sequence
atgagacttgccttactctgggctcttgggttactaggggctggatcaccattgcccagttggccccttcccaacataggcggaacggaggaacagcaggccgaatctgaaaaggctcccagagagcctcttgagccacaggttctgcaagatgacctgccaatcagcctgaaaaaggtcctccagactagccttcccgagccattgagaatcaagcttgaactggacggcgactcccacatccttgagttactccagaatagagaactcgtcccagggcgcccaaccttggtgtggtatcaacctgacggaacacgagttgtgtccgaggggcacacgctggaaaattgctgctatcagggtagggtgcgcgggtacgcagggtcttgggtgagcatctgcacttgttcagggctgcgcggattagttgtcctcacacccgagagatcttataccttggagcaagggccgggcgacctccaaggacccccaattatttccaggattcaagacctgcaccttccaggtcacacttgtgcgctgagctggcgcgaatcagtccacacacagaaaccccccgaacaccccctggggcagaggcacatcaggcgcaggagggatgtcgtgacagaaacaaaaaccgttgagctagtgattgtcgccgatcactctgaggcccagaaataccgggattttcagcacctgctgaatcgcaccctggaagtggcattgcttctcgataccttcttccggccgctgaatgtccgcgttgcactcgtcgggctggaggcgtggactcaaagggatctcgtcgagatctcgccaaatccagctgttactctcgagaactttctgcactggcggagggcacatcttctccccaggctgccccatgatagtgctcagcttgtgactggaacgagctttagtggtcctactgttggaatggccatccagaactccatctgtagccccgatttctccggcggggtcaacatggatcattcgaccagcatcctaggggtcgctagttctattgcacacgaacttggacactctctgggcctagaccacgatctcccaggcaatagttgcccttgccccggtccagcccctgcaaaaacctgcattatggaagcgagcacagacttcctccctggactgaatttttcaaattgcagtcgacgagcactggagaaagccctgctggatggcatgggttcctgcctgttcgaacggcttccctcattgccccccatggctgccttttgcggcaacatgtttgttgaaccaggggaacaatgtgattgtggatttctggatgattgcgtggacccatgctgcgattctcttacctgtcagctccgtccaggcgcacagtgcgcaagcgatggaccctgttgccaaaattgtcagctgcgaccttctggctggcagtgccgacccacgcgaggagactgtgatctccctgaattctgtcctggggattccagccagtgccctccagacgtgagcctcggcgatggcgagccctgcgctggagggcaggctgtgtgtatgcatggaagatgcgccagctacgcacaacaatgccagagtctctggggtcctggcgcacagccagccgcaccactgtgtttacaaaccgcaaacacacgtggtaacgcattcggctcttgcggtagaaatccaagcgggtcatatgtatcttgtacaccacgcgatgctatctgtggccaactgcagtgtcagactggtagaactcaaccactactgggcagcatccgagatcttctgtgggaaaccattgatgtgaatggcaccgaattaaactgcagctgggtgcacctcgaccttggtagtgatgtagcccagccgctcctcacactgccggggaccgcctgtggcccgggtctagtctgtatagatcatcggtgtcaacgggtcgatcttttgggtgcacaggagtgcaggtccaagtgtcatgggcacggagtgtgtgattccaatagacactgctattgcgaggagggctgggcccccccggactgcaccactcagcttaaagccacatcatctttgacgactggcctgctgttatcactgctggtcctgctggttcttgtaatgctcggggctagctactggtaccgcgccaggctacatcagcgactgtgtcaacttaaaggaccaacctgccagtacaggctggtcctaagtgctagcaggcctccactgcctggcaggtgtagactcacactgtgccccagagactcctccctgcgcggtcagccttcacctcacccccagggatcacactgcctgccaacaccgcgggccggagctcatagggtcacgtgccctgcacagggcctggagtcacgtccctag

SEQ ID NO: 107194 - DNA, 2475 bp, Artificial Sequence
  Description of Artificial Sequence: Synthetic coding sequence
atgcggcttgctttactctgggccctgggactcctgggggctggctccccactgccgtcttggcccctacccaatattgtcctctcctggggtgttctaggaccagccgggggcacagaggagcagcaggctgaatccgaaaaagcacctcgagagcctcttgagccacaagtcctccaggacgacctgccaattagtctgaagaaggttcttcagaccagcctgcccgaaccgttacgcattaaattagagcttgacggcgactctcacatacttgagctattgcagaatagagaattggtgcctggccgcccaacgctggtgtggtaccagcccgacggtaccagagtggtgtccgaaggccatacacttgagaactgttgttatcaaggtagggtacgcggatacgcaggctcatgggtgtccatttgcacctgtagcgggctgagagggctggtagttttgactcccgaacgcagctacaccttggagcaagggccgggggatctccaggggccccccattatttccaggatccaggaccttcaccttcccggacatacatgcgccctctcatggagagagtcggtgcacacacagaagcctcctgaacatcctctgggtcaacgccatattcgccgtcgacgcgacgtggtcacagaaacgaagaccgtcgaactagtgatagttgcagatcacagcgaggcccagaaatacagggacttccagcatcttttgaacagaacccttgaggtggcacttcttctcgatactttcttccgccccctgaatgtgagggtggctttagtaggccttgaagcctggactcaacgggatctcgtcgaaataagcccaaaccccgcagttacacttgaaaactttttacattggcgccgagcccatctcctgcctcgcttacctcatgattccgctcagctcgtaacaggcaccagtttctcaggtccgacagtgggaatggcaatccagaatagtatctgttctccagatttttccggcggcgtgaacatggaccacagcacctccattctgggggtggcctcatccattgctcacgagctgggacactccctcggcttggaccatgacctgcctggcaatagttgcccttgtcctggacccgcccctgcaaagacatgcataatggaagcctcgacagacttcttacccggactgaacttcagcaactgcagtcgacgtgcgcttgagaaagccctcctcgatgggatgggttcctgtctttttgagcggctgccctccctgccacctatggcggccttctgcggtaatatgtttgtggagccgggcgagcagtgtgattgcggatttctggacgattgcgtagacccgtgttgtgactccttgacttgtcaactccgcccaggtgctcaatgtgcctccgatgggccatgctgccagaactgccagctgcgtccaagcggctggcagtgcagaccaacccggggagactgcgatctccctgaattttgtcccggtgattcttcacagtgtccacccgacgtgtccctgggggacggcgagccctgtgcaggaggacaggctgtgtgtatgcatgggcgctgcgcatcctacgcgcaacaatgccagtctctgtggggccccggtgcgcagcctgccgccccactctgcctgcagacagctaacactagggggaacgcattcggatcatgcggccgaaacccttcaggttcctatgtaagctgcacgcccagagacgctatctgcggccagttgcagtgccagactggccgaacacagcccctgctcggctctatccgggacttattgtgggagaccatagacgtaaacggtaccgaactcaattgttcatgggtgcatttggacctgggatcagatgtggctcaaccccttctaacccttccaggaacagcttgcgggccaggattggtgtgcattgaccatcgctgtcaaagggtggatctcttgggcgcccaggagtgccgttccaagtgtcatggccacggggtgtgcgacagcaaccggcactgttattgcgaggaaggctgggctccgccagactgtacaacgcagctcaaagcaacctcgagcttgaccacgggcctcttgctgtccctgcttgtgctgctggtactggtaatgctaggggcgagctactggtatcgcgcccgcttacaccagcggctttgccagctgaaaggccccacatgccagtacagggctgctcaatccggacccagtgaacgccccggccctccccagagagcactgctcgcgagaggcacaaaatctcaggggccggccaagcctccacctccgcgaaagcctctgccagctgatccgcagggccgttgtccatccggcgacttaccggggcccggtgcaggtattccccctctggtagtgccctctcgcccggcaccaccccctcctacagtgtcaagcctgtatctgtag

SEQ ID NO: 107195 - DNA, 2757 bp, Artificial Sequence
  Description of Artificial Sequence: Synthetic coding sequence
atgcctggcggagccggcgccgctcgtctctgcttgctggctttcgcactgcagcctctgcgacctcgggctgctagagagccaggttggacacggggatcagaggagggttccccaaaactacaacacgaacttataataccccagtggaagacgtccgaaagcccagtgcgggaaaaacaccccctgaaggccgaactgcgggtgatggccgagggacgcgaactgattctggacctggaaaaaaacgaacagttgtttgctccctcgtacacagagacacactatacctcttccggaaatccacagactactacacggaaactggaggatcattgtttctatcatggtaccgtccgcgagaccgaactctcctccgtcaccttgtccacttgtcgcggcatcaggggtctgattaccgtcagcagcaatctgtcctacgtaatcgaacctcttcccgatagtaaaggtcagcatctcatctatcgcagcgaacacctgaagcccccaccaggaaattgtggcttcgaacacagcaagcccacaacccgagactgggcgctgcaattcacacaacagactaagaagagacctcggcgcatgaaaagagaagacctgaacagtatgaagtacgttgaactctatctggtcgccgattacctggaatttcagaagaaccggcgggatcaagatgccaccaagcataagctgattgaaatagcaaattatgtcgataaattttatcggtctctgaatattcggattgccttggtggggcttgaggtgtggactcacggtaatatgtgtgaagtgtctgaaaacccctatagcactctgtggtcatttctctcctggagacgcaagctcttggctcagaagtatcacgataatgcacaattgataactggcatgtcatttcacggcacaacgattggcctggcacccctcatggcgatgtgctccgtgtaccagagcggcggtgtgaatatggatcactcagagaacgccattggagttgctgcaacaatggcccacgagatgggccataacttcggcatgacacacgattccgccgactgttgctcggcctccgccgctgacggcggctgcataatggcagctgcgactggccatcccttcccgaaagtcttcaacggctgtaatcgcagagagctggataggtacttgcagagcggcggcggcatgtgcctgtccaatatgcctgacacccgcatgttatacgggggcaggcgatgcggcaacggctacctcgaagacggagaagaatgtgactgcggggaggaggaagagtgcaataacccatgttgtaacgccagcaattgtaccctccggccgggggcagaatgcgctcatgggtcctgttgtcaccagtgtaaactccttgcccctggcaccctatgccgcgaacaggcccggcaatgcgatctgcctgagttctgtactggcaaatcccctcactgtcctaccaatttttaccagatggacggtaccccctgcgaaggcgggcaggcgtactgctataatggaatgtgtttgacttaccaggagcagtgccagcagttgtgggggccaggagcaaggcccgccccggatctttgcttcgaaaaggtgaacgtggccggtgacacgttcggtaattgtggcaaggacatgaatggagaacaccgcaaatgtaacatgcgggatgccaaatgcgggaagattcagtgtcagtcctcggaagctcgcccattggaatcaaacgctgtgcctatagatacaacaatcattatgaatggccgccagatccagtgccgcggtacccacgtctacaggggaccggaagaagagggtgatatgctggaccctggcctggtcatgactggtaccaaatgcggctacaatcatatttgcttcgagggacagtgtaggaacacctccttcttcgagacagagggttgtggaaaaaagtgcaacgggcatggagtctgtaataataaccaaaactgccattgtctgcctggatgggccccacccttttgcaatacaccaggacacggtggttctattgactctgggcctatgcccccagaatccgtcggcccggttgtggctggcgtgttagtggctattttggtgctggccgttctgatgctcatgtattactgttgtcgtcagaataacaaactcggccagctgaagccgagcgcgttgccatctaaactccgacagcaattctcttgtccattccgcgttagccagaattctggcaccggtcacgcaaatccgacatttaaactccagaccccgcagggtaaacgcaaagtcatcaatacgccagaaatccttagaaaacccagtcagcctcccccgaggccccccccagactatttgcgaggcggatctcctcctgcgccattacccgcccacttgagccgggccgcccgcaactcccctggccccggctcccaaatcgaacgaaccgagagcagccggaggccaccccctagccggcccattccaccagctcccaactgtatagtttctcaggactttagtcgcccacgccctcctcagaaggctcttcccgcaaatcccgtgccggggagaaggtctctgcctcgccccgggggcgcaagcccactgcgacccccaggtgcaggaccacagcagtctcggccactagcagcgcttgcccccaagttcccagagtatagaagtcaacgggcgggagggatgatctcctcaaagatctag

SEQ ID NO: 107196 - DNA, 2763 bp, Artificial Sequence
  Description of Artificial Sequence: Synthetic coding sequence
atgccgggtggggctggggcagccaggctttgcctgctggcttttgctttgcagcctttgagaccgcgagccgcccgtgaacccgggtggacaatctctcggggttccgaggaaggcagcccaaaactgcagcacgagcttatcattccccagtggaaaacgtccgaatctcctgtgcgagaaaaacatccacttaaagccgaacttcgcgttatggctgagggcagagagctgattttggacctagaaaagaatgaacagctcttcgcccccagctacacagagacccattacacatcttccgggaacccacaaaccactacgaggaaacttgaagaccactgcttttaccacggaacggtccgcgaaaccgagctatcttccgtgaccctgagcacatgtcggggtatccgcgggctgatcactgttagctcaaacctatcgtatgtgattgagcccctaccagacagcaaaggacaacacctgatctatagaagtgaacatctcaaacctcctcctggcaactgcggcttcgaacattctaagccaaccacacgagactgggcactgcagttcacccagcaaactaagaagcggccaagacgcatgaaacgcgaggacttgaattctatgaagtatgtggagctgtacctcgttgctgattatcttgaatttcagaagaaccggcgagaccaggacgcgaccaagcacaagctgattgaaatagccaactacgtcgacaagttttataggtctctgaacattagaatcgccctggtagggctggaggtgtggacacacgggaatatgtgtgaagtgtcggaaaacccctatagtactctctggtcttttttgtcatggagacggaaattattggcccagaaataccatgataatgcacagctgataaccggcatgtccttccacggcacgaccatcggcctggcacctttgatggcaatgtgctccgtgtatcagtcaggaggagtgaacatggaccactccgagaacgctataggtgtggctgccactatggctcatgagatgggtcataattttgggatgacacatgactctgccgactgctgctctgcttccgcagcggacggtggctgcatcatggctgctgcgacaggtcaccccttccctaaggtttttaacgggtgcaaccggagagagctcgatagatacctacaatccggcggaggaatgtgtctgagcaatatgccagacactcgcatgctatatggcggccgccgctgtgggaatggatacctggaagatggagaggagtgtgattgcggagaggaggaagagtgcaataacccttgttgcaacgcttccaattgcacgttgaggcctggagccgaatgcgcccacgggtcatgttgccaccaatgcaagctgctggctcccggcacactgtgccgtgagcaagcgcgtcagtgtgatctgccagagttttgcacagggaagtcgccccactgccctaccaacttttatcaaatggatggaaccccatgcgaaggtggtcaagcttattgttacaacgggatgtgcttgacatatcaggagcagtgtcagcagctctgggggccaggggcgcgcccggctccagacctttgcttcgaaaaagtcaatgtcgctggggatactttcggaaattgcggcaaggacatgaacggcgaacatcgaaaatgcaatatgcgagatgctaaatgtggcaagattcagtgccaatcctcagaggcgcggccactggaatcgaatgccgttccaatcgacacgacaattattatgaatggacgccagatccaatgtagagggacccacgtttacaggggccccgaagaggaaggcgacatgctagaccctggtctggtgatgacaggaacaaagtgcgggtacaaccacatctgcttcgaaggtcaatgcaggaacacctcatttttcgagactgagggttgcgggaaaaagtgcaacgggcacggggtgtgcaacaacaatcaaaattgccactgtctgcccgggtgggcacctccgttttgcaacacacccggccacggcgggtctattgacagcggacccatgcctcctgagtctgttgggccagtcgtggcaggcgttctggtggcgattctggtgctagccgtattaatgctgatgtattattgttgtcgtcaaaacaataaactgggacaattaaagccgtccgccctgcccagcaagttgcgtcagcagtttagctgtccttttcgcgtctctcagaactcaggcacaggccacgctaaccctacttttaaacttcagacaccacagggaaagcggaaagtgataaacacacccgaaatccttcggaagccttctcagccgcctcctaggcccccacctgattacctacgtggtggctctccccctgctcccctacccgcccacctatctcgagcagcaagaaattcaccggggcctggctctcaaattgaaaggacagagagctcaaggcgtcctccaccaagcaggcccatcccacccgcccccaactgtatcgtttcacaggatttctctcgaccccggccaccacaaaaggccctgccagccaatcccgtcccggggcgacgaagcttaccgcgcccgggaggggctagcccgctgcggcctcccggagccgggccacagcagagtcggccgcttgccgccctagcccccaagttccctgagtacagaagccagcgagcgggcggtatgataagctctaaaatctag

SEQ ID NO: 107197 - DNA, 1917 bp, Artificial Sequence
  Description of Artificial Sequence: Synthetic coding sequence
atgtgcgaggtcagcgaaaatccatacagcacgctgtggagcttcctgtcatggcgcaggaagctgctcgctcagaagtatcatgataacgcacagctcataaccggcatgagtttccatgggaccacaatcggcctagcgcctctgatggccatgtgtagcgtctatcaaagcgggggggtgaacatggaccattcagaaaatgccattggagtggccgctacaatggctcacgagatggggcacaattttggcatgacacatgactcagctgattgttgtagtgcttcggccgcagatggtggctgcattatggctgccgccacggggcacccattcccaaaagtcttcaacggttgcaaccggagggagcttgatagataccttcagtctggaggcggaatgtgcctctctaacatgccggatactcggatgctgtacggtggtaggaggtgcggtaatggttacctggaagatggagaggagtgcgattgtggtgaggaggaggagtgcaacaatccatgctgcaatgctagtaactgcacgctgagacctggtgcagaatgtgctcatgggtcttgctgtcatcagtgcaaactactcgcacccgggaccctatgtcgcgagcaggctcggcagtgtgatctgcccgagttctgtacaggtaagagtccccactgtccaacaaacttctatcagatggacggaactccttgcgagggaggccaggcttattgctacaatggcatgtgtctcacttatcaggagcagtgtcagcagctgtggggccctggagctcgacccgcccctgatctctgctttgagaaggttaatgtggccggggataccttcgggaattgtgggaaggatatgaacggggaacataggaaatgtaatatgcgtgacgctaagtgcggtaagatacagtgtcaatcaagtgaagccaggccactggagtccaatgccgtcccaattgacactaccataattatgaacggacgacaaattcagtgccgaggtacccacgtgtatagaggacctgaggaagagggagacatgctggatcccgggctcgtgatgacaggcactaagtgtggctacaatcatatctgcttcgaaggacaatgtagaaatacaagcttctttgagaccgaagggtgtggaaaaaaatgtaacggacatggtgtgtgtaacaacaaccagaattgccattgtctgcctggctgggcacctccattctgcaacaccccagggcacggtggctccatcgattctggtcccatgccccctgagtccgtcgggcctgtggtcgccggcgtgttggtggctatactggtccttgctgtcctgatgcttatgtactattgttgtcgccaaaataataagctgggccaattgaagccatcagccttgccgtctaaactgcggcaacaattttcatgtccattccgggtttcacagaacagcggaaccgggcatgcgaacccgactttcaagctgcagacaccccaggggaaacggaaggtgattaacactcctgagatccttaggaagccttctcagccgccgcctcggcctcctcccgattatctgcgagggggctcaccccccgcgcccttgccagcacatcttagccgggcggcccgaaatagcccgggccccgggtctcagatcgaaaggaccgaatcgtcacgaagacccccgccatcaaggcccatcccacctgcccctaattgcatcgtgagccagaagtgtctgctaccccctgcaatgatcctaagagccccacagccatccgggaccgttgtatgcttagttatcagttttaatatggccttttacagatccatgcgcattcgcattgagccgggcatcaaaaccaaactgctcgttcttctggtctggaagcaattctag

SEQ ID NO: 107198 - DNA, 2868 bp, Artificial Sequence
  Description of Artificial Sequence: Synthetic coding sequence
atgccaggcggagccggtgcagctaggttgtgtctgctggcctttgctctgcaacctctccgacccagggcagcaagagagcctggatggacgcgagggagcgaggagggctcccccaaacttcagcacgaactgattataccacagtggaaaacctctgagtcgcccgtgagagagaagcacccccttaaagcagaactgcgggttatggccgaaggtcgtgagttgatactagatctcgagaaaaatgagcagttgtttgcaccttcctatacagaaacccattacacctccagcggcaatcctcagacaaccacccgcaagttagaagatcattgcttttaccacgggactgtgcgagaaaccgaactaagttctgtgacactcagcacgtgtaggggcattcgtggcctcattactgtcagcagcaacctcagttatgtcatcgaaccactccccgacagcaaaggacagcacttgatttatcgctccgagcatctaaagcctccccccgggaactgcggatttgaacacagtaagcctactaccagagactgggcactccagtttacccagcagaccaagaagcggccccgcagaatgaagcgggaagacctgaactctatgaagtacgtggaactgtacctggttgctgactatctggaattccagaagaatcggcgagaccaggacgccaccaaacataagttgatagaaattgcaaattacgtagataaattctaccggtccctcaatatcagaattgctctcgtgggcctcgaggtatggacgcacgggaacatgtgcgaggtgagtgagaatccctattctacgctttggagcttccttagttggcgccggaaactgctggcccagaaatatcacgacaatgcacagcttatcacaggcatgtcctttcacgggaccacaattggcctggcccctctgatggcgatgtgctctgtctaccagagcggtggcgtaaatatggatcattcagaaaatgcaattggagtagcagctaccatggcccacgagatgggtcataacttcggaatgacacacgatagtgcggactgctgctcggcttctgctgctgacggagggtgcataatggcggcggccaccggccaccctttcccaaaggtattcaacggatgcaatagacgcgaacttgaccggtatttacagtcagggggaggaatgtgcttgtctaacatgccagatacgaggatgctttatggagggcgcaggtgcggtaacggatacctagaggatggagaggagtgtgactgcggcgaagaagaggaatgtaataacccttgctgtaacgcatccaactgtacactgaggcctggcgccgaatgtgcacatggctcttgctgccaccagtgcaaactgctcgccccaggcactctgtgtagggagcaggcgcggcagtgcgacctccccgagttttgtaccgggaagtctcctcattgccccacaaacttctatcagatggatggtacaccttgcgagggtggccaagcgtattgttataacggaatgtgtttgacctatcaagaacagtgccaacagctatgggggcccggtgcccggcctgcccctgatttgtgttttgagaaggtgaatgtggctggagatacgttcggaaattgcggcaaagatatgaacggcgaacatcggaaatgcaatatgagggatgcaaagtgcggcaaaatccaatgtcagagctccgaagctaggcccctcgagtctaacgcagtccctatcgacaccaccatcattatgaacggtcgtcagatacagtgccgcggcacccacgtgtatcgaggtcccgaagaagagggggatatgttagatcccggcttggtgatgacaggcaccaagtgtggctataaccatatctgcttcgaaggccaatgccgtaacacttccttcttcgagacagaaggttgtggtaagaagtgtaacggacacggcgtgtgtaacaacaatcaaaattgccactgcctgccgggctgggccccacccttttgtaacacgccaggccacggagggtcaatcgactcaggccctatgccaccagaatccgttggtcctgtggtcgccggcgtcctggtagctatcttagtactcgccgtgttgatgctgatgtactactgctgtcgccagaataataagcttggacagttaaaacccagtgccctcccttccaagttaaggcagcaattcagttgtccgttccgggtgtctcagaatagtggcaccggccatgcaaaccccacatttaaactgcaaacacctcagggaaagaggaaggtgatcaatactcctgagatcctacgaaaaccttcccaacctccccctagaccgccgcccgactatctccggggcggaagtccgcctgctccattacctgcccatttgtccagagcggccagaaactctccagggccgggatcacagattgaaaggaccgagagctcccggagaccacccccttcacggccgatccctcccgcccctaactgcatcgtcagtcaggacttttcccgcccacggccaccacaaaaggccctccccgcaaacccagtgcctggtcgtaggtctttgcccaggccaggcggagccagtcctttgcgccccccaggtgccggcccacaacagagcagaccattggccgcattggctcccaaagtttctcctagagaggctctcaaggtgaaggccgggacgcgtggactgcagggagggagatgcagagtggagaaaaccaaacagtttatgctgctggttgtatggactgaactccctgaacagaaaccacgcgctaagcacagctgtttcctagtgcccgcctag

SEQ ID NO: 107199 - DNA, 2208 bp, Artificial Sequence
  Description of Artificial Sequence: Synthetic coding sequence
atgtggagggtcctgttcctcctctctggactgggcggcctccgtatggacagtaatttcgacagtctccccgtacagatcacagtccccgagaagattcgatccattattaaggaggggatagagtctcaggcctcttataaaattgtgatcgagggaaagccctataccgtgaatctgatgcagaagaacttcttaccacacaactttcgcgtctacagctactccgggacaggcattatgaagcctttggaccaggattttcagaatttctgtcactaccaaggttatattgaaggatacccgaagagcgtggttatggtctcaacttgcacgggccttcggggtgtgctgcagttcgagaatgtgtcttacggcatcgaacctttggaaagttctgtgggattcgaacatgtgatataccaggtcaaacataagaaggcagacgtttcgctttacaatgagaaggacatcgagagcagggatctgtccttcaagctacagtccgtagaacctcagcaagactttgccaagtacatcgaaatgcatgtgatagttgagaagcagctctataatcatatggggagcgacaccacagtggtggcccaaaaggtttttcagcttatcggactgacgaatgccatattcgtgagttttaacattaccatcatcctctctagtctagaattgtggattgatgaaaataaaatagccacaacaggcgaggccaatgaactgctccacacattcctgaggtggaagacctcctacctcgttttgagaccacacgacgttgcctttctgcttgtataccgagaaaaaagcaattacgtgggggctactttccaagggaaaatgtgcgatgccaactacgccggtggcgttgtgttgcacccaagaactatcagcctggaatcactggccgttatccttgctcagctcctcagtctgtcaatgggcatcacctatgacgatataaataagtgtcagtgttctggtgcggtatgcattatgaacccagaagcgatacatttttccggagtcaaaatcttttccaactgctcattcgaagactttgctcactttatatctaagcagaagagtcagtgcctgcacaatcaaccgagattggacccctttttcaagcagcaggccgtttgtggaaacgccaagctcgaggccggcgaggaatgcgattgtgggacagaacaagactgtgccctgataggagagacctgctgcgacatcgctacctgcagattcaaggcaggttctaattgcgcagagggaccttgctgcgaaaattgtttgtttatgtccaaagaacggatgtgccggccttcatttgaggagtgtgaccttccggaatattgtaacggttcttctgcctcatgccctgagaaccactatgttcagaccggccacccctgcggccttaaccagtggatttgtatcgatggagtgtgtatgtcgggagacaaacagtgtactgacacatttggcaaagaggtcgagtttggccctagcgagtgctattcacacctgaatagcaagacagatgtcagtggcaactgcggtatttcagactccgggtatacgcaatgcgaggctgataatctacagtgcggaaagctgatttgtaagtatgttggcaaattcctgctgcagattcctcgggcgacaatcatctacgccaacatcagcgggcacctctgtattgcagttgagtttgccagtgatcacgccgatagtcagaagatgtggatcaaggacggaacatcgtgcggcagtaataaggtctgccgcaaccagcggtgtgtgtcttccagctacctcgggtatgactgtactaccgataaatgtaatgaccgcggcgtatgcaacaataagaagcattgccattgtagcgccagttatctgccgcctgattgtagtgtgcagtccgatctgtggcccggggggagcatagacagcggaaactttccaccagttgctatcccagctcggctgcccgaacggaggtatatcgagaacatttatcatagcaaaccaatgcgatggccattctttctattcatcccattttttattatattctgcgtgctgattgcaatcatggtcaaggtgaattttcagcgaaaaaaatggaggaccgaggactactcttctgacgagcaacccgagtccgagtccgaacctaagggttag

SEQ ID NO: 107200 - DNA, 2151 bp, Artificial Sequence
  Description of Artificial Sequence: Synthetic coding sequence
atgtggcgagtgctctttctgttgagcgggttgggaggtctgaggatggacagtaatttcgattccttgccggttcagatcacagtgcctgaaaagatcagatcaattataaaagagggaattgaatctcaggcctcatataaaatagtgatcgaggggaaaccctatactgtcaatctgatgcaaaaaaattttttgccacataacttccgcgtgtattcttacagtgggacaggaataatgaaaccactggaccaggatttccaaaacttctgtcattaccagggttatatcgaagggtatccaaagtcggtggtaatggtgtctacgtgcaccgggctgagaggagttctacagttcgagaacgtcagctacgggatcgagcctctggagagcagtgtggggttcgagcacgtcatctatcaagtcaagcataagaaagcagatgtgtcgttatataacgagaaggacatcgagtcacgagatctgtcttttaagctgcagagtgttgagtataatcacatgggcagtgatactaccgtagtagcccagaaagttttccaacttattggcctgacgaatgctatctttgtgtctttcaatatcactattattctcagcagcctggagctttggattgatgagaataagattgcaaccaccggggaggccaacgagcttctgcacacgttcctgaggtggaagacaagctatctggtattgcggcctcacgacgttgccttcttgctggtgtaccgggagaagtcgaattacgttggggcaacattccagggcaagatgtgtgatgcgaattatgccggaggagtagtcctgcacccccgcacaattagcctcgagagcctcgctgtgatactggcccaattactgagtttgagcatgggtatcacctatgatgacatcaataaatgccaatgctccggtgcggtttgcattatgaaccccgaagccatccacttttctggggtgaaaatcttctccaattgttcctttgaagattttgcccacttcataagcaagcagaaatcccaatgcttgcacaatcagccccgactggatccgttctttaaacaacaggccgtgtgtggaaatgccaagcttgaggccggggaagaatgcgactgtgggacagaacaagattgtgccctcataggggagacctgttgcgatattgccacctgcaggtttaaggccggctccaactgcgctgagggaccttgctgcgaaaattgtctcttcatgtccaaagaacggatgtgtagacccagctttgaagaatgcgacctgccagagtattgcaacggatcttcggcttcctgccccgaaaatcattacgttcagacaggtcatccttgcgggttgaatcagtggatttgcattgatggggtttgcatgtctggtgacaaacagtgtactgacacatttgggaaggaggtcgagttcggaccatcagaatgttattctcaccttaactctaagacagatgtttccgggaattgtggcatcagtgactctgggtatacacaatgcgaggccgacaacctgcagtgtggcaaattaatttgcaaatatgtgggcaaatttttgctgcaaatcccacgagccacaatcatatacgcaaacattagtggtcatttgtgtatcgctgttgagtttgcaagcgatcatgcagacagccagaaaatgtggattaaggacgggacatcctgcggtagtaataaggtgtgccgaaatcagcgttgtgtttctagttcatatctgggttacgactgtactactgacaaatgcaatgatcgcggcgtctgcaataacaaaaaacactgtcattgttccgccagctatctgcccccagattgtagtgtgcagagcgatttatggccgggggggtctatcgactccgggaactttccgcctgtagccatacctgcaaggctgcccgagcggcggtatatcgagaacatttatcactctaaacccatgcgctggcctttctttctttttattccattttttattattttttgcgtgcttattgctatcatggtgaaagtcaatttccagcgcaagaagtggcggacagaagactacagttccgacgagcagcccgagtctgagtccgagcccaagggttag

SEQ ID NO: 107201 - DNA, 2331 bp, Artificial Sequence
  Description of Artificial Sequence: Synthetic coding sequence
atggtccagctgcaccaagacacagacccccaaatccccaaaggacagccctgtacactgaacagcagtgaggggggagctaggcctgcagtcccgcacaccctgttctcctctgccctcgacaggtggctccataatgacagctttatcatggcagtgggagagcctctagtgcatatccgtgtgaccctcctgctgttgtggttcgggatgtttctgtctattagcggccatagtcaagcaagaccttctcagtattttacaagcccggaggtggttatccctctcaaggtaatcagccgggggagaggggcaaaagcccccggctggctatcctacagcctgcgattcgggggccagagatacatcgttcatatgcgagttaataaattgttatttgccgcccacctacccgtgtttacgtacacagagcagcacgccctgctgcaggatcagccatttattcaggatgattgctactaccacggctacgtggagggagttccagagtccctggttgcactgtcaacttgctcaggcggctttctgggcatgctgcagataaatgacctggtatatgaaatcaaacccataagcgtatcagctacttttgagcatcttgtgtacaagatcgattccgatgatactcaatttcccccaatgcggtgtggtcttacagaggaaaagattgcccaccagatggagctgcaattaagctataacttcacgcttaagcagtcgtcctttgtgggttggtggacgcaccagcgatttgtagagcttgtggtggtggttgacaatattcgctacctgtttagtcagagcaacgctactactgtccagcatgaagtgttcaacgtagtcaacatagtcgattccttttaccaccccctggaggttgatgttattctgactgggattgatatttggacagccagcaatcctctaccaactagcggcgacctggataatgtgcttgaggatttctccatttggaagaattataatttaaataatcggctacaacacgacgtagcgcatcttttcataaaggacacccagggaatgaaactaggagttgcgtatgtcaaagggatctgtcagaaccccttcaacacaggggtagatgtttttgaggacaacaggctagtagtcttcgccatcacactggggcacgaactagggcataatctcgggatgcagcacgatacgcagtggtgtgtctgcgagctgcaatggtgtatcatgcacgcatatcgaaaagttacgacgaaattctctaattgttcctatgcccaatactgggatagtacgatatcctcaggactatgcatacagccacccccttatccaggcaatatcttccggctcaagtattgcgggaacttggtggtggaagaaggggaggaatgcgactgcggcacgattagacagtgcgcaaaggacccctgttgtctcttgaattgtaccctacaccccggggccgcgtgcgctttcgggatatgctgcaaagattgtaaattcctcccaagtggcactttatgtcgacaacaggtcggcgaatgcgatctcccggaatggtgcaatggtacttcccatcagtgtcctgacgatgtgtatgtccaagacgggatttcctgcaacgttaacgctttttgctatgagaaaacctgcaacaatcacgacatccagtgcaaagagatatttggccaggatgctcggtcggcctcccagagttgctatcaggaaatcaacactcaggggaacagatttgggcactgcggcatcgtggggactacctacgtcaaatgctggacgcccgacattatgtgcgggcgagtgcaatgcgaaaacgtgggcgtaattccaaatcttatagagcactccaccgtgcagcagtttcacctgaatgatacaacttgctgggggactgattaccacttgggcatggcaattcctgacatcggagaggtgaaagacggtacagtgtgcggccctgagaagatttgcattcggaaaaagtgtgcaagtatggtgcacttgtcacaggcctgtcaacctaagacttgtaatatgaggggcatctgcaacaacaaacaacactgccattgcaatcatgaatgggcaccaccgtactgtaaggataaagggtacggcggaagcgccgacagtgggccgccaccaaagaataacatggaaggacttaatgtgatggggaaactcagatacttatccctcctctgcctgctaccacttgttgcctttctcttattttgtttacatgtactgttcaagaagcggactaagtctaaggaggatgaagaaggatag

SEQ ID NO: 107202 - DNA, 2169 bp, Artificial Sequence
  Description of Artificial Sequence: Synthetic coding sequence
atggcggttgatggtacactggtttatatccgagtgactctgttgctactttggctaggggtgtttctctccatcagcggttattgccaagcgggaccctcccagcactttacctcaccagaagtggttattcctctcaaggtcatcagccgcgggcgctcagctaaggctccaggctggttaagctacagtctcagattcggcggacagaagcatgttgtccatatgagagtgaaaaaactcctggttagtaggcatcttcctgtgtttacctatactgatgaccgcgctctgttggaggaccaactgtttattcccgacgattgctactaccatgggtacgtagaggcagctcctgagagcctagtggtgttttccgcctgttttggtgggtttcggggggtgcttaagatcagcgggttgacatacgagatcgagccgatcagacattccgctacctttgaacatctggtgtataagattaattctaacgagacacagttcccagctatgcgctgcggcttaaccgaaaaggaggtcgccagacagcaattggagtttgaggaggctgagaatagcgccctggagcctaaatcagccggggattggtggacccacgcttggtttctcgaactcgtggtggtggttaatcatgacttctttatttactcccaatcaaatatttctaaagtacaagaagatgttttcctggtcgtgaacatcgtggactccatgtacaaacagctgggtacatacattatcttaattggtatcgaaatctggaatcagggcaacgttttccctatgacaagcatagagcaagtgctgaatgacttctcccagtggaagcagatatctctgagccagctccagcatgatgctgcccatatgttcatcaagaatagtctgatttccattctgggattggcctacgtcgctggcatttgccgaccgcccatcgactgcggcgtggataatttccagggcgatacctggagcctatttgctaatacggtcgcgcatgagttaggtcacactctgggcatgcagcacgatgaggagttctgtttctgtggggagagaggatgtattatgaatacctttagggtccccgcagaaaaatttacaaactgctcctacgccgactttatgaagacaacactgaatcagggcagctgtctgcacaatcctcctcgactgggcgagatttttatgcttaagcgctgcgggaatggcgtggtcgaacgagaagaacaatgcgactgcggcagcgtacagcaatgtgaacaggacgcgtgttgtctgctgaattgtactctacggccaggcgccgcttgcgcctttggactgtgttgcaaagactgtaaattcatgccctccggcgaactgtgccgtcaggaggtcaacgagtgtgacctgcctgagtggtgtaacggcacctcccatcagtgccccgaggaccgatacgtacaagatgggattccctgttccgattccgcttactgttaccagaagcgttgtaacaaccatgatcagcactgtcgagaaatttttgggaaggacgcaaaatctgccagccagaactgctacaaggaaatcaattcacaaggcaataggttcggccactgtgggatcaatggaacgacctacttgaaatgccacattagtgacgtcttttgcgggcgtgtccagtgtgagaacgtgcgcgatatcccgctgctgcaggatcactttacgctgcagcacacacatatcaatggggtcacatgctggggaatcgattatcatttgcggatgaatatctctgatataggtgaggtaaaggacggtaccgtgtgcgggccgggaaaaatttgtatccacaagaagtgtgttagtctgtcagtgctcagtcatgtctgcctgcccgaaacatgcaatatgaagggcatatgcaataataaacaccactgccactgcggttacggttggagccccccttactgtcaacataggggatacggcggaagcattgacagcggccccgcttctgcgaaaaggggtgtgttcttgcccctcatagtcatccccagcctgagtgtcttgaccttcttatttacagtagggttgttgatgtacttgagacagtgcagcgggccgaaagagactaaggctcactcatcaggatag

SEQ ID NO: 107203 - DNA, 2721 bp, Artificial Sequence
  Description of Artificial Sequence: Synthetic coding sequence
atgcaggcagctgtcgctgtgtccgtgcccttcctgctgctatgtgttcttggaacatgccccccagcccgatgtggacaagccggcgatgcctctctcatggagctggaaaagcggaaggaaaatcgcttcgtggaacgacaatcaattgtgcctctgcgtctaatatatcgcagcggcggcgaggacgaaagtcgccatgacgccctcgatactcgggtccgcggggatttggggggaccccaactcacccacgtggaccaagcaagctttcaggtggatgcgtttggtaccagcttcatcctggatgtagtcctgaatcatgatttgctaagtagtgaatacatagaaaggcacattgaacatggtggtaagaccgtcgaggtgaaggggggagagcactgttactatcagggccatattagaggaaatccagattcttttgtagccctcagtacctgtcatggtttgcatgggatgttttacgatgggaatcatacttatctgattgagcccgaggaaaatgacacaacccaagaggattttcacttccattccgtctacaaatcccgcctttttgaattcagcttagacgacctgccctcagagtttcagcaggtcaacattacccccagcaagtttatattaaaaccacggccaaagcggtcaaaaagacagctgaggcggtacccccggaacgtggaggaggagactaaatacatcgagttaatgattgtaaacgaccacctcatgttcaaaaagcatcgcctgtcagtggtgcacacaaacacatacgccaagagtgtggttaacatggcagatctcatctacaaagatcagctgaaaacccggatcgtcctggtggctatggagacctgggcgacagataataaatttgccatttccgagaaccccctgataacactgcgcgagttcatgaagtatcgacgggatttcataaaggaaaaatctgatgctgtgcatcttttcagcggcagccagtttgagtctagcaggagtggcgccgcatatatcggcggcatatgctctctgttgaagggggggggtgtcaacgaattcgggaaaaccgatctaatggcagtgacgctggcgcaatcccttgctcacaacatcggaatcatcagcgacaagagaaaactggcatcaggggaatgcaagtgcgaggatacttggagtggttgtatcatgggggacactggctactatcttccgaagaagtttacccagtgtaacatcgaagagtaccatgacttcctcaatagcggtggcggcgcttgtctctttaacaagccgtctaagttgctggaccccccagagtgtggaaatgggttcatcgaaactggcgaagaatgcgactgcggaaccccagcggagtgcgttcttgagggcgcggagtgttgcaaaaaatgcactctgacccaggatagccaatgtagtgacggtttgtgttgtaagaaatgcaaatttcagccaatggggaccgtctgccgcgaagctgtgaacgattgcgatatccgagagacatgtagcgggaactcttctcagtgcgcccctaacatccacaagatggatggttactcctgcgacggagtacagggcatttgtttcggtggccgatgtaaaactagggatagacaatgcaaatacatctggggccagaaggtgacagcctcagacaagtactgttatgagaagctgaacatcgagggcaccgaaaaggggaactgcggcaaggataaagacacatggattcaatgtaataaaagggacgtcctctgtggatatctcctctgtaccaatatcgggaatattccccgcctgggagagctggacggcgaaataacaagcactctggtcgtgcagcagggacgcaccttaaactgttctggagggcacgtgaagctagaggaagatgttgatctggggtacgtggaggacggaaccccttgtggtccacagatgatgtgcttggaacatcgctgtctgccagttgcaagctttaacttcagcacatgtctttcctccaaagagggcactatctgtagcgggaatggcgtctgttccaacgagctgaaatgtgtgtgcaatcgacattggatcggcagcgattgcaacacatactttccacataatgacgacgccaaaacaggcattactctctccggcaatggagtggctggaacgaacattatcatcggcataatcgcaggaactattctggtcctcgccctcatcctcggcattaccgcttgggggtacaaaaactatagggaacagcgacagctcccccagggcgattatgtcaagaaacctggcgatggagattcattttactctgatattccgccaggagtctctaccaattcagcatccagcagcaagaaaaggtctaacggtctcagtcacagctggtctgaaaggatccccgacacaaaacatatttcggacatctgcgaaaatgggaggccaaggtcaaatagctggcaggggaatctcgggggtaataagaagaagatacggggcaagaggtttagaccgaggtcaaacagtacggaaaccctgtcacccgcgaagtcgccttcctctagcacaggaagcatcgcatcatcgcggaaatacccctacccgatgcctcccctgccagacgaagataagaaggtaaataggcagtccgccaggctttgggagacctcgatttag

SEQ ID NO: 107204 - DNA, 2700 bp, Artificial Sequence
  Description of Artificial Sequence: Synthetic coding sequence
atgcaggccgccgtcgcggtgtcggtccccttcctcctgctttgcgtgctcgggacctgtcctcctgccagatgcggacaagctggtgacgccagtttgatggaactcgagaaacgcaaggagaaccgcttcgtcgaacgccagtccatagtgcctttgaggctcatctatcgaagcgggggcgaagatgaatccaggcatgacgccctggacacccgggttagaggcgatctgggggggccgcagctgacacacgtggaccaggccagcttccaggttgatgctttcggcacctccttcattctggacgttgtcctgaatcacgatctgctatcaagcgagtacatcgagaggcatatcgagcacggcgggaagacagtggaggtgaaaggcggagaacattgttactatcaggggcacatccgcggcaacccagactcgttcgtggccctgtcgacttgtcatggcctgcatgggatgttctatgacggtaaccacacttaccttatcgagccagaggagaacgacaccacacaagaagatttccactttcactcagtctataagtcaaggcttttcgaattttccttggacgacctcccaagtgagttccaacaggtcaatattactccttccaagtttattctcaagccacgacccaaacgctcaaaacgtcagctgcgccgctacccccgcaatgtggaggaggaaactaaatatattgaacttatgattgtcaacgatcacttgatgttcaaaaaacacaggctcagtgtggtacatacgaacacctacgctaaaagcgtggttaatatggctgacctaatctataaagaccagctgaagactcgcatcgtcctcgtggcaatggaaacctgggcaactgacaataagtttgccatatcagaaaaccccctaatcaccttaagggagtttatgaaatatagacgtgacttcatcaaagaaaagtctgatgccgtgcacctgtttagcgggtcacagtttgagtcttcgcggagcggcgccgcatacattggcgggatttgtagcctgctcaaagggggaggggtgaatgagttcggcaagaccgacctgatggccgtgactctcgctcaaagcctcgcgcataacattggtatcattagcgataaacggaaactggcgagtggagagtgtaagtgcgaggacacatggtctggctgtatcatgggagataccggatactacctgccaaagaagttcacacaatgtaatatagaggagtaccacgattttctgaatagcggcggcggcgcttgcctgttcaataagcccagcaagctcctcgacccgcctgaatgtggtaatggcttcattgagaccggggaggagtgtgactgtgggactcctgcagagtgcgtgttggagggagctgagtgctgtaaaaagtgcactcttacacaggacagccagtgttcggacggactgtgttgcaagaagtgcaagttccagccgatgggcacggtgtgtcgggaagctgttaacgattgcgacattcgggaaacgtgcagcggaaattcttcacagtgcgctcctaatatccataagatggacgggtactcatgcgacggtgtgcaaggaatctgcttcggtggaaggtgcaagactagggaccggcagtgtaagtacatatgggggcaaaaggtcactgcatcagacaagtactgctacgaaaagctgaacattgaaggcaccgaaaaaggcaattgtgggaaagacaaggatacctggattcagtgtaacaagagagatgttctgtgtggttacctcctgtgcactaacatcgggaatatccccagactcggcgaactggatggagagatcacaagtacgctcgttgtacagcaggggcgtactctcaactgtagcggaggacacgtcaagttagaggaggacgtggacttgggctatgttgaagacggtaccccttgcggtccccagatgatgtgtttggaacaccgttgtctccccgtggctagcttcaatttcagtacttgtctgtcctcgaaagagggcaccatctgtagcggaaatggcgtctgctctaacgaactgaagtgcgtctgtaacagacattggatcggaagcgactgcaatacctatttccctcacaatgacgatgcgaaaactggcattactctgtctgggaacggtgttgccgggacaaatataataataggcataatcgccggcaccatcctggtgctcgccctaattctcggcatcacggcctggggctataacaatatcttcaattttcggtccaatgggctgtcccattcctggtccgagcgcatccctgacactaaacacatttcagacatttgtgagaatggccgccctaggagcaatagttggcagggcaaccttgggggtaataagaaaaagattaggggtaaacgttttaggccacgctctaatagcaccgagtatttgaatccatggtttaagagggactataacgtggcaaagtgggtagaagatgtgaacaagaatacagaaggtccatattttaggactctttctcctgcaaagtctcctagttccagcactggatctatcgctagcagccgcaagtacccctacccgatgccaccactccctgacgaagataagaaggtgaacaggcaatcagcgcggttatgggagacatctatttag

SEQ ID NO: 107205 - DNA, 2580 bp, Artificial Sequence
  Description of Artificial Sequence: Synthetic coding sequence
atgcaggctgccgtagcagttagtgtgccattcctgctgttgtgtgtgcttggcacatgcccacctgctaggtgcggacaggccggcgacgcctctctgatggaattggaaaaaagaaaagaaaacagattcgttgaaaggcagtctatagtgcccctgcggttgatctaccgtagcggaggcgaggacgagtcgcgtcacgacgcgctggataccagagtgcggggagatctggggggcccgcagctgactcacgtagaccaggcaagcttccaggttgatgcatttgggacgtcctttatcctggatgtggtgctgaaccacgacttgcttagctcggaatacattgagcgtcatatcgagcatggaggtaaaaccgtagaagtaaaaggtggcgagcactgctattatcagggacacattagagggaacccggactccttcgttgccctttcaacatgccacgggctgcacggaatgttttatgatgggaatcatacatacctgatcgagcccgaagaaaatgacaccacccaggaggatttccactttcactctgtctataagtctcgtctatttgaattctcccttgatgacttgcccagcgagtttcaacaagttaatattacaccaagtaaatttatcctaaaaccgaggcctaagcgatcgaaaagacaactgcggaggtacccccgcaatgtggaggaagagacgaaatatatcgagcttatgattgttaatgatcacttgatgtttaaaaagcaccgactatccgtggttcacacgaacacttatgcaaagtctgttgtgaacatggccgatttaatttataaagatcagctgaaaaccagaatcgtgctggttgccatggagacttgggctacggacaacaagttcgcaattagtgaaaacccactgattacactgcgcgagtttatgaagtacaggcgggatttcataaaagaaaagagtgatgctgtgcacctgttttccggatctcagtttgagtcatcccggtcaggggctgcctacattggcggaatctgctctctgcttaagggagggggcgtaaatgaattcggaaaaacagacctcatggctgtgacacttgcccagtctctggctcacaatattggaataatttcagacaaacgcaagctggcatccggagagtgtaagtgtgaggatacatggtcaggatgcatcatgggggacaccggatactacctgcctaaaaaatttactcagtgtaatatcgaagaataccatgatttcctgaacagcggggggggcgcttgcttgttcaataagccttctaaactacttgatccccccgagtgcggtaatggctttattgaaaccggtgaggaatgtgattgtggaacacccgccgagtgtgtactggagggagctgaatgctgcaagaaatgcacccttacacaggattctcagtgttccgacgggctgtgctgtaaaaagtgtaagtttcagcctatgggtactgtgtgtcgggaggcagttaacgactgtgatataagggaaacctgctcaggcaactcgagccagtgcgcacctaacattcataaaatggatgggtatagttgcgacggagtccagggcatatgtttcggaggcagatgcaagacacgggacagacagtgcaagtacatttggggtcagaaagtcaccgcgagcgataaatactgttatgaaaaactcaacatcgagggcaccgaaaaagggaactgtgggaaggataaggatacgtggatccagtgtaacaagagagacgtgttatgtggatacctgctgtgtactaatatcgggaacatcccccgactgggcgagctggatggcgaaatcacctcaactctcgtggtccagcagggacggactcttaactgttcaggagggcacgttaaacttgaagaggacgtcgatctgggttacgtcgaagatgggactccgtgtggacctcagatgatgtgccttgagcatcggtgtctgcccgttgcttcattcaacttctccacatgtctcagctctaaggaggggacgatctgctcaggcaatggtgtatgttctaatgagctgaagtgtgtgtgcaatcgtcattggataggcagcgactgtaatacatattttcctcataatgacgacgccaaaacaggtataactttatctggcaacggagtcgctggcactaacataatcataggtattatcgcaggtacaatacttgtccttgctttaattctgggcatcacagcctggggttacaaaaactaccgagaacagaggcaattaccccagggggactacgtgaagaagccgggggacggcgattctttctactcggacattcctcctggcgtgtccactaactccgccagctcttccaaaaagcgctccaacggactgtcccactcttggagcgagcgtatacccgatacaaaacatatctccgatatttgcgagaacggccgcccccggagtaatagttggcagggcaacctcgggggcaacaaaaaaaagattcgggggaaaaggtttaggccgcgatccaacagcacagaatag

SEQ ID NO: 107206 - DNA, 2613 bp, Artificial Sequence
  Description of Artificial Sequence: Synthetic coding sequence
atgcaggcggccgttgcggtgagtgtcccgtttctgctgttgtgtgtcctgggtacgtgcccccccgccaggtgtgggcaagctggtgacgccagccttatggagttagagaagaggaaggaaaataggtttgtcgagagacagagcattgttccactgcgccttatttatcggagcggaggagaggatgaatcaagacacgacgctctggatacccgggtcaggggagacctcggagggccccagctgacccacgtggaccaagcatccttccaggttgacgcattcgggaccagtttcattttagatgtggtattaaatcatgatctcctgtcatctgaatacattgagaggcatatagaacatggcggtaagaccgttgaagtcaagggcggcgaacattgctactaccagggccatattcgagggaaccccgattcctttgtggccctctctacatgtcacgggcttcatggaatgttttatgatgggaatcacacatacttgatcgagccagaggagaatgacaccacacaggaggattttcatttccattccgtatataagtctagactcttcgagttcagccttgatgacctcccaagtgagttccagcaagtcaatatcaccccaagtaagttcatcttgaagccacgcccaaagaggagtaagcgtcagctgcgtagatacccccgcaacgttgaggaagagactaaatacatcgagctgatgattgttaacgaccatctcatgttcaagaagcaccgactctctgtagtgcacacaaatacttatgctaagagcgtggttaatatggctgatctgatctacaaagaccaacttaaaacaagaattgtgctggtcgctatggagacttgggccacggacaacaaatttgcaatttccgagaacccactaattacccttagggagtttatgaagtaccgccgggacttcattaaagagaagtccgatgcagtgcatttgttctccggttctcaattcgaatcatcacgatcaggcgctgcctatatcggaggtatctgttcgctgctgaaaggcggaggagttaacgagttcggcaaaacggatctcatggcggtgactctggcccaatccttagcccacaatattggaattatcagcgacaaaagaaaactggcatctggggaatgcaagtgcgaggatacctggagcggctgtatcatgggcgatacaggatactatctccccaaaaagttcacgcaatgcaacatcgaggaataccacgactttctaaacagcggtggaggagcttgcctgtttaacaagccctcaaaactgttggacccacccgagtgcggcaatggctttatcgaaacgggggaagagtgtgactgcgggaccccagccgagtgtgttctggagggcgctgaatgctgcaaaaaatgcacccttacccaagattcccaatgtagtgacggcctgtgttgcaaaaaatgtaaatttcagcccatggggacagtgtgtagagaagcagtaaatgattgcgatattcgggagacctgcagtgggaattcttcccaatgcgcaccaaatattcataaaatggatggctattcctgcgacggcgtgcagggaatctgtttcggtggccgatgcaagacgagagatcggcagtgcaaatacatatggggccagaaggttactgcctccgataagtactgttatgagaagcttaacattgagggcaccgagaaaggaaattgcggaaaggacaaggatacgtggattcagtgcaacaaaagagacgttctctgtgggtatttgctgtgtaccaatattgggaatatcccacgcctcggggagctggatggagaaatcacaagtactcttgtcgtgcagcagggtcgcaccctgaactgtagtgggggtcatgtcaagctggaggaggacgttgacctgggctacgttgaggatggtactccctgtggtccccagatgatgtgtctggagcacaggtgccttcccgtggcaagttttaacttcagcacttgtctgagctcgaaggagggcaccatctgctcggggaacggcgtatgtagcaacgaactcaagtgcgtatgtaatagacactggataggttctgactgtaatacatatttcccccataatgatgacgcgaagactgggatcacgcttagcgggaacggcgtggctgggactaatatcatcatcggcatcattgccgggacaattctcgtgctggccctcatcctggggatcactgcatggggctacaagaactaccgagagcaacggagcaatggtctgtcccacagctggtccgagcgaatccccgacaccaagcacatctctgatatctgtgagaatgggcggcctcggtccaactcgtggcagggcaaccttggggggaacaagaaaaaaatcaggggaaaaaggtttagacccaggtctaactcaaccgagaccctgtcacccgccaagtctccaagctctagtaccggatccatcgcctcttctagaaagtacccttaccccatgccaccattgcccgacgaggacaagaaagtgaacagacagagtgctcgcctgtgggagaccagcatttag

SEQ ID NO: 107207 - DNA, 2700 bp, Artificial Sequence
  Description of Artificial Sequence: Synthetic coding sequence
atgcaagcggccgttgccgtgtcagtgccctttctgcttttgtgcgtcttggggacttgtccgcctgcccgatgcgggcaggcgggcgatgcatccctgatggaactcgagaagaggaaagaaaataggttcgtcgagaggcagtccatcgtgccccttcgactcatctaccgctctgggggcgaggacgagagtcgccacgacgccttagacacccgggttagaggggatctcggcgggccacagctcactcatgtggaccaggcttctttccaggttgacgcattcgggacttcatttatcctggacgtggtgctcaatcacgacttactctcgtctgaatatatagaacgccacatagaacacggagggaaaactgtggaagtgaagggcggggaacactgctactatcagggccacataagagggaaccctgacagtttcgtggcactcagtacgtgccacgggttgcacggcatgttttatgacggaaatcacacctaccttatcgaacctgaggagaacgataccacccaagaagattttcatttccattcggtctataagtcccgcctcttcgaattctcgctggatgacctgccctccgagtttcagcaggtgaatattacacccagtaaatttatactcaagccaagacccaaacggtctaaaaggcagttgcgtaggtatcctagaaacgttgaagaagaaacaaagtatattgaactgatgatcgtgaacgaccatttgatgtttaagaagcatcgcttaagtgtggtacacacaaacacatacgcgaagtcagttgtgaacatggctgacttgatctataaggatcagctcaagacgcgcatcgtcctggtcgcgatggaaacttgggcgaccgataataaattcgcaatatcggagaacccactaatcactctccgggagttcatgaaatatcgccgcgatttcataaaagaaaagtctgatgcggtgcacctcttctccggcagccagtttgaatcctccagatcaggcgccgcttatatcggcggtatctgttccctcctgaagggtggcggcgtgaatgagttcggaaaaaccgaccttatggccgtcactctggcccagtccctagcccacaacatcgggatcatatcagataagcgtaagcttgctagtggagaatgcaagtgtgaagatacatggtcagggtgcataatgggagacactggatattacttacctaaaaaattcacgcaatgcaacatcgaggaatatcatgatttcctgaattcagggggcggagcctgcttgtttaacaaaccgtccaagctgctcgacccgcccgagtgtggaaacggctttattgagacgggcgaagagtgtgattgtggaacaccggctgaatgtgtgctcgaaggagccgaatgttgcaagaagtgcacacttacacaggactcccaatgctccgatggtttatgttgcaagaagtgtaagttccagcctatggggaccgtgtgcagagaggcggtcaacgactgtgacattcgcgagacttgctccgggaattctagccaatgcgcacccaatatccataaaatggatggatactcttgcgacggcgtgcaaggtatatgttttgggggacgctgcaagaccagagatcgccagtgtaagtacatttggggccaaaaagttaccgcctctgacaaatattgttatgagaaattgaacatagagggcactgagaaggggaactgtggcaaggataaagacacttggattcagtgcaataagagagatgtcttgtgtggctacctgctctgtaccaacatcggcaacatcccaaggctcggagagcttgacggggagatcacaagcacactcgttgtgcagcaaggtagaacactgaactgctctggcggccatgtgaaactcgaagaagacgtggacctgggttacgtagaggacggaacgccatgcggcccccagatgatgtgtctggaacaccgctgtctgcccgtggctagcttcaacttttcaacgtgtctgtcttccaaggagggcaccatctgttctggaaacggagtttgcagcaatgagctcaagtgtgtatgcaacagacattggatcggctcagactgtaacacctattttccgcacaatgatgacgcaaaaaccggcattacactgtcaggtaacggtgtggcaggaactaatattatcattgggataatagctggaaccattctggtcctggccctcatcttaggtatcactgcatgggggtacaaaaattatagagagcagcgcagcaacgggctgagccatagctggtctgagcggattccagacacaaagcatatctcagatatatgcgaaaacgggcgtccccgtagcaactcttggcaagggaatctgggaggtaacaaaaagaagattcggggaaaaaggtttcgcccgagatccaattctacggaatatctgaatccctggtttaagcgggattataacgtggctaaatgggtcgaggacgttaataaaaatacggaaggcccctatttccgaaccctgtcaccagctaaatctccttcctcgtcaacagggtctatcgcaagctctaggaaatacccctaccccatgccgcccctgcccgacgaggacaagaaagtaaatagacagtctgcacgtctctgggagacatccatttag

SEQ ID NO: 107208 - DNA, 2328 bp, Artificial Sequence
  Description of Artificial Sequence: Synthetic coding sequence
atgcttcaaggattgctgccggtgagcttactgctttccgtggcagtgtctgcaatcaaggaactcccaggagtcaagaagtatgaggtcgtgtacccaatcagactgcaccctctacacaagcgtgaggctaaagaacccgaacaacaagaacagttcgagaccgagctgaaatataagatgactataaacgggaagattgcggttctgtacttaaaaaaaaacaaaaatctgctagcccccggttatacagagacttattacaactctacgggaaaggaaattacgaccagcccgcagattatggatgattgttactaccagggacatatcctgaacgagaaagttagcgacgcatctatcagcacgtgcaggggcctgcgtggctattttagccaaggggatcaacgatactttatcgaaccattgagccccattcaccgggatggccaggaacatgccctattcaagtacaacccagacgagaaaaactatgactccacatgcggtatggacggggtcctgtgggcccatgatcttcagcaaaatatagccctgcccgcaactaaattggtaaaactgaaagacaggaaggtgcaagagcacgagaaatatatcgagtactacttagtcctcgacaacggagaattcaagcgatacaacgagaaccaggacgaaattcggaagcgagtcttcgaaatggcaaattatgtcaacatgctgtataaaaaactgaatacccatgtcgccctcgtgggcatggagatctggaccgacaaggacaaaatcaaaatcaccccaaatgctagttttacactcgaaaacttttctaagtggcgcggttccgtgctgtcgcggcggaagagacatgatatcgcgcagctgataacagctacagaacttgctgggactactgtcggactggcctttatgagcaccatgtgctccccctacagcgtgggagtagtgcaggaccattctgataacttactgcgcgtcgccggaactatggcccatgagatgggacacaattttgggatgtttcatgacgactatagttgcaaatgccccagtaccatctgcgtgatggataaagccttaagtttctatatcccaaccgatttttccagttgcagccggctatcttatgataaatttttcgaggataagttgagcaactgtctgtttaacgctcctcttcccactgacatcatttccacaccaatctgcggaaatcagctcgtggagatgggtgaagattgcgactgcggcacgtccgaagaatgcactaatatctgctgcgatgccaagacttgcaaaataaaagccacatttcaatgtgccttgggggagtgctgcgaaaaatgtcagttcaagaaagcaggcatggtatgccgcccagctaaggatgaatgtgaccttcctgagatgtgtaacgggaaatcgggtaattgcccagatgacaggtttcaggtgaacggcttcccatgtcatcatggcaagggacattgtctgatgggcacctgtcctaccctgcaagaacagtgcaccgagctctgggggcccggaactgaggtggccgacaagagttgttacaaccgcaacgagggcggcagcaagtatgggtattgccggagagttgacgacacgctcatcccctgtaaagcaaacgatactatgtgcgggaaactgttttgccagggtggatcagacaatctaccttggaaaggtaggatagtgacatttctcacatgcaagaccttcgaccctgaagacaccagccaggagatcggcatggtagcaaacggcacaaagtgcggggacaataaggtttgtatcaatgccgagtgtgtggacatcgaaaaggcctataagtccactaactgcagcagcaagtgcaaaggccacgccgtctgtgatcatgagttgcagtgtcaatgtgaagagggctggatacccccagactgtgatgattcatcagtcgtgtttcatttctcgatcgtggtcggggttttattcccgatggctgtgatcttcgtcgtcgtggcaatggttatccgtcatcagtcttctcgggagaaacagaagaaggaccagcgtccgttaagtacaaccggcactcgacctcataaacaaaaaaggaagccccagatggtgaaggccgtccaaccacaggagatgtctcagatgaagccccacgtgtatgacctccccgtggaggggaacgagcctcctgcaagctttcacaaggacacaaatgccttaccgcctactgtgttcaaggacaaccctgtcagtacaccaaaagatagcaaccctaaggcatag

SEQ ID NO: 107209 - DNA, 1452 bp, Artificial Sequence
  Description of Artificial Sequence: Synthetic coding sequence
atggagatctggaccgacaaagataagataaagatcacgcctaatgctagcttcacactggagaatttctctaagtggaggggcagtgtgctttctagacgcaagcgtcatgatattgctcagctgatcaccgccaccgagctcgctggtacgaccgtgggtctggcctttatgtcaactatgtgtagtccgtactctgtgggagtagtgcaggatcattctgacaatctcttacgggtcgcgggaaccatggcacacgaaatgggacacaacttcggcatgtttcacgatgattattcttgcaagtgtccctctacaatctgtgtgatggataaagctttgtctttctatatccccaccgacttttcttcatgctctcggctgtcatatgacaagttttttgaagataagttatccaactgtctgttcaacgctcctcttcccacagatatcatttccacccctatctgcggaaatcagctggttgaaatgggggaggattgtgattgcgggactagcgaggagtgtaccaatatatgttgtgatgctaaaacctgcaaaattaaagccaccttccagtgcgcactgggcgagtgctgcgaaaagtgccaattcaaaaaagccggaatggtgtgtaggcccgcgaaggacgagtgtgatctcccagagatgtgtaacggtaaatcgggcaattgccccgacgatcgctttcaggtgaatggttttccttgtcaccatggcaaggggcactgcctcatgggtacatgtcctacactccaagaacagtgcacagagctttggggtcctggcactgaagttgctgacaaatcttgttacaaccgcaatgaggggggctcaaagtacggctattgccgccgcgtcgatgataccttgattccatgcaaagccaacgacaccatgtgtggcaagctattttgccagggcggaagcgataacctgccctggaaaggaagaatagtgaccttcctgacttgtaagacattcgaccccgaggacactagccaagagattggcatggtcgcaaacggtaccaagtgcggggacaataaggtctgcatcaacgccgaatgcgttgatatcgaaaaggcctataagtccactaactgcagcagtaaatgtaaaggtcacgcagtctgtgaccacgaactccagtgtcagtgtgaggaaggttggatccctcccgattgcgatgactctagcgtcgtatttagacgcttacttcattgcggctggggagccgtccctaatggaggccatttttgcggcgggtgctacgggaatccagcccctgagttacagaggaaagctgaagagcgtagcgaagctaccatctaccattggcatcaggcaactcagacagaggaagagaccccggacgggaagggctgttctacacctcgggacgagtcggatgaggccccctgcgtgtag

SEQ ID NO: 107210 - DNA, 1623 bp, Artificial Sequence
  Description of Artificial Sequence: Synthetic coding sequence
atgctccagggtctgctgccggtgtccctgctgctgagtgtggccgtgagtgccatcaaagaattgccaggtgttaagaagtatgaggttgtttatcccatccggctccacccactccacaagcgggaggccaaggagcccgaacagcaggaacaatttgagaccgagttaaaatacaaaatgaccataaacggtaagattgctgtgctgtatctgaagaaaaataaaaacctattagctcctggctacaccgagacttactacaacagtaccggcaaagagattacgacgtctccgcagatcatggatgattgttactatcaaggtcacattttgaacgagaaagtttctgacgcgagcatctccacctgccgtgggctgcgcggctatttcagccagggtgatcagcggtattttatagagccacttagcccaattcatagagatggacaggagcatgcccttttcaagtataaccccgacgagaagaattatgatagcacatgtggcatggatggagtcctttgggcacacgatctgcagcagaatattgccctccctgccactaagctcgttaaactcaaagaccggaaagtccaggaacatgagaaatatattgagtattatctggtgcttgacaacggcgagttcaagcggtacaatgaaaaccaggatgagatccggaaacgcgtgttcgaaatggcaaattacgtgaacatgttatataaaaaactcaacacgcacgttgcccttgttggaatggagatctggaccgacaaagacaagatcaaaataacccctaacgcgtcctttacactggagaactttagtaagtggcggggatcagttttaagtcgtcggaaacgacatgacatcgctcagctaataacagctacggagctggctgggacaactgttggccttgctttcatgtccacaatgtgcagtccgtatagcgtgggggtggtccaagaccactccgataacctgctacgtgtggcaggcacgatggcccacgagatggggcacaattttgggatgttccatgatgactacagctgcaagtgtccctcaaccatctgtgtgatggacaaagcgctcagtttctacatcccaaccgatttcagcagctgcagccgtttgtcctacgacaaattttttgaggacaagctgagcaactgcctgttcaacgctcccctgcctacagacatcatctcaacacccatttgtgggaatcagctggtggaaatgggtgaggactgtgactgcggtactagtgaagagtgcacgaacatatgctgcgatgccaaaacttgtaaaatcaaggccacctttcaatgcgctctcggagagtgttgcgagaaatgtcagttcaagaaggccggtatggtttgccgcccagccaaagacgaatgtgacttacctgaaatgtgtaatgggaaatccggaaactgccccgatgataggttccaggttaatggctttccctgccaccatggcaaagggcactgccttatggggacctgcccaactctacaggaacagtgcaccgagttgtgggggcccggacgtagaacaaatccctttccatgcgcatgcgccaaggaaaaccatttcaggtag

SEQ ID NO: 107211 - DNA, 924 bp, Artificial Sequence
  Description of Artificial Sequence: Synthetic coding sequence
atggccaactatgtaaatatgctctacaagaaactgaacacccacgtggctttggtggggatggagatttggacagacaaggataaaattaagatcactcctaatgcttcctttactcttgaaaacttttccaagtggcgggggtccgtcctgtcacggcgtaagcgccacgacattgcacagcttattaccgccacagaactggcagggacaaccgtagggctggctttcatgtccactatgtgttctccctactccgtgggagtcgtccaagaccactcagataacctgttgagggtcgcaggcactatggcccacgagatgggacacaatttcgggatgtttcacgacgattattcctgcaagtgcccgtctacaatttgcgtaatggacaaagcactctccttctatatcccaacagatttcagctcttgctctcgactgtcctatgacaaattttttgaggacaagttgagtaattgcctcttcaacgcgcctctgcccactgatatcatttctaccccaatttgtggaaatcagctcgtggaaatgggagaggactgcgactgcgggacctccgaagagtgtaccaacatctgttgtgacgccaaaacctgtaagatcaaggctaccttccagtgtgccctgggtgagtgctgcgagaagtgccaattcaaaaaagctggcatggtgtgtcggcccgcgaaggacgagtgcgacctccctgagatgtgcaatgggaagtccggcaattgtcccgatgatagatttcaggtaaacggctttccttgccatcacggcaaggggcactgtcttatgggtacatgcccaacactccaggaacagtgtactgagttatgggggcctggtcggcggactaatccgtttccatgcgcctgtgctaaggagaatcattttcgatag

SEQ ID NO: 107212 - DNA, 2463 bp, Artificial Sequence
  Description of Artificial Sequence: Synthetic coding sequence
atgaagatgctgttgctgctgcactgtctaggcgtctttctgtcttgtagtgggcatatacaggacgagcatcctcagtatcattcacctcctgatgtagtgattccagtgcgcataacaggcaccacccggggaatgaccccccccgggtggctgtcctatatacttcctttcggcgggcagaagcatatcatacatattaaggtgaagaagctgctcttttccaaacatcttcctgttttcacatacaccgatcagggtgccattctggaggaccagcctttcgttcagaacaattgctattaccacgggtacgtcgagggagaccctgagtcgcttgtctctctctccacttgctttggcggcttccagggcatcctccagataaatgactttgcgtacgaaatcaagccactggccttctccaccaccttcgagcacctcgtttacaagatggacagtgaagagaaacagttttctacaatgaggtctggcttcatgcagaatgaaatcacttgtcggatggaattcgaagagatcgacaacagcacccagaaacagtctagctacgttggctggtggattcactttaggatcgtggagattgttgtggtcattgataactacctttacataagatacgagcgaaacgattccaagttgttagaagatttatatgtgatcgttaatatcgtagacagcatactggatgtgatcggcgttaaggttctgctctttggtctggaaatatggacaaataagaacctaatcgtggtcgacgatgtgagaaagagtgttcacctctattgcaagtggaagtcagagaacatcacccctagaatgcagcacgacacatcccatctgttcacgaccctggggcttagagggctctccggtatcggggcttttcgtggaatgtgtaccccacacaggtcgtgcgcaatagtaactttcatgaataagacactcgggacattcagcattgccgtcgctcatcatctggggcacaatctcgggatgaaccatgacgaggacacatgccggtgttcccagccccgttgcatcatgcacgagggaaatccaccaattactaagttttcaaactgctcctacggggatttctgggagtacactgttgaaaggactaagtgcctcttggaaaccgttcataccaaagatatcttcaacgtgaagcgctgtgggaatggtgttgtggaggaaggagaggagtgtgattgtgggccactaaaacattgtgccaaagatccgtgctgcctgagcaactgcaccttgactgacgggagtacatgtgcgtttggcctttgctgtaaagactgtaaattccttccatcaggtaaggtctgcaggaaggaggtcaatgaatgcgacctccccgagtggtgtaatggtacttcccacaagtgccctgacgacttttacgtggaggacggcattccctgtaaggagaggggttactgttatgaaaagagctgtcacgatcgaaatgagcagtgccgccggatattcggcgctggggccaacaccgcctccgagacttgctacaaagagttgaatactctgggggaccgagtaggccattgcggcattaagaacgctacttacatcaagtgcaacatttcagacgtccagtgtggacgtatccaatgcgaaaacgtaacagagatccctaacatgtcagatcataccaccgtccattgggcgcggttcaacgatataatgtgttggtcgacagactaccatctgggcatgaaggggcccgatataggagaggtcaaagatgggaccgaatgcggtattgaccatatctgcattcaccgccattgtgttcacataaccatcctgaacagcaactgctcccctgcattttgcaataagaggggaatctgtaacaataagcatcactgccactgcaactatctgtgggacccacctaactgccttattaaggggtacgggggatctgtagactccgggccacctcccaagaggaaaaagaagaagaagttctgctacctatgcatcctacttctgattgtcttatttattctgttgtgctgtctttaccggctgtgcaagaagtcaaagcccataaaaaagcagcaggacgtacaaaccccatcagcaaaagaggaggagaagatccagcgtaggccccacgaactgccaccccagtctcaaccctgggtgatgccaagccagagtcagccacctgtgactccttctcaatctcatcctcaggtgatgccctcacagagccagccccccgtgacaccctctcaaagccaaccccgcgtaatgccctcacagtcccagcccccggtcatgccttcccagagccacccccagttgaccccaagccagtctcagccgcctgtgacaccctctcagagacaaccacagttgatgccaagtcagagtcagcctccggttaccccttcctag

SEQ ID NO: 107213 - DNA, 2463 bp, Artificial Sequence
  Description of Artificial Sequence: Synthetic coding sequence
atgaagatgctactgttactacactgcctcggcgtgtttctgtcctgttctggtcatattcaggacgaacatccccaataccattctcctccagacgtggtgatcccagtccgtatcacaggcaccactaggggcatgacaccgccaggctggctttcttacatactgccatttggaggccaaaaacatatcatacacattaaggtgaaaaagttgttattcagtaaacatttacccgtgttcacctatacagaccagggcgctattttagaagaccagcccttcgtgcagaataattgctactatcacgggtacgtggaaggggaccccgagtcgctagtgagtttgtcaacatgttttggcggatttcaggggatactacaaatcaatgacttcgcctacgagattaagccactcgcattttctaccacatttgagcacctggtatataagatggacagcgaggagaaacagtttagcactatgagaagcggatttatgcagaatgagataacctgcaggatggaattcgaagagattgataattcaacccagaaacagagctcctacgtagggtggtggatccacttccggatcgtcgaaattgttgtcgtgatcgacaactatctgtatattcggtatgaacgaaacgactccaaactgttggaagatttgtacgtcattgttaacatcgtggactcaattttggacgtcattggtgtcaaggttttgttattcggactagagatctggacaaacaaaaacctgatcgtcgtcgacgatgtccggaaaagcgttcacttgtattgtaagtggaagtccgaaaatattacaccaagaatgcagcacgacacgtcgcatctgtttaccaccctggggctgcgaggactgagcggtattggggctttccgcgggatgtgtaccccccatcggagctgtgctatcgtcacgtttatgaataagaccctaggcacctttagtatcgcagtcgcccaccatcttggccataaccttggaatgaaccatgatgaagacacctgccggtgctctcagcccaggtgcattatgcatgaaggcaaccccccaatcaccaagtttagcaattgcagctacggcgatttctgggagtacaccgttgagcgcactaaatgcctgctggaaaccgtccatacaaaagacatctttaatgtgaaacgctgcggaaatggagtagtcgaggaaggcgaggaatgtgactgtggacccctgaagcactgcgctaaggacccctgttgccttagcaactgtacccttaccgacggatccacttgtgcattcggcctgtgttgcaaagattgcaagttcctgccctctggtaaggtgtgtagaaaagaggtaaatgaatgcgatttacctgagtggtgcaacggcacgtcgcataaatgtcccgatgacttctacgtggaggacgggatcccatgtaaggaaaggggatactgttatgaaaagtcatgtcacgacagaaatgagcagtgtcgcaggatctttggagctggtgctaatactgcatctgagacctgctacaaggagttgaacaccctaggggatcgcgtcggtcactgtggcatcaagaacgcgacatacatcaagtgcaacatatctgacgtgcagtgcggtcggatccaatgcgagaacgtgactgaaataccaaacatgagtgatcacaccacagtgcattgggcaagatttaatgatattatgtgttggtctaccgactaccacttaggtatgaagggaccagacattggtgaggttaaggatggaacagagtgcgggatcgatcatatctgcattcaccggcactgcgttcacatcacaattctcaatagtaattgcagcccagcattctgcaacaagagggggatttgcaacaacaagcaccactgccattgtaactatctgtgggacccccccaactgcctgattaaaggttacggaggcagcgtcgactcagggccgccgcccaagaggaaaaagaaaaagaagttctgttacctgtgtatactactgctgatcgttctattcatactcctgtgttgtctctataggttgtgtaaaaagtcaaagcctatcaagaagcaacaggatgtccagaccccttccgcaaaggaggaggaaaagatccagcgcagaccgcacgagttgccgcctcagagccagccttgggtcatgcccagccagtctcaacccccggtgacaccttctcagtctcatcctcaagtgatgccatctcaaagccagcccccagtcacacccagtcagtcccagcctcgagtgatgccatcccagtctcaaccgccggtgatgcccagccagtcacatccacagctgactcccagtcagtctcagccaccggtgactcccagtcagcggcagccccagttgatgccatctcaatctcagccccccgtcacaccgagctag

SEQ ID NO: 107214 - DNA, 2463 bp, Artificial Sequence
  Description of Artificial Sequence: Synthetic coding sequence
atgaagatgctgctcttactccattgcctcggagtctttttgtcatgctctggacacatccaggatgagcatccccagtaccacagtccgccagatgtcgtgattccagtgcggatcaccggcacgactagagggatgacgcctccaggttggctgtcttatatacttccttttggagggcaaaaacatattatacacataaaggtaaagaagctgctgttctccaaacatctgcccgttttcacttatactgaccagggagccatattggaagatcagccgtttgttcagaacaattgttactatcatggctatgtggaaggcgaccccgaatctctggtttctttgtctacatgctttgggggattccaaggcatcctgcagattaacgattttgcatatgaaattaagcctctggcattctccactacattcgaacacttagtctataagatggactccgaggagaaacaatttagcacaatgaggtcaggcttcatgcaaaacgagatcacttgtagaatggaattcgaagaaatcgacaacagcacccaaaaacagagctcctacgtagggtggtggatccactttcgaattgtggaaatcgtggttgtgatcgacaattacctgtacattcgatacgaacgaaatgacagcaagctacttgaggacctctacgtcattgtcaacatagtggacagcatcctcgatgtcatcggcgtgaaagtcctgctgttcggccttgagatctggacgaacaagaacttgatcgtggtggatgacgtgcggaagagcgtgcatctgtattgtaagtggaagtcagaaaacatcacaccaagaatgcaacatgatacctcacacctgttcaccactctgggattgcgggggctgtcaggtatcggagccttcagaggaatgtgtacaccacacaggtcatgtgccattgtgacctttatgaataaaactttgggcacattctccattgcagtggcgcatcatctgggccacaacctgggcatgaaccacgatgaagatacgtgccggtgcagccagcccaggtgcatcatgcacgagggaaacccccctatcaccaagttttctaattgctcctacggcgatttttgggaatacaccgtggagaggaccaaatgcttgctggaaaccgtgcacaccaaagacatttttaacgttaaacgctgtggtaatggtgtcgtggaggagggcgaagaatgcgattgcgggcccttaaagcattgtgcaaaggacccctgctgcttatcaaactgtacactaaccgatgggagcacatgtgcgttcggtctttgttgcaaagactgcaagtttctcccttccggaaaagtctgtagaaaggaggtgaatgagtgtgatctgcctgaatggtgtaacggaactagccacaagtgtcccgatgatttctatgtggaagacggcattccatgcaaggagcggggctactgctatgaaaaatcatgccacgatagaaacgagcagtgtaggagaatattcggtgcaggggcaaacacagcatctgagacatgttacaaagaacttaacacgttgggcgaccgggtgggtcactgcggaatcaaaaacgctacttatattaaatgcaatatttcggacgttcaatgtggccggatccaatgtgaaaacgtgactgaaattccaaatatgagtgaccacaccacagtccactgggctcgctttaatgacattatgtgctggtcaacagattaccacctgggaatgaagggccccgatattggagaggtgaaggatgggactgagtgcggaatcgaccacatctgcatacaccgccactgcgtacacatcacaatccttaattctaactgctccccagcattttgcaataaacggggtatttgcaataacaaacaccattgtcactgcaactacctctgggatcctccgaactgcctcatcaaaggatacggcggctctgtggacagtggccccccccctaaacgaaagaagaaaaagaagttttgttacctgtgtatactgctcttgatcgtccttttcattctcttgtgttgcctctatagactctgtaagaaatccaagccaattaagaaacagcaggacgtgcagaccccgagcgctaaagaagaagagaaaatccagcgtcgtccgcatgagctgcccccccagtcacagccgtgggtcatgccctcacagtcccaaccacctgtgaccccctctcaaagtcatcctcaggtaatgccgagccagagccagccccccgtgactccatcccagtctcaaccgagggtaatgccatcccagagtcagccacccgtgatgcccagccagagtcacccgcaactaacccccagtcagtctcaacccccagtaacccccagtcaacgccaaccccagctaatgccttcacagtcacagcccccagtgactccttcctag

SEQ ID NO: 107215 - DNA, 135 bp, Artificial Sequence
  Description of Artificial Sequence: Synthetic coding sequence
atgaagatgttgttgttgctgcattgtctgggcgttttcctctcgtgctcgggacacattcaggacgagcatccccagtaccacagcccgcctgatgtggttatacccgtccgaatcaccgggacaaccagatag

SEQ ID NO: 107216 - DNA, 273 bp, Artificial Sequence
  Description of Artificial Sequence: Synthetic coding sequence
atgaaaatgcttctattgctgcactgccttggcgttttcttgtcttgttccggtcacattcaggatgaacatccacagtaccattccccacctgatgtggtcattcccgtgaggattaccggcacaactcgcggaatgaccccccctggatggctaagctacatcctgccgttcgggggccaaaaacacataattcacataaaggttaaaaaactattattcagcaaacacctgcccgtgtttacttataccgaccagggggcaatcctatag

SEQ ID NO: 107217 - DNA, 45 bp, Artificial Sequence
  Description of Artificial Sequence: Synthetic coding sequence
atgaaaatgctgctccttctccactgtctgggtgtctttctctag

SEQ ID NO: 107218 - DNA, 2463 bp, Artificial Sequence
  Description of Artificial Sequence: Synthetic coding sequence
atgaaaatgctgctgttgctccattgtttgggagtattcttgtcttgcagcgggcatatccaggacgaacacccgcagtaccactctccgcctgatgtcgtgattcctgtgcgaataacagggacaacccggggaatgacaccccccggttggctctcatatattctgccctttggaggacagaagcacatcatccacatcaaggtgaagaaactgctcttttctaaacacctgcctgtgtttacatacacagatcagggcgcaatactcgaggaccagccctttgtgcaaaataactgctattatcacgggtacgtggaaggggatcccgaaagcctggtttctctgagcacatgctttggaggcttccaagggattctgcaaatcaatgactttgcttatgaaatcaagcccctggctttcagcaccacattcgagcatctagtatacaaaatggattccgaagagaagcagttcagcaccatgcggtcaggttttatgcagaatgaaatcacatgtcggatggagttcgaagagatcgataattctacccagaagcagtcctcttatgtgggatggtggattcatttccggatagtagaaatagtcgtggttatagataattatttgtatataaggtacgaaaggaacgatagcaagcttctggaggatttgtacgtcattgttaatatcgttgattcgattctggatgtgatcggtgtgaaggttctccttttcggactggagatctggactaataaaaatctaattgtggtggacgacgtgaggaagagcgtgcatctgtactgtaaatggaaaagcgaaaatattacacccaggatgcagcatgatacaagtcacctttttacaacactgggtctgaggggcttgtcaggcatcggtgcttttaggggaatgtgtacaccacataggagctgcgctatagtaacttttatgaacaaaactctggggacattttccattgccgtggctcaccatcttggtcacaatctcgggatgaatcacgacgaggatacatgtcgatgtagtcagcctagatgtatcatgcatgaaggaaatccccctattacgaagtttagtaactgttcttatggggatttctgggaatacaccgttgagagaactaaatgcctccttgagacagtgcacactaaggacattttcaacgtgaagaggtgtggaaatggggtggtggaagaaggagaggagtgcgattgcggccctctgaagcattgcgcaaaagacccgtgttgcctgtcgaactgcaccctcacagacggtagcacttgcgcctttggcctttgttgtaaagattgcaaatttctcccctccggcaaggtctgtagaaaggaagttaacgaatgcgatctcccagaatggtgtaacggaacctcccacaagtgccctgacgatttttacgtcgaggatggaatcccctgcaaagagcgcggttactgttacgaaaaatcatgccacgaccgaaatgagcagtgccgccgcatcttcggtgcgggcgccaatactgccagtgagacctgctacaaagaactgaataccttgggggatagagtgggtcattgcggcatcaaaaatgccacctacataaaatgcaatatttctgacgttcagtgtggccgcatccagtgcgagaacgtcacggaaatcccgaacatgagtgaccacacaaccgtgcactgggcccgctttaatgacatcatgtgctggtccacagactatcacttgggtatgaaaggaccagacataggtgaagtgaaagacggcaccgaatgtggcatagaccacatatgcatccatcgccattgcgtgcacatcacaattcttaactcaaactgcagtcctgccttctgcaacaagaggggaatctgcaacaacaagcatcattgccactgcaactatctgtgggacccacctaattgtctgatcaagggctatggaggaagtgtagactccggacctccaccaaagcgcaagaagaaaaagaaattttgctatctgtgcattctgcttctcatagtcctgtttatccttctgtgctgcttgtacagactgtgtaaaaagtcaaagccgatcaagaaacagcaagatgtgcagaccccaagtgcaaaggaggaagaaaagatacaacgcagaccacatgaactccccccacagtcccagccatgggtcatgccttcccaatcccagccgccagtcacaccgagtcagagccatccacaggttatgcccagccagtcccagccaccagttaccccctcccagtctcaacctagagtgatgcctagccagtctcagccccccgttatgcccagtcagagtcatcctcaacttacaccttcgcagagtcaaccccccgtcactcccagtcagaggcaaccgcagttgatgccgagtcagtcacaaccaccagtcacccccagttag

SEQ ID NO: 107219 - DNA, 2373 bp, Artificial Sequence
  Description of Artificial Sequence: Synthetic coding sequence
atgcgttcagtccagattttcctcagtcagtgtaggcttctcctgctcttggtgcctacaatgcttctgaaatccctgggagaggacgtgattttccatccagagggggaattcgacagctatgaggtcactatccccgaaaagctctcttttcgcggcgaagttcaaggagtggtgtcccctgtgagctatttgctgcagctaaaaggcaagaaacacgtgcttcatctatggcctaagcgactcctcttgccaagacatctgcgggtattctctttcaccgaacatggagagctccttgaagatcatccgtatattcccaaggactgcaattacatggggtccgttaaggagtcccttgattctaaagccaccatctccacttgcatggggggcctgcgcggagtcttcaacattgacgcgaagcactaccagattgaaccgctcaaggctagtccgtctttcgagcatgtcgtttaccttttgaaaaaagagcagtttggaaatcaggtgtgcggactaagcgatgacgagatcgagtggcagatggctccatacgaaaacaaggctagactgagagatttccctgggtcttacaagcacccgaagtatcttgaactcatcttgttgttcgaccagagtagatacaggttcgtcaataacaatctaagccaagtaatccacgacgctatccttctcaccggcatcatggacacctattttcaggacgttcgaatgagaatccacctgaaagctttagaagtgtggaccgatttcaataagatcagggtggggtatcctgaattggcagaggtgttaggtcgtttcgtcatttacaagaaaagcgtcctgaacgcccgactgagctctgattgggcccacttatacctccagagaaaatataacgacgccttggcttggtcattcggaaaggtttgttcactcgagtacgcggggtctgtgtccacactcctggatactaacattctggctccagcgacctggtctgcccacgaactgggccacgcagtggggatgagtcatgacgaacagtactgccagtgccgaggacggttgaattgcataatggggtctggcaggaccggattctctaactgttcatacatttctttttttaagcacatatcatcgggcgctacatgtctgaataacatacccggcctcgggtacgtcctgaaaagatgtggtaacaaaatcgtcgaggataacgaagagtgtgactgcggcagcacagaggagtgtcagaaagacagatgttgccagagcaattgtaagttgcaacctggcgctaactgtagtattggcctgtgctgccacgattgtcgcttccggccaagcggttatgtatgcagacaggagggaaacgagtgcgatttggccgagtactgtgatgggaactccagcagctgtcctaacgacgtatataagcaggatggaaccccatgtaagtacgagggcagatgcttccggaaagggtgccgcagccggtacatgcagtgccaaagtatctttggccctgacgctatggaagctccaagtgaatgctatgacgctgtcaatctaataggcgaccaattcgggaattgtgaaataactggaatcagaaatttcaagaaatgcgaaagtgccaactccatttgtgggaggttgcaatgcatcaatgtggagactatcccagatctccccgaacacactacaataatttcaacccatttgcaggcagaaaacctcatgtgctggggaactggctaccacctgagcatgaagccgatggggatcccagacctggggatgatcaatgatggcacaagttgtggcgagggaagagtatgttttaagaaaaattgtgtgaactcttcagtgctgcagttcgactgtctacctgaaaaatgcaacacgcgaggcgtttgtaataaccgcaagaactgccactgtatgtacggctgggctcctccattctgcgaagaggtcggctatggagggtctatcgatagcggaccacctggactgctacgcggcgccatcccatcaagcatttgggttgtgtctatcatcatgttccgcctgatcctcctcattctcagcgttgtcttcgtcttcttccggcaagtcatcgggaatcacctgaagcctaaacaggaaaaaatgcccctctcaaaggctaagactgaacaggaagagtctaaaactaaaacggtgcaggaggagagcaaaactaagacgggccaggaagaatccgaagctaaaactggccaggaggaatctaaagctaaaaccggtcaggaagaaagtaaagcgaatatagaaagcaagcgccccaaagctaagagcgtcaagaaacagaagaagtag

SEQ ID NO: 107220 - DNA, 2346 bp, Artificial Sequence
  Description of Artificial Sequence: Synthetic coding sequence
atgcgatccgtgcagatcttcttgtctcagtgcaggcttctcttactgctcgtgcctaccatgctgctgaagtcactgggtgaggatgtcatctttcatcccgaaggtgagttcgattcttacgaggtgacaataccagagaagctgtcttttaggggggaggttcagggagtggtaagccccgtatcatatctactgcagctgaagggcaaaaaacatgtgctgcatctctggccgaagcgtcttctgttgcctcgccacctcagggttttcagctttaccgaacacggggaattgttagaggatcatccgtacattcctaaagactgtaattacatgggaagcgtcaaagaaagcctcgacagtaaagccactattagcacctgtatgggaggtctgcgaggcgtgtttaatattgacgccaaacattaccagatcgaaccactgaaggcttctccttcattcgaacacgtggtgtacctgctaaaaaaagagcagttcggcaaccaggtctgcggcttgtccgacgacgagattgagtggcagatggccccttatgagaacaaagccaggctcagggattttcctggttcatacaagcatccgaaatacctggagctgattttgctatttgatcagagtagataccgtttcgtgaacaacaatttgtctcaggtcatacatgacgcgatcctgctgactggaatcatggacacatacttccaggatgtccggatgcggattcaccttaaggccctggaagtatggactgatttcaataagatccgagtgggctacccggagctggcagaggttctaggcagattcgtgatttataaaaagagcgtgctcaatgctaggctctcctctgactgggctcacctgtatctgcagaggaaatataatgatgctttggcctggagctttggcaaggtttgctccctggaatacgcaggatctgtgagcaccctgctggacacaaacatcttagcgcccgccacttggtctgcccacgaattgggccacgccgttggaatgtcgcatgacgagcagtactgtcagtgcagaggaagacttaattgtattatgggttccggacgtaccgggttctctaactgctcctacatttccttctttaagcacatcagctctggagccacttgcttaaataatatccccggacttggatacgtcctcaagcgctgtggcaacaagattgtggaggacaatgaagagtgtgattgtggtagtacagaggaatgccagaaagaccggtgttgccagtccaattgtaagctccagcccggcgcaaactgtagcatcggtctctgttgccacgactgcagatttcgtccatctggatatgtgtgtcgccaggaagggaacgagtgtgaccttgctgagtactgtgacggtaacagttccagttgtccgaacgacgtctacaagcaggacggcaccccatgtaaatacgagggccgctgcttccgaaaaggatgtagatcaaggtacatgcagtgtcagagcattttcggccctgatgccatggaggccccgtctgagtgctacgatgccgttaatcttatcggtgaccagtttgggaactgcgagattaccggtattcgtaatttcaagaaatgcgaatctgccaactcgatctgtggacgcctgcagtgcattaacgtcgaaactattcccgatttaccagaacatacaaccattatatctacccacttacaagcggagaacttgatgtgctggggaactggatatcatttgtccatgaaacccatgggtattccagatctaggtatgatcaacgacggaacatcatgtggcgaaggccgagtctgctttaagaagaactgcgtcaattcatccgtcctccagtttgattgcctccctgaaaagtgcaatacgaggggggtgtgcaacaatcgaaagaactgccactgtatgtacggctgggccccgcccttttgtgaggaggtgggttatggtgggtctatcgattcagggccccctggactgctgcgtggggccattccatccagcatctgggtcgtgtcaattattatgtttcgactgattctgctgatcttgtctgtcgtgtttgtatttttccgccaagtgatagggaaccatctgaagccaaagcaggagaaaatgcctctgtccaaggcgaagacggaacaagaggagagtaagacgaagactgtgcaagaagaatccaagactaaaactgggcaggaggagtccgaggcaaagacgggccaggaggaatccaaggccaatattgagtcgaaaaggcccaaagctaagagcgtaaagaagcaaaaaaagtag

SEQ ID NO: 107221 - DNA, 540 bp, Artificial Sequence
  Description of Artificial Sequence: Synthetic coding sequence
atgggttggcgcccaagaagagccagaggcactcccctgctcctcctactgctgctgctactcctgtggccagtgcccggcgccggggtccttcagggccacattcctgggcagcccgtcaccccccattgggtactcgacgggcaaccgtggcgcacagttagcttagaggaaccggtcagcaagcctgatatgggcctggtcgcattggaggcagaaggccaggagctgttactggagctcgaaaagaaccagctcttggcccctggctatatcgaaacccactacggccccgacggccagcctgtcgtcctggcacctaaccacaccgtacgttgcttccacgggttgtgggacgcaccccctgaagggcgccgcgaggcaaggcgcacacggaaatacttggagctgtacattgtggcagaccacacgctgttccttacgaggcaccgaaacctgaatcatacgaagcaacgtctgctcgaggtagcaaactatgtggaccaggtcgttaacagcgcaggagatgctcacggttag

SEQ ID NO: 107222 - DNA, 336 bp, Artificial Sequence
  Description of Artificial Sequence: Synthetic coding sequence
atggggtggcggcctagacgtgcacgcggcactccactgcttcttcttctgctgctcctattactgtggcctgtccccggagccggcgtgctccagggccatatacctggccagcctgtgacaccccactgggtgctggacgggcagccgtggagaactgtcagtcttgaagagcccgttagcaaacctgatatggggttggtcgccttggaagctgaaggccaggagcttttactagagcttgaaaagaaccagttactcgccccagggtacatcgaaacccactatgggcccgcacaggaatgtagagacctgtgctgcttcgcgcataactag

SEQ ID NO: 107223 - DNA, 2364 bp, Artificial Sequence
  Description of Artificial Sequence: Synthetic coding sequence
atgggatggcgcccacgtcgggcacggggcacaccattactgctcctgctcctgctcctgctcctatggccagtgcccggcgctggggtgttgcagggtcatattccaggtcagccagtcactccccactgggttctggatggacagccttggcgtactgtatctctcgaagagcccgtcagtaaaccagatatgggcctggtagccctggaggcagaaggtcaggagctgctgcttgaactagagaaaaatcacagattactcgcacccggctatattgaaacccactacggtccagatggccaacccgttgtgctggcacccaaccacacagaccactgccactaccagggacgcgtaaggggctttcccgatagttgggtagtgctttgcacttgcagcggaatgagcggccttataaccctgagtcggaatgccagctactatttacggccatggccacctcgggggtccaaggattttagtacacacgaaatcttcagaatggagcagctcctgacgtggaaaggaacctgcgggcatcgagaccccggcaacaaagcgggcatgacttcacttcctggaggacctcaaagtcgcgggagacgtgaagcccgtagaaccagaaaatacctcgagctttatatcgtcgctgaccataccctcttcctgacccggcacaggaatctgaaccacactaagcagcggttgcttgaggttgcgaattatgtggatcagcttcttagaaccctagatattcaggtcgccctcaccgggctggaggtttggaccgagcgtgataggtcccgcgtcacacaggatgcaaatgcaacactctgggcatttttacagtggcgtcgcggcctgtgggctcagcgccctcacgacagcgcccagctgctaaccggccgagcctttcagggggcgacagttggactggcgcctgtggaagggatgtgcagggcggaaagcagtggcggcgtgtctacagatcactccgagctcccaattggagctgctgccacaatggctcatgagattgggcattcattagggctgagtcacgaccctgacgggtgctgtgttgaagccgcggccgaatcagggggatgcgtgatggcagctgctaccgggcaccccttccctcgtgtttttagcgcctgtagcagacggcagttgagagcgttctttcggaaaggcggtggggcatgcttatcaaacgcgcctgaccccggactacctgtgcctccggccctgtgcggaaatggttttgtggaagccggcgaagaatgcgactgtgggcccggccaggagtgccgggacctctgctgctttgcacataactgttccctgaggcccggcgcccagtgtgcccatggcgactgttgtgttcggtgccttcttaagcctgccggagcgctctgcaggcaggctatgggggactgcgacttgcctgagttttgcacaggaacaagctcacactgcccacccgatgtctacctgcttgatggctctccatgtgcgcgcggctcaggttattgttgggatggcgcctgccccaccttagagcaacaatgccagcagctgtgggggcctggctcacatcccgctcccgaagcatgttttcaggtggtgaactccgcaggagatgcccacgggaattgcggacaagactctgagggccactttctgccctgtgccggccgagacgcgctctgtgggaagctgcagtgtcagggagggaagccatccctgcttgcccctcacatggtgcccgtggattctaccgttcatctggacggccaggaagtgacttgtagaggcgctctggctctcccatctgctcaattagacttgctggggcttggcctggtggagcctggaacgcaatgtggcccgagaatggtgtgcaactcaaaccataactgtcactgcgccccgggctgggcccctcctttctgtgataagcccggattcggtggaagcatggattccggtcccgtacaggccgaaaaccacgataccttcctcttggccatgctactctctgtgctccttcccttactgcctggggccgggttagcttggtgctgctatcggcttcctggtgcacatttgcagaggtgtagttggggctgtcgacgggatcccgcttgttctgggccaaaagatgggcctcatagggatcacccactgggaggggtacacccaatggagttaggacctactgctaccggccagccatggccgcttgatccagagaactcccacgagccgtctagtcatccagaaaagccgctgccagcagtgtcccccgacccacaggccgaccaggtgcagatgccccggtcatgcctgtggtag

SEQ ID NO: 107224 - DNA, 2442 bp, Artificial Sequence
  Description of Artificial Sequence: Synthetic coding sequence
atgggatggaggcccaggcgcgccaggggtactccccttttactgttgctcctgctgctacttttgtggcccgttcctggagcaggggtcctgcaagggcatattcctggacagccagtaacaccccattgggtgctagatggccagccttggcgcacagtgtccctggaggagcccgtttcgaaaccagatatgggactggtggcgttagaggcggagggccaggagctgcttctggagttggaaaaaaatcacaggctgcttgctcctggttacatcgagacccattacggaccggacggccagcccgtggtccttgcacccaaccacaccgatcactgtcactaccagggacgcgtgcgcgggttccctgactcatgggtcgtcctgtgtacttgctcgggcatgtcagggctgatcacgttgagtagaaacgcctcatattacttgaggccatggcccccccggggtagtaaagacttcagtacgcacgaaatctttagaatggagcaactgctcacatggaaagggacctgcggccacagagaccccggtaacaaagccggcatgaccagtctgcccggcggccctcaatctagaggcaggcgggaagctcgtcgcacccgtaagtatttggaattgtacatcgtggccgaccatactctatttctcactcggcaccggaacctgaaccataccaagcagcgactgctggaggttgcaaactacgtcgaccagctgcttcgaaccttagacatacaggtggcgctgactgggttggaggtttggacagagagggaccggtctagagttacccaagacgccaatgcaaccctgtgggcctttctccagtggcgacgggggttatgggcccagagaccacacgactccgctcagctgctcacaggccgtgcctttcagggagcaacggtcggcctggcgcctgtcgaggggatgtgcagggccgagtcttccgggggggtgagcacagatcacagtgaacttccaattggagcagctgcaacaatggctcatgaaataggacattccctcggcctgtcccatgacccggatggatgctgcgtggaggcagccgcagagtccggtggatgcgttatggccgcagccactggccaccccttcccaagggtttttagtgcttgttctcgccggcagcttagggccttctttcgtaaaggtggcggggcatgcctctcaaatgcgccggaccccggactccctgtgcctcctgcattgtgcggaaacggctttgtggaagcgggagaagaatgtgactgcggcccgggtcaggaatgcagggatctgtgctgcttcgcccacaactgctcactgagacccggtgcccagtgcgcccacggggattgctgtgtgcgctgcctgttgaagcctgctggcgccttgtgccgccaggccatgggcgactgcgacctcccagaattctgcactgggacttctagccactgcccccctgacgtctatttgctggatggatccccatgcgctagaggctccggatattgctgggatggtgcctgtcctacccttgaacaacagtgtcagcagctgtggggacccggctctcaccccgcccccgaagcatgcttccaggtggtcaattcagctggagatgcccatggtaattgcggacaggacagtgaaggacacttcctcccttgcgctggccgcgatgcgttgtgcggcaaacttcagtgtcagggcgggaagccctcgcttctggctcctcacatggtacccgttgatagtactgtgcacttagatggccaagaggtgacctgtaggggcgccttggcactgccgagcgctcagttggacctactgggcctcggactagttgagccggggacccagtgcggccccaggatggtctgtcagtctcgtcgctgtcgtaaaaacgcatttcaggagctgcaacggtgccttaccgcttgccactcccacggagtatgcaattccaaccacaactgccactgtgcccctggctgggcgccacctttctgtgataaaccgggcttcggcggatcaatggactctggccccgtgcaagctgagaaccatgacactttcttgcttgcaatgctcttgtctgtactgctacccctgcttccaggtgcaggcctggcctggtgctgttataggctgcctggcgcccacctccagagatgtagttggggctgcaggcgcgaccctgcttgtagtgggcctaaggatggtccccaccgcgaccatccactgggcggggttcatcctatggagttgggcccgactgccactgggcagccatggcctctggacccagaaaacagtcatgaacccagcagccacccagagaaacccctccccgcagtgtccccagatccccaagccgatcaggtgcaaatgccacgtagctgtctctggtag

SEQ ID NO: 107225 - DNA, 417 bp, Artificial Sequence
  Description of Artificial Sequence: Synthetic coding sequence
atgggctggcgcccacgaagagctagagggacccctctgctcctcctccttctccttctgttgctctggcccgttccaggtgctggtgtactacagggacatataccaggacagccggtgacccctcattgggtgcttgacggccaaccatggagaaccgtgtccttggaggagccagtgtctaaaccagacatgggcttagttgccctggaggctgaggggcaagaattactactggagctcgaaaaaaatcataggctgcttgcccccggttatatcgagacacattatgggccagacgggcaacctgtggtgctggctccgaatcacactgtgcggtgcttccacggactttgggatgccccgcccgaagtcccgccacatcattcctatccttattctagcctacacagctag

SEQ ID NO: 107226 - DNA, 543 bp, Artificial Sequence
  Description of Artificial Sequence: Synthetic coding sequence
atgggttggaggccaaggcgcgctcgcggcacacccctgctgctgctcctcttgcttctgttgctatggcctgtgccaggagcaggggttctgcaaggtcacatccctggtcagccagtgaccccacactgggttctagatggccagccctggcgaacagtgtcactcgaagagccagttagcaagcccgatatgggactggtggcacttgaagccgagggacaggaactgctgcttgaactggaaaagaaccagcttctggccccggggtacatagaaactcactacggaccagatggccagcctgtcgtgctggctcccaatcatacagtccgctgcttccacgggctgtgggatgctcccccagagggaagacgcgaggcccggcgcacccggaagtacctggaactctacatcgtagccgatcacaccttgttcttaactcggcatcggaatctgaatcacacaaagcaacgattgctggaggttgcaaattacgtggaccaagaatgtcgcgacctctgctgctttgcacacaactag

SEQ ID NO: 107227 - DNA, 2439 bp, Artificial Sequence
  Description of Artificial Sequence: Synthetic coding sequence
atgggatggagaccccggcgggcgagggggacgcctctgctgctgctcctgttactgctcctgctttggccggtcccgggagctggggtgctccagggccatattccaggccagcctgtcacgccccactgggtcctggatggtcagccttggcgtactgtatccctggaggagccggtaagcaagccagatatgggactggtagccctcgaggctgagggccaggagcttctattggagctcgagaagaaccacaggttacttgcacctggttacattgagacccactacggaccagacggccagcctgtggtgctggctccaaatcatacggaccactgtcattatcagggacgagttagaggcttccctgactcttgggtggtgctgtgcacgtgttccggaatgagcgggcttattaccctgagcagaaacgcttcctactatttgcgaccctggccgccccgtgggagcaaagatttttccacccatgaaattttcaggatggagcagttgctgacttggaagggaacttgtgggcatcgtgacccaggtaacaaggccggcatgacaagcctccccggcggcccccagtcccggggacggcgggaagccaggcgtacccgaaagtatctggagttgtatatcgtggctgaccataccctgttcttgactcgtcaccgcaatctcaatcatactaaacagaggcttctcgaggttgccaactacgttgatcagctcctgaggacgttagatatacaggtagctttgacgggacttgaggtttggactgagcgcgataggtctagagttacccaggatgcgaatgccacactctgggctttcctgcagtggcgccggggactgtgggctcaacgtccacatgactccgcccagctgctaacaggtcgcgcctttcaaggcgcaacagtcggattagccccagtcgaaggcatgtgtagggctgaatccagcggtggggtctccactgatcatagtgagttgcctatcggcgccgccgctactatggcccatgagatcgggcactcacttggactgtcgcacgaccccgatggatgttgcgttgaagctgccgcggaatccggaggctgcgtgatggcagcagctaccgggcatcccttccccagggtgttctccgcctgctccaggcggcagctccgcgctttcttcagaaaaggcggaggggcatgtctcagcaatgcccccgacccagggttgcccgtcccccccgctctgtgcggcaacggcttcgtagaagctggagaagagtgtgactgtggccccggacaggagtgtcgggacctgtgttgctttgcccataactgcagcctgcgccccggtgcacagtgcgcccatggtgactgttgcgttcgatgccttctgaagccagccggcgccctatgccggcaggctatgggggattgcgacttacccgaattctgtactggaacctcctctcactgccctcctgacgtttacttactcgatggatccccgtgcgccaggggttccggatactgttgggatggcgcttgcccaactctcgagcagcaatgtcaacaattgtggggacccggatctcatccagcacccgaggcctgcttccaagtcgtgaactccgctggagacgcccatggcaattgcggccaggattcagagggacactttttgccatgtgccggcagagatgcactttgtggaaaactccagtgtcagggcggtaagccctccctcctggcccctcacatggtgccggtggacagcactgtacacctagacggacaggaggtgacctgtagaggtgcactagcactgccctccgcccagttagacctgctgggtctgggcctcgtcgagcccggaacacaatgcggtccccggatggtgtgtcagagtagaaggtgtagaaagaatgcctttcaggagctccagagatgtctaactgcttgccacagccacggcgtgtgcaattcaaaccacaattgccactgtgctccgggctgggctccgcccttttgtgacaagcccgggttcggcggctccatggactcaggacctgtccaggcggaaaatcacgatactttcctgctggccatgctgttaagtgtgctgttaccactcttgcctggcgccggactggcatggtgctgttataggctgcctggagcacatctccagagatgttcctgggggtgtagaagggatccagcttgtagcggaccaaaagatggcccccaccgggatcacccactgggcggcgtgcatcctatggagctgggccctaccgcaacaggacagccatggccgctggacccggagaattcgcacgagccaagctcccaccctgaaaaaccgctacccgccgtgtcgcccgatccccaagaccaggtgcagatgcctagatcttgtctgtggtag

SEQ ID NO: 107228 - DNA, 456 bp, Artificial Sequence
  Description of Artificial Sequence: Synthetic coding sequence
atgggatggaggccgaggagagcccgcggcactcccctgctgctcttgttactgctcctgttgctgtggcctgtgccaggagcaggggtactccagggacacatacccggccagccggtaacaccccactgggtgctggacggccaaccttggcgcaccgtgtccttggaggaaccagtctcaaagccagatatgggactggtcgctctggaggcggaaggtcaggagctgctgttagagctggaaaaaaaccaggatgctctttgcgggaagctgcaatgccagggcgggaagccaagcctccttgctccacacatggtacccgtagactctacagttcacctagatggacaggaagtcacctgccgaggggctcttgcactgccgagcgcccagctggacctgctggggctgggactggtcgaacccggtacccagtgtgggccacggatgtag

SEQ ID NO: 107229 - DNA, 2079 bp, Artificial Sequence
  Description of Artificial Sequence: Synthetic coding sequence
atgggctggcgcccaagaagagccagagggacccccttactactcctacttttgctgcttctgttgtggccagtgcctggcgctggggttctgcaagggcatattcctggccagccagttacaccacactgggtgttggacggacaaccatggaggacggtctcacttgaggagcccgtgtctaagccagacatgggcctggttgcactcgaagcagaaggccaggaactgcttctggagcttgagaagaaccaccgtttgcttgcccccggctatattgaaacccactacgggcctgatggccagccagtggtgctggctccaaaccacaccgaccactgccactaccagggcagagtgcgaggttttccagattcctgggtggtcctgtgcacttgcagtggaatgtcgggtctgattaccctcagccgaaacgcaagttattatctccgcccctggccgcctcgcgggagcaaagacttttctacccatgaaatttttcgcatggaacagctcctgacttggaagggcacttgtggtcatcgggatcctggaaataaagcaggaatgaccagcctcccaggtggtccacaaagtagaggccgacgggaggcccgtagaacccgtaagtacttggagctgtacattgtagcagaccacactttattccttaccagacatcgaaatctcaaccatactaaacaacggctgctggaggtcgctaattatgtggaccagctgcttaggaccctggacatacaggtggccctcaccggactggaagtgtggacggaacgcgaccgctcgaggcgtcaactaagggcgttcttccgaaaaggcgggggagcttgtctgtcgaatgcccctgacccaggcctgccggtcccacctgctctctgcggaaacggctttgtcgaagcaggagaagagtgcgactgtggacccggacaggaatgtagggatctctgctgctttgcccataactgctcactccgccctggagcccagtgcgcgcacggtgactgttgtgtgcgatgcttactgaaaccagctggggcgctgtgccgccaagctatgggcgattgtgatctccccgaattctgcacaggtacatcttcccactgtccacccgacgtgtatttgctcgacggatccccttgtgcccggggatctggatactgttgggacggagcctgccccaccctcgagcaacagtgtcagcagctgtggggacctggcagccaccccgccccggaggcgtgttttcaggtggtgaatagtgctggggatgcccacggaaactgtggccaggactctgagggacactttctaccatgcgctggtcgagatgctttgtgcggcaagctgcagtgtcaaggcggcaagccttcactgctcgctcctcacatggttcctgttgacagtacagtccacttggacggacaggaggttacctgtcggggcgctctagccctgccttctgcccagctggatctgctggggctgggccttgtggaacctggcacccagtgcggccccagaatggtatgccagtcccgaagatgtagaaagaacgcattccaggagctgcagagatgtctaaccgcctgccactctcatggagtatgtaacagcaaccataattgccactgtgcccccgggtgggccccacccttttgtgataaacccggtttcgggggatccatggattccgggccagtgcaggcggaaaatcatgacactttcctactcgccatgctcctttctgtactgctgcccctactgcccggcgcgggcctagcatggtgttgctatagactgcccggcgctcacctgcagcgatgttcttggggctgccgacgtgatccggcctgttcaggccctaaggatggccctcatcgggaccacccgctgggaggagtccaccccatggagttaggccctaccgcaaccggccagccctggccactcgatccagagaacagccatgagccatcttctcacccagaaaagccattgcctgccgtttctccagaccctcaggatcaggtccagatgccccgcagctgcctgtggtag

SEQ ID NO: 107230 - DNA, 522 bp, Artificial Sequence
  Description of Artificial Sequence: Synthetic coding sequence
atgggctggcgtccgcggcgcgcaagagggacgccactactccttttgctgctcttgctgctgttgtggccagtgcctggcgccggcgttctgcaggggcatataccggggcagcctgtcactccacactgggtgcttgatgggcagccctggaggacggtgtcactcgaggagcctgtgtccaaaccagatatggggctggtagccctggaagctgagggtcaagagctgctgctggagttggaaaagaaccataggctgcttgccccaggctatatcgagacacattacgggcccgatggtcaacccgtcgtccttgcgcctaaccacaccgttcggtgttttcatggtctctgggacgctccacccgaggaccactgccactaccagggtcgcgtgcgtggctttccggatagctgggtggttctgtgcacatgcagcggcatgcgggctggcgaaaagcgcgcggggccaggcagtacgtggaattgcacgctctggcagactaccccctgcagctag

SEQ ID NO: 107231 - DNA, 291 bp, Artificial Sequence
  Description of Artificial Sequence: Synthetic coding sequence
atggggtggcggccacggcgtgccagagggacaccactcctgcttctgctactacttctcttactatggcccgtgcccggcgccggcgtcttacagggccatatccctgggcaacctgtgacaccccattgggtcttggacgggcagccctggcgaacagttagccttgaagaacccgtgtctaagcctgatatgggattagttgccctcgaagccgaaggccaggaactgctcctggagctcgaaaagaatcagttcgcaatagccactattaccgccaccgttctgtag

SEQ ID NO: 107232 - DNA, 2265 bp, Artificial Sequence
  Description of Artificial Sequence: Synthetic coding sequence
atgcttccaggatgcatattccttatgatcctccttatcccccaggtaaaagagaagttcatcttgggcgtggaaggccagcagctggtgaggccaaagaagctgcctctaatccagaagagggatacaggccacacacacgacgatgacatcctgaagacatacgaggaagagttgctgtacgaaattaaactcaatcgaaaaacactggtcttacacctcctgagaagcagagaattcctcggaagcaactattctgagacattctatagcatgaaaggtgaggctttcacgaggcatccacagatcatggatcactgtttttaccagggcagcattgtccatgagtacgacagcgccgcttcaatctctacttgcaatggactgcggggtttctttcggatcaacgaccagaggtacctgatcgagcccgtgaagtactctgacgagggggagcacttagtctttaagtataatctgcgcgtcccctacggggccaattatagttgtacagaactgaatttcactcgaaaaacggttccgggagacaacgagagcgaggaggacagcaaaattaaaggcatacacgatgagaaatacgtggaactcttcatagtggctgacgacacggtctataggaggaacggccacccgcataataaactccggaacagaatctgggggatggtaaatttcgtgaacatgatctacaagactcttaatattcatgtgaccttggtcggaatcgaaatatggactcacgaagataaaatagagctgtacagtaacattgagaccacactgctgagattttcattctggcaggagaaaatccttaaaaccaggaaggactttgaccacgtagttcttttgtccggcaagtggctttactcacatgtccagggcatttcttaccctggtggcatgtgcctaccctactatagcacaagtatcataaaggacttgcttcctgatacgaatatcatcgcaaatagaatggcccaccagctggggcacaacctggggatgcaacacgacgaatttccctgtacttgcccctctgggaagtgtgtcatggacagcgatggctctatccctgcgctgaaatttagtaaatgcagtcaaaaccaataccaccagtacctcaaagattacaagcctacatgtatgttgaacattccctttccttacaacttccacgactttcaattttgtgggaacaaaaagcttgatgaaggagaagagtgtgattgtgggccagctcaggagtgcaccaatccctgctgcgacgctcacacttgcgtgctcaagcctgggttcacctgcgccgaaggagagtgctgcgagagttgccagattaaaaaggctggttctatctgcagaccagccaaggacgagtgcgacttccccgagatgtgcaccggccactccccagcttgccccaaggaccagtttcgtgttaacggctttccctgtaagaattccgaggggtactgtttcatgggaaagtgtccaacaagagaagaccagtgtagcgagttattcgatgacgaagcaattgaaagccacgacatctgctacaagatgaacactaaaggaaataaatttggatactgcaaaaacaaggaaaatagattcctgccctgcgaggagaaagatgtcaggtgcgggaaaatatactgcacaggaggcgaactgtcttctctcctgggggaagataagacataccatttaaaggatccacagaaaaacgctaccgtaaagtgcaaaaccatattcctgtaccatgatagtacggatattggcctcgtcgcttcaggaacaaagtgtggagaggggatggtgtgtaacaacggcgaatgtctgaacatggagaaagtctacatctctacaaattgcccttctcagtgcaatgaaaacccggtagacggacacgggctacagtgtcattgcgaagaaggtcaagcgcccgtggcctgcgaagagaccctgcacgtgacaaatatcaccatactggtggtagtgctggtgcttgtgattgttggcatcggtgtgctcatcctgctcgtacgttaccgaaagtgcataaagcttaaacaggtgcaatcccccccgacggaaacgcttggggtcgaaaacaaagggtatttcggcgacgaacagcagatcaggactgagccaatattgccggagatccatttcctaaacaagccagccagcaaggactccaggggcatcgctgatcctaaccagagcgcaaaatag

SEQ ID NO: 107233 - DNA, 1656 bp, Artificial Sequence
  Description of Artificial Sequence: Synthetic coding sequence
gtatgccccaggtcttattttcttgagggacgaggatcgtatagttttctgtctttgttttcaactagtcccgccccataccgccgcaatggacaccctcacaacaagctgcggaatcgaatatggggcatggtaaattttgtaaatatgatttataaaactctaaacattcacgtaacactggtaggcatcgaaatatggacacacgaggacaagatagaactatacagcaacatcgaaacaacactgttgcgtttttccttttggcaggaaaaaatcctcaaaacccgcaaggattttgaccacgttgttctgttgtccgggaaatggctgtactcccatgtgcaggggatcagttatcctggtggcatgtgcctgccctattactccacaagtatcattaaggatctcttacctgacaccaacattatagctaatagaatggcccaccagctggggcacaacctgggaatgcagcacgatgaattcccctgtacatgcccaagcggcaagtgcgtcatggactctgacggctccatccctgcccttaaatttagtaagtgttcccagaatcagtaccaccagtatctcaaagattacaaacccacatgcatgctcaacatcccgtttccctacaatttccacgacttccaattctgtggcaacaaaaagctcgacgagggagaggagtgcgactgtgggccagcacaagagtgcaccaatccatgctgtgacgcccatacttgtgtcctcaagcctgggttcacttgcgccgaaggggagtgctgtgaaagctgccagatcaaaaaggctgggtcaatttgtaggcccgctaaggatgaatgtgacttcccggagatgtgtaccggccactcccctgcttgtcctaaagatcaattccgtgtgaacggcttcccctgcaagaactctgaaggctattgttttatgggaaagtgtccaacccgggaggaccagtgcagcgagttattcgacgacgaggccatcgaaagtcatgacatctgctataagatgaatacgaaaggaaacaaatttggttattgcaagaacaaggaaaaccggtttctgccctgcgaggaaaaggacgtcaggtgcggcaagatctactgcacaggcggcgagctgtccagcttattaggggaagataagacataccacctgaaagatccacagaagaacgccactgtcaagtgcaagaccattttcctatatcatgattccaccgacatcggccttgttgcgtctggtaccaagtgcggcgaaggcatggtgtgtaacaatggcgaatgcctgaatatggagaaggtatacatctctacgaattgcccctcccagtgtaacgagaaccccgtcgacggacacggactgcagtgccattgcgaggaaggacaggcccccgtagcatgcgaggagaccctgcacgtcacaaacattaccatcctggttgtagtcctggtgctggtcatcgtggggattggcgtccttatcctgctagtgaggtacaggaaatgcattaagctgaagcaggtgcagagtccacccacagagaccctgggcgtggagaacaaagggtattttggcgacgaacagcaaatccgaactgaacccatccttccagaaattcactttctcaattag

SEQ ID NO: 107234 - DNA, 2475 bp, Artificial Sequence
  Description of Artificial Sequence: Synthetic coding sequence
atgcggggtttgggactatggctcctgggcgcgatgatgctgcccgccatagctccatctaggccatgggcattgatggagcaatacgaggtggtgctcccttggaggctgcccggccctcgggtcagacgtgcactcccctctcatctcggcttgcaccctgaacgggttagctacgtactcggagccaccgggcacaatttcaccctccacctacgcaagaatcgagatctactcggtagcggttacacagaaacatacactgctgcgaatggttctgaggtcactgagcagccaagaggccaggaccactgtttctatcaaggccatgtggaaggctaccctgacagcgccgcttccctgagtacctgcgctggcctccgcgggttttttcaggtaggttccgaccttcaccttatcgaacctctggatgaggggggcgagggcgggaggcacgcagtttaccaagccgagcatctacttcaaaccgctggaacatgcggagtgagtgacgattccctgggctccctgctggggccgcgcactgcagccgtgtttcgacccagacccggcgattcacttccaagcagagaaacccgatacgtggaattgtacgttgtagtggacaacgccgagtttcagatgttgggcagcgaagcagcggtgcggcatcgtgtcctcgaggttgtaaatcacgtcgacaagctttaccagaagctgaactttcgcgtggtcctggtagggttagagatttggaacagccaggatcgattccatgtgtccccagatccaagtgtaacactggaaaacttgcttacctggcaggcccggcagcgcaccaggcgccatttgcacgacaacgtgcagctgatcaccggcgtcgacttcacaggtaccacggtcggtttcgcccgggtttctgcgatgtgttcccattcaagtggggcagtaaaccaggaccactctaagaaccccgtgggagttgcttgtactatggcccatgagatggggcataacctggggatggatcacgacgaaaacgttcagggctgcaggtgtcaggagcgcttcgaagccggccgatgcatcatggccggcagtataggctcttcttttccccgtatgttctcagattgtagccaagcatacctggagtctttcctggaacggcctcagtccgtgtgtctcgcaaacgctccagatctctctcacctagtcggcggcccagtgtgcggcaatctgttcgttgaaaggggtgagcagtgtgattgtgggccacccgaggattgtcgaaaccggtgttgcaatagtacaacgtgtcagctagctgagggagcccagtgtgctcacggaacatgttgccaggagtgtaaagtcaaacccgcgggcgaactttgcaggcctaaaaaggacatgtgtgacctcgaagaattctgcgatgggaggcacccagagtgccccgaagatgcattccaggaaaatggtacaccctgctccggaggttattgctacaacggagcatgccccacattggctcagcaatgccaggccttctgggggcccggaggccaagctgcggaggagtcatgttttagctacgatatcctgcccggctgtaaggctagccgctacagagccgatatgtgcggggtattacaatgtaaaggcggacagcagcccctgggcagagctatatgcattgtggacgtctgccacgccttaaccaccgaggatggtacagcatacgaacctgtgccggagggcactagatgcgggccagagaaggtctgctggaaggggagatgtcaggatcttcacgtttatagatcaagcaattgtagcgcccagtgtcataatcacggcgtctgtaatcacaaacaggagtgccactgtcatgcgggctgggcgccaccccattgcgccaagctgctgaccgaagtccacgctgcttcaggctctttgcccgttttcgtggtggtggtgctggtccttctggccgttgtactcgtaacactagcaggaattatcgtctatcgcaaggcgcgatctaggatcctgtcacgaaacgtcgctcctaagactactatgggcaggtccaatcctctgttccaccaggctgcgtctcgggttcctgcaaaagggggcgctcctgccccatcaaggggtccacaggagcttgtgcccacaactcacccgggtcaaccagcgagacacccagcgtcgtcagttgcactgaagcggccaccccccgctccacccgttacagtgtcttcacccccatttccagtgcctgtctacacaaggcaagcgcctaagcaggtgatcaaacccacatttgccccccccgtcccaccggtgaagcccggtgccggagctgcaaaccccgggccagcagaaggcgctgttggccctaaagtcgccctgaaaccgcccatacagcggaagcagggtgccggggcccccacagctccctag

SEQ ID NO: 107235 - DNA, 2202 bp, Artificial Sequence
  Description of Artificial Sequence: Synthetic coding sequence
atgagaggactgggcctgtggctgctcggcgccatgatgttgccggggcctgcaccacgagaaggcgaattgcggccttggggacaccgtgctcagctccatccgccaccggctgaagaacagggcccagcaggcttaaggctgcatcgggacctttacgggtgtcaatggttgcggggcgatggcgcagcatcacgcgcgggtcccttactgctgcccggaccacgtaggggagtgcccggtttatctcggcagccccagcatctgtgtagaccccaggtgggcagtgacttacacctgatcgaacctcttgacgagggcggtgagggaggccgacacgctgtgtaccaggccgagcacttgctccagacagccgggacatgcggagtgtccgatgactctttgggctctctacttgggccccggacagcagccgtctttaggccccggccaggagactctctgccaagccgggaaacccggtacgtggaactgtacgtggtggtggataacgcagaatttcagatgctcggctcagaggctgcagtgagacacagggtactggaggtcgtcaaccatgtggataaactgtaccaaaaactgaactttagggttgttctcgttgggctggagatctggaactcgcaagacagattccatgtgagtccagacccatccgtcacgctggaaaatttgctgacctggcaggcgcggcagcggacacgaaggcacttgcacgacaatgtgcagctcattacaggggttgacttcactggtacaaccgtaggctttgctagggtcagcgccatgtgtagccactcgtcgggtgccgtgaaccaggaccattcgaagaatccggtgggggttgcctgtacgatggcacatgagatgggtcacaaccttggaatggaccacgacgagaatgtgcagggctgtagatgccaagaacgctttgaagctgggaggtgcatcatggccggatctattggcagcagcttcccccgaatgttttcagattgtagccaagcatacctggaaagttttctagagaggcctcagagcgtgtgtctggcgaacgctcccgatctgagccatctggtgggaggtcctgtatgtggcaatctctttgtggagcgcggcgagcagtgtgattgtggcccacccgaagactgcagaaataggtgctgcaattccaccacctgtcaactggccgagggtgcacagtgtgcacacggaacctgttgccaggaatgcaaggtgaagcctgctggcgaactttgtagaccaaaaaaggacatgtgtgatctggaagagttttgcgatggtagacacccggagtgcccagaggatgcgtttcaagagaatggaacaccgtgctccggaggctactgctacaatggtgcctgtcccaccctggctcagcaatgtcaagcattttggggccctggaggccaggccgcagaggaatcttgcttcagctacgatattcttccaggatgcaaggctagtcgatatcgcgcagacatgtgcggcgttctgcaatgcaaagggggacagcagcccctcgggcgggccatatgcattgtcgacgtttgccacgctcttactacggaagatgggactgcgtacgagcctgtgcccgagggaacccgctgcggcccagaaaaggtatgcaatcacaaacaagagtgccattgccacgcggggtgggccccaccacactgtgcgaagcttcttacggaagtacacgccgcatcggggtctttgccagtattcgtggtggttgtgctggttctactcgctgtggtcctggttaccctcgcagggattattgtgtaccgaaaggccaggtcaaggatcctttcaaggaatgttgctcctaaaacaacaatgggtcgcagtaatcccctgtttcatcaggccgcaagccgtgtgcctgccaagggaggcgctccagcgccatccaggggccctcaggagctggtgcccaccactcatccgggtcagcctgcgcgacaccctgcttcctctgtcgctctgaaaaggccaccccctgcaccgccagtgacagtgtcgtcacctccattcccagtgccggtctatacaaggcaggctcctaagcaaggggccgtcggacccaaagtggctctgaagcccccaatccagcgcaagcaaggtgcgggagcgccaaccgctccctag

SEQ ID NO: 107236 - DNA, 2229 bp, Artificial Sequence
  Description of Artificial Sequence: Synthetic coding sequence
atgaggggtttaggcctgtggttgctgggagccatgatgctgccggccatagctccatcaaggccatgggccctgatggagcagtacgaggttgtgctgccctggagacttcccggcccgagagttcgccgcgctctgcctagccatcttgggttgcaccctgagagggtgtcctacgttctgggagctactgggcataattttacgctgcatctgcggaaaaaccgcgatctgcttggcagtggatacactgaaacctatacagcagccaatggtagtgaggtgaccgagcagccacgtgggcaagatcactgcttctatcaaggacacgtcgagggctatcccgattcagcagccagtctcagtacgtgtgccggcttaagaggttttttccaggtgggctctgatctccacctgatagagccattggacgagggaggggaggggggccgccacgcggtttatcaggccgaacatctgctgcagacagccggtacatgcggagtgagtgacgacagcctgggatctttacttggccctagaacagccgctgtgttcagaccaagaccaggtgactccctgcctagcagagaaacacgatacgtggagctatatgtggtggtggataatgctgaatttcagatgctaggctcagaagccgcggtcaggcatcgggtgctggaggttgtaaatcatgtcgacaagctttaccaaaaactgaactttagagtggttctcgtgggtttggagatttggaacagccaggataggtttcatgttagccctgatccttctgttactctagagaacctattgacatggcaggctagacagaggactcgacgtcacttacacgacaacgtgcaactgattacaggcgttgattttaccggcacaacagtgggatttgctcgggtgtcagctatgtgttctcactctagcggagccgttaatcaggatcattccaagaacccagttggtgtggcgtgcactatggctcacgagatggggcacaatcttggtatggaccacgatgagaatgtgcagggttgtcgatgtcaggagcgcttcgaggccgggcggtgtataatggcaggctcaataggctcctcatttccgaggatgttcagcgactgttcccaggcctatctggaaagctttttggaaaggccccaaagcgtctgtctcgcaaacgcccctgacctaagtcatctggttggcgggcccgtgtgtggaaatctcttcgtagaacggggtgagcagtgtgactgtgggcctccagaagactgtcgaaatagatgctgtaactctactacatgtcaattggcagagggggcccagtgtgcacacggtacctgctgtcaggagtgcaaagtcaagccggccggtgaactgtgccgaccgaaaaaggatatgtgcgacctcgaggagttctgcgatgggcggcaccccgaatgtcctgaagacgcattccaggagaacggcacgccgtgcagtgggggatactgctataatggcgcctgtccaaccttagcacagcagtgtcaggctttttgggggccaggcgggcaagctgccgaggagagttgcttctcctatgatatactgccaggctgcaaagcctctaggtatcgagccgacatgtgcggagtccttcagtgcaaggggggccaacagcctctgggaagggccatatgcatcgtggacgtctgccatgccttaactaccgaagatgggactgcatacgagccagttccagagggaaccagatgtgggcccgagaaagtgtgctggaagggtcggtgccaagacttacatgtctataggagctctaattgctcagcacagtgtcataaccatggcgtatgcaatcacaagcaggaatgtcattgccatgccggatgggcgccgcctcactgcgccaagttactcacagaagtccacgccggttgccagcctcgagcaggacaaggaagggggagcagccctatacagggcccacccagggcgggaccacaccacccacctgggcccgcccgccccaccccaggtctcttgggaggatctgaagaggcagccccttgttcgtcggggcattgtgtccagcccactcttcctagctcttgcctacatccagcaggcaccaaagctggccatcaggcgaatgtcaggacaccttccgcaccatcgcagactagggggtggtgcggacaaccttggtcatcatag

SEQ ID NO: 107237 - DNA, 2460 bp, Artificial Sequence
  Description of Artificial Sequence: Synthetic coding sequence
atgggcagcggcgctcggttcccttcaggaacattacgggtacggtggctgcttctgctgggtctggtgggacctgttctgggcgccgctcggcccggattccaacagacctcacatctttcttcctacgagatcatcaccccatggcgtttgacgcgagagcgcagagaagccccaagaccttatagtaaacaggtctcttacgtgattcaggccgagggcaaagagcatatcattcacctggagcgtaacaaggacctgcttcctgaggattttgttgtctatacttataataaggaggggacactgatcacagaccatcctaatatccagaatcactgtcattaccgcggctacgtggaaggcgttcacaattccagtatagccctgtcagactgtttcgggctgcggggactactgcacttggagaatgcgagctatgggattgagccccttcagaactcctcacatttcgaacatataatctatcggatggacgacgtctacaaggagcccctgaagtgtggggtgtctaataaggatattgagaaggagacagctaaagatgaggaagaagagcccccgtctatgacacagctcctccggagacggcgcgcagtgctgccacagacacgttacgtcgaattgtttattgtggtggacaaagagcgatacgatatgatgggtagaaatcagaccgcagttcgggaggagatgattctgctcgcaaactatctcgattctatgtatatcatgctgaatatccgcatcgtactcgtgggactggaaatttggacaaatggcaatctgatcaacattgttggcggggccggagacgtgctgggcaatttcgtgcagtggcgcgaaaagtttctgattacacggaggcgacacgacagtgcccagctcgtattgaaaaaggggtttgggggcactgctggcatggctttcgttggtacggtttgcagccggtcacatgccggcggtatcaatgtttttggccaaatcaccgtggaaacctttgctagtattgtggcgcatgagctcggccacaacctggggatgaaccatgatgatggacgggactgcagttgcggggccaaaagctgtattatgaactccggtgctagtggcagccggaacttcagctcgtgttctgcagaggatttcgagaagcttacactcaacaagggagggaattgcctcctcaatattcccaagcccgatgaagcttactccgccccctcatgtggaaataagttagtcgacgccggcgaagagtgcgattgcggcacaccaaaggaatgtgaactggatccgtgctgcgaaggaagtacttgtaaactgaagtcattcgccgagtgtgcctacggtgactgctgtaaggattgtcgcttccttccgggaggcaccttgtgccgaggaaaaacttcggaatgcgatgttccagagtactgtaacggctccagccaattttgccaacccgacgtgtttatccaaaatggttatccatgccagaataacaaagcgtattgttataatggaatgtgtcagtactacgacgcacagtgtcaggtgatcttcggatccaaagcgaaggcagcccccaaggactgttttatcgaggtgaacagcaaaggcgaccggttcgggaattgtggcttttctggaaatgaatacaagaagtgtgccaccggaaacgcactgtgcggaaaactgcaatgtgaaaacgtgcaggaaatcccagttttcggaatcgttcctgccatcatacagacgccaagccgcggtactaaatgttggggggtcgatttccagctggggagtgatgtccctgatcctggcatggttaatgaaggaacaaagtgtggcgcaggcaagatctgcagaaacttccagtgtgtcgatgcgtcggtacttaattatgactgtgacgtccagaagaaatgtcatggccacggggtgtgtaactctaacaaaaactgccactgcgaaaacgggtgggcacccccaaactgcgagacaaagggctatggaggaagtgtagactccggcccgacctacaacgagatgaataccgccctccgcgatgggcttctggtgtttttcttcctaatcgtgcctctgattgtgtgtgcgatctttatatttataaaacgcgaccaattgtggaggtcttactttcgcaaaaaaagatcccaaacttacgagtccgatggcaagaaccaagctaatccttcccggcaacccggcagcgtgcctcggcacgtatcaccagtgacacccccacgtgaagtgccgatttatgcaaatcgattcgccgtgcctacctacgctgctaaacaaccccagcagttcccgtcaagaccacccccaccccagccaaaggtgtccagccaagggaacctcatccctgcaagacccgcccccgcccccccgctctattcttcactcacctag

SEQ ID NO: 107238 - DNA, 2904 bp, Artificial Sequence
  Description of Artificial Sequence: Synthetic coding sequence
atgcaacgcgccgtccccgaggggtttggccggcgaaaacttgggtccgacatgggtaacgccgaaagagctcccgggtccaggagttttggacctgtgccaacccttctgctactagccgcggccttgctcgccgtcagtgacgccttgggtaggcccagtgaggaggatgaagaactggtggtgcccgagctggagagggcgcccggtcatggcactaccaggttacggttgcatgcattcgatcaacagctcgacttggaactcagacccgactcttcatttcttgctcccgggtttactctgcagaatgtggggcgaaagagcgggtccgaaacaccgctcccagagacagacctggctcattgcttttactctgggacagtcaatggcgatccgagcagcgcagccgccctgagtctatgcgagggcgtgcggggggccttttacttgttaggcgaggcatacttcatacagccccttccagctgctagtgagaggctggcaaccgccgcacctggcgagaaaccccctgctcctctgcagttccatctgctgcgacggaatcgacagggggatgtggggggtacatgcggggtagtggatgatgagcctcgccccaccggcaaagccgagactgaagacgaagacgagggaactgaaggagaagatgagggggcccagtggtccccacaggatcccgctctgcaaggtgtgggtcagccaacgggaacgggcagcatacgaaagaagcgcttcgtgtcttcacacagatacgttgagactatgttggttgcggaccagagtatggctgagttccacgggtccggattgaaacactacctgctgacattgttcagcgtcgcggcacgactgtacaagcatccatccattcggaatagcgtgagtctcgtagtggtgaaaatcctcgttattcatgacgagcagaaagggccggaggtaaccagcaacgctgccctgacactgagaaatttctgtaactggcagaagcagcacaaccctccaagtgatagggacgctgaacattatgacaccgctattctgtttactagacaagatttatgcgggtcccagacttgcgacaccctgggtatggcagacgtaggaactgtgtgcgatccaagccgcagttgcagcgtgattgaggacgatggacttcaggccgccttcacgaccgcccacgagctaggacacgtattcaacatgccccatgacgacgcaaaacagtgcgcatccctgaacggcgtcaatcaggactctcacatgatggcaagcatgctgtccaatctcgatcattctcagccctggtcaccctgtagcgcctatatgatcacatccttcctggacaatgggcacggcgaatgcctgatggataagccgcagaacccaatccagttgcccggagatcttccaggcacctcatatgacgcgaatcggcagtgtcagttcacgtttggagaggatagtaaacactgtcccgatgctgcgagtacgtgcagtactttgtggtgcacgggcaccagtggcggcgtgctggtctgtcaaacgaagcactttccctgggcggacggcaccagctgcggtgagggcaaatggtgcatcaacggtaaatgtgttaacaaaactgaccggaagcactttgacactccgttccatggctcatggggtatgtggggcccatggggagattgctccagaacgtgcggagggggcgtgcagtatacaatgagggagtgcgacaaccctgtgccgaaaaacggcggcaagtactgtgagggaaaaagggtcagatatagatcctgcaaccttgaggattgccctgataacaacggcaaaacatttagagaagagcagtgtgaagcacacaacgagtttagtaaggccagcttcgggagcggccccgctgtcgaatggataccaaagtacgccggagtctcccccaaggaccggtgtaagctaatttgccaggcaaagggaatcggctatttttttgtcttacagcctaaagtagtagatggtactccatgttcaccagactccacgtcggtctgtgtccaagggcagtgcgtcaaggctggctgcgataggattattgactccaagaagaaatttgataagtgcggagtgtgcggaggcaatgggtcaacctgcaagaagatcagtgggtccgtcacttcagcaaaacccggttaccatgatattatcaccatcccaaccggagctaccaacatcgaggtgaagcagcgtaaccagcgtggctcacgcaataacggttcgtttctcgcgatcaaggcggctgatggaacttacattttgaatggagattatacgcttagcaccctggagcaggatatcatgtataaaggtgtcgtgctccgatactccggttcctccgcagcattagagaggatacgctctttttccccactgaaagaaccccttactattcaggtcctaaccgtgggtaatgctctgcggccaaaaatcaagtatacatatttcgtaaaaaaaaagaaggaatcctttaacgcgataccaaccttctccgcctgggtgattgaagaatggggggagtgctctaaaagttgcgaactgggatggcaaagaagactggtggagtgtcgggacatcaatggccagccagccagcgagtgtgcgaaagaagtgaaacctgcatccacacgcccatgtgcagatcacccttgccctcaatggcagctgggcgaatggagtagttgctctaagacatgtggcaaagggtataaaaaaagaagtctgaaatgcttatcacacgacggcggggtgttgtcacatgagagttgtgatccactcaaaaagccaaaacacttcatcgacttctgcaccatggccgaatgcagttag

SEQ ID NO: 107239 - DNA, 3312 bp, Artificial Sequence
  Description of Artificial Sequence: Synthetic coding sequence
atggctccagcatgccagattctccgttgggcattggcacttggtcttggactcatgttcgaggtcacgcacgcctttagatcccaggatgaattcctctcaagtctcgagtcttacgagatcgcgtttcctacaagggtagaccacaacggagccctgcttgccttcagtccacccccccctagacgtcaaagacgaggaactggcgctactgcagagtcccggcttttttataaggtcgccagcccaagcacgcatttccttttaaacctaacaaggtcctcccgacttctggccggacatgtttccgtcgagtactggacgcgggaggggcttgcttggcaaagggccgcgcggcctcattgtctatatgcaggacatcttcaggggcaggcctctacttcgcatgtggccatctctacgtgtggcggcctgcatggcctgattgttgccgatgaggaggagtacttaatcgagcctcttcatggaggaccgaaaggctccagatcacctgaggagagcggcccacacgtggtatataagagaagctctctaaggcacccccatctggataccgcttgtggcgtgagggatgaaaagccctggaaggggaggccttggtggttgcgtaccctgaagccaccccccgcgcgccctctggggaacgagacggaaagaggccagcctgggctcaaaaggtctgtgagcagagagaggtatgtggagaccctggttgtagccgacaaaatgatggtcgcctaccacgggcggcgggacgttgaacaatacgttctggccatcatgaacatcgtcgccaaactttttcaagattcaagtctcggaagcactgtaaacattctggtgacccgtcttatcctgttgacggaagaccagcctaccctggagatcacacaccacgctggcaagtctctcgactcattttgcaagtggcagaagagcattgtcaatcactctggacatggcaatgctatccccgagaatggagtggctaatcatgatactgcagtcctcataaccagatatgacatttgtatctataagaataaaccctgtggtactctcgggctcgctccagtgggcggaatgtgtgagcgcgagcgttcctgttctgtgaacgaggacattggcttggctaccgccttcactatcgcacacgagattggccatactttcggcatgaaccacgacggggtgggcaatagctgcggcgctcggggccaggaccccgccaaactgatggcggcccacataacaatgaagacaaatcccttcgtctggtcttcctgttcacgggattatatcaccagctttctcgattcaggattgggactgtgtctgaataacaggccccctaggcaggattttgtttacccaaccgtagcccctggtcaggcgtatgatgcagacgaacaatgccgctttcagcacggggtaaagtctcgccagtgtaaatacggagaggtttgtagcgaactgtggtgtttgtctaagagcaatcggtgcataactaattccatccccgccgccgaaggaacactctgccagacacacacaattgacaaggggtggtgttacaaaagggtgtgtgttccatttggctctagacccgaaggggtcgatggtgcttgggggccttggaccccatggggggactgtagtaggacatgtgggggaggagtcagctcctcatcaaggcattgcgacagtcctaggccaaccattggcggaaagtattgcttaggagagaggcgcaggcaccggtcttgtaatactgacgattgtccccccggctcacaggacttcagggaggtacaatgcagcgagttcgacagcatacccttcagggggaagttctataagtggaaaacctataggggcggcggtgtgaaagcatgttccttaacctgcctggctgagggattcaacttttatactgagcgcgcagccgccgtggtcgatggaaccccctgcaggcctgacacagtggacatatgcgtgagtggagaatgcaagcacgtgggctgcgaccgcgtgctgggctcagacttacgagaagacaagtgtcgcgtttgcggaggtgacggctccgcttgtgaaaccatcgaaggcgtgttctcacctgcaagcccaggagccgggtatgaggatgtggtgtggattccaaaggggtctgtgcacattttcatacaagacctaaatctcagcctttcccaccttgccctgaaaggggaccaggaatctctgcttctggaaggactgcctggcactccacagccacataggctcccactggccggcactacgtttcaactgcgtcagggaccagaccaggtccagtcattggaggccctgggcccaatcaatgcatctctgattgtgatggtgttagcgaggacggaattacctgctttgcggtaccgcttcaacgcacctatagcacgggattctttgccaccctactcttggcactacgcgccgtggactaagtgttctgctcagtgtgccggcggatcccaagtgcaagccgtggagtgccggaaccagctggattctagtgccgtggcacctcactattgctccgcacattccaagttacctaaacggcaacgtgcctgtaacactgagccttgtcctcccgattgggtggtgggcaactggtctctgtgtagcaggtcatgcgacgcaggagtcagatcccggtccgtggtctgtcagaggcgcgtgtccgcagctgaggagaaggccctcgatgattccgcctgcccccagccgagaccgcccgtgctagaggcatgccacgggcccacctgtcctccagagtgggccgccctggactggtctgagtgtacacccagttgcggccccgggctccgtcaccgcgtagtcctgtgcaaaagcgcggaccatcgagccaccctccccccagcccattgtagcccagcggctaaaccccctgctacaatgcgctgcaacctccgaagatgtcctcccgccaggtgggttgcaggggagtggggtgaatgctctgctcagtgtggggtggggcagcgacagcgatctgttcgctgcaccagtcacaccgggcaagcctctcatgaatgcacagaggcactcaggccccccacgacgcagcagtgtgaggctaagtgtgacagcccaacacctggagacggtcctgaggaatgtaaagatgtgaataaagtggcttactgcccactggtgctgaaattccagttttgctctcgagcatatttcagacagatgtgctgtaagacctgtcatggccactag

SEQ ID NO: 107240 - DNA, 2544 bp, Artificial Sequence
  Description of Artificial Sequence: Synthetic coding sequence
caagacgacggcggcctatctcgagccccgggctgtggagctgtgtgtcccgggcatcacgagcactgtcaagtagcaaagctgtttcaagacagctcactgggctccacggtaaacattctagtgacccgactgattttactaaccgaagaccagcctactttagagattactcatcacgctggcaagtctctggactcattttgtaagtggcaaaaatccatcgtcaatcacagtgggcacggcaacgctatccccgagaatggggtggcaaaccacgacacggccgtgctcataactaggtacgacatttgtatatacaagaataaaccttgcggtactctgggcctcgctcctgttgggggaatgtgtgaacgggagcgctcttgtagcgttaacgaggacattgggctggccactgcgttcaccatcgcacatgagatcggccacactttcggtatgaaccacgatggggtgggcaactcttgtggcgcccgcggccaggacccagcgaaattgatggccgcccatatcacaatgaaaacaaatccatttgtgtggtctagctgctcaagagattacatcacctcattcctggattcaggcttgggcctgtgtcttaacaatcggccaccaaggcaggactttgtctatcccacagtagctcctggccaagcttatgacgcagacgagcagtgccggtttcagcatggtgtaaaatccaggcagtgtaagtacggggaggtctgcagtgagctctggtgcctgtccaaatcgaacaggtgcattacaaacagtatacccgccgcggaggggaccttgtgtcagacccacacaattgataagggatggtgttataaaagagtctgcgtgcccttcggcagcagaccagagggagtggacggagcctgggggccctggaccccttggggggactgttccagaacttgcggcgggggggtttctagttctagtcgtcactgcgatagcccccgccctaccattgggggtaaatactgcctgggggaaaggcggcgccacagatcctgtaatacagacgattgccctcccggcagccaagatttccgggaggtgcagtgtagcgagttcgactcaatccccttccgcggaaagttctacaagtggaagacctaccgaggaggtggcgtgaaagcttgtagtctgacatgcctggcggaggggtttaatttctacactgaacgggccgcagcagtcgtggacggaaccccctgcaggccggataccgtggatatttgtgtgagtggcgagtgcaaacacgtgggatgcgatagggtgctcgggagcgatctgagagaagataagtgccgagtctgcgggggcgacggaagtgcatgtgaaacaatagaaggagtctttagccctgctagcccaggtgctggttacgaagatgtggtgtggatccccaaagggtcagtccacatcttcatacaggacctgaacttgtctctttcacacctcgcactgaaaggtgaccaggagtcgctgcttctggaggggctacccggtacaccccagccacatcgattgcctctggcgggcacaacatttcagctgcggcaagggcccgaccaggtgcagagcctcgaagccctgggtcccatcaacgcgagcctgatagtgatggtcctggctagaacagaattgcccgctctcaggtaccgcttcaatgctcccattgcccgggatagtctgcctccctacagctggcactatgcaccttggactaagtgctctgcccagtgcgccggggggagccaggtgcaggcagtggaatgcagaaaccaactcgactcgtctgccgtggccccgcactattgctcggcacactcgaagctgcccaagcgtcaacgagcttgcaacacagaaccctgtccgcctgactgggttgtgggcaactggtcactctgttcgcggtcgtgcgatgccggggtgaggagtaggagcgtggtgtgtcagcgccgcgtctccgcagcggaagagaaagccctcgatgacagcgcctgcccccagcccaggcccccggtgttggaagcatgccacgggccaacttgcccacccgagtgggcagctcttgattggagcgaggtgtctcggccactgccctccaggcccctcggatgcccaggcggcgtttcaaccgaaacacctctgaggggactgcaggtctcttgcccgttactgacctctcattggggatctacgctgagtacgaagaggccgttccagcttcagtgtacgccaagttgcggccctgggttgaggcaccgtgtggtcctctgtaaaagcgccgatcaccgcgctaccctgccgccagctcactgttcccccgccgctaagccccccgctacaatgcggtgtaacctgcgaaggtgtccccccgctagatgggtagccggcgagtggggcgaatgcagtgcccagtgtggagtgggacagagacagcgcagtgttagatgtacatcccacactgggcaggcatcccatgagtgtaccgaggcctag

SEQ ID NO: 107241 - DNA, 4530 bp, Artificial Sequence
  Description of Artificial Sequence: Synthetic coding sequence
atgccatgcgcacagcgtagctggctcgctaatctgagtgtggtggcccagttacttaatttcggcgcactatgctatggccggcagcctcagccaggccccgtaaggtttcccgaccgacgccaggagcacttcattaagggtcttccggagtatcatgtggtcggcccagtgagggtggatgctagcgggcatttcctctcctacggcctccactatcctatcactagcagccgtcgcaagcgggacctcgacggatccgaggactgggtctattatcggatcagtcatgaggagaaagacctttttttcaacctcactgtcaaccaagggtttctgtccaactcatacataatggagaaacgctatggcaatctgtcccatgtgaagatgatggcgtcctctgcacccctgtgccatctgtccgggaccgttctgcagcagggaaccagggtcgggaccgccgcactctcggcttgtcacgggcttaccggattctttcagctcccacatggcgattttttcattgaaccagtcaaaaagcatcctctggtggagggggggtaccacccccatatcgtgtatagaaggcagaaagtgcccgagacaaaagaaccaacgtgcggactgaaggattcggtcaacatcagccagaagcaggaactgtggcgtgagaaatgggaacggcacaatctgccgtcaaggagcttgtcccgacgctctattagcaaagaacggtgggtagaaaccctggtcgtcgccgacactaaaatgattgaatatcacggctccgagaacgtggagagctacatactcactatcatgaacatggtgacgggactgttccacaatcctagcattggcaatgccatccatatcgtcgtcgtgcggcttatcctccttgaggaagaagagcagggcctcaagattgtccaccatgctgagaaaacactcagctctttctgtaaatggcaaaagtccataaatcccaagagtgacttgaatcctgtgcaccacgacgtagctgtgctgctcactcgcaaagacatttgcgctggctttaataggccttgcgaaaccctgggcctgtctcacctgagcggcatgtgccaaccccatcgcagctgcaatataaacgaagatagcggcttaccactcgcttttactattgcccacgaactcggccacagctttgggatccagcacgacggaaaggaaaacgactgcgaacccgtagggcgccacccctatattatgtcgcggcagctccagtacgaccccactccattaacttggtctaagtgcagtgaggagtatattaccagattcctggaccggggctggggcttttgcctggatgatatcccaaagaaaaaaggtttaaagtccaaggtgatcgccccgggagttatctacgacgttcaccatcagtgccagctccagtatggtccaaacgctacgttctgccaggaggtggagaatgtctgccagaccctctggtgtagcgtgaaaggattctgcaggtccaagttagacgccgcagccgatgggacccagtgtggagagaagaagtggtgtatggcaggtaagtgtatcacagtaggaaagaagcctgagtcgatccctgggggatgggggcggtggtcaccttggtcacattgttcccgtacctgcggggctggcgtccagtcagcagagaggctttgcaataaccccgagcctaaattcgggggcaagtactgtaccggcgagcgcaagcggtatcggctgtgcaacgttcacccctgtaggtccgaggcccctacttttcggcaaatgcagtgcagcgagttcgacacagtcccctacaaaaacgagctctaccactggttccctatattcaatccagggtacgtcgacatcgggctcatccctaaaggagccagagacataagagttatggagatagaaggcgccggaaacttcctagccatcagatctgaagatcctgagaagtattacttgaatggcggattcatcatccagtggaacggcaattacaagctagcaggaaccgtgtttcagtacgatagaaagggcgatcttgaaaaactgatggctaccggcccaacaaacgaaagcgtctggatacagttgcttttccaggtgacgaatccaggcattaaatatgaatacactatccaaaaagacggactggataatgacgtcgaacagcaaatgtacttttggcagtatggacactggaccgagtgttcagtgacatgcggtacagggattagaagacagaccgcccattgtatcaagaaaggccgtggcatggtgaaggcgacattctgcgacccggaaacccagcccaacggccgacaaaaaaagtgccatgagaaggcctgtccaccaagatggtgggctggagaatgggaagcatgctcagccacctgcggacctcacggagaaaagaaacggactgtgttatgcatccaaacgatggtaagcgatgaacaggctctgccacccactgattgccaacacctcctcaaacctaaaacgctgctgtcttgtaatcgcgacatcctgtgccccagcgactggacagttgggaattggtccgagtgttccgtctcttgtggtggcggcgttcgcatcaggtctgtcacttgcgcaaagaaccacgacgagccctgcgatgtgaccaggaagcctaactcccgggccctttgtggcctccagcagtgtccttcctccaggagggtccttaagcccaataagggaaccatttccaacgggaagaatcccccaaccctgaaacctgtccccccacccacttccaggccccgaatgcttaccactcctaccggccctgagagtatgtccacctcaacaccagctatctcctctccaagcccaacaactgccagtaaggaaggcgaccttgggggtaaacagtggcaggactcctctacccagccagagttatcctctcggtatttaatctccaccggctcaacatcacagcctattttgactagccagagcttgagcatccagccaagtgaggagaacgtgtctagctctgacaccggcccaactagtgaggggggactggttgcgactacgacctcgggctctggactttcatcttcccggaatcctataacttggcctgtgacccctttctacaacactctgaccaaaggccccgaaatggaaatccacagcgggtcaggcgaagagagggaacaacccgaagacaaggacgagtcgaatcccgttatatggactaagatcagggttccggggaacgatgcacctgttgaatcgactgagatgccgctcgcacccccacttacccctgatctgtctcgggaatcctggtggcctcccttcagcacggtgatggaaggtttgctcccctcccagagaccaactaccagtgaaaccggtacgccacgggtggagggtatggtgacggaaaaacctgccaacacactgttacctctggggggtgaccaccagcctgagccatctggcaaaactgctaataggaatcacctgaagttacccaacaacatgaatcaaacaaagtcttccgaaccagtccttacagaagaggacgcgacgtcgttaatcactgaggggttccttctgaacgcgagtaattataagcagctaaccaacgggcatggtagtgcacactggattgtcggcaattggagcgaatgcagtacaacatgtggccttggggcatactggcggagggtcgaatgtagcacacagatggattctgactgcgcggcaatccagcgccctgatccagcaaaacgctgccacctgaggccctgcgcgggatggaaagttgggaattggtctaagtgtagccgtaactgtagtggtggattcaagatccgcgaaattcagtgcgtagacagccgcgatcacagaaatttgcgaccattccactgccagttcctggctgggatcccccctcctctaagcatgtcttgcaacccggagccctgcgaggcttggcaggtggagccatggtcgcagtgcagccgctcctgtgggggcggtgttcaagagcgcggcgttttctgccctgggggtctgtgcgactggaccaaaagacctacgagcacaatgtcatgtaatgaacatctctgttgtcactgggccactggcaactgggatttgtgttcaacctcatgtggcggtgggttccagaaaagaacagtccagtgcgtgcctagtgaggggaataaaacagaggatcaggaccaatgtctctgtgaccacaaaccccgcccgccagagttcaagaaatgcaaccagcaggcctgtaagaaaagcgctgatttgctgtgtactaaagataaactctccgcctcgttttgccagactttaaaagccatgaaaaagtgttcggttccaaccgtgagagcggagtgttgtttctcctgtcctcaaacccacatcacacatacccagcggcagcgcaggcagaggctgcttcagaaatccaaagaactgtag

SEQ ID NO: 107242 - DNA, 4785 bp, Artificial Sequence
  Description of Artificial Sequence: Synthetic coding sequence
atgccgtgtgcgcagaggtcctggcttgctaatcttagcgtcgttgcccagctcctgaattttggagccctgtgctatggcaggcagccccaacctggtccagtgagattccccgatcgccgtcaggagcacttcatcaagggactcccagaatatcatgttgtcggtcctgtccgggttgatgcctctgggcacttccttagttatggcctccattacccgattacatcctcccggcggaagcgcgatctggatgggagcgaggactgggtctactacagaattagtcacgaagagaaagatttatttttcaacttgaccgtgaatcagggcttcttaagtaattcctacataatggagaagagatacggcaatctgagccatgtgaagatgatggcttcctcagcaccactctgccatctgagcggaaccgtattgcagcaggggacccgtgtagggacggctgcgctctccgcgtgccatggactgaccggtttcttccaactgccacacggcgacttcttcatagagcctgtgaaaaagcatcctctggtggaaggcgggtaccaccctcatattgtttaccggcggcagaaggtgcctgaaacgaaagagccaacttgtggactaaaggattccgtgaacatttcacagaaacaggagttgtggagagaaaagtgggaacgccataaccttccatctcgcagcctctcaaggcggtccattagcaaggagagatgggtcgagacacttgttgtggcggatactaaaatgatcgaataccatggttccgaaaatgtggaatcctacatcttaacaattatgaacatggtaacaggactttttcataacccgtccattgggaatgctatacacattgtggttgtgagacttatccttctggaagaagaggaacaggggctgaagattgtgcaccacgcagagaaaactctgagttcgttctgcaaatggcagaaaagcatcaatcctaagagcgacctcaatcctgtccaccatgacgtggccgttttattaacccgaaaggatatctgtgcaggctttaaccggccatgtgaaactctgggtctgagccatttgtccggcatgtgccaaccccaccgcagctgtaacatcaacgaggacagcggacttcccctcgcctttaccatcgcgcacgagctggggcactcgttcgggatccagcacgacggcaaggaaaacgattgcgagcccgtcggacggcacccatatattatgagcagacagcttcagtacgaccctacgcctctcacatggtccaaatgctcagaggaatatatcacccgctttctagaccgcggatggggattttgtttagacgacatcccaaaaaaaaagggacttaaatcaaaggttatcgctccaggggtcatatacgacgtgcaccatcagtgccagctgcaatacggcccgaatgcaacattttgtcaggaagtggagaacgtatgccagacactctggtgtagtgtgaaaggcttctgtagatccaagctcgatgcagctgccgacggaactcaatgtggcgaaaaaaagtggtgtatggccgggaagtgtattactgtcggcaaaaagcctgaatccattccagggggctggggccggtggtctccttggtctcattgttcccgtacctgcggggccggggtacagtctgccgagagactgtgcaacaatcctgaaccaaagttcggaggaaagtattgtacgggagaacgaaagagatatcggctttgtaatgttcatccgtgcagatctgaagcccctacatttcgccagatgcaatgctctgaatttgacactgtgccatataagaacgaactgtaccactggtttccaattttcaatcccgcacacccatgtgagctgtactgtagacctatcgacggtcagttcagtgagaaaatgctcgacgccgtgatcgatggcacaccttgcttcgagggtggcaatagcagaaacgtctgcattaacgggatttgcaaaatggtgggttgtgattacgagattgactcgaacgccactgaggaccggtgtggcgtgtgtcttggagacgggtctagctgtcagactgtaagaaagatgttcaagcagaaggagggcagcggctatgtggatataggcctgatccccaagggggcgcgtgatattagggtgatggagatcgagggggctgggaatttcctcgcaataaggtctgaggatccagaaaagtactatctgaacggtgggtttatcattcaatggaatggtaattataagctagccggaacggtgttccaatacgaccgtaaaggtgatctggaaaaactcatggctactgggcctaccaatgagagtgtgtggatccagttgttgttccaagtcacaaatcccggcataaaatacgaatacaccattcagaaggatggacttgacaacgacgtggagcagcagatgtacttttggcagtacggacactggaccgagtgctctgtgacctgcggcactggtatacggaggcagacggcgcactgtataaagaaaggccggggaatggtgaaggcgacattctgcgatccggagacccagcctaacggcagacaaaagaaatgccacgaaaaggcgtgtcccccccggtggtgggccggagaatgggaggcctgcagtgctacctgtggcccacacggggaaaagaagaggacagtgctctgcatccaaacaatggtttcagatgaacaggccctaccacctacagattgtcaacacctcctgaagcccaagacacttctatcgtgtaatcgggatattttgtgtccttccgactggacagtaggaaactggtccgaatgcagtgtatcttgtgggggaggagtgcggattcgatcagtgacatgcgcaaagaatcacgacgagccttgcgatgtgaccaggaaaccaaacagtagggctctgtgtggactgcaacagtgtcctagctctcgtagagttctgaagcccaacaaggggaccatttctaacgggaaaaatccccctacgctcaaacccgttccaccccccacatctcgaccgcgaatgcttaccacaccaaccgggcccgagtctatgtcgacttccacgcccgccatctcgagtccatcccccactactgcatctaaagaaggggatctgggtggcaagcaatggcaggatagtagcacacaacctgaactctcatccagatacctcatcagtactggaagcaccagccagcctattttgacttcccagagcttgagcatccagccatcagaggagaatgtcagttcctccgacacggggccaacctctgagggcggtcttgtggctactaccactagcggatcgggactgtcatctagtaggaatccaattacttggccagtaacacctttttacaatacgctcactaaaggacccgaaatggaaatccacagtggatccggagaggaacgagagcagcccgaggataaagacgaatcgaatcctgtgatttggacaaaaataagagtgcccggaaatgacgcacctgtggaatctactgagatgccactcgcacccccgctcacgccggacctgtccagggagtcttggtggcctcccttcagcaccgtgatggagggccttctgccttcacagcggcccaccacatcagaaacgggaacaccaagggtcgaaggcatggtgacagaaaaaccagccaataccctgctgcctcttgggggcgaccatcagccagaaccatcgggtaaaacagccaatcgcaatcatttgaagctgccaaacaacatgaaccagacaaaaagttcggaaccagtgttgacagaggaggatgcaactagcctgatcactgagggtttcttactcaacgcctccaattataaacagctaaccaatggccacggcagcgcccactggatcgtggggaactggtcagagtgctccactacatgtgggttaggcgcatactggcgccgcgtagaatgctctacacagatggatagtgattgtgcagctattcaacggcccgaccctgctaagagatgccacttgcgtccctgcgccggatggaaagtaggtaactggagcaaatgttctagaaactgctcaggggggtttaaaatcagggagatccagtgcgtggattcaagagaccacagaaatctgagaccttttcactgccagtttctggcagggattccacctccactgagcatgtcctgtaaccccgagccctgcgaagcatggcaagtggagccttggtcccagtgctcacgatcctgcggagggggcgtgcaggaacggggtgtgttctgcccagggggtctgtgcgactggacaaagaggcccacaagcaccatgtcctgcaacgagcacctatgctgtcactgggccacaggcaattgggacctttgtagcaccagttgcggaggcgggtttcaaaagcggactgtgcaatgcgtaccaagcgagggcaacaaaacagaggatcaggaccagtgcttgtgtgaccacaaacctcgtcctccagagttcaaaaaatgtaatcagcaagcatgtaagaagagtgccgatctgctttgcactaaagacaaactgtcagcttcgttttgccagaccctgaaagctatgaagaaatgcagtgtgcctacggtccgagccgaatgttgtttctcttgccctcagacccacattacgcatacacaacgacaaaggagacagagactactgcaaaagtctaaggagctgtag

SEQ ID NO: 107243 - DNA, 699 bp, Artificial Sequence
  Description of Artificial Sequence: Synthetic coding sequence
atgccatgcgcccagagatcttggctggcaaatctgtctgtagtagctcaactcttgaacttcggcgcattatgctacggccgccagccacaaccaggcccagtcagattcccagaccgccgccaggaacacttcattaaagggttgcctgagtatcacgttgtaggacctgtgcgggtggatgctagtggacactttctatcttatggcttacactacccaatcacatcaagtagacgcaaaagggacctggacgggtcagaagactgggtgtattacaggattagtcatgaagaaaaagatctcttcttcaatctaaccgttaaccagggatttttatctaattcttacatcatggaaaagcgctacgggaacctttctcatgttaagatgatggcaagtagtgctccactttgccatctgtccggtacagtgctgcagcaggggaccagggtggggactgccgcattgtcagcttgccatggccttacagggtttttccagctgccacacggagatttctttattgagcccgttaaaaagcaccccctggtggagggcgggtatcatccccacatcgtttaccgtaggcagaaggtacctgagacaaaggaacctacgtgtggactcaagggtatcgtgacacacatgtcatcatgggtggaagagagcgtgcttttcttttggctcttctactag

SEQ ID NO: 107244 - DNA, 3675 bp, Artificial Sequence
  Description of Artificial Sequence: Synthetic coding sequence
atgaagccccgagcccgcggttggaggggactggctgccttgtggatgctcctggctcaggtggccgaacaagcccccgcctgcgctatggggccagccgccgcggctccaggctcccccagtgtccccagacccccgccgcccgccgagcgaccgggatggatggaaaagggcgagtatgatttagtgagcgcttatgaggtggaccatagaggagactatgtgtctcatgaaattatgcaccaccagcggaggcgacgggcagtgcccgtctctgaagtggagagcctgcacttgcgccttaaaggaagccggcacgactttcatatggatttgaggacgtcttctagcttagtcgccccagggttcattgtccagaccctgggaaagactggcaccaagtccgtgcagactttgccacccgaggatttctgcttttaccagggaagtcttagaagccacagaaattcttctgtggccttgagcacctgccagggcctgagtggcatgattcgtacggaggaggcagactattttctgcgccccctgcccagtcacttatcatggaagctgggcagggctgcccagggatcgtccccctcacacgttttatataagaggtcaaccgaaccccacgctccgggggctagcgaggtgctggtcacgtcaaggacctgggaattggctcaccagccactccactcatccgacctgcggctgggactcccccagaagcaacatttttgcggacggcgtaagaagtacatgccccagccccccaaggaggatctattcatcctcccggacgaatacaaatcatgtttgaggcataaacggtctttgcttcgctctcaccggaatgaagagcttaacgtcgagacactcgttgtcgtggataagaaaatgatgcagaaccacggacacgagaacatcaccacttatgtgctgacaatcctgaacatggtgagtgcgctttttaaagacggaaccatcggcggaaatattaatattgccatcgtcggcctcatcctgctggaagacgaacagccaggactcgtcatctcacatcacgccgatcacacactttccagcttttgtcaatggcagtccggattgatgggcaaagatgggacccggcacgaccacgcaatcctgctcaccggccttgatatttgttcttggaaaaacgagccttgtgacaccctggggttcgctcccattagcgggatgtgtagcaaatacagatcctgcacaataaacgaagatacgggactcggccttgcatttactatcgcacacgagtctggacataacttcggaatgatccacgatggggaagggaacatgtgcaaaaagagtgagggaaatatcatgtccccgaccctcgctggacgtaatggtgtcttttcgtggagcccatgctcccggcaatacctgcacaagttcttatcaacagcacaggcaatatgcttggccgatcaaccaaagccggtgaaggagtataaatacccagagaaattgcctggcgaattatatgacgccaacacgcagtgcaagtggcagttcggcgagaaagcaaagttgtgtatgctcgattttaaaaaggacatctgcaaggccttatggtgtcatcgcatcggacgcaagtgcgagacaaaattcatgcctgcagccgaagggactatttgcggacacgatatgtggtgtaggggtgggcagtgcgtaaagtacggcgatgaggggcccaaacccacacacggccattggtccgattggtccagttggtccccttgttcccgtacctgtgggggaggggtgtcccacagatcccggctctgtacgaacccaaaaccctcccatggaggcaagttctgcgaaggcagcacccgcaccctaaagctttgcaactctcagaaatgtccccgtgattcagtggactttcgggcagcacagtgcgctgagcataattctcggcgctttaggggccggcactacaagtggaagccgtacactcaggtagaggatcaggatttgtgcaagctgtactgcatagctgaaggcttcgatttttttttttctctaagcaataaggtgaaggatgggacaccctgcagcgaggattccaggaacgtgtgcatagatggtatctgcgagcgcgtggggtgcgataacgttttgggaagcgatgccgttgaagatgtgtgtggcgtttgtaacggtaacaacagcgcatgcaccatccatcggggcctttatacaaagcaccaccatactaatcagtattaccacatggtaacgatcccgagtggtgccagatcaatcaggatttatgagatgaacgtgagtacaagctatatatctgtgaggaacgccttacgaagatattacttgaatggacactggacagtggactggcccgggcgttacaagtttagtggcactacatttgactacagacgcagttataacgagccggagaacctaatagcaactggcccaacaaacgagaccctgattgtggaattactgtttcagggtaggaacccaggcgtggcatgggagtactcgatgccaagactgggcacagagaaacagccccctgcacaaccgtcctacacttgggccatcgtccgtagcgagtgcagcgtgagctgcggcggaggtcaaatgactgtaagagaggggtgctaccgcgatctgaagttccaggttaatatgtcattctgtaatcccaagaccagacccgtcacaggtttagttccttgtaaagtttccgcctgcccgccttcatggtccgttggcaattggtccgcctgttctcgaacctgtggcggcggcgctcaatcccgcccggtccagtgtacaaggcgcgtccattatgatagtgagcctgttcccgctagcttgtgtccccagcccgccccttcctcccggcaagcctgtaatagccagtcatgcccaccagcgtggtctgcaggaccatgggccgaatgctcccatacatgtggtaaaggctggcggaaacgcgcggtggcctgcaagagcaccaatcctagcgcccgagctcaactcctcccggacgcagtttgcacatcagagcccaagcccaggatgcatgaggcatgtctgctgcagaggtgccataagccaaaaaagcttcaatggctggtgagcgcttggtcgcagtgctctgtaacgtgcgagcgcgggactcagaagcggtttttgaagtgcgcggagaaatacgtgagcggaaagtaccgcgagctcgcaagcaaaaaatgcagtcatctcccaaagccgagcttagaacttgaaagagcatgtgcccctcttccctgcccaagacaccctcctttcgccgccgcaggccccagcaggggctcatggttcgctagcccctggtcccagtgcacagcctcttgcggcgggggcgtccagacccgaagtgtgcagtgtctcgcggggggtcggcctgcatccgggtgtctgctccatcaaaagccttctgccagcctggcttgcaacactcacttttgtccgatcgcagaaaaaaaggacgccttctgtaaagactactttcactggtgctatctggtgcctcagcacgggatgtgttcacacaaattttatggcaaacaatgttgtaagacatgctcaaagagtaacctgtag

SEQ ID NO: 107245 - DNA, 2787 bp, Artificial Sequence
  Description of Artificial Sequence: Synthetic coding sequence
atgaagccacgagcaagaggctggcgcggactggccgctctgtggatgcttctggcgcaggtggctgagcaagctcctgcgtgtgctatggggcctgccgccgcagcccctggttctccctctgtgcccagacccccaccgccagctgaaaggcctggttggatggaaaagggggagtacgatctggtcagcgcatatgaagtggaccacagaggggattacgtgtcacatgaaattatgcaccaccaaaggcggcggagggcagtgccagtaagcgaggttgagagcctccaccttcgcttgaaaggtagtaggcacgacttccatatggatctccggacctcctcctccttagtcgctcctggtttcattgtgcagaccctcgggaaaaccggtaccaaatcagtgcagaccctccccccagaagacttctgcttctaccaagggtccttgaggtcccacagaaactcatcagtcgctctgtcaacttgccaggggctgtcaggcatgatacggacagaggaagcggattattttctgaggccccttcctagccacctatcatggaaactgggcagagctgcacagggcagctctccatcccatgtcctgtataagcggagcaccgaacctcacgcccctggagcaagcgaggtactggtgaccagtaggacgtgggaactcgcccaccaaccactgcactccagcgatctgcggttgggcctcccacaaaaacagcatttctgcggccgtaggaaaaaatacatgccacagcctcccaaagaggacctctttatcctgcctgatgaatataaaagctgcctccggcacaagaggtcactgctcaggagccaccgtaacgaggaactgaatgttgagactttagtggtggtcgataaaaaaatgatgcagaatcacggccacgaaaacatcaccacatacgtgctcacgatactcaatatggtgtcggccctgttcaaagacggtacaatcggcggcaatatcaatattgcaattgttggcctgatccttctcgaggacgagcagcctggcttagtgatttcacatcatgctgatcatacgttgtcatccttttgtcagtggcagagcgggcttatgggcaaagacggcaccaggcatgaccacgctatcctgctcaccggactggacatctgtagctggaagaatgagccttgcgacacactgggctttgcccccatcagcggaatgtgttcaaagtatcgtagttgcactattaacgaagatactggactgggtctagccttcaccatcgcccacgaatctgggcacaactttggcatgattcatgacggtgaagggaatatgtgtaagaaatctgaggggaacatcatgtcacccactctggcagggcgcaacggcgtctttagctggagtccctgttccagacagtaccttcataagtttttgtctaccgcccaggctatctgcctggccgatcaacccaagccagtaaaggagtataagtatccagaaaagctgccaggggaactgtatgacgcgaacacccagtgtaaatggcaatttggggagaaggctaagctatgtatgctcgattttaagaaagacatatgcaaagccctctggtgtcaccgcatagggagaaaatgtgagaccaagtttatgccagctgccgaaggaaccatctgtggacacgatatgtggtgtcggggcgggcagtgcgtgaagtatggagacgagggaccgaaaccaacccacggccactggagtgactggtccagctggagcccctgttctagaacttgcgggggaggagtgtcccatcgatccaggctttgtactaatcctaagccatcacacgggggcaaattctgtgaaggctctacacgtacactcaagctgtgcaactcccagaaatgcccacgagactctgtggactttagagctgcccaatgtgccgagcacaactctcggcggtttagaggacgccactacaagtggaagccttatacccaagttgaggatcaggatctgtgcaagctatactgtatagccgaaggtttcgatttcttctttagtttgagtaacaaagtgaaggacggtactccctgctccgaggatagtcggaatgtgtgtattgacgggatctgtgaaagggtgggttgtgacaatgtgctcggttccgatgctgtagaggatgtctgcggagtgtgcaacggtaacaacagcgcttgtacaatacatagaggattgtacaccaagcaccatcacaccaaccagtactaccacatggttaccattccgtcaggtgcccggtcaatccgcatctacgagatgaacgtgtctacctcttacatttccgtaaggaatgctctccggaggtattacctgaacggccactggaccgtcgactggcccggaaggtataaatttagcggcaccacgtttgactaccgcaggtcatataacgaacccgaaaatctgatcgctactggcccaacgaacgaaaccctgattgtagaactgctgttccaaggtaggaatcccggagttgcctgggagtactcgatgcctcgtttaggaactgaaaaacagccgcccgcccaaccaagctatacctgggcaattgtcagaagcgagtgctccgtcagctgcgggggtgggcagatgactgtgcgagaaggatgctatcgggactttttatattttatgttctatctgagtcagttatttgcctccgagtgccccttcaaaaatacactgctgcacgcttttctctgcaagtag

SEQ ID NO: 107246 - DNA, 3288 bp, Artificial Sequence
  Description of Artificial Sequence: Synthetic coding sequence
atgtgcgacggcgcccttctcccgcccctggtgctgcccgtgctgctgcttcttgtgtgggggcttgaccccggcacagcagttggcgacgccgccgccgacgtagaagtggtgttaccatggagagtgcggcccgatgacgtgcacttgccaccgctgcccgcggcacccggacctagaagaaggagacggccccgcactcccccagccgctccaagggcgagacctggcgaacgagctctgcttctgcacctgcctgccttcggccgagatttatatctccaattgcgaagggacctgaggttcttgagcagagggtttgaggttgaggaagccggcgccgcgagacgtcgcggccgccctgctgagctatgtttctactccggtcgggtgctcggacatccggggtcactggtctccctgagcgcttgcggagccgctggggggctggtggggctgatccagctggggcaggagcaggtgctcatacagccactcaacaattcccagggcccattctctggcagggagcatttaatccggaggaaatggtccctaacaccttctccttctgccgaagcgcagaggccggagcaactgtgcaaagtgctgacagagaagaagaagccaacttggggtaggccgtcccgtgattggagagagaggcggaatgctatacgattgacctccgaacatacagtagagacacttgtggtagccgacgccgatatggtccagtatcacggggccgaggccgcccagcgtttcatattaaccgtgatgaacatggtgtacaacatgttccagcatcaatctctaggcataaaaataaacatccaggtgacaaagttagttctgctgcgccagcgaccagccaagctatcaattggtcaccatggcgaaagatcactcgaatccttttgtcactggcagaacgaagaatatggcggcgccagatatttggggaacaaccaggtgcccggggggaaagacgatccaccactggttgacgcagccgtttttgtgacacgcaccgatttctgtgtccataaggacgagccgtgcgacactgtgggtattgcgtatctaggtggcgtctgtagtgctaagcggaagtgcgtcctggcagaagataatggtctcaacctggctttcacgattgcccatgagctggggcacaacttgggcatgaatcacgatgacgaccattcctcttgcgcgggaagaagtcacataatgtctggcgaatgggttaaggggcgtaatccgtccgatttgtcgtggtccagttgttctcgggatgatctagagaatttcctcaagagcaaagtcagtacctgcctcctggtaactgaccctcgaagccagcacaccgtgcgccttccccataagctcccgggaatgcattacagtgctaatgagcagtgtcagatactgttcggtatgaatgccaccttttgccggaacatggaacaccttatgtgcgccgggctctggtgtctggtggagggtgatacctcttgtaagacaaaacttgaccctcctctggacggaacggagtgcggagcagacaaatggtgccgggcgggtgaatgtgtgtctaagaccccgattcccgaacacgtagacggagactggagtccgtggggcgcctggagcatgtgctccagaacgtgcggaaccggtgcgcgctttcgacagaggaaatgcgataatcctccgccaggccccggtggtactcactgccctggcgccagtgttgaacatgccgtgtgtgaaaatctgccatgcccaaaaggattgccctcctttagagaccagcagtgtcaggctcacgatcgcttatcaccgaaaaagaaggggctccttaccgccgttgtcgtggacgacaaaccatgcgagctctactgttccccacttggaaaggagagtcccctcctagtggctgatagagtcctcgacgggacgccttgtggcccatatgaaaccgatctttgcgtgcatggcaagtgtcagaaaattggatgcgatgggatcataggctccgccgccaaagaggacaggtgtggtgtatgtagcggcgatgggaagacttgtcacttggtgaagggagatttcagccacgccagaggcactgcacttaaggacagtggcaagggatctatcaactctgactggaagatagagctacccggagagttccagattgcagggaccactgtcaggtacgtcaggcgcggactgtgggagaagatcagtgcgaaggggcctacaaaactgcctctccatcttatggtgctgcttttccacgaccaggattacggaatacactacgaatatacggtgcccgtaaacagaactgctgaaaaccagtctgaaccggaaaaaccacaggattctctatttatttggactcactcgggatgggaaggatgttccgttcaatgcggaggtggggaaaggcgcaccatcgtgagctgtacaagaattgttaacaagacaacaactctggtcaatgatagtgactgcccacaggcctcaaggcccgagccacaggtaagacgctgcaatctgcatccatgccagagcagatgggtggccggcccctggtcaccttgctccgctacctgcgaaaagggttttcagcaccgcgaggtaacgtgtgtttatcagctgcaaaacgggacacacgttgcaacaagacctctgtactgccctgggccacgccctgccgccgtgcaatcctgcgaaggtcaggactgcttgtctatttgggaagcgtcagagtggagccagtgctctgccagctgtggaaagggggtctggaagcggacagtggcttgtaccaattcgcagggcaaatgcgatgcttctactcgccctcgggcagaggaggcctgtgaggactactctgggtgctatgaatggaaaactggtgactggtctacatgctctagcacctgtggtaaggggttacagagtagggtggtacaatgcatgcataaggtcactggcaggcatggctccgaatgtcccgccctcagtaagccagctccataccggcagtgttaccaggaagtttgcaatgacaggataaacgccaacacaataacttctccccgcttagctgcactgacttacaagtgcaccagagatcagtggaccgtttactgtcgggtaatccgcgaaaagaacttgtgccaggacatgcggtggtatcaacgatgctgtcagacatgcagggatttctatgcgaataagatgcgccagcctccaccaaattcgtag

SEQ ID NO: 107247 - DNA, 3666 bp, Artificial Sequence
  Description of Artificial Sequence: Synthetic coding sequence
atggaatgcgcccttctgttagcttgtgcgttcccagccgccgggagcggcccgcctcgcggcttggccgggttaggtcgagttgccaaagccctgcagctgtgttgtctatgttgtgcgtccgttgccgctgccctcgcatccgacagcagctcaggcgcatcggggcttaatgacgactacgtcttcgtcactcctgttgaggtcgatagtgccgggagttacataagtcatgatatcctgcacaacggacgaaagaagaggagcgcacagaatgccaggtcctctctgcactatagatttagtgctttcggacaggagctccacttggagctcaaacctagtgctattctctcttctcactttattgtacaggtcctcggtaaggacggcgcatctgaaacgcaaaaacccgaagtccagcagtgtttctaccaagggttcattcggaacgactcctcatcttccgtagccgtaagcacatgtgccggcttgagcggcctgattagaacaagaaagaacgagttcctgattagtcccctgccccagttgctggcccaggagcataattactcatctcccgctggccatcacccacacgtgctatacaagcgcaccgcagaggaaaaaatccagcgctataggggctaccctgggtccggtaggaactatcctggctattctccctcacacattcctcatgcctctcaatccagagagaccgaataccaccaccgtaggcttcagaaacagcacttttgcggacgacgcaaaaaatacgccccaaaacctcctacagaagacacatacttaaggttcgatgagtatggatcatccggtcgtcctaggcggagtgcgggcaagagtcagaaaggcctcaacgtggagacgcttgtggtagccgacaagaaaatggtggagaagcatggaaagggcaacgtcactacttacattttgacagtgatgaatatggtatccggactattcaaggatggcaccattggatcagatatcaacgttgtcgtcgtgagcctgattctactggaacaggagcctgggggtctgctgatcaatcaccatgctgatcagagtctcaattctttctgtcagtggcagtccgcgttgattgggaagaacggcaagaggcacgaccatgctattctgctgacagggttcgacatctgttcttggaaaaacgagccatgcgacacgctgggcttcgcccccatctccggtatgtgttctaagtaccggtcttgtactatcaatgaggacaccgggttgggcctagctttcaccattgcccacgagagtggccacaacttcgggatgatccacgacggtgagggaaatccctgccgtaaggcggagggaaatattatgagtcccacgctaaccggaaacaacggcgttttttcctggtccagttgctcacgtcagtacctcaaaaagtttctcagcactcctcaagcgggttgccttgtggacgagccaaaacaggcagggcagtacaagtatccagacaaactcccgggacagatatatgatgctgacacacagtgtaaatggcagttcggagcgaaagcgaaactctgctcactcgggtttgtcaaagacatctgtaagagcctgtggtgtcacagggtaggccacaggtgcgagaccaaattcatgcctgccgccgaagggacagtctgcggtctgagcatgtggtgtcggcaaggtcagtgtgtgaagtttggcgaactggggccacgtcctatacatggtcagtggtccgcctggtcaaagtggagcgagtgcagtcggacctgtgggggaggcgttaaatttcaggagagacattgcaataatccaaagccacagtacggaggtctcttttgtcctggctcctcaagaatatatcagctatgtaacatcaatccatgcaatgagaattctctcgattttagggcacagcagtgcgctgagtataattccaagccttttcgcggctggttctaccagtggaaaccctataccaaagttgaggaggaggatagatgcaaactctactgcaaagctgagaacttcgaattttttttcgccatgagcgggaaagtgaaggacgggacaccttgctctcctaataaaaatgatgtgtgtatcgatggggtgtgcgagctcgttggatgcgaccacgaactgggctcaaaggcagtgtctgacgcgtgtggtgtctgcaaaggggacaactctacatgcaaattctacaagggcctctacctaaaccaacacaaagccaatgagtattatccagttgtcctcatccctgctggagcacgctcgatcgaaatccaggaactccaagtcagttcgagttaccttgcagttcgctccctttcacaaaagtactacctgactgggggatggtcgattgactggccaggcgagtttcctttcgccggaacgacctttgagtaccagcggtctttcaacagacccgaaaggctgtatgcaccggggcccacaaatgagacactcgtgtttgagatattgatgcaaggtaagaacccaggaatcgcttggaaatatgcactgcccaaagtgatgaacggcacaccacccgccacaaagcgcccagcatacacttggagcattgtgcagagtgaatgcagtgtgtcgtgtggcggtggctatattaacgtgaaagctatttgtctgagggaccagaacacccaagtgaattctagcttctgcagcgctaaaacaaaacctgtgactgagcctaaaatctgtaatgcattcagctgtccagcctattggatgcctggcgagtggagtacatgctcaaaggcctgtgctggaggacagcagagcaggaagatccagtgtgtgcaaaagaagccttttcaaaaagaggaagcagttcttcattctctgtgcccggtatcaacccccacacaggttcaggcctgtaattctcatgcctgtccgcctcagtggagtctgggcccctggtcccagtgttctaaaacttgcggtagaggagtccggaagcgcgaactcctgtgtaaaggcagtgccgcggaaacgctgccagaaagccagtgcacaagtctgccccggccggagcttcaagaaggttgcgtgctggggcggtgtccaaaaaacagccggctgcagtgggtagcttctagttggtcagagtgttctgcaacgtgtggactgggcgtcaggaaacgagagatgaagtgcagtgaaaaagggtttcagggcaagctgataacctttcccgagcgccggtgcagaaacattaaaaagcctaatcttgacctcgaggaaacatgcaaccgtagagcctgcccagcacaccctgtttacaacatggtggcaggttggtactccctgccctggcaacagtgcacggtcacctgtggagggggcgtccaaactcggtcagttcactgtgttcagcaggggcgccccagctctagttgtctgctccatcagaagcccccggtgttgcgggcctgtaacacaaacttctgccccgccccggaaaagcgggaggatccaagctgtgtggatttttttaactggtgtcatttggtcccgcagcacggagtgtgcaaccataagttttacggcaaacaatgttgcaagtcctgtacaagaaaaatttag

SEQ ID NO: 107248 - DNA, 825 bp, Artificial Sequence
  Description of Artificial Sequence: Synthetic coding sequence
atggaatgcgcccttctcttggcgtgcgcttttcccgcagctggttcaggacctccacgggggctagccggtctgggcagagtcgctaaagcactacagctctgttgcctgtgctgcgcgagcgtggcagctgctcttgcctccgactcctcctctggggcttccggactgaacgatgattacgttttcgtcacgcctgtagaagtcgatagcgccggatcctatatttcccacgacattctgcacaatggaagaaagaagcgctcagctcaaaatgcaagatcctctttgcattacagattcagcgccttcgggcaggagcttcacttggaactaaaaccatcagcaattctgtcttcacacttcattgtgcaagttctggggaaagacggcgcctccgaaacccagaagcccgaggtgcaacagtgtttctaccaaggcttcattcgtaacgactcatctagttcagtggctgtcagcacatgtgccgggctgtccggactaatcaggacacggaaaaatgagtttttgattagtccactgccccagttgcttgcccaggagcacaactactcctcccctgccggccaccatccccacgtcttgtacaagcgtacggcagaggagaagatccagaggtaccgcggatatccagggtcaggtcgcaattaccctggatatagcccgtctcatataccacacgcctctcagtcccgcgaaactgaataccaccatcggcgtctgcagaaacagcacttctgtgggcgacgaaagaagtgcatatgtagccaggcgagccacagaggtcatctgtccaaagtttag

SEQ ID NO: 107249 - DNA, 3636 bp, Artificial Sequence
  Description of Artificial Sequence: Synthetic coding sequence
atggatcctcccgctggggccgcccgcaggctgctttgtcctgcattgctgcttctgctcctgctgttgcccccaccgttgttaccacccccccctcctccggccaacgctaggctggccgctgctgccgatccgcccggcgggccgctggggcacggcgcggaacggatcctagctgtgcctgtgcgtacagacgctcagggccggttggtgtctcacgtggtctcagctgcaaccagccgagccggggtcagagccaggcgcgctgcaccagtgaggacacccagctttcctggggggaatgaagaggagcccggaagtcatctgttctacaatgtgacagtgttcggtcgagatcttcatctccggctgagacctaatgcaaggctcgtggcccctggcgctactatggagtggcagggcgaaaagggcaccaccagagtcgagcctttgctggggtcctgcttatacgtgggcgatgtggctgggctggcagaggccagctcagtcgctctgtcgaactgtgatgggctggcgggactgattcggatggaggaagaggagttctttattgaaccactggaaaaaggactggccgctcaagaggctgagcagggccgggtccatgttgtgtatcggcgacctcctacaagtccacccctgggaggtccacaagccttagacacaggcgcgtctctagacagtttggactcactgtcccgggcgctgggagtcctggaggagcatgcgaactcctctagacgccgcgcacggaggcacgctgctgatgacgattacaacattgaagtgctgttgggcgtagacgacagcgttgtacagtttcacggaaaagaacatgtacagaagtatctcctcacattaatgaatattgtgaacgagatttaccacgacgaaagcctcggggcccacattaacgtggttcttgtgagaatcatcctgctgtcttatgggaagagcatgagcttgattgagattggtaatccctcccaaagtctggagaacgtatgccgctgggcatatctgcagcagaagcccgatactggtcacgatgaataccatgaccatgccattttcctaacaaggcaggattttggcccaagtggaatgcagggatatgcacccgttaccgggatgtgtcaccctgtgagaagctgtacgctgaatcatgaggacggcttctcttcagcgttcgtggtggcccacgaaaccggacacgtactggggatggaacacgatggccagggaaaccggtgcggtgacgaggtgagactcgggtctatcatggctcctctggttcaggccgcatttcatcgcttccactggagcaggtgttcacagcaggagctttcaaggtatcttcacagttacgactgtctcctcgacgacccgtttgcacatgattggcccgccctgccccagcttcccggtctgcactacagcatgaatgagcaatgtcggttcgactttggccttgggtatatgatgtgtacggcattcaggacatttgacccttgtaaacagttgtggtgctcacaccccgataatccctacttttgcaaaacaaagaagggcccgcccctggacgggactatgtgtgcaccaggcaagcattgctttaaaggccattgtatttggctgacccctgacattctgaaacgtgatggtagttggggcgcctggtctcctttcggaagctgcagccgtacctgtggaacaggagtgaagttccgcacccgccagtgtgacaatcctcatccagctaacggaggtcgcacctgctccggacttgcctatgactttcagctatgttcgcgacaagactgtccagactccctggctgacttcagggaggagcaatgtcggcaatgggatctatactttgaacacggggacgcccaacatcactggctgccccacgagcatcgggacgcaaaggagagatgccacctgtactgcgaatcccgcgagaccggagaagttgtgagcatgaaaaggatggtgcacgatggcacacgttgctcatacaaggatgccttctctttgtgcgtgcggggcgattgcaggaaggtggggtgtgacggggtcatcggctcttctaagcaggaagacaaatgtggcgtctgcggaggtgataacagtcactgtaaggtggtgaaagggacctttactcgctccccaaaaaaacacggatatatcaagatgtttgagatcccggccggcgccaggcacctcctgatccaggaagttgacgcaaccagccatcacctggccgtgaagaaccttgagacaggcaagttcattttaaatgaggagaacgacgtggacgcaagttctaagacttttatagctatgggagtcgaatgggaatatcgcgacgaagacggccgggagactctccagaccatgggccctctacacgggacaatcaccgtcctggtcattcctgtgggggatacaagggtctcactgacctataagtatatgatacatgaggatagcctgaacgttgacgataacaatgtactcgaggaggatagcgtggtttacgagtgggcgttaaaaaagtggagtccctgtagcaagccctgcggcggtgggtcccagtttaccaaatacggctgcagacgacggctagaccataaaatggtgcaccgcggcttttgtgctgccctgtccaagcctaaggctatcagaagggcttgcaacccccaggaatgctctcaacctgtctgggtgaccggtgaatgggaaccttgttctcaaacctgcggcaggacaggaatgcaggtgcggtctgtcagatgtattcagcctttgcacgacaacaccactcggtcagtgcatgccaaacactgcaatgatgcacggcccgaatcgcgcagggcctgctcccgggaattatgccccggcaggtggagagctggaccatggtctcagtgcagcgtgacatgcggaaatggaactcaggagagaccagtgctgtgtcgcaccgctgacgactcatttggtatctgccaggaggaacggccagagacagcaaggacgtgtcgcttaggcccgtgtccgcgtaatatctcagatcccagcaagaagtcttacgtggtgcagtggctgtcaagacctgacccagattccccaattcgtaagatcagctcgaagggccactgtcagggagacaagtccattttttgtaggatggaggttctttccaggtattgtagcatcccagggtataataagctgtgttgtaagagctgcaacctctacaataacctgactaacgttgaaggccggattgagccccctccgggcaagcataatgatattgatgtgttcatgcctacactgcctgttcccacagttgcgatggaggttcggccttcacccagcaccccattggaggttccactaaacgcctcctccacgaatgccacagaagaccatcctgagactaatgcagttgatgagccctataaaatccacggcctcgaggacgaggtccagccaccaaacctgattcctagacgtccctctccttacgaaaagaccaggaaccagaggatacaggaactcatcgatgagatgcgaaagaaggagatgcttggaaagttctag

SEQ ID NO: 107250 - DNA, 1701 bp, Artificial Sequence
  Description of Artificial Sequence: Synthetic coding sequence
atggacccacccgccggcgccgcccgtagattgctctgccctgctctgctcctgcttttgctgctgctgccccctccactgttaccacctcctcctccccctgcaaacgccaggctggccgccgcggccgacccaccaggcggcccgctaggtcatggcgcggaacgaattctagcggtcccagttagaacggacgcccagggccgtctcgtctcacacgtggtgagtgcggccacttcaagggcgggggtgagagccaggagagctgccccggttcggactccctcctttccaggcggaaacgaagaggaaccgggatcccacctcttctacaatgttacggttttcggcagggatctgcatttacggttgaggcccaatgcgcgcctggtcgctcccggagctacaatggagtggcagggggagaaagggaccactagggtggaaccactcctcggcagctgcttgtatgtaggagatgttgctggactcgccgaagccagctccgttgcgctctcaaactgtgacggcttagcaggcctgattcggatggaggaggaagagttcttcatagagcctctcgaaaagggtctcgctgcccaggaagcggagcagggaagggtgcacgttgtgtatagacgaccccccacaagccctccattagggggaccacaagccctggacacaggggccagcctagacagcctggattccctgtcccgagcattgggtgtcctcgaagagcacgccaactccagtcggcgacgcgcgaggcgccacgctgcagacgatgactataacatagaggtactgctgggggtggacgattctgtcgtacagtttcacggtaaggagcacgtgcaaaagtatctcctgactctgatgaacatcgtgaatgagatctaccacgacgagtcactgggtgcacacatcaatgtggtgctggtgcgaatcatccttctgtcatacgggaaaagtatgtcattaattgagattgggaacccttcccagagtctggagaatgtgtgtcggtgggcctaccttcagcagaagcccgatactggccacgacgagtaccatgatcacgccattttcctaacgcgacaggattttggacccagcggaatgcagggatacgcccctgtgaccggaatgtgccaccccgtgcgctcatgtactttaaaccacgaagatggcttctcatccgccttcgtggtcgcacatgaaactggccatgtgctggggatggaacacgatggacagggcaatcggtgcggcgatgaggtgcgccttggcagcatcatggctccactggtccaggcagcgtttcatcgcttccattggagtcggtgctcccaacaggaactgtccaggtatctgcacagttacgattgcttactagacgatcctttcgcccacgattggcccgccctaccacaactgcctggtctccattacagcatgaatgaacagtgtcggtttgatttcgggctcggatatatgatgtgcaccgcgtttcggacttttgacccttgcaagcagctctggtgttcacatccggacaatccctatttctgtaaaactaaaaaggggccgcctctggacggaaccatgtgcgcaccaggcaagttccggccaggtgcagtggctcacgcttgttacccttccacccttgggggccagggccggtggattgcatag

SEQ ID NO: 107251 - DNA, 4515 bp, Artificial Sequence
  Description of Artificial Sequence: Synthetic coding sequence
atgtgggtggcgaaatggctgacaggcttgctgtaccacctctcactgttcatcacccgctcatgggaggttgatttccacccgaggcaggaggctctggtgaggactctgacctcctacgaggtggttatcccagagagagtcaacgaatttggcgaggtgttcccccaaagccatcacttttcacgacagaaaaggagctcagaggctcttgaaccaatgccatttagaacccactacaggtttacagcatacgggcagttgttccagctcaacctcactgctgacgcctcctttttagctgcaggctacactgaggtacacctcgggactcctgagcgaggagcttgggaatccgacgccggtccttcagaccttagacattgtttctatcgaggccaagtaaacagtcaggaagactataaggcggttgtgagtctctgtggtgggctgactggaaccttcaaagggcagaacggtgagtacttcttagagccaatcatgaaagccgatggtaatgagtacgaggacggccacaacaagcctcacctgatctaccgccaagacctgaacaactcatttctgcagacactgaaatattgctctgtgtccgagagtcagatcaaggaaacttccctcccgtttcacacttatagcaacatgaacgaggacctcaacgttatgaaagagagagtactagggcacacctcaaagaatgtgccgctgaaggacgagcgtcgccatagtaggaagaaacgccttatatcttaccctagatacatcgagatcatggttactgctgacgccaaggtggtttcagcccatggctctaatctgcagaactacattttgaccctaatgtctatagtagccaccatatacaaagaccccagcattggaaatttaatccacatagtggtggtcaaactggtgatgattcatagagaagaagaaggacctgtaattaactttgacggggccactaccctgaagaatttctgttcctggcaacaaacgcagaacgacctggacgacgttcatcctagccatcatgatactgccgtactgataacacgcgaagacatatgctcctctaaggaaaagtgcaacatgctgggcctctcttatttaggtacgatatgtgacccccttcagagctgtttcataaatgaggaaaagggactgatttcggccttcacgatcgcccatgagctaggccacacattgggggtgcaacacgacgataatccacgctgcaaagagatgaaagtgacaaagtaccacgtgatggccccagcactgagctttcacatgtccccctggtcttggagcaattgtagtcgcaagtacgtgaccgagttcctggatacaggctatggagagtgcctgctggataagccagacgaggaaatctacaatctcccctctgagcttccaggatcccgatatgacggaaacaagcagtgcgagttggcgttcggccctgggagccaaatgtgcccacacattaacatctgcatgcatctgtggtgcacttccactgaaaaactgcataaagggtgtttcacacagcatgttcccccagctgatggaacagactgcggcccaggcatgcactgcagacacggactctgcgtgaataaagagacggaaacccgaccagtgaatggggagtgggggccgtgggagccttactcgtcatgttcccggacctgtggaggcggcattgagtctgccactcgtcgttgcaaccgaccagagccacgaaatggcggaaactactgcgtcgggcgacggatgaaattccgttcttgcaacactgactcctgtcccaaaggcacccaggattttcgggaaaagcagtgcagcgactttaatggtaaacacctggacatcagcggcattccgagcaatgtgcgatggctgcctcgctattctgggatcggcactaaggatcgatgcaagctctattgccaggtggccggcacaaactatttctacctgctcaaagacatggtcgaggatggaacaccctgtggaaccgaaagctacaatatcgactgtaattgtgtgctgaaggcagcaggatgcgaccacgtgctcaactcctcggcaaagattgacaagtgcggcgtctgtggaggggacaactcttcgtgtaagaccattacaggagtgtttaacagctctcattatgggtataacgtggtcgtgaaaatacccgctggggccactaatgtcgatatccgacaatatagctactccggtcaaccagacgatagctatctggctctatctgacgcggaagggaatttccttttcaatgggaacttccttttgtctactagcaaaaaagagatcaacgtgcaaggaactagaacagtcatcgagtactcaggctccaacaatgccgtcgaaaggatcaattctacaaataggcaggagaaagaaatcctcattgaggtcttatgcgtgggcaacctttacaatcctgatgtccactattcattcaatatccctttagaagagagatccgatatgtttacgtgggacccatacggtccatgggagggatgcacgaagatgtgccagggccttcaaaggcgaaacatcacttgtatacacaaaagcgatcacagtgtggtcagcgataaggaatgtgatcatttacccctgccatcttttgtaacccagtcctgtaataccgactgcgagcttcgctggcatgtcatagggaagtcggagtgttccagccagtgcggccagggctataggaccctggacatccactgtatgaagtatagtatccacgaaggtcaaacagtccaggtggacgaccattactgcggagaccagttgaaaccaccaacccaggaactgtgccatggaaattgcgtgtttaccaggtggcattatagcgaatggagtcagtgttcacgctcctgcggtggcggcgagcgctctcgggagtcctattgtatgaacaatttcgggcatcgcctggcagataatgaatgtcaggagctgagcagagttactcgagagaattgtaacgagtttagttgtccctcttgggcggcctctgaatggagcgaatgtctcgtgacgtgtggtaaggggacaaaacagaggcaagtttggtgtcagttgaacgtggaccacctctcagacggattttgtaattcttccacgaagcctgaatctctgagcccctgcgaacttcacacttgcgcctcatggcaggtgggtccttggggcccctgtacaactacttgtggccatgggtaccaaatgagagatgttaaatgtgtcaatgagcttgcaagcgccgtgctcgaggataccgagtgtcatgaggctagccggccttccgatagacagagctgtgtgctgaccccctgctcatttatcagtaagctggaaaccgccctgctgcccacggttcttattaaaaagatggcacagtggcgccacggaagctggacaccctgcagtgtaagctgtggaagagggacccaggcccgctacgtcagttgcagggatgcgcttgaccgaatcgctgacgagtcatattgtgctcatctcccaaggccagccgaaatttgggattgctttaccccatgcggcgagtggcaagcaggcgactggagtccttgttctgcaagctgtgggcacggcaagacaacccgccaagtgctgtgcatgaattaccaccaacctatcgacgagaactactgtgatccagaagtccgccccctgatggagcaggagtgctctctggccgcttgcccccccgcccatagccatttcccaagctcccctgtgcagccctcctattatctgtctaccaaccttccgcttacgcagaaactggaagacaatgagaaccaggttgtgcacccatcggtgcggggaaatcaatggcggacgggcccatggggtagctgctcctcttcgtgctcagggggactgcaacaccgggcagttgtttgccaggacgagaatggccagtcagcgtcctactgcgacgcagcgagcaagccccctgagctgcagcagtgcgggcccggcccctgccctcagtggaattatggcaactggggagagtgcagccagacttgcggcggtggcataaagtcaagactggtcatttgccagttccccaacgggcagatcctggaagaccataattgtgagatcgtgaataaacccccgagcgtgatccagtgccacatgcatgcctgcccagccgacgttagttggcaccaggaaccttggacctctgaagacttgaaagtcaaacttttaccccagaggaccataatactgtgggagttgatgaagaatattttctgtcacgggaagcacagtcatatgtacctgatcaacgtcgtaacagatcatctcttatacccacgtcactgcgaccccgagactatcgaaacctacttcttgagtctgtggtccctgcagtttacctggggcgatctgaagtattacaagaatagtctctag

SEQ ID NO: 107252 - DNA, 5733 bp, Artificial Sequence
  Description of Artificial Sequence: Synthetic coding sequence
atgtgggtcgccaagtggctcacgggtcttttgtatcacctctctttgtttattacgcgatcctgggaggtggacttccatcctcgacaggaggctttagttaggaccttgacaagctatgaagtagtcatcccggagcgtgttaacgagtttggagaggtctttccacagtctcaccatttcagtaggcaaaaacgttcaagcgaggccctagaacctatgcccttccgcacgcactatcggttcaccgcctatgggcagcttttccagctaaacctgactgccgacgctagttttcttgccgccggatacactgaggtgcacctgggaacacctgagcgaggagcttgggagtccgatgctggtccgagtgatctcagacattgtttctataggggccaggtaaactctcaggaggattataaggccgtcgtgtccttatgcgggggtctaaccggaacttttaaaggtcagaatggcgagtactttcttgagcccataatgaaggccgacgggaatgaatacgaagatggccataacaagcctcacctcatctaccgtcaggacctaaataattcctttctccagacgctgaagtactgtagcgtgagcgagtcccagattaaggagacatccctgcctttccatacttattcaaatatgaatgaggacctgaatgtcatgaaagaacgggtactgggccatacatctaagaacgtccctttgaaggacgaaaggaggcactcccgtaagaagcgcctgatctcttacccccgatacatcgagatcatggtgaccgccgacgcaaaagtcgtctcagcccacggcagtaacctccagaactacattctcacactgatgagcatagtggccactatttataaagaccccagtataggcaatctgattcacatcgtggtggtcaaactggtgatgatccaccgggaagaggaggggcccgtcattaacttcgacggcgccacaactctaaagaacttctgtagttggcagcaaacccagaatgacttagacgacgtccaccccagtcaccatgacacggccgttttaatcactagagaggatatctgttcgtccaaggaaaaatgtaatatgctgggcctgagttacctgggtacgatttgcgacccactgcagagctgcttcatcaatgaggagaaagggctgatttccgccttcacaatcgcccatgaattgggtcacacattaggcgtgcagcacgatgataaccctcgctgtaaagagatgaaggtgactaagtatcacgtcatggccccggcattatcttttcatatgagcccttggtcttggtcaaattgctcacgaaaatacgtgacagaattcttggacacaggttacggggaatgccttttagacaaaccagatgaagaaatttacaacctgcccagcgaactccccggcagccgctacgacggcaataaacaatgcgaactagccttcggccccggctctcagatgtgtccacatatcaacatatgtatgcatttatggtgcacttctacggagaaattgcataagggttgctttacccaacacgtcccgcctgccgacggcaccgattgcggtcccggcatgcattgtagacacggactgtgcgtgaacaaggagaccgagactagacccgtgaacggcgagtgggggccatgggaaccttatagtagttgtagccgcacatgtggaggtgggatagagtcggcaacccggcgatgtaatcgcccggaacctaggaacggcggcaactattgtgtcggccgtaggatgaagtttaggagctgtaacacagatagctgtccaaaaggcactcaggatttcagggaaaagcaatgtagcgacttcaacggaaagcacttggacatcagcgggatcccttcaaacgtcagatggctccccagatacagcgggatcggcactaaggacaggtgtaaactgtactgtcaggtggccgggacaaactacttttaccttctaaaagacatggttgaagacggtactccttgtggtacggaaacccatgacatctgtgtacagggccagtgcatggctgccggatgtgaccacgtgttgaatagcagcgcgaagattgacaagtgtggggtgtgcggcggagataactcatcgtgcaaaactatcaccggtgtgtttaactcaagccactacggttacaacgttgtggtgaagatccctgccggcgccactaatgtcgacattaggcagtactcgtatagtgggcagcccgatgattcttatctagcgctatcagacgctgaggggaatttcttgtttaacgggaacttccttctgtccaccagtaagaaggagattaatgttcaggggacacggacagtgattgaatactcgggcagtaacaacgccgtggagcgtataaattcaacgaataggcaggaaaaagagctgatcttacaagtgttgtgtgtcggtaatctctataatccagatgtgcactatagcttcaatataccgctagaagagcggagcgacatgtttacctgggacccgtatggcccctgggagggctgtacaaagatgtgccaggggttgcagcgaagaaacattacatgtatccacaagtccgatcacagtgtagtctccgacaaagagtgtgatcaccttccacttccttcgttcgtcacccagtcctgtaacacagactgtgaactccgctggcacgtaatcggtaagtcagaatgttcctcccagtgcgggcagggctatcgcaccctggacatccactgtatgaaatacagcatacacgaaggccagacagtgcaggtcgatgatcactactgtggcgatcagctgaagccccctacacaagaactgtgccatggaaattgcgtgtttacacggtggcattactctgaatggtcccagtgctcaagatcctgtggggggggagaaaggtcacgcgaatcatattgtatgaataatttcgggcatcgcttagctgataatgaatgccaggagctctcccgggtgaccagagagaactgcaacgagttctcctgcccatcatgggctgcatcagaatggagtgagtgcctcgttacctgtggaaaggggacaaagcagcggcaagtgtggtgccagctcaatgtagatcacctgtccgatggtttctgcaacagttccactaagcctgagtctctgagtccttgtgaattacacacctgcgcctcttggcaagtggggccgtggggtccttgcactacaacctgtggccacgggtatcagatgagagatgtcaagtgcgtcaatgagcttgcctctgccgtcctcgaggatacggaatgccacgaagcgtccaggccgtccgatcgacagtcgtgcgtacttacgccatgcagcttcattagcaagctcgagactgcgctgctgccgacagtgctcattaagaaaatggcgcaatggaggcatgggtcctggaccccctgttctgtcagttgcgggagaggaacacaggcccggtatgtgagctgtcgtgacgcgcttgatcggatagccgacgagtcatattgcgctcatctgccaagacccgcagagatttgggattgtttcactccctgcggggagtggcaagccggggactggagtccctgcagcgccagttgcggccacggcaaaaccacacgccaggtgctttgcatgaattatcaccagcccattgatgagaactattgcgatcctgaagttcgccctctgatggaacaggaatgttccctggcagcatgccctcccgctcattctcacttcccaagttctcctgtccagcccagctactacctgtctactaatctgcccctgactcagaagctggaggataacgaaaaccaggtggtgcatccctccgtccgcgggaaccagtggcggaccggtccatggggtagttgctcatcttcctgttctggaggtttgcaacacagggccgtggtttgccaggatgagaatgggcagtccgcctcctactgcgacgccgcctccaaacccccagagctgcagcagtgtgggcctgggccctgtcctcaatggaattatggtaactggggtgagtgttcccagacttgtggggggggaatcaagtcaaggctggtgatctgtcaatttccaaatgggcagattcttgaagaccataattgtgagattgtcaataagccaccaagcgttatccagtgccatatgcatgcctgtcccgccgatgtttcctggcatcaagaaccatggacaagttgcagcgcatcatgtgggaaaggcaggaagtatcgtgaggtcttctgcatcgaccaattccagcgcaagctggaagacaccaactgctcacaggtacagaaaccccctactcacaaagcatgccgatctgtgagatgccctagttggaaggctaattcctggaacgagtgctctgtgacatgcggtagtggggtgcagcaacgggatgtctattgccggctgaagggggtcggacaggtggtagaagagatgtgtgatcagtccacccgcccctgctcccaacggaggtgttggagccaggactgcgtgcagcacaagggcatggagcgaggacgtctgaactgttctacgtcttgcgaacgcaaagattcccaccaacgaatggagtgtacggataatcagatcaggcaggtcaacgagattgtctacaacagctcaacaatatcgctgacgtcaaagaattgtcgcaatccaccctgcaattatatagtagttaccgccgatagcagtcagtgtgccaataactgtggattcagttaccgtcagaggatcacttactgtaccgagatccccagcaccaaaaagcacaagctgcatcggttacgtcctatcgtgtatcaagaatgtcctgttgtgccaagctcacaggtctaccagtgtatcaattcctgtctgcatctggccacctggaaggttggcaaatggagcaagtgttctgtcacttgtgggatcggtattatgaagcggcaggtaaagtgcataaccaaacatggcctctcttcggacctgtgcctgaatcatctgaaaccaggagcacagaagaagtgctacgctaatgattgtaaatctttcactacctgcaaggaaatccaggtgaagaatcacataaggaaagacggagactactatctgaatatcaagggccgcatcatcaagatttactgtgccgacatgtacctggagaacccaaaggaataccttacgctggtgcagggtgaggagaacttttctgaagtgtatggatttagactgaagaatccctaccagtgccctttcaacggctcaagaagagaagattgcgagtgtgataacggccatcttgcagcagggtacactgtctttagtaaaatccgaattgatctcactagcatgcagataaagactaccgatctcctgttctccaaaactatcttcggcaatgctgtgccttttgcaaccgctggtgattgttactccgcatttcgctgtccccaaggacaattttctatcaaccttagcggcaccggaatgaagatctctagcaccgccaaatggcttactcagggctcatacacgtcggtgtcaatccggcgctctgaggatggaaccagattcttcggcaaatgcggtggatattgtggtaaatgcctaccacatatgactacgggcctccccattcaggttatctag

SEQ ID NO: 107253 - DNA, 1869 bp, Artificial Sequence
  Description of Artificial Sequence: Synthetic coding sequence
atgtttacctgggacccatacgggccgtgggaaggctgcacaaaaatgtgtcaagggcttcagcgaaggaacatcacatgcatccacaaatcagaccacagcgttgtctccgataaggaatgcgatcacctccctctcccgtctttcgttacccagtcttgcaacactgattgcgagctgcggtggcacgtgatcggaaagtccgaatgttcatctcagtgtggacagggctaccgcaccctcgacatccactgcatgaagtattctattcatgagggacaaaccgttcaggtggatgatcattactgtggtgatcagctaaagccgcctactcaggaactgtgccacggcaattgtgtgttcactcgctggcattacagtgaatggagtcagtgctctcgatcctgcggtgggggagagaggtcacgggagtcttattgtatgaacaacttcgggcataggctagcagacaacgagtgtcaggaactttcccgagtcacacgcgaaaactgtaacgagttctcctgtccctcctgggcggcatcagaatggtccgaatgtctcgttacttgcgggaagggcactaagcagcgccaggtgtggtgccagctgaacgtcgatcatttaagcgacggattttgtaactctagcaccaagccagagagcctttctccctgcgagttgcatacatgtgcatcctggcaggtgggcccatgggggccctgcacaaccacatgcggccacggataccaaatgagggatgtgaagtgtgtgaacgagctggctagcgctgtgctggaagacactgagtgtcatgaggcctcccggccctcagaccggcagtgtagcgtgagttgtggcagggggacccaggccagatacgtcagttgcagagacgcactggaccggattgctgacgagtcatactgtgcccacttacctcggccagcagagatttgggattgtttcaccccttgtggggagtggcaggccggagattggtcaccctgctccgcatcatgtggtcacggcaaaactactcggcaggtgttatgtatgaactatcaccagcccattgatgagaactactgcgaccccgaagttcggcctttaatggagcaggagtgttctctggcagcatgtccaccggcccactcccacttccccagttcccccgtccagccaagctactacctttctaccaacttgcccctcacacagaagctggaggataatgagaatcaggtggttcatcctagcgtccgggggaatcagtggcgcacaggcccttggggaagttgcagctcctcctgctctggcggcttacaacaccgtgcagtggtgtgtcaagacgagaacgggcagtctgcaagttactgtgatgcagcttccaagccgccggagctccagcagtgcggacccggcccatgtccccagtggaactatggcaattggggcgagtgtagtcagacctgcggtggcggaattaaatcacggttagtgatttgtcagttccccaatggccaaatccttgaggatcataactgcgagatcgttaataagccaccatccgtaattcaatgtcacatgcatgcctgtcctgccgacgtatcatggcaccaggaaccttggactagtgaagatctcaaggtgaaactgctgccgcagagaacaattatactgtgggagcttatgaagaacatcttttgtcacggcaagcactctcacatgtatctgatcaatgtggttacagatcaccttctttatccccggcactgtgaccccgagaccatagaaacttactttttatcattatggagtctccagtttacatggggggatctgaagtattataaaaatagcctctag

SEQ ID NO: 107254 - DNA, 4515 bp, Artificial Sequence
  Description of Artificial Sequence: Synthetic coding sequence
atgtgggtcgccaagtggctgactggactcctttaccacctgtccctattcattacacggtcctgggaagtggacttccacccaagacaggaggctcttgtccggacccttacatcctacgaagtcgtaatacccgagagagtgaatgaatttggcgaggtgttcccacagtcccaccacttttcgcgtcagaaaaggtccagcgaggccttggagccaatgccttttcgaacacattacaggttcacagcatacgggcagctattccagttgaatctaacagctgatgcctcgtttttggcagctggatatacagaggttcaccttggcacacctgaacgaggtgcgtgggaaagtgacgcgggcccctcagacttgcggcattgcttctatagaggacaggtgaatagccaggaggactacaaagctgtggtgagcctgtgtggcggactgacgggcacctttaaaggacaaaacggtgaatactttctagagcctatcatgaaggcggacggcaatgagtacgaggatggtcacaacaaacctcacctgatttacaggcaggacctaaacaatagctttttgcagactctgaagtactgctcagtgtcagagagccagattaaggaaacatccctgccttttcatacatattcaaatatgaatgaagatctgaacgttatgaaggaaagggtgttggggcacacctcaaaaaatgtccccctcaaagatgagcggcggcactcaagaaagaagagactcatctcatatccaaggtacatcgaaatcatggtgacagccgacgccaaggtcgtgtctgctcacggatccaatctccagaattatatattaacactgatgtcaattgtagctaccatatacaaggaccctagcattggaaatttaatccacattgtggttgtcaaattggtaatgatccacagagaagaggagggccctgtgatcaatttcgacggtgccactaccctcaaaaatttttgttcatggcaacaaactcagaatgatttagacgacgtgcacccaagtcaccacgacactgccgtgttaattacccgagaggacatttgtagcagcaaggagaagtgcaacatgttggggttatcgtatctcgggactatatgtgatccgctgcagagctgttttattaatgaagagaagggcctaatctccgctttcaccatcgcacatgaactgggtcacaccctgggtgtgcagcacgacgacaatcccagatgtaaagagatgaaagtgacaaaatatcacgtgatggcacctgcgctgagtttccatatgtcaccttggagttggtcgaactgttcgagaaaatatgtgactgaattcctggataccggctatggtgaatgtcttctggataaacccgatgaggagatctacaatcttcccagtgaactgcccggtagcagatatgatggcaacaagcagtgtgaacttgctttcggacccgggagccagatgtgtcctcacattaacatttgtatgcatctgtggtgtacctcaacagagaagctccataagggctgtttcacccagcacgttccaccagccgacggaaccgactgtgggcccggcatgcactgcaggcacggcctgtgcgtgaacaaagaaacagagacaaggcccgtaaatggcgagtggggaccctgggagccgtatagctcctgttcacggacctgcggcggggggatcgagtctgctacaaggaggtgtaaccgccctgagccgcggaacggaggcaactattgtgtaggtagacggatgaagttccgctcgtgcaacacagatagctgtcctaagggtacccaggacttcagagagaaacagtgttctgacttcaatggaaagcatttagatatttccggcatcccgtccaatgtgcgttggctgccccggtactccggaatcggcacgaaggatcgttgtaaactgtactgccaggtcgccggtactaattacttttacctcttgaaagatatggtggaagacggtactccctgcggcactgagacccacgatatctgtgttcagggacagtgcatggcagcaggctgcgaccatgtcctgaacagttcagctaagattgacaaatgtggtgtttgtggtggcgataatagttcatgcaaaacaattaccggggtctttaacagctctcattacggatacaacgtggtggtgaaaatccctgcgggcgccacaaacgtggacatccgccagtatagctacagcggacagccagatgacagctatcttgcgctgagcgatgccgagggtaactttttgttcaatgggaattttctgctgagcacatctaagaaggagatcaacgtccagggcacgcgcacagtgattgagtattcaggttctaacaacgcagttgagcggattaacagtacaaatcgacaggagaaagagctgatcctgcaagtcctctgtgtaggtaatctttacaacccagatgttcattacagcttcaacataccgctagaggaaagaagtgatatgtttacctgggacccctatgggccatgggaaggttgcacgaagatgtgccagggcttacaacggcgtaacattacttgtatccataaatctgaccactccgtagtgagcgataaggagtgcgatcacctccctctgccatcgttcgttacccagagttgtaacactgattgcgaacttaggtggcacgtgatcggcaaaagcgagtgttcctcccagtgtggccagggatatagaacactggatattcattgcatgaagtattctattcatgaagggcagacagtgcaggtggatgaccactactgcggggatcagctcaaaccccccacccaagagctgtgccacggcaattgcgttttcacgcggtggcattacagtgagtggtctcagtgttccagaagctgcggagggggtgagagaagccgcgagagctactgtatgaataattttggccatagattagcggataacgagtgccaggagctgtctagggttacgcgggaaaattgtaatgaattcagctgccccagctgggcagcatctgagtggagtgaatgcctggttacttgtggaaaaggcaccaaacaacggcaggtttggtgccaactgaatgtagatcatttatcggacggcttttgcaatagttccaccaagcctgaatccctgagtccttgtgaattgcatacctgtgctagctggcaggttggcccatgggggccgtgtaccacgacctgcggacacggatatcagatgagggacgtgaagtgcgtcaatgagcttgcctctgccgtgctagaagacacagaatgccatgaggcgtctcgcccctctgaccggcagtcgtgtgtactgactccctgtagtttcataagtaaactggaaaccgctctcctaccaacagtactgataaagaagatggcgcagtggaggcacgggtcctggacaccttgctctgtgtcatgcggcagggggactcaggcccgctacgtgagctgccgggatgcactggacagaatcgccgacgaaagctattgtgcccacctgccaagaccagccgaaatttgggattgcttcactccgtgcggcgaatggcaggccggagattggagcccgtgcagcgctagttgtggccatggcaagaccactcgccaagtgctgtgcatgaactaccaccagcccatcgatgagaactattgcgacccagaagttaggccgctgatggagcaggagtgttccctcgccgcctgccctccggcacactcacactttccttcgagccctgtgcagcctagctattacctaagtaccaacttgcctcttactcagaaactggaggacaacgagaaccaagtggtccacccatcggtccgggggaatcagtggcgcacaggtccatggggctcctgctcctctagttgtagcgggggactccaacacagggccgtggtttgccaagacgagaatggtcagagtgccagctattgtgacgctgcatccaaaccccccgagttgcaacagtgcggtcccggaccatgtccgcagtggaattacggaaactggggagagtgctctcagacttgcggcggcgggatcaaaagtcggctggtcatttgccaattccccaatggccagattctcgaagaccataactgcgagatcgtgaacaagcccccgtccgtcattcagtgccatatgcatgcgtgccccgccgatgtgtcttggcaccaagaaccatggacatccgaggatttaaaagttaagctgctgccacaacgcaccataattctgtgggagctgatgaagaacatcttctgccacggtaaacacagccacatgtatctcattaacgtagttactgaccatctgctctaccctagacattgtgatcctgaaacgatcgaaacatattttctttccctgtggagcctgcagttcacctggggtgacctcaagtactataagaattccctgtag

SEQ ID NO: 107255 - DNA, 3618 bp, Artificial Sequence
  Description of Artificial Sequence: Synthetic coding sequence
atggtccttctgtcactgtggctcatcgcagcagcactggtggaggtgcgcacaagcgccgatgggcaggccgggaatgaagagatggtgcagatagacctgcccattaaaagataccgggaatatgagctagtgactcccgtgagcactaatctggagggccgctacttgagtcacaccctgagcgcctctcacaagaagcggtccgcaagagacgtctcgtctaaccccgagcaactgttttttaatatcaccgcctttggaaaggacttccacctccggcttaagcccaacactcagctggtcgctccaggcgccgtggtggagtggcacgagactagccttgtgccgggtaatatcacagatcctatcaataaccaccagccgggctccgccacctacagaatcagacgaaccgaaccactccaaactaattgcgcgtacgtaggcgacatcgtggacatccccggcacctccgtcgccatatccaactgtgacggccttgctggaatgataaagtcagacaatgaggagtactttattgaaccccttgagcgtggcaagcagatggaggaggaaaagggccggatacacgttgtgtacaagcggtcagcagtggagcaggccccaatcgacatgtctaaagacttccattacagggagtcagatttggaaggccttgacgatctgggcactgtctacggcaatatccaccagcagctaaatgaaacaatgcgcagaaggagacacgctggcgaaaatgactataacattgaggttcttctcggcgttgacgattccgtcgtccgatttcatggcaaggaacacgtgcagaactatttactgactcttatgaatatagtcaacgaaatctatcatgacgagtctttgggggtccacataaacgttgtactggtgaggatgattatgcttggatacgctaagtcaatttctctgattgagcgaggcaacccctcccgatcacttgagaacgtgtgccggtgggcatcccagcaacagcggtcagatctaaatcactctgagcatcatgaccacgccatcttcttgactcgccaggactttggacctgctgggatgcagggatacgccccagtcacggggatgtgtcatcctgttcgaagttgcacactcaaccacgaggacgggttcagctcagcctttgtggtagctcatgaaaccggacatgtgcttggcatggaacacgacgggcagggcaacagatgcggcgatgagacagctatgggtagtgtgatggcccccctagtgcaagccgcgtttcaccgatatcactggtctaggtgtagtggccaggagctcaaacgctacatccactcctacgattgcttgcttgatgacccattcgaccacgactggcccaaattaccggagctgcctggaattaactactccatggatgaacagtgtagatttgacttcggtgtggggtacaagatgtgcactgcattcagaacgtttgacccatgtaagcagctgtggtgtagtcacccagataacccttatttttgcaaaactaagaagggtccacccctggatggtacagagtgtgcagccggaaagtggtgttacaagggccattgtatgtggaagaatgcaaaccaacagaaacaagatggcaattggggctcgtggacaaagttcggatcttgttccaggacctgcggcaccggcgtgagatttagaactcggcaatgcaacaaccccatgccaataaacggcggccaggactgtccaggcgtcaacttcgagtatcagctgtgtaacactgaagaatgtcaaaagcatttcgaagacttcagagcccaacagtgccagcagcggaatagccacttcgagtatcagaacactaagcatcactggctgccctatgaacaccctgatccaaagaagcgatgccacctgtactgtcagagcaaagagacaggcgatgtggcctatatgaagcaacttgttcatgacggcactcactgtagttataaggatccttattctatatgcgttcggggagagtgcgtgaaggtaggatgtgataaggaaataggatctaacaaagtggaggataaatgcggtgtttgtggtggggataactctcactgcagaaccgttaaggggacttttacccggactccccgcaagcttgggtatctcaagatgttcgacatcccaccaggagcccggcatgtcctcattcaagaagatgaagcttctcctcacatcttagctatcaagaatcaggccaccggtcactatatcctgaatggcaagggcgaggaagccaaaagcagaacattcatcgacttgggggtggagtgggactacaatatcgaggatgatatagaatccctgcatacggatggccctctgcatgacccagtcatagtattgatcattccccaggagaatgataccagatcttctctgacgtataaatacataatccacgaggactctgttccaaccatcaactcaaacaacgtcatacaagaagagttagacacctttgagtgggccctgaaaagctggtcgcagtgcagcaaaccatgcggaggcggtttccagtatacaaagtatggttgccgccgaaagtcagacaacaagatggtgcatagatctttttgtgaagccaacaagaagcctaagcctattcggaggatgtgtaatattcaggagtgtactcaccctctttgggtagcggaggaatgggaacactgtacaaagacctgtggctcgagtggctaccagttgcgtacagtgagatgtctgcaaccactgctcgatggcacgaaccggtctgttcatagtaaatattgtatgggagatcgccctgaatctcgcaggccatgtaaccgcgtgccatgtcccgcacagtggaaaacaggaccatggagtgaatgtagcgtgacctgcggtgaagggacggaggtccgacaagtcctgtgccgggccggcgaccactgcgacggcgagaaacccgaatcagtccgggcttgccagttaccaccctgtaatgacgagccgtgtcttggcgacaagagcattttctgtcagatggaggtcctcgccagatactgctcaatccctgggtacaataaactgtgttgcgagtcttgctctaagcgttcctccaccttgcccccgccatacctcctggaggcggcagaaacacacgacgatgtgatctcaaacccctcagatctgcctcgctcccttgtcatgccaacaagcctggtgccctatcactcagagactcctgctaagaagatgagccttagcagcatttctagcgtgggcggacccaatgcctatgccgccttccgcccgaactcaaagcctgacggagccaatctgaggcagaggagcgcccagcaggccggcagcaagactgtgcgtctggtcaccgtgccctcctcacctcctaccaaaagagtgcatttatcaagtgcaagccagatggcagccgctagtttttttgccgcctctgactcgattggcgcctcaagccaggcccggacgtccaagaaggacgggaagataatcgataacaggcgcccaaccaggtcctctaccctagagcgctag

SEQ ID NO: 107256 - DNA, 1020 bp, Artificial Sequence
  Description of Artificial Sequence: Synthetic coding sequence
atgagtcagactggcagtcacccgggtcgcggactcgccggaagatggctctggggtgctcagccctgtttgctcctgcctatagtcccactcagttggttagtgtggttgctgctcttgcttctggcatccctgttgccctccgcacgcctcgctagcccactgccacgggaggaagagatcgtattccccgaaaagctgaacggcagtgttttacctgggagcggggccccagcccggcttctgtgccgactccaggcattcggcgagactcttttgctggaactggagcaagatagcggtgtccaggttgagggacttacagtccaataccttggccaagccccagaactgttgggtggagccgaacctggtacctacctgacagggactatcaatggtgaccccgaatccgtcgcttcgttgcactgggacggaggagcgctcctcggagtgcttcagtaccgcggagccgagctgcatttacagcctctggaaggaggtactccaaatagtgcaggtggtccaggggcccacatacttcggcggaagagccctgcctcggggcagggccctatgtgcaatgtcaaggccccacttggatctcctagtccgcgacccagacgggccaaaaggtttgccagtctgtcccgttttgtagagacgctcgttgtcgccgacgacaagatggcagctttccatggggccgggctgaagcgatatctactcaccgtgatggcggccgcagccaaagcttttaagcacccctctatcagaaaccccgtgtctctggttgttaccaggctcgtaattctgggatccggcgaggaaggcccccaggtggggccttccgcggcccagacactacgttctttttgtgcctggcagagaggactgaatacacctgaagatagcgaccccgaccattttgatacagctattctgtttaccagacaagtgcggccacaatccgcccctcaagctatgcactgtaccattctccgtagcgccacgacttag

SEQ ID NO: 107257 - DNA, 2514 bp, Artificial Sequence
  Description of Artificial Sequence: Synthetic coding sequence
atgtctcagaccggctcgcacccgggccgcggcctggctggaaggtggctttggggcgcacaaccgtgtctcttactgcctattgtaccactctcctggctcgtctggttgctgctcctgctcttggcctcattactgccctctgccaggcttgcctctccacttccgcgggaagaggaaatagtgtttcctgagaagctgaatggctcagtgctccccggctcgggcgcccccgctagattgctctgcaggttacaagcattcggcgagacattactgctagaactggagcaagactctggcgttcaagtggaagggttgaccgtacaatacctgggacaagccccggagctccttggcggcgccgaacccggcacctatctcaccggaacaattaacggggacccggagtctgtggctagtttacattgggacggaggagcactgcttggtgtgctacaataccgcggcgccgagctacatctgcagcccctcgaagggggcacccctaattcagctgggggaccaggggctcatattcttagacgtaaatccccagcctcaggccaaggacccatgtgtaacgtcaaagctcccctcggttcaccaagtccacggccaagaagagctaagagattcgcatccctcagtcgcttcgtcgagactctggtcgtggcagacgacaaaatggctgcgttccatggcgcgggcctgaaaaggtatcttctgactgtaatggcggctgccgctaaagcatttaagcacccctctatcaggaaccctgtaagtcttgtggtgacccgactggttatcctaggatcaggagaagagggaccccaggtgggtccatcagctgcacagactctgcgatccttctgcgcttggcagagaggactgaacacacccgaggattccgacccggatcatttcgacactgccattcttttcacacgccaggacctgtgcggggtgtccacttgtgatacgcttgggatggcggacgtcggcactgtctgtgaccctgccagatcctgcgccatcgtcgaggacgacggccttcagtcagcttttacagccgcccatgagttaggacatgtgtttaatatgctgcacgataattccaaaccctgcattagcttaaatggtcctttaagcacatcccgccatgtgatggcccctgtaatggctcatgtggaccccgaagaaccatggtctccatgctctgctaggtttattacagatttcttggacaacggctacggtcactgtctgcttgacaagcctgaagctccactccatttacctgtcactttcccaggtaaagactatgatgctgatagacagtgtcaactgacctttggcccagattcgcggcactgcccccagttgcccccaccttgcgcagctctgtggtgcagcgggcatctgaacggccatgcaatgtgtcagacgaagcactctccgtgggcagacggaaccccctgcggcccagctcaggcatgtatgggtgggaggtgtcttcacatggatcagctccaagattttaatatcccgcaagccggaggttggggaccctggggcccatggggagattgctcccggacctgcgggggcggggtacagttctccagccgcgactgtacccggccggtcccaagaaatggaggtaaatactgtgaagggcggcggacccggttccggtcttgtaacactgaggattgcccgaccggatcagccttgacgttcagggaagagcagtgtgctgcatacaaccatcgcacggatctgtttaagagttttccagggccaatggactgggtgcctcgatacacaggagtggcgccacaagaccaatgtaaactgacctgtcaggcacaggctctgggctactactacgtactcgagccaagagttgtggatggaacaccatgctccccggactcctcctcagtctgtgtgcagggaaggtgcattcatgccggctgcgatcgcatcatcggaagcaagaaaaagttcgataaatgcatggtgtgtggcggagatggttcgggatgcagtaagcagagtggatcttttaggaaatttcgctatggctacaataatgtggtcactattcctgctggcgccacgcatatcctcgtgagacaacaggggaaccccggtcatcgaagcatttaccttgccctcaagctgcccgatggctcgtacgcgctgaacggggaatataccttgatgcctagccccactgacgttgtgctccccggcgcggtcagcttgcggtatagtggagcaacggcagcctccgaaacactctcggggcacggccccctcgcacagcctctaactctgcaagtgctggtcgccggaaacccacaggatacccgcttgaggtattctttttttgtcccccggcccacaccaagtacacctaggccgactcctcaggactggctccatcgtagggcccaaatactggagattcttcggcggaggccttgggccggaaggaagtag

SEQ ID NO: 107258 - DNA, 2793 bp, Artificial Sequence
  Description of Artificial Sequence: Synthetic coding sequence
atgctgctggggtgggcctccttactgctgtgcgctttcagactgcctctcgctgccgtcgggccagctgccacccccgcccaagacaaagccggacagcctcctacagcagcggccgccgcacagccgcgtcggcgacagggcgaagaggttcaagagagggctgaaccaccaggacatccccacccacttgctcagcgtcgtcggtctaaaggactagtccagaatatcgatcagctgtactctgggggtggcaaagtggggtatctcgtatatgccggaggacgcaggtttctgttggacttagagagggacggcagtgtggggattgccggcttcgtccccgccggtggtggcaccagcgctccgtggcgacaccgcagccactgtttttaccgagggacagttgacgggagcccacggtccctcgcagtattcgatctctgtggcgggttggacggcttcttcgcagtgaagcacgcccgctacaccttgaagcctctgctgcgcggcccttgggcagaggaggagaaaggacgagtctatggagatgggtcagcaaggatcttgcatgtgtacacacgggaggggttcagctttgaggcactgcctcctagagcgtcttgcgaaactccagctagtacaccggaggctcatgaacatgcgcccgctcacagtaacccttccgggagggccgctctcgccagtcaacttctggaccagagtgcacttagccctgccggcggctcagggccacagacatggtggcgaaggcggaggagatcaatcagcagagcgcgccaggtcgagctattgttagtggcggacgcatctatggctcgactatatgggcgtggcctccagcattatctactgaccctggcatccatagctaatagattgtacagccatgcctcaatagaaaaccacattcggttagccgtagtcaaggtagttgttttaggtgataaagacaagagcttggaagtgtctaagaacgcagcaaccaccctcaagaacttctgtaagtggcaacatcagcataaccaactgggcgacgaccacgaagaacactacgatgctgccatcttgttcacacgggaagacttatgtggacatcattcatgcgatacactgggcatggctgacgttggcacgatatgttctccagagcggagctgcgccgtcatcgaggatgacgggctccacgctgcatttacagtggctcacgaaattgggcatctgttgggactgagccacgacgactctaaattctgcgaggaaacttttggcagcaccgaggacaagaggctcatgtccagcatcctgaccagtatcgacgcctccaaaccctggagcaagtgcacatccgcaacaatcactgaatttctggacgacgggcacggcaactgtttactcgacttaccaagaaaacagattcttggccccgaagagttgccaggccagacctatgatgcaacgcagcagtgcaacctcactttcgggcccgagtatagtgtttgtcccggaatggacgtatgcgcccgactgtggtgcgcagtcgtgcgtcagggccagatggtgtgcctgaccaagaaactgcccgcagttgagggaacaccttgtgggaaaggtaggatttgtctgcagggtaaatgcgtcgacaagactaagaaaaagtattattctacttcatcccacggcaactgggggtcgtgggggtcgtggggtcagtgctcgaggtcgtgtggcgggggcgtgcagttcgcttaccgtcattgcaacaatcctgctcctaggaacaacgggcgctactgtacgggcaaaagggcaatctaccgtagctgctccctcatgccgtgccctccaaatggcaaatctttccgccatgaacagtgcgaggctaagaacgggtatcagtccgacgctaagggtgtcaagacatttgtggagtgggtaccaaagtatgcaggcgtccttcccgctgatgtctgtaaacttacctgtcgggccaaaggtaccgggtattacgtggtgttctcccccaaagtcaccgatggaaccgaatgtcgcctttatagcaattcagtctgcgtccggggaaagtgcgtgcggaccgggtgcgatggaataataggtagcaagctccagtacgacaagtgcggcgtgtgtgggggggacaatagtagttgtaccaaaattgtgggcacttttaacaaaaaatccaagggctacactgacgtggtcagaattcctgaaggggctacacacataaaggtccgccagtttaaggccaaagaccagaccagatttacagcataccttgcccttaagaagaaaaacggcgagtatctgattaacggcaagtacatgatctctaccagtgaaacaataattgatatcaatggtaccgtaatgaattacagcggttggtcgcacagggatgacttcctccatggaatgggctatagcgcaacgaaggagatcttgatcgttcagatactggccactgatcctactaaaccgctggatgtgcgctactctttttttgtgccgaagaaatcaacaccaaaagtgaattccgtgacctcgcacggctctaacaaggtaggcagccacacctcgcagcctcaatgggttaccggcccatggttggcgtgcagcagaacttgtgacacaggatggcatactcgtacggtgcagtgccaagatggcaacaggaaacttgctaagggttgtccactgtcacagaggccatctgccttcaagcagtgtctcctgaaaaagtgttag

SEQ ID NO: 107259 - DNA, 2577 bp, Artificial Sequence
  Description of Artificial Sequence: Synthetic coding sequence
atggaaatcctgtggaaaacgttgacctggattttgtcactcataatggcatcttccgaatttcactcggatcaccggctctcttatagtagccaagaggaattcctgacttaccttgaacactaccaactcacaataccaatccgcgtggaccagaatggtgcatttctatccttcactgtaaagaacgacaagcattcccggaggcggcgatctatggatcccattgatccccagcaggccgtgagcaagctcttcttcaaactttctgcttatgggaagcactttcacctcaaccttactctcaatacagacttcgtctccaagcatttcactgtggagtactggggcaaggatggaccgcagtggaaacacgactttctcgacaattgccattatactggctacctccaggatcaaagaagtactaccaaggtggctctcagcaactgcgtgggcctgcacggtgttatagccacagaggatgaggaatatttcatcgagccactaaagaatacaacggaagattcgaagcacttctcctacgagaacggccatccccacgtgatttacaagaagagtgcattacagcagaggcacctgtacgatcattcacactgtggggtcagtgactttacaaggagtgggaagccctggtggttgaacgatacatctaccgtgtcttattctctcccaatcaacaatacacacatacatcataggcaaaagaggtcagtgagcatagagcgcttcgtagaaaccttagtggtcgctgataagatgatggtgggataccacgggcgaaaagacattgagcattatatcctttcagtaatgaacatcgtggccaaattgtatcgtgatagttcgctgggcaatgtggtgaacatcattgtggcgcgtctgatcgtactgacggaagaccagccaaatttagaaatcaatcatcatgctgacaagtctcttgactcattctgcaagtggcagaagtccattctgtcacaccaaagtgacgggaacacgattcccgagaacgggattgcacaccatgacaacgctgtgctgattactagatatgacatttgtacctacaaaaacaaaccttgcggtaccctgggccttgcgtctgtcgctggaatgtgtgaaccagaaaggtcttgctcgatcaacgaggacattggtcttgggagcgcctttacaattgctcatgagatcggacacaactttggcatgaaccatgacgggataggaaattcttgcagaaaggtgatgaagcagcaatacggatcctcacactattgcgaatatcagagctttttcctggtctgcctgcagtcaagattacatcatcagctgtctcgtgaagtgtgtcgagaactctggtgtttatctaaaagcaacagatgcgtcacaaattcaatcccagccgccgagggaacactatgtcagactgggaacatcgaaaaggggtggtgctatcaaggggactgtgtgccattcggaacatggcctcagtcaatcgacggagggtggggcccctggtccctgtggggggagtgctctaggacttgtggaggcggagtctcttctagcctgagacactgtgattcgccggccccgagcggcggaggaaagtattgtctcggggagcggaaaagatatcggtcttgtaatactgacccatgcccccttggcagtagagatttccgcgaaaaacagtgcgccgacttcgacaatatgccattccggggaaagtattacaactggaaaccttacactggagggggagtgaagccttgtgctcttaattgtctagctgaaggttataatttttataccgaacgcgctccagcagtgatcgacggcacgcaatgcaatgccgactccctggatatatgcataaacggcgaatgcaagcacgttggctgtgataacattttaggcagcgatgcaagagaggatcgttgccgggtgtgtggcggagacggttccacatgcgatgctatagaagggttctttaacgactccctccccagaggcggatatatggaggtcgtccaaatcccaagagggtccgtgcacatcgaggtacgggaggtggccatgtccaagaactacatcgcactgaaatcagaaggtgatgactactacattaacggtgcctggaccatagactggccccgtaagttcgatgtggccgggaccgcatttcattacaagcggccaaccgacgagccagaatcattagaagccctgggccctacaagcgagaatctgattgtgatggtgctgcttcaggaacagaatctcggcattagatataagtttaatgtgcctattacacgcaccggatccggagataacgaggtaggatttacttggaaccaccagccctggtctgagtgttccgccacgtgcgccggcggcaaaatgccaacccgtcagcctacacagcgggccagatggcgcaccaaacacatcctctcgtacgcactttgcctgctaaagaaactcattggaaacatatcctgtcggttcgccagtagctgcaacctagctaaagagacccttctctag

SEQ ID NO: 107260 - DNA, 3354 bp, Artificial Sequence
  Description of Artificial Sequence: Synthetic coding sequence
atggagatcctctggaaaaccctcacttggatcctctccctgattatggcttctagcgaattccactctgatcaccggctgtcctacagctcccaagaagagttcctgacttatctggagcactaccaacttacgatccccatcagggtcgatcagaacggagcatttctcagctttactgtcaagaacgacaaacactcccgccggaggcgatcgatggatcctatcgatcctcagcaggccgtctctaaacttttttttaaactcagtgcctatggcaaacacttccaccttaatctcactcttaataccgattttgtgagcaagcactttactgtggagtattggggcaaggacggacctcagtggaaacacgatttcctcgacaattgccactatactggttacctccaggatcaaaggtccactaccaaagtggctctgagcaattgcgtcggccttcacggcgtcattgctactgaggatgaggagtatttcattgagcctctcaagaacacaacagaagattctaaacacttcagctatgagaatggacaccctcacgtcatctataagaagagcgctctacagcagcggcatctgtacgaccatagccactgtggcgtgagtgattttacaaggagcggcaagccttggtggctaaacgatacctctacagtgagctactcattgcctataaacaacacccacattcaccatcgccagaaacggagcgtctctattgaaagattcgtggagaccctcgtggttgccgataaaatgatggtcgggtatcacggtcgcaaggacattgaacactatatcctttccgtcatgaacatcgtggcgaagctctatcgggatagcagcctaggcaatgtggtcaacattatcgtggcccgccttattgtcttgactgaggaccaacccaatctagagataaaccaccatgccgataaatctttagattctttctgtaaatggcaaaaaagcatcctgtctcatcaatccgatggcaacacgatcccggaaaatggcatcgcgcaccatgacaacgccgtattgattactcgttacgacatttgcacctacaaaaataagccttgcggtacactcgggctggcctcagtggcaggcatgtgcgaaccagaaaggagttgctccatcaacgaggacattggtctgggttcagcttttactattgcccatgagataggacataacttcgggatgaatcacgatggcataggcaacagctgtggtaccaaaggacacgaagcagcgaagctcatggccgcccatatcacagcaaacactaaccctttttcctggtccgcatgctcccgagattacatcacctcattcttggactcagggaggggtacatgtctggataatgagccccccaaaagggactttctctaccctgcagtagcaccaggacaagtgtacgacgcagacgaacagtgtcggttccagtatggcgcaacgtcacgtcagtgtaagtacggagaggtatgccgggagttgtggtgcctgagtaagtccaataggtgcgtcactaactctataccagctgctgagggcactttatgtcagacaggaaatatcgaaaaggggtggtgctaccagggggactgcgtgcccttcggaacctggccacagagcatcgacggtggttggggcccctggtcactgtggggcgagtgtagtcgcacttgcgggggtggcgtgagctccagcttgcgccattgtgattcgcctgccccaagcggtgggggaaagtactgccttggcgaacgaaagcggtatcgcagctgcaatacggatccttgcccactgggctcgcgagattttagggagaagcagtgcgctgacttcgacaacatgccattcaggggcaagtattataactggaaaccctatactggaggaggagtaaagccctgcgctctgaactgtctggccgagggttacaacttctatactgagcgcgcaccagccgttatcgacggcacacagtgtaatgcggacagtctcgatatttgtattaacggcgaatgcaagcacgttggttgcgataacatcttagggagcgacgcccgcgaggaccgttgtcgcgtgtgtggcggcgatggcagtacctgcgatgcaatcgaaggtttcttcaacgattcattgcctaggggcggttatatggaagtggtccagatcccaagaggatctgtacatatcgaggtccgggaagtcgccatgtcaaagaactatattgcgctgaaaagcgaaggggatgactactacatcaacggggcctggacaatcgattggcctcgaaagtttgacgtcgctggtacggcattccactataagcggcccactgacgaacccgagagtctggaagcattgggccccactagtgagaatttaattgtcatggtgctattgcaggagcagaatctggggataaggtacaagtttaacgtaccaatcacaaggactggttcaggcgataacgaggtcggcttcacttggaaccaccagccttggtccgagtgctcagcgacatgcgctgggggcgttcagcggcaggaggtggtatgcaagagattagatgataacagtatcgtccagaataattactgcgaccctgactccaagcccccggaaaatcaacgggcctgcaataccgagccctgtccaccggaatggtttatcggcgattggctagagtgtagcaaaacctgcgatggcggaatgagaacccgcgcagtcctgtgtattagaaagattggccctagcgaggaagagaccctcgactatagtggctgcttgacgcataggccagtcgagaaagaaccttgcaacaatcaatcctgccctccccagtgggttgcccttgactggtccgagtgtacacctaagtgcggtccggggtttaaacatcgcattgtcctttgcaagtcttccgatctcagcaagactttccccgccgcccagtgccctgaagagtctaaacctccggtccgcattaggtgcagcttaggccgctgtccccctccgcgttgggtcacaggggattgggggcagtgctctgctcaatgcggcttgggccagcaaatgaggactgtccagtgcctttcctatacgggtcaggctagctctgactgtctcgagacagtccgacctcccagcatgcagcagtgtgaatctaaatgtgattcaactccgatcagcaatactgaggagtgtaaggacgtcaacaaggtggcctactgtccactggttctgaagttcaagttttgttctagggcatatttccgacagatgtgctgtaaaacttgtcagggccattag

SEQ ID NO: 107261 - DNA, 1407 bp, Artificial Sequence
  Description of Artificial Sequence: Synthetic coding sequence
atggaaattctctggaaaactctgacctggatactgagccttataatggcttccagtgagttccactccgatcacagactaagctatagctcccaagaagaattccttacgtacctcgagcattaccagttgaccattcccatcagagtcgaccaaaacggtgcctttctttctttcactgtgaagaacgacaagcattctcggaggaggaggtccatggatccgattgatccacagcaggccgtctctaagctgttcttcaaactctcagcctatggcaagcactttcacctcaaccttaccctgaacacggattttgtgtcaaagcatttcacagtagagtactggggcaaggacggaccgcaatggaagcatgactttctggataactgtcactatacggggtatctccaggaccagcggtccaccacaaaagtcgccttaagtaactgcgtggggctccacggagtgatcgccaccgaagatgaagagtacttcatcgagcctctgaagaatacaaccgaagactctaaacactttagctatgagaacgggcacccacacgtaatttataagaagagtgccttacagcaaagacacctgtacgaccactcacattgtggggtgtccgacttcactcgaagtgggaaaccttggtggctgaacgataccagcaccgtctcctattcattgccgatcaacaacacccacatacatcacagacaaaagcggagtgtgtcgatcgagcgttttgtcgagacactggtcgtggcagataagatgatggtaggttatcacggccgcaaggatatcgagcactatatcttatctgtgatgaacatcgtggcgaagctctatcgggactcctcgttggggaacgtcgttaatatcatcgtggcccgactcatcgtcctaaccgaggatcagcctaacttagagattaatcaccatgctgacaaatcgcttgactccttttgcaagtggcagaagagcatactcagccaccagtccgacggaaacacaattcccgaaaacgggattgctcaccatgataacgcagtgttgatcactcgatacgacatctgtacatacaagaataagccttgtgggactctcggccttgcctccgtggctggaatgtgcgaaccagagagatcctgtagcatcaatgaggatatcgggttaggctccgcttttacgatagcccacgagatcggacacaacttcggaatgaaccacgacggaatcgggaacagttgcgggacgaaaggccacgaggcagcaaaactaatggctgcccatatcaccgcaaataccaacccctttagctggagtgcctgttccagggactacatcacatcttttctagagttcttaaagttaggtgactctataagtggctcctag

SEQ ID NO: 107262 - DNA, 5061 bp, Artificial Sequence
  Description of Artificial Sequence: Synthetic coding sequence
atgccagggggcccatctccaagaagcccggcccccctgctgcggccacttcttcttctcctgtgtgcacttgcccccggagctccgggccccgcccccggtcgcgccaccgagggccgggcagcactagatatagtacatcctgttcgcgtggacgctggaggcagcttcttgtcctatgaattatggcctcgtgccctccgtaagagagacgtcagcgtccggcgtgatgctcccgcgttctacgaactgcagtatcgaggacgagagttgaggttcaacctgaccgctaaccagcatcttttggcacctggatttgtctcagaaacaagacgcagaggaggcctgggtagggcccatatacgagcacacacacccgcgtgtcacctccttggtgaggttcaggaccctgagctggaaggtggactggccgccatttccgcctgcgacggtctgaagggggtgttccagctgtccaacgaggactatttcatagagccacttgactcagcccccgcaaggcctggacatgctcagccgcacgtagtctacaagagacaggctcctgaaagattagcccagcgcggggactcttcggcaccttccacttgtggtgttcaggtataccccgaacttgagagcagacgcgaaaggtgggaacaacggcaacaatggcgacgaccccggctgcgacgcctgcatcagagatcagtttctaaggaaaaatgggtcgagacccttgtggtcgccgacgccaaaatggtagaatatcatggtcagcctcaagtggagtcctacgtgttaacgattatgaatatggtcgccggcctgtttcacgatccgtctataggaaatcccatccatatcactatcgtgcgcctggtgcttctggaagatgaagaagaagatttgaagatcacccaccacgccgacaatactctcaagtctttttgcaagtggcaaaagtctatcaatatgaagggcgatgcacaccccctacaccacgacaccgccattctgctgacgcgtaaggacctatgcgccgctatgaatagaccctgcgaaaccctgggactgtctcacgtggccgggatgtgccaaccccatcgctcctgttccattaacgaagacactggcctgccactggcctttaccgtggcccacgagctaggccactcgttcggcattcaacatgatggctcaggaaatgactgcgaaccagtggggaagagaccctttatcatgtcccctcaattgctttatgatgctgccccgctaacgtggtcaagatgttcccgccagtacattacccgctttttggatcgcggatgggggctttgtctggacgatcccccggccaaagatataattgatttcccctctgtccctcccggcgtgttgtatgacgtgagtcatcagtgtagattacagtatggagcctactcagccttttgtgaggacatggataacgtgtgtcacacactatggtgcagtgttggcacgacctgccactccaaactcgacgcagctgtcgatggaactaggtgtggcgagaataaatggtgtctctcaggtgaatgtgtacccgttggtttcaggcccgaggctgtcgatggtggctggtccgggtggtccgcttggtcaatttgctctcggtcctgtgggatgggagtacaatctgctgaacggcagtgcacccagccgacacccaagtacaaggggcgctactgcgttggagaacgcaaacgtttccggctctgtaacctgcaagcttgccccgcgggccgccctagcttcagacatgttcagtgctctcactttgatgccatgttgtataaggggcagttacatacttgggtgcctgttgtgaacgatgtgaatccttgcgagctccattgtagacccgcgaatgagtactttgcggaaaaactccgcgacgccgtggtcgacgggaccccttgctaccaggtcagagctagtcgggatctttgtattaatggcatttgcaagaacgtcgggtgtgatttcgagattgactcaggagcaatggaggatcgttgcggggtgtgccacggaaacggatcaacctgccacaccgtgagtggcacattcgaggaggctgaaggactggggtacgtcgacgtaggtcttattccagcgggcgccagggagatccgtattcaggaggtggctgaggccgccaatttcctggccttaaggtcagaggatcccgagaaatatttccttaacggagggtggaccatccagtggaacggagattatcaggtcgccgggaccacttttacgtatgcacgccgagggaattgggaaaatctgacatctccagggcctacgaaagaaccagtgtggatccagctgctgtttcaggagagcaacccgggggtacactatgagtacaccatccaccgcgaggcggggggccatgatgaggtgcctccccccgtgtttagctggcattacggaccttggactaaatgtacagtaacatgcgggcgcggagttcagagacaaaatgtgtattgtctcgaaagacaagcaggccccgtcgacgaggaacactgcgatcctttgggacggcctgatgaccagcagaggaagtgttccgagcagccttgcccagcacgttggtgggcaggtgaatggcagctttgcagttcatcctgcggtccaggaggcctctctagaagagccgttctctgtattagatcggttggcctagatgaacagtcagctcttgagccacctgcttgcgagcatctgccaaggccacccacagaaactccctgcaatcgccacgtgccatgccctgcaacttgggctgtgggtaactggtctcaatgctccgtgacctgcggtgagggaacccagcgtagaaacgtcctgtgtactaacgataccggtgtgccctgtgacgaagcccagcagcccgcttctgaggttacatgttctctgccgctctgccggtggccgctcggcacactgggacctgagggcagtggaagcggctccagttcacacgaactcttcaatgaggccgactttatccctcaccacctcgctcctaggccatcaccggcttcaagtccgaagcccggcaccatggggaacgctatcgaggaagaggcgcccgagttggacctgcctggacctgtgttcgtcgacgacttttactacgactataattttattaacttccacgaagatctctcttacggtccatccgaagagccagatctcgacctggcaggaacgggcgacaggacccctcctcctcatagtcatcctgccgccccctctactggaagccccgtacctgccactgagccgccagcggcaaaggaggagggtgttctgggcccttggagcccctccccctggccaagccaggctggacgatccccgccgccaccttcagaacagacccccggaaaccccctaattaattttctccccgaagaggataccccaatcggcgcaccagatctgggtctaccttctttgtcatggcccagagtgtctacagacggtctacagacgccagcaactccagagagccaaaatgacttccccgtgggtaaagattcacaatctcaactgccacccccttggcgtgacagaacaaacgaggttttcaaggatgacgaagaacccaaaggtcggggtgcgccccatcttccaccgaggcccagttccacattaccaccgctgagtccagtgggaagcacccactcttctcccagtccagatgtcgccgaactgtggactggtggcacagtggcttgggagcccgcactggagggcggcctcgggcccgtggactccgagctgtggcccacagtgggggtggcttcactgttaccccctcctatcgctcctctgcccgaaatgaaggtaagagacagcagcctggaacctggaacccctagttttcctaccccgggaccaggttcgtgggacctgcagaccgtggccgtctggggtacgttcctaccaacaactttgacaggccttggacacatgcccgaaccagccttaaaccctggtcctaaagggcagccagaatcactctccccagaggtcccactgagcagtaggcttctcagtacccccgcttgggacagtcccgctaactcacaccgtgtgcccgaaacccagccactcgctccgagtctggccgaggccggccctcccgcggatcctctggtggtgcgaaatgcggggtggcaggccggaaactggtccgagtgcagtacgacatgcgggttgggggccgtgtggcgtccggtgagatgtagctctgggcgggatgaagattgtgcgcccgcgggccgcccccaacccgccagacggtgccatctgcgtccctgcgctacgtggcattcagggaattggtccaagtgctctcgatcatgcggcggaggaagtagtgtccgagatgtgcagtgtgtcgacacccgggacctgaggcccctccggccgttccactgtcagcctgggcccgccaaacctcccgctcaccggccatgcggggctcagccatgtctttcgtggtatactagctcctggcgcgaatgttcagaggcatgcggcggtggcgagcaacagcgactggtcacatgtcctgagcccggcctttgcgaggaggctctcagaccgaatacaacaagaccttgcaatacccatccgtgtacacagtgggtggttgggccctgggggcagtgttcaggtccatgcggcggtggggtgcagaggcgtctggtcaaatgtgtgaatactcaaaccggtcttcccgaggaggactctgatcaatgtggacacgaagcgtggcccgagagttctcgaccgtgcggaactgaggattgtgaaccggtcgaaccacccagatgcgagagagacagactgagtttcgggttctgtgagacgctgcgcctgcttggtcggtgtcagttgcccactatcaggacccaatgttgccgtagctgtagccccccttcccatggagcgccgagtcgtggtcaccaacgcgtagcccgccgctag

SEQ ID NO: 107263 - DNA, 1383 bp, Artificial Sequence
  Description of Artificial Sequence: Synthetic coding sequence
atgcctggaggcccttccccaagatccccagctccactgctgaggccactgcttttgcttctttgtgcccttgcccctggggcacctggccctgcccccggaagggcaaccgagggccgggcagccctcgatatcgtgcacccagtcagagtcgatgctggcggatctttcctcagttacgagttgtggccccgcgccctccggaagagggatgtgagtgtgcgacgcgacgccccagccttttacgagctgcagtatagaggtcgggaacttaggttcaaccttaccgctaaccagcacttacttgcgcccggattcgtgagcgaaacaaggaggaggggggggctcggacgcgcccacatccgggcccacacccctgcctgccacttgctgggtgaagtgcaggatccggagttggaaggcggccttgcggctattagcgcctgtgatgggttgaaaggcgtgttccagctgagcaacgaggattactttatagagcctctggactcagcacccgcgagaccggggcacgcacagcctcacgtcgtttacaaacgtcaggcccccgaacggctggcgcagcgaggagatagtagtgcaccgtctacctgtggggtgcaggtttaccccgagctggaatcgaggagagagaggtgggaacagcggcaacaatggaggcgcccgcggttgcgcagattacatcagcgaagcgttagcaaggaaaaatgggtagaaactctggtcgttgcagacgccaagatggtcgaataccatggacaaccgcaggtggaaagttacgtgttgactataatgaatatggtcgccggtctgttccacgacccctctataggcaacccaattcacattaccatcgtgcggctagttctcctggaagacgaggaggaggacttaaaaattacccatcacgccgacaacactcttaagagtttttgcaagtggcagaagtccatcaacatgaagggggatgcccaccccttgcaccacgataccgcgattctgcttactcgaaaggacttgtgtgcagcaatgaacagaccgtgcgagaccctgggcctctcacacgtcgccggcatgtgccaaccccacagaagctgctctattaacgaggacacaggccttcctctggcgtttaccgtcgctcacgagctcggacacagttcctgcacaacccccctaccaagccccggccccgcggcagctgcgagtatttctccaggctcgctctcagtgcagagacaaaatgtgtactgtcttgaacgtcaggccggacccgtagatgaggagcactgtgatccccttgggaggcctgacgatcagcagcgtaagtgttcagagcaaccttgtcctgcttcagcgcaatag

SEQ ID NO: 107264 - DNA, 2670 bp, Artificial Sequence
  Description of Artificial Sequence: Synthetic coding sequence
atgctcccggctcccgctgctccacgctggccacccctgctgctcttactgctattgttgctgcccctggcccgcggagctccagcaaggcccgccgcaggcgggcaagcttcagagctggttgttcccactcgacttcctggcagcgctggtgagcttgcgcttcatttgtcagcctttggcaagggcttcgtgctgaggttggctccagacgacagttttctcgccccagagtttaaaattgagcgactcggcgggtcaggaagagctacgggcggagagagaggtctgcgcgggtgctttttctcggggacggtcaacggggaacccgaatccctggctgccgtgagcctctgccgcggactcagcggatcctttctcctcgacggggaggagttcacaattcagccacagggggctggtggcagtttggcgcagccccataggctacagagatggggtcccgccggggccaggcctctccctagggggccagagtgggaggtggagactggggaagggcagagacaagagcggggagatcatcaagaggatagcgaagaggaatcccaagaggaggaagccgaaggagccagcgaacctccaccaccccttggagcgacgagccgtactaagaggttcgtctccgaagcacgctttgttgagactctgttagtggcagatgcatccatggcagccttttacggcgcggacctccagaaccacatcttaaccttgatgtccgtggccgccaggatctacaaacatccaagtattaagaacagcatcaatcttatggtcgtaaaagtcctgatcgtagaggacgagaagtggggaccggaagtttcagacaacggtggcctgaccctgcggaacttctgcaactggcagcgcagatttaatcaacccagtgaccggcaccccgaacattatgatacagccatcctcttgactagacagaatttttgtggacaggaaggtctgtgcgacactctgggagtggccgacattggaacgatatgcgatcccaacaaaagctgtagcgtgatcgaagacgaggggctgcaagctgctcacacactggctcatgagctcgggcacgtcctctctatgccccacgatgattccaagccttgcaccagactgtttgggccgatgggtaaacaccacgtgatggcaccactatttgtgcacttaaaccagacactgccctggtcgccctgctcagcaatgtacctgacggagctgctagacggcggccacggggactgcctgcttgacgctccagccgccgctcttcccctgcccacaggcctgccaggtcggatggctctgtatcaactggatcaacaatgccggcagatcttcggccctgatttcaggcattgtcctaataccagtgcacaggacgtgtgcgctcagctatggtgtcacactgatggcgctgagcctctgtgccataccaaaaatggctcgttaccttgggcagacggaactccttgtggacctgggcacctttgtagcgaagggtcctgcctgccggaagaggaggtggagagacccaagcctgttgctgacggaggctgggccccatggggcccatggggagagtgctcaaggacatgcggaggcggggtccagttttcccacagagagtgtaaggacccagagccacagaatggcggcaggtactgtctcggccgtcgggcgaaataccagagttgtcatacagaggagtgccctcccgatggcaagtctttcagagaacagcagtgcgaaaagtataatgcttataattacacagacatggacggcaatctgctccagtgggtcccgaagtacgcgggtgttagccctcgggatagatgcaaactgttctgccgcgctcggggaaggagtgaattcaaagtgttcgaggccaaagtgatcgatgggaccctttgtggacccgaaaccttggccatctgcgtaaggggacagtgtgtgaaagccgggtgtgatcatgtggtggactcgcccagaaagctcgataagtgtggcgtgtgtggaggaaaagggaactcttgtcgaaaggtgtcaggaagtctcactcccaccaactatggctacaatgatatcgtgactatacctgcgggtgccacgaacatcgatgtcaaacaacggagccaccctggagttcagaatgacggcaactaccttgccctcaagacggccgatggccaatatctcctcaatgggaacctggccatctccgctatagagcaggatatcttggtaaagggtaccatcctcaaatattcaggttcaattgcaacgctggagcggctccagtcctttcgacctctgcctgaaccactgaccgtgcagttgctgacagtgcccggcgaagtgttccctccaaaggtgaaatatactttcttcgttcctaatgatgtagatttttctatgcagagctcgaaagagcgggctacaaccaatataatccagcccctgttacatgcgcaatgggtactgggcgattggagtgagtgctctagcacatgtggtgccggatggcaaagacgtacggtcgagtgccgggatcccagtggccaggcatcggctacatgcaacaaagctctgaagcccgaggatgcgaagccctgtgagtcacagctgtgccccctatag

SEQ ID NO: 107265 - DNA, 2757 bp, Artificial Sequence
  Description of Artificial Sequence: Synthetic coding sequence
gctgccagagctaggctgggcgggggaggggccggtggagccggctgcgccagccaacgaggcagaagagggtctgcaccagcagctggcccccgcggccctagcagaccttgtactcggcttataccactttttctcgaacgtgcagcaggaccacgctccggcagacagcatctgcccgccccaggcgggctcctgccatctcctgcacgaagccacagacgaagcccacatgcgcccagacccaggagacccccagtggcctcagcaccggcggcagctgcagccgccgctgccgctggaccccggcgaccaggaccggcaaggagtagaggagccggcctgggtgcgggcggagcacacgccgtggcccggctcaggggctgcttcttttcaggcaccgttaacggggagcccgaatccctcgctgctgtgagcttatgccggggactcagtggtagcttcctgctcgacggcgaggagtttacaatccagcctcagggtgctggaggcagcttagcccagccccatcgattacagcgctggggcccggcgggcgcacgtccacttcctcgcgggccggaatgggaagtggaaacaggggaaggacagagacaagaaaggggcgaccatcaggaggactcagaagaggagtcacaagaagaggaggccgagggcgcctcagaaccgccccccccccttggagctacttccagaacaaaacgattcgtgagtgaagcaaggtttgtcgagaccctcttggtggccgatgcgtccatggctgccttctatggtgcagacctacagaatcacattctgaccctcatgtctgtggcagctagaatctataagcacccatccatcaagaacagcatcaaccttatggtggtaaaagttttaatagtggaggacgaaaaatgggggcctgaagtgagcgataacggggggctgaccctgcgcaatttttgtaattggcaaaggcgattcaatcagccatccgacagacatccagaacattatgatactgctatccttctcaccaggcagaatttttgtggacaggagggactgtgtgatacccttggagtcgctgacattgggactatatgtgaccccaacaaatcctgtagtgtcatcgaagatgaagggttgcaggccgcccacacgttggcccacgaactcgggcacgtgctctctatgccacacgatgattcaaaaccttgcacccggttgttcgggccgatgggcaaacaccacgtgatggcccccctgttcgttcacctgaatcagacgctaccttggtctccttgctccgcaatgtatctgacagagctgctagatgggggccatggtgattgtctcctcgatgccccggctgccgcattgcccctgcctactggcttgccaggtcgcatggccctgtaccaacttgaccaacaatgccgtcagatttttggcccagattttcggcactgtcccaatacctctgcgcaggacgtgtgcgcccagctctggtgccacacagacggagccgaacctctgtgtcacactaaaaatggcagcttaccttgggctgatggcactccttgtggccctggccacctgtgtagtgaggggagctgcctgcccgaagaagaagtggaaagaccgaaacccgttgcggatggaggctgggcaccttgggggccttggggggaatgttccagaacatgcgggggcggagtacaattcagccatagagaatgtaaagatcctgaaccacaaaatggaggccgttactgcctgggcagacgcgctaaatatcaatcatgtcacacagaggaatgcccgcccgatgggaagtcgttcagggaacagcagtgtgagaagtacaatgcatataactatacggatatggacggcaacctgctgcaatgggtgccaaaatacgccggagtctccccaagggaccggtgcaaactattctgtcgggccaggggtcgctctgagtttaaggtgttcgaagctaaggtgattgatggcactctgtgtgggcctgaaacactggcgatctgtgtaagggggcagtgtgtgaaagcgggatgtgaccacgtggtggactcacccaggaaacttgataaatgcggtgtgtgtgggggcaaggggaatagctgccgcaaagtgtcggggtctctgacaccaaccaattacggttacaatgacatagtaacgatcccagcgggcgccaccaacatcgatgtgaagcagagatcacatcccggagtacagaatgacgggaactatctggccctgaaaacagcagatggacagtacctgcttaacggtaacctggctatttctgcaatcgagcaggatattcttgttaagggcactatcctgaagtacagcgggtccatcgccacactggaaaggctccagagtttccgacccctgccagagccgctcactgtgcagctccttaccgtgcccggcgaagttttccctccaaaagtgaaatacactttcttcgtacctaatgacgtggatttctcaatgcagtcctctaaggagagggccaccacaaacattattcagcctctgctgcacgctcagtgggtgctcggcgattggagcgaatgctccagcacttgtggcgccgggtggcagcggcgcaccgtggaatgcagagatccctcagggcaggccagcgccacctgtaacaaggcactaaagccggaagatgcaaaaccatgtgaatcgcaactgtgtcccctatag

SEQ ID NO: 107266 - DNA, 5724 bp, Artificial Sequence
  Description of Artificial Sequence: Synthetic coding sequence
atgcagttcgtgagctgggccacgctgctcaccttgctggttcgagacttggccgagatggggagtcctgatgccgcagccgccgtccggaaggacagactccaccctcggcaggtcaagctcctggaaacgctgtcagaatatgagatcgtgtcacccatcagagttaatgctctgggagagcccttccccactaacgtgcatttcaaacgaacgcggaggagtattaatagcgctacagacccctggccagccttcgcaagttcttcatcctcctccacatcatctcaggctcactatagacttagtgcgttcggccagcagttcctgttcaaccttacagccaatgctggcttcattgcaccgttgtttacagtgacccttttgggtacccctggggtgaaccagaccaagttctattcagaagaagaagctgagctgaaacattgcttctacaagggctacgttaataccaattctgaacataccgcagtgatcagcttatgtagtggtatgctgggtacgtttaggagccatgacggagattacttcatagagccactgcagtccatggacgagcaggaagacgaggaggagcagaataagcctcatattatttatcggcgcagtgccccccaaagagagcctagcaccggaaggcatgcgtgcgatacaagcgagcacaagaacagacacagcaaagataaaaagaagactagggctcgcaaatggggtgaaaggatcaatctagcaggggacgtcgccgcgttgaattccgggctggcgacagaggcattcagtgcgtacggtaacaaaaccgacaatacaagagaaaaacggacacacaggcgtaccaagagatttctttcctatccgcgattcgttgaagtgttagtggtggctgataatcgcatggtgtcataccatggcgaaaacttgcagcactacattctcacgctgatgagtatcgatggcccatctattagcttcaacgctcagactactctcaagaatttttgtcaatggcagcactccaaaaatagtcccggcggaatccaccacgacaccgctgtcttgttaacccggcaagatatatgcagagctcacgataaatgcgatacgctcgggttggcagaattaggaacgatttgcgatccatacaggtcgtgtagtatctccgaagattcaggcttatccaccgcattcacgatagcacacgaactaggacacgtgtttaacatgccccacgatgataacaacaagtgcaaagaggaaggagtgaagtcgccacaacacgttatggctccaaccctgaacttttacacaaatccttggatgtggagcaaatgctcgcggaagtacataactgaatttctagacaccgggtacggggagtgtttgctgaatgaaccagagtccaggccctatccccttcctgtgcagctccccggtattctttacaacgtgaacaaacagtgcgagcttatcttcggtcccgggagtcaagtgtgtccatacatgatgcagtgccgtcgcttgtggtgcaacaatgtaaatggagtgcacaaggggtgtcgcacgcaacatactccttgggcggacggaacagaatgcgagcctggaaaacactgtaaatacggcttttgcgtccctaaagaaatggatgtgcccgtgacagatggcagctggggatcatggagtccttttgggacttgttcccgaacctgtggaggtggcatcaagactgctatcagggaatgcaatcggcctgaaccaaagaatggagggaaatactgcgttggcaggcggatgaagttcaagtcctgcaacaccgagccctgtctcaaacaaaaaagggattttcgcgatgagcagtgtgcacatttcgatggtaagcattttaacattaatggcctgttgccaaatgtccgttgggtcccgaagtactccgggattcttatgaaggacagatgtaaacttttttgtagggttgctggcaataccgcgtactaccaattaagggacagggtcatcgacgggaccccttgcggccaggataccaatgatatttgtgtacaggggctgtgtaggcaggccggctgtgaccatgtgctgaatagcaaagcaaggcgggataagtgtggcgtgtgcggcggggacaattcctcatgcaagacagttgcagggacgttcaatacagtgcactacggatacaatactgtggtgcgcattcccgctggagccactaatatcgatgttcgtcagcactccttctccggcgagaccgacgacgacaactacctcgccctctcttcatcgaagggggaatttctcttgaatggcaattttgtcgttacaatggctaagcgtgaaattaggatcggtaatgccgtagttgagtactccggctctgaaacagccgtagagagaataaacagtacagaccgcattgaacaggaactgctgctccaggtcctctctgtgggaaagctctacaatcccgatgttcgttacagttttaatattcccatcgaggacaaacctcagcagttttactggaattctcatggcccttggcaggcatgttcaaaaccatgccagggtgagaggaagcgcaaattggtctgtacccgagaaagcgaccagctcaccgtgagtgatcagagatgcgacagactgcctcagccaggccatattactgaaccctgtggaactgactgcgatctccgatggcacgttgcttctcggtccgaatgcagcgcccaatgcggactgggatatagaacattagatatctactgcgccaaatatagccgcctggacggtaaaacagaaaaggtggacgatggcttctgtagttctcatccgaagccttccaacagagagaaatgcagcggcgaatgcaatacgggcggttggcgctactcagcttggaccgagtgttcgaaatcctgcgacgggggaacccaaaggcgccgggccatatgcgtcaacacgcgaaacgatgtcctggacgactcaaaatgcactcaccaggagaaggtaaccatacagcgctgcagtgaatttccatgccctcagtggaaatccggcgattggtccgaatgtcttgtgacatgtggtaaaggacacaaacataggcaagtgtggtgccagttcggtgaagaccggttgaatgatcggatgtgtgatcctgagacgaaacctacttctatgcagacttgtcagcagccagagtgcgcttcgtggcaggctggaccctggggtcaatgttcagtgacgtgtgggcagggctaccagctgcgtgccgtgaaatgtataatcggcacttatatgtccgtggtcgatgacaatgattgcaatgctgccacccggcccaccgatacgcaagactgcgagctcccctcatgtcatccccctcctgctgcgcccgagacccgccgcagcacatacagtgctcctaggacccagtggaggttcgggtcatggacaccctgtagtgctacttgcgggaagggcacgaggatgcgctatgtgtcgtgtcgggacgaaaacggttcagtggccgatgagtcagcctgcgcgacgttgccaaggccagtcgccaaggaagagtgctccgtcacgccctgtggtcagtggaaggcgctagactggtcttcatgttcagtaacctgcggacaaggccgggccacccggcaggttatgtgtgtgaactacagtgatcacgtgattgaccgcagtgagtgcgatcaggattacatacctgagaccgatcaggactgttcaatgagcccttgtccgcagcgaactccggactcaggtcttgctcaacatcctttccagaatgaagattaccgtccaaggagcgcgtccccatctaggacgcatgtgctggggggaaaccagtggcgcaccggaccctggggcgcctgctccagcacatgcgctggaggtagccagcgaagggtcgtggtctgtcaggacgaaaatggttacactgccaacgattgcgtcgagagaattaagcctgatgaacagagagcatgcgagagcggcccatgcccacagtgggcttatggcaattggggcgaatgcacaaagctttgcgggggcggaattcggacgcgcctagttgtgtgtcagcgcagtaatggggagcgctttccagatctgtcctgcgagatcctggacaagcctcccgatagagaacagtgcaatactcacgcttgccctcatgacgcggcttggagcacagggccctggtccagctgttctgtgagttgcggcaggggtcacaaacaaagaaatgtttactgtatggctaaggacggcagtcatctggaatccgactactgcaagcaccttgccaagccacatggtcacagaaagtgtagaggaggccgttgtcccaagtggaaggccggggcttggtcccagtgtagtgtgtcctgcggtcgaggtgttcagcagagacatgtaggctgtcagatcgggacccataagattgccagggaaaccgaatgcaacccttatacccgacccgaatcggaaagggattgccagggtccaagatgtcctttgtacacttggcgtgcagaagagtggcaggagtgtaccaagacctgtggggaaggaagtaggtaccggaaggttgtttgcgttgatgataataagaacgaagtacatggtgcaagatgcgatgtgtcaaaacgtcccgttgaccgtgagtcttgttcactccagccctgcgaatatgtgtggatcaccggcgagtggtccgaatgctcagtaacatgcggcaaaggctacaagcagcgtctcgtgagttgctccgaaatttatacaggcaaagaaaactatgagtattcttatcaaacaaccattaattgtccaggaacacaaccaccgagcgttcacccttgctacctgcgtgactgccctgttagcgcgacttggcgggtcggtaactggggaagctgcagcgtgagctgtggggtgggtgtgatgcaacgatcagtccaatgcctgacgaacgaagaccagccctcccatttgtgtcacacagatctgaaaccagaagagcgcaaaacatgtagaaatgtgtacaattgcgaattaccgcagaactgcaaggaagtcaagaggctgaagggagcctctgaggacggcgaatattttctgatgatcaggggcaaacttctgaagattttctgtgccggcatgcactcagatcatccaaaggaatatgtaaccctggttcacggcgatagtgaaaacttttcagaggtttacggccacagactacataaccctacagagtgcccctacaatgggtctaggagagatgactgccagtgcaggaaggattacacagctgcaggctttagctcgtttcaaaaaatcaggatcgacttgactagcatgcagatcattacaactgacctgcagttcgctcggacatcagaaggccacccagtgccctttgccactgccggggattgctactctgctgcaaagtgccctcaaggccggttcagcattaacctttatggaacgggactgtcactgacggagtcagcacggtggatctctcaggggaactatgccgtcagtgatattaagaagagccccgacggcacaagggttgtgggaaaatgcgggggatactgcggtaaatgtaccccttccagcgggactggactcgaagtgagagtgttgtag

SEQ ID NO: 107267 - DNA, 2976 bp, Artificial Sequence
  Description of Artificial Sequence: Synthetic coding sequence
tgagaatgtagtgcccagtgcgggcttggctaccgcactttagatatctattgcgccaagtactcaagactggacgggaaaacagaaaaggtggacgatggcttctgctctagccatcccaagccgtctaatcgagaaaaatgctccggggagtgcaacacggggggctggaggtacagcgcttggaccgaatgttcgaagtcctgcgatgggggaacgcagaggagacgagcgatctgtgttaatactcgcaacgacgtgcttgatgactccaaatgtactcaccaagagaaggtcactattcagaggtgctccgaattcccatgtccacagtggaagtccggggactggtccgagtgtttagttacatgcggaaagggacataaacacaggcaggtttggtgccaattcggcgaggaccggctaaacgatcgcatgtgtgaccctgaaactaagcctacatctatgcaaacctgccagcagcccgaatgcgctagctggcaggcgggaccgtggggacagtgttcagtgacatgtggccaaggttaccaattgcgcgcagttaaatgtatcatcgggacctacatgtcagtggtggacgacaacgattgcaacgcagcgactaggcccaccgatacacaggactgcgagctgcctagctgccacccaccccccgctgcgcctgagacccggcggtccacatactcggcccctaggacccaatggagattcggcagttggaccccatgcagtgccacttgcggcaaggggactcggatgcgttacgtcagttgcagggatgaaaatggaagtgtggcggacgaatcagcctgtgcaactctgccgaggccggttgccaaagaggagtgcagcgtgaccccttgcgggcaatggaaggcactggattggtcctcatgcagtgtgacatgcggccagggtcgtgcgacgaggcaggtgatgtgtgttaactactctgatcacgtgattgacagatctgaatgtgaccaggactacattccagaaacagatcaggattgttccatgagtccgtgtcctcagcgcacgcctgattctggactcgctcagcatcctttccagaacgaagactatcgaccacggagcgcatctccctcgagaacccacgtgctgggtggaaatcagtggaggaccggcccttggggagcctgctcatctacctgtgctggcggtagccaacgcagggtcgtagtgtgtcaggacgagaatggctatactgccaacgattgcgtagaacgcattaaacccgatgaacagagagcttgtgagagcggcccttgccctcagtgggcctacggcaattggggcgagtgtaccaaactatgcggcggagggatccggacccggttagtcgtttgccagagatccaacggcgaaaggtttcctgacctgtcttgtgaaattttggataagcctcctgatcgtgaacaatgcaacacccatgcctgtccacacgacgcggcctggtcaacaggtccgtggagcagctgttccgttagttgcggcagaggccacaaacagcgtaacgtctactgtatggctaaagacgggagccacctggagagcgactactgcaagcacctggccaaaccccatggccatcgcaagtgtcgcgggggaagatgtcctaagtggaaagctggggcgtggtcacagtgctcagttagctgtggcaggggggtccaacagcgccatgtagggtgccagatcgggacacacaagatagctcgcgagacggagtgcaatccatataccagaccggaatctgagcgtgactgccagggtcccagatgtccgctgtatacatggagagccgaggaatggcaggagtgcacgaagacttgtggagaaggcagccggtatcgcaaagttgtctgtgtggacgacaataagaacgaggttcacggcgccaggtgcgacgtgagtaagaggcctgtggaccgtgaatcatgcagcctgcagccatgcgaatacgtgtggatcactggagaatggtccgaatgctccgtaacatgcggtaaaggatataaacagcgcctggtgagttgttctgaaatctacacaggaaaagagaactacgaatacagctatcagaccactatcaactgccctgggacacagccaccttccgtccatccgtgttacttgagggactgcccagtgagcgctacctggcgcgtgggaaactggggcagctgtagcgtgtcctgtggcgttggggtcatgcagcgttcggtccagtgccttaccaatgaggatcaaccatcgcacctctgtcatacagacttaaagccagaagaaaggaagacctgcaggaacgtgtacaactgcgagcttccccagaattgcaaagaagtgaaaagactgaagggcgcgtctgaggatggcgaatactttttgatgattagaggaaaactactgaagatcttctgtgcgggaatgcactctgaccatccgaaagagtacgtgacccttgtccacggagattccgagaatttttctgaagtttacggtcatcggctgcacaatcccacggagtgtccatacaacgggagtcgcagggacgactgtcaatgccgaaaggattatactgccgcgggtttctcctccttccagaagatcaggatcgatctcacaagtatgcaaattatcacaacagacctgcagttcgccagaacatccgaaggacatcccgtgcctttcgctaccgccggggattgttactcagccgcgaagtgtcctcaaggacgcttctccataaacctatacggaacagggttgagcctgaccgagtccgcccgatggatcagtcaaggtaactacgccgtatccgacatcaagaagtcaccagatggcacacgcgtggtcgggaaatgcggtggatactgtggtaagtgtactccttcaagcgggaccggcttggaggttcgggttctctag

SEQ ID NO: 107268 - DNA, 5808 bp, Artificial Sequence
  Description of Artificial Sequence: Synthetic coding sequence
atgcagtttgtgtcttgggccacgctgctgactctcctggtgcgggaccttgctgagatgggctccccagacgctgctgccgctgtaaggaaagacagactgcacccacgccaggtgaaattgcttgagacattgtctgagtacgaaatcgtgtctccaatcagggtgaacgcgttaggggaaccattccccacaaacgtccactttaaaagaactcgcagaagtataaactccgctactgacccctggccggctttcgccagctcctctagttctagtacttcaagccaggcccattatcgcctgagtgcctttgggcaacagtttctgtttaatcttacggccaacgctggctttatcgccccattgtttacggtcacgttacttggaacaccaggagtgaaccagaccaaattttactccgaggaagaagccgagctgaaacactgtttctataaaggctacgtaaataccaactccgagcatacagccgtgatatctctctgctcgggcatgctgggtacatttagatcccacgacggcgattactttatcgaaccacttcagtcgatggacgaacaggaggacgaagaggagcagaataagccccatatcatttaccggcgcagtgccccccagcgggaaccctcaacggggcggcacgcttgtgacaccagcgagcacaagaacaggcatagtaaggacaaaaagaagactagggccagaaaatggggagaaagaattaatttggccggggacgtggccgccctgaactcgggcctcgctacagaggcatttagcgcctatggcaacaaaactgacaacactagagaaaagagaacccaccgccggacgaagcggttccttagttacccgagatttgttgaagtgctggtggtggccgacaacaggatggtttcgtaccatggagagaatctgcagcactatattctgacgttgatgtctatcgtcgctagtatttataaggatccgtccatcggcaatttgatcaatatcgtgattgttaacttgatcgtcatccataacgaacaagacggcccaagcattagtttcaacgcccaaaccactcttaaaaacttctgccaatggcaacatagcaagaacagtcccggcggcatacaccatgataccgctgttctgctaactaggcaagatatctgtagggctcacgacaagtgcgacactttgggactggctgaactcggaacgatatgcgatccataccgctcttgcagtatctcagaggattctgggctgtcaaccgcgtttactatcgctcacgagctcgggcacgtcttcaatatgccgcacgacgataataataaatgtaaagaagaaggagtgaagagccctcagcatgtgatggctccaacactgaatttctatacaaacccatggatgtggtcaaagtgttcgagaaaatacatcaccgaatttctagatacaggatatggcgaatgtcttctcaatgagcccgagagccgaccttatcccctgcccgtccaattaccgggcatcctatataatgtgaacaaacagtgtgagctaatctttggtcctggctcacaggtgtgcccttacatgatgcaatgtcgcagactgtggtgcaacaatgtgaatggggtgcacaagggttgcaggacccagcacactccgtgggctgacggaactgagtgtgaacccggcaaacactgcaagtatggtttctgtgtgcctaaagagatggacgtgccagtcacagacggttcatgggggtcttggtctccctttgggacttgctcccggacatgtggcggtggcattaaaaccgcaattcgtgaatgtaaccggcccgagcctaagaatggcggaaagtattgtgtaggaaggaggatgaaatttaagagttgcaacaccgaaccctgtcttaagcagaaacgagattttagggacgaacagtgtgcacattttgacgggaaacactttaacattaatggactgctacctaacgtgcggtgggtacccaagtattctgggatcttgatgaaggatcgctgcaagctgttttgtcgagtagctggaaataccgcatactaccagcttagggatcgcgtgatagatggtaccccatgcggccaggacacaaatgacatctgcgtgcaagggctgtgccgacaggccggctgtgatcatgtccttaattccaaggcacgcagagataagtgtggcgtgtgcggaggggataactctagttgtaagacggtggccggcacctttaatactgtgcattatggctacaatactgtggtccgcattcctgccggagcaaccaatatcgacgttcgacagcatagcttctctggcgaaacagatgatgacaactatctcgccctgtcttcctctaaaggagagtttttgcttaacggaaacttcgtcgtcaccatggccaagagggaaattaggatcggcaatgcggtcgtggaatactcgggatccgagacagccgttgagcgcatcaattccaccgatcggatcgagcaggaacttctccttcaagttttgtcggttgggaaactttataatccagacgtgagatactcattcaatattcctatcgaggacaagccacagcagttctattggaacagccacggaccttggcaggcatgctcaaaaccttgccagggtgagaggaagaggaagttggtctgcacgcgcgagtctgatcagttaaccgtctccgatcaacggtgtgaccgcctgccacagccgggccacattaccgaaccctgtggaaccgactgcgatctccgctggcacgtggcatcccgtagcgagtgctctgcacagtgcggcctcggatatcgcacactcgacatctattgcgccaagtacagccgcctggatgggaagacagagaaagtggatgacgggttctgcagctctcatccgaagccgtcaaaccgagagaaatgctcgggggagtgcaataccggcggctggcgttattcagcctggactgagtgttccaagtcatgcgatggcggaactcagcggaggcgggccatctgtgttaatacacgtaacgacgttcttgacgacagtaaatgtacacaccaggagaaggttactatccagcggtgcagtgagttcccgtgtccacagtggaagagcggcgactggagcgagtgcctggtcacgtgcgggaaaggccacaaacacagacaagtgtggtgtcagtttggtgaagaccgccttaatgatcggatgtgtgatcctgaaaccaaacctacctccatgcagacttgccaacagcctgagtgcgcctcttggcaagcgggtccatggggccagtgctctgtgacctgtggtcagggctaccaactccgagctgtgaaatgcatcatcggaacctatatgagtgtggtcgacgacaatgattgtaatgcagctacccgtcccaccgatacgcaggactgtgagctgccctcttgtcatcccccacctgctgcgcccgagactaggcggagcacttatagcgccccaaggacccagtggcgtttcggctcctggactccttgctctgccacctgtggaaaaggtacacggatgcgctacgtgtcctgtagggatgagaatggaagcgtggcagatgaaagcgcatgcgctacgttaccccgaccagtcgccaaggaggaatgcagcgtgactccctgtggacaatggaaggcactggactggtccagctgttcagtcacctgtggacagggacgagcaactagacaagtgatgtgtgttaactactctgaccacgttatcgaccgcagcgaatgtgatcaggattacatcccagagaccgaccaggattgttccatgtccccttgtcctcagaggacccccgacagcggtttggcccagcaccctttccagaacgaggattacagaccgaggtcagcttcaccctccagaacccatgttctgggcgggaatcagtggcgcaccggaccatggggcgcatgttcttccacatgcgccggcgggtcacagcggagagtggtcgtttgccaagacgaaaacggatacacagccaatgactgcgtagaacgtataaagcccgatgagcaacgcgcatgcgagagcgggccttgcccccagtgggcctatggcaactggggagaatgtaccaagctgtgtgggggaggcattagaacacgactggtcgtatgccagcgaagtaacggcgagcggtttccagatctgtcctgtgagattctcgataagccacctgatcgggaacagtgtaacacgcatgcttgtccgcacgatgcagcatggagcacaggcccctggtccagttgtagtgtcagctgtggacgagggcacaagcagagaaatgtgtactgtatggctaaggacgggagtcacctggagagtgattattgcaaacaccttgctaaaccacacggccatcgaaagtgcaggggcggcagatgccccaagtggaaagctggcgcttggtcacagtgttccgtgagctgcggcaggggggtccaacagaggcatgttgggtgtcagatcggcacacacaaaatcgcaagggagacagagtgcaacccctatacccgacccgaaagtgaacgcgactgccagggtccgcggtgccccctgtacacgtggagggctgaggaatggcaggagtgcacaaaaacctgtggcgagggatcaagatacagaaaggtggtctgcgttgacgataataaaaacgaagttcacggtgcgaggtgtgacgtcagcaaacgtcctgttgatagagagagttgctctctgcagccttgtgagtatgtctggatcacaggggagtggagtgaatgcagtgtgacgtgtgggaagggatacaaacagagattggtgtcctgcagcgaaatttataccgggaaggaaaactacgaatatagctaccagaccacaataaactgcccaggcacccaaccacccagtgttcatccttgctatctaagggactgccccgtatcagctacatggcgggttggtaattgggggagctgcagcgtttcatgcggcgtgggtgtaatgcagcgatccgtgcagtgcttgacaaatgaagatcaacccagtcacctctgccacaccgacctcaaaccagaggaaaggaaaacgtgtagaaatgtgtacaactgcgagcttcctcagaactgcaaagaagtgaagagattgaagggagcctcggaagacggtgaatactttctgatgatcaggggcaagttgctcaagatcttttgcgcagggatgcacagcgatcaccctaaggagtacgtaactcttgtgcacggagactcagaaaattttagcgaggtctatggacacagactgcacaatccaaccgagtgcccatacaatgggtctagaagggacgattgtcagtgtagaaaggactatacagcggccggtttcagttcattccagaaaatcaggatcgaccttacctcaatgcaaattattaccactgatctccagttcgcacgcacctcagaaggacacccagtgcccttcgcaacagcaggagattgctatagtgccgccaagtgtccccagggaagattctccatcaatctctacggcaccggactgagtttaaccgagtccgccaggtggatctctcagggaaattatgcagtctcggatatcaaaaagtcccctgatggaacccgtgtggtgggaaagtgcggtgggtactgtgggaaatgcacaccatcctctggaacgggattggaggtaagagttctgtag

SEQ ID NO: 107269 - DNA, 1176 bp, Artificial Sequence
  Description of Artificial Sequence: Synthetic coding sequence
atgattttgaacggagaagagatcatcttaagtctccagaagacaaaacatttgcttggtcctgattataccgaaaccctgtatagcccacggggagaggagataactaccaaacctgaaaatatggagcactgctactacaaggggaatatcctcaatgagaaaaactctgtcgcctccattagtacttgcgacggacttcgcgggtattttacccatcaccaccagcgctatcagatcaagcctctgaaatccaccgatgaaaaggagcacgctgtgttcactagcaatcaggaggagcaagaccctgctaaccatacctgcggcgttaaatctaccgatgggaagcaagggcccattcgtattagccgctccctgaaaagcccagaaaaggaggactttctccgggcccagaagtatattgatctgtatctggtcctggataatgctttttacaaaaattacaatgagaacctgacgttgattcgcagtttcgtgttcgacgtcatgaatcttctcaacgtgatttacaatacaatagacgtccaagtcgccctggtaggtatggagatatggagcgacggggacaagatcaaagtggttccatccgcttcgacaaccttcgacaactttctgcggtggcatagcagcaatttggggaagaagatacacgatcacgcacaactcctttcaggaatcagctttaataatcgccgcgtgggtctggcggcctcaaacagtttatgtagcccttccagcgttgccgtgatcgaggcgaaaaaaaaaaacaacgtcgcattggtcggagtcatgagccacgaactggggcacgtactggggatgcctgacgtgccctttaacacaaagtgcccatctggctcctgtgtgatgaatcagtacctgtctagtaaatttcccaaggatttttccacatcttgtagagcacattttgaacggtatctgctgagtcagaagcccaagtgcctgctccaggctcccatccctaccaacatcatgactaccccagtgtgcggtaaccacctattggaggtgggggaggattgtgactgtggctcccctaaggagtgcacgaacctctgttgtgaagccctcacttgcaagctcaaacctggtaccgactgcggcggggatgcgcccaatcacaccactgagtag

SEQ ID NO: 107270 - DNA, 1413 bp, Artificial Sequence
  Description of Artificial Sequence: Synthetic coding sequence
atgttgaggggcatctcacagcttcccgctgtggccacaatgtcatgggtgttgctgcctgtgctatggctcatagttcaaacacaggcgatcgctatcaaacagactcccgaactaaccctgcatgagattgtatgccccaaaaaactgcacatacttcataaaagagagatcaagaataaccagacagaaaaacatggaaaagaggagcggtacgaaccggaggtccagtaccaaatgatactgaacggcgaggagatcattttgagtttgcagaagactaaacacctcctcggcccagactatactgagaccctatactcgccacgcggtgaagagatcaccacaaaacccgaaaatatggagcattgctactacaagggtaacatacttaacgagaaaaattcagtcgcatcaatctccacctgcgatggactgagggggtactttacccatcatcatcagcggtaccaaattaaacctcttaaatcgactgacgaaaaggaacatgctgtatttaccagcaaccaggaagagcaggacccagcaaaccacacatgtggagtcaagagcaccgacggaaaacaaggccctatcaggattagtaggagtctgaaaagccccgagaaggaagatttcttacgggcccaaaagtacatcgacctctacctcgtgctggataacgccttttacaaaaactacaatgaaaatctgaccctgatcagaagttttgtttttgacgttatgaatctcctcaacgtcatctacaacacaatagatgtacaagtcgcgctagtgggtatggagatttggagcgacggtgacaagattaaagtcgtgcccagcgcatcaaccacattcgacaacttcttaagatggcactcctccaacctgggtaaaaaaattcacgaccatgcccaactactctcaggaatcagctttaataatagaagagttggtttggcagccagtaacagcctctgcagcccttcttcggtggccgttatcgaggccaaaaagaagaataacgtcgctctcgtgggggtcatgagccatgaacttggccatgtcttaggtatgccggatgtaccgtttaacacaaagtgtccctctggcagctgcgtgatgaatcaatatctgtcgtcaaaattccctaaggactttagtaccagttgccgggcccacttcgagcgttatctactctcccagaagcctaaatgtctccttcaggccccaattcccaccaacattatgaccacgccggtttgcggcaaccacctactggaagttggcgaggactgcgattgtggctccccaaaggagtgcaccaatctgtgctgtgaggcccttacttgcaaactgaagccagggacagattgcgggggagatgctcccaaccacaccaccgaatag

SEQ ID NO: 107271 - DNA, 1176 bp, Artificial Sequence
  Description of Artificial Sequence: Synthetic coding sequence
atgatcctcaacggagaagaaatcattctgagcctccaaaagacgaagcatctgctcggaccagattataccgaaaccctctatagcccgagaggggaagagataactaccaaacccgagaacatggaacactgctattataaggggaacatcctgaatgagaaaaactctgtcgcttctatcagtacttgcgatggcctgcgcggatacttcacccaccaccatcagcgctaccaaattaaaccacttaagtctacagatgagaaggagcacgcggtgttcaccagtaaccaggaggagcaagaccccgctaaccatacttgtggtgttaagtctacggacggcaagcagggccccatccgtatctcccgtagtttaaagtctccagaaaaggaggattttctgcgtgcccagaagtacattgatttgtatctggtgcttgataacgccttttacaaaaactacaacgagaacctgaccctcatcagaagctttgtgtttgacgtaatgaacttattgaatgttatctataataccatcgatgtacaagttgcacttgtcgggatggaaatctggtccgatggagataaaatcaaggtagtccctagcgcatcaaccacatttgataactttctccgctggcatagttccaatctgggaaaaaaaatacacgatcatgcacagttgctgtcaggcatctctttcaacaatcggagggtgggtttagcagctagcaattccctgtgttcaccctctagcgtcgctgtaatcgaggcaaaaaagaaaaataatgtggcattagttggtgtgatgagccacgaactggggcatgtgctcggtatgcccgacgtcccatttaatacaaagtgcccaagtggatcatgtgtgatgaaccagtacctctctagtaagttcccaaaggatttttctaccagttgccgagcccatttcgaaagatatttgctgagccaaaaaccaaaatgcttgctgcaagcgccaattcccacaaatattatgaccactccagtatgcggcaaccatctcctggaagtgggggaggactgtgattgcgggagccccaaggagtgtaccaacctgtgctgtgaggctttgacttgcaaacttaagccaggaacagattgcggaggcgacgccccgaatcatactaccgaatag

SEQ ID NO: 107272 - DNA, 2052 bp, Artificial Sequence
  Description of Artificial Sequence: Synthetic coding sequence
atggagtgttgccgtagagctaccccggggacccttcttctatttttggccttcctgcttctatccagccgcacggcgagaagtgaggaggatcgtgacggtctctgggacgcctggggtccatggagtgaatgttctcgtacatgcgggggaggagcctcctacagtctgagacgatgtcttagctcaaagtcctgcgaggggagaaatatccggtaccgcacttgctcaaacgtggactgcccccctgaggccggtgatttcagggctcagcagtgcagcgctcataatgacgtcaagcaccacgggcaattctatgagtggcttcccgtgagcaacgatcccgataacccctgcagtttgaaatgtcaggctaaagggacaaccctggttgtagagcttgcccctaaagtgctggacggcacgcgttgctataccgaaagcttggatatgtgcatttccggcctttgccagattgtgggttgcgaccatcagctcggcagcacagttaaagaggacaattgcggcgtttgtaatggtgatggatcaacttgcaggttggtgcgcggacagtataagtcccagctgagcgccacaaaatccgacgacaccgtcgtcgctattccttatggaagcagacacattcggcttgttctgaaaggccccgaccatctgtatctggaaaccaagaccctgcagggcacaaagggggaaaattcactctcaagcaccggtaccttcctggtggacaattcctcagtcgactttcagaagtttcccgacaaggagatactgcgaatggccggccctcttactgccgattttatcgtgaagatacggaactccggctccgcagactctaccgttcagttcattttctatcagccgatcatacatcgatggagagagacagatttttttccttgcagcgctacctgcggcgggggataccaacttacctccgccgaatgctacgatctcagatcaaatagggtggttgccgaccagtattgtcactactatccagagaacattaaaccaaagcccaagctgcaggagtgtaacctggatccttgtcctgcatctgacggctacaagcaaattatgccgtatgatttgtaccatccattaccccgatgggaagccacaccttggaccgcctgttcctccagctgtggcggaggcattcagtctagagctgtgtcctgtgtggaggaggacatccaaggccacgtgactagcgtagaggagtggaagtgtatgtacacaccaaaaatgcctatcgcacagccctgcaatattttcgactgcccaaagtggctcgcacaggagtggtcaccatgtaccgtgacttgcggacagggcctgcggtaccgagtggtgctctgtatcgatcaccgcgggatgcacactggtgggtgctctcccaagaccaagccacatatcaaggaggaatgtattgtccccacaccttgttacaagcctaaggaaaagctccccgtcgaggccaaattaccatggttcaagcaagctcaggaacttgaggaaggggccgccgtgagcgaagagccttcctttatcccagaagcctggtccgcctgtaccgtgacatgtggtgttggaacccaagtgcggatcgtccgctgccaggttctgctgagtttcagccagtcagtggcagacctgccgatcgatgaatgcgagggtccaaagcctgcctcccagcgggcctgttatgccggcccctgtagcggggagatccctgagttcaacccggacgagaccgacggacttttcggcggactccaggatttcgacgagctgtacgactgggaatacgaggggtttacaaagtgcagcgagagctgcggagggggagtacaggaagctgttgtgtcgtgtcttaacaagcagacacgagaaccggccgaagagaatctctgtgtaaccagcaggcggcctcctcagctgctgaagtcctgcaatctggacccttgtcccgcccgcagtagtattgactccgcctggaacgcgtgtaacgttttgtgctag

SEQ ID NO: 107273 - DNA, 1401 bp, Artificial Sequence
  Description of Artificial Sequence: Synthetic coding sequence
atgtgcctgactgatgagtgggggttctttttctttttttttctgggcgtgcccgaagcggaggttacctggtttcgaaacaaaagtaagctgggctcaccccaccatcttcacgaagggtcacttctgcttaccaacgtcagctcatccgaccaaggcctgtactcttgtagggcagccaacctgcacggcgagctgaccgagtccacacaactgctaattctggaccctccacaggtccctactcagctcgaggacataagagcgctgttggccgctacaggcccaaatctgccctctgtcctgacgagcccactcggaacccagctggtgctggatccgggtaattctgcgctcctaggctgtccaattaaagggcaccctgtgcccaacatcacctggtttcatggcggccaacctattgtgaccgccaccggcttgacgcaccacatccttgccgctggccagatcctgcaggtggctaacttgagcgggggttcccagggtgaatttagctgcttagctcaaaacgaggccggcgtgctgatgcagaaggcctctctcgtaattcaagactattggtggtctgtagacagactggccacttgttccgccagctgcggtaacagaggcgtgcagcagcccaggctccgctgtcttctcaattccacagaggtcaacccagcccattgcgccggaaaggttcggcccgccgtacagccaattgcgtgtaaccggcgggactgtcccagtagatggatggtgacctcttggagtgcttgcacccggtcatgcggcggaggcgtgcagacgcgaagggtcacgtgtcagaaattgaaggcctccggcatcagcacccctgtcagcaatgatatgtgcacgcaggttgccaaacgccctgtagacactcaggcctgtaaccagcaactctgcgtagagtgggcattctccagctggggccagtgtaatgggccatgcatcggccctcacctggccgtgcaacacaggcaagtgttctgccaaacaagagacggaatcacgcttccgtccgagcaatgtagcgctctcccgaggccagtgtctacccagaattgctggagcgaagcatgctcagttcattggagagtttccctttggactctctgcacagccacctgtggaaactacggctttcagagcaggcgtgtggaatgtgtacacgcccggaccaacaaagcagtgccagagcatctttgtagctggggaccccgtccagccaactggcagaggtgcaacataacaccatgtgaaaatatggaatgcagagatacaaccagatactgtgagaaggtcaagcagctgaagctgtgccagttgtcccagtttaaatcccgatgttgtggaacctgtggcaaggcttag

SEQ ID NO: 107274 - DNA, 1578 bp, Artificial Sequence
  Description of Artificial Sequence: Synthetic coding sequence
atggaatgttgcagacgggcaactcccggcaccctactcctcttcttggcttttcttctgctgagcagtcgtacagctaggtctgaggaagatagagatggtctctgggacgcatgggggccctggtcagaatgttcgagaacatgcggcgggggcgcaagctattcgctacgacggtgtctgtctagtaaatcttgcgaggggcgcaatatccgataccgcacctgcagcaatgtagactgcccccctgaggctggagatttcagagcacagcaatgcagtgcacataatgacgtgaaacatcacggccagttctacgagtggcttccagtgagcaacgaccctgataatccctgctccctcaagtgtcaggccaagggcaccactctggtggtggaattagccccgaaagtgctcgatggaacacggtgttatactgagagcttggacatgtgtatttccggcctctgccaaatcgtggggtgtgatcaccaactcgggtccacagtcaaagaggacaattgtggcgtgtgcaatggcgatggcagcacgtgccgcttggtgagggggcaatacaagagccagcttagcgccacaaagagtgacgatacggtcgtggccattccatacggttctcgccacattcggctagtgcttaagggtcccgaccatttatacctggagaccaaaaccctacaaggaacaaaaggagagaactcgttgtcttccacggggacgtttttagttgacaactcttccgtggacttccaaaagttccccgataaagagattctgagaatggccggacccctgacagcagatttcatcgtgaaaatccgcaattctggctctgctgactccactgtgcagtttatcttttatcaacccatcattcacaggtggcgggaaacggacttctttccctgtagcgcaacatgcggaggaggctaccagctgaccagcgcggaatgctatgacctacggtccaatcgggttgtcgctgaccagtattgccactattaccctgaaaatatcaaaccgaaaccgaagctgcaggagtgtaacctggatccttgcccagctagcgacggatataaacaaatcatgccgtacgacctctaccaccctctccctcgatgggaggcaactccttggacagcctgctcttcttcctgcggaggtgggatccagagccgcgccgtctcctgtgtcgaggaggatattcagggacacgtgacctcggtcgaagaatggaagtgcatgtacacccccaagatgccaatcgctcagccctgcaacatttttgattgtcctaaatggctggcccaggagtggagcccttgcacagtgacatgcggccaggggcttcgttacagggtcgtcctgtgtattgaccatcggggaatgcacaccggcggatgttcccctaaaacaaagccccatattaaggaggagtgcattgttcccaccccatgctataagcctaaagaaaagctgcctgtcgaagccaaactgccatggttcaagcaggcccaggaactcgaggagggagccgccgtaagtgaggagcccagctag

SEQ ID NO: 107275 - DNA, 786 bp, Artificial Sequence
  Description of Artificial Sequence: Synthetic coding sequence
atgtgcctgactgacgaatggggcttctttttcttcttttttctgggtgtacccgaagctgaagtgacatggtttcgtaataaatcaaagctgggcagcccccatcacttacacgagggctcattgcttttgaccaacgtgtcatctagcgaccagggattgtacagctgccgtgcagccaacctgcatggcgaactcacagagtccacgcagctattgattctggatccgccccaggtccccacccagcttgaagacattagggcactattggccgccaccgggccaaatctaccttccgtcctcacaagcccccttgggactcagctcgtgttggatccgggaaattccgctctgctgggctgtccaatcaaggggcatcctgtgcccaatataacctggttccatggaggacagcctatcgtaactgcaactggtctaacacaccacatcctggccgccggtcagatcctgcaagtggctaacctcagtggggggtctcagggggaattcagctgtctggcacagaatgaggccggcgtgctgatgcagaaggcctcactggtcatccaggattactggtggtcagtcgatagactagctacatgttctgccagctgcggtaaccgaggcgtgcagcagcccagattgcggtgtctccttaatagcaccgaggtaaaccctgcacattgtgcagggaaggtcagacctgccgtgcaaccaatcgcctgtaacagacgggattgtcctagtcgggctatgggcctggcttctggtcttacctag

SEQ ID NO: 107276 - DNA, 5289 bp, Artificial Sequence
  Description of Artificial Sequence: Synthetic coding sequence
atggagtgttgcagaagagcaacacctggcacattattgttgttcctggcctttctactgttgtcaagcaggaccgctcgaagcgaggaagatcgggatggactgtgggacgcgtgggggccatggtcggaatgtagcaggacctgcggaggtggcgccagttatagcttaagaaggtgcttaagcagcaagtcttgtgaaggacggaacatcagatataggacctgttcaaatgtagactgcccacctgaggccggcgacttcagagcacagcagtgcagcgcgcataacgacgttaagcaccacggacaattttacgagtggctgccagtgtctaacgaccctgacaacccatgttccctcaagtgccaggccaaaggcacaactctggttgttgaactggccccaaaggtactggatggcacgcgttgttacactgagagcctggacatgtgcatttcaggtttgtgtcaaatagtcggatgtgaccaccagttagggtcgacggtgaaggaggacaactgtggtgtgtgcaacggagacggctctacgtgtcgcctggttcggggccagtataaaagtcagctctccgcaaccaaatctgacgatacggtcgtagctatcccctatggttctaggcacatcaggctggtcctgaagggcccagaccacctttatctggaaacgaagactctacaaggcaccaagggagagaacagtctctcaagtaccggtacgtttctggtggataattcaagcgtagactttcaaaaatttccggacaaggagatactccgaatggcagggccgctcaccgctgacttcatagtgaaaattcggaattctggctctgctgactccaccgtgcagtttatcttctaccagccgatcatacaccgctggagggagaccgatttctttccttgctctgctacttgtggaggagggtatcagctcaccagcgccgaatgttatgacctccgctctaatcgagtggttgccgaccagtattgccattactatcccgaaaacataaagcccaagccaaagttacaggagtgcaacctagacccttgtccggcgtcagatggctacaaacaaattatgccttacgacctgtatcatcctctgcctaggtgggaagcaacgccatggacagcctgttcatcatcctgcgggggcggcatacaatccagggccgtgtcttgcgtcgaggaggacatacagggtcatgtcacgagcgtagaagagtggaaatgcatgtacacccctaaaatgcccattgctcagccctgtaatattttcgattgcccgaaatggctggcccaagagtggagcccctgtacagtgacgtgtgggcaaggcctgaggtatcgggtggtgctctgcattgaccaccgcggaatgcacaccggcggctgctcacccaagaccaagccccatatcaaagaggagtgcattgtacccaccccatgctataagccaaaggaaaaattgcctgtagaggcaaagcttccctggttcaaacaggcccaggaactggaagaaggggcagcggtgagtgaagagccctcattcattcctgaagcttggtcagcctgtaccgtgacatgcggagtggggacacaggttagaatcgttcggtgtcaggtactcctcagtttttctcaaagcgtggcagatctgcccatagatgaatgcgagggcccaaagcctgcctctcagcgtgcctgttatgcaggcccttgctcaggtgagatccccgagttcaacccagatgaaacagacggactttttggtggccttcaggactttgatgagctgtacgattgggaatatgagggatttacgaagtgcagtgaaagttgcggcggaggcgtccaggaggccgtggtctcttgcctgaataaacagacaagagaaccagctgaagagaacctgtgcgttaccagccggcgaccaccccagctgcttaagtcttgcaaccttgatccttgcccggctcggtgggaaatcggcaaatggagtccctgcagtcttacatgtggcgtggggctacagacccgcgatgtgttttgcagccatcttctttcaagagaaatgaacgagacagtcatcctggctgatgagctgtgtcggcagccaaagccatctactgttcaggcctgcaatcggttcaattgtcccccagcctggtaccccgctcagtggcaaccatgttccaggacctgtggtggaggagtccagaagcgggaagtgctctgcaagcaacggatggcagatggcagttttctggagctcccagagacattttgttctgctagcaagcccgcctgccaacaggcttgtaaaaaggatgattgcccaagcgaatggctgctgtcggactggaccgagtgttccacaagctgtggagaaggcacccaaacccgatcagctatctgtcggaagatgctcaaaaccgggctgtctaccgtggttaactcgaccctgtgtccgcctctcccttttagttcctccattagaccctgtatgttggcaacctgtgctcggcctggcaggcccagcactaagcacagccctcacattgccgcagctagaaaagtatatatccaaactcggcggcagcgtaagctgcacttcgtagtgggcgggttcgcatacttactgcctaagacagccgttgttctcagatgtcccgcccggcgggtgcgtaagcccctcattacatgggaaaaagatgggcagcaccttatcagttccacccatgtgactgttgcaccgtttggctatttgaaaatacaccgtcttaagccaagtgatgccggtgtatacacatgttctgccggcccagcccgcgagcattttgtgatcaaactcatcggagggaacaggaagctcgtcgctcgccccctgtcgccgcggagcgaggaggaagtattagcgggacggaagggcgggcccaaagaggcccttcagactcataagcaccagaacggtatcttttccaacgggtctaaggccgaaaagcgcggactggcagcaaatcccgggagcagatatgatgacctggtgagccgactactggagcaggggggatggccaggtgaactattagcatcttgggaagctcaagactccgcagaacgcaacaccacaagcgaagaagatcctggtgcagagcaagtgctgcttcatttgccctttaccatggtgaccgagcagaggagactggacgacatcctggggaacctgtcccagcagccagaagagttgcgcgacttatattctaaacacttggtggctcagctggcacaggaaatctttcggtctcacctcgaacatcaggatacactactcaaaccatccgagaggcgcacttctccagtgacactgagcccccataaacatgtgtccggattttccagttcgcttcgtacctcttctacaggcgacgccggcggtggttcccggagacctcaccgaaagcctaccatcctccggaagatcagcgctgcccagcagctgtcagcctcagaagtcgtgacacatttggggcaaacagtcgcactggctagcgggaccctcagtgtcctgctgcactgcgaagctataggtcacccccggcctacaatctcttgggctcggaatggagaggaggtacagtttagtgatcggattttgctccagccagatgatagcctgcagatcctggcaccagtcgaagccgatgttgggttttacacgtgtaatgctaccaacgctttgggctatgacagcgtctccatcgcagtaaccctcgcaggtaaacccctggttaaaaccagcaggatgactgtcattaatactgagaagcccgccgtgactgtcgatattggtagcacaatcaagaccgtgcagggggtgaacgtcacaattaattgccaggtggccggggtgccagaagctgaagtgacatggtttcgaaataagagtaagctcggaagcccacaccacctccatgagggatcgctgctcttaaccaacgtctccagctctgaccagggcttatacagctgcagagctgccaatctgcacggtgagctcaccgagtctacacagctgttgatactggaccctccccaggttccaacacagctggaggatatacgcgcactgctggccgccaccggccctaatttgcctagcgttctgacatcccctttggggacacagttggtcctggatcccggcaattccgctctgctaggctgccctattaagggacaccccgttccgaatatcacgtggttccacgggggtcagcccatagtgactgccacagggctaacacaccatattttggcagctggacagattcttcaggtagccaacctatccggcggttctcagggtgagttcagttgccttgcccagaacgaggccggcgtgcttatgcaaaaggccagccttgtcatacaggattattggtggtcggtggataggttggccacatgttccgcttcatgtggaaaccgaggggttcagcagcccagactcaggtgtttactcaactcgactgaagttaacccagcccactgtgccggaaaagtaaggcctgctgtgcagccaatcgcatgtaacagacgggattgtccgtctagatggatggttacatcatggagtgcatgtacccgtagctgcgggggcggtgtgcagacccgtcgggtcacatgtcagaagctcaaagcgtccggtattagcaccccggtgtcaaacgacatgtgtacacaggtggcaaaacgccctgtagacactcaggcctgcaaccagcaactatgtgtggagtgggcattttcgtcgtgggggcagtgtaatggcccctgtatcggcccgcatctggcagtgcagcaccggcaggtgttctgccaaacacgagacggaatcactctgccgtcagaacaatgtagtgccttgccgagaccagtgtcaacacagaattgctggtctgaggcttgctccgtccactggcgtgttagtctgtggaccctgtgtacagcgacttgtggcaactatggctttcagtcccggagagtcgaatgcgtccatgcacggactaataaggctgtccccgaacatctatgcagttgggggccacggcccgctaattggcaaaggtgtaatattacgccctgcgaaaatatggagtgcagagacacgactagatactgcgagaaagtgaagcagttgaaattatgccagctcagccagttcaagagccgctgttgcggtacctgtggtaaagcctag

SEQ ID NO: 107277 - DNA, 1320 bp, Artificial Sequence
  Description of Artificial Sequence: Synthetic coding sequence
atggagtgttgtagaagagctaccccagggactctgctgctgtttctagctttcctgcttctctcttctaggactgcccgatctgaagaagacagagacggactgtgggatgcctggggcccctggagtgaatgcagtagaacctgcggtggaggtgctagctacagtcttagaaggtgcctcagctccaagagctgtgagggtcgaaacataagatacaggacctgctctaatgtggactgccctccagaagctggagactttagagctcagcagtgttccgcccacaatgatgtgaaacatcatggacagttctacgaatggctacctgtcagtaatgaccctgataatccctgctctctaaaatgtcaggccaaggggaccactcttgtggtcgagttagctcccaaggtcctggacgggacacgctgctacaccgaatctttggatatgtgcatctcagggctctgccagatagttggttgcgatcatcagctgggtagtactgtgaaggaggataactgcggagtgtgtaacggagacggtagcacctgtcgtctggttagggggcagtacaagagccaactgtcagccacaaagtcagatgatacggttgtggccatcccgtatgggagcaggcatattcggctggtactgaaaggaccagatcacctgtacctcgagactaagactctacaaggcacaaaaggggagaatagcctgagtagcaccggaacgttcttggtggacaattctagcgtggacttccagaagtttccagataaagaaattctgaggatggcaggcccactaaccgcagactttatagtcaagatcagaaattccggctccgcagactctaccgtgcaattcatattttaccagccaatcatccaccgttggcgggaaaccgatttcttcccctgtagcgctacctgcggtggtggctaccagctgacctctgcagagtgctacgaccttcgcagcaatagggtggtcgcagatcaatattgccactactacccggaaaatataaagcccaagcctaaactgcaggagtgcaaccttgacccgtgccccgcacggtgggaggctactccgtggaccgcatgttccagctcttgtggcggcggaattcaatccagagccgtgtcatgcgttgaagaggacattcagggtcatgtaaccagcgtggaggagtggaagtgcatgtacaccccaaagatgccaattgcccagccatgtaacatctttgactgccctaaatggctggcccaggaatggtctccagtcacagtgccgtccttcttcgtgcactag

SEQ ID NO: 107278 - DNA, 2856 bp, Artificial Sequence
  Description of Artificial Sequence: Synthetic coding sequence
atggatggccggtggcagtgttcatgttgggcctggttcctgcttgtgctggccgttgtggcgggcgatacagtgtcaactgggagtaccgataactccccgaccagcaatagcctcgaggggggcactgacgccaccgccttctggtggggcgagtggacaaagtggaccgcctgcagtagaagttgtggcgggggggtcaccagccaggagcggcactgtttgcaacagcgtcggaaatccgtgccaggccctgggaatcgtacttgtactggaacctcaaaacgataccagctctgcagggtacaggagtgcccacctgatggaagatcattccgagaagagcagtgcgtcagctttaatagtcacgtttataatggccgaactcaccagtggaagcctctttaccccgacgattacgtgcatatatcttccaagccctgtgatctccactgcacaaccgtggacggccagagacagctaatggtacctgcccgggatggaactagctgtaaattgacagacttaaggggcgtttgtgtatccggcaagtgcgagccaatcggatgcgatggggtgctcttttctacccataccttagataagtgcgggatctgccagggcgatggttcaagctgtacacacgtgactggaaactataggaagggcaacgcccacctcggatactccctggtgacccacatcccagccggcgctagggatattcagatcgtggaacgcaaaaagtctgccgacgtcctggctctggccgacgaggcagggtattacttttttaatggcaattataaggtcgactcgcccaagaacttcaacatcgccggcaccgtggttaaataccgcagacccatggacgtttacgagactggtatcgagtacattgtggctcagggacccacaaaccaggggctgaacgtaatggtttggaaccaaaacgggaagagcccatccatcacattcgagtacacgttgcttcaacctccacatgagagtagaccacagccaatttactacggtttttcagaatcagccgaatcccaagggcttgacggcgcgggcctaatgggattcgtaccacataatgggtccctgtatggacaagcaagttctgaaagactcggcctcgataaccgactttttggccaccccggccttgatatggaactgggtccctcacagggccaggagactaatgaggtgtgtgagcaagctggaggcggggcatgcgaagggcctcccaggggtaaaggatttagagaccgaaacgtcaccggcactcctctgaccggagacaaagacgacgaggaagtagatactcacttcgcttctcaggagttctttagcgcaaacgcaatttccgatcagctgcttggtgccggctcggacctcaaagatttcacactaaacgagacggtcaatagcattttcgcgcagggggccccccggagctcattggctgagtctttttttgtggactacgaggagaacgaaggggcgggcccttatctcctgaacggcagctacttggagctttcttccgaccgggtggcaaattcctcttcagaggccccctttcccaacgtttcgacctctctactcaccagcgccggcaatcgcactcacaaagcaaggacaaggcctaaagcgcgaaagcaaggtgtgtccccagccgacatgtaccgatggaagttgtcctcacacgagccctgcagtgccacctgcaccaccggcgttatgtcagcgtatgctatgtgtgttcgctatgatggcgtggaagttgatgattcatattgtgacgcgctgaccaggcccgagcctgtgcacgaattttgcgcaggaagggaatgccagccgcgctgggaaacctcgtcttggtctgagtgctccagaacatgtggtgaaggctaccaatttcgggtggtgcgttgttggaagatgctatccccaggcttcgactcttctgtgtatagcgatctctgtgaggcagccgaggcggtgcgaccggaagagaggaagacatgccggaaccctgcttgtggcccccagtgggaaatgagcgagtggtcagaatgcactgcgaaatgtggtgagagatccgttgtaacccgggacatcagatgtagcgaagacgagaaactgtgtgatcccaacacacgccccgttggagaaaaaaactgcacaggtccaccttgcgatcgtcagtggactgtgtcggattggggcccatgttctgggagctgcggccagggcaggacaatacgccatgtgtattgcaagacctcagatggccgggtggtcccagaaagccagtgccaaatggagaccaaaccgctggcaatacatccttgcggtgacaaaaattgtccggcgcactggttggcccaagactgggagcggtgtaacactacatgtgggcgaggagtgaagaagcgccttgtgctgtgtatggaattagctaatggcaagcctcaaacacgttcagggcccgaatgcggcttggcaaagaaacctcctgaggaaagcacctgcttcgagcgtccttgctttaagtggtatacgtccccctggtctgaatgcaccaagacttgcggcgtcggagttaggatgcgagacgttaaatgctatcagggaactgacatagtgcggggctgtgaccccctagtgaaacccgttggaagacaagcgtgcgatctgcagccctgccccaccgagccaccggatgatagttgccaggatcagcctggtactaattgcgctcttgcaattaaggtcaatctatgcggacattggtactattcaaaagcatgttgtcggtcttgccgccctccccatagctag

SEQ ID NO: 107279 - DNA, 2856 bp, Artificial Sequence
  Description of Artificial Sequence: Synthetic coding sequence
atggatggccgatggcaatgttcgtgttgggcgtggtttcttctggtccttgctgtcgttgcaggggacactgtaagtaccgggagtacagataacagtcccacctccaattctctcgaaggtggcactgacgccaccgcgttttggtggggcgaatggacaaaatggaccgcctgctctcgatcttgcggaggcggcgttaccagtcaggagcggcactgtctccagcagagacggaagagtgtgccgggaccaggtaataggacatgcactgggacaagtaaaaggtaccagctctgtcgagtccaggagtgccccccagacgggcgctcatttcgggaggagcaatgtgtgagttttaacagccacgtgtataacgggagaacccatcagtggaagcccctgtatccagacgattacgtgcacatcagctccaagccctgcgatctgcactgtactactgtggatgggcagcgccagctaatggtccccgcaagagatgggaccagctgcaagttgacggatctgagaggcgtctgcgtgtccgggaaatgtgagcctatcggttgtgacggggtgcttttcagcacgcatactctggataaatgtggtatctgccaaggcgacgggtcctcctgcacccacgttaccggcaactacaggaaaggtaacgctcatctgggatatagtctagtgacacacatccccgcaggagcccgtgatatccaaatagtggaacggaaaaaaagcgcagatgtgctcgcgctggctgatgaggccggctattactttttcaatgggaactataaggtggactcgccgaagaattttaatatcgccggcaccgtggttaaatacagaagacccatggatgtttatgagaccggcattgaatatattgtcgctcagggaccaactaatcagggcctgaacgtgatggtgtggaatcagaacgggaaatccccttccatcacatttgagtacactctgctccaacccccgcacgagagcagacctcagcctatctactatggtttctctgagagcgcagaatctcagggattagatggggcagggctgatgggctttgtgcctcacaatggcagtctctacggtcaagcttccagcgagagacttggcctggacaaccgactgttcggccatcccggattagatatggagctgggccctagtcagggacaggagaccaacgaagtgtgcgagcaagccgggggcggtgcttgcgagggacctccacgtggtaagggtttccgcgatcggaatgtcactggtactcctctgacgggcgacaaggacgacgaggaggtagacacccattttgcttctcaggaatttttctctgccaatgccatctctgaccagctgctaggtgcagggtctgatctgaaggatttcaccctgaatgagacagtgaacagtatttttgcgcagggcgcccctaggtcttccttagcagagagcttctttgtggactatgaggaaaacgagggagcaggaccatacctgctgaacgggtcatacttggaactgagcagcgacagggtcgccaactcaagctcagaggcgccgtttccaaacgtcagcacaagtctcctcacctccgcagggaaccgaacacataaggccaggacccggcccaaagctaggaagcaaggagtgtctcctgcagatatgtacagatggaagctcagctcccacgagccttgctcggcgacatgcacaacaggagtaatgagcgcttatgccatgtgcgtgcgctatgatggggtggaagttgatgattcttactgtgatgctctcacccgaccggaaccggtgcacgagttctgtgctggccgcgagtgccaaccccggtgggagacatccagctggtctgagtgttctaggacgtgtggggaggggtatcaatttcgcgtcgtgaggtgctggaagatgctttcaccagggttcgactctagtgtttatagtgacctgtgtgaagcagcagaagccgtccgtcccgaagaaagaaagacatgcagaaaccccgcttgtgggccacagtgggagatgagtgaatggtctgagtgcacagctaaatgtggggaacggtccgtcgtaactcgggacattagatgtagcgaggatgagaagctgtgcgacccaaacactcgcccagtgggagaaaagaactgtaccgggcccccatgcgatcggcaatggacagtgtccgattggggaccctgctctggatcgtgcggccagggcaggacaattcgccacgtgtattgtaagacttccgacggacgagtggtgcctgagagtcaatgccaaatggaaactaagcctctcgctattcacccctgcggagataagaactgccccgcacactggctggctcaagattgggagaggtgcaacaccacatgcggtcgaggcgtaaagaaacgcttggtactgtgcatggaattggctaatgggaaaccacagactcggagtgggccagagtgcggcttggcaaaaaaacctccggaggagagcacatgcttcgagagaccatgtttcaagtggtacacgtccccatggtccgagtgcactaaaacttgcggcgtcggagtgcgaatgcgggacgtcaagtgttaccagggcacagatatcgttcgcggatgtgaccccttggtaaaacctgtaggcaggcaggcctgcgacctgcaaccgtgcccaacagaaccccccgatgatagctgccaggatcagcctgggacaaattgcgccctggcgatcaaagtcaacctgtgtggccattggtactatagcaaagcctgttgtcgatcctgtcgcccaccacactcctag

SEQ ID NO: 107280 - DNA, 3183 bp, Artificial Sequence
  Description of Artificial Sequence: Synthetic coding sequence
atgctgtttgaagtcggcgaaggcggcggggcaggcgaagaaggaaagggcaggggtcgcccaggacgctcactttgcacccacgccgcccccgcgcgcactgcacacctggcgccatcggcactgcggagcgcgcggcccttcctgtgggaggataacctcctgacccgttcccagggactgcctgacaatcatgatcaacttgtacctgataacctggaggcctgggcacttgctggccctcgggggttgtttcccaaaagaacacttgtgatctggaagcgtataggggccggcctagttgttactgtggcgctacttccaagaatggacggccggtggcaatgtagttgttgggcatggtttttactggttcttgccgtcgtcgctggagacaccgtgtcaacaggctctaccgacaatagtccaaccagtaactcgctggagggcggtacagacgctactgccttttggtggggggagtggacaaaatggactgcctgttctcgttcctgtggtggaggggtcacctcccaggagcggcattgtctgcagcagcggaggaagagcgtgccgggaccagggaataggacttgcaccggcaccagcaagagataccagttgtgcagagtgcaggagtgccctcccgatgggaggtcgttccgcgaggagcagtgcgttagtttcaacagccatgtgtacaacgggaggacacaccaatggaagccactctaccccgatgattatgttcatatatcatccaagccttgcgatctgcactgcactacagtggatggacagcgtcagctgatggtgccggctagagacggtacctcctgtaagctgacagacctgcgaggggtgtgtgtgtccggcaagtgtgaacccataggatgcgatggcgtcctgttttccactcataccttagataagtgcggcatctgccagggtgatggtagttcctgcacccacgtgaccgggaattaccggaagggtaatgcacacctggggtattccctggtgacgcatatacccgcgggagctcgggacatccaaattgtcgaaaggaaaaagagcgcggacgtcctcgctctggccgatgaagctggttactacttctttaatggaaattataaggtggattcccccaagaactttaatatcgcgggtacagttgtcaagtatcggcggcccatggatgtttacgagaccggtattgagtatatcgttgcgcaaggcccaactaatcagggcctgaacgttatggtctggaaccagaacggcaaaagcccctctatcactttcgagtacaccctgttgcaaccaccgcacgaatctagaccacagccaatctattatggcttcagcgaatctgccgagagtcaggggcttgacggtgctgggctgatgggctttgtacctcacaatggctccctctatggacaagcaagctctgagagactgggcctagacaaccgcctatttggtcaccctggcttggacatggagcttggaccctcccaaggccaggagacaaatgaggtttgtgaacaagcaggtggcggcgcttgtgaagggcccccccgtgggaaggggttccgtgaccggaacgttaccggaacgccactgacaggggataaagacgatgaggaggtggacacccacttcgcctcccaggagtttttctccgctaatgccatcagcgaccagctgcttggtgctggctccgatttaaaggatttcaccctgaacgaaaccgtgaatagtatctttgcacagggcgcgcctcgctcctctttggctgagagcttcttcgtcgattatgaagagaacgaaggcgccgggccctatttgctaaacggaagttatctggagctcagcagtgaccgcgtggcaaactcttcctcagaagcaccattccctaatgtgagcacgagcttgctcacatcagccggaaatcggacccacaaggctcgtacaaggcctaaagctcgcaagcagggagtgtcaccagcagatatgtaccgatggaagctctccagtcatgaaccatgctctgcaacttgcacgacaggcgtgatgagcgcctatgctatgtgcgtccggtacgatggagttgaggttgatgacagctattgtgacgctctgactaggcccgagcctgtgcatgaattctgcgcaggcagggaatgtcagccacgctgggaaacttctagctggagtgaatgctcgaggacatgcggtgaaggataccagttcagggtggtgcgttgctggaaaatgttgtcaccaggtttcgacagcagtgtgtacagcgatctttgtgaggcggcggaggcggtgaggcccgaggaacgcaagacatgcaggaaccccgcctgtgggccccagtgggaaatgtctgagtggtccgaatgcaccgccaagtgtggggagcggagcgtggttaccagagacattcgctgtagtgaggacgagaagctgtgcgacccaaacacccggcctgtaggcgagaaaaattgcaccgggccgccctgcgacaggcagtggacggtcagcgactggggaccctgtagcgggtcatgtggacagggccggactattcgccatgtgtactgcaagacctctgatggacgtgttgtccccgagtcccagtgtcagatggaaactaagcctctggccattcatccttgcggcgacaagaattgccccgcccattggctggctcaggattgggaacgttgcaacactacttgcggccgtggtgttaaaaaaagattggtgctctgcatggagctcgcgaacgggaagccacaaacacgctcagggcccgagtgcggcttggccaagaagccacccgaagaatccacctgctttgaacggccctgctttaaatggtatacatccccttggagcgagtgtactaaaacctgcggcgtcggcgtcaggatgagagatgttaaatgctaccaagggacagacatcgtgagggggtgcgaccctttagtcaagccggtaggcaggcaggcctgtgatctgcagccctgtcccacagaaccacccgacgattcatgtcaggaccagccaggcacgaactgcgcccttgccatcaaagtgaacctatgtggacactggtattattccaaagcttgctgtcgaagttgccggccaccacacagctag

SEQ ID NO: 107281 - DNA, 5076 bp, Artificial Sequence
  Description of Artificial Sequence: Synthetic coding sequence
atggcctcctggacctcaccctggtgggttctgatcggcatggtgttcatgcacagccccctgccacagacaacggccgagaaatcacccggcgcatattttctgccagagtttgcactgagccctcagggatctttccttgaggacacaacgggcgagcagtttttaacgtaccggtacgacgaccagacctctcggaatacgagaagcgatgaagacaaggacggtaactgggatgcttggggagattggagtgactgttcccgtacctgcgggggcggagccagttactctttgcgccggtgcctgacagggagaaattgtgagggtcagaatattaggtacaaaacatgtagcaaccacgactgtccaccggacgccgaggatttccgcgctcagcagtgcagcgcctacaatgacgtccagtaccagggtcattactatgagtggttgcctagatataacgatccagcagcaccttgtgccttgaagtgtcatgctcaaggacagaatctcgttgtggaactggctcccaaagtgttagatggaacccggtgtaacactgactccctggatatgtgcatttccggcatttgccaggcagtgggctgtgatcgccagctgggcagcaacgcaaaggaagacaattgcggggtgtgtgcgggcgatggatctacctgccgtctggtgagagggcagtcgaagagtcatgtctccccagagaagcgggaagagaacgtcatcgcggtgcctcttgggtctcgcagtgtgcgaataaccgtgaaaggccccgcgcacctgtttatagaaagcaagactctgcagggatctaagggggaacattctttcaactcgcccggcgttttcttggtggaaaatacgactgtggaattccagcgggggtcagagcggcagacattcaaaatccccggtcccctgatggccgatttcatctttaaaacacgatataccgccgctaaagactccgtggtgcagtttttcttttatcagcctatcagccaccaatggagacagaccgatttctttccttgtactgtgacatgcggtggagggtaccagctcaatagcgctgaatgcgttgacatccggctcaagcgagtggtacccgatcattactgtcactattacccagagaatgtgaagcccaagcccaagctcaaagaatgcagcatggacccttgccccagtagtgatggttttaaagaaatcatgccatacgatcactttcagccactgcctaggtgggagcacaatccgtggactgcctgcagcgtgtcctgcgggggcggcattcagcgtcgctccttcgtgtgtgtggaggaatcgatgcatggggagattctgcaggtggaagagtggaaatgtatgtatgccccaaagccaaaggtcatgcagacctgcaacctgttcgattgccccaagtggattgcgatggagtggagtcagtgcaccgtaacatgtggccggggactgcgctatagggtggtactgtgcattaaccatcgaggggaacacgttggtggctgtaatccgcagttaaagcttcatattaaggaggagtgcgtgattcctataccatgctacaaacccaaggaaaagtcacccgtggaggccaagctgccctggctgaagcaggctcaggaactggaggaaactcggatcgccaccgaggagccgaccttcataccagagccttggtctgcttgctcaacgacttgcggcccaggagtgcaggttcgagaggttaaatgccgggtgctgctgactttcactcaaacagagacggagcttcctgaggaggagtgcgaaggtccaaaactgcctacggagagaccatgtctgctggaggcttgcgatgaatcacccgctagccgcgaactcgatatccccctgcccgaagactccgagacgacatacgactgggaatacgcagggtttaccccctgtacagcaacttgcgttggaggacatcaggaggctattgcggtgtgtttgcacatccaaactcagcagacggtgaacgactccctttgtgacatggtgcatcgcccccccgccatgtcgcaggcttgcaatacagagccctgtcctccccggtggcatgtcggttcctggggcccctgcagcgcaacgtgcggggtaggaatacagaccagagatgtttactgcttgcacccaggggagactcccgctccgccggaagagtgtagagatgagaagccccatgccctgcaagcgtgcaatcaatttgattgtccacctggttggcatatcgaagaatggcagcagtgcagtaggacctgtggtggaggaacgcagaataggcgggtgacctgtagacaactgctaactgacggatctttcttgaacctctccgatgagctgtgtcagggtcctaaggcctcttctcacaaaagctgcgcccggacagattgccctcctcacctcgccgtgggggattggtcaaaatgctctgttagctgtggagtcggcatccagcgccgcaagcaggtgtgtcagagactggccgccaagggtcgacggatacctctgagtgagatgatgtgccgcgacctgcctggattaccacttgtgagatcctgccagatgcccgaatgcagcaagataaagagtgaaatgaaaacaaaacttggggaacagggacctcagatcctctccgtacagcgggtctacatccaaacacgggaagaaaagagaatcaatctgacaattggatccagagcgtatctgctgcctaacacctccgtgataataaagtgtcccgttcggaggttccagaagtccttgatacagtgggagaaagatggaagatgcttgcagaacagcaaacggctaggcatcactaagtctggcagtctgaagattcacggactcgccgcccccgacatcggtgtttatcgatgcatagcagggagcgcccaagagacagttgtacttaagttaattggaactgataatcgacttatcgctaggcctgctctgcgggaaccgatgagggagtatccggggatggaccattccgaagccaactctcttggcgtcacctggcataagatgaggcagatgtggaacaacaaaaacgacttgtatttggacgacgaccatataagcaaccagccttttttacgagccctgttaggtcactgcagtaattccgcgggctctactaactcctgggagcttaagaataaacaattcgaagccgctgtaaagcagggagcctattccatggatactgcgcagttcgatgagctcattcggaatatgtctcagttgatggagactggtgaagtgtctgacgatcttgcttctcaacttatttatcaattagtcgccgagctggccaaagcccagcccactcacatgcaatggcgggggatacaggaagagacaccccctgccgctcagttgaggggcgagacaggctcagtttcgcagagctcacatgctaagaactctggcaaattgacatttaagcctaaggggcctgtgctgatgcgtcagagccagccacccagtatttctttcaacaaaacaatcaattctcgaatcggaaacaccgtctacattacgaagagaacagaagtcataaacattctctgtgacctgataactccctcagaggcaacttacacatggacgaaggatggaacactgctgcaaccatccgttaaaatcatactggacggcactggtaaaattcaaatccagaacccaacccggaaggaacagggaatatacgaatgtagcgtggccaatcacttaggatccgatgtagagtcctccagcgtgctttacgctgaggcacccgtaatcctaagtgtagagagaaacattacaaaacctgaacacaatcacctctcagttgtggtcgggggtatcgtggaggctgccctaggagccaatgtcactattcgttgccctgtaaaaggagtaccccagcccaatatcacttggcttaagcggggaggctctttatcaggtaatgtgtctctcctgttcaatgggagcctcctgctccagaacgtctcactcgaaaacgaagggacatatgtgtgtattgctaccaacgccctgggcaaggctgtcgccacctccgttctccacctgctggagcgaagatggcctgaaagccgaatcgtattcctccaaggccacaaaaagtacatcttacaggctacgaatactaggaccaactctaacgatccaacaggtgaaccaccaccacaggagccattctgggagcccggcaattggtcccattgcagcgccacttgcggacatttaggtgctaggattcagcgaccccagtgtgttatggccaacgggcaggaagtgtccgaagccctttgcgaccacttacagaagcctcttgcagggtttgaaccgtgcaatattcgggactgccccgccaggtggttcacctccgtttggagccagtgcagtgtctcatgcggagagggttatcattcccggcaggttacttgtaagcgcacaaaggccaacggcaccgttcaggttgtgtccccacgggcttgtgcaccgaaggaccgcccccttgggcgcaagccctgctttggtcacccttgtgtccagtgggaacctggaaaccggtgcccgggacggtgtatgggtcgcgctgtccggatgcaacaaaggcacacagcttgccaacacaattcgtccgacagcaattgcgacgatcggaaaagaccaactctaaggcgaaactgtacgagtggtgcttgcgatgtgtgttggcacactggcccttggaaaccatgcactgccgcatgtggtaggggtttccagagtcggaaggtcgactgcatccatactcggagctgtaaaccagtggctaagagacattgtgttcagaaaaagaagcctatctcctggagacattgtctgggcccctcatgtgacagagactgtactgatactactcactactgcatgtttgtcaaacacctgaatctgtgctccctggatcgatacaaacagcgctgctgtcagagctgtcaggagggctag

SEQ ID NO: 107282 - DNA, 3225 bp, Artificial Sequence
  Description of Artificial Sequence: Synthetic coding sequence
atggagaattggacaggaagaccctggctctacctgctgttgctactctctctgccgcagttgtgcctggatcaagaggtgctctcaggccactcattgcaaaccccaactgaggagggtcagggtcccgaaggagtctggggaccgtgggttcagtgggcctcctgttctcaaccctgtggcgtgggggttcagcgccgctcacgtacttgtcagcttcccacggtacagctccacccaagcctgcccctccccccccgacccccacggcatcctgaagctctcttaccacgcggtcagggtccccgcccccagacttcacctgagaccttgccactgtatcggactcagtcaagggggcggggcggaccacttaggggtcctgcctcgcatcttggccgtgaggagacacaggagatccgcgctgcaaggagaagtaggttgcgagacccaataaagccagggatgttcgggtacgggcgggtgcccttcgctcttccattgcaccgtaaccgtcggcaccctcggagtccaccaaggtctgaactgtccctaatcagcagccgcggcgaggaagcgatcccctcccccactccgagagcagagcccttctcagccaacggcagtccccagacggagctgcctccgaccgaactcagtgttcacacaccgtcccctcaggcagagccgctgagccctgaaactgcacagacagaagtagctccacgtacaagacccgctcctctccggcaccaccctcgcgctcaggcgtccgggacggaaccaccaagtcccacccactccctgggtgaaggaggcttcttccgtgcatcacctcaaccgcggcgccctagctcccaagggtgggcgtccccacaggtagccggcagacgcccagatcccttcccatctgtgccgcggggacggggccaacaagggcaaggcccgtggggtaccggggggacacctcatggccctaggctggagcccgaccctcagcatcccggggcctggctaccgctcctctccaacggcccacacgcttccagcctgtggagcttgttcgcccccagcagtcccatccccaggtgctccggcgagtcggaacagctaagggcctgctcccaggcaccctgtcccccagaacagcctgaccctcgcgcattgcagtgcgccgcgttcaactcacaggagttcatggggcagttgtatcagtgggaacctttcactgaagtccagggttcccagcggtgtgagcttaactgcagaccacgaggattccgcttctacgtgcgccacacagaaaaggtgcaagatggcactttatgccaacccggcgcccctgatatctgcgtcgcagggcgatgtctaagccctggctgcgatggaattttgggatcaggccgacgcccggatgggtgcggcgtctgcggaggcgatgattctacctgtcggctggtgtccggtaacctgacggatcgtggagggccactagggtatcaaaagatactctggatcccagcaggagccctcaggctgcaaatcgcacaactgagaccctcatctaattatctcgcactgagaggcccaggcgggcgcagcatcatcaacggaaactgggctgtagaccctcctggcagctacagagcgggcggcaccgtgtttaggtacaatcggccccctcgggaggaggggaaaggagagagtctatcggccgaagggccaaccacacagcccgtagacgtctacatgatctttcaagaagaaaatcccggggtgttttaccagtacgttatttccagtccaccaccgattctagaaaatccaaccccagaaccccctgtcccccaactgcagcctgagattctcagggtcgagccacccctggcaccggcaccacgacccgctagaactcccggcaccctgcagcggcaggtgagaatcccacagatgcctgcccctccccacccacgcacgccccttgggtcacctgctgcctactggaagagggtaggccactcggcctgttcggcatcgtgcggaaaaggtgtgtggcgacccattttcctctgtatttccagggaatctggcgaggagctggatgagagaagctgtgccgccggagccagacctccagcttcacctgagccctgtcacggcactccctgtccaccttactgggaagcaggggaatggacgagctgttctaggtcttgcggcccaggaacccagcacaggcagctgcagtgtagacaggagttcgggggagggggttcaagcgtgccccctgagcgatgtggtcacctgcccagacccaacatcacacagagctgtcagctgagactttgtggtcactgggaggtgggttcaccctggagccagtgctcagttcgctgtgggaggggacagcggtctagacaggtgaggtgcgtgggcaataatggagacgaagtcagcgaacaggaatgcgcaagtggtcctcctcagccaccttctagggaagcgtgcgatatggggccatgtaccacggcgtggttccattccgactggagctccaagtgctcagcagagtgcggtacgggaatccagcgtaggtcggttgtttgtctgggttctggggctgcccttggtcctgggcagggggaagccggagctgggaccggacaaagctgccctacggggtcacggcccccagatatgcgtgcctgtagcctgggcccttgcgaaagaacctggaggtggtacaccgggccctggggcgaatgctcgtccgaatgtggatcaggcacacagagacgagatatcatctgcgtctcaaagctcggcacagagtttaacgtaacgtccccctcgaactgttcacacctgcctagacctcctgcccttcagccatgccagggccaggcctgccaggatcgatggtttagcacgccctggtctccttgcagtcggtcctgtcagggcggcacacagacacgggaggtgcagtgcttgagtacaaatcaaacactgtccactcgatgccctccacagctgcgcccttcaagaaaaaggccatgtaactcccaaccctgcagccagcgccccgacgatcagtgcaaagatagcagcccccactgtccactggtcgtgcaagcaagactgtgcgtctatccctattacactgccacatgctgtcgcagttgtgcccacgtgctggaaagatcaccacaagaccctagctag

SEQ ID NO: 107283 - DNA, 3225 bp, Artificial Sequence
  Description of Artificial Sequence: Synthetic coding sequence
atggagaactggacgggacgtccctggttatacctcttgcttctcctgtccctgccccagttgtgtcttgaccaggaagtgctctcaggtcatagcttgcagactcccaccgaggagggacaggggcccgaaggcgtgtggggaccctgggtccaatgggccagctgcagtcagccttgcggggtgggtgtgcagaggcgctcgcgtacctgtcaactcccaacagtgcagctgcacccctcgctacccttgccaccgagaccaccccgacaccccgaagccctgctaccccggggtcagggccccaggcctcagacatcgcctgaaaccctgcctctgtatcgcactcagtccagaggacgtggaggccctcttcggggccctgcttctcacctgggtagagaggaaacacaagaaatacgcgccgcccggcggtccagactgagagacccaataaagcctggcatgtttgggtacggacgcgtgccattcgcattgcctctgcacaggaatcgccggcatcctcggtcccctcctaggtcagagctgtcattgatatcttcacgcggggaagaggccattccgtccccaacacccagagcggagcccttcagcgccaacggatctcctcaaacagagctgcctcctacggaactgtctgtgcacaccccatcaccccaggccgagccattaagccccgagacagcacagactgaggtggccccccgaacaagacctgctcccctgcgccatcatccaagagcacaggcatccggcactgagcctccctcccccactcatagtcttggagagggaggtttctttagagcatccccacagcccagacgcccaagctcacaaggttgggcttctccccaggtggccggtagacgcccagacccctttccaagcgtgccaagaggcagaggacagcaaggacaaggcccctggggcaccggaggaacaccacatgggcctcgtttagagcccgacccacagcatccaggcgcctggctgcccctcctttcaaacggcccacacgcgtcgagcctctggtccctgttcgctccatctagtccaatcccccgctgctcgggggagtctgaacaattgagagcctgttcccaggctccatgccctcctgagcagcccgatccgcgtgctttacagtgtgctgcattcaacagtcaagaattcatgggccagctctatcagtgggagcccttcactgaagtccaggggagtcagcgttgcgagctgaactgtcgacctcggggcttccgcttttacgtccgacacactgaaaaggtccaggacggtacactctgccagcccggagcacccgacatttgcgttgccggaagatgtctgagcccaggctgcgacgggatcttagggtctggacggaggcccgacgggtgcggagtttgtgggggcgatgatagcacatgccgtctcgtgtctggaaacctgactgataggggcggccccctgggctaccagaaaatactttggatccccgctggggctctgagactccagatcgcacagctgcgtccctctagtaactaccttgcgcttcggggccctggaggccggtccatcatcaacggaaattgggccgtggatccgcctggaagttaccgagcagggggaacggtgtttaggtataatcgtccccctcgtgaggagggaaaaggggagagtctgtcagcggagggccctacgactcagccagtcgatgtgtatatgatttttcaggaggagaatccaggtgtcttttatcagtacgtcatttcctcccctccacctatccttgaaaacccgacacccgaaccaccagtcccgcagctgcaacctgaaattctgcgggtggaacctcccctggcccctgcgccacgcccagctcgtacaccggggaccctccagagacaggtgcggatcccacagatgcctgcaccgccgcaccctaggaccccccttgggtccccggcggcctactggaagagggtgggccactcagcttgttctgccagctgcggcaagggagtatggagaccaattttcctgtgcatttccagggagagcggagaagagctggatgagcggagttgtgccgccggtgcccggccacccgccagccctgaaccttgtcacggcaccccatgccctccatattgggaggccggagaatggacatcatgcagcaggtcctgtgggcccggtacacagcatcgccaactccagtgcaggcaggaattcggcggtggaggatcttccgtcccacctgagagatgtgggcacctgcctcggcctaacattactcagtcttgccagttgcgcctctgcggtcattgggaggtcggatccccgtggtcccagtgcagcgtccgttgtggtaggggacagcgcagcaggcaggtgcgatgcgtaggcaacaacggggatgaagtctccgagcaggagtgcgccagtgggccgccacagcctccatcaagagaagcatgcgacatgggtccctgtaccactgcctggttccactcagactggtccagcaagtgctctgccgaatgtgggaccgggatccagcgtagaagcgtggtctgtttgggcagcggggctgcactgggtcccggccaaggtgaggcaggcgcaggcacaggccagagttgtccaaccggatctcggcccccagatatgagggcttgtagtcttggcccgtgtgaaaggacatggcgctggtatactggcccgtggggagaatgctcatccgaatgcggctccgggacgcagcgacgagatattatctgcgtgagcaagctcggtactgagttcaatgtgacaagtccgtccaactgcagccacctgccaagacctccggccctgcagccctgccagggtcaggcctgtcaggaccggtggttttcaacgccttggagtccctgctcacgcagctgccagggcgggacacaaactagagaggtccagtgtttatccaccaatcagaccctgtcaacccgatgtcccccgcaattgcgaccttcacgaaagcggccatgcaatagccaaccttgcagccagaggcccgacgatcaatgtaaggattcttctccgcactgtccactagttgtgcaggcgagactctgcgtgtacccttactacacagccacgtgttgccgctcctgtgcccacgtcttagagaggagcccacaggacccatcctag

SEQ ID NO: 107284 - DNA, 3294 bp, Artificial Sequence
  Description of Artificial Sequence: Synthetic coding sequence
atggaaaattggacaggtaggccctggctgtatctactcctgctgctgtcactgcctcaactgtgcttagaccaggaggtgttaagtggtcacagcctgcagaccccaacggaggagggacaggggcctgagggagtgtggggtccttgggtccagtgggcctcttgctcccagccctgcggggtgggcgtacaacgacggtctcgcacctgtcagttgcccaccgtacagctgcacccctctctgccactgccaccacggccacctaggcacccagaagccttgctgccgagaggacaggggccccgaccccagacgtccccagagacattgcctctgtataggacacagtcacgcgggagaggagggcctttacgcgggccagctagccacctaggtcgggaggagacccaggagatccgtgctgcaagacggagccgcctgcgcgatccgattaagcctggtatgttcgggtacgggcgcgtgccattcgctctccccttgcaccggaatcggaggcatccaagatcacccccaagaagcgagctcagtttgatctctagccgcggcgaagaggcgattccaagccctacccctagggccgaacctttcagtgctaatgggtcaccccaaaccgaactgccccctactgaactgtcagtacacacaccttctccacaagcagaaccccttagtccagaaaccgcccagacagaagtcgcgccccggacacgacccgcaccattgaggcaccatccccgcgcccaagcatctggtaccgagccacccagcccaacacactccctgggcgaaggaggattcttccgcgcaagtccccagccaagacgcccgagttcccagggctgggcctcaccacaagttgccggaagacgtccagatccattcccctctgttcctagaggccgtggacagcagggtcaagggccatggggaacgggtggtacccctcatgggccccgactggagccggaccctcagcatccgggggcctggttgcccctcctgtctaacggaccacatgcttcatcgctgtggagcctgtttgccccaagttcccccattccacggtgttccggggagtccgaacaactgagagcttgttcgcaagcaccttgtccacccgaacagcccgatcccagagcgctccaatgcgctgctttcaattctcaagaattcatggggcagctttaccagtgggaacccttcaccgaggcacctctcctacccctacgacacgccttcttccttctccccggtgctgggagcggagactcaacgggcgtgcagggctctcagcgctgcgaactaaactgcaggccaagggggtttcgcttctacgtgcggcatacagaaaaagtccaggacggcactctgtgtcagccaggggctcccgatatctgcgtggctggaagatgcctcagtccagggtgcgacggaatcttgggcagcgggaggcgccctgatggctgcggggtttgtggcggcgacgatagcacctgccgcctggtatccggcaacctgacagacagagggggccctttgggctatcagaagatactttggattcccgcaggagccttgcggctgcagatagcccagctgaggcctagcagcaattatctggctctgagaggaccgggaggccgctcgatcattaatgggaattgggccgtagatccccccggctcatatcgggccgggggtacagttttccggtacaatcggcctccaagggaagaaggaaaaggagaatcactctccgcagaaggacctaccacacagcctgtcgacgtttacatgatcttccaggaggagaacccaggagtcttttaccagtacgtgatatcctcgccaccccccatcctcgagaaccccacacctgaacctcctgtccctcaattacaaccagaaattctgcgggtcgaaccacctttagccccagctcctcgacctgcccgtactcctggcacactccagcgtcaagtgcgaataccacagatgcctgcccccccccaccctcggacgccattaggcagtccagccgcttactggaagcgggtgggccactccgcctgcagcgcctcttgtggtaaaggagtgtggagacctatttttctgtgtatctctcgggagtccggtgaagagttggacgagaggtcatgtgccgctggagctcgcccccctgcttcacctgagccatgccacggtaccccctgtcctccttactgggaagcgggcgagtggaccagctgctcgagatcttgtggcccaggcacgcaacatcgccagctccagtgtagacaagaattcggcggtgggggatcgagcgttccgccagagcggtgcggtcatctgcctagaccgaatataactcaatcatgtcagctcaggctatgcggccactgggaagttggatcaccatggagccagtgttccgtgcgctgtggacgcggccagcgttctcgccaagttcgatgtgtaggaaataacggtgacgaagtaagcgagcaggaatgcgctagcggtccgccccaacctccttccagggaggcctgcgacatggggccctgcacgaccgcctggttccattctgactggagcagcaaatgctcggccgagtgcggaaccggaatacaacggcgtagtgtcgtctgtctgggctctggcgccgccttgggtccgggccagggagaggccggcgccggaacaggacagagctgtccgacgggctcacggcccccagacatgcgcgcgtgtagcctggggccgtgcgagaggacgtggaggtggtacaccggaccatggggtgaatgttcctccgaatgcgggtcaggcacccaaagacgcgatatcatatgcgtatctaagctgggcaccgagtttaacgtgacttccccctcaaactgtagccatttgccccggccgcccgcactgcagccctgccagggacaggcatgccaggaccggtggtttagtacaccttggtctccctgctcccgctcctgccagggggggacacaaacgagggaggttcaatgtctctcaacaaaccagaccctcagtactaggtgcccaccccagcttcgcccctcgagaaagcggccgtgtaactcccagccttgctcacagcgtcctgatgatcagtgtaaagactcatctccccattgccctttggtggtacaggcaaggctctgcgtctatccctattatacagctacgtgctgccgatcctgcgcccatgtgctcgagcggagccctcaggacccaagctag

SEQ ID NO: 107285 - DNA, 2634 bp, Artificial Sequence
  Description of Artificial Sequence: Synthetic coding sequence
atggaaaactggaccggtagaccctggctgtacctactgctgctcctctccctgccccagctgtgtctggaccaggaggtgctcagcgggcatagcctgcaaacccccacagaggagggacagggaccagagggagtgtggggcccctgggtgcagtgggcaagctgtagtcagccatgcggggtgggtgtccagcgcaggtccaggacttgccagttgccgaccgtacagctccacccgagtctgccactgccaccgcgacctccccgacatccagaggccctactccctagaggacaagggcctaggccacagacctctccagaaaccctgcctttatatcgtacgcagtctcgcggacggggcggccctcttcgaggaccggcctcacacctgggaagagaggagacacaggagatcagagcggcacgtcgatcacggctgcgggaccccatcaagcctggcatgttcgggtacggccgcgtgcccttcgcactacctctgcacagaaatcggcgccatccccggtccccacccagaagtgaactttctcttatatcatctaggggcgaggaagccattccttcccctacccctcgagccgagccgttctccgccaacggctctccccaaacggagctccctcctacagagcttagcgtacacacgccaagcccacaagctgagccactttctcctgagaccgcgcagacggaagtggctccccgcacccgcccagcccccttgaggcatcacccacgggctcaggctagtggaactgagccccccagtccaacgcacagccttggcgagggaggttttttccgagcatcaccacagccgcggcgtccgtcaagtcaaggctgggcctcccctcaggtggcaggaagaagacctgatccttttccttcagtgccgcgtggacgcggtcaacagggacaaggcccgtggggcaccggaggcacgccccacggtcccaggctggagcccgatccccagcatcctggtgcttggctgccactcctctcaaacggaccacacgcctcctcgctgtggagtctgttcgcacccagtagccctatcccccgatgtagcggagaatcagagcagttgcgagcctgttctcaggccccttgccccccagagcagccagatcccagggcacttcagtgcgccgccttcaacagccaggagtttatgggtcaactctatcagtgggaaccattcacggaagttcagggctcacaacggtgcgaattaaactgtcggccaagaggatttcggttttacgtgaggcataccgaaaaagtccaggatggaactctatgccaaccgggagctcccgacatatgcgtggctggccggtgcctctctccaggttgtgacgggatcctgggctcaggacgccgtcctgacggctgcggcgtgtgcggaggcgacgactctacttgcaggctggtgtccggtaatctcacggacagagggggacctttgggctaccagaagatcctgtggattcccgctggtgccctgcgactgcagatagctcaactgcgccccagctctaactacctggctttaagggggcctggcgggcgctccattattaatggaaactgggccgtcgatcccccaggctcttatagggccggaggtaccgtgtttagatacaacaggcctccaagagaagaaggcaagggggaatctctgtcggccgaggggcctaccacgcagcccgtggacgtgtatatgatttttcaagaggaaaatcctggggtcttttatcagtatgtaatttcctctccacctcctattctagaaaaccccacacccgagcccccagttcctcagctgcagccagagattcttcgggtggagccgcctttggctcctgccccccgcccggctaggacgcctggcacgctgcagcgccaggtccggatcccccaaatgcctgcccctcctcatcctagaacgccattgggctcccccgctgcctactggaaaagagttggccatagcgcctgttctgcctcatgcggcaaaggggtatggcgtcccatattcctgtgtatttctagagagtcaggagaagagctcgacgagcggtcttgtgccgccggtgcacggcccccagcgtctccagagccttgtcatggcaccccatgtccaccatactgggaggctggggagtggacctcttgttctcgatcttgcgggccaggcacccagcaccgccagctccagtgtagacaagagtttggcggcgggggctcaagcgtcccgcccgagaggtgcgggcacctgcccaggccaaacatcacgcagagctgtcagctgcgcctgtgtgggcactgggaggtgggaagcccatggtctcaatgctctgtcaggtgcgggcgggggcagcgcagcagacaggtccgctgtgtgggcaataatggagacgaggtgtccgagcaagagtgtgcatctgggccccctcagccgccatcccgggaggcctgcgacatgggcccgtgtaccactgcttggttccactctgattggagctcaaaggtgagtccagagccgcctgctatcagctgcatcctgggcaaccatgcacaggatacctctgctttccccgcttag

SEQ ID NO: 107286 - DNA, 1311 bp, Artificial Sequence
  Description of Artificial Sequence: Synthetic coding sequence
atgggcagccttgcccttgccggagttctgatggcagtcgaaagcgttggcgttatgatcttgccagtggccctgtttcgcggcaccagcctgaccgagggcgccccctgggctataagacggtcctgtgggtttcaaagagagccgtgtgggtctaggttaccaagctcagggctggctcccacgacatggcatttcgtggctctgggcaggagtatcataaatggcaactgggctgtggacccccccggctcatatcgcgccggcggaacggttttcaggtacaatcgaccaccaagggaggaagggaagggtgagtccttgtccgccgagggccctaccacgcaaccagtggatgtgtacatgatcttccaggaagagaaccccggcgttttttaccagtacgtgatcagcagccctcccccaatccttgagaaccctacaccagagccacccgttccacagctccagccagaaatcttacgggtagaaccaccactggctcctgcacccagacccgctcggacccccggcaccctccagcgacaggtcagaatccctcagatgcccgcccccccacaccccagaactccgttaggatcccctgccgcatattggaagcgcgttgggcactctgcctgttccgcttcctgcggcaaaggtgtgtggcgcccaatttttctttgtatcagccgagagagcggcgaagaactggatgagcgcagctgcgccgcaggggcgaggcccccagcctcaccagagccttgccatggcaccccctgccccccatactgggaagcaggcgagtggacttcttgttctcgctcctgcggccctggcacacagcatagacagttacaatgtcgccaggagtttggagggggggggtcatctgtgccccccgagagatgcggacacttaccaagaccaaacataactcagagctgccaactgcgcctatgcggacactgggaagttggctctccatggagccagtgcagtgttcgttgcggtaggggtcaacggagccggcaggtccggtgtgtggggaacaatggggatgaggtgtccgagcaagaatgcgcatcaggtccacctcaaccaccatccagggaggcttgcgacatgggcccgtgcaccactgcctggtttcactcagattggtcaagcaagtgctcagctgagtgtggcacaggaatccagaggaggtcagtggtttgtctcggaagtggcgctgctctgggtcctgggcagggcgaggcaggcgccgggaccgggcagagctgcccaacaggaagtagacctccctag

SEQ ID NO: 107287 - DNA, 2130 bp, Artificial Sequence
  Description of Artificial Sequence: Synthetic coding sequence
atgcctggtattgacaaacttcctattgaggagacattagaggacagcccacaaacccggagcttgctgggagtgttcgaggaggatgctaccgctatttcaaattacatgaaccagctataccaggctatgcatcgaatttacgacgctcagaacgagctttccgccgccacgcatttaacctccaagctcctgaaagaatacgagaagcaaagatttccccttgggggggatgatgaggtcatgtctagtaccttacagcagttttcaaaagtgatcgacgagttatcttcctgtcacgccgtcctatccacccagttagcggatgctatgatgttccccataacccagttcaaagaaagagacctcaaagaaatactgacgcttaaggaagtctttcagatagccagtaatgatcatgacgcagctattaatcggtactcacggctgtcaaaaaagagggaaaatgataaggttaagtacgaggtcacagaggatgtctatacaagtagaaagaagcaacaccaaaccatgatgcactacttttgcgctctaaatactctgcagtacaagaaaaaaatcgcactcctagagcctctgctggggtacatgcaggctcagattagtttctttaaaatggggtctgagaatctcaacgagcagctagaggagtttctcgctaacatcgggacaagcgtgcagaacgtgcgcagagagatggattcggatatagaaacgatgcagcagactatagaggatttggaggtggcctccgatccactctacgttccagatcctgacccgactaagtttccagtaaacaggaatctgactaggaaggccggctacctcaatgcaaggaataaaacaggcctggtttcttccacttgggatcggcagttttattttacccagggcggtaatctgatgagccaagctcgaggggatgtcgccggcggtttagccatggatatcgacaactgctcagtgatggccgtcgactgcgaagaccgccggtactgcttccagatcacaagctttgatggaaagaagagctccattttacaggccgaaagcaaaaaggatcacgaggaatggatctgtaccatcaacaatatcagcaagcaaatctacttatcagaaaaccctgaggagacggcggcccgagtcaatcagagcgctctcgaggctgtcacccctagcccatcatttcagcagcgccacgaatccttgaggccggcggctgggcaaagcaggcctcctacagctcgcacaagcagcagcggctccctcgggagcgaatcaaccaatcttgccgctctgtctctagactccttggtcgcccctgacacacctatacagtttgatattatctctccagtgtgtgaagatcagcccggacaggccaaagcattcggtcagggaggcaggcgcaccaacccgtttggggaatcaggtgggtcaacaaagtccgagaccgaagattccattcttcatcaactgttcatcgtgcgctttttgggctcaatggaagtgaagagcgatgaccatcctgatgttgtgtatgagacaatgcggcagatcctggctgcccgcgccatccacaatattttccggatgacggagtcacacctactggtgacatgtgactgtttgaaactgatagacccacagactcaggtcacgaggttgactttccccctgccctgtgttgtgctgtacgctacccaccaagaaaacaagcggctgtttggcttcgtccttcgtacatcgtcgggcagatcagaatctaatcttagttccgtgtgctacatttttgagtccaacaacgagggggagaaaatttgcgacagcgtgggactggccaaacaaatagccttgcacgccgagctcgaccgccgagcatctgagaagcagaaagagatagaaagagtgaaagagaagcaacagaaggagctcaacaaacagaagcagattgagaaagatctggaagaacaaagccggttaatcgctgcttcttctcgtcctaaccaggctagttcagaagggcagttcgttgtgctgtcatcctcccaatccgaggagtcagacctgggggaagggggtaagaagagagaatccgaggcctag

SEQ ID NO: 107288 - DNA, 1995 bp, Artificial Sequence
  Description of Artificial Sequence: Synthetic coding sequence
atgcccgcagtcgataaactgctcctggaggaagccctccaagatagcccccagacccgatctttgctctcagtgttcgaagaggacgctggcacattgaccgattacactaaccagctgctccaggcgatgcagcgggtatatggagcccaaaatgagatgtgtctagcaacgcaacaattaagcaagcagctgttggcatatgagaaacaaaacttcgcactcggtaaaggggatgaagaggttatcagcacccttcactacttttccaaagttgtcgatgagttaaacctgctccatactgagctggccaaacaactggcggacactatggtgcttcccatcattcaatttagagaaaaggacctgaccgaggtttctactttgaaggacctttttggccttgcgtcgaacgaacacgacttatccatggctaagtacagtagactgccaaagaagaaggaaaacgaaaaagtgaagacggaagttgggaaggaggttgccgcagcacgacgaaagcaacatctttcttcccttcagtattactgtgccttaaacgcattgcagtaccgcaaacagatggctatgatggaaccaatgattggtttcgctcacggtcagattaatttttttaagaagggcgccgagatgttcagcaaaaggatggatagtttcctgagctctgtagccgacatggttcaatctattcaggtggaactagaagccgaagcggagaagatgagggtttcccagcaggaacttctgtcagtcgatgagagcgtctatactcctgatagcgatgttgcagccccccaaataaacagaaacctcatccagaaagccggatatctcaatctacgcaacaagaccggactggtgacaacaacttgggagagactgtacttttttacccagggaggaaatttgatgtgtcagcctcgcggggctgtggccggcggtctgatacaggatctggataactgcagtgtaatggccgttgactgtgaagaccgaaggtactgcttccagattaccacccccaatggcaaatcaggaatcattctgcaagcagaatcacgcaaggaaaatgaagagtggatctgtgcgatcaacaatatcagtagacaaatttacctgactgataatcctgaagccgtggctataaaacttaaccaaaccgcactgcaggccgtcacccctattacctcatttgggaagaagcaggagtcatcatgtccaagccaaaacctcaagaattctgagatggagaatgagaatgataagatcgtgcccaaggccactgccagcctacccgaggccgaggagttgatcgccccgggaacgccaattcagttcgatatcgtactgcctgcaaccgaatttctggaccagaatcgcggctcccgaaggaccaatcctttcggagagactgaagatgaatcatttcccgaagcagaggacagccttctgcagcaaatgttcatcgtcagatttcttgggtcaatggcggtgaaaactgatagtactactgaagttatttatgaggccatgcggcaggtactggccgccagagccattcacaatattttccggatgacagaaagccacctgatggtgacatcccagtccctgcgacttattgacccccagacccaggtgagtagggcaaatttcgaattgacctccgtgacgcaattcgcagcacaccaagaaaataaaagattagtgggattcgttatcagagtgccggagtccacgggcgaagaatccctgagcacctacatttttgaatccaattccgagggcgaaaaaatttgctatgccatcaatctcgggaaagaaatcatcgaggtgcagaaagaccctgaggcactagcccagctcatgctgtcaatcccgttaaccaatgatggtaaatatgtgcttttgaacgatcagccagacgacgacgacggtaatccgaatgagcatcgaggcgccgaaagcgaggcatag

SEQ ID NO: 107289 - DNA, 2013 bp, Artificial Sequence
  Description of Artificial Sequence: Synthetic coding sequence
atgcctgccgtcgataaactgctactggaagaggcattacaagactccccccaaacccggagcctcctcagcgttttcgaggaggatgccggcacacttactgactatactaaccagcttctgcaagctatgcaacgtgtctacggagcacagaatgaaatgtgtctcgcaacacagcagctaagcaaacagctcctagcttacgaaaaacagaatttcgccctgggcaagggagatgaagaagtgattagtacactccactattttagtaaagtcgtggatgaattgaacttactgcatactgagcttgctaagcagctggctgatactatggtgctgcccatcatccagttccgggagaaggacctgaccgaggtatcaacacttaaggacctgttcggactcgcctctaacgatgtgtgtttgttccttgagcacgatttgtcgatggcaaagtacagcaggttgccaaagaaaaaagaaaatgagaaggtgaaaactgaggtaggaaaggaggtcgccgccgcgcgccgaaagcagcacctgtctagtctacagtattactgtgccttaaacgccttacagtatagaaaacagatggcgatgatggagccgatgataggattcgcccatggccaaattaacttcttcaaaaagggggccgagatgttcagcaaaaggatggacagcttcctttcatcagtagccgatatggtgcagtcaattcaggtcgagcttgaggccgaagctgaaaagatgcgagtgtcacaacaggaacttttatcagtggacgaaagcgtttataccccagatagcgatgtggctgctccacagatcaatcgtaatctgatacagaaggcaggatacctaaacttgcgcaataagaccggtctggtgacgacaacctgggaaaggctgtatttctttacacaaggcggcaacctgatgtgccagcctcgaggcgctgtggccgggggcttaatccaggacctggataactgctcggtaatggctgtcgattgcgaggaccggcggtactgtttccaaattactactccgaatgggaaatccggcattatcctccaagcggagagccgaaaggaaaatgaggagtggatttgcgctattaataatataagtcgtcagatttacctaaccgacaacccggaagctgtggcgatcaagctcaatcagaccgccttgcaagcagtgacacccatcaccagtttcggcaagaaacaggaaagcagctgtcctagtcagaacctcaaaaactcggaaatggagaatgagaatgataaaatagtgcccaaggcgacagcatcacttccagaggcagaggaattaatcgctccgggcacccctatccagttcgacatcgtgctgcctgcaacggagtttctggatcagaataggggttctaggcgcacaaaccctttcggggaaactgaggatgaatcctttcctgaagcagaggacagcctacttcagcagatgtttattgtgcgcttcctggggtcaatggctgttaagacagactcaactactgaggtgatctacgaggcaatgcggcaggtactcgccgcgagagcaattcataacatttttaggatgacagagagtcaccttatggtgacctcccagagcttgcggctcatcgaccctcagactcaggtcagcagagccaattttgagctgacatctgtaactcaattcgccgcccaccaggagaataagcgcctggtcggttttgtaatccgggtgcccgaaagtaccggagaggagtctcttagtacatacatcttcgagagcaattctgaaggagagaaaatatgttatgccataaacctggggaaagagatcattgaagtgcagaaggatcctgaggctctggcccaactcatgctgtccattcctctcactaacgacggtaagtatgtcctgctcaatgaccagcccgacgacgacgacggtaatcctaacgaacatcggggcgccgagtctgaagcgtag

SEQ ID NO: 107290 - DNA, 2760 bp, Artificial Sequence
  Description of Artificial Sequence: Synthetic coding sequence
atgacagacagtaaatactttacaactacaaagaaaggcgagatcttcgaactcaaggccgagctaaattctgataagaaagaaaagaagaaagaggccgtgaaaaaggtcatagcatccatgacggtgggcaaggacgtcagcgctctattccccgacgtcgttaactgtatgcagaccgacaatctggagctgaagaaactcgtctacctgtacctgatgaactatgccaagagccaacctgatatggctatcatggccgtcaacactttcgtgaaggactgcgaagatccaaacccattgatccgcgcacttgccgtccgcacaatgggttgtatccgagtggataagataactgagtatctatgcgagcccctgcgtaagtgtctcaaagatgaggatccttatgtccgtaagactgcggccgtttgtgtggcaaagttgcatgatatcaatgcccaattggtggaagatcagggcttcctggacactttgaaggatctgatttcggactcgaacccaatggtggtagccaatgccgtggccgcactctcagaaatagccgagtctcatcccagctcaaacctgttggaccttaacccccaatctatcaataaactcctgacagccctcaacgaatgtaccgagtggggacagatattcatcctggactgcctcgcaaactacatgccgaaagacgaccgcgaggctcagtccatctgcgagcgcgtaactcctagactgtcacatgcaaactctgccgtggtcctcagcgctgtgaaagttctgatgaagttcatggaaatgctgtccaaggacttggactactacgggaccctactcaaaaagctggctccacctctggtgaccttgttgtctgccgaacccgagcttcagtacgtggctctccggaacatcaatctcatcgttcagaagcgcccagaaatactgaagcatgagatgaaagtcttcttcgtcaagtacaatgatccaatttacgtgaagctggagaaactcgatatcatgattcgtttggcaagtcaggctaatatcgcacaggtacttgccgagctgaaggagtacgccaccgaagtggacgtggacttcgtccgtaaggctgtgcgggccatcgggaggtgcgcaattaaagtagaacaatcggccgagcgatgcgtgagcaccctgctggacctaattcaaacaaaggtgaattatgtggtccaggaagcaatcgtggtgatcaaagacattttccggaaatacccaaacaaatatgagtcagtgatagctactctctgcgaaaatctcgacagtctggacgagcccgaggccagggcggcaatgatttggatagttggagagtacgccgagcggattgacaatgctgacgagctactggaatcattcttagagggtttccatgatgaatccacacaagtgcagctgcagctgcttactgcaattgtaaagctgtttcttaagaaacccacagaaacacaagagctggtgcagcaggtcctgtccctggccactcaggactctgacaaccctgatctgcgtgacagaggatatatctactggcgacttttgagtacagaccctgttgcagccaaagaggttgtgttagcagagaagccgttgatctccgaagagactgatctcatcgaacccaccctgctggacgaactaatctgttacataggaaccctagcttcagtgtaccataaaccgccatccgccttcgtcgagggggggaggggcgtcgttcataagtccctgccacctaggactgctagtagtgagagcgctgagtctccagagaccgccccaacaggtgctcctcctggggaacaaccagatgtgatccctgctcagggtgacctgcttggtgatttactaaacctggacctaggtcccccagtttcggggccccccctggccacatcatccgtgcaaatgggagccgtcgatctcttgggcggcggcctggactccctgattggcggtacgaattttgtggcacctcctacagccgccgtgccagcaaatctcggtgcgcccataggttcgggcctttcggacctcttcgacctgacatccggcgtgggcactctgtcgggcagctatgtggcgccaaaggcagtcggatctataagtatggatctgcagcttaccaataaggcccttcaggtaatgacagattttgcaatccagttcaacaggaacagcttcgggctagcccccgcaacccctctccaagtgcatgctcctctgtcccccaaccagaccgtcgagatcagtctgcccctttccaccgtcggctccgtcatgaagatggagcctttgaacaacttgcaggtggccgtgaagaacaatattgacgtgttctatttttctaccctgtatcccctgcatattctgtttgtggaggatggaaagatggacagacagatgtttttggccacgtggaaggatattcctaacgaaaatgaagctcaattccagattcgggattgcccactcaatgctgaggccgccagcagtaagctgcaatcaagtaatattttcactgttgccaaacggaacgttgaaggtcaggacatgctctaccaatcgctcaaactgacaaatggcatctgggtgctggcagaattacgtattcagccgggcaacccatcttgcaccttatcgctcaagtgtagggcacctgaggtcagtcagcacgtgtatcaagcctatgagaccatcttaaagaattag

SEQ ID NO: 107291 - DNA, 2829 bp, Artificial Sequence
  Description of Artificial Sequence: Synthetic coding sequence
atgacggacagcaaatacttcaccactacaaaaaagggtgagattttcgaacttaaagccgagctgaactcggataaaaaagaaaagaaaaaggaagccgtcaaaaaggtcattgcctcaatgacagtggggaaggatgtctccgcactttttcctgacgtcgtcaactgtatgcaaaccgacaatctggagctgaagaagctggtttacctttatctaatgaattacgccaagtcccaacccgatatggcaataatggcagtcaacacctttgtgaaagattgtgaagatccaaacccactgattagagctctcgcagtgcggactatgggctgcataagggtcgataaaataactgaatatttgtgcgagcccctgcgaaagtgcttaaaagacgaagacccatatgtgcggaagaccgctgctgtctgtgtcgctaaattacacgatatcaatgctcagctcgtcgaagaccagggtttcctagatacactcaaagatctgattagcgatagcaaccccatggtagtggccaacgccgttgctgcgctgagcgaaatagcggaatctcacccttcaagcaatctccttgacctcaaccctcaaagtattaacaagttgctgactgccttgaatgagtgtaccgagtggggacaaatatttatcctggactgtttggccaattacatgccaaaagatgaccgggaagcccagtccatatgtgagcgagtaacgccacggctgtctcatgcaaatagcgccgtggtcctgtcagctgtaaaggtcctgatgaagtttatggaaatgctatcaaaggacctggactactatgggacccttctaaagaaactggctccgcctctggtaactctgctgtctgctgagccagagctccaatatgtcgccctgagaaacatcaatctcatcgtgcagaaacggccggagatactcaagcatgaaatgaaagtgttctttgtgaagtacaatgaccctatttacgtcaagctcgagaaacttgatatcatgatcaggctcgccagtcaggctaatattgcacaggtgcttgccgagctcaaggagtacgcgacagaggttgacgtggactttgtgcgaaaagcggtaagagctatcggccgctgtgctattaaggtggagcagagcgcagagcgttgcgtaagcaccctgctcgacctgatccagactaaagtgaattacgtcgtgcaggaagcaatcgtggtgataaaagacatatttcggaagtacccaaataaatacgaaagtgtgatcgctacactatgtgagaatctggactccctcgacgagcccgaagcaagagctgcaatgatctggattgtgggcgagtacgcggagcggattgacaacgctgacgaactgcttgagagctttctcgaagggttccacgatgaatccacccaggtgcagctccagttactgaccgccatcgtgaaactgtttctcaagaaaccaacagagacccaggagctggtgcaacaggtactctccctcgccacacaagatagtgacaatccagatctgcgcgatagaggctacatatattggagacttctcagcacggatccagtggcagcgaaagaggtggtattggccgaaaagcctctcatctctgaggaaacagatctaattgaacccacactattggacgagctcatctgttatatcggtaccctagccagcgtctaccataagcctcccagcgctttcgtcgaggggggcagaggagtagtgcacaaaagcctgcctccgcggaccgcgtcatccgagtcagctgagtccccagagactgcccctaccggcgctccgcccggcgagcagcccgatgtgattccagctcagggagacctcctgggagatctgctcaatctggatctcggacctcctgtgtctggaccccctctcgccacaagctcagttcagatgggcgctgtcgacctgttgggtggcggacttgactctctgataggggggacaaacttcgtagcacccccaacagcggccgtgcctgcaaacctgggtgcccctattggaagtgggctgtcagatttatttgaccttacatcaggcgtgggcacactcagcggaagctacgtggcccccaaggctgtgtggttgcctgccatgaaggccaaagggctggagatttccgggacgtttactcggcaggtgggaagtatcagcatggacctccaattgactaacaaggcattacaagtcatgacggatttcgcaatccagttcaacagaaacagtttcggcttggctcctgccacacctcttcaggtgcatgctcccctctcacctaaccaaacagttgagataagtttgcctttatccactgtgggatctgtcatgaagatggaacccctgaacaatctgcaggtcgccgtgaaaaacaacatcgatgtgttctacttttcgaccctttatcctctacacatcctttttgttgaggacggtaagatggacagacagatgtttctcgcaacttggaaggacatcccaaatgagaatgaggcacaatttcaaattcgggactgcccattgaatgcagaagcggcaagtagcaaactgcagtcttcaaatatattcaccgtggccaagagaaacgttgagggccaggacatgctgtaccagtcccttaagctaactaacggtatttgggtcttggcggagctgcgcatacaacctggaaatccgagctgtacggatcttgagttatccctgaaatgtagagcgcctgaagtttctcagcacgtgtatcaggcctacgagactattcttaaaaactag

SEQ ID NO: 107292 - DNA, 2850 bp, Artificial Sequence
  Description of Artificial Sequence: Synthetic coding sequence
atgaccgatagcaaatacttcaccactactaaaaaaggcgaaattttcgagctgaaagctgaattgaatagcgataaaaaagaaaagaaaaaggaagccgtaaagaaggtgatcgccagtatgactgttggcaaggatgtgagcgccctcttcccagacgttgtcaactgcatgcaaacagataacctagaactgaagaagctcgtctacctctacttgatgaattatgctaagtcgcagccagacatggcgataatggcggttaacaccttcgtcaaggactgtgaggacccaaatccactgatccgcgctctggcggttcgcacgatgggctgcattagagtcgataagatcaccgagtacctttgcgagccactgcgaaagtgcctcaaggacgaggacccttacgtccggaagaccgcggccgtttgtgtggcgaaactgcacgatatcaatgcacaactggtggaagaccaaggttttcttgatacgctcaaggatctgatctctgactccaatcctatggtggtagctaatgcagttgccgctttaagcgaaattgcggaaagccaccctagtagcaacctcttagatctcaacccgcagtcaattaataagctactgaccgcgttgaatgaatgtacagagtgggggcagatcttcattctggattgtctagctaattacatgccgaaggatgatagagaggcgcagtcaatttgtgaacgggttacccccagactgagccatgctaactccgctgttgttctatcagctgtcaaggtcctgatgaaattcatggagatgctttcaaaagaccttgattattatggtactcttcttaagaaacttgctccgccccttgttaccctgttgagtgcagagcctgagctgcagtacgtcgcactccggaatattaacctaattgtgcagaaacggccagagatcctcaagcatgagatgaaggtgttttttgtgaagtataatgacccgatttacgtcaaactcgagaaactggatattatgattcgcctggcctcccaagctaatatagcccaggtacttgccgagttgaaagagtatgcaaccgaggtcgatgtcgatttcgttaggaaggcggtcagagcgataggcaggtgcgcaattaaggtggagcagtccgccgaaaggtgtgtcagcactctgctcgacctgatccagacaaaagtgaactatgtggtgcaagaagctatcgtggtgatcaaagacatctttcggaaatatcccaataaatacgaatcagttatcgctaccctgtgcgagaacctggactcgttagacgagcccgaggcccgggccgccatgatctggattgtcggtgagtacgccgaaagaattgacaacgcagatgagctgttggagagctttctcgagggcttccacgatgagtcaacccaggtgcagctgcaactgctgacagctattgtaaagctgtttctgaagaagcctacagaaacccaggagctggtccagcaggtgctgagcctggctacccaagacagcgacaatccagaccttagggacagggggtacatctactggcgtcttctctcaacggaccccgttgccgccaaggaggtggtgctcgcggaaaaacccctcatctccgaggagacggatctgatagagccaactctgctcgatgagctgatatgttatatcgggacgctggcgtcagtatatcataagcctcccagcgctttcgtcgagggaggacggggcgtggttcacaaaagcctacctcccagaaccgctagctcggaaagcgcagagtcccccgaaactgccccgaccggcgcaccgcccggagagcaacccgatgtgatccccgcccagggggatctgctgggtgacctgctgaacttggatttgggccctccggtcagcggacccccgctcgcgacatcctccgtacagatgggggcggttgatctgctgggcggcggcctggactcgctcatgggggatgagcccgaaggcatcggtggcaccaatttcgtggccccacccacagcagccgtcccagccaacttaggcgccccaataggctcggggctcagcgacctttttgatctcacaagcggcgtgggaaccctgtccggctcatacgtcgcccccaaggctgtgtggctacccgccatgaaagcaaagggattagagattagtggaactttcaccaggcaggtcggctccatttctatggacttgcagctaaccaacaaggccctgcaggtgatgactgatttcgcaatacagtttaatcgaaactcatttggcctagctcctgccaccccacttcaagtgcatgctccgctgtctcctaaccaaaccgtcgagatttccctgcctctcagcactgtgggcagcgtgatgaagatggagccgttgaacaacctacaggtggcagtcaagaacaatattgacgtgttttacttcagtaccctttaccctctccacatcctgttcgtcgaagatggaaaaatggacaggcagatgttcctggcaacatggaaggacataccgaacgagaacgaggcgcagttccagattagggattgcccactgaacgccgaagccgcctccagtaaactccagagcagcaacatttttactgtcgctaagaggaatgtggagggccaggacatgctctatcagagcttgaagctgacaaacggaatttgggtcctagccgaactgcgcatccagcctggaaacccctcgtgcaccgacttggagttaagtcttaaatgtagagcacctgaggttagccaacacgtgtaccaggcctacgagacaattcttaagaactag

SEQ ID NO: 107293 - DNA, 2820 bp, Artificial Sequence
  Description of Artificial Sequence: Synthetic coding sequence
atgaccgatagcaagtactttacaactaccaagaaaggcgagatctttgagttaaaggcagagctgaattccgataaaaaagaaaaaaagaaggaggccgtcaaaaaagtgatcgcttctatgaccgtgggaaaggacgttagcgctctctttcccgatgtagtgaattgtatgcagaccgataatctcgagttgaagaaactggtgtacctgtatctgatgaattacgctaagtcacagcctgacatggccatcatggccgtgaacacgttcgtgaaggactgcgaggaccccaatccactcattcgggcgcttgctgtaaggactatgggatgtatacgagtcgacaagatcaccgaatacttgtgcgaaccactccggaaatgcctcaaggatgaggacccctatgtccgcaagaccgccgccgtgtgtgtggcaaagttgcacgacatcaatgcacagctggtggaggatcaaggcttcctcgatacactgaaagatctgatctcagacagtaatccgatggtcgtggccaatgcggtagcggccctatccgagatcgccgagagccaccccagttccaaccttctggacttgaacccacagtctattaataaactgctaaccgctttgaatgaatgtacggagtggggccagatctttatcctggactgcctggcgaactacatgcccaaggacgatagggaagcccagtccatctgtgagagggttactccacgcctcagtcacgcaaactcagccgttgtactgagtgctgtcaaagtgcttatgaaattcatggagatgctttctaaggatttggactactatggaacccttttaaaaaaactggctccccccctggtcaccctgttatctgcggagcccgaactgcagtacgtcgcgttaagaaacattaaccttattgttcagaagcgtcccgagatacttaagcacgaaatgaaggtgtttttcgtgaagtacaatgacccaatttacgtgaaactcgagaagttagacatcatgattcggctcgcttctcaggctaacattgcccaagtgctggccgagttaaaagagtacgccactgaggtcgatgttgattttgttcggaaagccgtgcgcgctatcggtcggtgcgcgattaaagtcgaacagagcgccgaacgctgcgtgagcaccctgctagacctcatacagacaaaagtgaactatgtggtccaagaggccatcgtagtgatcaaagacatctttagaaaatatccaaacaagtacgaaagtgttatagccacactgtgcgaaaacctcgactctctggatgagcccgaagcacgtgctgctatgatttggatcgtgggggaatatgcagaacgcattgataatgcagatgagttactagagagcttccttgaagggttccatgacgagtcaactcaggtccagctgcaattgctaaccgccatcgtgaagctatttctgaaaaagcccaccgagacacaggaactggtgcagcaggtgctctcattggctacacaggactcagacaatccagacttacgggatagaggttacatttactggagactgctatctacagaccctgtggctgctaaggaagtggttctagcagaaaaacccttaatttccgaagaaaccgatctcatcgaacccactctactggatgaactgatctgctatattggtactttggcttctgtataccacaagcccccctccgcgttcgttgaaggaggtcgcggggtggtgcacaagtctctgcccccccggacggcatcttctgagtcagcggagagcccagaaaccgcccctaccggcgcacctcccggggaacagccagacgtgatcccagcgcagggcgatttgctgggagacttgctgaacctagatctggggccaccagtctcagggccacccttggcaacctcttcagtccaaatgggagccgtagatctcctgggcggcgggttggattccctcatcggtggcaccaactttgtggcacccccgaccgctgcagtcccagctaatctgggggcccctatcggctctggcctgagcgatttattcgacttgacatccggggtgggcactctctcaggatcttacgtggcccccaaagccgtgtggctacctgctatgaaagctaaaggcctcgaaattagtgggacattcacaagacaggtgggctcgatctctatggatttgcagttgaccaacaaagccctccaagtcatgacagattttgctatacagttcaatcggaatagttttggtctggcccctgcgactcctctacaggtgcatgcccccttaagtcccaaccaaactgtcgagatctctctcccactcagcactgttggcagcgtaatgaagatggaacccctgaataacttgcaagttgcagtgaaaaacaatattgacgtgttttactttagtacgctttacccactgcatatcctgttcgtcgaagacgggaagatggatagacagatgttcctggctacctggaaggatattccaaacgagaatgaggctcagtttcaaatcagagactgcccgttgaacgccgaagcagcatcgagcaagctgcagagctctaacattttcacggtggcaaagagaaacgtagagggacaggacatgctgtatcaatccctcaagctgacaaatggaatatgggtgttggccgagctcagaatccagccgggtaatccctcatgtacactgtcccttaaatgtagagctcctgaagtcagtcagcacgtttatcaggcatacgagaccattctgaagaattag

SEQ ID NO: 107294 - DNA, 2850 bp, Artificial Sequence
  Description of Artificial Sequence: Synthetic coding sequence
atgactgatagtaaatatttcaccaccactaaaaaaggagaaatttttgagctgaaggccgaactaaattctgataaaaaagaaaagaaaaaagaagctgttaaaaaggtcattgcttctatgacagtcggcaaagacgtcagcgcactgttccctgatgtcgtgaattgcatgcagacagacaacttggagctgaaaaagttggtgtacctctatctaatgaattacgccaaatcacaacctgacatggcgattatggccgtgaacacatttgtaaaggattgtgaggatcccaaccccctgatccgtgcgctggcagtcaggactatgggttgcatcagagtcgataaaataaccgaatacttgtgtgagccgttaagaaagtgcctgaaagatgaggacccttatgtcagaaaaacagcggccgtctgtgtggctaagcttcacgatatcaatgcccagctggttgaagatcaggggttcctggataccctaaaggacttaatttctgactctaatccaatggtggtcgcgaacgccgttgcagctctgtccgaaatagcagaatctcaccctagctctaaccttctggatctcaaccctcaaagtataaacaagttgttgacagcgctaaacgagtgcacagagtgggggcagatctttatcctggattgcctagctaattatatgccaaaggatgaccgcgaggcacagtccatctgtgagagagtcacccccaggttatcacacgcaaactcagccgtggtcctttccgccgtcaaagtgctgatgaaattcatggagatgttgtcgaaggacctcgactattacggcaccctgctgaagaagttggcgcccccgctcgtgaccttgttgtcagcagagcctgagttgcaatacgtggctctgcgtaacatcaatcttatcgtgcagaagaggccagaaatcctaaaacacgaaatgaaagtgttctttgtgaagtataacgacccgatctacgtgaagctggagaaactcgacattatgataaggctggcatcacaggccaacatcgcccaggttctagccgaactcaaggagtacgctacggaagtggatgtcgactttgtacgcaaagcagtgcgcgctattggcaggtgcgctataaaggtagagcagtccgctgagcgatgtgtctctacactccttgatcttatccagactaaggtaaactatgtcgtgcaagaagctatcgtcgttatcaaagacatatttcggaagtatcccaacaagtacgaatcggtgattgccacattatgcgagaatctggatagcctggatgaaccagaagctagagccgcgatgatctggattgtgggggagtatgctgagcggatcgataatgctgacgaattactagaatccttcttggagggcttccacgacgagtccactcaagtacaactgcagctgttgaccgctattgttaaactttttcttaagaagcctacggagacccaagaactcgtacagcaggtgctcagcctcgccacacaagatagcgataacccagatttgagagataggggctacatctattggaggctgctgtccactgacccagtcgcagctaaagaagtcgtactggctgagaagcctctcatctcagaggaaaccgaccttatagagcctactctgctggatgagctgatttgttatattggtacgctggcttctgtctaccacaagcctccctcagcctttgtcgagggagggagaggcgttgtgcataagtcccttccacctcgcaccgccagtagcgagagtgccgagagtccagaaacagcacccacaggagctccacctggcgaacaaccggatgttatccctgcacagggggatctactgggggatctcctgaacctcgatttaggaccccccgtgagtgggcctccactggctacaagcagtgtgcaaatgggcgccgtggacttgctcggcggaggtctggactccctgatgggggacgagccagagggcattggtgggacaaactttgttgcccctccaaccgcagcggtgcctgctaatctcggcgcccctataggaagcggtctgagcgacctgtttgacctgacctccggggtgggcaccttatccggctcctatgtagccccaaaagcagtatggttaccggccatgaaagccaagggtctagagatctccggtacattcacacgccaggttggaagtatttctatggacctgcaactcaccaacaaagctttgcaagtgatgaccgacttcgccattcagtttaatcgcaactccttcggcctcgcacccgcaactccactgcaggtgcatgctcccctctcaccaaatcaaacagtcgagatatctctgccactctctaccgtggggtccgtcatgaagatggagcccttgaacaacctccaggtggctgtcaagaataacattgatgtgttctacttttcaacattgtatccactccatatcctattcgtggaagatggaaaaatggataggcagatgttcctggctacttggaaggatattcccaatgaaaatgaggctcagtttcagatacgcgattgtcctctgaacgccgaagctgcaagctccaaattgcagagtagtaacatttttacagttgctaagagaaacgtcgaaggacaggatatgctctaccagtcactgaagctcaccaatggtatctgggtgttggccgagttaagaatccaacccggcaacccctcctgtaccgatctggagttgtcactgaagtgtcgagctcctgaagtgtcacagcacgtgtatcaggcatatgagactatcctgaaaaactag

SEQ ID NO: 107295 - DNA, 2820 bp, Artificial Sequence
  Description of Artificial Sequence: Synthetic coding sequence
atgacagactccaagtactttacaacaacaaagaaaggagaaatcttcgagctgaaagcagaactgaattctgataaaaaggagaagaaaaaggaggccgtgaaaaaggttatcgcgtctatgacggtaggcaaggacgtgagtgcgctgtttccagacgtggtgaattgcatgcaaaccgataacttagaattgaagaagctggtgtacttgtatcttatgaattacgctaaaagccagccagacatggccatcatggctgtgaataccttcgtaaaagactgtgaggatcctaatcctctgatccgcgcactggcagttagaactatgggttgtatcagggtagacaagatcacagaatacttatgtgagcccttgcggaagtgtttgaaggatgaggacccttacgtgaggaaaacagccgccgtttgcgtggccaagctgcacgacattaatgcccaactagtggaggatcagggatttctggacacccttaaagacctcattagcgactccaacccgatggtggttgcaaacgccgttgccgctctgtctgagattgccgaatcccaccctagttccaatctactagaccttaatccccagagcattaataaactcctgactgctttgaacgagtgcaccgaatggggacagatcttcattttggattgtttggctaattatatgcctaaagatgatagagaagcccagtctatctgtgaacgcgtgaccccccgactgtcgcacgcaaattccgccgtcgtgttgagcgccgtcaaagttttgatgaaatttatggaaatgttatcaaaagaccttgattattacggcacactgctgaagaagctcgcacctcctcttgtgactctgcttagtgctgagcccgaattacagtatgtggcactgagaaatattaacttaatcgtgcagaaaaggcccgagattctgaaacatgaaatgaaagtcttcttcgtgaaatacaatgatccaatctatgttaaactcgagaagctcgacatcatgattcgactcgcctcgcaagctaacattgcacaggttctggcagaactgaaagagtacgcaaccgaagtggacgtcgatttcgtcaggaaggccgtgagagctataggccgctgtgccataaaagttgaacaatccgcagagagatgtgtgagcacactgctggacctgatacagacgaaggtcaactacgtggtgcaggaggctatcgtggtcatcaaagacattttcagaaaatacccaaacaagtacgaaagtgtcatagccacgctttgtgaaaatctagacagtctcgacgagccagaggctagagcagcaatgatttggatcgtcggtgaatacgcagaaagaattgacaacgctgatgaattgctggagtcctttctggaagggttccatgatgaaagcacacaggtgcagctgcaactgctgacagctattgtgaagcttttcctcaagaagccaactgagacacaggaattagtgcaacaggtgctgagcctggctactcaggacagtgacaatcctgatctgagagatcgcggatacatatactggcgcctcctgagtacggaccccgtagccgccaaagaggtagtgcttgcagaaaagcctctgatatctgaggagacagaccttattgaaccaaccctactggacgagttgatttgctacattggtaccctggcaagcgtttaccataagccgccgtcggccttcgtcgagggcgggagaggagtagtgcacaaaagcttgcccccccgcacagctagctctgagtctgccgagtcccccgaaacagcacctacaggagcaccccccggggagcagccagacgtgatccctgcccagggcgacttgctgggggacctccttaaccttgacctgggtccccccgtcagtggacctccgcttgcgacatcctcagtgcagatgggcgctgtcgacttactgggcgggggcctcgactctcttatcggcggtacaaattttgtggctccacccaccgccgcagtgcctgctaacctcggtgcccctattggtagcgggttgtccgatctttttgatctcacatccggcgtgggcaccctatccgggagttatgtagctccaaaggccgtgtggctgccggcgatgaaggctaagggcctggaaatctcaggtacctttacccgccaggtggggtctatctccatggacctccagctgacaaacaaagcactgcaggttatgaccgactttgccattcagtttaataggaattcctttggattggccccagccactcctctccaggtgcacgcgccccttagcccgaatcaaacagtcgaaatttcgctgcctctttctacagtggggagcgtcatgaaaatggagcctcttaataacctgcaggtcgccgttaaaaataacatagacgtgttttatttctcaaccttgtaccctctgcatatactcttcgtggaagacggcaagatggaccgccaaatgtttctagccacgtggaaggatattccaaatgaaaatgaggctcagtttcagattagggactgccccctgaatgctgaggcagcgagctcaaagttacagtctagtaatatctttaccgtcgccaaacggaacgttgagggacaagatatgctctatcagagcttaaaactcaccaacggaatttgggtgttggctgagcttaggatccagcccgggaacccgtcgtgcactttaagtctgaaatgtcgggctccggaggtgtctcagcacgtgtatcaggcatacgaaacaattctgaaaaactag

SEQ ID NO: 107296 - DNA, 1737 bp, Artificial Sequence
  Description of Artificial Sequence: Synthetic coding sequence
atgaccgatagcaaatatttcactaccaccaagaagggagagatctttgaacttaaagcggaattgaattcagataagaaagagaaaaagaaagaggcggtgaaaaaggttatcgccagtatgacagtggggaaagacgtgtctgcattatttcccgacgtcgttaattgcatgcagacagacaacttggagttgaagaaacttgtttacttgtaccttatgaactacgcgaaatctcaaccggatatggcgattatggctgtgaataccttcgttaaggactgcgaggatccgaatccgttaattcgcgcactggctgtccggacgatgggatgtatcagggtggataagataacagagtatctgtgcgagcctctcaggaaatgtttgaaggatgaagacccttacgttcgtaaaactgctgcagtttgtgtcgcaaaactacacgacattaatgcccagctcgtcgaagaccagggatttctcgacactctcaaggatctgatctctgacagtaaccctatggtggttgctaatgccgttgcggccttatcagagatagccgagagccacccctcttctaacctgttggatcttaatccacagtcaattaacaaactgctcactgcccttaatgagtgcaccgaatggggtcagatctttatcctggattgtcttgcgaattacatgcccaaagacgatcgagaagctcagagtatttgcgaacgcgtgactccacggctgtcccacgctaatagcgcagtcgttctgagcgcagtgaaggtcctgatgaaattcatggagatgttaagcaaggatctggattactacggcaccctcttgaaaaagcttgcgcctcctttagtgactttgctctccgctgaacccgagctacagtatgttgccctaagaaacattaacttgattgtgcaaaaaaggccggaaatcctgaaacatgaaatgaaagtgttttttgtgaaatataatgaccctatctatgtcaagttagagaagctagacattatgatacgtttagcatcacaggccaacatcgcacaggtgctggccgagcttaaggaatatgccacagaggtagatgtagacttcgtacgcaaggcagtcagggctatcggccggtgtgccatcaaggtggagcagagcgctgagcggtgtgtctccacgctgcttgatctcatacagacaaaagtaaattacgtggtgcaagaggcgattgttgtaatcaaggacatctttaggaagtatccgaataaatatgagtcagtgatcgctactctgtgcgaaaacctggactccctagacgagccggaggcaagagcagccatgatctggattgtgggagagtacgcagagcgcattgacaatgctgatgagctgcttgagtctttcctggaggggtttcacgacgagtccactcaggtgcaacttcaactgctcaccgccatcgtgaagctcttcctgaaaaaacccaccgaaacccaagaactggtgcagcaggtgttatctctggcaactcaggacagcgataaccccgatcttagagatagggggtacatctattggcgcctgttgtccacagacccggttgcggcaaaggaagtggtcctggcagagaagcccctgatctcggaagaaaccgatttgattgagccaactctccttgatgagctcatttgttacatcgggacattagcttcagtgtaccataaaccgccctag

SEQ ID NO: 107297 - DNA, 2820 bp, Artificial Sequence
  Description of Artificial Sequence: Synthetic coding sequence
atgactgatagcaaatacttcactacaaccaagaaaggggagattttcgagctgaaggccgagctgaattcggacaagaaagagaaaaaaaaggaagcggtcaagaaggttatagcctcaatgactgtgggtaaggatgtgagtgccctttttccagacgtggtgaattgcatgcagaccgataacttggagcttaagaaactggtctatctgtatcttatgaattatgccaagagccagcctgacatggcaataatggccgtaaatacattcgtgaaggattgtgaggacccaaatcccctgattagggccttggctgtgcggactatgggctgtatccgagtggataagatcaccgaatacttatgcgaacctctgcgcaaatgtctaaaggatgaagatccttacgttcggaagacagcagctgtctgcgttgccaagttgcatgacataaacgcgcagttggtagaggaccaaggattcctggacactcttaaggacctgatctccgatagtaatcccatggtggtggccaacgctgtggccgcactctctgaaatagcggagagccacccttctagtaatctccttgacctgaacccccagtccatcaataagctcctgaccgctctgaatgagtgcaccgagtggggccagattttcatcctggattgtctggcaaactatatgcctaaagacgatcgggaggcccagagtatttgtgagcgcgtgactccccgactgtcccatgctaatagcgcggtggtgctttctgctgtgaaagtgcttatgaaatttatggaaatgttaagcaaagatttggattactatggaacattactgaaaaaactggcacctcccctggtgacgctgctttccgctgagcccgagctccagtacgtggctctgcggaatattaacctgattgtacagaaacggcccgaaatcttgaaacacgagatgaaggtgttctttgtcaaatataacgatcctatctacgtgaaactggaaaagctggacatcatgattagactcgcttctcaggccaacattgcccaggtgctggcggaactaaaagaatatgccaccgaggtcgatgtggacttcgtgcgtaaggctgttcgcgccatcggcagatgcgccatcaaagttgagcaaagcgccgaaagatgtgtgtcaacattactggatctgatccagaccaaggtaaactatgttgttcaggaggctatcgtcgttataaaagacatttttagaaagtatccaaataaatatgagtccgttatcgccaccctatgtgagaatctggattctcttgatgaacctgaagctcgggcggcaatgatttggatcgttggcgaatacgcagagaggatcgacaacgccgatgagcttttggaatcattccttgagggtttccatgatgagtccacccaagtgcaattgcaactgctcactgcaatcgtcaagctctttctgaagaagcctacagagacacaagaactggtgcagcaggtcctctctttggcaacgcaagactccgacaaccctgacttaagggacagagggtacatatactggcgcctcttgagcacagaccctgttgcagcgaaagaagtagtgctcgccgaaaagccattgatcagtgaggaaacagatcttatagaacccaccttgctggacgagttgatctgctatataggtacgcttgcctcagtgtatcacaaaccgccatccgcctttgtcgaaggagggcgtggggtggtacacaagagtctgcctccacgtaccgcttcatccgagagtgcggaatcacccgagacggcacctacaggcgcaccgcccggcgagcagccagacgtcatccctgctcagggagatctgctgggagacctgctcaatctggacttgggcccacccgtgagcggtccaccactggccaccagtagcgtgcagatgggagctgtcgatctattggggggaggtctcgactcactcatcggagggactaattttgttgccccgcctacagccgccgtgccggctaatctaggggcccccatcggctccgggttgagtgatctctttgaccttacatcaggggtgggaactctgagcgggtcttacgtggcacccaaggccgtatggctccctgccatgaaggctaagggactcgaaatcagcgggacgttcacccgtcaggttggcagcatcagcatggacctgcagttaacaaacaaggctctccaggtgatgaccgacttcgcaatccagtttaaccgaaacagcttcggtctggcccccgctacaccccttcaggtgcacgcgcccctgtcacctaatcagaccgtcgagatttccttgcccctgtcaaccgtcggctccgtgatgaagatggaaccgctcaataatctgcaggtcgcagtgaaaaacaacattgacgtgttttatttctccacgctataccccttacacatcctgttcgtcgaggatggcaagatggaccgtcaaatgtttcttgccacttggaaggatattcccaatgaaaatgaggcgcagttccagatccgagattgccctcttaatgcagaagccgcatctagcaaattacagagtagcaatatatttacagtagcgaaacggaatgtggagggacaggacatgctgtaccagtcactgaaactgactaacggtatctgggtgttagccgaactcaggatccagcccggaaatccctcctgcaccctgagccttaaatgccgggctcctgaggtgtcccagcatgtgtatcaggcatacgaaacaattctcaaaaattag

SEQ ID NO: 107298 - DNA, 2469 bp, Artificial Sequence
  Description of Artificial Sequence: Synthetic coding sequence
atgcctgcacccatccgtctgcgcgaactgattcgcactataaggacagcccggactcaggcggaggagcgcgaaatgatccagaaagagtgtgccgctatacgctctagcttcagagaggaagataatacatatagatgcagaaacgtggccaagctgctctatatgcatatgctgggatatccggcccacttcggacagttggaatgtttgaagctcatagcctcccagaaattcaccgataaacgcattggctatctgggtgcgatgctactcctcgacgagaggcaagacgtgcacctgctgatgactaactgtatcaagaacgatctgaatcactcaacacagttcgtgcagggtctagccctctgcaccctggggtgcatgggctcctccgaaatgtgcagggatctggccggggaggtggaaaagctactcaaaacgtccaactcttacctcagaaagaaggccgctctgtgcgcggtgcacgtcatcagaaaggttcccgagttgatggaaatgttcctgcccgccactaaaaacctactgaacgagaaaaaccacggagtcttacacacctcagtggttctgcttacggagatgtgcgaaaggagcccagatatgctcgcacactttaggaaactcgtccctcagctggtccgtatcctcaagaacctgattatgtccggctattcacctgaacacgacgtaagtgggatatcagatccattcctgcaggtgagaattctaagactccttaggattctcggtagaaacgacgacgacagtagcgaagctatgaatgacatcctggcccaggtggctacaaacactgagacatccaaaaacgttgggaatgccatcctctacgaaacagtactgacaattatggacattaagtcagagagcggactccgtgtgctggctatcaatattctcgggagattcttactgaataacgataagaatatacggtatgtcgcgctgacgtcacttctgaaaacggtgcagacagatcataatgctgtccaacgacatcggagcaccattgtggattgccttaaagacctcgacgtttccattaagcggagagccatggagctcagtttcgccctcgtgaatggtaacaatatccgggggatgatgaaagagctactgtacttcctcgacagttgcgagcccgagttcaaggccgattgcgcaagtggcatattcctggcggctgagaagtacgcaccaagcaaacgctggcacattgacaccattatgagggttctaactaccgccggctcctacgtgcgcgacgacgcagttcctaatctaatccaacttatcacgaactcagtcgaaatgcacgcctacacagtgcaacgcttgtataaagcaatattgggtgactactcccagcagcctctggtgcaggtagctgcatggtgtattggagagtacggggacttgctggtgagtggccaatgcgaagaggaagaaccaatacaggtcactgaggatgaagtgctggatatcctagagtctgtattgatatccaacatgtcgaccagcgtgaccagagggtacgctttgaccgcaatcatgaaactgtctactcggtttacatgtaccgtcaatagaataaagaaggtcgtctccatctacgggagctcaatcgacgtggaacttcagcagagagccgtcgagtacaatgccctgttcaagaagtatgaccatatgcggagtgctttgcttgaaagaatgcctgtgatggagaaagtgaccacgaacgggcctaccgaaatagtccagacaaacggggagaccgaacctgcgccactggagacaaaacctcccccttcgggtccgcagcctactagtcaggcaaatgatctgctcgacttgttaggcggcaacgacattacaccagtcatccctacagctcccacaagtaagccgtcatctgcagggggtgaactgcttgacctcctgggcgatattaatcttactggtgcgcccgctgccgcccctgcccccgccagcgtaccccagatctcccaaccgccatttcttttggacggcctgtcatcacagcccctgtttaatgatattgccgctgggattcctagcattactgcttactccaagaatggcttgaagatcgaattcacttttgaaaggtccaatacaaaccctagtgtgacggtaataaccatccaggcaagcaactccactgaactggacatgacagatttcgtgtttcaggctgccgtgcctaaaacatttcagctccaacttctttcaccgagctctagcatcgtgcccgctttcaacaccggcacaatcacacaagtaatcaaggtgctgaatccacagaaacagcaactgagaatgagaataaagctcacttataaccacaaagggtccgccatgcaggacctggcggaagttaacaactttcctccccaatcatggcagtag

SEQ ID NO: 107299 - DNA, 2478 bp, Artificial Sequence
  Description of Artificial Sequence: Synthetic coding sequence
atgcctgccccaattcggttgcgcgagctgataaggacgatcagaaccgcgcggacccaggcggaagaacgagaaatgattcagaaagaatgcgccgccatccgttcatccttcagagaagaggacaacacttatagatgccggaacgttgcaaaactgttatacatgcatatgttagggtaccccgcacattttggacaactcgaatgtttgaagctgatcgcttcccagaaattcaccgataaacgaatcggttacctgggagcaatgcttctgctggacgagcggcaagatgtacatcttctgatgacaaactgcataaaaaacgaccttaaccacagcacccaatttgtgcagggcctagctctgtgcaccctcggatgtatgggctcgagcgagatgtgccgggatcttgcgggtgaggtagaaaagctgcttaagactagcaattcgtacctgaggaagaaggcggccctgtgcgccgtgcatgtcatacgtaaggtgccagaactcatggagatgttcctacccgctacaaagaaccttctaaatgaaaaaaaccatggagtcttgcatacatcagttgtgcttctaacagaaatgtgtgagcggtcccccgacatgttggcacacttccgcaagaacgaaaaattggtgccgcagctcgtgcggatcctgaaaaacctcattatgtctggctactcgccagagcacgatgtatctggtatttccgacccatttctgcaggttcgtattctccggcttctgaggattctcgggcgaaatgacgacgatagcagcgaggcaatgaatgacatcctggcccaggttgccacaaatacagaaacatccaagaatgttggcaatgcgatcctttatgagaccgtgctgacaatcatggacattaaatccgaatcaggcctaagggtgctggcaattaacattttgggaaggtttttactgaacaacgataagaatatccgctatgtggctttaacaagcctgttaaagacagtgcagactgaccacaacgctgtacagcgacaccgctctaccattgtggactgcctgaaagacttagatgtctccatcaaacggagggccatggagctttcatttgctctggtcaatggaaacaatataagaggtatgatgaaggaattgctgtattttctggacagttgtgaacctgagttcaaagctgattgtgcatctggtattttccttgccgctgaaaaatacgccccctccaaaaggtggcatatcgacacaattatgagggtgctgacgaccgctggctcttacgtgagagacgatgctgtgccgaacttaatccagctgatcacaaacagcgtggaaatgcacgcatacacagtgcaacggctgtataaagccatcctgggcgattattcccaacagcccttggtgcaggttgccgcatggtgtatcggcgaatacggggatctcctggtatcaggccagtgtgaggaggaagaaccgatccaggtgactgaggatgaggttctcgacatactagaatccgtcttgatctccaatatgagtacaagcgtaacacgcggatacgcactgactgcaatcatgaaactgagcacacggttcacctgtacagtgaacagaatcaaaaaagtggtgagtatatacggcagcagcatagatgtggaactgcaacagcgcgctgtcgaatacaacgcattattcaaaaagtatgatcacatgcggtcagcccttcttgagcgtatgcctgtgatggagaaggtgacaacaaacggcccgacagagatcgtacagacaaacggagaaaccgaaccagcgcccctggagacaaagcctcctccttccggcccccaaccaacatcccaggccaacgatctccttgatctgttgggcggaaacgatataaccccagtgatacccacagcacctaccagcaaaccatcttcggccggaggcgagctcttggacctcttgggtgacattaacctcacaggagcacctgccgccgctccagcccctgcatccgtgccgcaaatctcccagccgcctttcctgctggatggcctgagttctcaacccctcttcaatgacatcgccgcagggatcccctcaataactgcatactccaagaatggcctcaagatcgagttcacctttgagcgctcaaacacaaacccatccgttacggtaatcacgatccaggcctccaattctaccgagctcgacatgaccgattttgtcttccaggcagctgttccgaagacctttcagctccagctcttatcaccatcctccagcatcgtgccggcttttaacacaggaaccattacacaagtgatcaaagtgttgaatcctcagaaacagcagttgaggatgcgtatcaagcttacatataatcacaaaggatccgcaatgcaggatctggccgaagtcaataactttcccccgcaaagctggcagtag

SEQ ID NO: 107300 - DNA, 2478 bp, Artificial Sequence
  Description of Artificial Sequence: Synthetic coding sequence
atgcctgctccaatcaggctaagggagttaatcaggacaattcggacagctagaactcaggcagaggaaagagagatgatccaaaaggagtgcgcagcaatcagatccagcttccgggaagaagacaacacctacagatgtaggaatgtggccaaacttttatacatgcatatgctgggatatcccgcccactttgggcaactggagtgtctcaaacttatcgcttcccagaagttcacagacaaaagaatcggttatctgggagctatgctcctgttggacgagcggcaggatgtgcacttgttgatgacaaattgcatcaagaatgacttgaaccacagcacccaattcgtgcagggattggcactgtgcacacttggatgcatgggttcctccgagatgtgtcgagacctggcaggtgaggtggagaagctgctgaaaacctccaactcatacttacgtaagaaggccgccctgtgcgccgtgcatgtgatcaggaaagtccccgagctaatggaaatgttccttcctgcaaccaagaacctgctgaatgaaaagaatcacggagtcttgcatacgagtgtggtcctactcaccgaaatgtgcgaacgctcccctgacatgttggctcacttccgaaaggaaagtaaattggttccccagcttgtccggatattgaaaaacctgataatgtccggatattcgccagaacacgatgtctctgggattagtgatccttttctgcaggtgagaatcctccggctcctgagaatcctgggtaggaatgatgacgattcaagtgaggcaatgaacgacatcttggcacaggttgccaccaacactgagacttccaaaaacgtaggcaatgcaatactgtacgagactgtgctgacaataatggacatcaagtccgaaagcggtctcagagttctcgccatcaacatactgggccggttcctgctgaacaatgacaagaatattcggtatgtcgcacttactagcctgctgaaaaccgtccagaccgatcacaatgccgtgcagagacatcgctcaacaatcgtcgactgcctgaaggacttggacgtgtctataaagcgaagggcaatggaattatcatttgccctggttaacggaaacaatatccgcgggatgatgaaagagcttttatattttcttgatagctgtgaaccagagtttaaagctgactgcgcgtcggggatcttcctggcggcagagaagtacgctccctcgaaacgctggcacatcgacacaattatgcgcgtgctcacgactgccggcagctacgtccgggatgacgccgtgccaaacctcatccagttaatcacaaattccgtagaaatgcacgcctacacagtgcaacgcctgtataaggcgatcttgggggactacagccagcaacccctcgtgcaggtggcggcttggtgcattggagagtacggggatttgttagtcagcggacagtgcgaggaagaggaaccaattcaggtgacagaagacgaagttctggacattttggaaagcgtgctaatctcaaacatgagcacgtctgtgaccagaggatatgctctgacggccatcatgaagctgtctactagatttacctgcacagtcaataggatcaagaaggtcgtgtctatttatggaagcagtatagacgtggaactgcagcaaagggccgtggaatacaatgccctctttaaaaaatatgaccacatgagatcagctttgctggagaggatgcccgtcatggagaaagtcaccactaatgggcccacagagattgttcagaccaatggcgagacagagcctgcccccttggaaactaaacctcctccctctggtccccaaccgacatcccaggcaaatgatctgcttgatctgctcggtgggaacgacatcacacccgtcatcccaacagctccaacttcaaagccttcatctgcagggggcgaattactcgacttactgggagatataaatctcactggcgcccccgccgccgctcccgccccagccagcgtcccgcaaatcagccagccacccttcctgctcgatgggttgagcagtcaacctctatttaacgatatagctgccggcattccgagcattactgcctactcaaaaaacggattgaaaattgagtttacattcgaacggagcaatactaacccctccgtgaccgtaattaccatccaagcatccaattctaccgagctcgacatgacggactttgtgtttcaggccgctgtcccaaagacattccaactgcaattactttccccatccagcagcatcgtccctgcctttaacactggaacaataacgcaggtcataaaagttcttaatccccagaaacagcagttgaggatgcgaattaagctgacctataaccacaaagggagtgccatgcaggacctggctgaggttaacaacttccctccacagtcctggcagtag

SEQ ID NO: 107301 - DNA, 1698 bp, Artificial Sequence
  Description of Artificial Sequence: Synthetic coding sequence
atgtttgggagctgctgccactgctgtagaagacctcgaagttgctggttccatagcagatttcgagcagtttccggtgtccaatcacaagccgtgggcgtggagaaaaggagacagcgatcatgggcccggcgaggcagggaaccgcagggcttgttgagattattggagggacgaccccggggattggggcccggcggctccgcaagaaggggagtgccttgttgcggagtggcccccccgcgcatgcccgcacccatccgcttacgtgagctcattcgaaccatccggacagcaagaactcaagccgaggaacgggaaatgatacagaaggaatgcgccgctattcgttccagctttagggaggaggacaatacctaccggtgtcgaaatgtggcaaagttattatacatgcacatgttagggtacccagcccacttcgggcaactagaatgtcttaaactgattgcctctcagaaattcaccgataagcgcataggctacttaggcgccatgttactgctcgacgagcgccaggacgtgcacctgttgatgaccaactgcatcaaaaatgatctaaaccactccacacagttcgtgcaggggctagctctatgtaccttgggatgtatgggatcttcagaaatgtgccgcgatcttgccggggaggtggaaaaactgctcaagacttccaactcttacctgaggaagaaagcagccctgtgcgctgttcatgtaatccggaaagtgcccgagctgatggaaatgtttcttcccgccacaaagaacctcctcaatgaaaaaaatcatggagtgctccacacatctgtggtcctgttgactgaaatgtgtgagagatctccggatatgttggctcactttcggaaagaatcgaaactggtcccacagctggtgcgaattctaaagaatcttatcatgtcaggttacagtccagagcacgacgtgtcagggatatccgatccatttctccaggtccggatcctgaggctgctgaggatactaggtaggaatgatgacgacagtagcgaagccatgaatgacatcctcgcccaggttgcaaccaacacagagacgtctaaaaacgtggggaatgcaattctctacgagaccgtgctcaccattatggacatcaaatctgaatccggcctgcgggttctagctatcaatattctgggacggtttctactaaacaatgacaagaacataaggtacgtggccctgacaagcctcctgaaaacagtccaaacagatcataatgcagttcagagacaccgttccaccatcgtcgactgcttgaaagacctggacgtttccataaagagaagggctatggaactgagctttgcgttggttaatgggaataatatccgaggcatgatgaaggaactgctttattttctagactcatgcgagcctgagttcaaggcggactgcgccagcggtatcttcttagctgcggagaaatacgctccctcgaagcgctggcacattgacactataatgagagtactgacaacagcaggaagttacgtgcgcgacgacgccgttcctaacctcattcagcttattacaaattctgtggaaatgcacgcctatacagtgcagaggttgtataaggcaatcttgggcgattatagccctaccttcggcacgagcggctgtatggtgtaccgctag

SEQ ID NO: 107302 - DNA, 2538 bp, Artificial Sequence
  Description of Artificial Sequence: Synthetic coding sequence
atggaaaagaatatcaatctgagaaactgtcagaccctgaatacatatgtgatgctcacccacctcaggatgccagcacctatcaggctacgagagctgattcgcacaatcagaacagccaggacgcaggccgaggagcgtgagatgatccaaaaggagtgcgccgccattagatcatctttcagagaagaggataacacatacagatgccgaaacgtcgcaaagctcctctatatgcatatgttgggctatccagcgcattttggacaattggagtgcctcaaattgatcgccagtcagaagttcacagacaagcgcattggatacctgggggccatgctactgctcgacgaaaggcaggatgtccatctgttgatgactaattgcattaagaacgatttgaatcacagcacacagtttgtgcagggcctggctctgtgtaccctcggctgtatggggtcaagcgagatgtgccgggatctagcaggtgaagtcgaaaagctgttaaaaacgtccaactcatacctccgaaagaaagcagctctatgtgccgtccatgtaattcgtaaagtgcccgagctgatggagatgtttttgcccgccactaaaaacctcctgaatgaaaagaaccatggcgtgctgcacacttcagtcgttctcttgacagagatgtgcgagcggtccccagatatgcttgcccacttcagaaagttggtgccacagctggttaggatcttaaagaatctaataatgagcggttattcacccgaacacgacgtcagcggcattagcgacccatttctccaggtccggatccttaggctgctgagaatactggggagaaatgatgatgatagtagtgaagccatgaatgatatcttggcgcaggttgccactaacaccgagacctcaaagaatgtggggaatgcaattctctatgaaactgtgctgactatcatggacattaaaagtgaatccgggctgagggtgctggcaattaatatccttgggagattcctactgaacaacgacaagaatatacggtacgtggcactcacatctttgctcaagaccgtacaaacagaccacaatgctgtgcagagacaccggtccacaatcgttgactgcctgaaagatctggacgtcagcattaagcggagagcaatggaattgtcatttgccctcgttaatggcaataacatccgtggaatgatgaaagaacttctgtactttctggacagttgcgaacccgaatttaaggcggactgcgccagtggaatttttctggccgctgagaagtacgctccgtccaagcgatggcacattgacaccattatgcgcgtcctcaccactgcagggtcttatgttcgggacgatgccgtacctaaccttatccagctcattaccaatagcgtcgagatgcatgcctacaccgtccagcgcctgtacaaggccattctgggggactatagccagcagcctctcgtgcaggttgctgcctggtgtatcggtgaatacggagatcttttagtctcagggcagtgcgaagaggaggaacccattcaagtgacagaggacgaggtgctggacattttagaaagcgtcttaatctctaacatgtctacttctgttaccaggggctacgctctgactgccatcatgaaactatcaactcggtttacctgcacagttaatagaattaaaaaagtggtgtcaatttacggcagctcaattgatgtcgaactgcaacagcgagccgtggaatacaatgctttgttcaaaaagtacgaccacatgaggagtgctctgttggagcggatgccagtgatggagaaagtcacgacaaacgggccaactgagattgtccagactaatggagaaacggaaccggctcccttagaaactaagccgccaccctccggcccccaacctacatcacaggctaatgacctcctggacctgctaggggggaatgacattaccccagtgattcccaccgccccgaccagtaagccttccagcgccggcggtgagctgcttgatctactgggggatatcaatctgactggtgcacctgctgccgcccctgccccagcaagtgtgccccagatctcacagcctccattcctgttggatggcctgagcagtcagcccttattcaatgacattgccgctggaatcccgagcattaccgcttatagcaaaaatggcctgaagatagaatttactttcgagcggtcaaacaccaacccttctgtcaccgtgattacaatacaggccagtaactccacagagctcgatatgacggattttgtgtttcaagctgcagtgcctaagacttttcagctccaactgctgtcaccttcctcctcaattgtgcctgcatttaatacaggaacaataacgcaggttataaaagtgttgaacccccagaagcagcagctccgaatgagaattaagctgacatataaccacaaggggagcgctatgcaagacctcgcagaggtcaacaatttccctccacagagctggcaatag

SEQ ID NO: 107303 - DNA, 531 bp, Artificial Sequence
  Description of Artificial Sequence: Synthetic coding sequence
atgccagctcctatcaggcttagagaattgatcaggacaatcaggaccgcacgaacccaggctgaagaacgggaaatgatccagaaggaatgcgccgctattcgatcctcgttcagggaggaagacaacacgtatcgatgtcgaaacgtggcaaaactcctgtacatgcacatgctcggctacccggcacatttcgggcagctggaatgcctcaagttaattgccagccagaagtttaccgacaagagaattggctatctcggcgccatgctcctgctggatgagcgacaggacgtgcatctgctcatgacaaattgcattaaaaatgacctgaatcactcaacccagtttgtgcaaggcctcgcattatgcactttgggatgcatgggaagttccgagatgtgcagggacctcgcgggggaggtggaaaaactgctgaagacctctaactcttacctgcggaagaaggagatgatttacaagcaaacaaatgtcacaggttacatactgggcggcattcccaattcatag

SEQ ID NO: 107304 - DNA, 1047 bp, Artificial Sequence
  Description of Artificial Sequence: Synthetic coding sequence
atgaaagacaagatgtgtcgagacctggcgggagaggtagagaagctgctgaagacctctaactcatacctgcgcaaaaaagccgccctttgtgccgtgcacgtaattaggaaagtgcctgaactgatggagatgttcttgcctgccacaaaaaaccttctgaacgaaaaaaaccacggggtgctgcacacttccgtagtgctgctaactgagatgtgcgagcggtccccggacatgctggcccattttcggaagctcgttccccaattggttaggattttgaagaatctaatcatgagtgggtactccccagagcacgatgtgtctggcatttccgacccattcctccaggtgaggatcctgcgactgctgaggatcttgggtaggaatgatgatgatagctccgaggccatgaacgatatcttggctcaagttgctactaataccgagaccagcaagaatgtgggaaatgctatcctttacgaaaccgtgctcacaattatggatatcaagagcgaatcgggactgcgggtgctggctataaatattctcgggaggttccttcttaacaacgacaaaaatatcaggtatgttgccctaacttccttgttgaagacggtccagacagatcacaacgccgtacagagacacagaagcaccattgtggattgtctgaaggaccttgatgtatctattaagagaagagccatggagttgtcctttgctctggtgaatggaaacaatatccgtggaatgatgaaggaactactttacttcctagactcctgcgagcccgagttcaaggcagactgtgcgagcggcatcttcctcgcagcagtgccgaagaccttccagctgcaactcctgtcccctagctcctcgattgtacctgcctttaacactggcacgatcacgcaggtgatcaaggtgcttaaccctcagaaacagcagttgaggatgagaattaaactgacctacaatcacaaaggatcggccatgcaggacctcgccgaagttaacaatttccctccccagagctggcagtag

SEQ ID NO: 107305 - DNA, 1272 bp, Artificial Sequence
  Description of Artificial Sequence: Synthetic coding sequence
atgtccgcctcagccgtgtacgttcttgacctgaagggtaaggtgcttatttgtcgtaactatagaggcgacgttgatatgagcgaagtggaacattttatgcccattttgatggaaaaggaggaggagggcatgctttcaccaatcctcgcccacggaggggtacggttcatgtggattaagcacaacaatctgtatctcgtagcgacctctaaaaagaacgcatgcgtttcactggtgttttcttttctctacaaggtagtgcaggttttttctgaatattttaaggaacttgaggaagaaagtattagggacaactttgtcattatctatgagttacttgacgaacttatggacttcggatatccacaaacgactgactctaagattctccaggaatacattacccaggaggggcacaaactcgaaacaggagctccccggccaccggcaactgtgactaatgctgtttcctggcgcagtgagggaatcaagtaccggaaaaacgaggtgttcctggatgtgatcgagtccgtgaacctccttgtgtccgccaacgggaacgtgcttcgctcagaaatcgttggctcaattaaaatgcgggtctttcttagcggtatgccagaattacggctgggactgaatgataaagtgctgtttgacaacactggacgcgggaagtctaaatccgtcgagttagaggatgttaaattccatcagtgtgtgaggctgtctcgttttgagaacgacagaacaatatcttttatccctcctgacggcgagtttgaactaatgtcttaccggctgaacacacatgtgaagccactgatctggatcgagagtgtgatcgaaaaacactcacatagcaggatcgagtacatgattaaagcgaagtctcagtttaagagaaggtcgactgcaaacaatgtggagatacatatccccgtcccaaacgacgcagatagcccaaagtttaaaacgacggtgggctcagtgaagtgggtccctgagaattccgaaatcgtgtggagcattaagagtttccccggcggcaaagaatacctgatgcgcgcacatttcgggttaccaagtgttgaggccgaggataaggagggtaagcccccaattagtgtaaaatttgagattccgtactttacaacaagcggcatccaagtccgctacctcaagatcatcgaaaaaagtggctatcaggccctcccctgggtgaggtacatcacccagaatggagattatcagcttcggacccagtag

SEQ ID NO: 107306 - DNA, 1113 bp, Artificial Sequence
  Description of Artificial Sequence: Synthetic coding sequence
atgagcgcatccgcagtttacgttttagatttaaagggcaaagtgctcatttgccgaaactatcgcggcgatgtggatatgagtgaggtggagcacttcatgccaatcttgatggaaaaggaggaggagggtatgctcagtcctattcttgctcatggcggagtgaggtttatgtggataaagcacaacaatctgtaccttgtagccacgtccaaaaagaacgcatgtgtctctttagtgttttctttcctgtataaggtagtgcaagtgttttccgaatattttaaagaattagaggaggagtctatcagagacaattttgtaatcatttatgagctgctcgatgaactaatggacttcggctatccacagacaactgactcaaagatcctccaagaatacataacccaggagggccacaagctggaaacaggtgcacctcggcctcccgccacagttaccaacgccgtgagctggcgttcagaagggattaagtaccgtaaaaacgaggttttcttagatgtcattgaatctgttaacctgctggtgtcagccaacgggaatgtgctgcggtcggaaatcgtgggctcaattaaaatgcgcgtattcctgtccggcatgcccgaactacggttgggcctaaacgataaagtccttttcgacaacactggaagggggaagtcaaagagcgtagaactggaggatgtgaagttccatcaatgcgtccgcttgtcacgattcgaaaatgacaggactatttcgttcatcccgccagatggtgaatttgagctgatgagctaccgtctgaatacgcacgtgaaaccgttaatatggatcgagagcgttatcgagaagcactcccactcccgtatcgagtacatgattaaagggggcaaagagtatctgatgcgagcccacttcggactgccctccgtcgaggcagaggacaaagagggcaaaccacccattagtgtcaaattcgagattccgtattttacaacaagcgggatccaggtgagatacctcaagataattgagaagtccgggtatcaagcgctgccctgggtgcgctacatcacgcagaacggggactatcagttgcggactcagtag

SEQ ID NO: 107307 - DNA, 1308 bp, Artificial Sequence
  Description of Artificial Sequence: Synthetic coding sequence
atgagcgcatctgcagtgtacgtgctggacctgaaagggaaggttctgatctgccgcaattaccggggcgatgttgacatgtccgaagttgaacacttcatgccaatcctcatggagaaagaagaggaaggcatgttgtcccccattctagcgcatggcggagtgaggtttatgtggattaaacataacaatctctacctcgtggccacatcaaagaagaacgcttgcgtgagcctggttttcagcttcttgtataaggtggtccaggtattctctgaatatttcaaggagctggaagaggagtcgatcagagataattttgtcattatctatgagctattggacgagctgatggatttcggctacccccagactactgacagcaagatactgcaggagtacatcacccaggaaggccacaaattagagaccggggcccctaggcctcctgccactgttaccaacgcagtctcatggcgtagcgagggaataaagtacagaaagaatgaagtctttctggatgtgattgagtccgtgaacctgctgggaaaataccccggtgtgggctggctggggcatacagtgagcgccaacggtaacgtgttgcggtccgagattgtgggatcaattaagatgcgtgtcttcctgtcgggtatgcccgaacttcgcctggggctcaatgacaaagtgttgtttgacaacacaggcaggggcaaatcaaagtccgtggagctcgaggatgttaaattccaccaatgcgtaagactgagcagatttgagaacgatagaactatctcctttatcccaccggacggtgaatttgagctgatgtcataccgacttaacacccacgtgaagccactgatctggatcgagtctgtgattgaaaagcactctcatagtaggatcgagtacatgattaaagctaagagccagttcaaaaggcggagcactgctaataatgtcgaaatccacatccccgtgccgaacgatgcagacagtcccaaatttaaaactaccgtcggcagtgttaaatgggtcccagagaatagcgagatagtctggtctatcaaaagtttccccggcgggaaagagtacctgatgcgcgcacacttcggcttgccttcagtggaagccgaggacaaagagggcaagccgccgatctccgtcaaattcgaaataccttacttcaccacatccgggatacaagtgaggtacttgaagataattgagaagtctggataccaggccctgccatgggtgcgctacattactcagaatggcgactatcagctgcggacacagtag

SEQ ID NO: 107308 - DNA, 1056 bp, Artificial Sequence
  Description of Artificial Sequence: Synthetic coding sequence
atgagcgccagcgctgtgtatgttctggacctcaagggtaaagtggtacaagtatttagtgaatattttaaggaattggaagaggagtcaatccgcgataactttgtgattatttacgagcttcttgacgaacttatggactttggctatccgcagacaaccgactctaaaattctgcaagagtacatcacgcaggaaggccacaagttagaaacaggtgccccgagacctcccgccactgtcactaacgctgtttcctggagaagtgagggcattaagtatcggaagaacgaggtgttccttgatgtgattgagtcagtgaacctgctagtgtctgccaacgggaacgttctgaggagcgaaatcgtgggaagcataaaaatgcgcgtctttttgagtggcatgcctgaactccgccttggattgaatgacaaggtgctttttgataacacaggccgtgggaaatcaaagtcagtggagctggaggatgtaaaatttcaccagtgcgtgcgactgtcccgctttgaaaacgacaggaccatctcatttatccctcccgacggagagtttgaactgatgagttataggctcaacacacatgtcaagccactgatttggatcgagagcgtgatcgaaaagcactcccactccagaatcgaatatatgatcaaagccaagtctcagtttaaacgaaggtccactgccaataacgtggagatccacattccggtgccgaatgatgccgacagccctaaattcaagacaaccgttggatctgtcaaatgggtaccagagaactccgaaatagtctggtcaataaaaagcttccccggaggcaaggaatacctgatgcgggcccactttgggctgccatctgtcgaggcggaagacaaagaagggaagcctcccataagtgtcaaattcgagattccttacttcacaacgtcgggtattcaggtgcgctatctaaaaatcattgagaagagcggctaccaggcgctcccgtgggtgaggtatatcacccaaaatggtgattatcaacttcggacccagtag

SEQ ID NO: 107309 - DNA, 1272 bp, Artificial Sequence
  Description of Artificial Sequence: Synthetic coding sequence
atgtccgcctccgcagtgttcattctagatgttaaaggcaaaccactgatctcccggaactacaaaggcgatgttgcgatgagcaagatagagcactttatgccgttgctcgtccagcgggaagaggagggggcacttgcgccccttttatcccacggccaagtccatttcctctggataaaacattcaaatctgtacctggttgcaacaaccagtaaaaacgcgaacgcgtccctagtctacagcttcttatacaagacaatcgaagtgttttgcgagtattttaaggagctcgaagaagaatccatccgtgacaacttcgttattgtttatgagctactggacgagctcatggactttgggttcccacaaaccactgactcgaaaatccttcaggaatacattacccagcagtctaataagctcgagacagggaaatctcgtgtgcctccgaccgtgacaaacgcagtgagttggcgaagtgagggcatcaaatacaagaaaaacgaggtatttatcgatgttattgagtctgttaacctgctggtgaatgcaaacggaagtgtgctgctgagtgagatagtgggcacaatcaagctgaaggtgtttctgtctggcatgcctgaactccgtctggggctgaatgatcgagtactctttgaactgacgggtcgctctaaaaacaaatctgtagaactggaggatgtcaaatttcatcagtgtgtacgcctgtcacgcttcgacaacgataggacaatctccttcatccctccggacggcgacttcgagctgatgtcataccggctatcgactcaagtgaagccccttatctggattgagtcagtcattgaaaaattctcacactctcgcgtggagatcatggtgaaggccaaaggccaattcaaaaaacagagcgtagcgaacggcgtggagatctcagtccccgtgcctagcgacgccgacagtccccgcttcaagacctccgtcggtagcgccaagtatgttccagagcgcaatgtcgtcatctggtccatcaagtcatttcccggcggcaaagagtaccttatgcgtgctcattttggccttccctccgtggaaaaggaagaggtagaagggcggcctcctatcggagttaaattcgagatcccgtatttcacggtgagtggcatacaggttagatatatgaaaattatagaaaagagcgggtaccaagctctaccttgggttcggtatatcacccaaagtggggattatcagctgcggacaagttag

SEQ ID NO: 107310 - DNA, 477 bp, Artificial Sequence
  Description of Artificial Sequence: Synthetic coding sequence
atgatgaggtttatgctccttttttctcgccagggaaaattgagactgcagaaatggtaccttgccacttcagataaagagcggaaaaaaatggtgagggaactgatgcaggttgtcctagcccgtaaacccaagatgtgctccttcctcgaatggagagacctgaaggtggtgtacaaaagatacgcaagcctgtacttctgctgtgccatcgagggccaggataacgaactcatcaccttagagttgatccacaggtatgtagagctgttagataagtacttcgggtctgtatgcgagctcgacattatatttaatttcgagaaggcctatttcatcctggacgaatttctgatgggaggcgacgtccaggatacttctaaaaagtcggtgctgaaagcaatcgagcaagccgaccttctccaggaagaagatgagagcccaagatctgtactggaagagatggggctagcctag

SEQ ID NO: 107311 - DNA, 477 bp, Artificial Sequence
  Description of Artificial Sequence: Synthetic coding sequence
atgatgagatttatgctactgttctctaggcaaggcaaactgcgcttgcaaaagtggtacctggcaacctccgacaaagagcggaagaaaatggtaagagaactcatgcaggtagtactggctcgcaagcctaaaatgtgtagctttttggaatggcgggacctgaaggtagtctataaacggtatgcttcactgtatttttgctgtgctatcgagggacaagacaatgagttgattaccctcgaactcattcaccgatacgtcgagctgctggataagtactttggtagtgtttgtgagctggacatcatctttaacttcgaaaaagcttattttatcctggacgaatttctgatgggcggggacgtgcaagacacctctaagaaatctgttctcaaggcaatcgagcaggcagacttgttgcaggaggaagacgaatctccacgctctgtgctggaggaaatgggattggcatag

SEQ ID NO: 107312 - DNA, 474 bp, Artificial Sequence
  Description of Artificial Sequence: Synthetic coding sequence
atgcagtttatgctactgttctcacggcaggggaaattgagactgcagaaatggtatgtgcccctctccgacaaggagaagaagaagattacacgagagctggtgcaaaccgtgctggcacggaagccaaagatgtgctctttcctagagtggcgtgacttaaaaatagtctacaaaagatacgcatctttgtatttctgctgcgccattgaagatcaggataatgagctcatcacgctggagattattcacagatatgtggagctgctggacaaatacttcgggtctgtgtgtgaattggacatcatctttaacttcgaaaaagcatatttcattctggacgaatttttactggggggggaggtacaggagaccagcaaaaaaaacgtgctcaaggccatcgaacaggcggacttgctccaagaagaagcagagacccccagatccgtactcgaggagattggcctgacctag

SEQ ID NO: 107313 - DNA, 462 bp, Artificial Sequence
  Description of Artificial Sequence: Synthetic coding sequence
atgctgttattttcacggcagggcaaactgagactgcagaagtggtacgtccccttgagcgataaggagaagaaaaaaatcacaagagagctcgtgcagactgtgctggctcggaaacctaaaatgtgtagttttcttgaatggagggacctgaaaattgtatataagcgctatgcatctctgtatttctgctgtgcaatagaggatcaagataacgaactgattacactggagataattcaccggtatgtcgaactgctggataaatactttggcagtgtctgcgagctggacattatattcaatttcgaaaaagcttactttatccttgatgagtttctccttgggggagaagtccaggagactagcaagaagaatgtgttaaaagctatcgaacaggcagatctgctgcaggaatcacagaatgaagagtggggcggactcagcgaagatatactgtag

SEQ ID NO: 107314 - DNA, 483 bp, Artificial Sequence
  Description of Artificial Sequence: Synthetic coding sequence
atgcaattcatgttactcttttctcgccagggaaagctacgcctacagaagtggtacgttcctttgagtgacaaggagaagaaaaagatcacgcgcgagctggtgcagaccgtgttagccaggaaaccaaaaatgtgctctttcctcgagtggagagacctaaagatcgtgtacaaaagatacgcatccttgtatttctgctgtgctattgaagaccaggataacgagctgataacgctcgagatcatacataggtatgttgaactccttgacaagtactttggctccgtatgcgagctagacatcatttttaacttcgagaaagcttacttcatcttagacgaatttctgctcggaggagaggtgcaagaaacaagcaagaaaaacgtactgaaagcgattgaacaggctgacctgctgcaggaaaagacggagaccatgtatcacagtaaaagctttattggcttcaagaaggcttattag

SEQ ID NO: 107315 - DNA, 609 bp, Artificial Sequence
  Description of Artificial Sequence: Synthetic coding sequence
atgcctgctggatgccctccacatagcaccaccgccagcttacctcaacatggcgataggggcttcccattcgcagcagcagctgctgctggacaggcgcccccccgtcctagacccgctgccgccatgcagtttatgctgctttttagcagacagggcaaactccgacttcaaaagtggtatgtccccctgtctgacaaggaaaaaaaaaagatcacgcgggagctcgtgcagacggtcctggctcgtaagccaaagatgtgctcttttctggagtggagagatttgaaaatcgtctataagcgatacgcaagtctctacttttgctgtgctatagaagaccaggacaatgagctgataacactggagattatacacagatatgtagagctccttgataaatacttcggcagcgtgtgtgagcttgatattatctttaactttgagaaagcatatttcatcttagacgagttcctgctcggaggtgaagtccaagagacctccaaaaagaacgttttaaaggcaatcgagcaggccgatttgctccaggaaaagaccgaaacaatgtaccatagcaaatccttcatcggattcaagaaagcttactag

SEQ ID NO: 107316 - DNA, 441 bp, Artificial Sequence
  Description of Artificial Sequence: Synthetic coding sequence
tgacgacaggggaagcttaggttgcagaaatggtatgtgccactatccgataaggagaagaagaagattactagagagcttgtgcaaacggtgcttgcacgaaagcccaagatgtgctcattcctggagtggcgagatttgaaaatcgtgtataaacgctacgcctctttgtacttctgttgtgcaatcgaggatcaagataacgaactcattacattagaaattattcatcgctatgtcgagctccttgataaatattttggcagcgtctgcgagttggacattatctttaacttcgagaaggcctattttattcttgacgaatttctgctaggaggtgaggtccaagagacaagtaagaagaatgtgttgaaagccattgaacaagctgacctgcttcaggagcctagacacgaatacttcaacgtgcccgtgtactag

SEQ ID NO: 107317 - DNA, 462 bp, Artificial Sequence
  Description of Artificial Sequence: Synthetic coding sequence
taactcctcttctcaagacaaggcaagcttagacttcagaagtggtacgttcctctgtccgacaaagaaaagaaaaaaattactcgcgaactggtgcaaacagtcctggcccgaaagcccaagatgtgcagctttctagagtggagagacctgaagatcgtgtataagagatatgcctccttatacttctgttgtgccatagaggaccaagataacgaactgataacactggaaatcattcaccgctacgtcgaattactggacaaatattttgggagcgtgtgtgaactcgacatcattttcaatttcgagaaggcttactttatcttggatgagttcttattaggcggtgaagttcaggagaccagcaagaagaacgtattaaaagcaattgagcaagctgatcttttgcaggagagtcaaaacgaggagtggggcgggttgtcagaagacatcctgtag

SEQ ID NO: 107318 - DNA, 588 bp, Artificial Sequence
  Description of Artificial Sequence: Synthetic coding sequence
atgcctgccggctgcccaccccactctactacagcttcgctcccccagcatggagacaggggctttccgtttgccgctgccgctgcagccggacaggccccaccccgccccagaccagccgccgctatgcaattcatgttgctttttagtcggcagggtaaattgcggcttcagaaatggtatgttcccttgtccgacaaagagaagaaaaagatcactagagaactggtgcagactgtgctggccaggaagccgaaaatgtgtagcttcttggaatggagggacctcaaaatcgtatacaaacggtacgcctcattgtatttctgttgcgcgatcgaagatcaggataacgagctgattactctggagattattcaccgctacgtggagctcctcgacaaatacttcggcagcgtgtgcgagttagacattatatttaatttcgaaaaggcctatttcatcttggatgagtttctgctcggcggcgaagtccaagagacctcaaagaaaaatgtgctgaaggcaattgaacaggctgacctcttacaggagccacgacacgagtattttaacgttcccgtgtattag

SEQ ID NO: 107319 - DNA, 315 bp, Artificial Sequence
  Description of Artificial Sequence: Synthetic coding sequence
atgattcgcttcattctgattcagaaccgtgccggcaagactaggctggctaaatggtacatgcagtttgacgatgacgagaaacagaagctgatcgaagaggtacatgcggttgtcaccgtcagagacgcaaagcacaccaacttcgttgaagtgctgaacgaatattttcataatgtctgtgaactggatttggttttcaatttctacaaggtatacacggtggttgacgagatgtttctggctggggaaataagggagacaagtcagactaaggttctgaaacagctccttatgttacagagcctggagtag

SEQ ID NO: 107320 - DNA, 2868 bp, Artificial Sequence
  Description of Artificial Sequence: Synthetic coding sequence
atgcccgcggtttctaagggcgacggaatgcgtggccttgccgtttttattagcgacatacggaactgcaagagcaaagaggcagagatcaagcgaataaacaaggaattagccaatatccgctcaaagtttaagggagataaggctcttgatggatatagtaagaaaaagtatgtctgtaagttattgttcatctttctgctgggccacgacattgactttggacacatggaagctgtaaacctgctttcctcaaacaaatacaccgagaaacagatcgggtacttgtttatttcagtattggtcaatagtaattccgaactgatccgcttaatcaacaatgctatcaagaacgaccttgcttctcgcaacccgactttcatgtgtctcgcattgcattgcattgcaaacgtgggtagccgcgagatgggtgaggcattcgcggccgatatcccgcgaatcctcgttgcgggcgactctatggactcagtgaagcaaagcgccgccctttgcctgttaagactgtacaaggcctccccagatctcgtacccatgggggagtggactgccagagtggtccacctgctaaacgatcagcacatgggggtagtgactgccgcggtatccttaatcacctgcctttgcaaaaagaatccagatgattttaagacatgtgtctcattggccgtgagtcgcctgtcaaggatagtaagcagtgccagcaccgacctccaggattatacctactattttgtgcctgccccttggctgagcgtgaagctcctgcgcctgctgcagtgttatcctccacctgaagatgccgccgtcaagggccggttggtcgaatgcctggagacagttctcaataaggcccaagagccacctaaatctaaaaaggtacagcactcgaatgccaagaacgctattctctttgaaaccatttctttaattatccactatgactccgagcctaatctgcttgtgagggcctgcaaccaactggggcagttcctgcagcatagggagaccaacttgagataccttgctctggagtctatgtgtaccctcgcatctagtgagttctcacacgaggccgtgaaaactcatatcgacaccgtaatcaatgctctgaaaaccgagcgggatgtttcagtcaggcagagagccgctgacctcctatacgcaatgtgtgacagaagcaacgcaaagcagattgtgagcgagatgctcaggtacctagagacggcagactacgccatcagagaggagattgtgcttaaagtggcgatcttagctgagaagtatgctgtggactattcttggtacgttgacacgattttgaaccttatccggatcgccggcgattatgtcagcgaagaagtgtggtaccgagttctgcaaattgtcactaaccgtgacgatgtgcagggatatgcagcgaaaacggtattcgaagcccttcaggcccctgcctgtcacgaaaacatggtaaaggtgggagggtacatcctgggcgaatttggaaacttgatcgcaggagacccaagatcaagccctcctgtccagttttcactgttgcattcaaagttccatctttgtagcgtggcgacgcgagccctgttgctatctacatacattaaatttattaatctcttccccgaaactaaagctacaattcaaggcgtgttacgcgcgggatcccagctgcgcaatgctgatgtggagctgcagcaaagggcagtggaatacttgacccttagcagcgtggcaagcacagatgtgctggcgactgtactcgaagaaatgcctccctttcccgaacgcgagagcagcattctcgcaaagctcaaaagaaaaaagggtcctggtgcaggtagcgcgcttgacgacgggcgtcgggacccttcctctaatgatatcaatggaggcatggagcctacccctagtacagtctccactcctagtccatccgctgacctgctagggttgagagccgccccacctcctgctgctcctcctgcgtctgcaggagctggtaatctcttggtggacgtgttcgacggtcctgctgcccagccttcattaggaccaactcccgaagaggcattcctaagtcccggccctgaagatatcggacctcctattccagaagcagacgagctgcttaataaattcgtgtgtaaaaacaacggggtactgttcgaaaatcaacttcttcagatcggggtgaagagcgagttcagacagaacctgggtcggatgtatctattttatggaaacaagaccagtgtgcagttccagaacttcagtccaaccgtcgtgcacccaggcgatctgcagacccagttagcggtccagaccaaacgagtggctgcacaggtggacggaggcgcccaagtgcaacaggttctgaatatagaatgcctaagggatttcctcacccctcctcttctgtctgtccgatttaggtatggaggagcccctcaggccctgacactcaagctcccggtcactatcaacaaattttttcagccaaccgagatggctgcccaagactttttccagcgatggaaacaactctcactgcctcagcaggaggcccagaaaatttttaaggccaatcaccccatggacgccgaggttacaaaagccaaacttctgggctttggcagtgctctgctggataacgtcgatcccaacccagaaaactttgtgggagccgggatcatccaaactaaagcattacaggtgggatgcctactgagactggagcctaatgcccaggctcagatgtaccggctgaccctccggacatctaaggagcccgtgagtcgtcacctctgcgagttgcttgcccaacagttctag

SEQ ID NO: 107321 - DNA, 2934 bp, Artificial Sequence
  Description of Artificial Sequence: Synthetic coding sequence
atgccggccgtcagcaaaggcgacggtatgcgcggtcttgccgtgttcattagcgacatcaggaattgtaagtcaaaggaggctgagattaaaaggattaacaaggagctcgccaacatcagatcaaaattcaagggagataaagccctggatggctacagcaagaaaaaatatgtgtgtaaactcctatttatctttcttctagggcatgacatcgacttcggccacatggaggccgtgaatttgctgagcagcaacaagtataccgaaaagcagataggctatctgtttatctcagttctcgttaattccaacagtgagctcattcggctcatcaacaacgccattaaaaacgacctggcttctcgaaatccgactttcatgtgcttagccctccattgcatcgccaatgtgggctcacgcgagatgggggaagcatttgccgctgacattccacgcatccttgtagcaggcgactccatggacagtgtaaaacagagcgccgccttatgtctgcttagattgtataaggcctcccccgatctcgtacctatgggagaatggaccgccagggtcgtccacctgcttaacgaccagcacatgggcgtggtgacagctgccgtgtccctgataacctgtctgtgcaaaaaaaatcccgacgacttcaagacgtgtgtctccctagctgtctcaaggctgtcacgaattgtctccagtgcttccactgatttacaagattacacatactatttcgtgccagcaccatggctgagtgtaaagttgcttaggctgctccagtgctatccacctcccgaagacgctgctgtcaaaggccgtctggtcgagtgcttagagacagtgcttaacaaagcccaagaaccacctaaaagcaaaaaagttcagcattctaacgccaagaacgctattctgtttgagacaatttctcttattatccattatgacagtgaaccgaaccttttagtgcgagcatgcaaccagcttggacagtttctgcagcacagggagactaatttgaggtacctggctctggagtctatgtgcacgctggccagctccgagttctctcacgaagctgtaaaaacacatattgatacggtcattaacgccctcaaaaccgaacgggatgtgtcggttcgacagcgggcggccgatctgctgtatgcaatgtgcgataggtccaacgctaagcagatcgtcagcgaaatgctgcggtatctggagaccgccgactatgccataagagaggaaatagtcctgaaggtggctatcctggctgagaagtacgccgtggattattcgtggtacgttgacacaattttaaacctaatacgcatagccggggactatgtgagcgaagaagtgtggtatagagtattacagatcgtgactaaccgtgatgacgttcagggctatgccgccaagacagtgttcgaggccctacaggcgcctgcctgtcacgaaaacatggtgaaggttggaggttacatcctcggggagttcgggaatctgatagccggggaccctagaagcagcccgccagtgcagttcagtctgctacactccaaattccacctgtgttcagtagccacgcgagcactgcttctgtccacgtacatcaagtttatcaacctattcccggagacaaaggcgactattcaaggtgtactgagagcaggtagccagctgaggaacgctgacgtggaacttcagcagcgcgctgtggaatatctgaccctgtcctcagtagcatcaactgatgtcctggccaccgtcctggaggaaatgccacccttccctgaacgcgaaagctcaatcctcgcgaagctaaaaagaaagaaggggcctggcgccggaagcgctctagacgatggtcgccgcgacccttcttcaaacgatattaacggcggcatggaacccacaccatcgaccgtatcgaccccttcccctagcgccgacctgctcggccttagggctgcgccaccgcctgcagccccccctgccagcgccggtgctggaaacctcctcgttgatgtgtttgatggtcctgccgcccaaccctccctgggtcctactcctgaagaggcattcctttcagagttggaacccccagctcccgaatcccccatggcacttctggccgatcctgcccctgctgctgatccaggacccgaagatattggtcccccaatccctgaagctgacgaactgcttaacaaattcgtttgcaaaaataatggggtgctgttcgagaatcagttgctgcagattggagtgaagtctgagttccgacaaaacttgggccgcatgtacctgttttatggaaacaagaccagcgtacagttccagaatttcagtcctacagttgtgcatccaggggatttgcagactcaattagctgtgcagacaaaaagagttgcagctcaagtcgacgggggggcccaggtgcaacaagttctgaacatcgagtgtctacgcgatttcctcaccccgcctctccttagcgtaagattccgctatgggggggctcctcaagctttaacgctcaagctgcccgtaaccattaacaagttctttcaaccaacagagatggcagctcaggatttctttcagaggtggaagcagctatccctgcctcaacaggaggcacagaagatatttaaggccaaccaccctatggacgccgaagttactaaagccaagctgctgggattcggttcagcgctgctggataacgtcgaccccaaccccgagaatttcgtcggcgcaggaattatacagacgaaagcgctccaggtgggttgcctgctgcggctcgaacccaacgcacaggctcagatgtatagattgaccctgcggacttccaaagaaccagtgtccagacatctgtgtgagctgctcgctcaacagttttag

SEQ ID NO: 107322 - DNA, 1404 bp, Artificial Sequence
  Description of Artificial Sequence: Synthetic coding sequence
atgggattagctttgcactgcatagcctctgtggggtcccgggagatggctgaagcgttcgccggtgagatcccaaaagtcctggttgctggggacacgatggacagcgtaaaacaatccgccgccctgtgcctgctgagactgtatcgaacctcccccgatttggtgccaatgggtgattggacatctagagttgtccatctgttgaatgatcagcatttgggtgttgtgactgctgcaacaagtctcatcacgaccctggcacaaaagaacccagaggagttcaaaacgagtgtctccctggccgtcagcagactgagtagaatcgttaccagcgccagcactgaccttcaggattacacctactacttcgtccctgcgccctggctaagcgtgaagcttttgagattgctccagtgttaccccccaccagatccggcggtcagggggagactgactgaatgcctggagacaatcctcaacaaggcccaggagccacccaagagtaagaaagtccaacactctaatgcaaaaaacgccgttctattcgaagcaatttccctgatcattcaccatgatagcgagcctaatctgttggttagggcttgtaaccagcttggacagttcctgcagcacagggaaacgaatctccgatatctcgcattggagtccatgtgtaccctggcctcatcagaatttagtcatgaagcagtcaagacccatattgagaccgtgattaacgctctgaaaaccgagcgggacgtgtcagtcctgcctcccacacccccgaggagcctgtgggaacagcagtgtcactgtgcttggagaggactctcactgggagtctggccgagctggtggctgcatacctggcgaaggcctggccccctgggcggggcccaactgactttagtcctactgcagagccagttggactgcttcccaaggcaggattttaacctggaattccgtaatatatgtatttgtaatgacttctggcagaagcacgtgagctggccggatgtcactgtcctgctgtctcaattgttgttcgttaagggcgtttgctacgcccctgccgtggctgaagcactggacgtccagcctggagaggagcgtccggccggccccgcagggccacccggcctccaaggtaaggtttgggccggcggggcacgcctgagaggtgttcttgtgagcttcctctcagaatgggctagtcccggccacggcgccggactttccccttctactgggcccgtgcagtctagcctcgagggattgtggcggcgtgacgcatccgtgtggtccgggtccgagggcgcaataggtcgtatgccctgtgcaacttgcggcctgtgtctgacatgtcacttggactcagcccctagactgcacgtttag

SEQ ID NO: 107323 - DNA, 2823 bp, Artificial Sequence
  Description of Artificial Sequence: Synthetic coding sequence
atgcccgctgtaagcaagggggacgggatgaggggcctcgcggtcttcatcagcgacatccgaaactgcaaaagcaaggaggcagagatcaagagaattaacaaggaactggccaacatccggtcaaagttcaaaggcgacaaagccctcgatgggtactcaaaaaaaaaatacgtgtgcaaactcctgtttatctttctgctcggacacgatattgatttcgggcacatggaggcggtcaatttgctcagctcaaaccgatacaccgaaaagcaaattggctatctctttatatctgttctcgtgaactccaactccgagctcatccgcctcatcaataatgcgataaagaacgatctcgcatcaagaaatccaacatttatgggcctggccctccattgcatcgcctctgtgggctctcgtgaaatggccgaggcctttgctggagagatcccaaaagtgctggtcgcaggcgacactatggattcagtgaaacaaagcgcagctctctgtctgttgagactctaccggacctcccctgaccttgttccgatgggggactggacctccagagtcgtacaccttcttaacgatcagcacctgggggtggttactgcggccacctctctcattactacacttgcacagaaaaatccggaggagttcaagactagtgtcagcctggccgtctcccgcctgtcacgcattgtgacctccgcatctaccgacctacaggactatacttattattttgtgccggctccttggttgtctgtcaagctcttgaggctgttgcagtgctaccctccccctgaggaccccgccgtacgtggtcgattgactgaatgcttagaaacaatcttgaacaaggcgcaggagcctcctaagtccaaaaaggtacagcactcaaacgccaagaatgctgtcctcttcgaagctataagccttattatccaccacgacagcgagcccaatctgttggtcagagcttgtaaccagctagggcagtttctgcagcaccgggagaccaacctgcgttacttggctctggagagcatgtgcaccctggcctccagcgaattcagtcacgaagccgtgaagacccatattgagaccgtcatcaacgctctgaaaacagaaagagacgtatcagtgcgccagcgggcagtggacctcctgtatgccatgtgtgaccggtccaatgccccccagattgtggcggagatgctgtcctacctggagactgccgattactcgattcgcgaagagatcgtcctgaaggtagccattcttgcagagaaatatgccgtcgactatacttggtatgtcgatactatacttaaccttattcgaattgcaggcgattatgttagtgaagaggtttggtaccgggtcatccagatagttatcaatcgcgatgatgtgcagggttacgcagcaaaaaccgtgttcgaggccctgcaggcacctgcctgtcatgaaaatctagtaaaggtgggagggtacatcctaggagagttcggcaacctaattgctggcgacccacggtcctcccccctgatccaatttcacttactacactctaagttccacctgtgtagcgttcccacccgagccctgcttctaagtacttacattaagttcgtgaacttattccccgaagtaaagcccacaattcaggacgtcttgcgctcagacagtcaattgcgcaatgccgatgttgagttgcaacagcgtgccgttgaatatctgagactgagcactgtcgctagtactgacattttagcaacagtccttgaggagatgcctcctttccccgaacgggagtcttctatactcgcaaagttgaagaaaaagaagggccctagtacagttacagacttggaggacaccaaaagggatcgaagtgtggacgtgaatggaggacctgagccagccccagcgagcacatcggccgtctccacgccatcaccatctgccgatctgctcgggctcggggccgccccccctgctcctgcaggccctccgcctagttctggcggatccggtctgctcgtggacgtattcagcgatagcgcttctgttgtggcacctctggctcctggatccgaggacaattttgctcgattcgtgtgcaagaataacggcgtgctatttgagaaccagctgctgcaaattgggttgaaaagcgagttcaggcagaatttgggaaggatgtttattttctatggaaacaaaaccagtactcagttcctgaattttaccccaaccttaatatgtagtgacgacctacagccaaatctaaacttacagactaaacctgttgacccaaccgtggaaggaggagcccaagttcagcaggtggttaatattgaatgcgtgagcgacttcactgaagctcctgtgttgaacattcaatttcgctacggcggcactttccaaaatgtgtccgtgcagcttccaattaccctgaacaaattcttccagcccaccgagatggcttcccaggatttctttcagaggtggaaacagttgtctaacccccagcaggaagtgcaaaacatctttaaagcaaagcacccaatggacactgaagtaactaaagcaaagattatcggctttgggtccgctcttctggaagaggtggacccaaatccggccaatttcgtaggggctggcattatccacacaaaaactacccagatagggtgcctgctcagactcgagccgaacttacaggcccagatgtaccgcttaacactgcgaacctcaaaggaggccgtgtctcaaagactctgcgaactgttatcggctcagttttag

SEQ ID NO: 107324 - DNA, 1062 bp, Artificial Sequence
  Description of Artificial Sequence: Synthetic coding sequence
atgcctgcagtgtccaagggagatgggatgaggggtttagctgtcttcatttccgatattcgcaactgcaaatccaaagaagccgaaatcaaacgcataaacaaggagctggccaacattcggtccaaattcaagggtgacaaggctctagatggatacagcaaaaagaaatatgtgtgtaagctgctgtttatctttctgctagggcatgatatcgattttggacacatggaggccgtgaatcttttaagtagcaataggtatacagaaaaacagattgggtacctctttataagcgtactggtgaattctaattccgaattgatcagactcataaacaatgcaataaaaaacgacctcgccagtcgcaatcccaccttcatgggccttgctttgcattgtatagcgagtgtgggatcaagggaaatggcagaggccttcgccggagaaattccaaaggtgttagttgccggagatacaatggatagtgtcaagcagtccgccgctctgtgtctgctgcgcttgtatagaacgtcaccggatttggtgcctatgggtgattggacatcccgcgtcgtgcacctgttgaatgaccagcacctgggagtcgtgactgcggctacctccttgataaccaccttggctcaaaaaaaccctgaggagtttaaaacaagtgtaagcttagcagtgagccgcctgtccaggatcgttactagcgcatctactgacctccaggactacacttattactttgtgccggctccctggttgtctgtgaagctcttgagactgctgcaatgctacccccccccagatccagccgtgcgcggcaggctaaccgaatgtctggagaccattctcaacaaagcacaggaaccccccaaaagtaagaaggttcagcatagcaacgcgaaaaatgctgtcttattcgaggctatcagcctgatcatccaccacgatcgagagccaaatctccaggctcagatgtaccgtctgaccctgcgcacatcaaaggaagccgtgagccagcgcctgtgcgagcttctgtctgcacagttttag

SEQ ID NO: 107325 - DNA, 1971 bp, Artificial Sequence
  Description of Artificial Sequence: Synthetic coding sequence
atgcctgccgtttctaagggagacggcatgagagggctcgcagtcttcatctccgatatcagaaattgtaaatctaaggaggcagagatcaaacgcattaacaaagagctggctaatatacgcagcaaattcaaaggggacaaagcccttgatggatattcgaagaagaaatacgtctgcaaacttctgttcattttccttttaggacacgacatcgatttcggacacatggaggcggtgaatctgctttcgtccaacaggtatacagagaaacagatcggatacctattcatctcagtcctcgttaattcaaattcagagctaattagactgatcaacaatgcaatcaagaacgatctggctagccgtaacccgacctttatgggcctcgcactccactgcatcgcatccgtgggttccagggagatggccgaagctttcgccggtgaaattccaaaagtgcttgtggccggggacaccatggatagcgtcaagcagtccgccgctctctgtctgttgaggttgtaccgcacgagccccgaccttgtgccaatgggtgactggaccagccgcgtggtgcacctcctgaatgatcagcacctaggcgttgtgacagccgcaacatctctgatcaccacacttgcccagaagaatcctgaggaatttaaaaccagtgtgagtctagccgtcagtcgtcttagtaggattgttaccagtgctagtaccgacctccaggactacacctactattttgtgccagccccatggctaagtgtcaagctgctgcgcttgctgcagtgctatccccctcctgaggatccggccgtccgtggacgtctgaccgagtgcctagagactatcttgaataaggcgcaggaacctcctaagtccaagaaagtgcagcattcaaacgcaaagaacgcggtgttgttcgaagctatcagtctgatcatccaccacgactccgaaccgaacctgctcgtccgtgcatgcaatcagctcggacagtttctccagcatcgcgaaacgaatctgagatatctggcactggagagcatgtgcaccctcgcgagcagcgagttcagccacgaagcggttaaaactcatattgagaccgtcataaacgccctcaaaaccgagagggacgtctccgtccgccagcgggccgtagacctgctctacgccatgtgcgaccggagcaacgcgcctcagattgtggcggaaatgttgtcctatcttgaaaccgccgactacagtattcgagaggagattgtcctcaaggtggcaattttagccgaaaagtatgccgtggactatacatggtacgtagacacaatcctgaacctgattagaatcgccggtgattacgtgtcagaggaagtgtggtatcgcgttattcagatcgtgatcaatcgagatgacgtgcaaggttatgctgctaagaccgtgtttgaagccctgcaggcccctgcatgtcatgagaacctggtcaaggtgggaggttatatcctaggcgagttcggaaatctaatcgccggcgatccccggtcctccccccttattcagttccacctccttcacagcaaattccacctgtgctcagtgccaacacgagctctgttgctaagcacgtatattaagtttgtgaatctcttcccggaagtcaaacccaccatccaggacgtcctgaggtctgactctcagttgagaaacgctgacgtggagcttcagcagagagccgttgagtacctgcgcctgtccacagtggcgtcaaccgacatcttggcaactgttctcgaagagatgcctccattccccgaacgcgagagctcaatactcgctaagctaaagaaaaagaaaggtcccagcaccgtcacagatttagaagataccaagagggatagatctgtagacgtgaatggtgggcctgagccagcaccagcctcgacttctgccgttctctgcttgtag

SEQ ID NO: 107326 - DNA, 2820 bp, Artificial Sequence
  Description of Artificial Sequence: Synthetic coding sequence
atgccagctgtgagcaagggggatggcatgcgcggattggccgtattcattagtgacataagaaattgtaaatccaaagaagcagaaattaaaagaatcaacaaggagctggcgaatatcagatctaagttcaaaggcgacaaggcactggatggctattccaaaaaaaaatatgtatgcaagttacttttcatttttttgttaggacacgatatagactttggccatatggaggctgtgaatttactctcctctaaccgatacactgagaaacaaatcggctacctgtttattagtgtgctcgtgaactctaattccgagcttatccggctgattaataacgccatcaagaacgacctcgcttctcggaaccctacttttatgggattagccctgcactgtatagcttccgtgggatcccgggaaatggctgaagccttcgccggcgaaataccaaaggtgctggtggctggtgacaccatggattcagtgaagcagagcgccgccttgtgcctgttgagactctatcgcacatctcctgaccttgtgccaatgggagattggacgagccgcgtggttcacctcctcaatgaccagcacctcggggtagttacagcagctactagtctaatcacgacactggcacagaagaatcctgaggaatttaaaacatccgtctccctggctgtatcacggctgtcgcgaattgtcaccagcgcctctaccgatctgcaggattacacttattatttcgttccagctccttggttgtccgtaaagctgctacgtctgctccagtgctacccgccacctgaccctgccgttagagggcggctgaccgagtgcctcgagactattctcaacaaagcacaagagcccccaaaatccaaaaaagtccagcactcaaacgcaaaaaatgccgttctgttcgaggcgatcagcttgataatccatcacgactcagagccaaatcttctagtcagagcctgtaaccagctcgggcagttcctgcagcaccgggaaacaaacttgcgctatctcgctctcgagtccatgtgtacgctcgcttcctccgagtttagccacgaggctgtgaagacccatatcgaaactgtaatcaatgcgttgaagacagagcgcgatgtgagcgtccggcagcgggcagtggatctgctgtatgcgatgtgcgacaggtccaacgctccacagattgttgctgaaatgctgtcctacctcgagacagctgattattctatccgggaggagatcgtcctgaaggtggctattctggccgagaagtacgccgtagattatacttggtacgtggatactattttgaatcttatccgaatcgcaggagattacgtgagcgaagaggtgtggtatcgtgtgatacaaattgtcattaatcgcgacgatgtgcaggggtatgcggctaagaccgtgttcgaagctcttcaggcccccgcctgtcacgagaacctggtgaaggtgggagggtacatcctgggagagttcgggaatttgattgcaggggaccctagatcaagccctctgatccagtttcacctgctgcactccaagtttcacctgtgttctgttcccacacgagcgctgctgttgagcacctatattaagttcgtcaaccttttcccagaagtcaagccaacgatacaggatgttctccgctcagactcccagctccgcaatgcagacgtggaactccagcaaagggccgttgaatacttgcggctgtccaccgtggccagcacagatatactggcaacggtgctggaagagatgccgccattcccagagcgcgaatctagtatcctagccaagctgaaaaaaaagaagggaccctcaacagtcactgatctcgaggatactaagcgagacagatccgtcgacgttaacggggggcccgaacctgctcctgcttcaactagcgcggtatccaccccatctccatctgctgacttattaggtctgggcgctgcaccccccgccccagctggaccccctcccagtagtggcggctctgggctgctggtcgacgttttttcggactccgcgtctgtagtggcacccctggcccccggctccgaggataacttcgcacgattcgtctgcaagaataacggggtgctgttcgagaatcagcttttgcagataggtcttaagtccgagttcagacaaaacctgggccgcatgttcatattttacggcaataaaacctctacccagttccttaattttacccccactctcatctgctctgacgatcttcagcccaacttgaacttgcagaccaagcccgtggaccctacggtcgaggggggcgcccaagtacagcaggttgtgaacattgaatgtgtgtctgactttacagaggcccccgtcctaaacatccaattccgctacggcgggactttccagaacgtgtctgtgcagctgcccatcacgctgaacaaattctttcaacctacggaaatggccagtcaggacttctttcagcgctggaagcagcttagtaacccacaacaggaggttcagaatatttttaaggctaagcacccgatggacaccgaggtgaccaaggcgaagattataggatttggatcagcgctactcgaggaggtggatccaaatcccgccaactttgtcggtgccggcatcatccacacaaaaactacacaaataggatgcctgctgaggctggagccgaatctgcaggcacaaatgtatcgactgactctcaggaccagtaaggaggcggtatcccagagactgtgcgagctcctatctgctcaattttag

SEQ ID NO: 107327 - DNA, 2040 bp, Artificial Sequence
  Description of Artificial Sequence: Synthetic coding sequence
atgcctgccgtgagcaagggagacggaatgcgtggcttggcggtattcatctctgacatcaggaattgcaagagtaaggaggcggagataaaacgtatcaacaaagaactggctaatattcgctccaaattcaagggtgacaaagctctggatgggtacagtaaaaaaaagtacgtgtgtaagcttctctttatcttcctcctggggcatgacattgatttcggccatatggaggcagtgaacctattgagttccaatcgctacactgagaagcagattggttatctgttcatcagcgtcctcgtgaatagcaattctgaactgataagactgatcaataatgccatcaagacggagagagacgtatcagtgcggcagcgggccgtcgacctgttatatgctatgtgcgacagatccaatgccccacagatagtcgcggagatgctatcttacctcgaaaccgctgattattctattcgagaggaaattgttctgaaggtcgcaattctggcagagaagtatgctgtcgactacacatggtatgtagacaccatcctgaatctgattagaatcgctggggattatgtgagcgaggaagtttggtatcgagttattcagatcgttattaaccgggacgatgtgcagggctatgcagcgaaaacggtattcgaagcacttcaggccccggcgtgccacgagaacctggttaaagtgggcggatacatcctcggcgaatttggtaatctgatcgccggtgacccgcgatcctcacccctcattcagttccacctgttgcattccaaatttcacctgtgctccgttcccaccagagctttacttctgtcaacttacatcaagtttgttaatttatttcccgaagtaaagcccactatccaggacgtcctccggtcagatagtcaactaagaaacgctgatgtcgagttacagcaaagggccgttgagtatcttagactgtctaccgtggcaagtacggacattctcgctaccgtactggaagagatgccacccttcccagagagagaatcttctatcctggccaagcttaaaaaaaagaaaggtccatccacagtcaccgacctcgaagacacaaaaagggataggagcgttgacgttaacggagggcccgaacctgctcctgccagtaccagcgcggtgtcaaccccatccccaagcgctgacctcttgggtttgggcgctgctccaccagcccctgctgggccgccccctagctctgggggctcaggtttgcttgtagacgtgttcagtgactcagcgtccgtcgtggcgccactggctcctgggtcagaagacaatttcgcccgctttgtatgcaaaaacaacggagttctcttcgagaaccagctcctacagattggactgaaatccgaatttagacagaacctcggccgcatgttcatattctatggaaataaaacctctacccagtttctcaacttcactccgacattaatctgcagcgatgatctgcagcctaaccttaacctgcagaccaaaccagtggatcccactgttgaagggggggcgcaggtgcagcaggtggtgaatattgagtgtgtcagcgactttactgaggcccctgtcctaaacatccagttcagatatggcggaacatttcagaacgtttctgttcagctgcccatcacactcaacaaatttttccagccgaccgagatggcatcacaggattttttccagcggtggaagcagctgtcaaacccccagcaagaagtacagaatattttcaaggctaagcatccgatggacacggaagtgactaaggctaagatcataggattcgggtctgccttactcgaggaagtcgatcctaatcccgcaaacttcgttggagcgggcattatacataccaaaacgacacaaattggatgtctgttgagactcgaaccaaacctgcaggcacaaatgtacaggcttaccctgagaaccagcaaagaggcggtctcacagagattgtgcgagctgctgagcgcacaattttag

SEQ ID NO: 107328 - DNA, 2031 bp, Artificial Sequence
  Description of Artificial Sequence: Synthetic coding sequence
atgcctgcagtgtccaagggggacgggatgaggggtctggcggtgtttatttccgatatccggaattgcaaaagcaaagaagccgagataaaacggattaataaagagctggctaatatccgatccaagttcaagggtgataaagcgctagacggatattccaagaagaagtacgtgtgcaagctactgttcatattccttttaggacatgatattgattttggacacatggaggcagtgaatctcctcagcagtaacaggtacacagagaaacaaatcgggtacctgtttatctctgttcttgtcaattctaacagcgaactgattagactgatcaataacacggagagggacgtgagtgttcgacaaagagctgtcgacctcctttacgccatgtgtgacaggagtaatgccccacagattgtcgctgagatgttatcgtacttggagaccgccgactactcaatccgggaagagatcgttctcaaggtagctatccttgccgaaaaatacgctgtagattatacctggtatgttgacacaatcctgaacctgatcaggatcgcgggtgattatgtctccgaggaggtgtggtaccgagtgattcagatcgtcataaatcgggacgatgtgcaggggtacgcagctaagaccgtgttcgaggccctgcaagcaccagcctgtcacgagaatttagtgaaggtgggaggatatattctgggcgaattcggaaaccttattgcaggggacccccggtcctccccattaatccagttccatctgctgcatagcaaattccacctgtgttcagtgcctacccgcgccctgctgttgtctacttacattaaattcgttaacctttttcctgaagtgaagccgacaatccaagacgtgctccggtccgactctcagctgagaaacgcggacgtggaactgcagcagcgagccgtggaatacctgcgattaagcaccgtggcaagcaccgatattctagcgacggtcctggaagaaatgcctccctttccggagagagaaagttccatcctggctaagctgaagaaaaaaaaagggccttcaactgttaccgacctggaggatactaagagggaccgctcagtcgacgtgaacggtggccctgagcctgcacccgcgtcaactagcgccgtatctaccccatcaccatcagcagatcttctgggtcttggggctgctcctcccgcgccagccggccccccaccttcctcaggaggctctggcttgctggttgacgtcttctccgattctgccagcgttgtggctccactcgcccctggcagtgaggataatttcgctcgctttgtatgcaaaaacaatggcgtcctcttcgagaaccagctgctgcagatagggcttaagtccgaatttcgccaaaaccttgggaggatgttcatattttatgggaacaaaacatcaactcagttcttgaatttcaccccaactctgatttgctcagatgatcttcagcccaatctcaatcttcaaacaaaaccggtggacccaacggttgaaggaggggcccaggtgcaacaggtcgtaaacattgagtgcgtgagcgacttcaccgaagcacctgtactcaatatacagttcaggtatggcgggaccttccagaatgtctctgtgcagctgcctatcacgctcaacaaattcttccagccaacagagatggcttcgcaggacttctttcagagatggaagcagctcagtaatccacagcaggaagtccagaatatatttaaagccaaacacccaatggatacagaagtcactaaggccaaaattatcgggttcggctcagccctcttggaggaagttgacccaaaccccgctaactttgttggtgccggtatcatccacactaaaaccacccaaataggttgcctcttaagacttgagccgaatcttcaggcgcagatgtataggttgactctgcgtacatccaaggaagccgtatcccagaggctctgtgaactgctctcagctcagttctag

SEQ ID NO: 107329 - DNA, 2814 bp, Artificial Sequence
  Description of Artificial Sequence: Synthetic coding sequence
atgacagacagtaaatactttaccaccaataagaagggggagatcttcgaactgaaagccgaactcaataacgaaaaaaaggaaaagaggaaggaggccgtaaaaaaggtcattgccgcgatgactgttggcaaggacgtgagttcactgtttcccgacgtagtaaattgcatgcagactgacaacctcgaactgaaaaaactggtatatctttatctgatgaactatgcaaagagtcagccagacatggcgattatggctgtcaacagttttgtgaaggattgcgaggacccgaacccactcatacgggccctcgcagtaaggactatgggctgtatacgcgtggacaaaattaccgagtacctgtgtgaacctctgagaaagtgcttgaaagatgaagacccgtatgtgaggaagacagccgctgtgtgcgtcgccaagctccacgatatcaacgctcagatggtagaagaccaagggttcctggatagcctgagggatctcatcgcggatagcaaccccatggtggttgccaacgcagtcgccgcgctctcagaaatctctgaatcacatcctaactcaaatctgttagacctgaacccccagaatatcaataagctgctgacagccctgaacgaatgtactgagtgggggcagattttcatccttgactgtttgtccaactataaccctaaagacgatagggaggctcagtccatctgtgagcgagtcacccctcgcctctcccacgctaatagcgcggttgtgctgtcagctgttaaagtactgatgaagtttctggaactgctccccaaagatagcgattattataacatgctgctgaaaaaattggccccacctcttgtcacccttctttcaggagaaccagaggtgcagtatgtggccctccggaacatcaatcttatcgtccaaaagcgtcccgagatcttgaagcaggagattaaagtgttctttgtgaaatacaatgatccaatatacgtgaaactggagaagttggacattatgattaggctggcgtcccaagctaacatcgcgcaggtactggcagagcttaaggaatatgccaccgaagtggacgtcgatttcgtccgaaaggcagtgcgagccatcggtcggtgcgctataaaagtggagcaaagcgcagaacggtgtgtgtccacactgctggacctcattcagacaaaagtgaactatgtcgtgcaagaggctattgttgtgatacgggacattttcaggaagtacccaaacaagtatgaatccataattgccaccctttgtgagaatttggattcactcgacgaaccagacgcgagagctgcaatgatctggatcgtgggggagtacgcggaaaggattgataatgcagacgaactgctcgagtcgtttctggaaggtttccacgacgaaagcacccaggttcaactgactctcctgacagctattgtgaaattgtttctgaagaaaccttcagagacgcaggaactggtccaacaggtgctgtctctagccacgcaagatagcgacaacccagatctgcgagacagggggtacatttattggaggctgttgtcaacagatcctgtgaccgcgaaggaggtggtactgtcggaaaaaccattgatcagcgaggaaaccgatttgatcgaacccacgcttctggacgaactcatctgccacatcggatccctggcctcagtctatcacaaaccccctaacgcttttgtggaaggatcgcacggtatccataggaaacacctccccatccatcatgggagcactgatgccggggatagcccagtgggcactaccactgctactaatctggagcaaccccaggtaattccttctcaaggtgatctgctgggcgatctactcaaccttgacctgggtcctcccgtgaacgtcccccaggtttcatctatgcagatgggggctgttgaccttctgggcggtggactggattcattagttggccagagttttataccatcctcagtgcctgccacctttgctccttcccctacccccgcagtcgtaagtagcgggctgaacgatctgttcgagctctccactggaatcggaatggcaccgggaggatatgtagccccgaaagccgtgtggctgcctgcggtgaaggctaaaggcctcgagattagcggcacattcacccataggcagggccacatttacatggagatgaacttcaccaacaaggcgctgcagcacatgactgactttgccatccaatttaacaagaattcatttggtgtgattccctcgactccgttagcaattcacacaccactgatgccgaaccagagcatcgacgtctccttaccactcaacaccctgggacccgtcatgaaaatggagcctttgaataacttgcaagtagcagtgaagaataatatcgacgtgttttatttttcgtgtctaatacctctgaacgtgttgttcgtggaggacggcaagatggaacgccaggtgttcctggcaacctggaaagatatccctaatgaaaacgaacttcagttccagatcaaagaatgccacctcaacgccgatactgttagtagcaaactccaaaataataacgtttataccatcgccaagcgcaatgtggagggccaagacatgctgtatcaatccctgaaactcacaaatggcatatggatcttagcagaattacgtatccagcccggcaaccccaattacaccctgagcctgaagtgtagggccccggaagttagccagtacatctaccaggtttatgacagtatcctgaaaaattag

SEQ ID NO: 107330 - DNA, 2856 bp, Artificial Sequence
  Description of Artificial Sequence: Synthetic coding sequence
atgactgatagcaagtacttcacaactaataagaagggcgaaatctttgagttaaaggcagaactcaacaatgagaagaaggaaaaacgcaaggaggctgtgaaaaaagtgattgccgcaatgacagtgggcaaagatgtgagtagtctcttccctgatgtcgtgaattgcatgcagacagataatttggaactgaagaagctcgtctacctgtacctgatgaactacgctaagtcccaaccagatatggcaattatggccgtgaattcttttgtgaaggattgcgaggaccctaaccctttgatccgagcgttggcagttcgtacaatgggatgtatcagagttgacaagatcacagaatatctctgtgaaccgctgaggaaatgcctgaaagatgaggacccctacgtgaggaagaccgctgccgtctgtgtggcaaaactccatgacatcaacgctcagatggtggaagatcaaggcttcctggatagcctgcgcgacctcattgcagactccaacccgatggtagttgctaatgccgtggcggctctatctgagattagcgaatcccatcccaacagtaacctgctggacttgaacccccagaacatcaataagctgctcacggccctgaacgagtgtaccgagtggggtcagatcttcatccttgattgcctgtccaattacaatccgaaagatgatcgcgaggcccagtcaatttgcgagagggtgacccccagactgtcacacgctaattctgctgtagtgctctctgcagtgaaggtgcttatgaaattcctggagctcttgcctaaggatagcgactactacaatatgctgctaaaaaaacttgctccccccctcgtaactttactgtccggggaaccagaggtccagtacgtggcactcaggaacatcaatttgatagtccagaaacggcccgagattctcaagcaagagatcaaggttttttttgtaaaatataatgatcctatctacgtcaaacttgagaaacttgacatcatgatccgcctggccagtcaggctaatattgctcaggtgctggcagaactcaaagagtatgctacggaagtggatgtggatttcgtaaggaaagctgtcagagctatcggtaggtgtgctattaaggtggagcagagtgccgagaggtgcgtgagcactctgctagacctcatccagaccaaggtgaattacgtcgtccaggaggctatcgtggttattcgcgacatctttaggaagtatcctaataagtacgaatcaattatcgcaacattatgcgagaatcttgacagtctggacgaaccggacgccagggccgccatgatctggatcgtcggagagtatgccgaacggattgataacgctgatgagctgttagaatcctttctcgaaggtttccatgacgagtccacccaggttcagctcacactgttgacagctatcgttaagctgtttttgaagaagccttccgaaacacaggagctcgtccagcaggtactaagtcttgctacacaggactcagacaatcctgaccttcgtgaccgcggctatatttactggcggctgctttctaccgaccccgtgactgccaaggaagtcgtgctcagcgaaaagccgctcatcagcgaagaaaccgatcttattgagccaaccctactggatgaactcatctgtcatatcggtagtttggcgagcgtctaccacaagcctcccaacgcctttgtggagggatctcatggtatacaccgaaaacacttgcccatccaccacggttctaccgatgccggagatagccccgtcggtactaccaccgccactaatctggaacagccgcaggtcattccttcacagggcgatctgctcggcgatctcctgaatctagatctgggccccccagtgaatgtgccacaagtcagtagcatgcagatgggtgccgtggatctccttggaggcggactcgactccctcctgggttcagatctgggcgggggaatcgggggcagcccagccgttggtcagtccttcatcccctcctccgtcccagcaaccttcgcgccctcacctacccccgccgtcgtctcgtcgggcctgaacgatctgttcgaactctcgacaggtatcggcatggcgccagggggctacgtcgctcctaaggccgtctggttacctgctgttaaggcaaagggcctcgagatcagtggtacctttacacatcggcagggccatatttacatggagatgaatttcactaataaagccctgcagcatatgacagattttgctatccagttcaacaagaatagctttggcgtaataccaagcacccctctcgccatccatacgcctttgatgccaaaccagtccatagatgtctctctccccctgaacacactcggcccagtgatgaaaatggagcccctcaataatttgcaagttgccgttaagaataatatcgatgtcttttatttctcttgccttattccactgaatgtgttatttgtggaggatggcaagatggaaagacaggtgtttctggccacctggaaggacataccaaatgagaatgagcttcagttccagatcaaggaatgccatctcaatgccgacacggtaagtagcaagctgcagaataataatgtgtataccattgctaaacggaatgtggagggacaggacatgttgtatcagtcccttaagcttacaaacggcatttggatactggctgaactcaggattcagcctgggaaccccaattacaccctgtcattaaaatgtagggctcctgaggtgtctcaatatatctaccaggtttacgatagcattctcaaaaattag

SEQ ID NO: 107331 - DNA, 2856 bp, Artificial Sequence
  Description of Artificial Sequence: Synthetic coding sequence
atgactgattccaagtacttcacaacgaataagaagggggaaattttcgagttgaaagctgagctcaataatgagaagaaggagaagcgcaaagaggctgttaaaaaagtgatcgctgctatgacagtgggaaaggacgtgtcctcgttgttccccgacgtggtcaactgtatgcagactgataatttggagttaaaaaaactagtttatctctacctcatgaactatgctaagtcccagccagacatggctattatggcagtgaattcctttgtgaaggattgtgaagaccccaatccactaattcgcgctctggcagttcgaacgatgggttgtattcgcgttgataaaatcaccgaatacctgtgcgagccactgaggaaatgtctcaaggacgaagacccctatgttcgtaagaccgccgctgtctgcgttgcgaaactgcacgacatcaacgcccaaatggtcgaggatcagggatttcttgacagtctgcgagatctcatcgcggattctaaccccatggtagtggcaaacgccgtggctgccctatccgagatatcagaatcccaccctaactcaaatctcctagacctcaaccctcagaatatcaacaagctcctgaccgctttaaatgagtgtacagagtggggacaaattttcattctagactgtttatcaaactacaacccgaaagacgatagagaggcccagtccatctgcgagcgggtgacgccacgcctgtctcatgccaacagcgcggttgtgctctctgccgtaaaagtgctgatgaaattcctggagctgctgccgaaggattccgactattataatatgctcctcaagaagttagccccgcccctggtgacgctcttaagtggagaaccagaagtgcaatatgtagctcttaggaatattaatctaatcgtgcaaaagagaccagaaatccttaagcaggaaataaaggtgtttttcgttaagtacaatgacccgatttatgtcaaactcgagaaacttgacattatgattagactagcatcacaagcgaacatcgcgcaggtcctggcagagctgaaggagtacgccaccgaggtggatgtagatttcgtccggaaggccgtgcgcgctatcggacgctgtgccatcaaagtcgaacagagtgccgaacgatgcgtgagtacacttctagacctgatccagaccaaagtgaattatgtggtgcaggaagcgattgtagtaattcgcgacatcttccgaaagtaccccaataagtacgaatcaatcattgcgacgctgtgtgagaacctggactcgctggacgagccggatgcacgcgcggccatgatttggattgtcggtgaatatgcagagaggatcgataatgctgatgagctcctggaatctttcctggaagggttccacgacgagtcgacacaggtccagctgaccctgctgacagcaattgttaaactgtttctgaagaaaccatccgagactcaggaacttgtccaacaggttctcagccttgctacacaagactctgacaatcccgatctgagagaccgcggctatatttactggcgtctattatccaccgacccagtgacagccaaagaggtggtcctgagcgagaagcctctgatcagtgaggagacagacttgattgaacccaccctcttggacgagcttatctgtcacataggtagcttggcctctgtataccacaagccccctaacgccttcgtggagggttctcatggcattcacagaaagcatttgcccattcaccacggatcgactgacgctggagacagcccagtaggtaccaccactgccacaaatctcgaacagccacaggtcatcccttcacagggagatctactgggcgatcttctcaacctggacctcggtccccctgtcaacgtcccgcaggtctccagcatgcagatgggcgcggtagatcttttaggcggcggcctggatagtcttctcgggagtgatctaggaggcggcattggtggttcgcctgccgtcggacagtcgttcatcccttcgtcggtgccggccactttcgcaccttcaccaacgccagcggtggtttctagcggcctcaatgatttatttgaattaagtacaggcattggaatggctcctggtggctatgttgcgcccaaagcagtttggctgcctgccgtgaaagccaagggcctcgaaataagtggaacttttacacaccgccagggtcatatttatatggagatgaatttcaccaataaagctctgcagcacatgaccgactttgcaatacagtttaataagaacagcttcggggtgattccttctacccccctcgccatccacactcctctgatgcccaaccagtctattgacgtgtctctcccattgaatactttagggcccgtaatgaaaatggaacccctcaataatctccaggtggcagttaaaaacaatattgacgtcttctacttctcgtgtctgataccgctaaacgtgctattcgtcgaagacggaaaaatggaaagacaggtctttctcgctacatggaaggatattccaaatgaaaatgaactgcaatttcaaatcaaagagtgccacctgaacgcagatactgtgtcttcaaagctacagaataataatgtatacaccatagctaagcggaacgtggagggtcaagacatgctgtatcaaagcctcaagctaacaaacggtatatggattttggctgagctaaggatccagcctgggaatccgaactatactctgtcattgaagtgcagggcccctgaggtgtctcagtacatctatcaagtgtacgacagcatcctgaagaactag

SEQ ID NO: 107332 - DNA, 2643 bp, Artificial Sequence
  Description of Artificial Sequence: Synthetic coding sequence
atgcagaccgacaatctggaattgaagaagttggtgtacttgtatctgatgaactatgccaagagccagcctgatatggccatcatggccgttaattcctttgtgaaggactgcgaggaccctaacccgcttattagggcactggcggtgagaactatgggatgtatacgcgtcgataagattaccgagtatctgtgcgagccactgcgaaagtgcctgaaagatgaagatccctacgtcaggaaaacagccgccgtgtgcgtcgctaaactccacgacattaacgcacaaatggttgaagaccagggattccttgacagtctgagggatttgatagctgattccaatccgatggtcgtcgctaatgccgtcgcagctctgtctgagatcagcgagagccatccaaacagtaatcttctcgacctgaacccacaaaatatcaataagttgctgaccgctctcaacgagtgtacagaatggggtcagatcttcatcctggattgtctgtctaactacaaccccaaagatgaccgggaagcccaaagcatttgtgaacgtgttacacctcgcttgtcacacgccaactctgctgtggtcctgagcgccgtaaaggtcctcatgaagtttcttgagctgttacctaaagacagtgattactacaatatgctactgaagaaacttgccccccctcttgtgaccctcctgagtggggaacctgaagttcagtatgttgctctcaggaacatcaacttgattgtgcaaaagaggcccgaaatcctcaaacaggaaattaaagtgttcttcgtgaagtataatgatcccatctacgtgaagttagagaaactagacattatgatcaggcttgcctcccaggccaatatagcacaggtgctcgccgagctcaaggagtacgctactgaagtggacgtggattttgttagaaaagcagtgcgagcaatcggccggtgtgctatcaaggtcgagcagagcgccgaaagatgcgttagtaccctgctggatctgatccaaactaaagtgaactacgtggtgcaagaggcgatcgtggtgatcagagacatcttccgcaagtatcctaataagtatgagtcaatcattgccacgttatgcgaaaatctggacagcctggatgagcccgacgcacgcgccgccatgatctggattgtgggcgaatacgccgagcggatcgataatgctgatgagctactggaatcatttcttgaagggtttcacgacgagtcaacccaggttcagctgaccctgctgaccgctattgtgaagctgtttctgaagaaaccttccgaaacgcaggaactagtgcagcaggtccttagcctcgcgacccaagattctgacaatcccgatctgcgtgaccgtggatacatttattggaggctgctatctaccgaccctgtgacagcaaaggaagtggtgctctcggaaaagcctcttatttcagaggagaccgacctgattgaacccactttgctggatgaactgatatgccatatagggtccctggcctccgtatatcataagccacctaatgcgttcgtggagggctcacatggtatccaccgaaaacatctcccaatccaccatggctcaaccgatgccggagactcccctgttggcaccacaaccgcaacaaacctcgaacagccccaggtcatccccagtcagggggaccttctaggcgacttgcttaacctggacttaggtccccctgttaatgtccctcaggtgagttccatgcagatgggggctgtcgacctacttggtggtggattggacagcctagtaggtcagtcgtttattccctcctccgtacctgctacttttgcccctagccctacgcctgccgtagtgagttcaggtcttaacgatctgtttgagttgtctacaggtatcggaatggcacctggagggtatgtggctcccaaggccgtgtggttgcctgcagtgaaggccaaggggctcgagatctctggaacattcacgcataggcaggggcatatctacatggagatgaacttcacaaacaaggctctgcaacatatgacggactttgccattcaattcaacaagaacagcttcggcgtcattccctccacgcctcttgcgattcacacaccactaatgcccaaccagtcaatcgacgtgtctctgcccctgaatactctcgggcccgtcatgaaaatggagccgttgaataacctgcaagtggccgtaaaaaacaatatagatgtgttttactttagctgtttaatacctctcaacgtgctattcgtagaggacggtaaaatggaacgacaggttttcctagccacctggaaggacattcccaacgagaacgagctccaatttcagattaaggagtgccatttgaacgccgataccgtgtcctccaagctgcaaaacaacaacgtatacactatagctaagcgcaacgtagagggtcaggatatgctgtaccagtctctgaaactgaccaacggaatctggatactggccgagcttcgtattcagcccggaaatcctaactatactctgtctttaaaatgtagggcgcccgaggtgtctcagtacatctaccaggtgtatgatagcattctgaagaattag

SEQ ID NO: 107333 - DNA, 2067 bp, Artificial Sequence
  Description of Artificial Sequence: Synthetic coding sequence
atgaagtttttggagctcctacccaaagatagcgattactacaacatgctgctgaaaaaacttgctccacctttggtcactctcctcagtggagagcccgaggtgcaatatgttgcgttgaggaacataaatctcatagtccaaaagagaccggagatcctcaaacaggaaataaaggtgttttttgtgaagtataatgatcctatctatgttaaactggagaaactggacataatgataaggcttgcctcccaagccaatattgcccaggtgctggccgagttgaaggagtatgctactgaggtggatgtggactttgtgaggaaggcagtacgggcaatcgggagatgcgccatcaaagtagagcagagcgccgaaagatgtgtgtccaccctgttagaccttatccagacaaaagtgaactatgtggtgcaggaagcaatagtcgtgatccgggatattttccggaagtatccgaataagtacgaaagcattatcgccactctctgtgaaaatctggattccttggatgaaccagacgccagggctgccatgatctggatcgtgggggaatatgcagagcgcattgataatgctgatgagctgctcgagtcgtttctcgaaggctttcacgacgagagtacacaggtgcagctcactctgctcacagccatcgtaaagctgtttctcaagaagccaagtgagacccaggaacttgtgcaacaggtactgagtctggctacccaggacagcgataatcccgatctgcgggatagaggctacatctactggcggctgctgagtaccgatccggtcacggcaaaggaggttgtgctatccgagaagcccctgattagtgaggagacggacctgatcgagccaacattgctggatgagctgatctgccatatcggctctctggccagcgtgtatcataagcctccaaatgcatttgttgagggctcgcatgggatccaccgcaaacatctgccaatacaccatggatctactgacgccggtgattctcccgttggcaccacaacagccacaaatctggagcaaccgcaagtgatcccctctcagggggacctgctgggcgatctgcttaacctcgatctcggaccacccgtgaacgtccctcaggtatctagcatgcaaatgggcgcagtggatctccttgggggcggacttgacagcctgctgggaagtgatctgggggggggaatcggcgggtcaccagctgtgggtcagtcgtttataccaagcagtgttcccgcaacatttgctccgtcacctacccccgccgtggttagtagtggtcttaacgatctgttcgagctgtctactggcattggaatggcacctggaggctatgtggctcctaaggctgtgtggctcccagctgtgaaagccaaaggactcgaaatttctggcacatttacacacaggcagggtcacatttacatggaaatgaattttaccaacaaggctttacaacacatgacagacttcgctatccagtttaacaaaaacagttttggcgtgatacctagcacccccctggccattcacactcccctgatgcctaatcagtcaattgacgtgagtctacctctaaacacattaggcccagttatgaagatggagcccttgaataaccttcaggtggcagtgaaaaacaacatagatgtgttttacttctcttgcttaatacctctgaacgttctattcgtggaagacggtaagatggagcggcaggtgtttctcgctacatggaaggacattcctaacgagaatgagttgcagttccagatcaaagaatgccacctaaatgccgataccgtgtcctctaagttgcaaaataacaatgtatacaccattgcaaagcgtaacgtggaaggacaagatatgttatatcagtcactgaaactcaccaacggcatctggatattagcagaactacgtatacaaccggggaacccgaattataccttaagtcttaaatgcagggcccccgaagtcagtcagtatatctatcaagtttatgactcaatccttaaaaactag

SEQ ID NO: 107334 - DNA, 1308 bp, Artificial Sequence
  Description of Artificial Sequence: Synthetic coding sequence
atgatcggtggactgttcatttacaatcataagggggaagtgttgatttcaagagtctatcgggatgacattgggagaaatgcagtcgacgccttcagagtaaatgtcatacacgccaggcagcaagtcagaagtccggtcaccaatatcgccagaaccagcttctttcacgtaaagcggtcaaatatttggttggccgccgtcactaagcagaatgtaaacgcggcaatggtgtttgaattcttgtataagatgtgcgatgtcatggccgcttacttcggcaagattagtgaagagaacataaagaataatttcgttctgatatacgagcttcttgacgaaattcttgacttcggctacccacagaatagtgagactggcgctctgaagacctttatcacccagcagggtattaagagccagcaccaaactaaggaggagcagtcacagattaccagccaagtcactggacagattggctggcgcagagaaggtattaagtacaggcgaaatgagctttttcttgacgtcctggaatcagtgaacctgttgatgtctccacagggacaggtcttgagtgctcacgtctcaggcagggttgtcatgaagtcctacctgtcaggtatgcccgagtgtaagtttggcatgaacgacaaaattgtgattgagaagcaaggcaaagggactgctgacgaaacaagcaaatccggtaaacaaagtatcgcaattgacgactgtaccttccatcaatgtgtgagactgagcaagtttgattccgagcgctccatctctttcatccctcccgacggggagttcgaactaatgcggtacagaacaactaaggacattatcctcccgttccgagtcatccctctggtaagggaagtgggtaggaccaaattagaagtaaaggtcgtaattaaatccaactttaagccaagtctacttgctcagaaaattgaggtccgtatccccactcctcttaacacgagcggtgtccaggtgatctgtatgaagggaaaggctaagtacaaggcctccgaaaatgccattgtgtggaagatcaaacgcatggccggaatgaaggaatcccaaatctcagcggagatcgagctgctgccaacaaacgacaagaaaaaatgggcccgcccgcccattagcatgaattttgaggtcccttttgccccttctggactcaaggtgcgatacctgaaggtctttgagcctaagcttaattacagcgaccatgacgtgatcaaatgggtccggtatatcgggaggagtggtatctatgaaacacgatgctag

SEQ ID NO: 107335 - DNA, 1302 bp, Artificial Sequence
  Description of Artificial Sequence: Synthetic coding sequence
atgatcggcggcttgttcatctacaatcacaaaggtgaagttctgatttcccgggtatacagggacgatatcgggcgaaacgccgttgacgcttttcgagtcaatgttatccacgctaggcaacaggtgagaagcccggttacaaacatagcccggacctccttcttccacgtcaaacgtagcaatatctggctcgccgcagtaaccaagcagaacgtcaacgctgccatggtgtttgaattcttgtataagatgtgcgacgttatggccgcttacttcgggaagatatccgaagagaacatcaaaaataattttgttctgatctatgaactgctggacgagatccttgactttggctacccccaaaactccgaaactggcgcccttaagacattcattacccagcagggcatcaagagccagaccaaggaagagcaatcacagatcacctcgcaggtgaccgggcagatcggctggaggagggaaggaataaagtacagacggaatgagctgttcctggacgtgctggagtctgtgaacttgttaatgtctccacaaggacaagttctgtccgcccacgtgtccgggagggttgtaatgaaaagctatctatcaggtatgccagagtgtaaattcggcatgaacgacaagatagtcatagagaagcaaggtaagggcaccgctgatgagactagcaaatctggcaagcagtcaatcgccattgacgactgcacgttccatcagtgcgtgaggctgtccaagttcgactccgaacgctcgatatcctttatccctccagacggggaattcgagttgatgcgctaccgcacaaccaaagacatcattctccctttcagggtgattccacttgtacgggaagttgggcggaccaagctcgaggtgaaagttgtgattaaaagcaattttaaacccagtttgcttgctcagaaaattgaggtccggattccaaccccgttaaacaccagcggtgtgcaggtcatctgtatgaaaggaaaggccaagtacaaggccagtgaaaacgctattgtatggaagatcaagcgcatggcaggcatgaaagagtcccaaatatcagcggaaatcgagttgctccccacgaatgacaagaaaaagtgggcaaggcctcccattagcatgaattttgaggtgccatttgctccctctggactgaaagtgcgctacctgaaggtgttcgagccgaagctgaattattccgaccacgacgttattaagtgggtgcgctatattgggaggagcggaatttacgagacccgttgctag

SEQ ID NO: 107336 - DNA, 1302 bp, Artificial Sequence
  Description of Artificial Sequence: Synthetic coding sequence
atgatcggggggctgttcatctacaatcacaaaggcgaagtgctgatctctagggtctaccgcgacgacattgggcgcaacgccgtggatgctttccgcgtcaatgtaattcatgctaggcagcaggtgcgttcccctgtgaccaatattgcccggacttctttctttcacgtgaagaggagcaacatctggctcgcagccgtgacaaagcagaatgtaaatgccgctatggtgtttgaattcttgtataaaatgtgcgatgtgatggctgcatactttggaaagatctccgaggagaatataaagaacaactttgttttgatctacgaacttttagatgaaattctggactttggctacccgcagaattctgaaaccggagccctcaaaacattcatcactcagcaaggtatcaaatcacaaaccaaagaagagcagtcccaaatcacctctcaggtcactggtcagattggttggcggcgggagggcatcaaatataggagaaacgagttattcctggatgttctagagtccgtcaatttactgatgtctccccaagggcaagtcctgagtgcccatgtctcaggccgagttgtaatgaagagctatctgagcggaatgcccgagtgtaagtttggcatgaacgacaagatagtgatagagaaacaaggtaaaggcactgctgatgagactagcaaatcaggcaagcagtctattgccatcgacgactgcaccttccaccaatgtgttagattgtctaaatttgactcggaacgctccattagctttattccccccgacggtgaatttgagctgatgaggtacaggacgacaaaagatatcatcctaccctttcgggtgattcctctggtgagggaagtgggtcgcacaaagctggaggtgaaggttgtgattaagagcaattttaagccttccttgctcgcgcagaagatagaggtccggatacccactccgctcaatacttccggagtacaggttatttgtatgaagggcaaggcgaaatataaagcaagtgaaaatgcaatagtctggaagatcaagaggatggcagggatgaaagagtctcagatcagcgccgagattgagcttcttcccaccaatgacaagaaaaagtgggccagaccaccaatcagcatgaactttgaggtgccttttgcccctagcgggctgaaggtgcggtacctcaaagtcttcgaaccaaagttgaattacagtgatcacgacgtgatcaaatgggtgcgctatattggaagatccggaatctatgagacgcgatgctag

SEQ ID NO: 107337 - DNA, 342 bp, Artificial Sequence
  Description of Artificial Sequence: Synthetic coding sequence
atgataggcggcctgttcatctacaatcataagggggaggttctgatcagtagagtgtaccgcgacgatattgggcggaacgccgtggacgcgttcagagtgaatgtgatccacgccagacagcaagtgaggtctcccgttacaaatatagcaagaacgagctttttccacgttaagagatcaaatatatggctcgccgcagtgactaaacagaacgtcaacgcagcaatggtgttcgaattcctctacaagatgtgcgacgtgatggcagcttatttcggtaagatctctgaggagaacatcaagaacaactttgtcctgatatatgagcttctcgactag

SEQ ID NO: 107338 - DNA, 1263 bp, Artificial Sequence
  Description of Artificial Sequence: Synthetic coding sequence
atgataggtggactttttatatataatcataaaggcgaggtcctcattagtcgtgtctacagagatgatatcgggcgaaacgctgtggacgctttcagggttaacgtgatccacgcccggcagcaggtcagatcaccagtgacaaacatctggctagccgctgtcaccaaacaaaatgtgaacgccgcaatggtgttcgagttcctttataaaatgtgtgatgtgatggcagcctatttcggcaagataagcgaagagaatatcaagaacaatttcgtgctaatttacgagttactggacgagattttggattttgggtacccccagaactctgaaacaggcgcgttgaaaacctttattacccaacagggaattaagtcccagaccaaggaggagcagtctcagatcacttcccaggtgaccggccagattggctggcggagggagggaatcaaatacaggagaaatgagctcttcctcgatgtcctcgagtcagtgaacctgctcatgtctcctcagggccaggtgctaagcgcccatgttagcggccgcgtggtgatgaagtcttatctcagcggaatgcccgagtgcaagttcgggatgaacgacaaaatcgtgattgagaagcaagggaagggcaccgccgacgagactagcaagtccgggaaacagtctattgctattgatgattgtacattccaccagtgcgtgcgcctgagcaaattcgactcagagcggtcgatctcattcattccccctgatggcgaatttgaactaatgcggtatagaaccacgaaagatattatcttaccttttcgtgtgataccgcttgtccgagaagtcggccggactaagctcgaagttaaagttgtgatcaaaagtaacttcaaaccatctcttctcgcacagaaaattgaggtcaggatcccaacacctcttaacacgagcggggtccaagtcatctgcatgaaagggaaggctaaatacaaggcgtccgaaaatgccatagtgtggaaaatcaagcggatggcagggatgaaggaatcgcaaatcagcgctgaaatagaactgctcccaacaaatgacaagaagaaatgggcccggcctcctatcagcatgaactttgaagtacctttcgctcccagcggactcaaggttaggtatctcaaagtgttcgagccgaaactaaattactctgatcacgacgttatcaaatgggtaagatatatcggacggagcgggatatatgaaactcgatgctag

SEQ ID NO: 107339 - DNA, 1128 bp, Artificial Sequence
  Description of Artificial Sequence: Synthetic coding sequence
atgattggggggctttttatttacaatcacaaaggggaggtgctgatctcccgggtttacagggacgatatcggtagaaatgctgtggcagcatacttcggcaaaatctccgaggaaaatataaagaacaatttcgtcttaatttacgagctcctggatgaaatactcgacttcgggtacccccagaactcggagactggagccttgaaaacgtttataactcagcaaggtattaagtctcaacatcagaccaaagaggaacagtctcagataacatcacaagtgaccggccagatcggatggcgaagagaaggtatcaagtatagacgaaatgagctcttcctcgatgttttggaatccgtgaatctgctaatgtccccccaggggcaggtccttagtgctcacgtctccggccgagttgtcatgaagtcatatctgagtggcatgcccgagtgtaaattcgggatgaacgataaaatcgtcattgagaaacagggaaagggaaccgctgatgaaacgagcaaatcaggtaaacagagtatagcaattgacgactgtacgtttcatcagtgcgtgcgtctctccaaattcgactccgaaagatctatatcttttatccccccagacggcgagttcgagttaatgagataccggacaaccaaggacataatactgccctttcgcgtaattcccttggttagagaggtgggacgtacaaaacttgaggtcaaggttgtcattaaaagtaattttaaaccaagtttattggcccagaagatcgaggttagaatacccacccccctcaacaccagcggggtgcaagtgatttgcatgaaaggaaaagccaagtataaagccagcgaaaacgcaatcgtgtggaaaatcaagcgcatggccgggatgaaggaatcccagatctctgcggagatcgaattgttgccaacgaatgataagaaaaaatgggctcgaccgcccatcagcatgaactttgaggttccgtttgccccgtctgggctgaaggtgcgataccttaaggtcttcgaacctaaattgaattacagtgatcacgacgtcataaaatgggtccggtacatcggcaggtcaggtatttatgaaacacgctgctag

SEQ ID NO: 107340 - DNA, 429 bp, Artificial Sequence
  Description of Artificial Sequence: Synthetic coding sequence
atgatccgctttatcctcatccagaatcgcgctggcaaaactagattagctaagtggtacatgcagttcgacgatgatgaaaaacagaaacttatcgaggaggtccatgcagtcgttaccgttagggatgcaaagcacacgaatttcgtagagttcagaaactttaaaatcatctaccgtcggtatgctggactatatttttgtatctgcgttgacgtcaatgacaacaatctcgcctaccttgaagctattcacaactttgttgaagtgctcaacgagtatttccacaacgtatgcgagctcgacctggtctttaatttttacaaagtgtacactgtggttgatgagatgtttctagccggggagatccgtgagacaagccaaaccaaggtgttgaagcagctgctgatgttacaatctcttgagtag

SEQ ID NO: 107341 - DNA, 315 bp, Artificial Sequence
  Description of Artificial Sequence: Synthetic coding sequence
atgatcaggttcattctgattcagaatcgcgcagggaagactcgtttggcaaaatggtacatgcaattcgacgatgatgagaagcagaaacttattgaggaggtgcatgcagtcgtgactgtaagggacgccaagcacactaattttgtggaggtgctaaatgagtactttcacaatgtgtgtgagctggatctcgtgttcaacttttacaaagtgtacacagtggtggatgagatgtttctggccggtgagattagagagacctcgcagacaaaggttctgaaacaattgcttatgctgcagagcttagagtag

SEQ ID NO: 107342 - DNA, 3285 bp, Artificial Sequence
  Description of Artificial Sequence: Synthetic coding sequence
atgagcagcaactccttcccatataacgagcaatccggcggcggcgaagccactgagctcggacaggaagccacgagcacgatcagtccaagtggcgcttttggccttttctcatccgatctaaagaagaacgaggacttgaagcagatgctcgagagtaataaggattcagccaaattggacgccatgaagcgtatcgtcggaatgattgccaagggaaagaacgccagtgaattgtttccagccgtggttaaaaacgtcgccagcaagaacatcgaaataaaaaaactggtgtacgtttacttagtgcggtatgccgaagagcagcaggatcttgctttacttagtatctccacattccagagggctctgaaggatccaaatcagcttattagggcatcggctctccgggttctgtcttctattcgagtgcccatcattgtgccaatcatgatgctcgctatcaaggaagctagtgccgacctgtccccatacgtgaggaaaaacgccgcccatgcaatccagaagctttactccctggacccagaacagaaagagatgttgattgaagtgatcgagaagctgttaaaagacaaatctactctggtggcaggctctgtcgtgatggccttcgaagaggtgtgtccagacaggatcgatcttattcataagaactatcgaaagctttgtaatttgctggtagacgtagaggagtggggccaggtggtgatcattcacatgttgaccagatatgctaggacacagttcgtcagcccttggaaggagggtgatgaactggaggacaacgggaaaaacttctacgaatcagatgatgatcagaaagagaagaccgacaagaaaaagaaaccttatacgatggacccagaccacaggctgctgatccgaaacaccaagcctctgctgcagagtagaaatgccgccgtcgtgatggctgtcgcccagctctattggcatatctcaccaaaatcagaagcgggcatcatcagcaagtctcttgtgcggttactccgttcaaatagagaggttcaatatatcgtgttacagaatattgccaccatgtcgattcagaggaagggaatgtttgaaccttacctcaaatccttttatgtgagaagcacagatcctacgatgatcaagactctgaaactggaaatccttaccaacctagctaatgaggctaacatcagcactcttctgcgcgagtttcaaacatacgttaaatcacaggacaagcaattcgctgcagctaccatccagactataggtcggtgtgcaacaaatatccttgaagtgaccgacacctgcttaaacggattagtgtgtcttttatctaaccgggatgaaattgtggttgccgagagtgtggttgtgatcaaaaagcttctgcaaatgcaaccagctcaacacggcgagataatcaagcacatggccaaactcctggactctattacagtacccgtggcaagggcgagcatcctatggcttatcggtgaaaattgcgaacgagtgcctaagattgctccagacgtgctgagaaagatggccaagagcttcacttccgaagacgaccttgtgaagctgcagatcctcaatctaggtgccaagctctacctgaccaattcaaagcagactaaactactcacgcagtatatattaaaccttgggaagtacgatcagaattatgatatccgcgacaggacccgattcattaggcagttgatcgtacccaacgtgaaaagtggtgctctttcgaagtacgccaaaaaaatcttcctggcacagaaaccagcccccctcctggagtctccatttaaagatagagatcactttcaattgggcacgctttcacacactcttaatataaaagcaactggctacctcgagctgtcaaattggcccgaggtggcccccgacccctccgttcgcaacgtggaggtcattgaactggccaaagaatggacacctgcaggcaaggctaagcaagaaaattctgccaagaaattctattctgaatcggaggaggaagaagattcttccgacagcagctcggacagcgagagtgagtctgggagcgaatctggtgaacagggcgaaagcggcgaagaaggagacagcaacgaggattcatctgaggactcaagtagtgagcaggactctgagagcgggcgtgagagtggactcgagaacaaacgtaccgcgaaaagaaattccaaggccaaagggaaaagcgattccgaggatggggagaaagaaaatgagaagtccaaaacttctgactcaagcaatgatgaatccagttctatagaggattccagcagtgattcagagtcggaatccgaacccgaatcagagtcagagtcaaggcgtgtgacgaaagagaaggagaagaaaaccaagcaggacaggacacccctcaccaaggatgtgtcccttctggatctagacgactttaaccctgtaagtacacctgttgctctccccacacccgccctatctcccagccttatggccgacctggaaggcctgcatctgtccacttcctcctccgtgatctcagtgagcacgcccgcatttgtgccaactaaaactcacgtgttactgcaccggatgagtggcaaaggattggccgcccactatttttttccaaggcagccgtgcatttttggtgacaagatggtttctatccaaattacactgaacaatacaacagatcggaagatcgagaatatacatattggcgagaagaaattacccattggaatgaaaatgcacgtgttcaatcccattgatagcctcgagccggaaggctcaatcacagtgtccatgggcattgatttctgcgactccacccagacagcatccttccagctctgcacgaaagacgactgctttaacgtaaacatccaaccacctgtgggcgaactgctccttccagtggcaatgagtgagaaagatttcaaaaaggaacagggggtcttgactgggatgaatgagacctcagcggtgataatcgctgcaccccagaatttcaccccatccgtgatatttcaaaaggtggtgaatgtggccaacgtcggcgccgttccaagcgggcaggacaacatccatcgcttcgccgctaaaactgttcattctggtagcctaatgctcgtgacagtggaactgaaagaagggagcacagcccaattgatcattaacactgaaaaaaccgtcattggatctgtactgctgcgggaactgaaaccagtgctgtctcaaggatag

SEQ ID NO: 107343 - DNA, 1698 bp, Artificial Sequence
  Description of Artificial Sequence: Synthetic coding sequence
atgagctccaactcatttccgtacaacgagcagtcgggcgggggggaggctacagaactgggacaggaagcgacaagcactatctcacctagcggagccttcggtttattttcctctgatttgaagaaaaacgaggacctgaagcaaatgctggagtcaaataaggattctgctattaaagaggcaagcgccgacctgtctccctacgtccggaaaaatgcggctcacgctatccagaaactgtattcccttgatccggagcagaaagagatgctcattgaagtcattgagaaactgctaaaggacaagtccactctggtcgctggttcagtcgtaatggctttcgaggaagtatgccctgataggatcgatctgattcacaagaactaccgtaaactgtgcaatcttctggttgacgttgaggagtgggggcaggttgttatcatccatatgcttacgcggtacgcacgtacgcagttcgtctctccatggaaggagggcgatgaactcgaggacaacggaaagaacttttatgagtcagatgatgaccagaaagagaaaacagataagaaaaagaaaccctatacaatggaccctgatcataggctgttgatacgcaatactaaaccactgttacagagcagaaacgccgctgtcgtgatggccgttgcccaactgtattggcacatttccccaaagagcgaagcagggatcatatctaagtcattggttagactcctcaggagcaaccgcgaagtgcagtacatcgtcctgcagaatatcgcaaccatgagtattcaacgcaaaggaatgttcgaaccttacctcaagtctttttatgttagaagcacagatccaaccatgataaagactctgaagcttgagatcctgactaacctagcaaatgaagcaaatattagcaccttacttcgagagtttcagacctacgtgaagtcccaggataagcagtttgccgcagccaccattcaaaccatcggtcgatgcgcaacaaacattctggaggttactgatacatgtctaaatggcctcgtttgcttattgtctaatcgtgatgagattgttgtagcagagtcagtcgtcgtgataaaaaagttgctgcagatgcagcccgctcaacacggggagattatcaaacacatggccaagcttctcgactcaatcactgtaccagtggcgagagcctccatcctatggctcatcggcgaaaactgcgaacgagtgcccaaaatcgctccagacgtacttagaaaaatggccaaatcttttacttcagaggacgacctagtgaaactgcagatcctcaatttaggggcaaaactatatctgaccaactcaaaacagaccaaacttctgacacaatatatcctgaacctgggcaaatatgatcaaaactatgacatcagggaccggacccggttcatcagacagttaatcgtcccaaatgtgaagtctggggccttgtccaaatacgcaaaaaaaatcttcctggcacaaaaaccggcaccgctgctggaatctccgtttaaagacagggatcattttcaactggggacactctcccacactcttaacatcaaggccaccggctatctggagctgtcaaattggcccgaggtggcacccgaccccagcgtgaggaacgtggaggtgatcgaattagtggtcctatcagagtag

SEQ ID NO: 107344 - DNA, 2403 bp, Artificial Sequence
  Description of Artificial Sequence: Synthetic coding sequence
atgtcttcgaatagctttccgtacaacgagcaaagcggaggtggagaggccaccgagctgggccaggaggcaactagtaccatttccccttcaggtgcattcgggcttttttccagtgatctcaagaaaaacgaagatcttaaacagatgctggaatccaacaaagactcagctaaactggatgcaatgaagcgtatagttgggatgattgcgaaggggaaaaacgctagcgagttgttccctgccgtggtgaaaaatgtggcctctaaaaacattgaaattaaaaagctggtctacgtgtatctagttcggtacgcagaggagcagcaggacttagccctcttgtcgatttccacattccaaagagccctgaaggaccctaatcagttaatccgagcgagcgctctccgcgtactatcatccatccgggtgcccattattgtgcccatcatgatgcttgccatcaaagaggcctccgcagacctcagcccttatgtgcggaagaatgctgcccatgctatccagaagttgtactccctggatccggagcagaaggagatgctcatagaagtgatagagaagctccttaaagataagtctaccctcgtggccggctcagtggtcatggccttcgaggaggtttgtccagataggattgacctgatccataaaaactacaggaagttgtgtaatctactggttgatgttgaggaatggggacaggtggttataatccatatgttgaccagatacgcccgtacccaatttgtgtctccctggaaagaaggggacgaactggaagacaacggcaaaaacttctatgaaagtgacgacgaccaaaaagagaagaccgataaaaagaaaaagccgtatactatggatcctgaccaccgactgctcatccgaaatactaaacctctgctgcagtcgagaaacgctgcagtcgtcatggcagtcgcgcagctgtactggcacatcagccccaagagcgaggccggtatcatttccaagagcctcgtccgcctgttacgctctaatagggaggtgcagtacatcgtcctgcagaacatcgcgactatgtcaatccagcgcaaggggatgttcgagccttacctgaaatcgttttatgtgcgatctaccgatccgactatgatcaagacgttgaagttggaaatactcacaaatttggcgaatgaagcaaacattagtactttactgcgcgaattccaaacttacgttaagtcacaggataaacaattcgcggcggctacaatccaaaccatcggacggtgcgctaccaacattctggaggttactgatacctgccttaacggactagtgtgtttgctgtcaaaccgtgacgaaattgtggtggcagaatcggtcgtcgtgattaagaagttgcttcaaatgcagcccgcgcagcacggagaaatcatcaaacacatggccaagctgcttgactcaatcaccgtgccagttgcccgggctagcatcttgtggcttattggagagaattgcgagcgtgtacctaagatcgcaccagacgtgctgcgaaagatggcaaaaagtttcacgtctgaagatgacctggtcaaactgcaaatactcaatctaggtgccaagctctacctgaccaattcaaagcagaccaaactgttgacccagtacatcttaaaccttggcaagtatgaccagaattacgatatccgggatcgcacaaggttcatcaggcaactgattgtacctaacgtgaagagtggggcgctaagcaagtatgccaaaaagatcttccttgctcagaaacctgccccgttgttagaaagccctttcaaggaccgggatcacttccagttagggacgctcagccacacgttgaatataaaggctacaggatatttggagctgagcaattggcccgaggtggctccagatccctccgtcagaaacgtggaggtgatcgaattagccaaggagtggaccccggccggcaaggcaaaacaagagaacagcgcgaagaagttttactcagaatctgaagaggaagaggatagttccgactcctcctccgatagcgagagtgagtccggaagcgaatcgggcgaacagggagagtccggcgaagagggggacagtaatgaggacagctccgaggattcctccagcgagcaggattccgagtcagggcgggaatcaggattagagaacaagagaacagccaagcggaacagtaaggctaaaggtaagtccgatagcgaggatggcgaaaaagaaaatgaaaagtctaagacaagcgactcgtctaatgacgagtctagctctatagaggactcttcatctgactctgaatccgaatccgagccagaaagcgagagcgaaagccgtagagtgaccaaggagtag

SEQ ID NO: 107345 - DNA, 582 bp, Artificial Sequence
  Description of Artificial Sequence: Synthetic coding sequence
atgataaaagctattctcatctttaacaatcacgggaagccgagattgtccaaattttatcaaccttactccgaagacacacagcagcagataatccgggaaacctttcacctcgtctctaagcgggacgaaaatgtatgcaatttcttggaaggggggctgctgataggcgggtccgataataagctgatttaccgtcactacgccaccctgtatttcgtgttttgcgttgactcctccgagagtgaattgggcattcttgatttgatccaagtgtttgtagaaactctagataagtgcttcgagaatgtctgtgaattggatctcattttccatgtagacaaggtgcataatattttagcggaaatggtgatgggcggcatggttttggaaaccaatatgaacgagattgttacacagatcgacgcgcagaataagcttgaaaagtccgaggcaggtttggccggagcccccgcccgggcagtgtccgcggtcaagaacatgaacctccccgaaattccaaggaatattaatataggggacataagtatcaaagttcctaatctcccatcattcaagtag

SEQ ID NO: 107346 - DNA, 450 bp, Artificial Sequence
  Description of Artificial Sequence: Synthetic coding sequence
atgattaagtttttcctgatggtgaataagcaggggcaaactcgcctcagcaagtactatgagcacgtggacatcaacaaaagaaccctgttggaaacagaggtgatcaagtcctgcctatccagatccaatgagcaatgtagcttcattgagtacaaggacttcaagcttatctatcggcaatacgccgcactgtttatagtggttggtgtgaacgatactgagaacgagatggccatctacgagtttatacataacttcgtggaagtgctggatgagtacttcagcagggtatccgaactggatgtgtcattttttaatacggtcttccattcaacctggcaaatgcactccgggccttaccaaacccggtcttgttcagttacacaggcgggcgtgcaacggtgcgatcacggctcactgcatcccggctcccctggactcaagtag

SEQ ID NO: 107347 - DNA, 408 bp, Artificial Sequence
  Description of Artificial Sequence: Synthetic coding sequence
atgataaagtttttcctgatggtcaacaagcaagggcagacgcggctctccaagtactacgaacacgtggacattaataaaagaaccctgctagagaccgaggtgattaagtcatgtctcagccggagcaacgagcagtgcagctttattgaatacaaggacttcaagttaatctatagacagtatgctgcactgttcatcgtcgtaggggtgaatgacaccgagaacgaaatggcgatctacgagtttatccataactttgtcgaagtgcttgacgagtacttcagtagagttgagcccatcgacgaactgcccaaaatttgcagcgcgttagagcctcaacagacgtgcttttctccagacagtagcagcttcaagggtgcagctagtacgacacctatctactag

SEQ ID NO: 107348 - DNA, 2220 bp, Artificial Sequence
  Description of Artificial Sequence: Synthetic coding sequence
atgccttatctgggtagtgaggatgtggttaaagagctgaagaaggcactctgcaacccgcatattcaggccgacaggttaaggtatcggaatgtaatccagagggtgatccgttacatgactcaaggcctcgatatgagcggtgtgtttatggaaatggtgaaagccagtgctaccgtcgatatcgttcagaagaagctcgtgtatctctacatgtgcacttacgctcccctgaagcctgacttggctctgttggccattaatacactttgtaaggattgctcggaccctaatcctatggtccgggggttggcgctgagaagtatgtgttccttgcgcatgccaggcgtacaagagtatattcagcaaccaattctgaatggcctcagggataaagcctcctatgttcgcagagttgccgttcttgggtgcgccaagatgcacaacttgcatggtgattctgaagttgatggagccctcgtcaacgaactatactctctcctcagagatcaggacccgatcgtggttgtgaactgtctcagatctctggaagagatccttaagcaggaagggggtgttgtcattaataaacccatcgcccatcatctcctgaaccgcatgtcgaaactcgatcagtggggtcaggccgaggtgctgaatttcttgctgcgataccagccaaggagcgaagaggagctgttcgacattctaaacctgctcgactctttcctcaagtcctcctctcctggagttgttatgggagcaaccaagctgtttctgatacttgccaagatgtttccccatgtgcagacagatgtcctcgtgagggtgaaaggcccactgctggctgcctgttcatccgagtccagagagctgtgctttgtcgctctgtgtcacgttcgccagatactgcactcactgcccggtcactttagtagtcattataagaagttcttctgtagttacagcgagccacactatatcaaacttcagaaagtggaggtgttgtgcgaattggtaaacgacgagaatgttcagcaggttctcgaggaattgcgcggttactgtactgatgtttcagccgactttgcacaggctgccatcttcgctattgggggtattgctcgcacatacacagatcaatgcgtgcagattctgaccgaattactgggccttagacaggaacatattaccacagttgttgtgcagacatttagagacttggtctggttgtgtcctcagtgcaccgaggccgtgtgccaggctttacctggctgcgaagaaaatatccaagacagcgaaggaaaacaggccctaatctggctactgggggtgcacggtgagcggattccaaatgccccctacgtgctggaggacttcgtcgagaatgtgaaatctgaaactttccccgccgtgaaaatggagctgctgacagcattactgaggcttttcctatcccgacccgcagaatgtcaggatatgctgggccgacttctttactactgtattgaggaggagaaagacatggctgtacgggacagagggctgttctactacaggttgctgctagtggggatcgacgaagtcaaaagaatcctgtgtagtcccaaatccgacccgacactgggtctactggaggaccctgccgaacgccccgtgaactcgtgggctagtgatttcaatacccttgtgccggtatacggcaaggcccattgggctacaatctctaaatgccaaggagctgagcgatgcgatcctgaactgccaaagacctccagcttcgcggcaagtgggcctctgatcccagaagagaataaggagagggtgcaggaactgcccgactctggcgcactgatgctggtgcctaacagacagctcaccgccgattacttcgaaaaaacctggctgtccctcaaggtggcgcaccagcaggtgctgccttggcgaggggaattccacccagacactctgcagatggccttgcaggttgtcaacattcaaactatcgccatgtcccgagctggtagtcggccttggaaggcatacctgtccgcacaggacgataccgggtgcctgttccttacagagctcctccttgagccggggaacagcgagatgcagatttccgtgaaacagaatgaggctcggactgagaccctcaactcctttatctccgttttggaaactgtaattgggactatcgaggagattaagtcctag

SEQ ID NO: 107349 - DNA, 891 bp, Artificial Sequence
  Description of Artificial Sequence: Synthetic coding sequence
atgccatatctcgggtcagaagatgtggtgaaggaactgaaaaaagcactgtgtaacccacacatacaggcggataggctccggtataggaatgtgattcaacgcgtgattagaatgccaggtgtccaggagtatattcagcaaccgatccttaacggtctgcgcgacaaagcttcatatgttagacgagtggctgttttaggatgcgcaaagatgcacaatctgcacggagactccgaagtggacggggcgctggtgaatgagctgtattcgctcctgagggatcaggacccaatcgtggttgtaaactgtctccgctccctggaggagatactcaagcaggaagggggcgtcgtcattaataaacccattgcccaccatctgttgaatcgaatgtccaagttagatcagtggggtcaggccgaggttctgaacttcttgctgcggtatcagccacggtccgaggaagagctgttcgacattctcaacctcctcgacagttttcttaaatctagttccccaggggtggtaatgggcgccacgaaactattcctcatcttagccaagatgttcccccatgtgcagaccgacgttctggtgcgggtcaaggggcccttgctggctgcttgctctagcgaaagccgcgaactttgtttcgtggcactgtgtcacgtgcggcagatcctccactccctgccggggcatttctcctctcattacaagaagttcttttgcagctacagcgagccccactatattaagctccaaaaggtagaggtattatgcgagctggttaacgacgagaatgtacaacaggtcctcgaggaactgaggggatactgcaccgacgtgtcagccgactttgctcaagccgcgatcttcgcaatttag

SEQ ID NO: 107350 - DNA, 909 bp, Artificial Sequence
  Description of Artificial Sequence: Synthetic coding sequence
atgccttatctgggtagcgaagacgtagttaaagaacttaagaaagccctctgtaacccacacatccaggcagacaggctgcgctaccgtaatgtgatccagcgagttatccgttatatgacccagggacttgacatgagcggagtattcatggagatggtcaaagcctccgccaccgtggatatcgtgcagaaaaagctggtgtatctgtatatgtgcacatacgctccacttaaacccgacctcgccctcctggccatcaataccttatgtaaggattgctcggatcctaacccgatggtgcgagggcttgccttgcgatctatgtgctccctgcgcatgagtaagctcgaccagtgggggcaggcagaggtgcttaacttcctactgagataccagcctcgctctgaggaggaactgttcgacatcttaaacctcctggattcctttctgaaatcaagtagtcccggggttgtgatgggggccacaaaactgttcctgatcctggcgaagatgttcccccacgtgcaaactgacgtgctcgtaagagtgaaaggccctttactggctgcgtgttcctcagagtccagggagctatgttttgtcgctctctgccatgttagacagatcctccattctctgccaggccacttctcgtctcactataagaaattcttctgttcttactcggagcctcattatataaaactgcagaaagtggaggtgctatgcgagctcgtgaatgatgagaacgtgcaacaagtcctcgaagagcttcgagggtattgtaccgacgtaagcgctgacttcgcacaggcggctattttcgcaattggccggtgtctccttcttttccttctggagaatcttgaccagccagcccgaaagctatggctggaggaaccatag

SEQ ID NO: 107351 - DNA, 1716 bp, Artificial Sequence
  Description of Artificial Sequence: Synthetic coding sequence
atgccctatctgggatcggaagacgtcgtgaaggaactcaaaaaggctctgtgcaaccctcatattcaggcggaccgtctgcgataccgcaatgtcatccagcgcgtgatccgaatgagcaaacttgatcagtggggacaggctgaggtgctgaattttctgttaagataccagccaagatcggaagaggagttgttcgacatactgaatttgctcgattccttcctgaagagctcgtcccctggcgtcgtaatgggtgcaacgaagctgtttcttatccttgcgaagatgttcccccatgtgcaaacagatgtcctcgtaagagtgaaaggacccttgttggccgcctgctcttctgagtctagggaactctgtttcgtggcactgtgtcatgttagacagattctgcacagtcttcccggacattttagttcccattataagaaatttttctgctcgtattctgagccccattacattaaactccagaaagtggaagtcttgtgtgagttggtaaacgatgaaaacgttcagcaagtcctggaggagttgaggggatactgtaccgatgtaagcgccgacttcgcccaagccgcaattttcgctattgggggcatagcccgaacgtacacagatcagtgtgtacagatcctgaccgagctgctgggtctgaggcaagagcacattacaacagtggtggtgcaaacattccgcgatctggtctggctgtgcccccagtgtaccgaggcagtatgtcaggcccttcccggctgcgaggaaaacattcaggatagcgaaggaaagcaggccctcatttggctgctgggagtacatggcgaacgaatacccaatgccccctatgtcctggaagacttcgtggaaaatgtcaagtccgaaacattcccagcggtgaaaatggagctgttgaccgccctgttgcggctcttcctctcacgccccgcggaatgccaagacatgctcggtcgtttgctgtactattgtatcgaggaggaaaaagacatggccgtgagagataggggcctattttattaccgacttctgcttgttggaatagatgaagtcaaacggatactgtgctcacccaagtcagatcccactttgggcttgctggaagaccctgccgagaggccagtcaattcctgggccagtgattttaatacccttgtacctgtttacggcaaagcccactgggccaccatctcaaagtgccagggcgcggagcgctgtgatcccgagcttcccaaaactagctcgttcgccgcttccggccccctcatcccggaagaaaataaagaacgggtccaagagctgcccgacagcggagccctaatgctggtgcctaatagacagctcaccgctgactatttcgagaagacctggctcagcctcaaggttgctcatcagcaagttctgccttggagaggggagttccaccccgacacactccagatggctctgcaggtcgttaatatccagaccatcgctatgagccgcgctggaagccggccctggaaagcctacctgagcgcccaggatgataccggatgcctgtttctaacagagctgctcctcgagcccgggaattcagagatgcagattagtgtaaagcagaatgaggccaggaccgagaccctcaactcatttatttctgttctggagaccgtcatcgggaccattgaggagatcaagagttag

SEQ ID NO: 107352 - DNA, 2220 bp, Artificial Sequence
  Description of Artificial Sequence: Synthetic coding sequence
atgccgtatctgggcagtgaagacgtggtcaaggaactcaagaaggccctgtgcaatccgcatattcaggcggatcgcttgcgctaccgaaatgtgattcagagggttatcaggtacatgactcagggccttgatatgtctggagtgttcatggagatggtgaaggcttcggcaaccgtggacatagtgcagaagaagctcgtttatttgtacatgtgcacttacgctcccttaaaacccgatctcgccctgctggccataaatactctgtgcaaggattgtagtgatccaaaccccatggtgcgcgggttggcccttcgatcaatgtgctcattaaggatgccgggagtccaagagtacattcaacagcctattctgaatggactgagggataaagcttcctatgtgcgtagggtcgccgtcctagggtgtgctaagatgcacaacctccatggcgactcagaagtagatggtgcacttgttaacgagctttattctttactcagggaccaggaccccatcgtggttgttaactgtttgcgcagcctggaagagatcctaaagcaggaggggggggtcgtgatcaacaagcctattgcccatcacctcctgaaccgcatgtccaaattggatcagtggggccaggcagaggtgttgaactttctgctgaggtaccagccgcggagcgaggaagagctgtttgacatactgaacctgctcgacagcttccttaaaagctctagccccggggtggtaatgggggccacaaagttgtttctcattctcgccaagatgtttccccatgtgcagactgacgtgttggttagagtgaagggcccccttctggctgcttgttcctcagaatcccgtgagctctgttttgtcgccctctgtcacgtgcgccagatactccactctctgcccgggcactttagctcacactacaagaaattcttctgttcttactcggaacctcactacattaagttacagaaagttgaagtgctctgcgaacttgttaatgacgagaacgtgcagcaggttttagaggagctccgcggttactgtactgacgtgtcggcagattttgctcaggccgcaatcttcgccatcgggggcattgccagaacatatacagatcagtgtgtccagattctgaccgaactgctgggattaagacaagagcatatcaccacagtcgttgtccagacattccgagatctggtatggctttgcccgcaatgtactgaagccgtttgtcaggcccttccgggatgtgaagagaatattcaagactccgaaggtaaacaggccctgatttggctgttaggcgtccatggagagaggatccccaacgcgccctatgtcctcgaagactttgtagaaaatgtgaagagcgaaacctttccagccgtcaaaatggaactcctaaccgccctcctaaggctgttcctgagccggccagctgagtgtcaggatatgcttggaaggttactatattactgcatcgaggaggaaaaggatatggcggtaagagacaggggcctgttttactaccggctcctgctggtgggaattgacgaagttaagcggatcctgtgcagcccaaagtccgatcctactcttggcctcctcgaggaccccgctgaacggcccgttaactcttgggccagcgatttcaacacactggtccccgtctacggtaaggctcattgggctactatcagtaaatgtcagggagccgagcgctgcgatcctgagctgcctaagacctctagcttcgccgcatccggcccactcattcccgaagagaacaaagaaagggtccaagaactaccggactctggcgctttaatgctggttcccaataggcaattgactgcggattacttcgagaaaacatggttatctctaaaggtcgctcatcagcaagttttaccatggcggggtgagtttcacccggatacactgcagatggcactacaggtcgtgaacattcagacaattgcgatgtcaagggctggcagtaggccttggaaggcttatctctctgcgcaggacgacactgggtgcttgttcttgacagagcttctcctggagcccggcaatagcgagatgcagatctccgtcaagcagaacgaagcaagaacagagacattgaacagttttatctcagtgttggagacggtcattggaaccatcgaggaaatcaaaagctag

SEQ ID NO: 107353 - DNA, 789 bp, Artificial Sequence
  Description of Artificial Sequence: Synthetic coding sequence
atgccttacctggggagcgaggacgtggtgaaagaactcaagaaagccctgtgtaacccgcatatccaggccgataggctaagataccgcaacgtcatccagcgtgtgattagatatatgacacaggggctcgatatgagcggcgtatttatggaaatggtcaaggcctctgccacggtggatatcgtgcagaagaagctggtttacctctacatgtgtacatatgcaccgctaaagcctgatctcgccttgctggcgattaacaccttgtgtaaagactgctctgacccaaacccaatggtgcggggcctcgctctccgctcaatgtgctctttacgcatgcccggagtgcaagagtacatccagcagccaatcttgaatggactgcgggacaaagctagttacgtgaggcgagtggctgtgcttggctgtgcaaagatgcacaatttacacggcgactcagaggtcgacggggcattagtaaacgaactgtactcactgttgcgagaccaggacccaattgtagtggtgaactgcctgcgtagcctcgaagaaatattgaaacaggagggcggcgtggtcattaataagccaattgcgcatcacttactgaacagaatgtcaaaactggatcagtggggacaggctgaggtgctcaacttccttctcaggtatcaaccccgatccgaagaggagctgttcgacatcctgaacctccttgattccttcctaaaatcttcctcacccggggttgtgatgggtgcgacaaaactgtttctgattctgtag

SEQ ID NO: 107354 - DNA, 528 bp, Artificial Sequence
  Description of Artificial Sequence: Synthetic coding sequence
atgccctacctggggtctgaggacgttgtcaaggaactcaagaaagcattatgtaacccccacattcaagccgatcggcttcgctatcggaatgtcattcagagggtgataaggatgtctaagctcgatcaatggggacaggctgaggtcctgaacttcttgcttcggtaccagccaaggtctgaagaagaactttttgacatcctgaacctgctggattcgtttttgaagtcctcctcacccggagtagttatgggcgcgacaaagctgtttctcatattggctaaaatgttccctcatgtccagacagacgtgctggtgcgcgtcaaagggccactgttggccgcctgttcttccgagtcacgggagctatgtttcgtggccctgtgccacgtgcgtcaaattctccattccttgcccggccatttctctagccattataagaagttcttctgttcatactctgagcctcattacatcaaactgcagaaagttgaggtgctgtgtgaactcgtgaatgacgagtag

SEQ ID NO: 107355 - DNA, 3414 bp, Artificial Sequence
  Description of Artificial Sequence: Synthetic coding sequence
atgtcagacattgtggagaaaacgttgactgccttgcccgggttatttctacaaaatcagcctggaggcggaccagctgcagccaaagcgtccttttctagcaggctggggagcctcgttcgcggaatcaccgctctgaccagcaaacatgaagaagaaaaactgatccagcaggagttgtcatccctgaaggctaccgtctctgcccctactaccaccctgaaaatgatgaaggaatgtatggtgcgcctcatttattgcgaaatgttgggatacgacgcctcgttcggctacatccatgccatcaaacttgcccagcaaggcaacttgctggagaaaagggtcgggtacctggcagtgagcttgtttcttcacgagtctcatgaattactgctcctactggtgaacactgtagttaaagacctgcaatctacgaacctggtggaggtatgcatggccctgactgtcgtatctcaaatctttccctgtgagatgatccctgcagtgctccctttgatagaagataagctacagcactccaaggagattgttcgaagaaaggccgtgctggcactgtataagtttcacctgattgctcccaaccaggtgcagcacatccatattaagttccgcaaagctttgtgcgatcgggatgtgggtgttatggccgccagcctccacatatacctgcggatgatcaaggaaaattcaagtggctacaaggacctcaccgggtcttttgtgaccatcctgaagcaggtggtcggcggtaaacttcctgtggagtttaactatcactctgttccagcgccctggctgcaaattcagctgttacgcatattaggactgctcgggaaagacgatcagcgtactagtgaactcatgtatgatgttttggacgaaagtttaagacgtgcagaactgaaccacaatgtcacttacgcaattctgttcgagtgcgtgcacacagtgtactccatctatccgaaatcagaattgctggaaaaagctgctaagtgcatcgggaagtttgtgttatcccccaagattaacttgaaatatctcgggcttaaggccttaacgtacgttatacagcaggatcctacattggccctccaacaccagatgactatcatcgagtgtctggaccaccccgaccccataatcaaaagagagacattggaactgctgtatagaattacaaatgcgcaaaatataacggtgattgtgcagaagatgctcgaatatctccaccaaagcaaggaagaatacgtgattgtcaacctggtgggcaaaatcgctgagctcgccgagaagtatgccccggacaatgcttggttcatccagactatgaacgctgtatttagcgttggaggagacgttatgcacccggatatccctaataactttttgcgccttcttgctgagggctttgatgacgagacagaggaccagcaacttagactttacgccgtgcagtcctacctgacccttttagacatggagaacgtgttctacccccagcggttcctccaggtgatgtcttgggttctcggagaatattcctacctgctggacaaagaaactccggaggaggttatcgccaaactgtacaagttactgatgaacgactctgtttcaagcgagaccaaagcatggcttatcgccgcagtgaccaagctgacctcccaggcacacagctcgaacaccgtggaacgactgattcatgaatttacgattagcctggatacttgcatgcggcagcacgcattcgagctaaaacacctgcacgagaatgtggaactgatgaaaagcctgctacctgttgacagatcgtgtgaagatctggtcgtagacgcatcactctcctttctggacggatttgtcgcagaaggcctgtctcagggcgcagcaccatacaaacccccgcatcagcgccaagaggaaaagctgtcccaggagaaagtgctgaactttgaaccatacggtctcagcttcagtagcagcgggtttacaggcaggcaaagtccggctggtataagcctggggtctgacgtcagcggaaattccgcggaaacaggtctgaaggaaacgaattcccttaaactggagggcattaagaaactctgggggaaggagggatatctgccaaagaaggaaagtaagactggcgacgaatcaggcgccctccccgtcccccaagagagtatcatggagaatgtggatcaggctattacgaagaaagaccagagccaagttcttactcaaagcaaagaagagaaagagaagcaactactggcaagctctctctttgtggggctcggctctgagtccactattaacctcctgggtaaagcggatacagtgagtcataagtttcgccgcaagtctaaagttaaagaggccaagagcggggagaccacatccacgcacaacatgacctgttcctcgttttccagcctgagtaatgtggcctacgaagacgactattatagtaacacactccatgataccggggataaagaactgaaaaaatttagcctcacctccgagctactcgattccgagtctctcaccgagcttccactggtggagaagttttcctactgctcccttagcactccgtcactgtttgcaaacaacaatatggaaatttttcatccaccccagtctaccgcggccagcgtggcaaaagagtcgtcacttgccagcagctttctcgaggagacgacagaatacatccactcaaacgccatggaagtgtgtaacaacgagactatctccgtgtcgtcttataaaatctggaaggatgactgtctgctgatggtgtggagcgtgaccaataagtccggtctcgaactgaaaagtgccgatttggagattttccccgctgaaaattttaaggtaaccgagcagcctggctgctgcctgccagtgatggaggccgaaagcacgaagagctttcagtactctgtccagatcgaaaaaccatttactgaaggtaacctgacaggcttcatctcttatcacatgatggacacccacagtgcccagttggagttctctgtcaatctttctctgctggacttcattagaccccttaaaatcagctctgatgatttcggaaagctgtggttgtcttttgctaatgacgtcaaacagaatgttaagatgtcggaatctcaggctgcactgccatccgctctcaagactctccagcaaaagctgcgactgcacatcattgaaatcatcgggaatgagggtctgctggcatgccagctgttgccaagtattccttgcctgctacattgtagagttcacgcggatgtcctggcattatggttccggtcatcatgctctacgttgcccgactacctgctgtaccagtgccagaaggttatggaaggcagctag

SEQ ID NO: 107356 - DNA, 1362 bp, Artificial Sequence
  Description of Artificial Sequence: Synthetic coding sequence
atgatcagccaattctttatattaagctcaaagggcgatcctctgatctacaaggacttcaggggagactctggcggtagagatgtcgccgaactgttttacagaaaactgacgggtctaccaggggacgagagccctgtggttatgcatcatcatgggcgacactttatccatatacgccactctggcctatacttagtggtcacaacgtcagagaatgtctctccgtttagcctgcttgagctgctgagccgcctggctacccttctgggtgactactgtggctcacttggagaggggacaatctctagaaacgtcgccctggtctatgagcttttagatgaagtgctggactatggttatgtgcagacgaccagcacagagatgctgcgcaactttatccagacggaggcggtggtaagcaaacctttttccctgttcgacctgtcctctgttggattattcggagctgaaactcagcagtccaaagtcgcccccagcagtgccgcttctcgccctgtcctgtcctccagatccgatcaatctcagaagaatgaagtattcctggacgtggtggagcgcctttctgttttgatcgctagtaatggcagtctgctcaaggtggacgtgcagggggagataaggctaaagagcttcctgccctcggggtctgaaatgcgcatcgggctcactgaagaattttgcgttggcaagtcagaattgcggggttatggtcctgggataagagtcgacgaagtgtcattccattctagcgtgaatcttgatgaattcgagtcccaccggattctccggctgcagccccctcagggagaacttacggtgatgagataccaactgtccgacgatctcccttctcctctcccattcagactgttcccatccgtacaatgggacagaggaagcgggagactgcaggtgtatctgaagcttcggtgcgatttgttatctaaaagccaggctcttaacgtgaggctgcatctgcctttaccccgcggcgtcgtgagcctctcacaagagctgtcctcccctgaacagaaagctgagttggccgaaggtgcattacggtgggacctgccccgcgtccaaggcggtagccaattgagtggcctttttcagatggacgtgcccggccctcccggtccaccctctcatggactgtcgactagtgcctctccgctggggctgggtcctgcctccctgtcctttgagctgccacgccacacgtgttctgggttgcaggtgaggtttctgaggcttgctttcaggccatgtggcaacgcgaatccccataaatgggtgcggcatctgtctcatagtgatgcatacgttatccgcatctag

SEQ ID NO: 107357 - DNA, 1362 bp, Artificial Sequence
  Description of Artificial Sequence: Synthetic coding sequence
atgatcagccagttctttatcttgtcctccaagggagatcctttgatttacaaggactttcggggtgattctggaggcagggatgtggccgaactgttttataggaagcttacaggtctgccaggagatgagtcacccgtggtgatgcatcatcacggacgacacttcatccacatccgccacagcggcttatacctggtagtcacaactagcgaaaatgttagcccttttagtctgctggagctgctaagccgcttggcaacacttctgggagactactgtgggtcactaggcgagggcacgatttccagaaatgtggctctggtctacgagctgctagatgaggtattagactatggctatgtgcagacaacatcaaccgaaatgctcagaaacttcatccagaccgaggctgtcgtaagtaagccattcagcttgttcgacctttcctctgtcgggctcttcggggctgagactcaacaatccaaagtggcaccatctagtgccgctagcaggcccgtcctttcatctaggtccgaccagtcacagaagaacgaagttttccttgatgtggtggagaggctatctgtattaatcgcctctaacggatccttacttaaagttgatgtccaaggagagatccggttaaagtctttcctgccctccggtagtgaaatgcgtatcggactcacagaagaattttgcgtgggaaaaagcgagttgcgggggtacggtcccggaattagggtggacgaagtatcctttcattcttcagtcaatctggacgagttcgagtcccatagaattctcaggctgcagcctccacagggagagctgacggtcatgcgttatcagctgagcgatgatctcccatcaccccttccgttccgactctttccgagcgtgcaatgggataggggctctgggagactccaggtctacctgaaactacgttgtgacctgttgtctaaaagccaagctttaaatgtgaggctgcacctgcccctgcctagaggtgtggtgtccttgtctcaagaactgtcctcgcctgaacagaaggccgaactcgcagagggcgcactcaggtgggatcttcctagagtccagggtggttcccagttatccggcctattccagatggacgtacccgggccacccggccctcctagccacggtttgagcacttccgccagcccactgggcctagggcccgctagtctgtcctttgaattgcctagacatacgtgcagtggcttacaagtgagattcctgaggttggcctttcggccttgtggcaatgcaaacccccacaaatgggttcgtcatttgagccactcagatgcctacgtgatccggatatag

SEQ ID NO: 107358 - DNA, 1653 bp, Artificial Sequence
  Description of Artificial Sequence: Synthetic coding sequence
atgagcgccgcttggatcccagccctgggactgggagtctgcctcctgctgctccctggaccagccggctccgagggtgcggcacccatagccattacatgcttcacacgcggccttgatatcagaaaggagaaagccgatgtgctctgtccagggggctgccctctggaagagttctcagtgtatgggaacatcgtctatgctagcgtctcttccatatgtggtgctgccgtgcataggggcgtcatctcaaactccggcgggccagttcgcgtctacagcctgccaggccgcgagaattacagtagcgtcgatgccaacggcattcagtctcagatgttgagcagatggtctgcaagcttcaccgttacaaaagggaagtcctccacccaagaagcaaccggtcaggctgtgtctacagcacaccctccaactgggaagcgtctgaagaaaacacctgaaaagaaaaccggcaacaaggactgtaaagctgatatcgcattcctaatcgatggctcttttaatatcgggcaacggcggtttaatctacagaagaacttcgtcggcaaagtcgcactaatgctgggaattggaactgaagggccacacgttggacttgtgcaggctagtgaacacccaaaaatcgaattctacctgaagaatttcacttccgctaaggacgtactcttcgcgatcaaagaagttggattccgaggtggcaacagcaatacagggaaagccttaaagcacacagcccagaaattttttaccgttgatgcaggcgtgcggaagggaataccaaaggtcgtggtggtgtttatagatggttggccaagtgacgacatagaagaggctggtattgtggcgagagagttcggtgtgaacgtcttcattgtcagcgtcgctaagcctattcccgaggagttgggaatggtccaggatgttaccttcgttgataaggctgtatgtaggaataacgggttcttctcgtatcatatgcccaattggttcgggactaccaagtatgtgaaacctctggttcagaagctttgtacccacgaacaaatgatgtgcagcaagacctgctataatagtgtgaatatcgcattcttaatcgacggatcctcttccgtcggcgatagcaatttccggctaatgctggaattcgtcagtaacattgcaaagacattcgaaattagtgatattggagcgaaaatagccgcggtgcagttcacgtacgatcagcgcactgaattctcctttacagactactccaccaaggagaatgtcttggctgtcattagaaacatccggtacatgagtgggggtacagctaccggagatgcgatatcttttaccgtgcgcaacgtgttcgggccaatccgcgaaagcccaaacaagaacttcctggtgattgtgacagacggccagagttatgacgacgtgcagggtcccgccgctgccgcccatgacgctggaatcactattttctcagtgggcgtcgcttgggctccattggacgacctaaaggacatggcatccaaacctaaagaatctcatgccttttttactcgagagttcaccgggctggagcctattgtttctgatgtgattcgggggatctgcagagatttcctagagagccaacagtag

SEQ ID NO: 107359 - DNA, 435 bp, Artificial Sequence
  Description of Artificial Sequence: Synthetic coding sequence
atgataaaatttttcctgatggtcaataaacagggccagacacgtctgtcgaagtactacgaacatgttgatattaacaaaaggacgctactggagactgaagttattaaatcttgcctgagcaggtctaacgagcaatgcagcttcattgagtacaaagacttcaagttgatctacagacagtacgcagccctgtttatcgtggtgggcgtgaatgacactgagaacgaaatggcaatctatgagttcatccacaacttcgtcgaggtgctggatgagtatttcagcagggtggttaagggacacatcatgtttaatttggacaaagtgcacatcatcctggacgaaatggttctcaatggttgcatcgtcgaaactaatcgggcaagaatcctggctccattgctgattctggacaagatgtctgaatcatag

SEQ ID NO: 107360 - DNA, 435 bp, Artificial Sequence
  Description of Artificial Sequence: Synthetic coding sequence
atgatcaaattttttttaatggtgaataagcaggggcagaccagactgtcaaagtattacgagcacgtagatatcaataaaagaacactgctcgaaaccgaagttattaagagctgtcttagtcggtccaacgaacagtgcagttttatcgaatataaggatttcaagctcatctacaggcagtatgcagcactgtttattgtggtgggcgtcaacgatacggaaaatgaaatggccatttatgaatttatccacaatttcgtggaggtcctcgacgaatattttagccgggtttctgaactggatatcatgttcaatctggacaaagtacacattattctagatgagatggtcttaaacggttgcattgtggagactaatcgggcacgaattctcgctccactcttgattcttgataaaatgtctgagagctag

SEQ ID NO: 107361 - DNA, 27 bp, Artificial Sequence
  Description of Artificial Sequence: Synthetic coding sequence
atgattaaatttttcctcatggtatag

SEQ ID NO: 107362 - DNA, 297 bp, Artificial Sequence
  Description of Artificial Sequence: Synthetic coding sequence
atgattaagttcttcctgatggtcaacaagcaggggcagacacgcctatcaaagtactacgaacacgtcgacataaataaacgcactctgttggagacagaagtgatcaagagttgcttgtctcggtctaacgagcaatgtagtttcatcgagtataaagatttcaaactgatttatcggcagtacgcggcgctgttcattgtggtgggcgtgaatgatacagagaatgagatggcaatctatgagtttatccacaactttgtcgaggtgctggacgagtatttcagcagagtgtag

SEQ ID NO: 107363 - DNA, 402 bp, Artificial Sequence
  Description of Artificial Sequence: Synthetic coding sequence
atgattaagttcttcctgatggtcaacaagcagggtcagactcggctgtccaaatattatgaacacgtcgatattaacaagaggactcttttagagactgaagtgataaagagctgcctgagccgttcgaatgagcagtgcagttttatcgagtacaaagatttcaagctcatctacaggcagtatgccgcgctgtttattgtggtgggcgtcaacgacacagagaacgagatggccatctatgaatttatccacaatttcgtggaagtgttggacgaatatttttctcgcgtgagcgagctggacatcatgttcaacctggacaaggtgcatataattctggacgaaatggtcttgaatggttgtattgtggagaccaatagggcccgcatcctcgcctag

SEQ ID NO: 107364 - DNA, 4611 bp, Artificial Sequence
  Description of Artificial Sequence: Synthetic coding sequence
atgggcgtagtgaactttgtgtttcgagctagtgaggacctgcaggtactcgagaactactcagatgccccgatgacaccgaaacagattctccaggtcattgaagctgaaggattgaaggagatgtcggggacctcccctctggcatgtctcaatgccatgctgcatagcaatagtcgaggcggtgagggccttttttacaaattgcctggcagaatttcgctctttacgctcaaaaaggatgccctccagtggtcacgacatcccgcaaccgtagagggggaagagccagaagataccgccgacgtcgagtcatgtgggtccaacgaagcgagcaccgtgagcggggaaaatgatgtatctctcgacgaaacctcctccaacgctagctgtagcactgagtcacagtccagaccactgtcaaacccacgagacagctacagagcctccagccaggccaataaacagaaaaagaagaccggagtaatgctgcctagggttgtactgacccctttgaaggtcaatggcgcacacgtagagagcgccagcggtttctccggctgccatgctgatggagaatcaggcagtccttcctctagcagttcagggagtctggctctggggtccgctgccatccgcggccaggcagaagttactcaagatcctgcccctctgctccgcggatttagaaagccagccactggccagatgaagaggaatcggggcgaagagatcgactttgaaacccctggtagtatcctggtgaacacaaacttaagggcactcattaattcccgtaccttccacgcgcttccttctcacttccagcagcagctgctgttccttctacctgaagtggacagacaggtcgggacagatgggctgctgcggctgtctagtagcgccttgaacaatgagtttttcacgcatgccgcacaatcatggagagaaagactcgccgatggcgagtttactcacgagatgcaggtgcgtattcgccaggagatggagaaagagaaaaaagtggagcagtggaaagagaagttttttgaggactattatggccagaagttgggcctgactaaagaggaatcactacaacaaaacgtgggccaggaggaagcagaaatcaaatccggcctatgcgtgcccggcgaatcagtccggatacagagggggccggctacccgacaacgagacggtcacttcaagaagaggtcacggccagacctgcgaacccgagcacgccgaaatctgtacaaaaagcaggagtcagagcaagccggggtggctaaagacgcgaaaagcgtcgcatccgacgtgcctctgtacaaggacggcgaagccaagacagaccctgccggtttgtccagtccacacctcccagggaccagttccgctgctccagacctggaaggccccgaattccctgtcgaaagcgtcgcttcccggattcaggccgagccagataacctggcacgagcttccgccagtcctgatagaattccttcgctacctcaggagactgttgatcaagagcctaaagaccagaaacgaaagtcgtttgaacaggctgcgagcgccagcttcccagaaaagaaaccacgactggaagaccgccagagctttaggaacaccatcgagtctgtccacacagagaaacctcagcctaccaaagaagaaccgaaggtgccacccatccgcatccagctgtccagaatcaagccgccttgggtcgtgaaaggtcagcccacctatcaaatatgcccccggatcatacctactaccgagtcaagctgcagagggtggactggcgcccggactctagccgacattaaagctcgcgccttgcaggtgcgaggcgcacggggacaccactgtcacagagaggctgcaacaaccgccatcggaggcggcggcgggccaggtggcggcggcggcggcgccacggatgagggcggcgggcgggggagctcctctggagatggcggggaggcctgcggacatcccgaaccaaggggaggtccctcaacccccggaaaatgcacttctgacctgcagcgaacccagctactacccccgtatccgcttaatggcgaacatactcaagcgggcaccgctatgtccagagcccgtcgggaggacctcccatccctccggaaagaagagtcctgcctactccagcgggctactgtagggctgaccgatggcctgggcgacgcgagtcagcttcctgtggcgcctaccggcgatcaaccctgtcaggcactgcctctgttgagcagccagacatcagttgccgagagactcgtagagcagccgcagttgcatcccgacgtcagaacagaatgcgaaagcgggaccacgtcttgggaaagcgatgacgaggaacagggacctactgtgcccgccgataacggccctattctgtctctagttggagatgacactctggagaagggcaccgggcaggccttagactcgcatcccaccatgaaggatccagtgaacgtgaccccctcctccactcccgagagcagccccacggactgcctgcagaatcgcgccttcgatgacgagctcggactaggtggctcttgcccaccgatgcgagaaagcgatactagacaagagaacctgaaaactaaagccctcgtatcaaactccagtctgcactggattcctattccgtctaacgatgaggtggtgaaacagcctaaacccgagtcgcgggagcacataccctcggtagaaccccaggtgggagaggaatgggagaaagcagcgccaacaccacctgcactccccggtgaccttactgccgaggagggactggacccactggattcgttgactagcttatggaccgtgccctctcgtgggggctccgattcaaacggctcctactgccagcaggttgatattgagaagttaaagatcaacggcgattctgaagcattgagccctcacggcgagtcaactgatacggcttccgacttcgaaggccacctgacggaagatagctctgaagccgacacaagagaagctgcagtcaccaagggaagctccgttgataaggatgagaagcctaactggaaccagtcagcccccctgtcaaaggtaaacggcgatatgcgcctagtgacacggacggatgggatggtagcccctcagagttgggtctcccgggtgtgtgccgtacgtcagaagatccccgacagtctccttctggcatctactgagtatcagccacgggctgtttgcctctccatgccggggtctagcgtcgaagccaccaatccccttgtgatgcagcttctgcaaggcagcctacccctcgagaaagtgttgcctcccgctcacgacgattctatgtcagagtctccgcaggtgcccctgaccaaagaccagtcccacggcagtctgagaatggggagcttgcacggtctgggcaaaaacagtgggatggtggacgggagctccccgtcatcactgagggcacttaaagaaccattgttacccgattcctgtgagactggcacaggcctggctcggatcgaggcaactcaggctcctggggccccgcaaaaaaattgcaaagccgtgccctcttttgactcactgcatcccgtaactaatcccatcacaagtagccgcaaactggaggaaatggattcaaaggagcaattttcctctttttcttgtgaggaccagaaagaagtgcgcgctatgagccaagactcgaatagtaacgccgcccccggcaagtcccccggtgatctgacgacaagccggaccccccggtttagctccccaaacgtaatttcttttggccctgagcagacaggaagggccctgggtgatcagagcaatgtgaccggacagggcaagaagctgttcggaagtggcaacgtggctgccacactgcagagaccgcgacccgctgacccaatgcccctgcctgctgagattcccccagtgttcccctctggaaaactcggcccaagtaccaatagtatgtctggcggggtacagactccccgcgaggactgggctcccaaacctcacgcattcgtggggagtgtaaagaacgaaaagacctttgtggggggtcccttgaaggctaacgcagagaacaggaaagcaaccggccattccccgttggagctcgtgggacatctggagggtatgccattcgtgatggaccttccgttctggaaactcccaagggagccaggaaaaggcctgtcagaacctctagaacccagctctctgccaagtcagctctctatcaagcaggctttctatggcaaactgagtaaattacagctgtctagcacatcttttaactacagtagcagctctcccaccttccccaagggcctggcgggctccgtggtccagctgagtcataaggccaatttcggggctagccattctgccagtctttccctccagatgttcacggattcttctaccgtggaaagcattagtctacagtgtgcatgctccctgaaagcgatgatcatgtgccagggatgcggcgccttctgtcacgatgactgtattggaccgagtaaactttgtgtcctatgtcttgtcgtgcggtag

SEQ ID NO: 107365 - DNA, 4626 bp, Artificial Sequence
  Description of Artificial Sequence: Synthetic coding sequence
atgaaggacaagcagaagaaaaagaaagagcgcacgtgggccgaagcagcccggctcgtactggagaactacagcgacgcccctatgactcctaagcaaatccttcaggttatcgaggcagagggactaaaagaaatgaggtccggaaccagcccgttggcctgtctgaacgccatgctgcacagcaatagccgcggaggtgagggactcttctacaaactgcccgggagaatcagcctctttacactaaagaaggacgcgctgcagtggagtaggcaccctgctactgtggagggcgaagaacctgaggatactgccgatgtggaatcctgtgggtcaaatgaggcatcaactgtcagcggagagaacgacgtttctctcgacgagacctcttctaatgctagctgcagcacggagagccagagtcgacccttgagcaatcctcgcgactcctatagggccagttctcaagccaataagcaaaagaaaaagaccggcgtgatgctgccccgcgtggtgctgaccccacttaaagtgaacggcgcccacgtggagtctgcctcaggattttcaggctgtcatgccgatggggagagcggctcaccttctagcagcagtagcggttcattagccctggggagcgcagccatccgcgggcaggctgaggtgactcaggacccggcacccctgctcaggggtttcagaaagcccgcaacaggtcaaatgaagagaaatcgcggcgaggaaatagatttcgagacaccagggagcattctcgtgaatacgaaccttagggccctgatcaactcacggacctttcacgcgctgccgtcccattttcagcagcagctacttttcctcctgcctgaagttgatcggcaggtcggcaccgatggcttgttgaggctctcctcatctgccctcaacaatgagttcttcacgcatgcagctcaaagctggagggaaagactggccgacggcgaatttactcacgagatgcaggttagaatcaggcaggaaatggagaaagagaaaaaggtggagcagtggaaggagaagtttttcgaagattattatgggcaaaagctgggcctgacaaaagaggagtctctgcagcaaaatgtgggacaggaggaagcggaaattaaatccgggttatgcgtgcccggagagagtgtcaggattcagcgaggcccagccacacgacagcgggatgggcattttaaaaagagaagccggcccgatctgcgcacccgggcccgccgcaacctttacaaaaagcaggagagcgagcaggcgggagttgctaaggatgcaaagagtgtggcttcggacgtcccgctgtacaaggacggagaagctaaaaccgatcctgctggcctatcaagtccccatctcccaggaaccagctccgccgctcctgacctagagggtccggagttcccagttgaatcagttgcatccaggattcaggctgaacccgacaacctggcaagggcttccgcaagcccagaccggattccgtccctgcctcaggaaaccgtagatcaagaacccaaagaccagaagcggaaatcttttgaacaagcagcgagtgcctcatttccagagaaaaagccccgcctggaagaccgacaatcctttcggaacacgatcgaatctgtccatacggagaagcctcaacccaccaaagaagagcccaaggtgcctccgatccgcattcagctcagtcgcattaaaccaccctgggtcgtgaaaggtcagcctacttatcagatatgcccaagaatcatccccaccaccgagtcttcatgtaggggctggaccggtgcgcgcacactcgcggacataaaggccagggctctgcaggtgagaggagctcgtggccaccactgccatcgcgaagccgctacgacggcaattggtggcgggggtgggcccggcggaggcggtggcggcgcgacagatgagggcgggggccgggggagttcatcaggggatggcggcgaagcgtgcgggcatcccgaacctagaggaggtccctccactcccggaaaatgcacaagcgacttacagcgcacccagctcctgcccccctatcccctcaacggagagcacactcaggcaggtacagcaatgagcagggctagaagggaggatctgcccagtctgcgcaaagaggagtcttgtctcttacaacgggccactgtgggcctaacagatgggttgggcgatgcttctcagctgcctgtcgcacccaccggcgatcagccatgccaggcgctgccactgctgtcttcccagacaagtgtagctgagcggctggttgagcagccccagctgcacccggatgtccgaaccgaatgcgagagcggcaccacttcctgggagagcgacgacgaggaacagggtcccaccgtgccggcagacaacgggcccatcttatcccttgttggcgatgatacactagagaaaggcacgggacaagcacttgatagccatccgactatgaaggacccggtcaacgtgacgcccagttcaactccagagtccagtccaactgattgtctacaaaatcgggcttttgacgacgagctgggtctcggcgggtcctgcccccctatgagagagtccgatacacggcaggagaatttgaaaaccaaagctctggtctccaattcctcgctgcactggattccaatcccttccaacgatgaggttgttaaacagcctaaacccgaatccagagagcacattcccagcgtggagccacaggtcggcgaggaatgggaaaaagcggcccctaccccacctgccctaccaggcgacttaaccgccgaagaggggttggacccactggattccctgaccagcctctggacagtgccctcacgaggggggtctgacagtaatggttcctattgccagcaggttgacattgaaaagctgaagattaatggggattctgaagctctatctccacatggcgagtccactgacaccgcatccgactttgagggccacctgacagaggactccagcgaggcggacaccagggaggcagctgtaaccaagggcagctccgtcgacaaagatgaaaagcctaattggaatcaaagcgcacctctgagcaaggttaatggggacatgaggctcgttacacgtactgatggaatggtggccccccagagctgggttagtcgcgtatgcgctgtgcgtcagaaaatcccggactccctgctgctcgcatcaacagagtaccagcctagagctgtgtgtcttagtatgccaggcagttcagtcgaagcaactaaccctttggtaatgcaattgcttcaggggagcctgccccttgagaaggttctgcctccagcacacgacgactccatgagcgagagcccccaggtccccctgacgaaggatcaaagtcacggctctttgaggatgggaagtctccatggtctgggaaagaactcggggatggtagacgggtcatccccttcttctctacgggccttgaaagagccgttattgccagattcatgtgaaaccggtacaggactcgcccgcattgaggcgacccaagctccaggcgcaccacagaaaaattgcaaggccgtgccatccttcgattctctccatcccgtgaccaaccccatcactagcagcaggaaactggaagagatggattcaaaagagcagttttcatccttcagctgtgaagatcagaaggaggtccgggcaatgtcgcaggattctaattccaacgctgcacccggtaagtccccaggggacctgaccactagtagaacgcctcgtttctcgtcccccaacgtgatatcttttggcccggaacagaccggccgggctcttggcgatcaatccaacgtgactggacaagggaagaaactgtttggctctggtaacgttgccgctacactccagaggcctcggcctgcagatccgatgccgttaccagctgagataccacctgtcttcccatcaggcaaacttgggccgtctactaactctatgagtggaggcgtccaaacgcccagagaggattgggcgcccaagccacacgcattcgtggggagcgtgaagaacgagaagactttcgtgggcgggcccttgaaagctaatgccgagaaccgcaaggctaccggacacagtccgctggagcttgtgggtcaccttgagggcatgccattcgtgatggatcttccattctggaagctgccccgggagcctgggaagggactgtccgagcccctggagcccagcagcctgccatcccaactttccatcaagcaggcattctatggtaagctgtccaaactacaactgtctagcacatcctttaactacagctctagctcgcctacatttccaaagggcctggccggaagcgtcgttcagttgtcccacaaggcaaactttggtgcatcccatagtgcaagtctcagtttacaaatgttcacagacagtagtacagtagaatctattagcctacagtgtgcatgttccctcaaggcaatgattatgtgccagggctgcggggccttttgtcatgacgactgcataggaccctccaagctgtgcgtgctttgcctggtcgtgagatag

SEQ ID NO: 107366 - DNA, 4626 bp, Artificial Sequence
  Description of Artificial Sequence: Synthetic coding sequence
atgaaggacaaacagaagaagaaaaaggaaagaacttgggccgaggccgctcgcctggtcctggagaactacagcgatgctcccatgacaccgaagcagatacttcaagtgatagaagctgagggcctgaaggaaatgcgatctgggactagcccgctggcttgccttaacgctatgctgcacagcaactctagaggaggcgagggactgttttataaattaccagggaggatctcactgtttacgctgaagaaggacgccttgcagtggtctcggcatcctgcgactgtcgagggggaagagccagaggacactgccgatgtggaatcgtgtggttcgaacgaggcttcaacggtcagtggtgagaacgacgtgagcctcgacgaaacctcctctaatgccagctgtagcactgagtctcagtctcgaccgttatccaatcctagagattcctatagggccagcagtcaagccaacaaacaaaagaaaaaaacaggggttatgctgcctagggtggtcctgaccccacttaaggtcaatggcgcccacgtcgagagtgcgagcgggtttagtggctgccacgcagatggagaatcaggatccccaagctcgtccagctccggctcactggctttaggcagtgcagcgatacgcggccaggccgaagtgacccaggatcccgcccccctgcttcgaggtttcaggaagccagctacgggacagatgaagcggaataggggcgaagaaatcgacttcgaaacacccggcagcatcctggtaaacactaacctccgtgcgcttattaactcacgcacctttcatgcactgcccagccatttccagcagcagctcttattcctgcttcccgaagtggaccgccaggtcggtaccgatggcctcctgcgcctgagctccagcgccttgaacaatgaattctttactcatgcagcacagtcttggagggaaaggctcgccgacggcgagtttacgcatgaaatgcaagtccggatcaggcaagagatggaaaaggagaagaaagtggagcagtggaaggaaaagttctttgaggattattatggccagaaactgggcctcacgaaggaagagagtctacagcaaaacgtggggcaggaagaagcagaaattaaaagtggcttgtgcgtccccggcgaaagcgttagaattcagcgcgggccagcgactcggcaacgcgatggacatttcaaaaaaagatccagacccgatctgcgcacaagggctcgccgaaatctttataagaagcaggagtctgaacaggccggggttgcaaaggatgctaaatctgtcgcgtccgatgtacctctgtacaaggatggggaagccaagactgaccctgcaggtctgagcagccctcacctgccaggtacaagcagtgctgcccctgaccttgagggcccagaattccccgtggagtctgttgctagtcggatccaggcagagcctgacaatttggccagggcttcagccagcccggatcgcatcccaagccttccacaggaaactgtggatcaggaaccaaaggaccaaaaacgtaagtcctttgaacaggccgcgtccgcctccttcccggagaaaaaacctcgcctggaagaccgacaatcattcagaaataccattgagagcgtgcatactgaaaaaccccagcctaccaaagaggaacccaaggttcctcctataagaattcagctctcacggataaaacctccgtgggtggtgaagggccagcctacttatcagatctgcccaagaatcatacccaccacagaatcgtcctgtcggggctggacaggggctagaaccttagctgatatcaaagctcgcgcactgcaggtccgaggagcacgaggccaccactgtcacagggaagcggccactactgccattggcggcggtggcggccccggaggtggggggggaggtgccacagacgaaggcggtggccgtggctccagttctggcgatggtggtgaggcttgcggccacccggagccccgaggaggtcctagcacgccaggcaagtgcaccagcgacctccagcgtacacagctgctccccccctacccgctaaacggtgagcacacccaggcaggcaccgcgatgtcgagagcccggcgcgaggatctgccgtccctaagaaaagaggagtcctgtctgttacagagggctaccgtgggccttactgacggccttggggacgcatctcagctcccagtggcaccgacaggcgaccagccctgtcaggctctgcccctgctctcgagtcagacaagtgtggctgaaagattggtggagcaacctcagctgcacccggatgtgagaacagaatgtgaaagcgggacgacctcctgggagtctgacgacgaagaacaggggcccaccgtgccagccgacaatgggccgattctgagcctggtaggcgatgatactctggagaaaggaacgggtcaagccttggactcacaccccaccatgaaggatcccgtgaatgtaaccccttctagcactccagagagttcgccaaccgactgtctgcagaatagggcttttgatgatgagctgggactgggcggcagctgtccccctatgcgtgagtcagatacaagacaggaaaacctcaaaacgaaggccttagtctctaactcgtcactgcattggattcccatcccatccaatgacgaggtggtcaagcagccaaagccagaaagccgggaacatattccttcagtggaacctcaggtgggggaagagtgggaaaaagctgccccaacaccaccagcccttcccggggatctgacagccgaggaaggcttggaccccctagacagccttacgtccctatggaccgtgccttctaggggcggatctgactctaatgggagctattgccaacaggttgatattgaaaaactgaagattaatggtgattccgaggcactctcccctcacggagaatctacagacactgcatccgattttgaagggcacttgactgaagatagcagcgaggctgacactagagaagcggccgtgaccaagggttcaagcgtggacaaggatgaaaagccaaactggaaccagagtgcccccctgagtaaggtgaatggtgacatgcggctggttacacgtacggacgggatggtggccccccaaagctgggtgtcccgcgtttgcgctgtgcgccagaaaattcctgattccctcctgttggcttcaacagaatatcagcctagggcagtgtgcttgtctatgcctggctcctcagtcgaagcaacaaatccgctagtgatgcagttgttgcagggctccctccccctggagaaagtgctaccccccgctcacgatgactctatgagcgagagcccccaagtgccgctcacaaaggaccagtctcatggatccttgagaatggggagcctacacggcttgggcaaaaattctggcatggtcgacggcagttcgcccagctccctgcgcgccctcaaagaaccactgttacccgacagctgcgagacaggtacaggattggctcgtattgaggccacgcaagcaccgggggcaccccaaaagaactgcaaggccgtcccatccttcgattccttgcaccctgtcactaaccccattacaagcagccgcaaactcgaagaaatggatagtaaggagcaattctcctctttctcttgtgaagaccagaaggaggtgcgtgccatgagtcaggacagtaactccaacgcagccccgggaaaaagccccggtgatctgacgacctccagaaccccgagatttagtagtccaaatgtcattagtttcggccccgaacaaacgggcagagcactaggtgatcaaagcaatgtgactggacagggcaaaaagctgttcggatccggaaacgtcgccgccaccctccagaggccaagacccgccgaccccatgcctctgcctgccgaaattccgccagtgttcccctccggcaaactggggcctagtacaaactcaatgtcaggcggggtgcagaccccccgagaggactgggcccccaaaccccacgctttcgtgggctcagtgaagaacgaaaagacatttgtagggggaccactcaaggcaaacgccgagaacagaaaagccacagggcattcgcccctggaattagtgggacacctggaaggcatgcccttcgtgatggatcttccattttggaagttgccgcgggaacccggcaaaggcctctccgagcccctggaaccttcaagcctgccgtcccagttgtcgattaagcaggctttttatgggaaattgagcaagctgcagcttagctcaacatcatttaattacagcagctcttcacctaccttcccaaagggtctcgcgggatccgtggtgcagctctctcacaaggcaaactttggggccagtcattcagccagcctgagtctccaaatgtttaccgattcatctacagtggagagcatctccctgcagtgtgcatgttcgctgaaagcaatgatcatgtgccaggggtgcggggccttttgccacgacgactgcattggcccgagtaagctgtgcgtcctgtgtttagtggtacgctag

SEQ ID NO: 107367 - DNA, 4389 bp, Artificial Sequence
  Description of Artificial Sequence: Synthetic coding sequence
atgctctctttccccaatctcaaccaagtgctagagaattattcagatgcccccatgactccaaaacagattttgcaggtgatcgaggccgaaggactgaaagaaatgagctcgggcacctctccactcgcctgcttaaacgcgatgctccattcgaactcccggggcggtgagggcctattttacaagcttccgggccgtatcagcctattcacactaaagaaagatgccctgcagtggtcacgccatccagcgaccgttgagggggaagaacccgaggatacagcagatgttgaaagctgtggatcgaacgaggccagtactgtgtcaggggagaatgatgtgtccctcgacgagaccagctctaatgccagctgctcaacggaatcccagtctcgcccactcagcaatccgcgcgactcctatagagcttctagtcaggccaacaaacagaagaagaaaaccggggtgatgctgccaagagtcgtgctgacccccctgaaggtgaacggtgcccatgtggaatcagcttccggccagatgaagcgaaatcggggcgaggaaattgactttgaaacccccgggtccatattagtaaacaccaacctaagagcactgataaattcacgaacctttcacgcactgccatctcacttccagcagcagctattgtttctcttacctgaagtcgacaggcaggtcggtaccgatggattactacgcttgagttcctcggcactgaataatgaatttttcacccacgccgcccaatcctggcgtgagcgactcgcggacggagagttcactcacgagatgcaagtgcgcataaggcaggaaatggagaaagagaagaaggtggagcagtggaaggaaaagttttttgaagactattacggtcagaaactgggcctcacgaaagaagagagcttacaacagaacgtgggccaggaagaggccgaaatcaaaagcggattgtgcgtgccaggagagtcagtaaggatccagcgcggaccggccacgagacagcgcgacgggcatttcaaaaagaggagccgacccgatctgaggactcgagcacgaagaaatctttataagaagcaggagtccgagcaggccggggtggccaaagacgccaaatccgtagcctctgatgtgcctttgtataaagacggcgaggcaaaaaccgatcccgccggactgtcctctcctcacctgcccggtacatccagcgcagctcccgatctggaggggccggagtttcccgtggaatccgtggcttcgcggatacaggccgagcccgataatctggcccgggcgtcggcctcgccggacagaatccccagcctgccccaggagaccgtggaccaggaaccaaaggatcagaagcggaaatctttcgagcaggctgcctccgcaagttttcccgagaaaaagccaagactagaagaccggcaatcatttcgaaacactatcgagtcagtacacactgagaaacctcagcccactaaagaggaacctaaagtgcccccaattcggattcagctgtccaggattaaaccgccatgggtcgtcaagggccagccaacctaccaaatttgccctaggataatacccactacggagtcatcatgccgaggctggaccggcgcaaggactctggccgacattaaagcacgtgctttacaggttaggggcgctagaggccaccattgccacagggaagccacagacgaaggaggcgggcgtgggtcctcctctggggacggcggggaggcctgcgggcatccggagcccagaggcggacccagcacacctggcaagtgcacaagcgacttgcagcggacccaacttttaccgccctatccgctaaacggcgaacacacccaggccggaactgccatgagccgggctcggcgtgaggacctcccgtctctcagaaaagaggagtcttgccttctccaaagagctaccgtgggccttaccgatggtttgggcgatgcgtcccagctccctgtggcccctaccggcgatcagccctgtcaggccctgccgcttcttagctcacagactagcgtagcagagaggttagtggagcagccgcaattacaccccgacgtaagaaccgagtgcgaaagcgggacaacttcttgggagagcgatgatgaagagcagggtccgacagtccccgcagataacggaccaatcctgtcactcgtcggggatgatacgttggagaagggcactgggcaggctttggattctcaccccactatgaaagacccagtaaacgtcacaccgtcaagtacccctgagtccagcccgaccgattgcctccagaatagagccttcgatgatgaactgggcctgggggggtcttgcccaccaatgagagagtctgacactaggcaggagaacctgaagacgaaggctcttgtttcaaacagctccctgcattggatcccaattccctccaacgatgaggtggtaaagcaaccaaaaccggaatctcgggagcacataccatctgtggagccccaggtcggtgaagagtgggagaaagccgctccgactcctccagctctgcctggcgatttaaccgcagaagagggactggaccctttggattcgcttacatccctgtggactgtgccaagcagagggggctccgacagcaacggatcatactgccagcaagtggacatcgagaagctgaaaatcaacggagattccgaggcactgtcaccccatggtgagtctacggacaccgcatccgatttcgaagggcatctaaccgaagattccagcgaggcagacacacgagaggcagcggtaacaaaagggagctctgtcgataaagatgaaaaacctaattggaaccagtcagctccgctgtccaaagtgaatggagacatgcgtctggtaacccgcactgacgggatggtggccccacagagttgggtgtcaagggtatgcgcggttcggcagaaaatcccagatagtttgctgctggcctcaactgaataccagccccgtgcagtctgtctgtctatgccaggaagtagcgttgaggcgacaaacccgttagtaatgcagctgcttcagggctcactgcctttggagaaggtgcttccacccgctcatgacgattctatgagcgaaagcccccaagtacctttaacaaaagaccagagccatggatctctgagaatgggctctctgcacgggctgggtaagaactcaggcatggtggatgggagttccccctcctccctgcgcgccctgaaggagcctctgcttcccgattcatgcgaaacaggcaccgggctggcgcgtatcgaggcaacccaagctcctggtgctccccaaaagaactgtaaggccgtacccagctttgattccctgcacccagtgactaaccccattacctcatctcgtaagcttgaagaaatggattccaaagagcagtttagttcattcagctgtgaggaccagaaggaggtcagagcgatgagtcaggactctaactcgaacgctgccccagggaagagccccggcgacctgactacctcacggacgccaagattctcctcccctaacgttattagcttcggacctgagcagaccggccgagctctcggcgatcaatctaacgtcacaggacaagggaagaagctgttcggcagtggaaatgtggcagcgactctgcagcgtccccgacccgccgatcccatgcctcttccggccgaaattccccccgtgtttccctcaggcaagcttgggccctccacgaatagtatgagcggcggagtgcagacccccagggaagattgggcccccaaaccccatgctttcgtaggaagtgtcaagaacgagaaaacattcgttggaggaccgctgaaggctaacgccgagaatcgcaaggccacgggccattcaccgttggagcttgtgggccatctggaagggatgccctttgtaatggatctccctttctggaagctcccccgtgaaccaggcaagggcctatccgagccactggaacccagctcactgccctcccaactgtctatcaagcaggctttctatggcaagctgagcaagctgcagctgagtagcacctcctttaattactctagcagtagccctacattcccgaagggtttggcaggcagcgtggtgcagctttctcacaaggcaaactttggtgcttctcactctgcctccttatcactccagatgttcacggatagttcaactgtggagagtatttcactgcagtgtgcctgcagtctgaaggcaatgatcatgtgtcagggatgtggagccttctgccacgatgattgtatcgggcctagcaaattgtgtgtgctttgcctggtggtgcggtag

SEQ ID NO: 107368 - DNA, 4626 bp, Artificial Sequence
  Description of Artificial Sequence: Synthetic coding sequence
atgaaggacaaacagaagaagaaaaaagagcggacatgggcagaagcagcaagacttgttctggaaaactactcagatgctcccatgaccccaaaacagatcctgcaggtgatcgaagctgagggcttgaaggagatgcgctccgggacctctccactggcttgtttaaatgccatgctgcactccaactcccgcggcggcgaggggctgttctataaactgcccggacggatcagcctcttcaccctgaagaaggatgcgttacagtggtcccgccaccccgcaaccgtggagggggaagagcctgaggacactgcagacgtggagtcctgtgggagcaacgaagcttcgacagttagcggagaaaacgacgtgtctctggatgagacttccagtaatgcctcttgctctacagagagtcaatcccgtcctctttctaatccccgggattcatatcgtgcctccagccaggccaacaaacagaagaagaaaaccggcgtgatgctgccgagggtggtgcttaccccactgaaggttaatggtgcacatgtggaatcagctagtggcttcagtggttgccacgccgatggtgagtccgggagccctagttcgagctctagtggatccctggctctgggatctgctgctatccgcggccaggcagaagtcacccaagaccctgcacccctgctgcgcggtttcaggaagcccgctactggtcaaatgaaaaggaacaggggagaggagatagattttgaaacaccaggaagtatcctggtcaataccaaccttcgcgcccttatcaattcacgaacatttcatgccctaccgtcccacttccaacagcaacttcttttcctcctaccagaggtcgatcgacaggtgggcacggacgggttgcttaggttaagtagctctgctcttaacaatgagttcttcactcacgccgcgcagtcttggagagaaaggttggccgatggtgaatttacccacgagatgcaggtgcgaattagacaagagatggagaaggagaagaaagtggagcagtggaaggaaaaattttttgaggactactacggtcagaagttgggcctgacaaaagaagagtccctccagcagaatgtcggccaagaagaggccgagatcaagagcggtctgtgcgtgcccggggagtctgtgaggatacagcgcggaccagctacccgccaaagggacgggcattttaagaaacgtagccgaccagacttacgaacgcgtgcccgccgaaacctatacaaaaagcaggagagtgagcaggcaggtgttgctaaggacgctaagagtgtagctagcgacgtgcctctttacaaggatggcgaagctaagaccgatccagctggtctgtcttcaccgcacctccccgggacctcttctgcagccccagatctggaaggtccggagtttcctgttgaatccgttgcatcaaggatccaagcggagcccgataaccttgcacgtgcgtccgccagcccagataggattcccagtttaccccaagaaaccgtggatcaggagcctaaggatcagaagagaaaatctttcgagcaggctgcctcggcaagttttcctgagaagaaaccaaggttggaggaccgacagtctttccggaacacaatcgagtctgtccatacagagaaacctcaacccacaaaagaagaaccaaaagtgcctcccattagaatccagctaagcagaataaagccgccctgggtggtgaaggggcaacctacataccagatttgccctcgcatcattcccactactgaatcttcttgtcgcgggtggactggggcccgcactctggccgacataaaagccagggctttacaagttaggggagccaggggacaccattgccacagagaagccgccactaccgccattggcgggggggggggcccaggaggcggagggggcggagctacggacgagggggggggacggggctcgagttcaggggatggtggggaggcatgcgggcacccagaaccacgcggtggtcccagcacgcctggcaagtgtacttcggacttacagagaacacaactgctgcctccctacccattaaacggagagcacacacaggcaggcaccgctatgtctagagcacgcagggaggatcttcccagcctgcgaaaagaggagagctgtctgctgcagagagccacagtgggcttgactgatggattgggggacgcctctcagttgccagtggcgcccacaggagatcagccatgccaggccctgccactgctcagctcgcaaacctcagttgcagaacggttagtggagcagccacagctacacccagacgtaaggacggaatgcgagtccggcaccacaagctgggaaagtgacgatgaggaacagggccccaccgtgccagccgataacggccccatcctttctctggtcggcgacgacaccctagagaagggaacaggacaggctttggatagtcatccaacgatgaaggatccagtcaatgtgactccttcatctacaccggaaagttcccctaccgattgtttacagaaccgggctttcgacgatgagctcgggttaggggggagttgtcccccaatgagggagtctgacactcggcaggaaaatctgaaaacgaaagcgctggtcagcaactccagtctgcattggatcccgatcccatctaacgacgaagtcgtgaagcaacccaaacccgaatcacgcgagcacataccatcagtagaaccccaagtgggggaagagtgggagaaggccgcccccacccccccagccctgccaggggatctgactgctgaggaaggtctggatccacttgatagtctgacttcactgtggactgtcccgagcagaggggggagtgattccaatggctcttattgtcagcaagtcgatattgagaagttgaaaatcaatggggactcagaagcactgtcaccacacggggaaagtaccgacacagctagtgatttcgaaggacatttgacagaagacagctccgaggccgacacacgagaggctgcggtgaccaaaggaagctcagtggacaaagatgagaaacccaattggaaccagagtgcgcctctgagcaaagttaacggcgacatgcgccttgtcactagaacggacggaatggttgccccacaatcctgggtgtcacgcgtgtgtgctgtgagacagaaaatcccagattccctattgctggctagtactgaataccaacctcgcgccgtgtgcttgtcgatgccagggtccagcgttgaggccactaaccccctggtgatgcagctgcttcagggtagcttgcccctggagaaagtgctgccaccagcacatgatgacagcatgtccgagtctccccaggttcctctcaccaaggatcaaagtcatggatcacttcgcatgggttccttacatggtctgggcaagaattcaggcatggtggatggcagttctccctcctccctgcgcgcactgaaggagccgctcttaccggatagttgtgagactgggactgggttggcccgtattgaggctactcaggcccccggggctccacagaagaattgcaaggcggttccaagctttgacagcttacatccggtgaccaaccccattactagtagtcgcaagctggaggagatggactctaaagaacagttttcgtctttcagctgtgaagatcagaaagaagtgagggccatgtcacaagacagtaacagcaacgcagcacctggcaaaagccctggagacctcaccacctccagaacgcctagattctcttccccaaatgtgatatcttttgggcccgaacaaacggggagagccttgggggatcagtctaatgtgaccggtcagggtaaaaaattatttgggagtggaaatgtagctgctactctgcagcgccctcgccctgctgacccaatgcccttgccagcggaaattccacccgtgtttccctccggaaaactgggcccctcaactaacagcatgagcggcggcgtgcagactcctcgtgaggactgggcgcccaaaccacatgcattcgtgggcagcgtgaagaacgaaaagactttcgtgggcggcccattgaaggcaaacgctgagaacagaaaagccactgggcacagccccctggaattggtggggcatcttgaaggaatgccattcgttatggacctgccattctggaaactacctagggagccaggcaaggggttgtccgagccattggagccaagttcgttgccttctcagctatccattaagcaagcgttctacggtaagctctctaagctccagctgagctctaccagtttcaattattcttctagctcgcctaccttccccaagggattagcagggagcgtcgtacagctgtcccacaaagctaattttggcgcaagtcatagtgcctccctatctctgcagatgttcacggattcaagtaccgtcgagtctatctcgctgcagtgtgcatgctcattgaaagctatgattatgtgccaaggctgcggagccttttgtcacgacgactgtatcggtcctagcaagctctgtgtgctatgcctagtagtgagatag

SEQ ID NO: 107369 - DNA, 225 bp, Artificial Sequence
  Description of Artificial Sequence: Synthetic coding sequence
taatgggcagaggcagcgagactcgtgcttgaaaactactcagatgcccctatgaccccaaaacagatcctgcaagtgattgaagcagaaggtcttaaggagatgcgctctgggactagccccttagcctgtctcaatgctatgctccactcgaattctaggggtggcgaggggctcttttataagctgcccggtcgcataagtcttttcacactgaaggtgtag

SEQ ID NO: 107370 - DNA, 258 bp, Artificial Sequence
  Description of Artificial Sequence: Synthetic coding sequence
atgaaagataaacagaaaaagaaaaaagagagaacttgggcagaggccgccagactcgtcttagagaactatagcgacgctcctatgactcccaagcaaatcctgcaggtgattgaggctgaaggtctgaaagaaatgaggtccggcacctcaccattagcatgtctcaatgctatgctgcactcgaactcaagaggcggagaagggcttttttacaagctccctgggcgaatatccctatttacacttaaggtatag

SEQ ID NO: 107371 - DNA, 255 bp, Artificial Sequence
  Description of Artificial Sequence: Synthetic coding sequence
atgaaggacaaacagaagaaaaagaaagagaggacctgggccgaggcagctagattggtcctcgaaaactattcagatgccccaatgactcctaagcagattctccaggtgatcgaggctgaggggctgaaggagatgtctgggacatcccccctggcttgtttaaatgcgatgctgcatagtaacagtcggggcggagaggggcttttttacaagctgcctggcagaatatcattgttcactctgaaacgttag

SEQ ID NO: 107372 - DNA, 2757 bp, Artificial Sequence
  Description of Artificial Sequence: Synthetic coding sequence
atgaagcggacaaaatgtgccgatatagacgtggagaccccagattctatactggtgaacaccaacttgcgggccctaattaacaaacacaccttcagtgtcttgccaggggactgtcagcaacggctccttttattgctgcccgaagtcgatagacaagtcggccccgacggacttatgaaactgaatggtagcgccctcaacaatgaattttttacatccgccgctcagggctggaaagagcgactgtcagagggcgagtttacccctgaaatgcaggtccgcattaggcaggaaatcgaaaaggagaaaaaggtcgagccttggaaggagcagttcttcgagagttactacggccagtcctccgggttgtctcttgaggatagtaagaaattgaccgcaagtccatcagacccaaaggtgaaaaagacacctgcggagcaacctaagagtatgccagtatctgaagcttcgttgatcagaatagtgcccgtggtgtcgcagtcagaatgcaaggaagaggcacttcagatgtctagccctggcagaaaggaagagtgcgagagtcagggcgaggtccagcctaatttttctacctcctcagagcctttactaagctcagccctcaacactcatgagctctcctcgatcctgcccattaaatgccccaaagacgaggatcttctcgaacagaagccagtaacgtccgctgagcaggaaagcgaaaagaatcacctcacaaccgcatcaaactacaataaatccgagagtcaggaatccctggtgaccagcccctcaaaaccgaaaagtcccggcgtggagaaacccatcgtgaagcccactgcaggcgcaggcccacaagaaacaaatatgaaagagccattggccacactagtagatcaaagccccgaatcattgaagcgcaagagttcactgacacaggaggaagcccccgttagctgggaaaagcgccctcgcgtgaccgagaatcggcaacatcagcaaccttttcaagtttctccccagccatttctgaataggggggatcgaatacaggtgagaaaagtacctccacttaaaataccagtctcaagaataagtcctatgcctttccacccctcccaggtgtcacctagagcccgatttcccgtcagcattacgagtcccaacagaactggagccagaaccttggccgatatcaaagctaaagcgcaacttgtgaaagcccagagagccgcggcagcagctgctgccgctgctgctgctgcagccagtgtgggtggcacaattcctggaccagggccaggaggaggccaaggccccggcgagggcggagagggccaaaccgccagaggcggcagccccgggtccgaccgcgttagtgagacagggaaggggcctacacttgaactagccgggaccggttctcggggaggcacgcgggagctgcttccgtgtggcccagagacacagcctcagagtgagactaagactacccctagccaagcccagccacacagcgtctctggggctcagctccagcagactcctcccgtcccccctactccggccgtgtccggggcctgcacaagcgtcccatcccccgctcatatcgagaaacttgacaacgaaaagctgaatccaacacgggccaccgccaccgtcgcatctgtatcccatccacaaggcccctcctcctgtcggcaggagaaagccccatcaccgacagggtttcaacttgaagacatatccacatcgcagagatttatgttgggatttgccggcagaaggacgagtaagccggctatggccggacactatctgttaaatatctcaacatacggacgaggatcggagagcttccggcggacacactcagtgaaccctgaggatcgcttctgcctgagtagccccaccgaagctctgaagatggggtatactgattgcaagaacgctaccggcgaaagcagctcatccaaagaggatgataccgacgaggaaagtaccggagacgaacaggagagcgtgacagtgaaggaagaaccacaggtcagccaatccgctggcaaaggcgacactagttcaggaccccacagccgagaaactctttccacctccgattgtctagcgtcaaagaacgtaaaggctgagatcccactaaacgagcagactacattatcaaaggagaattatctgtttacccgtggccagacgtttgacgaaaaaacgctggccagggatctgatccaggccgcccagaaacagatggcccacgctgttagaggtaaagccattcgcagtagtcctgaactgtttagctccacggtgcttcctctgccagcggactctccaacccaccagcctctattgctgccaccgttgcagacgccaaaactgtacggatcacccacccaaatcggcccaagctatcggggaatgataaacgtgagcacttcttcggacatggaccacaattccgctgtgccaggatcacaggtctcttcaaacgtaggagatgtcatgtctttctcggtgaccgtcaccaccattccagcatctcaggccatgaacccttcttctcacggacagacaatccctgttcaagctttttctgaagaaaacagcatcgaaggtaccccaagtaaatgctattgtaggctgaaggctatgatcatgtgcaagggctgcggagcattttgccacgacgactgcatcggaccttctaagctgtgtgtgtcatgtctcgttgtgcgttag

SEQ ID NO: 107373 - DNA, 4224 bp, Artificial Sequence
  Description of Artificial Sequence: Synthetic coding sequence
atgtcacacaaagaaattctgcaggtgatacagcgggagggactgaaggagatctcctctgggacctctcccctggcatgcttaaacgccatgctgcacaccaactccaggggagaggagggcatcttctacaaggtgcccggccgcatgggagtctatacccttaaaaaagacgtgcccgacggtgtcaaagagctgtcagagggtagcgaggagagttccgacgggcagtcagactctcagagctcagagaactcatctagtagctccgatggaggctcgaataaggaagggaagaaatctcgctggaaacggaaggtgagctcatcttccccccaaagcggctgcccaagccccactataccagccggcaaggtgattagccctagccagaagcactccaaaaaggcgctgaaacaagccctcaagcagcaacagcaaaagaagcagcagcagcaatgccgtcccagcatctcgatctccagtaaccagcaccttagtctgaagaccgtgaaagccgcaagcgacagtgtgcccgctaaaccagcaacatgggagggaaaacagtcggatggccagactgggagtccccagaattctaactctagtttttcctccagcgtgaaggtcgagaatacactgttagggctgggcaaaaagtcttttcaacgtagtgagagattacatacacgccagatgaaaagaacaaaatgcgcagacatcgacgtggaaacaccagattcgatcctagttaacacaaacttgcgggctttgattaataagcacactttctccgtactcccgggagactgccagcagagattgctgctccttctgcctgaggtcgatcgacaagttggtcctgatgggctcatgaagcttaacggttcagctctcaataacgagtttttcaccagcgctgcacaaggctggaaggaacggctctccgagggcgagttcacccctgaaatgcaggtgagaatccgacaggaaatcgagaaagaaaaaaaagtggaaccttggaaagagcagttcttcgaaagctattacgggcagagctccggcttgtccttggaggattccaaaaagctgacggccagcccctctgacccgaaggtcaagaagacccctgctgagcagcccaaatccatgcctgtgagtgaggcttctctgattagaatagtgcccgtggtgtcccagagcgagtgcaaggaggaggcattgcagatgtcatctcccggaagaaaggaggaatgcgagtctcagggagaggttcagcctaacttttcaaccagcagtgagcctttattgtcctccgccttaaatacacatgagctctcatctatccttcccattaagtgtcccaaggatgaggatctgttagaacagaaacctgtaacgtctgcggagcaggagagcgagaaaaaccatttaacgaccgcgtccaactataataagagcgaaagtcaggaatccctggttacgtcccccagcaagccaaagtccccaggcgtggagaaacctattgtcaagccaaccgccggtgctgggcctcaggagaccaatatgaaagagccactcgccactctggtggaccagagtcccgagtctctgaaaaggaagtcaagcctgacacaggaggaggccccggtctcatgggagaaacgtcccagagtgacagaaaaccgccagcaccaacagccttttcaggtgagcccccaaccattcctgaatcgcggcgatagaatccaagtccggaaagttccacccctaaagattccagtatcccgtatttcccctatgcccttccatccgtctcaagtgagcccaagggctcgattcccagtgtcaatcacaagcccgaataggacaggtgctaggaccctggccgacataaaggcaaaagcccaactggtcaaagcacagcgagcggctgcggctgccgcggcggcggcagcagccgctgcctctgtgggcggtactatcccgggcccagggccaggtggcggacaggggcccggagagggaggggagggccaaacggctcgaggggggagtcccggatctgaccgggtcagtgagacaggaaaaggacctactctcgagcttgccgggacgggaagtcgcggcggtactcgggaactgcttccttgtggtcctgagacacagccccagagtgagaccaagacgacaccctcccaggcgcagccacacagcgtgtccggggcccaacttcaacagactccgcccgttcctccgactccagcggtgagtggggcatgcacatcggttccaagtcccgcacacatcgaaaaactcgacaatgagaagctcaatcccacaagagcgaccgccacggtagcctctgtgtcacacccccaaggtccaagctcatgtaggcaggaaaaggcgccctcccccacggggcccgcactgatttctggggcttcacccgtccattgtgccgcagatggaactgttgaactgaaagctgggccatctaaaaatatcccgaatccatctgcttccagtaagacagacgcttccgtgccagttgcagtgactccatcaccgctaacctcactgctgactacagctaccttagagaaactgcctgtacctcaggtgtcggcaactacagcgcctgcaggaagtgctccacctagctccaccctgcctgctgccagctcactcaaaacacccggaacatcattgaacatgaacggcccaacgttgcggcctacttcatctatcccagctaacaaccctctggtcacacagttgctgcaaggaaaagacgtgccgatggagcagattttacccaaacctctgaccaaagtcgagatgaaaacagtgccacttaccgctaaggaggagagaggcatgggagccctgattgccaccaacaccactgagaactcaacccgtgaagaggtgaatgaacggcagagtcaccccgctacccagcaacagctgggcaaaacgctgcagtccaagcagctgcctcaggtaccccgccccttgcaactgttctctgcaaaagagttacgggactcatccatcgacacacatcaataccacgagggactgtctaaagccacccaggatcagattctgcagaccttgattcaaagagtgcggcggcaaaacctgttatcggttgttcccccatctcaattcaatttcgcccacagtgggttccagctcgaagacatctctacgtcccagcgatttatgctgggatttgccggtcggagaacctccaagcccgctatggctggacattacttgcttaacatctctacttacgggcggggctcggagtcctttagaaggacccacagtgttaaccccgaggaccgtttttgtttatcgtcccccacagaggcgctgaagatgggatacacagattgtaagaatgccacaggggagtccagctcatccaaagaggacgatactgatgaggaatctactggggatgagcaggaaagtgtgacagtgaaggaggagccacaggtcagccagtcagcagggaaaggggataccagtagtgggccacattcgcgcgagacccttagcacttctgattgtcttgcgtcaaagaatgtaaaggcagagatccctctgaatgaacagacaacattatccaaagaaaactatctcttcacccgcgggcagaccttcgacgagaagaccctggcccgggaccttattcaggccgcgcagaaacaaatggctcacgcggtcaggggtaaagccattaggtcttctccagagctgttcagcagtacagtgctccctctccctgccgacagcccaacacatcagccactgttgctcccccctctgcagacccctaaactctacggctcacccacacaaatcggcccttcctaccgggggatgattaacgtttccacctctagtgacatggatcacaactccgccgtgcctggatcacaagtgtccagtaacgtcggcgatgtgatgagtttttcagtgaccgtgaccaccattccagcttctcaggctatgaacccctcctcccacggacagaccattccagtccaggcgttttccgaagagaacagtatcgaaggtactccaagcaagtgttattgtcgattgaaggcaatgattatgtgcaaagggtgcggggccttttgtcacgatgattgtatcgggccttccaaactctgcgtttcttgtctcgtggtgagatag

SEQ ID NO: 107374 - DNA, 2757 bp, Artificial Sequence
  Description of Artificial Sequence: Synthetic coding sequence
atgaagagaactaaatgtgcagatatagacgtagagacccccgattcgatcctcgtgaacaccaatttgcgcgccttgattaataaacacacattttccgtgctccccggggactgccaacaacgactgctcctgttattgcctgaggttgatagacaggtgggacccgatgggttgatgaaactaaatggtagcgcacttaacaatgaatttttcacctcagccgctcagggatggaaagagaggctgtccgagggcgagttcactccagagatgcaggttagaatccgccaggagattgaaaaagagaagaaagtcgaaccttggaaagaacaatttttcgaatcatattacggacaaagcagcggactttcactggaagacagcaagaagcttacagcctcccctagtgaccctaaagtgaaaaaaacaccagcggaacagccgaaaagcatgcctgtttctgaggcctccctgatcaggatagtgcccgttgtgtcgcagtcagagtgtaaggaagaagcactgcaaatgagttcccctggaaggaaggaggagtgtgaaagtcagggcgaagtccagccaaacttttctacttcttcggaacccttgctgagttctgccctcaacacgcatgaattgagctcaatactgcctattaagtgcccgaaagacgaggacctccttgagcaaaaaccggttacctctgcggaacaggagtctgagaagaatcacctaactacagctagtaattacaataagagtgagtctcaagagtctctcgtgacttctcctagcaagccaaagagtcccggagtggagaaacctatcgtcaagcctaccgccggggcaggcccacaggaaacgaatatgaaggagccgctggcaactctcgtagatcagtctccagagtcgctcaaacgcaagtcctcactcacacaggaagaagcgccggtgtcttgggaaaagcgaccccgagttacagaaaatcgccagcaccagcaaccgttccaggtgagccctcaacctttcctgaatagaggagaccgcatacaggtgcggaaagtgccccctctgaaaatccctgtgagcagaatttcccccatgccatttcacccctcacaggtgagtccaagagctaggttccctgtgtcgattacaagccctaatcggacaggtgcccgcacgttggccgacatcaaggcaaaggcccagttggtgaaggctcaaagagccgccgccgcagccgcagccgccgccgcagccgccgcttctgttggcgggaccatcccagggccggggcctggcggagggcaaggacccggggaaggaggtgaggggcagactgcacgtggtggtagcccaggtagcgatcgggtgtctgaaactggaaaggggccaaccttggagctcgccgggaccggatccaggggcggaaccagagagctgcttccctgcggccccgagacccagccacagagcgagacaaagaccactccctcgcaggcccagccccacagtgtgagcggtgcccaactgcagcagactccacccgtaccgcccacacccgctgtgagcggagcttgcacatctgtccccagcccagcacatatcgaaaagctcgacaatgagaaactgaacccaacaagagccactgcgactgtggcttctgtgtcccacccacagggccccagctcatgtcggcaggagaaagctccctcccctacaggttttcagctggaagacatctccacaagccaaagattcatgcttggcttcgcaggccgaagaacgtccaaacctgcgatggccggccactacctccttaatatctctacctatggacggggatctgaaagtttcagacggacccactctgtgaaccccgaggatcggttctgtctgagcagtccaacagaggctttaaagatgggctacactgactgcaagaacgctactggagagagctccagtagtaaggaggatgacacagacgaagagtcgaccggagatgaacaggaatctgttacagtgaaagaggagcctcaggtgtcacaatccgccggaaagggcgatacgtcaagtgggcctcactccagagaaacactcagtaccagcgactgtttggcaagcaaaaatgtgaaagctgaaataccattgaatgaacagacgaccctttccaaggagaattacctattcacacgcggacaaactttcgatgagaaaaccctggccagagacttgatccaggcggcccaaaaacagatggctcacgccgtcaggggcaaagccattaggtcctcccccgagctcttttccagtacagtgttgccactgccggccgattcccccacacaccagcccctcctgctgcctccactgcagactcctaagctctatggcagcccgacacagatcggcccgagctacagaggcatgattaacgtttccacatcttccgatatggaccataactccgcagtccctggctcacaggtgagtagtaatgttggtgatgtgatgtcattctccgtaacagttaccaccattcccgcgagtcaggcaatgaacccctcctctcatggccagacgattcccgtgcaggccttttctgaagagaactccattgaagggactcctagcaagtgctactgtcgcctgaaagcgatgatcatgtgtaaagggtgcggtgctttctgtcacgatgactgtatcggacctagcaagctgtgcgtcagctgcctggttgtgcgttag

SEQ ID NO: 107375 - DNA, 4308 bp, Artificial Sequence
  Description of Artificial Sequence: Synthetic coding sequence
atgagggaaaaaggccggagaaaaaaaggcagaacctgggcggaagccgcgaagacagttctggagaagtatcctaatacccctatgagtcacaaggagatcctgcaagtcattcaaagagagggcttgaaggagatcaggtccgggacctctcccttagcatgtctgaacgcgatgctgcacacgaattctcgtggagaagaaggcatcttttacaaagtcccgggcaggatgggagtttacaccctgaaaaaggatgtgcccgatggagttaaagagttgtctgaaggaagtgaggaatctagtgacggtcaaagtgatagtcagtccagcgagaactcctcaagcagttccgatggagggtcgaacaaggagggcaaaaagtctcggtggaaaagaaaagtgtcctcctcctccccccagtctggctgtccaagtcccacaattccagccggcaaagttatttccccaagtcagaaacatagcaaaaaggccctgaaacaagctctgaagcagcaacaacagaagaagcagcaacagcagtgcagaccttctattagcatctccagcaatcaacaccttagcctgaagacagttaaagcagcttccgactcagtcccagccaagcctgccacttgggaaggcaagcagagcgacggtcagactggctccccccagaattcaaacagttcattttcctccagtgtcaaagtggaaaacacactgctgggcttaggtaagaagtccttccagaggtcagaacgtctgcatacccgccagatgaagcggaccaagtgcgcagacattgatgtggaaacccccgactctatactagtcaatacaaatttgagggccctcatcaataagcacacttttagcgtgctgcctggcgactgccagcagagacttctcctccttttaccggaggtcgacagacaagtggggcccgacggccttatgaagttaaacggaagcgctctcaacaacgagttctttacctccgccgctcaagggtggaaggaaagattgtctgaaggcgaattcacacctgagatgcaagtgaggatcagacaggagatcgagaaggagaaaaaagtggagccatggaaagaacagttctttgagtcctactacgggcaatctagtggactgtctttagaggattctaagaaactgacagcaagtcctagtgacccaaaggttaagaagacaccagccgagcagcccaaaagcatgcctgtttccgaagctagtctcatcaggatagtacccgtggtcagccagagtgaatgtaaagaggaagcactgcagatgtcaagtcctgggcgaaaagaggagtgcgaaagccagggcgaggtgcagcccaactttagcacatcatccgaaccccttctgagttccgcccttaatactcacgaactctcaagcattctgcccataaaatgccccaaagacgaagacctgttagaacagaagccagtgacctccgcagagcaggaaagtgagaagaatcatctgactacggctagtaactataacaaatctgagagccaggagagtcttgtgaccagcccttctaagccaaaaagcccaggggtggagaaaccgatagtcaagcctacagccggcgcaggtccccaagaaaccaatatgaaagagccactagcaaccctcgttgaccagtcccctgagagcctaaagaggaaatcatccttgactcaagaggaagcacccgtgagctgggagaaacgcccaagggtcaccgagaaccgtcaacatcagcaaccctttcaggtatcacctcagccatttctcaacagaggggacagaattcaagtgcggaaagtgcctcctctcaaaataccagtgtcgcggattagccctatgccatttcacccttcccaggtctcaccgcgcgcacggttcccagtctcaattacctctccgaaccggaccggcgccaggacactggctgacattaaggccaaagcgcagctagtgaaagcgcagagggcggccgctgccgctgcagccgccgccgcggctgcagcctctgtggggggaactatccccgggccgggccccggcggaggtcagggccctggagaaggtggcgaagggcaaactgctagagggggcagtccaggatccgacagggtgtccgagaccgggaaaggtccgactctcgagctggcaggaaccggctctcgaggggggaccagggagttactaccctgtggacccgaaacacagccgcagagtgagaccaaaaccacccccagccaggcccaaccccactcagtgtcgggggcgcagctgcagcagacccctccggtgccgccgactcctgctgtgtctggagcgtgcaccagtgtcccatcccctgctcacatcgaaaaactggacaatgaaaagttgaatcccacgcgcgccacagctacggtcgcaagcgttagccatccacagggtccctcttcatgccggcaggaaaaggctccgagcccaactggtccagccctgatcagcggtgcctcccccgtgcattgcgctgccgacggcacagtagaactgaaagcaggtccaagcaaaaatatccctaacccgagtgcctcgagtaagacggatgccagcgtgcctgtcgctgtaactcctagcccactgacctccctcctgacaaccgctacactggaaaaactgcccgtaccccaggtgtctgcaactaccgcacctgcgggcagtgctccgccttcttcaacgctgcctgctgcttcctcgctgaaaaccccgggaacatctctaaacatgaacggaccaactctgaggcccacctccagcattcctgcgaataatcctctggtgactcagctcctgcaggggaaagacgtgcctatggagcaaatactgcccaaacctctaacgaaagtcgagatgaaaactgtgcctttgacagcaaaggaggagagagggatgggagccctcatcgctaccaacactaccgagaatagcactagagaggaggtcaacgaaagacaatctcacccggctacccagcagcagcttggaaagactcttcagagcaagcaactgcctcaggtcccccggcctctccaactgttctctgctaaagagctgagggattcttcaatagatacccatcagtaccacgagggtctttccaaggccacgcaggatcagatacttcagaccctgatacaacgagtgcgcagacagaacctcctgtccgttgtgccgccgagccagttcaatttcgcacacagcgggttccagcttgaagatatatccacatcccagagatttatgttggggtttgccggaaggaggacatcgaagccagcaatggccgggcactacctgctaaatatctcgacatacggccgtgggtcagagtccttcaggaggactcacagtgtcaatcctgaggacagattctgcttgtccagtcctaccgaggctttaaaaatgggatacactgactgtaaaaatgctacaggggagagtagttcctccaaggaagacgacactgacgaggagagtaccggagatgaacaggaatccgtgacagtgaaggaggagccacaagttagccagtccgccgggaaaggtgatacttctagcggaccccatagcagagagactctgagcacgagcgattgcttagctagtaagaacgtcaaggccgagattccactgaacgaacagaccaccctcagcaaggaaaattacctgttcacgcgggggcaaacgttcgacgagaaaacactggccagggacttgattcaggccgcccaaaaacagatggcccatgccgttcgaggcaaagcaatcaggtcctcacctgagctgttcagctctacagtcctgccgttaccggccgactccccgacgcatcagcctctgttgctcccccccctgcaaacccccaagttgtatggcagccccacccaaatcggtccgagctatcgaggcatgatcaatgtgtctacttcatcggatatggaccacaactctgctgttcccggatctcaggtctcctccaacgtgggcgatgtaatgtccttttccgtgaccgttacaacaatccccgccagccaagctatgaacccatccagccacgggcagactatcccagtgcaggccttttccgaggaaaactcaattgagggaactcctagcaaatgctactgtagactaaaggctatgattatgtgcaagggctgcggggccttctgccatgatgattgtattgggccctctaaactctgcgtgtcttgtctggtggtcaggtag

SEQ ID NO: 107376 - DNA, 6747 bp, Artificial Sequence
  Description of Artificial Sequence: Synthetic coding sequence
atgaaagacaaacggaaaaagaaagatcggacgtgggcagaggccgctagactggccctggagaaacaccccaatagtcccatgacagccaagcaaatcctggaggtgattcagaaggaaggtctcaaagagacgtctggcacttctcccctcgcatgcttgaatgccatgcttcacacaaatacccgtattggggatggcactttctttaaaatacccggaaaatctggcctctacgcactgaaaaaggaagagagtagctgtcctgcagatggcactttggaccttgtatgtgagagcgaactggacggaactgatatggcggaggccaacgcccatggcgaggaaaacggtgtttgctctaagcaggtgacagatgaggcgagcagcacccgggactcctcgctcaccaacacggcggtacagtccaagctggtctctagctttcagcagcacacaaagaaggccctgaaacaggcactcaggcaacagcagaaacgccggaacggggtgagcatgatggtcaataaaacagtgccacgtgttgttctgacccctctgaaagtgtctgatgaacagtctgactcaccaagcggctcagagagcaagaatggcgaggccgactctagtgataaggaaatgaaacacggccagaagtctcctaccggtaagcagactagccaacacttgaaaagattgaaaaagtcggggctgggacacctaaagtggacaaaggctgaggacatcgacattgaaacaccagggtcgatcttggtgaatacaaacttgcgagcgctgataaataaacatacctttgctagtcttccccagcatttccagcagtaccttctacttttactgccagaggtggatcggcaaatgggttccgatggcatcctgcggctgtcaaccagtgcactgaataacgagttcttcgcttatgccgctcaaggctggaaacagcgtcttgctgagggggaatttacacctgaaatgcagctgaggatacgtcaggaaatagaaaaggaaaaaaaaacagagccttggaaggaaaagtttttcgagcgcttctatggagaaaaattggggatgtcccgggaggaaagtgtgaagcttactacagggccaaataatgcaggagcacagtctagctccagctgcggcacctccgggcttcctgtatccgcccaaaccgccctcgcagaacaacagcctaagagtatgaaaagcccagcaagtccagagcccgggttctgtgccactctgtgccctatggtcgagatcccgccaaaggatattatggctgagttggagtcggaggatatcctcatccccgaggagtcagtgatccaagaggaaatcgccgaagaagtggagacgtctatctgcgaatgtcaagacgaaaatcataagacgatcccagaattttctgaggaggccgaatccctgaccaattctcacgaggagcctcagattgccccacccgaagacaacttagagtcttgtgtgatgatgaatgatgtgctggagaccctgccgcatattgaagtcaagatcgaaggaaagtccgagtccccccaggaagaaatgacggtggtgattgaccaactcgaggtgtgcgacagcctgattccaagcacatctagcatgacacatgttagtgacacggagcacaaagagtcagagacagccgttgaaacgtccaccccaaaaatcaagactggctccagttccttggagggacagtttcccaacgaaggcatagcaatcgacatggagctgcaatcagatcccgaagagcagctatctgagaacgcatgtattagcgagacctctttctcaagcgagagtccagagggggcctgcacatctctgcccagccccgggggagagacccagagcacaagcgaggaatcttgcacccccgccagcctggaaactacattttgtagcgaggtcagttctaccgagaacacagataagtacaaccaacgcaattctacggatgaaaattttcacgcatcgctgatgtcagagatctccccgatttctacaagtcccgagatatcagaggcgtctttgatgtccaacctacccctgacttccgaagcttcacctgtctccaatctgccgcttacaagcgagacttcccccatgagtgatttgcctttaacaagtgagacaagtagcgtgagttcaatgctgttgacttcggagacaacctttgttagttcactgcctctaccaagcgaaacctcgccgattagcaatagctccatcaacgaacgcatggctcaccagcagcgcaagtcaccctccgtctctgaggagcctctgagcccccagaaggacgaaagttcagccactgccaaacctctcggggagaacttgacatcccaacagaagaacctgagcaatacacccgagcccatcataatgagttcttcttccatcgccccagaggcttttccaagcgaagacctacataacaagaccctgagccagcaaacatgtaaaagtcatgtggatactgagaagccataccccgccagtattccagagttagcgtccactgaaatgataaaagtcaagaaccacagcgtcctccagcggaccgaaaagaaagttttaccttccccactggaactgtccgtgttcagtgaagggacagacaacaaggggaatgagctgccaagcgccaaattgcaggataaacagtacatcagttctgttgataaggcccccttttcggaaggttctcggaataaaacccataagcaaggttcaacccagtcccgcctggaaacaagccatacttctaagtctagcgagccatctaaatcacctgatggtatcagaaatgaaagccgcgatagcgaaatcagtaagcgcaagactgctgagcagcatagttttgggatctgtaaagagaagcgggcgaggattgaggatgatcagagcacgagaaatataagctcttcttctcctccagagaaggagcaaccacccagagaagaacctcgagtgccgcctctgaaaatccagcttagcaagattggaccaccatttatcattaaaagccagcctgttagcaaacccgagtccagggcatcaacaagtacctccgtcagcggtggccgcaacaccggtgctcgaaccttagcagatatcaaagccagggcccagcaggccagagctcagagggaagccgccgcagctgctgccgttgctgcagccgcctctattgtgtccggagctatgggctcgcccggcgaaggtggcaaaacacggactctcgcccacatcaaagaacagactaaggctaagctattcgcgaaacatcaagccagagctcacctgttccagacttctaaggaaacccgactgcctcctccgctatcatcaaaggagggcccccccaatcttgaagtgagcagtaccccagagactaagatggaaggatcaacaggtgtgataatagtgaatcccaactgtagatctccctccaataagagtgctcatttgagggagacaacaactgtgctccaacagagcctgaacccaagcaaacttcctgaaaccgctaccgatctaagcgtccacagctccgatgaaaacattcctgtttctcacctgtccgagaagatcgtgagttctacgtcctcggagaactcatccgtgcctatgctgttcaataagaacagcgtcccggtcagcgtgtgctctaccgccatcagcggggccattaaagagcatcctttcgtgagtagcgtggacaagtctagtgttctaatgagcgtggattctgctaatacaacaatctctgcttgtaacatatccatgcttaaaaccatccagggtacagatacaccctgcattgctatcattccaaagtgcatagaatcaactcccattagcgccacaaccgagggatccagcatttcgagctcaatggatgacaaacagctcctgatctcatcttccagcgccagtaatctcgtttcgacccagtacactagcgtgcccacaccaagtataggaaataacctgccaaatctctctacatcttctgtgctaattccaccgatgggcatcaacaaccgctttccgagtgagaagatcgctatccccggatctgaggagcaggccaccgtaagtatgggcaccaccgtccgcgcagcgttgtcatgttcagatagcgtggctgtgaccgattccttagtcgcgcatccaaccgtggccatgttcaccggcaatatgttgacaattaatagttacgacagccctcctaagctgagcgccgagagcctcgataaaaactctgggcctcgaaacagggcagataactctgggaagccgcagcaaccacccggaggctttgctcccgctgcaattaaccggagtatcccttgcaaggtcatagtcgaccattccacaacattaacgagttccctgtctctcaccgtaagtgttgagtcaagcgaggcttctcttgacctccagggacgtcctgtccgtactgaggccagcgtccaacccgtcgcttgcccccaagtaagtgtcatttctcgtccagaaccagtggcaaacgaaggcattgatcattcctcaaccttcattgcagcctccgcagctaagcaagattccaaaaccttgcctgccacttgtaccagcttgagggaacttccactagtcccagacaagctgaatgaaccaacagcaccgtcgcataattttgccgaacaggccagaggacccgcgccgttcaaatcagaagccgataccacatgtagtaatcagtataatccaagtaaccggatctgttggaatgacgatgggatgcggtccactggccagcccctggtgacccattccgggtcctccaagcagaaagaatatcttgaacagtcttgtccgaaggccatcaagacggagcacgctaactacttgaatgtgagtgagctccatccgagaaaccttgttaccaatgttgctttgcctgtcaaaagcgaacttcatgaggccgataaaggcttccgtatggacacagaagacttccccggtcctgagttacctcccccagctgccgaaggggcctcatccgtccagcagactcagaatatgaaggcatccacatcatctcccatggaagaggctatcagcctggctactgacgccctaaaaagggttccgggcgcaggctcatccggatgcagactgagctccgtcgaagcaaataaccctctagtgacacagctcctccagggaaacctccccctggaaaaggttcttccacaacctcggctgggggcaaaactggaaattaaccggctgccgctcccgctccagactacatccgttgggaaaactgcccctgaacgcaatgtcgagatccctccttcatcccctaaccccgatggcaagggatatctcgccggcaccttagcccccttgcagatgagaaaacgggagaatcacccaaagaagagggtagcaagaactgttggtgagcatacgcaggtgaagtgcgaacccggaaaactcctggtggaaccagacgtgaaaggcgtcccatgtgtgatctcaagtggcatctcacagctgggtcattcccagcctttcaaacaggagtggctcaacaaacacagcatgcagaataggatcgtacactcccctgaggtgaagcaacagaagcgcctccttccatcatgctcttttcaacagaatctgttccacgtcgacaagaatggaggtttccacacagatgccgggacgtcccatcgccagcaattttaccagatgccagttgccgccaggggccccattccgactgccgctctgctgcaagcctccagcaaaacgccagtggggtgcaatgcattcgcctttaacagacacctggagcaaaagggactgggtgaggtgtcgctgagctccgcgccacatcagctgaggctcgccaacatgttatcccccaacatgcctatgaaggaaggggatgaagtcggagggacagcacataccatgcctaacaaggctcttgtgcacccccctccaccccctccgcccccaccgccaccaccattagcactgccaccgccgcctcccccccctccccccctccctccacccctgcccaatgctgaagtgccttccgatcagaaacagcccccggttacaatggaaactacaaagcggctctcctggcctcaatcgaccggaatctgttctaatattaagagcgaaccactgagtttcgaagagggcctgagctcttcttgtgaactcggaatgaaacaggttagttacgatcagaacgagatgaaagaacagctgaaagcctttgcccttaaaagcgccgattttagctcatatctgctgtcagagccccagaagccttttactcagctggccgctcagaagatgcaggttcagcagcagcaacaattgtgcggaaattatcctacaatccatttcgggagtacatcatttaagcgcgccgcatcagccattgagaaaagtattgggatcctcggcagcggctctaacccagctaccggtctatccggtcagaatgcccaaatgcctgtacaaaatttcgcagactcctccaatgcggacgaactggagctgaaatgctcatgcagactaaaggcgatgatcgtgtgtaagggctgcggagctttttgccatgacgattgcatcggtccctcaaaactgtgtgtggcttgtctggtcgtgcgttag

SEQ ID NO: 107377 - DNA, 2307 bp, Artificial Sequence
  Description of Artificial Sequence: Synthetic coding sequence
atgaacggtgattctcgcgccgctgttgtgacgtcgcccccccctactaccgctccacataaagaacgctacttcgacagggtggatgaaaacaacccagaatacttgcgggaacgtaatatggcgcccgaccttcgccaggactttaatatgatggagcaaaagaagcgtgttagtatgattctgcagtcccccgcattctgcgaggagctggagtctatgatccaggagcagttcaaaaagggcaaaaaccccaccgggttattggctcttcagcaaatcgctgacttcatgactaccaatgtgccgaatgtttatccagcagcccctcagggcggtatggccgccctgaatatgagtttgggcatggtcaccccagtcaatgacctcaggggatcagactccatagcgtacgacaagggcgagaagctgttaaggtgtaaactggctgcattctaccgattagccgaccttttcggctggagccagctcatctacaaccacatcaccactcgcgtcaactcagagcaagagcacttcctgattgtgccatttggacttctctacagcgaggtcaccgcaagttcattagtgaagatcaacctgcagggtgatatagtggatagaggctctacgaacttaggagtgaatcaggccggatttacgttgcatagtgccatctatgccgcgagaccagatgtgaagtgtgtagtacatatccatactccagccggagcagctgtatctgcgatgaaatgcggtcttttgcctatctctccagaggctctcagtctgggcgaggttgcttatcacgactatcacgggattctagttgacgaggaggagaaagtgttgatccaaaagaatctgggaccaaaatcaaaagtgctcattctgcggaaccacgggctagtgtccgtgggtgaatcagtggaggaggcgttttactacattcacaacttggttgtcgcatgcgaaatccaggtgcgtacactggccagtgccggtggcccggacaatctcgtgctcctcaatccagagaagtacaaggctaagtcacgaagccctggcagtccagtgggcgagggaactggttctccgccaaaatggcagatcggagagcaggagttcgaggcattgatgcgcatgcttgacaatcttggataccgaacagggtatccttacagataccccgcccttcgggagaaatccaagaaatatagcgatgtggaagtcccggcgtcggtcaccggctacagctttgcctcagatggggactcaggcacttgttcccccctaaggcacagcttccagaagcaacaacgagaaaaaaccaggtggttgaactctggacgcggagacgaagcctcggaagaaggacaaaatggcagctctcccaaaagcaagactaaggtctggacaaatattactcacgatcatgttaagccactcttacagagcctttcatctggcgtgtgcgtgccctcctgcatcactaactgcctttggactaaagaggacggccatagaacgtccactagtgccgttccaaatctcttcgttccattgaacactaatcctaaggaggtgcaagaaatgagaaataagattcgcgagcagaacctgcaggacatcaaaacagccgggcctcagtctcaggtgctgtgcggggtagtgatggacagaagtctcgtccaaggcgagcttgtgacagcctcaaaggccatcatcgagaaggagtatcaaccccatgtcattgtgagcaccacaggccctaacccattcactacgctgaccgatcgtgaactggaagaataccgacgcgaagttgagcggaaacaaaagggatctgaggagaatttagatgaagccagggaacagaaggaaaagtcaccaccggaccagccagcggttccgcatccccctccaagcactccaattaagctggaggaggatctggtccctgaacctaccactggtgatgactctgacgctgccacttttaagcccacactcccagatttgagtcctgatgagccgagcgaagccctggggttcccaatgctcgagaaagaagaggaggcccaccggccaccatctcccaccgaggctccaacagaagctagcccagagcctgcaccagacccagcccctgttgcagaggaggccgcaccctctgccgtggaagagggggcagccgccgaccctggtagcgatggatctccagggaagtctccatcaaagaagaagaagaagttccggaccccttcctttctcaaaaaaagtaaaaagaagtccgattcttag

SEQ ID NO: 107378 - DNA, 1989 bp, Artificial Sequence
  Description of Artificial Sequence: Synthetic coding sequence
atgaacggtgactcacgagccgcggtggtcacctctccaccacccactactgctccccataaagaaagatacttcgacagggtggatgaaaacaatcctgaataccttcgtgaaaggaacatggcccccgatctacgacaggacttcaatatgatggagcaaaagaagcgggtgagcatgatactgcagtcacctgcattctgtgaggaactggagtctatgattcaggagcagttcaagaagggtaagaatcctactggcctgctggccctgcaacagatagcagattttatgaccaccaacgtaccaaacgtgtaccccgccgctcctcagggggggatggctgctttgaacatgtctctgggtatggtcactccggtgaacgacttgcgcggcagtgatagtatcgcctatgataaaggggaaaaactgctccggtgcaaacttgccgcattctaccgcttagctgatctctttggttggtctcaactgatatataatcacattaccactcgggtgaacagtgagcaggaacatttcctgatcgtgccatttggcttactgtatagcgaagtgacagccagttcgctggtaaagatcaatctgcaaggtgatatcgtcgacagaggaagcaccaacctgggggtcaaccaagcaggttttaccctacactcggcaatttatgctgcccggcctgatgtgaagtgcgtggtacacatccatacaccagccggtgcagcagtatctgcaatgaagtgtggactcctccctataagtcccgaagctttgagcctgggcgaggtggcttaccacgactaccacgggatcttagtggacgaggaggaaaaagtgctcattcaaaagaacctcggtcccaagtccaaagtgctgattctccgcaatcacggcttggtctccgtgggggaatcggtagaagaagccttctactacattcataaccttgtcgtggcttgtgaaattcaagttcgcacgctggccagtgctggcggtcccgacaacctcgtactgctgaaccccgaaaaatataaggccaaaagccgatcacctggcagcccagttggggaggggacggggtctccgcccaaatggcagattggcgagcaggaatttgaggcccttatgcggatgcttgacaacctgggctatagaacgggatacccttatcgataccccgccctgcgtgaaaagagtaaaaagtacagcgacgtcgaagtaccagcctctgtgacaggatactctttcgcgtctgatggggactccgggacatgctctcccttgaggcactcatttcagaaacaacagagagagaaaacccgctggttaaactccggacggggtgacgaagccagcgaggaagggcagaacggtagctcgcccaaaagcaagacaaagtggaccaaggaggatggacatagaactagcacatctgccgtacctaatctctttgtgccactgaacaccaaccctaaggaggtgcaggaaatgaggaacaagattcgcgagcagaatcttcaggacatcaagaccgcaggaccccagtctcaagtgctatgtggcgtggtaatggaccgctccctggtccaggatgcccccctatctgactgcaccgaaactatcgaaggccttgaactcactgaacaaacctttagtccggctaaatccttgagttttcgaaaaggggagttggttaccgcgtcgaaggctatcattgagaaggaataccagccacacgtgatcgtgagcacgaccggtccgaaccccttcaccacactcactgaccgcgagctggaggagtataggcgggaggtcgaacggaagcagaagggcagtgaggagaacttggacgaggccagggaacaaaaggaaaagtcaccccccgaccagcccgccgtcccccatcctccgccctccacccccatcaagctggaagagggcgacggctgcgcgagagagtatttactgccttag

SEQ ID NO: 107379 - DNA, 1989 bp, Artificial Sequence
  Description of Artificial Sequence: Synthetic coding sequence
atgaacggcgattcaagagctgctgtggtgacaagtccaccaccaaccactgccccccataaggagcgctattttgaccgcgtggacgagaataatcccgaatatttgcgcgaaagaaatatggcgcccgatctgcgccaagacttcaacatgatggaacaaaaaaaacgggttagtatgatcctgcaaagccccgccttctgcgaggaactcgagtctatgatacaggaacagtttaagaaaggcaaaaatcctaccgggctgcttgccctgcagcaaatcgcggacttcatgacaaccaacgttcccaatgtttaccctgctgcaccccagggcggaatggccgcactgaacatgagtctggggatggttactccagtaaacgatctcagggggagcgacagcatagcatacgacaagggggaaaaactgcttcggtgtaagctggcagccttctaccggttggccgaccttttcggctggtcccagctcatatataatcacattactacacgcgtaaactccgaacaggaacattttctgatcgtcccgttcgggcttctgtactccgaggtgactgcctcctcactggtgaaaattaacctccagggagatatagtggacagaggttccaccaacctaggggtgaatcaggctgggttcaccctgcattccgctatatacgcagcccgccctgacgtcaagtgcgtggtccacatccacacccctgcaggggcagctgttagcgctatgaaatgcggcctgcttcccattagtcccgaggctctgtcattaggagaagtcgcttaccacgattaccatggcattctcgtcgatgaggaggagaaagtgctgattcaaaagaatttgggtcctaaatctaaagtcctgatactccggaatcacggactcgtctctgtcggcgagtctgttgaagaagcattctattatatccataacctcgtcgtcgcctgcgagatccaggtccgaactctcgccagtgccggtgggcccgacaacttggtgctgctgaaccctgagaaatataaagctaaaagcagatccccaggatcccctgtgggcgaggggactggctctcccccgaaatggcagatcggagagcaggagttcgaagctcttatgcgcatgctggataacttaggctacagaacaggatacccatacagatatccagctctgagggaaaagtctaaaaaatacagcgatgttgaggtcccagccagcgtaaccgggtactcctttgcctcagacggagactctggcacctgttctccactcaggcactcatttcagaagcagcaacgcgaaaagactcgctggctgaactcaggaaggggcgacgaggcatccgaggaaggacagaacggctccagccccaaatccaaaaccaaggtttggacaaatatcacccacgaccacgtgaagccgctgctgcagagtctctcctctggggtttgcgttccaagttgcatcaccaattgtctctggacaaaggaggatggccatcggacttccacatccgcagtgcccaacctttttgttccgcttaacactaatccaaaggaagtccaagagatgaggaataagatacgtgagcaaaatctgcaggatattaagaccgccgggccccaatctcaggtgctgtgcggagtggttatggaccgctcattggtccagggcgaacttgttactgccagcaaagccattattgagaaagagtaccagccccacgtaattgtcagcactacaggccctaacccatttaccacactgacagatagagagctggaggagtaccgtagagaagtcgagaggaagcagaaagggtccgaggagaaccttgacgaagccagagaacagaaggaaaagagccctcccgaccagcccgcggttccgcacccccccccgtctacccccatcaagctggaggagggtgatgggtgtgcccgagagtatctgcttccctag

SEQ ID NO: 107380 - DNA, 1203 bp, Artificial Sequence
  Description of Artificial Sequence: Synthetic coding sequence
atgaacggggactctcgcgccgccgtggtgacatccccaccaccaactaccgcccctcataaggaacgctactttgaccgcgtggacgaaaacaaccctgagtacctcagagagagaaatatggcacccgatctccgccaggatttcaacatgatggaacagaagaagcgtgtatctatgattctgcagtctcctgccttttgcgaggaattggaatccatgatccaggagcaattcaaaaaaggtaaaaaccccacagggctgttggccttgcagcagattgccgactttatgacaaccaatgtcccaaatgtttaccctgcggcgccccagggggggatggctgctctgaacatgtctctgggaatggtaacgcctgtcaacgatctcagaggttccgactctattgcctacgacaagggtgaaaaactgttgaggtgcaaactggcagccttctatcggctggccgatctcttcggttggagtcaacttatttacaatcatataacgacccgagtcaatagcgagcaagagcactttctaattgtgcctttcggacttctgtattctgaggttaccgcatcctctttagtaaaaatcaacctccaaggcgatatcgtggacagaggcagcacaaacttaggagtcaatcaggcagggtttaccctgcacagcgccatctatgctgccagaccggatgtcaaatgcgtggtccatattcacacacctgctggagcagctgtgtccgctatgaaatgcggcctgcttcctatcagcccagaagccctcagtctcggtgaagtcgcgtaccacgattatcatgggatactcgtcgacgaagaggagaaagtcctcatccagaagaatctgggaccaaaaagtaaggtgctaatcctgcggaaccacgggctggtgtctgtgggtgaaagtgtcgaggaggccttctactacatccacaatttagtggtcgcttgtgaaatccaggtgcggacacttgcctcagccggtggaccggacaacctggtgctgcttaacccggagaaatacaaggccaaatctcgctctcccggcagtcctgtgggagagggaaccgggagccctcctaagtggcagattggggagcaggagttcgaggcccttatgagaatgcttgacaacttggggtatcggactagcagctctggcagaagacaagatggatag

SEQ ID NO: 107381 - DNA, 1989 bp, Artificial Sequence
  Description of Artificial Sequence: Synthetic coding sequence
atgaacggggacagccgggccgctgtggtcacaagtcccccccctaccacagctccccacaaagagcgctatttcgatagagtggatgagaataatcccgagtacctgagagaacggaacatggcccccgatctccgccaggattttaacatgatggagcagaaaaagagggtgtccatgatcctgcaatctccagccttttgtgaggagctggaatccatgatccaggagcagttcaagaaggggaaaaatcccactggtcttctggctctgcagcagattgctgacttcatgacaaccaatgtgcctaatgtctatcctgccgccccccaggggggaatggccgctctgaatatgtcactggggatggtgactccagtgaatgacctccgtggaagcgacagtatcgcttatgacaaaggggagaagctactgcggtgtaagctggccgctttctataggctcgcagacctgttcggctggagccagctaatctacaaccatatcaccactcgtgtgaatagtgaacaggagcacttcttgatcgtcccatttggcctgctttactcagaggtgacagccagcagcctcgtaaagattaacttgcagggagatattgtcgaccgcggaagcacaaacttgggggtcaatcaagccgggtttactcttcactccgccatctatgcagccaggccagatgttaagtgtgtggtccatatccacactccagccggagcggcagtatcagcaatgaagtgcggcttgctgccgatctctcccgaggcactcagcctcggagaagttgcatatcatgattaccacggcattctcgtcgatgaggaggaaaaagttctcatccagaaaaacctgggaccaaagtcaaaggtgctgatcctgaggaaccacgggttggtgagcgttggcgaatcggtggaggaagccttctactacattcacaacttagtggtggcctgcgagattcaggttcggacactggcgagcgcgggaggcccggacaatctggtcctgcttaatccggaaaagtacaaggccaagtcacgcagccctggttcaccagttggcgagggaactggaagcccgcccaagtggcagatcggggagcaggagtttgaggcactcatgcgtatgctcgataacctggggtacaggacaggctacccttacaggtacccggccctcagagaaaaatctaagaagtactctgatgttgaggtccccgcttccgtgacaggctattctttcgcttcagatggagactctggcacatgctcccccttaagacacagcttccagaagcaacagcgcgagaaaacgagatggctgaactccggtcggggcgatgaggcttccgaagagggccagaatggctcaagccccaaaagcaagaccaaagtctggaccaatattactcacgatcatgtgaagccactgcttcagagcctgtcctccggcgtgtgcgtgccaagctgcatcacaaactgcctgtggaccaaagaggatgggcatcgtacatcaacaagtgctgtgccgaacctgttcgtacctttaaacaccaatcccaaagaagtgcaagaaatgaggaacaagatcagagagcagaacctccaggatatcaaaaccgccggtcctcagtcacaggtgctgtgtggggttgtcatggataggtccctggtgcaaggcgagctggtgaccgcgtctaaagcaatcatcgagaaagagtaccagccccatgtaatcgtgtccaccacaggtcctaatccctttaccacgctgaccgaccgcgagttggaggagtaccggagagaagtggaacgcaaacaaaaagggtctgaggagaatctggacgaggcacgcgaacagaaggaaaagtcaccaccagaccagcctgctgtcccccaccctccgccttccacacccatcaagttagaagagggcgacgggtgcgcgcgcgagtacctgctgccatag

SEQ ID NO: 107382 - DNA, 2214 bp, Artificial Sequence
  Description of Artificial Sequence: Synthetic coding sequence
atgaacggggacagtagagccgccgtggtcacatcaccaccacctactacggccccccataaagaaagatacttcgacagagtggatgaaaataatcctgaatatttgcgtgagagaaacatggcacctgacctgcggcaggacttcaacatgatggaacaaaagaagagagtttcgatgatcctgcagagcccagcattttgcgaagaactggaatccatgatccaggaacaattcaaaaagggtaaaaatcctactggtctcctagccctgcagcagattgccgactttatgacgactaatgtgcccaacgtataccccgccgcaccccaaggtggaatggccgctctgaacatgtcgctgggaatggtgacccctgtcaatgaccttagagggtcagattctatcgcttacgataagggggaaaagctgctcagatgcaagctcgcagctttctataggctcgccgatcttttcggctggagccagctaatttataaccacatcacaaccagagtgaacagtgagcaggagcatttcctcattgtgcccttcggcctgttgtattcagaggttaccgcttccagcttggtgaagattaacctgcaaggcgacatcgtggaccgcggcagcacaaatctgggagtaaaccaggccggcttcacactccattcagcgatatatgcagcccgccctgatgtgaagtgcgtggtgcacattcacactcccgcaggtgcagcagtgtctgctatgaagtgcggcctccttcccattagccccgaagccctcagtctgggagaagtcgcgtaccacgattatcatggcatcttggttgacgaagaggagaaagtgctgattcaaaaaaatcttggcccgaagtccaaagtgctgatcctaagaaatcacggactggtgtcggttggcgagagtgttgaggaagccttctactacatacacaatttggtggtggcatgcgagattcaggtgagaactctggcgtcggctggagggcccgataatctggttctgctgaaccccgaaaagtataaagcaaaatccagatctccgggctcacctgtcggagaggggactggcagccctccaaagtggcagataggcgagcaggaattcgaggcgttgatgcgcatgctggacaacctgggatatcgcacagggtatccatataggtatcccgcgcttcgggagaagagtaagaagtactcggacgtggaggtacccgcgagcgttacgggctacagctttgcaagtgacggagattccgggacatgcagcccactccgccactcatttcagaaacagcaaagggaaaagaccagatggttgaactcaggaagaggagatgaagccagcgaggaaggtcagaacgggtctagccctaaaagtaagactaagtggacaaaggaggatggccataggacatctacatccgccgtccctaatctgttcgttccactgaacacgaatcccaaggaggtgcaagaaatgagaaacaagattagggagcaaaatctgcaagatatcaaaaccgcggggcctcaatcccaggtgctgtgtggagttgtgatggatcgatcactagtacagggcgaactcgttaccgcctctaaagcgattatcgaaaaggagtatcagcctcacgtgatcgtatccacaacaggacctaatccttttacaactcttaccgacagggaactggaggaatatagacgcgaggtcgaacggaagcagaagggcagtgaggagaacctcgatgaggcccgggagcagaaagaaaaatcaccgcccgatcaacccgccgttccccatcccccgcccagtaccccgattaagcttgaggaagatctcgttcccgaacctactaccggcgacgacagcgacgcggccacgtttaaacccacacttccagatctctctccagacgagccaagcgaagctttgggcttcccaatgctcgagaaagaggaggaagctcatcggcccccgtctcccaccgaagctcccaccgaagcctctcccgagccagccccagacccagctcctgtggccgaagaagcggcaccatctgctgtggaggaaggggcagcagcagatcctggctctgacggctctccaggtaagtctcctagcaagaagaagaaaaagtttcggacacctagcttccttaaaaagagcaagaagaagtccgattcctag

SEQ ID NO: 107383 - DNA, 2214 bp, Artificial Sequence
  Description of Artificial Sequence: Synthetic coding sequence
atgaacggcgattcaagagccgcagtcgtgacttcccccccacctactacggcaccccacaaggagaggtactttgatcgagtggacgaaaataatcccgaatatcttagggagcgcaacatggctcctgacctccgccaagatttcaacatgatggaacagaagaagcgcgtgagcatgatcctccagtcacccgcattctgtgaagagttggaatcaatgatccaggaacagttcaaaaaaggaaaaaaccccacagggctgctggccctgcaacagatcgctgacttcatgacgactaatgtgccaaacgtctaccccgctgccccacaagggggtatggctgctttaaatatgagtctcgggatggtgacaccggtgaacgacttaagggggtccgactccatagcttacgacaaaggcgagaagttgctgaggtgtaaactggctgccttctataggctggccgacctctttggctggtctcagttgatttacaaccacatcactactcgggtcaattccgaacaggagcatttcttgatcgttcctttcggtcttctgtacagcgaagtgaccgctagctctctggttaaaatcaacttacaaggcgatatagtcgatcgtggttcgaccaaccttggagttaatcaagccggcttcaccctgcattccgccatttacgcagctagacctgatgtgaaatgtgtggttcatattcacactccagcaggcgcagcagtgtctgctatgaaatgtggactgcttcctatatcacctgaagcactgtctctgggggaggtggcctatcacgattatcacggtattcttgtcgacgaggaagaaaaagttctcatccagaaaaaccttggcccaaagtctaaggtgctgatcctgcggaatcacgggctcgtgtccgtcggagagtcagtcgaagaggctttttactacattcacaatctggtggtggcttgtgaaatccaggtgagaaccctcgctagcgctggcgggccagataatctggtgttgttgaacccagaaaagtacaaagcgaagagccgctcacccgggagtcccgtcggcgagggaacgggctctcctccaaagtggcagatcggggagcaggagtttgaggctctgatgaggatgctcgacaatctgggctaccgcaccggatacccatatcggtatcctgcgcttagggagaaatctaagaagtattctgatgtggaggtgcccgcttccgtgacaggatacagttttgccagcgacggcgactctggaacctgcagtcctttgcgacacagctttcaaaaacaacagagagagaaaacaaggtggttaaattccggtcgaggagatgaagccagcgaggagggacaaaacgggtcttcccccaagagcaaaacaaagtggactaaagaggatggacacaggacatccacctccgcagttccaaatctgtttgtacctttgaacaccaaccctaaggaggttcaggagatgagaaacaaaattcgcgaacagaatctgcaagacatcaaaaccgcagggccacagagtcaggttctctgcggcgtggtgatggataggtcccttgtccagggcgaattggttaccgccagtaaggcgatcattgagaaagagtatcagccacatgtgatcgtctctacaaccggccccaatcccttcacaacgcttacggacagagaactcgaagagtacaggcgcgaagtagaacgcaaacaaaagggtagcgaagagaacctggacgaagctagagaacagaaggagaagtctcccccagaccaacctgctgtgccacatccaccgccctcaacccccatcaaactggaggaggaccttgtgcctgagcccactaccggtgacgacagcgatgctgccacctttaagcccacacttcctgacctatcacctgacgaaccaagtgaagccttaggctttcctatgttggagaaggaggaagaagcacaccggccgccctcacccacggaagcccccacggaagcctcccccgagccagcaccagatcccgcaccggtggcagaagaggctgccccctctgccgtggaagagggagctgccgccgacccaggcagcgatggaagccccgggaaatcaccttcaaagaaaaagaaaaagtttagaaccccctcatttctgaaaaaatccaagaagaaaagtgactcttag

SEQ ID NO: 107384 - DNA, 414 bp, Artificial Sequence
  Description of Artificial Sequence: Synthetic coding sequence
atgaatggcgattccagagctgccgtggtaacgagccccccacctaccaccgccccacataaagagaggtatttcgatagagtcgacgaaaacaatcctgaatatttgcgagaaaggaatatggccccagacctgcggcaggactttaatatgatggagcagaagaagagagtgtccatgattctgcagagtcccgcattctgtgaagagttggagtcaatgatccaggaacaatttaaaaaaggtaagaaccccactggacttctggccctgcaacagatcgctgacttcatgacaaccaacgttccgaacgtctacccagccgcaccacaggggggtatggccgctctcaatatgagcttggggatggtgactcctgtgaacgatctgcgcggtagcgactccattgcctag

SEQ ID NO: 107385 - DNA, 1899 bp, Artificial Sequence
  Description of Artificial Sequence: Synthetic coding sequence
atgaatggtgactccagagcagccgtagtaactagcccaccaccaaccaccgccccacacaaggagaggtacttcgaccgtgtggacgaaaacaatcccgagtacttgagggaaagaaacatggcccccgacctgaggcaagactttaatatgatggaacaaaaaaaacgggtgagcatgattctccaatcccctgccttttgcgaagagctggaatctatgattcaagaacagtttaaaaaaggcaagaacccaactggcctgctggccctgcagcagatcgcagatttcatgactaccaatgtgcccaatgtttatcccgctgcaccacagggtggaatggccgccctgaatatgtccttaggaatggtcactccagtgaatgacctgcgagggagcgactctatcgcttacgacaagggggagaaactgctcaggtgtaagctcgcagcattttatcggttggcagatctctttggctggtcacagctaatctacaatcacatcaccactagagtgaactccgaacaggaacacttccttatcgttccgttcggcctcttatactcagaggtcacagcctctagcctggtgaagatcaacctgcagggcgatatcgtagaccgagggagtaccaatctgggagtcaaccaggctggttttacgttacattccgccatttacgctgcaaggcccgacgtaaagtgtgtcgttcatattcacacacctgccggcgccgccgttagcgccatgaagtgtggccttttgcctatttcccccgaggccctctccttgggggaagtagcttaccatgactaccatggcattctggtggatgaagaggagaaagtgttaatacaaaagaacttgggccctaagagcaaggtgctgattctccggaatcacggtctggtatcagtgggagagagtgtggaagaagcgttctactatattcacaatcttgtagtggcctgtgagattcaggtgaggactctagccagcgctggcgggcccgacaacctggtcctgcttaaccccgagaaatataaggctaagtccagaagcccgggatcaccagtgggcgaggggaccggctctccccctaagtggcaaattggcgaacaggaatttgaggcgctgatgcgaatgctagacaacttagggtaccgcaccggctacccataccgctaccctgccctgcgcgaaaaatccaagaagtactccgacgtcgaggtgcctgctagcgtgacaggttattctttcgcctcggatggtgattccggaacgtgctcccctctaagacattctttccagaagcagcagcgggaaaaaacaagatggctgaactctggcaggggggatgaggcgtccgaagaaggtcagaacggctcttcccctaaaagcaagacaaagtggacgaaggaagacgggcaccgaacgtcaaccagtgcagtcccgaatctgtttgttcccctcaatactaaccctaaggaagtacaggaaatgaggaataagattcgcgagcagaatctgcaagacattaaaacagccgggccccagtctcaggtgctttgtggagtggtcatggaccggtccctggtccaaggggagctcgtcaccgcttctaaagctattatcgagaaggagtaccagccccatgtaatagtttccactactggtcccaatccctttacaacactgactgatagggagctggaggaatatcggagggaggtggagcggaaacagaagggctctgaggaaaacctggacgaagctcgcgagcagaaggagaagtcacccccggatcagcctgccgtgccacaccccccgccgtcaacacctatcaaactggaggaggccggagacgggtgcgctagagaatacctgctcccttag

SEQ ID NO: 107386 - DNA, 1335 bp, Artificial Sequence
  Description of Artificial Sequence: Synthetic coding sequence
taagtcttgatccttcggaaccacgggctggtttctgttggagaatcagttgaagaggcattctattatattcacaacctggttgtcgcctgcgagatccaggtgcgcacattggcctcggccggggggcctgacaacctcgttctgttgaatcccgagaaatataaggccaagagcaggtctcctggctctcccgtgggagagggaaccggatcaccacctaagtggcagatcggggagcaggaattcgaggccttgatgagaatgctggataacctgggatatcgtaccgggtacccttataggtaccccgcccttcgggaaaagtcaaaaaagtattccgacgtggaagtgcccgcttcagtcactggttatagctttgccagcgacggggattcaggcacttgcagtccccttcgccattcctttcagaaacagcagagagaaaagacaagatggctgaatagcggaaggggggatgaggccagtgaggaaggacagaatggtagcagtccaaagagcaagacaaaggtctggacgaatatcacccatgaccacgtgaaaccactgttgcaatcacttagtagcggcgtgtgtgtaccatcatgcattactaattgtctctggaccaaagaagatggacaccgaaccagcacttctgctgttcctaatttatttgtgcccctgaacactaacccaaaggaagtccaggagatgcggaataagatcagagagcaaaacctgcaggatatcaagaccgctggaccccaaagccaggtgctctgcggcgtggtcatggataggtccctggtgcaaggggagctggtcaccgcctccaaggccatcatcgaaaaggaataccagcctcacgttatcgttagcaccacaggccctaatcccttcacaacactcacagacagggagctggaagaataccgccgtgaggtggaacgaaagcaaaaggggtcggaagaaaacctggatgaagcaagggagcagaaagaaaagtcccctccagatcagcctgccgttccccaccctccgccgagtactcctattaaactggaggaggacttggtccccgaacccactacgggagatgattcagacgctgccacttttaagcctacgctacctgatctgtcacctgatgagcccagcgaggcactggggttcccaatgcttgaaaaagaggaagaagcgcataggccgcctagccctaccgaggcgcccaccgaggcctcaccagaacctgcacccgacccggctccagtagccgaagaagctgcacccagtgccgttgaggaaggcgccgcagcagacccgggctcctag

SEQ ID NO: 107387 - DNA, 2181 bp, Artificial Sequence
  Description of Artificial Sequence: Synthetic coding sequence
atgtcggaggagacagtgcctgaggccgcctcacctccgccacctcaggggcagccttactttgaccgctttagtgaagacgatcccgaatacatgcggcttcgcaaccgcgcagctgacttgcgccaggatttcaatctgatggagcaaaaaaagcgagtgacgatgatcctgcagtctccaagtttcagggaggaactggagggtctgattcaagaacaaatgaagaaggggaataattcctccaatatttgggctctcagacagattgctgactttatggcttcaacgtctcacgcagtcttcccaaccagttcaatgaacgtatccatgatgacccctatcaatgaccttcacaccgccgactctctcaatttagctaaaggggagcgcctcatgagatgcaaaatcagctctgtctatagattgctggatctgtacggatgggcccagttgtccgacacttacgtcacacttagagtcagcaaagagcaagatcatttcctgatttccccgaagggagtctcctgctctgaggtcactgctagcagtcttatcaaggttaacatcctcggagaagtggttgaaaagggttctagttgtttcccggtggacactaccggcttttgtctgcacagcgctatatacgctgcaaggccggatgttcgctgcatcatccatctgcacacacccgccacagctgccgtaagcgccatgaagtggggactcctgccagtctcacacaatgcgcttcttgttggcgacatggcttattacgactttaatggagagatggagcaggaggcagaccggataaatcttcagaaatgcctcggaccaacgtgtaagatccttgtccttcgaaaccatggcgttgtggctctgggagacactgtcgaggaagccttttataagatctttcatctgcaggccgcatgcgagattcaggtgtctgctctaagctccgccggcggagtcgagaacctgattttgctcgaacaggaaaagcaccggccacacgaggtcggcagtgtgcagtgggcaggtagcacctttggacccatgcaaaaatcacggctaggcgagcatgagtttgaggctctgatgaggatgctggataacctgggataccgcacgggatacacctacaggcacccttttgtgcaggaaaagacaaaacataagtcagaagtcgagatccccgcaactgtaacagcattcgtgtttgaagaggatggtgcgcccgtcccagcactgcgccagcacgcgcagaagcagcagaaggagaaaacgaggtggttgaatacgccaaacacctatttgagggtgaacgtcgcagacgaagtccagaggagcatggggtctccccggcctaagacaacatggatgaaagcagacgaagtggagaagagtagtagtggaatgcctatccgaattgaaaacccgaatcagttcgtgccgctctatacggacccccaggaagttttggagatgaggaataagatcagggagcagaacaggcaggacgttaaatctgccggcccacagagtcagctgctcgccagcgttatcgctgaaaaaagtcgttccccgtcaacggagtcacagctcatgagcaagggtgatgaggacaccaaggacgactcagaagagactgtcccaaacccattttcacagctgaccgatcaagaactggaagagtacaaaaaggaggtggagagaaagaaacttgaacttgatggggagaaagagaccgcccccgaggagccgggaagcccagccaagagcgcacctgcaagccccgtgcagtctcccgctaaagaagccgaaaccaaatcccccctggtgtccccatctaaaagtcttgaagaaggtactaaaaaaacagagacatcgaaagccgctacaacagaacccgaaacaactcagcccgaaggagttgtggtgaatgggcgtgaggaagaacagacagcagaggagatcctgtccaaagggctatctcagatgacaacgtctgctgatacagatgtcgatacatcaaaggataaaactgagagtgtcacttccgggccgatgtcccccgagggtagccccagcaagagtccgagtaagaagaagaagaaattccgcactccttcttttctcaaaaagagtaagaagaaggaaaaagtggaatcatag

SEQ ID NO: 107388 - DNA, 297 bp, Artificial Sequence
  Description of Artificial Sequence: Synthetic coding sequence
atgagcgaagaaacagttcccgaagctgcctcacctccccctccacagggacagccatattttgatagatttagcgaggatgaccccgaatacatgaggttgaggaacagagccgccgatctccggcaagattttaatctgatggagcaaaagaagagagtcactatgatcctgcaaagcccctcctttagggaggaactagaaggtctaattcaagagcagatgaagaaggagtacaaaaaggaggtggagcgcaagaagctggagctggacgcacctgggtggttctcaagttag

SEQ ID NO: 107389 - DNA, 1764 bp, Artificial Sequence
  Description of Artificial Sequence: Synthetic coding sequence
atgagtgaggagactgtgcctgaagccgcttcgcccccccccccacaaggtcagccctacttcgacaggttttcagaggacgacccagaatacatgaggcttaggaatagggcggctgatctccggcaagattttaatctgatggaacagaagaagagagtcacaatgatcctgcaatccccgtcatttcgcgaggagcttgaggggttgattcaggagcagatgaaaaagggcaacaacagtagtaacatttgggcccttagacaaattgcggacttcatggcttctacctcccatgcagtcttccccacctcttcaatgaatgtctccatgatgactccaatcaatgatctgcacaccgctgattctcttaacctggccaaaggcgagcgcttgatgaggtgtaaaatctcgtctgtgtatagacttcttgacctctacggctgggcccagctgagcgatacatacgtgacgctccgtgtttcgaaggagcaggaccacttcttgatttcccccaaaggagtgagctgctcagaagtcacagcctccagtctgattaaggttaacatcctaggagaagtcgtggaaaaaggatcgagctgttttccagtcgacaccacaggcttttgcctgcattctgccatctacgctgctcgcccggacgtaaggtgtattatccacctgcataccccagcaacagcggcagtgtcagctatgaagtggggcctactgcctgtgtcccacaacgcacttctcgtgggtgacatggcttactacgattttaacggcgagatggaacaggaggcagacagaatcaacctccagaaatgcctgggtccaacctgcaaaatactggtgttgagaaatcatggagtcgttgccctcggggacacagtagaggaggccttttacaagatttttcatctgcaggcagcatgtgagattcaggtttccgccctgtcttcagcagggggggtcgaaaatttgatcctcttagagcaggaaaagcaccggccacacgaagtgggctctgtgcagtgggccggctccacttttggcccaatgcagaagagccgtcttggcgagcacgagtttgaggctttgatgagaatgcttgacaatctgggctaccgaaccggctatacctataggcatccgtttgttcaggaaaaaacaaagcacaaatcagaggtggagatccccgcaaccgtcacagctttcgtatttgaggaagacggagctcccgtccctgccctaagacagcatgcgcagaagcaacagaaggagaagaccaggtggctcaataccccaaacacttacctgagggttaatgtggccgacgaggtgcagagatctatgggcagtccccgaccaaagacaacctggatgaaagccgacgaagtggagaagagcagctccggcatgccaattaggatcgaaaatcccaaccagtttgtgcctctgtacactgacccgcaggaggtgcttgagatgcggaacaagatccgggagcagaatcgccaagacgtgaaatcagccggaccacaatcccaattgttggctagcgtcattgcagaaaaaagcaggagcccatctaccgagtcccaactgatgagtaagggcgatgaagacacaaaagacgactcagaggaaactgttcccaatccctttagtcagctcacagatcaggagctggaggaatataagaaagaggtagaaagaaaaaaactcgagttggacgcaccaggctggttctctagttag

SEQ ID NO: 107390 - DNA, 2181 bp, Artificial Sequence
  Description of Artificial Sequence: Synthetic coding sequence
atgtctgaggagaccgtacccgaagcagcatccccgccaccccctcagggccagccctattttgacagattttctgaagatgacccagagtacatgagactccggaatagggccgcagatctccggcaggactttaatctgatggagcaaaagaaacgcgtaaccatgatcctccagagcccaagcttccgcgaggaactggaaggtttgattcaggagcagatgaagaaggggaataatagctccaacatctgggccctgaggcagatcgctgactttatggcctcaacatcgcatgcagtttttcccactagctcgatgaatgtgagtatgatgacgcctattaacgacttgcacacggccgacagcctgaacctggccaagggcgagcgcctgatgagatgcaagattagtagtgtgtaccgcctcctggatctctacggctgggcccagcttagcgatacttatgtgacactgcgcgtgtcaaaggagcaggatcacttcctgatctcaccaaaaggcgtctcctgttccgaggtgaccgcctcatcactcatcaaggtgaatatcctgggggaagtggtagaaaagggttcatcttgctttcctgtggacaccaccggcttctgtctgcattctgctatctacgctgcacggccagacgtgcgctgtataatccacctacataccccagcaacagccgccgtctctgctatgaaatgggggcttcttccggtcagccataacgctttactggtgggggacatggcttattacgactttaacggggaaatggaacaggaagccgatagaatcaatctgcaaaagtgcctgggcccaacctgcaagattttggtgctaaggaatcacggggtggtagcgctaggggatactgttgaagaagccttttataagatcttccatctgcaagccgcgtgcgagattcaggtgtcagccctctccagcgctggtggcgtggagaacctgatactcctcgaacaggagaagcatcggccccacgaagtgggttccgtccagtgggctggatccacttttggtccaatgcaaaaaagtagattaggtgagcacgagtttgaggccctgatgcggatgctggacaatctgggctatcgaacaggctacacataccggcaccctttcgttcaggaaaaaacaaaacataagagtgaagttgagattcccgcaacagtgaccgcatttgtgttcgaggaagatggggcgcctgtgcccgcattgaggcagcacgcacaaaagcagcagaaggagaaaacgcgttggcttaatacccctaatacatatttgcgggtgaacgtggctgatgaggttcaacgttccatgggcagcccacggcccaaaacaacctggatgaaagcagatgaggtggagaagtctagtagtggaatgcccatcaggatcgaaaatcctaaccaatttgtgccactttacaccgatccccaagaggtgctggaaatgcgcaacaaaataagagaacaaaaccggcaggacgtgaagtctgccggtccgcagagccagctgctggcctctgtgattgccgaaaagtcaagaagcccctcgacagagagtcagctgatgtccaaaggcgacgaggatactaaagatgacagcgaagaaaccgtgcctaaccccttctctcagcttaccgaccaggaactcgaggaatacaaaaaagaagttgagcggaagaaactggagttggacggcgagaaggagaccgcccctgaggaaccaggcagccccgccaagtccgctccggcctccccagtccagtcacccgccaaggaagcagagacaaagtcaccccttgtgtccccatccaaatccctggaagaaggaactaaaaaaacagaaacgtccaaagctgctactaccgagcctgaaactacgcaacccgaaggggtcgtagttaacggaagagaagaagagcagacagcagaggaaatcctgtccaagggtctctcccagatgacaaccagcgctgacactgatgttgatacatccaaggataagacagagtccgttacctcgggcccgatgtcccctgaaggaagtccatctaaaagtccaagcaaaaaaaagaagaagtttcgtactccgtccttcctgaaaaagagcaaaaaaaaagaaaaagttgagagctag

SEQ ID NO: 107391 - DNA, 2181 bp, Artificial Sequence
  Description of Artificial Sequence: Synthetic coding sequence
atgtcagaagaaaccgtccccgaggccgcctcaccaccacctccacaggggcagccatactttgatcgtttctcagaggacgatcccgagtatatgaggctgcgcaatagagctgcggatctccgacaggacttcaacttgatggagcagaagaaacgagtcaccatgatactgcagtcaccctcttttagagaggaactagaaggtttaattcaggagcagatgaagaagggaaacaactctagtaacatttgggcactacggcagattgcagatttcatggcaagcaccagccacgctgtttttccaacctctagcatgaatgtgagcatgatgactccaatcaatgatctgcacactgcagactcccttaacctcgccaaaggagagcggctcatgagatgtaagatatctagcgtatacaggcttctcgacctctacggctgggcgcaattatctgatacctatgtaacactgcgtgtatctaaggagcaggaccactttctcatctcccctaaaggagtttcctgcagtgaagttactgcaagcagtctgataaaggtcaatattttaggagaggtggtagagaagggaagcagctgctttcctgtcgacacgactggcttctgcctccacagcgctatctatgcagcccgcccggacgtaaggtgcattatccacctgcatacccccgccacagcggctgtgtcggcgatgaagtgggggcttctgcctgtgagccacaatgccctgcttgtgggcgatatggcatattatgacttcaatggcgaaatggaacaggaagccgatcggattaacctgcagaaatgtctaggacccacttgtaaaatcctcgtcctccggaaccatggagtagtagccctcggggacaccgtggaagaagccttttacaaaatcttccacctgcaggccgcttgtgaaattcaagtttctgccctgtcctccgctggaggagtcgagaatctgattctgctggagcaagagaagcacaggccccatgaagtgggaagtgtacaatgggctggtagtacgttcggccccatgcagaagagcagattgggggaacacgaattcgaggctcttatgaggatgctggacaatctcggctatcgaacgggatatacctataggcacccatttgtgcaggagaagaccaaacacaaatctgaggtcgaaattcccgcgactgtcacagccttcgtgtttgaggaagacggtgccccagtaccagccttgcgtcagcatgcccaaaaacaacagaaagagaaaacccgatggctgaatacacccaacacttaccttagggtgaatgttgccgatgaggtgcagcgctcaatgggatcaccgcgccctaagacaacttggatgaaggccgacgaagtagaaaaaagcagttcaggcatgccaattcgaatcgaaaaccctaatcagttcgttcctttatacactgatccccaggaagtgcttgagatgaggaacaagatcagagaacaaaatagacaagacgtgaagtctgcaggccctcagtcacaactgcttgcctccgtaatcgctgagaagagtcgaagcccatctacagagtcacaactcatgagcaagggcgatgaagatactaaagatgacagcgaagaaaccgtccctaaccccttctcacagctgaccgaccaggagctggaagagtataagaaagaggtggagcgcaagaaactggaactggatggtgagaaggagaccgcccctgaggagcctggatccccagcgaagagcgcaccagcctcccctgtgcagtccccagccaaagaggctgagaccaagtcccccctggtgtcaccatccaaatccctcgaagagggtacaaaaaagacagaaacttctaaagcagctaccacagagccagaaaccacccagcctgaaggcgtagttgtgaacggtagagaagaggagcagaccgctgaagagattctgtctaagggcctcagtcagatgaccacctccgctgacacagatgttgacacaagtaaggataaaacagaatccgtgacttccggtccaatgtccccagaaggttcaccgtctaaaagcccttcgaagaaaaaaaagaagtttcgcacgcccagtttcctcaaaaaaagcaaaaagaaggaaaaggtggagagctag

SEQ ID NO: 107392 - DNA, 1680 bp, Artificial Sequence
  Description of Artificial Sequence: Synthetic coding sequence
atgagcgaagagactgttcctgaagcagcgtccccccctccaccacaagggcagccttattttgaccgcttctcagaagatgatcccgaatacatgcgccttcgaaaccgggctgctgacctccgacaggacttcaacctgatggagcagaagaaacgcgtcacaatgattcttcaaagtcccagcttccgcgaagaactagagggcctcatccaggaacaaatgaaaaagggaaacaactcctccaatatttgggccctgcgccagattgcagactttatggcttctacctctcacgccgtcttccccacaagttccatgaacgtttctatgatgaccccaattaatgacctgcacacagcagatagccttaacctggctaagggagaacggctcatgagatgtaagatctcatctgtctatcgcctcctcgacctctatggatgggcccagttgtctgacacatacgttactctgagggtgagtaaagagcaggaccacttcctgatcagcccaaaaggggtttcttgcagcgaggtcacagcctcctccctgatcaaggtaaacattctgggcgaggtagtggaaaaggggtcaagctgtttcccggtggacacgaccggcttttgtctgcacagcgcgatttacgccgctcgccccgacgtcagatgcatcattcacctccacactcctgctaccgccgcagtgagcgcaatgaaatggggtcttctgccagttagccacaacgctctgctagttggagatatggcatattacgattttaacggcgaaatggaacaggaggccgatagaatcaatttgcagaaatgccttgggccaacatgtaagattctcgtgctgagaaaccacggggtggtagccttgggcgataccgtcgaggaggcgttttacaaaattttccatctgcaagctgcttgcgagattcaagtaagcgctctgagcagtgcagggggcgtggagaacctcatcctgctcgaacaggagaagcataggcctcacgaagtcggctctgttcagtgggctgggtccaccttcggcccgatgcagaagagtcgtctgggtgagcacgaattcgaggcacttatgaggatgctggacaacttgggatacaggactgggtatacttaccggcacccgttcgtccaggaaaagactaaacataaaagcgaggtggaaatcccggccactgtaaccgccttcgttttcgaggaggatggagctccggttcccgccctcaggcagcatgcccagaaacagcagaaggaaaagactaggtggttgaatacccctaacacctacctcagggtcaacgtagctgacgaagtgcagcggtccatgggctccccccgacccaaaacgacctggatgaaggcggatgaagtggagaaatctagcagcggcatgcctatacgcatcgaaaaccccaaccagttcgttccactgtatacggatccgcaggaagtgcttgagatgaggaacaaaatccgtgagcagaatagacaggacgtgaagagcgctggacctcagtctcagctgctagcctcagtgattgctgaaaaatcacggtcccccgttgaacagcggctgcccctgacggggggagagacttgccttccttcagggagttctgtccccggggcaggactgcaggacccatag

SEQ ID NO: 107393 - DNA, 681 bp, Artificial Sequence
  Description of Artificial Sequence: Synthetic coding sequence
atgtccgaagagactgtgcccgaagccgcttcaccccctcccccacagggtcagccttatttcgaccggtttagcgaagacgacccagagtatatgagactgcggaacagagctgcggacttacgacaagatttcaatctgatggagcagaaaaagagagtcacaatgattctgcagtcgccatcctttcgcgaagagctggagggcttgattcaggagcagatgaaaaagggaaacaactcctccaacatttgggccttgcggcaaattgctgatttcatggcctcgactagccatgctgtgtttcccacaagctccatgaacgtgtctatgatgaccccaatcaacgacctgcataccgccgacagtctgaacttggctaagggcgagcggttaatgaggtgtaagattagtagtgtgtataggctgcttgatctctacggctgggcccaactgagtgacacctatgttacactcagagtcagcaaagagcaagatcactttctcatctccccaaagggagtgtcatgttccgaggtaacagctagctccctcataaaggttaatattttgggcgaggtagttgagaaaggctcatcgtgctttcctgtggacaccacaggcttctgtctgcatagtgcaatatacgccgccagaccggacgtgagatgtataatctag

SEQ ID NO: 107394 - DNA, 432 bp, Artificial Sequence
  Description of Artificial Sequence: Synthetic coding sequence
atgtcagaggagactgtgcccgaggccgcctcacctccaccaccacaggggcagccctatttcgataggttttcagaagatgatcccgaatatatgcgactcaggaacagggccgccgatcttaggcaggattttaatttgatggagcagaaaaagcgggtcacaatgattctccagtccccctccttccgcgaggaactagaaggcctgatccaagaacaaatgaaaaagggaaataacagtagtaatatttgggctctgaggcaaatcgcagatttcatggctagcacttcacacgccgtctttccaacttcgagtatgaatgtgtccatgatgacgcctatcaatgacctgcataccgctgattccctaaatttggccaagggggagaggctgatgcgctgtaaaatatcttcggtatacagactgtag

SEQ ID NO: 107395 - DNA, 1728 bp, Artificial Sequence
  Description of Artificial Sequence: Synthetic coding sequence
atgccccgacgccgagtgcctggcgccaattgcaagcctaccggcaaaatgagcgaggagacagttccagaagccgcaagcccccccccgcctcaaggccagccctattttgacagatttagtgaggatgatcccgaatacatgaggctccggaaccgcgcagcggacctaagacaggattttaacctgatggagcagaagaagagagtgaccatgatcctgcagtccccatcatttcgagaagaactcgaaggcctaatccaagaacagatgaagaaggggaataatagcagtaacatctgggcactgaggcagattgccgattttatggcctctacctcccacgccgtctttccaactagcagtatgaatgtgtctatgatgacgcccattaacgacctgcacacagcggacagcctcaaccttgcgaagggggagagactgatgaggtgcaagatatccagcgtgtatcgcctgctggatctctatggctgggcacagctcagcgatacttatgtcacgttgagggttagcaaggaacaggaccacttcctgatctccccaaaaggggtttcttgttccgaagtgactgcatcaagccttattaaggtgaacatcttgggggaggtggttgagaaaggctcaagctgcttccccgtggatactaccggcttctgcctacactcagcaatctatgcagcccggccggacgtccgctgcattattcacctgcacaccccggctactgctgcagtcagcgcgatgaagtggggcctgctgcccgttagccacaacgccctcctggtcggggatatggcctactatgactttaatggcgagatggaacaggaagccgacaggatcaacctgcagaaatgcctgggccccacatgcaaaattttagttctgaggaatcacggggtcgttgccctgggcgatacagttgaggaggccttttacaaaattttccacctgcaggctgcatgcgaaatccaggtgagcgccctaagctcggcgggaggtgtcgagaacctgatactgttggagcaggaaaaacaccggcctcatgaagtgggctccgttcagtgggcagggtcgacattcggaccaatgcagaaatccaggctgggcgaacatgaattcgaggcactcatgcgcatgcttgataacctcgggtataggaccggctatacgtaccgccatccatttgtgcaggagaagacaaagcacaagtctgaggttgagatcccagccacagtcacagctttcgtgtttgaggaggacggcgcccctgtacctgccctgcgccaacatgcccagaagcagcagaaagagaagacacggtggctgaacacgcctaacacctatctgcgggtgaatgttgcagatgaggtacagcgaagtatgggctccccgcgacccaaaactacctggatgaaggccgatgaagtggaaaaaagttcatcaggcatgcccatcaggattgagaatccgaatcagttcgtgcccctgtacacagacccgcaggaggtgctcgagatgcggaacaagatcagggaacagaacagacaggacgttaaaagcgcagggcctcagtcccagttgctggcctcggtgattgctgagaagtctagaagccccgtcgagcagcgcctgcctttgacaggcggtgagacttgtctccccagcggatcttccgtgccaggagcaggcctgcaagatccttag

SEQ ID NO: 107396 - DNA, 54 bp, Artificial Sequence
  Description of Artificial Sequence: Synthetic coding sequence
atgtcagaggaaactgttcctgaagcggccagcccacccccaccccagggttag

SEQ ID NO: 107397 - DNA, 846 bp, Artificial Sequence
  Description of Artificial Sequence: Synthetic coding sequence
atgagtgaagaaacagtacctgaagccgcaagccctcctccccctcagggccagccttatttcgacaggttttcagaagatgacccagaatatatgcgccttcgaaatagggccgccgacttgcggcaagattttaacttgatggaacagaaaaagagggtgacgatgattctgcaatcaccctcatttcgagaagagctcgagggactcatccaagagcagatgaagaaagggaataattccagcaacatctgggccctgaggcagattgcggatttcatggcctccacatcccacgctgttttcccaacttccagcatgaatgttagcatgatgaccccaatcaacgatctacacaccgctgattctcttaacctggcaaagggcgagcggctgatgaggtgcaagatctcgtccgtgtaccgcttgctggacttgtacgggtgggcgcagctcagtgacacctatgtgactctgcgggtcagcaaggaacaggatcatttccttattagcccaaagggagtgtcctgcagcgaagtaacagcctcctctctcgtcagtgaggttctggagatgcgcaacaagattcgagaacagaatcgtcaggacgtcaagtctgctggtcctcagtctcagttgcttgcctctgtgatagccgagaagtctaggtccccctctacggagagccagctgatgtccaaaggcgacgaggacaccaaggacgacagtgaggagactgtgccaaatccattcagccagttaacagaccaagaattagaagagtacaaaaaagaagttgaacgcaaaaaacttgagctcgacgcaccggggtggttctcatcctag

SEQ ID NO: 107398 - DNA, 1932 bp, Artificial Sequence
  Description of Artificial Sequence: Synthetic coding sequence
atgtctgaagagacagtgcccgaggccgcttctccacctccgccacaagggcagccatactttgatagattcagcgaggatgaccctgaatacatgagactgcgtaatcgagcagccgatttgcgccaggactttaaccttatggagcaaaaaaagagagtgacaatgatcctgcagtcaccctctttccgggaagagttagaaggtcttattcaggagcagatgaagaagggcaataacagttctaacatatgggctctgcggcagatagcggacttcatggcaagtacatcccacgcggtatttccaactagttccatgaacgtatcaatgatgactcccattaacgatcttcacacagcggattccctcaacctcgccaagggagagaggttgatgagatgtaagattagcagcgtctacagactcctcgatttgtacgggtgggcacagctatcagacacctacgtgactctaagagtttcaaaagaacaggaccattttttgatcagccctaaaggggtatcttgtagtgaggtcacagcatcgtcgctaattaaggtgaacatcctgggagaggttgtcgaaaagggatcctcttgctttcctgtagacaccacgggcttctgcctccactccgccatatacgcagctaggcctgatgttagatgcatcatacatctacacaccccagcaactgccgcagtaagcgccatgaaatggggtcttcttccagtttctcataatgcattgctcgtcggggacatggcatactacgactttaatggcgagatggagcaggaggccgataggatcaatctccaaaagtgtctgggacccacttgtaagattctggtactgagaaaccacggcgtcgtggctctgggggataccgtagaggaggcattctataagatctttcacctacaagctgcatgtgaaatccaggtttccgcgctgtccagtgccgggggggtggaaaacctgatcctcctggaacaggagaagcacagaccacacgaagtggggtcagtccagtgggccggcagtacattcggacctatgcagaagagccgcctgggagagcacgaatttgaagctttaatgcgcatgctggacaatttgggttaccgcactgggtacacctacagacatccttttgtgcaagaaaagacgaaacataagagtgaagtggagatcccagccactgttacggcgtttgtgttcgaggaagatggcgctcctgtacctgcgctgcgtcaacacgctcagaagcagcaaaaagaaaagacgcgctggctgaacacccccaacacttatctgagggtcaacgttgccgatgaagtccaacggtctatgggaagcccacggcccaaaacgacctggatgaaggccgacgaagttgagaaaagcagctcaggtatgccaataaggattgaaaatcccaaccagttcgtgccattatacacagaccctcaggaggtgctggagatgcggaataaaattcgcgagcagaatcgccaagatgtaaagtccgcaggaccacaatcccagctgctggcttccgttattgccgagaaatcccgaagtccatcaacagagtctcagctgatgtcaaagggagatgaggacacgaaggatgactcagaggagaccgttcctaacccgttctctcagctcaccgatcaagagcttgaggagtacaaaaaagaggtggagcggaagaagctcgagctggatgagacaggccaggaaagagagccaggatccggcccagctgtatgtgagttcttcagcgtcgctctgcatatttggtccaatatcttggaaagaaagaagctcccccagaaatctctggcccacttacagtccttacatcttttactgcagtgtcgggcgcagcggaggaggcagagacagagagcattgtag

SEQ ID NO: 107399 - DNA, 2025 bp, Artificial Sequence
  Description of Artificial Sequence: Synthetic coding sequence
atgtctagcgatgcatcgcagggagtgatcacaacacccccacctccaagcatgcctcataaggagaggtactttgaccgtatcaacgagaacgatccggagtacatccgtgaacgcaatatgtcacctgacctccgccaggatttcaacatgatggagcagagaaaacgcgtcacacaaattctacaatcccccgcattcagagaggatctggaatgcctgattcaggagcagatgaagaagggtcataaccccaccggcttgcttgctctacagcagattgccgactacattatggccaactcattctctgggttcagcagcccaccgctttctctgggaatggtgacccccataaacgaccttcccggagccgacaccagtagctatgtgaaaggggagaaacttactagatgtaagcttgccagcctttaccggcttgtcgatctgttcggatgggcgcacctagcaaacacctatatttctgttcgaattagcaaggagcaagaccacatcataatcattccacgcggactcagtttttcagaagccaccgccagcaacttagtaaaggtcaatattatcggcgaggtagtggaccagggctccactaatctgaagatcgatcacacaggtttctcaccacacgccgctatctacagcacccgccctgacgtgaagtgtgtcattcacatccacactctagcgaccgctgccgtatccagtatgaaatgcggaattttgccaatctcccaggaatccctcctgctcggcgacgttgcctattatgattatcaggggtcactggaagagcaggaggaacgcatccagcttcagaaagtgctgggcccctcctgcaaggtactggtgctgaggaaccacggcgtggttgcactgggcgagacactggaggaagctttccattatatctttaacgtacagctcgcctgtgagatccaggtccaggccctggctggagccggcggtgttgacaacctgcatgtcctagactttcagaagtataaggccttcacttacactgtggcggcatcaggaggcggtggtgtaaacatgggctctcaccagaagtggaaagttggggaaatcgagtttgaaggacttatgcgaaccctggataatcttggatatcgtaccggatacgcttacagacaccccctgattcgcgagaaaccccggcacaaatctgacgtggaaattcccgcaactgtgacggcctttagttttgaggacgatacagtgcctttgtcaccacttaaatacatggcccagcgccagcagagggaaaaaactaggtggctgaactcccccaacacatatatgaaagtaaatgtacccgaagagagccgcaacggtgagactagtccccgaactaaaataacttggatgaaggccgaagattccagcaaggtgagtggagggaccccaattaaaatcgaggacccaaaccaattcgtgccattgaacacgaaccccaacgaagtcctggagaaacgtaacaaaataagggagcagaatcgatacgaccttaagaccgccgggccccaatctcagttactggcaggaattgttgttgataagccaccctccaccatgcagtttgaagatgacgaccacggcccccccgctcctcctaatcctttctcccatttgactgagggagagctggaggaatacaagcggaccatcgagagaaagcaacagggactggaggagaatcatgagcttttttcaaaatctttcattagtatggaggtgcctgttatggttgtcaatggtaaagacgacatgcacgatgtcgaagatgagctggctaagcgagtatctagactctccacaagcactaccattgagaacatcgagatcacaattaagtcaccagagaagatcgaggaagtgctctccccggagggctcaccctcaaagagtccaagtaaaaagaagaagaagttcagaacccccagtttcctcaaaaagaacaagaagaaggagaaggtggaagcttag

SEQ ID NO: 107400 - DNA, 2121 bp, Artificial Sequence
  Description of Artificial Sequence: Synthetic coding sequence
atgtctagtgatgccagccaaggcgtgattaccacaccccctcccccctcgatgcctcacaaggaacgctactttgatcgtatcaacgagaatgaccccgagtatatccgggagagaaacatgtctcctgaccttaggcaggactttaacatgatggaacagagaaagcgcgtcacccagatcctgcagtcccccgcatttcgagaggatctggagtgcctgatccaggaacagatgaaaaagggacacaatcccacaggtctgttagccctgcagcaaattgccgactacataatggccaacagcttctctgggtttagctcaccacctctttccctgggcatggtcacacccatcaacgatttacccggtgcagatacgtcttcatacgtaaagggagagaagttgacaaggtgcaaattggcaagtctttaccggcttgtcgatctttttggttgggctcacctcgccaacacctacatatctgtgcggatctctaaagagcaagatcatattatcatcattcctagaggactgagcttcagcgaggccactgcaagtaacctggtcaaggtgaacataattggcgaggtcgtggaccagggaagcaccaatctgaagatcgatcacaccggattctctccccacgccgcaatttacagcacgcggcctgatgtgaaatgtgtcattcacattcatactctggctactgcggccgtgagctcgatgaaatgcgggattctgcccatttctcaggaatccctcctcttgggcgatgttgcctattacgactatcagggttccctggaggagcaggaggaaagaatacagcttcagaaagttctggggccctcttgcaaggtgctggtgctccggaaccacggagtcgtggccttgggagaaacgctggaggaggcttttcactatatattcaatgtgcagctcgcatgcgaaatccaagtgcaggcattagccggggccggtggagtagataacctccatgtactggacttccagaaatacaaggcgttcacttacaccgtcgccgcgtcagggggcggaggtgtgaatatgggatctcaccagaagtggaaagtcggggagatagagtttgaaggtcttatgcgcactttggacaacctgggctaccgtaccggctacgcctacagacatcccctgatcagggaaaagccccgacacaagagcgacgtggagatccctgctaccgtaaccgcattctccttcgaggatgacacagtccccctgtcaccactcaaatacatggctcagaggcagcaacgagaaaagacccggtggctcaactctcccaacacatatatgaaggtcaatgtacctgaggaaagcaggaatggggaaacatcacctaggactaagatcacgtggatgaaggctgaggactcaagcaaggtgagcgggggaacacccattaaaattgaagaccctaaccagttcgtgccactgaatacaaatcctaatgaggttctcgaaaagagaaataaaatcagggagcagaaccgttacgacttaaagaccgctggaccccaatcacagctgttggcagggatcgtggttgataaaccaccctcaactatgcagtttgaagacgacgaccatggaccacctgcccctcctaaccctttcagtcacctgacagagggtgagctcgaggaatacaaacgtaccatagagaggaaacaacagggcctcgaagacgcagagcaggagttgttgtctgacgatgcttctagcgtgagccagattcagagccagactcagtctccacagaacgtgccagaaaaactcgaggagaaccatgaactgttctcaaagagcttcatctcaatggaggtccccgtcatggtggtcaatggcaaggacgacatgcacgatgtcgaagacgaactggccaaacgcgtgagtaggctcagcacgtccaccaccatagagaacatagaaattacaattaagagtccagagaagatcgaggaagtactaagccccgaaggtagtccgtccaaatcgccatccaaaaagaaaaaaaagttcaggacacccagtttcctgaagaagaacaagaagaaggaaaaggtggaagcctag

SEQ ID NO: 107401 - DNA, 2025 bp, Artificial Sequence
  Description of Artificial Sequence: Synthetic coding sequence
atgtcgtctgacgctagccagggagtaattaccactcccccgccccccagcatgccccacaaagagaggtacttcgaccggatcaatgagaatgatcctgaatacatacgagagagaaacatgagtcccgacttgcgccaggactttaacatgatggagcagaggaagcgggtgacacagatcctccaatcccccgccttccgagaggatcttgagtgtctgattcaggagcagatgaagaaggggcacaaccccactggtctactggcattacagcagatcgccgactacataatggcaaatagtttcagcgggtttagttcccccccactatctcttggcatggttactccaatcaatgatctcccaggggcagacacttcttcgtacgtcaagggcgagaagctgaccagatgtaaactggcgtccctgtatcgccttgtggacctatttggttgggcccacctggccaatacttatatcagcgtccgcattagcaaggagcaggatcatatcataatcatcccaagagggctatccttctcagaggctaccgcgtcaaaccttgtcaaagtgaatatcatcggcgaagtggtggaccaggggagtaccaatctcaagatcgatcacaccggcttttcacctcacgctgctatttattcgactcgacccgatgttaagtgcgtgatccacatccacactctggctactgccgccgtgtccagtatgaagtgcggaattcttcctatttcacaggaaagtctccttctgggcgatgtggcttattatgactaccagggatcactggaggaacaagaggaacgcatccagcttcaaaaagtgttggggcccagctgtaaggtgctggtactgagaaaccatggtgtcgtggccctgggtgaaactctagaagaagcttttcattatatatttaatgtgcagttggcctgtgagatccaggttcaggccttggcaggcgcaggtggcgtcgacaacttgcatgtgctagatttccagaaatacaaagccttcacgtataccgtggccgcgagtggggggggcggagtcaacatggggagccaccagaagtggaaggtgggtgagatagagttcgagggactgatgaggaccctggacaacctggggtaccggacggggtacgcttataggcacccactgatcagggagaaacctcgtcataaaagtgatgtggaaatcccagccaccgttacggctttcagctttgaggatgacaccgtcccactgtcaccgctgaagtatatggcccagagacagcagcgagagaaaaccaggtggcttaatagtcctaacacgtatatgaaggtcaacgtgcccgaagaaagcaggaacggcgagaccagtccacgcactaaaatcacttggatgaaagccgaagacagttcaaaggttagtgggggtacaccaatcaagattgaggatcccaaccagtttgtcccccttaacaccaatcctaacgaggtgttggaaaagcgcaacaaaattcgggagcaaaaccgatacgacctgaagactgcaggtccacaaagccagttgctcgcaggcatcgtggtggacaagccaccaagcactatgcagtttgaggatgatgatcacggtcctcccgcccccccaaatccattcagccatttgacagaaggcgagcttgaggagtataagaggacaatcgagcggaagcagcaagggctggaagagaaccacgaactgttctccaaaagcttcatcagcatggaagtgcccgtgatggtcgtgaacggtaaagacgatatgcacgacgtggaagacgagttggccaaacgggtcagtcggctgtctacatctactaccatcgaaaatatagagattaccataaaaagtcccgagaagattgaggaagtgctctcccccgagggttccccttccaagtcaccatccaagaagaaaaagaagtttaggactccgtcatttctcaagaaaaataaaaaaaaagaaaaagtggaggcctag

SEQ ID NO: 107402 - DNA, 543 bp, Artificial Sequence
  Description of Artificial Sequence: Synthetic coding sequence
atggccgatagtgagttgcaactcgtcgaacagcggatcagaagcttccctgacttccctacaccaggtgttgtattcagggatatcagccccgtcctgaaagatccagcgtccttccgggccgccatcgggctgcttgcccgccaccttaaggccactcacggggggagaatagactacatagccggactggatagcaggggatttctatttggccctagcttggctcaagagctggggttgggttgtgtgctgattcggaagaggggcaagctgcctggacccaccttgtgggccagctacagtcttgaatacgggaaggctgagttggaaatccagaaagatgcactggagccaggacaaagagtggtcgtggtggacgatttattagctaccggggggacaatgaacgcggcctgcgagctcctgggacgactgcaagcagaggtgctggagtgtgtctcactggtcgagctgacctctctgaagggacgggagaaactggctccagtccccttcttctccctactccagtacgaatag

SEQ ID NO: 107403 - DNA, 405 bp, Artificial Sequence
  Description of Artificial Sequence: Synthetic coding sequence
atggccgactcagagctccagctcgtggaacagcgtatccgttcattcccagactttccgacaccgggagtggtctttcgtgacatcagcccagtgcttaaggaccctgctagctttcgggccgcaataggccttttagctcggcatcttaaggcgacacacgggggacggatcgactatatcgccggcttagattctagaggcttcctctttgggccttctctggcccaggagctagggctgggttgcgtgctgatccgcaagcggggtaagctgcccgggcctaccctgtgggccagctattcactggagtacgggaaagccgagctggagattcagaaagatgctcttgagccggggcagagagtcgtcgtggtagacgacctcctggctaccggggtctag

SEQ ID NO: 107404 - DNA, 555 bp, Artificial Sequence
  Description of Artificial Sequence: Synthetic coding sequence
atggatggccttagacaacgggttgaacacttcctcgagcaacgcaacctcgttaccgaggtattaggggctcttgaggctaaaacaggcgtggaaaaacgttacttggctgcaggcgcagttacgttgttatccctgtatctgctcttcggatatggcgcatccctactctgtaacctcatcgggttcgtttatcctgcatacgcgtctataaaggccatcgaatccccatctaaagacgatgataccgtctggctaacttattgggtggtatatgccttatttgggcttgcggaattttttagcgatcttctgctctcctggtttcccttctactatgtcggtaaatgcgcattcctccttttttgtatggctccccggccatggaacggggcgctgatgctataccaacgcgtggtacgcccactatttttacgtcatcacggtgccgtggaccgcattatgaacgacctcagcggacgggctctcgacgcggctgccggcataacacgcaacgtcaagccatctcagaccccgcagccgaaagacaagtag

SEQ ID NO: 107405 - DNA, 6090 bp, Artificial Sequence
  Description of Artificial Sequence: Synthetic coding sequence
atggccagcagtgtggctccctatgagcagctcgtccgacaggtggaggctctgaaggctgagaactcccatctgagacaggaactgagagataacagcagtcacctgagcaaattggagactgagactagcgggatgaaggaggtgttgaagcacctccaggggaagctcgagcaggaagccagagtcctggtctctagcggacagacggaagtgcttgaacagctgaaagcattacagatggacatcaccagcctgtacaacttaaaatttcaaccccctactttgggccccgagccagccgcgagaacccccgaaggttcccctgtacacgggagcggccccagcaaagacagctttggtgagctgtcaagggcgaccataagactgctggaagagttggatagggagcgctgcttcctgctgaatgagattgaaaaggaggagaaggaaaagctttggtattactctcagctacagggattgtcaaagagactagacgaacttccacatgtggattacgagatgcacaagatgacccgggaccccctaaacctggcgttgcgacggtacgctgggatgacactgaccaatttaacctttggagacgtggcaaataaggcgactctgtgtgccagacgtggatgtatggaagcaattgtcgcccagctggctagtgacagtgaggaactgcaccaggtcgttagttctatactgcgtaatctgagttggcgggcggacatcaatagcaagaaagtccttcgagaggctggatctgtgactgcacttgtccagtgcgttctgagagccactaaagaaagcactctgaaaagtgtactgtccgccctatggaatcttagcgctcattctaccgagaataaggctgctatatgtcaggtggacggagcactggggtttctagtcagcacgctgacttacaaatgccagtccaactcgttagcgattatcgagagcggaggcggcatactacgcaacgtgagcagtctcgtggccactagagaggattacaggcaggtgctccgcgatcataattgcctacagaccctactacagcacctgacctcacactcattgacaatagtctccaatgcctgcggaaccttatggaacctgagcgcaaggtcggctagagaccaggaacttctttgggacttgggtgctgttggcatgctacggaacctcgtgcattcaaagcataaaatgatcgccatggggagcgcagctgcactgagaaacctgctggctcatagaccagcaaagcatcaggcagctgcgaccgcggtgagccccggttcatgtgtcccatccttgtacgtgcgcaaacagagagcactcgaggctgagctggatgcgcggcatctggcccaggccctggagcacttggaaaaacagggccctcccgcagctgaggcagccacaaaaaaaccactgccaccattgcggcacctggacggtttggctcaggactatgcttctgatagtggctgcttcgacgacgatgatgctccaagcagtcttgccgctgcagcagcaactggtgagccggcctccccagcagctttgtctctttttttaggctcgccatttctgcagggacaggccctcgccagaaccccgcccacgcgtaggggtggtaaggaagctgaaaaggatacgtccggcgaggccgccgtcgccgcgaaggccaaagcaaagttagcactcgccgtcgcccgaatcgatcagctcgtcgaggacatcagcgcactgcatacatcaagcgacgatagcttctccttgtccagcggcgatccagggcaagaagccccgcgtgagggacgcgcacaaagctgtagtccctgcagagggcccgaaggaggtcgccgcgaagcaggatcgagggcccatccattgctccggcttaaggccgcccatgcttctctctctaatgacagtctgaatagtggatcagcatctgatggctattgtcctagagagcatatgctgccctgtccactggctgccttagccagtaggagagaagatcccagatgcggccaaccccggccgtcaaggttggatctggacctgcccggctgccaggctgaaccacctgcaagggaggcgacatcggcagatgccagggtccggacaattaagctgtctcccacttaccagcatgtgcctctcctggagggcgcgagcagagcaggggccgaacctctggcaggacctggaatttctcctggggcaaggaaacaggcgtggttacccgcggatcatctgagtaaagtgccagagaagctggctgcagccccattaagcgtggccagcaaggccctccagaagctggctgcccaggaagggccactgtccctctctaggtgcagttccctgagtagccttagtagcgccggacgacccggaccgagtgagggcggtgacctggatgatagcgactccagcctggagggcctggaggaggccggaccatctgaagctgaactcgactctacatggcgggctcctggcgccacttcacttccagtagcaatccctgccccacggcgcaaccggggcagaggtctcggcgtggaggacgccacacctagctccagcagtgagaattatgtgcaggagaccccactggtactatccagatgttcaagcgtgagcagtctcgggtcctttgagtcgccctctattgccagtagcattccttcagagccatgttccggacagggttcgggcaccatcagcccaagcgaacttcctgattcacctggtcaaaccatgccgcccagtcggagtaagactcccccactcgcgcctgccccccagggcccccctgaggctacacagtttagcctccagtgggaatcgtatgtcaagcggtttctcgacattgccgattgcagggagaggtgcagactcccctcggagcttgatgcagggtctgtgaggttcaccgttgagaagcctgacgagaactttagctgtgcaagctcactaagtgctctggcgctgcacgagcactacgttcagcaagacgtcgagcttcgactcttgccatctgcttgcccagaacgcgggggaggagccggcggtgccggtctccacttcgccggccacaggagacgggaggaggggccagcacccaccggctcccgaccccgaggcgcggccgatcaggagcttgagttgttgcgtgaatgtcttggggcagccgttccagctcggctgcgtaaagttgcatctgctctggttcctggaagaagggccctccccgtaccagtttatatgttggtccctgcacctgctccggcacaggaagacgactcttgtaccgactcggccgaagggactcccgtgaatttctcctcagcagcttccctctctgacgagactctacagggcccacctcgcgatcagccagggggtcccgccggcagacaaaggccaaccggccggcccacgagtgcgaggcaggcgatgggtcatagacacaaggcggggggagcagggaggagcgcggagcagtcacgcggcgcaggcaaaaatagagccggcctggagttaccactgggccggccgcctagcgcacccgccgacaaagatggttccaaacccgggaggaccagaggggacggtgccctgcagtccctatgcctgacgacacctacagaagaagccgtgtactgtttttatgggaatgactctgatgaagaacctccggcggccgcccccactccgacacaccggagaacaagtgctattcctagggccttcacacgggagcggcctcaaggcaggaaagaggcccctgctccatctaaagcggcacctgccgctccgccacccgcgagaacgcagccgtcacttattgcagacgagacaccaccctgctattcacttagtagcagcgcttccagcctctcagaacctgagcccagtgaacctcccgctgtccaccctagagggcgcgaacctgctgtcacgaaggatcctggacctggcggagggcgcgacagttcaccctctccccgcgccgcggaagagttgcttcagagatgcatctccagcgccctaccccgaagaaggcctcctgtctcaggcctcagacgtcggaaaccacgggccacccgactagacgagcgccccgctgagggcagccgtgagcgaggggaggaggctgcagggagcgatagggcttccgacttggactctgttgaatggagagccatccaggaaggggctaactcaattgttacttggctccatcaagcggctgctgctacaagagaggcctccagcgagagcgatagtatcttgtcattcgtgtcaggcctgtctgttggctcaacattacaaccccccaagcatcgaaagggtcgccaagcagaaggcgaaatggggtcagctagacgtcctgaaaagagaggcgccgcctcagtaaaaacgagcggctcccctcgttctccagcaggacctgagaagccccgcggaacccaaaagaccacccccggcgtgcccgccgttctccggggccggacagtaatctatgttccgagtcctgctcctcgggcgcagcccaagggcacacctggtcctcgggctacccctaggaaagtggcaccgccatgtctggcccagcctgctgcccctgcaaaggtcccctctcccggccagcagcgcagccgatcacttcatagacccgccaagacgtccgaactggccaccctgagccagcctccaaggagtgccacccctccagccagactggccaagacccctagtagcagctcgtcccagactagccccgccagccagccactgccaagaaaaaggccacccgtcacacaggccgcaggcgcactgcccggaccgggagcgtcccctgtgcctaaaacacccgctcgcacactgctggctaaacagcataaaacccaacggagtccagtgcggattccattcatgcagagacccgcgcggcggggaccgccgcctctggccagagcagtccccgagccgggccctcgaggacgcgccggcacagaggccgggcctggggctagaggaggaagactgggcttggtgcgggttgcttctgcactctcttccgggtccgagtcaagcgataggtcgggctttcgaagacagctgacctttatcaaagagagccctgggttaagacggaggcgatcagaactctcctctgctgagtccgcggccagcgccccccagggcgcttcgccccgccgcggcaggcccgcattgcctgctgtgtttctgtgtagctcccgctgtgaagagctccgtgccgccccacgccaaggccctgcccccgccaggcagaggccccccgctgcccgcccttcgccaggcgaacgacccgctagaagaactactagcgagagtcccagccggctgccagtgagagctccagcagcaaggccagagaccgtgaagcggtacgcttccctgccccacatttctgtggctcggagacccgacggagcagtgcccgccgctcccgcatctgctgacgccgcccggagatcatcagatggagagccacggcccctgccaagagtggccgccccgggcaccacttggcgccgcataagggacgaagacgttccccacattctgcggtctaccttgcctgcgaccgccctaccactgcgaggatccacacccgaggacgctcccgccggccctccccctcgcaaaacgtccgatgcagtcgtgcagacggaggaggtggcagcacccaagaccaactcctctacatctccctcactggagacccgtgaacccccaggggcccccgcaggtgggcaactgtccctgctggggtctgacgtagacggcccctccctggcgaaggctccaatatcagcgccttttgtgcacgagggcctgggtgtcgcagttggcggtttccccgcaagcagacacggtagtcctagtagatccgccagggtaccgccgtttaattatgttcctagccccatggtggtagctgccaccaccgactcagccgctgaaaaagctcctgccacggcttctgctacactgctggagtag

SEQ ID NO: 107406 - DNA, 6912 bp, Artificial Sequence
  Description of Artificial Sequence: Synthetic coding sequence
atggcctcctctgtcgccccctatgaacagcttgtacgacaggtggaagccttgaaggcagaaaactcacatctgaggcaggagctcagggacaactctagtcacctgtccaagttagaaaccgaaacaagcgggatgaaggaggttttgaagcacctacagggcaagctggagcaggaagcacgagtcctcgtcagcagcggacagactgaagtgttggagcagctcaaggcactgcagatggatattactagcttatacaacctgaagttccaaccacctaccttggggccggaaccagcagcccgcactcctgaagggtcaccagttcatggcagcggtccatcaaaagacagctttggagagctctcacgcgcaacgatcaggctgctggaagaactggatcgcgaaaggtgcttcctcctcaatgaaatcgaaaaggaggagaaggaaaagctttggtactacagtcagctccagggtctcagcaagcggctcgatgaactgcctcatgtcgaaacacaattctctatgcagatggacctcattaggcaacagttggagttcgaagcgcaacatatcaggtccctgatggaagaacgttttgggacttccgatgagatggttcagagagcgcagatccgtgcctctaggttagaacagattgacaaggagctgctcgaggcccaggatagggtccagcaaacagagccccaggcactgctcgcggtgaagtctgtcccagtagatgaagaccctgaaacggaagtgccaacacaccccgaggatggaactccccagccaggcaactctaaggtggaagtcgtgttctggctgctatcaatgctagccaccagagatcaggaggatactgctaggactctgctcgctatgtcaagcagtcctgagtcctgtgtggccatgcgcagaagtggctgcctgcccctgctgcttcagatcctccatggaacggaggccgcagccggcggccgcgctggcgcaccgggcgcacccggcgccaaggacgcaaggatgcgagcaaacgctgccttacacaacattgtgttttctcaacctgaccagggacttgccaggaaggagatgcgggtgcttcatgttctggagcagattagagcttactgcgagacatgctgggattggctgcaagctagagatggcgggccagagggagggggagctggaagtgctccgatacccatcgagcctcagatttgtcaagccacttgtgccgtgatgaagttatcgtttgatgaggaatatcgacgggcaatgaatgagctgggcggtttgcaggccgtggccgagctcctccaagttgactacgaaatgcacaaaatgacccgtgaccctctgaatctggcactgcgccgctacgcaggaatgacactcaccaacctgaccttcggtgatgtcgccaataaggccacactttgtgcaagaagaggatgcatggaagctatcgtcgctcaactcgcttctgacagtgaagagctccatcaggtggtgtcttcaatccttaggaatctgagctggcgcgctgacatcaacagtaagaaagtgctgcgcgaggcaggatcagtgaccgcgcttgttcaatgcgtattgcgcgcaacgaaggagtcaaccctgaagagcgttctttccgccttatggaatctgtccgcccactccaccgagaataaagctgccatctgtcaagtggacggagcactgggttttctggtgtcgacgctgacatacaaatgccaaagtaacagtctggccatcattgaatccgggggcggcatattgaggaacgtgtcaagtttggtggcgactcgggaggattatcgccaggtgttaagggaccacaattgcctgcagacactgttgcagcacctcacgtctcatagcctgacaattgtctccaacgcctgtgggaccctctggaatctgtcggctcggtctgccagagaccaggaactgctgtgggatttgggagctgttggaatgctgcgtaatctcgttcactctaagcacaagatgattgctatgggcagtgccgctgccctgcgcaacctacttgcccatagacccgctaaacatcaagcagccgccacagcagtctccccggggagttgtgttcccagtctgtacgtccgtaaacagagggccctggaggccgaacttgatgcccggcacctggcacaggccctggaacatctagaaaagcaaggcccaccagccgccgaggccgcaaccaagaaacccttgccaccattacgacatctagacgggcttgcccaagactacgcctccgactctggctgtttcgacgacgacgacgctccttcttcattggccgcagctgcagccacgggagagcctgcttcccccgcggcactgtcgctgttcctcgggagccccttcttgcagggccaagccctcgcaaggacaccgcccactcggaggggtggaaaggaggccgaaaaagatacctccggagaagccgcagtggcagccaaggctaaagctaagctggccctggccgtggctagaattgatcaactggtcgaggatataagtgccctgcacactagctctgacgattccttctcacttagttccggagaccctgggcaggaggcgccacgagaggggagggctcagtcgtgtagtccatgtcgtgggcctgagggcggccgccgcgaggctggcagtcgcgcgcaccctctcctgcggttgaaagccgcacatgcttccctgagcaatgactcactgaatagcggcagcgccagtgatggttactgcccccgggaacacatgttgccatgtcccctggcagctctggcaagccgaagggaggatcccaggtgtggacagccaagaccatcacggctggacttagatttgccgggatgtcaggcagagccaccagcgagggaggcgacaagcgccgatgctcgggtgaggacaattaagttgtcccccacctatcagcacgtaccactactggagggtgcttctcgagcgggggcagagcccttagcaggtccaggtatttcccctggtgcgcgaaagcaagcttggcttccagccgatcatctctctaaggtgcctgagaaattagcggcagcccctctgagtgtcgcctcaaaggcactgcagaaactcgccgcccaggagggtcccctgagtcttagtcgctgttcctcactgtcaagtctgagcagcgcgggccgaccaggcccttctgagggaggcgatctagacgatagtgactcctcgcttgagggcctggaggaggctggacccagcgaggcagaactggacagcacatggagggcacctggtgctacgtctttaccggtagccatccctgccccaagaaggaatagggggcgagggttaggagtagaggacgcaacccctagcagcagctcagagaattatgtccaagagaccccgcttgttctgtctcgatgtagcagcgtgagttcacttggtagttttgaatccccaagcatcgccagctccattccatccgagccatgctctgggcagggatccggcaccattagccctagcgagctgcctgacagccctggccaaacgatgccaccctcacggtccaagacaccacccctggccccagccccccaggggccccccgaggctacacaatttagtttacagtgggagtcttatgtgaagcggtttctggatatcgccgactgtcgcgagcggtgccggctccccagcgagcttgacgcagggagtgtgaggttcaccgtcgagaagcccgatgaaaacttctcgtgtgctagcagcctgtcagcattggccctccacgagcactatgtgcagcaggatgtggaactgcggctactgccgtccgcctgcccggagagaggggggggagcgggtggtgctggtctgcattttgcgggacataggagaagggaggaaggaccggcacctaccggttcccgtccaaggggtgcagcagatcaggaactggagcttctgagagagtgcctgggcgccgcggtgccagccagactgagaaaggtcgcttccgctctggtgcccggtcgccgcgccctgcccgtccctgtgtatatgctcgtgccagctcccgccccagcccaggaggacgacagttgtaccgactccgcagagggcacccccgtcaatttttcatccgcagccagcctcagcgacgagacactacagggcccaccccgagaccaacctggaggccctgctggacgccagaggcctactggcaggccaacttcagctagacaagccatggggcaccgacacaaggcaggaggggcaggccggtctgccgagcagagtcgcggcgccggtaaaaatagagccggtttggaacttcctctgggccgccccccttccgctccagcggacaaggatggtagtaaacccggaagaacacgaggtgatggcgccctgcaaagcctgtgtctcaccacaccaaccgaagaggccgtctactgtttctatggcaacgacagcgatgaggagccgccggccgctgccccaaccccaacacatcgtcggacctcagcaatcccaagggccttcactagggagcgacctcaaggccggaaggaagccccagcccctagcaaggccgctcccgccgcccccccacctgcaagaactcaacccagcctgatcgctgatgagacaccgccctgctatagtctctcctccagcgcgtccagtctgtccgaacccgaaccttctgagccacctgcagtgcatcccagaggaagagaaccggctgttacgaaagatcccggacctggcgggggcagggacagttctccaagcccccgcgcagccgaggaattactgcagagatgcataagctctgcactgccgagacgccggcctccagtgagtggtctccgccgaagaaagccacgtgccactaggctggatgagagaccagccgagggcagtagagagagaggcgaagaggccgccggctctgatcgtgcctccgatctcgactcggttgaatggcgggcaattcaggagggagcaaatagcattgtaacttggctacaccaggccgcagctgccactcgggaagcatcctccgaatctgatagtatcctatcctttgtaagcggacttagcgtaggtagcacgctgcagcccccaaaacatcgcaaggggagacaggctgaaggtgaaatgggatcagcacgccggcctgaaaagagaggagccgcttctgttaaaacatccgggtcacctcgctctcctgcgggcccagagaaaccgcgtggcacacagaagactaccccaggagtccccgctgtattacgtggcaggacggtcatctatgtacccagtcccgcacctcgcgcacagccaaaaggcactcctggcccacgtgctaccccgcgaaaggttgcccccccctgcttggcacaacctgcagccccagccaaggtgccttccccaggccagcaaaggagcaggtctttgcatagacctgctaagacctccgaattggcaaccctctcacagccacccagatctgcaaccccccctgccagactggcgaagacaccatcctcaagctctagccagacctcacctgcctcccagccccttcccagaaaacgccctccagtgacgcaagccgcgggggcactgcctggtccaggtgcatcacctgtgcccaagacccctgctcggacactgttagcaaaacagcataagacgcagagaagccccgtgagaatccctttcatgcagaggcctgctagacggggccctccaccactggcgagggcagtccccgaaccaggaccgcgaggtcgtgccggcaccgaggcagggccaggggcccgcggaggacgcctgggactggtgagggtggcttccgcactaagtagtggttctgagagctccgatcgatccggcttccggcgccagctgaccttcataaaagagtcaccaggtctaaggaggcgccgctctgagctctcaagcgccgaaagtgcagcctccgcccctcagggagcatctccgagacgaggtcgacccgccctgcccgctgtatttctctgcagcagccgttgtgaagagctcagagcagccccccgccaaggcccagcacctgctcgacaaaggccaccagccgcgcgccccagtccaggcgaacgacccgcccgcagaacaacatcagagagcccttctcgcctcccggtacgggccccggcagcaaggccggagactgtcaagaggtatgccagcctcccacatattagcgttgcccggcgtcccgatggggccgtgcccgccgcccccgccagcgcagatgcggcccgtcgcagctctgatggggagccccgcccattgccccgggtggcggcccctggaaccacctggaggaggattcgcgacgaggatgtacctcatattctgagatccacactacctgcaacggccctacctctgcggggcagcacacccgaggacgcacccgcaggtcctcctcctagaaaaactagtgatgcagtggtgcagacggaggaagtggccgcacctaagacaaacagttccacatctccttccctcgaaaccagggagccacccggcgcccccgccggaggtcaactgtctctcctggggtctgatgtcgatggcccatctttggccaaagcacctatcagcgcccccttcgtacacgaagggctgggagtggccgtgggcggatttccggccagcaggcacggcagtccctccaggagtgccagggtgcctccgtttaattatgtgccttcacccatggtggtcgccgctaccacagatagtgccgctgagaaggctccagctacggctagcgccaccctgcttgagtag

SEQ ID NO: 107407 - DNA, 1545 bp, Artificial Sequence
  Description of Artificial Sequence: Synthetic coding sequence
atgtcttggccccgccgtctcctcctgaggtacctgtttcctgctctgctgctgcatgggcttggtgaaggaagcgctctcctgcacccagacagccgctcccacccacggtccctagaaaagtctgcatggagggcgtttaaagagtcccagtgtcatcatatgctgaagcatctgcataatggggcaagaattactgtccagatgccgcccactatcgagggacattgggtgtctacaggatgtgaagtcaggagcggacctgagttcattacgagatcgtatcgcttttatcacaacaatacatttaaagcctatcagttttattatgggtccaatcgctgcaccaacccaacctacacactcattattcggggcaaaatccggttgagacaggccagttggatcattcgtggaggcacagaggctgattaccagctccacaacgttcaggtgatctgtcacacagaggctgttgcagagaaactagggcaacaggtgaaccgaacgtgccctggctttctggccgatggagggccctgggtgcaggatgtggcttatgatctttggagagaagagaacggctgcgaatgtacaaaggcggtgaattttgccatgcatgagcttcagcttatccgcgtggagaagcaatacctgcaccataatctggatcatctggttgaggaactgttcctgggcgacatccacacagacgccacgcagcgcatgttctacagaccatcttcctaccagccccctttgcaaaatgcgaagaaccacgaccacgcgtgcatcgcctgtcggataatataccggagtgatgagcaccatcctcctatcctgcctccaaaggctgacctgaccatcggactgcacggggagtgggtctctcagcggtgcgaagtcaggcccgaagtattgttcctgacccgacacttcatctttcatgacaacaataacacttgggaaggccactattatcattattcagacccagtttgcaagcacccaaccttctccatatacgccagagggagatattcaagaggcgtgctgtcctctcgggtgatgggcgggaccgaattcgtttttaaagtgaatcatatgaaagtgacacctatggacgcggcaaccgctagtctgttgaatgtcttcaatggtaacgagtgtggcgctgaaggcagttggcaggtgggcattcagcaagacgtgacccatacgaatggctgcgtggcactcggaatcaagctgccccataccgagtatgaaatctttaaaatggagcaggatgctcgggggagatacctcctgtttaatggccagagaccaagtgatgggtcgtcccctgatcgcccagagaaaagagcaacctcctatcaaatgccacttgtgcaatgcgcatccagctcacctcgggcggaagatttagccgaggactcagggtcgtcactgtatggaagggcccccggtaggcacacatggtccctgctgcttgcagcactggcatgtctggttcctttgctgcattggaatattaggcgatag

SEQ ID NO: 107408 - DNA, 1698 bp, Artificial Sequence
  Description of Artificial Sequence: Synthetic coding sequence
atgaaacggcgctgcagctgcggggggggaggtggccattgttcaagcgagcggagaaggactaggcccgaagcagaaggcagggcgagagctcagttgccaggacaccagattggagcaagacgcgccgggggccctcgggccgggctcgagatgtcgtggcctcgaaggctgttgttgaggtatctctttccagcactacttctccacggacttggggagggctcagcgctgcttcaccctgattctcggagccacccccggagtctggagaaatctgcctggagggcgttcaaagagagccagtgtcaccacatgctaaaacacctgcacaatggtgcgcgaataacagtgcagatgccacccactatcgagggacactgggtcagcacagggtgcgaggtccgctcagggccagagttcataactcggtcctatcgtttttatcataacaatactttcaaggcctatcaattctactatggcagcaatagatgtacgaaccccacctatacattgatcatcaggggaaaaatccgacttcggcaagcgtcatggattattagaggaggcacggaagccgattatcagctccataacgtacaagtcatatgccataccgaagcggttgccgagaagctcggccagcaggtgaaccgaacgtgtcccggctttctggccgacggcggtccctgggtacaagacgttgcctacgatttatggagggaagaaaatggctgcgagtgcacgaaagcagtcaatttcgctatgcatgaattgcaactcattcgagtagaaaagcaatatcttcaccacaatctggaccatctggtggaggagctctttcttggagacatccacacagatgccacacagcgcatgttttaccgaccaagctcgtatcagcctcctttgcagaatgcaaaaaatcacgaccacgcttgtatcgcttgccggatcatttaccgctccgacgaacaccacccgcccatactcccaccaaaggctgaccttaccatcggacttcacggcgagtgggtaagtcagaggtgcgaagtgcggcccgaggtgctattcctcacccggcacttcatcttccatgataataacaacacatgggagggccattactatcactattcagacccggtgtgtaaacatccaacgttcagtatctatgctcgagggaggtacagtcgcggcgtcctctcaagccgggttatgggcggcacggagttcgtgttcaaggtcaatcatatgaaggtcacacccatggacgctgccaccgcctcactgttaaacgtttttaatggcaacgaatgcggcgccgaaggaagttggcaggtcggaatccagcaggatgtgacccatactaatgggtgcgtggccctggggatcaagctgccgcacacagagtacgaaattttcaaaatggagcaggacgcgaggggcagatacctattattcaatggccagagaccatcagatgggtcatcccctgatcggcctgagaaaagggccacatcctaccagatgcctctggtacagtgtgccagctcaagtccgagggccgaggatctggcagaggactcggggtcgagcctttatggcagggcacctggacgccacacctggtcactcctgctcgccgcgctggcttgcttggtccctctgttacactggaacattagacggtag

SEQ ID NO: 107409 - DNA, 981 bp, Artificial Sequence
  Description of Artificial Sequence: Synthetic coding sequence
atgccccccagcatttccgccttccaagccgcttacattggaatcgaggtgctgatcgccttggtgtcggtccccggtaatgttctggtaatttgggccgtgaaggtgaatcaggctttgcgcgacgcaaccttttgcttcattgtgagcttggcggtggctgatgtggcagttggggctcttgtgatccccctggcaattctcattaatattgggccacagacctacttccacacttgtctgatggttgcctgccctgtgctcatacttactcagtcatctatactggcactgcttgctattgctgtggaccgttacctgcgcgtcaagattccgctaaggtacaagatggtggtgacccctaggcgtgccgctgtagcgatagcgggctgttggattctgagctttgtggtggggctgacacccatgttcggatggaataaccttagcgctgtcgagagggcatgggcagcaaatggaagcatgggggagcccgttatcaaatgcgagtttgagaaagtcatcagcatggagtatatggtttacttcaattttttcgtgtgggtcctgccgcccctgctgctgatggttctcatctatctggaagtcttctacctcatacggaagcaactgaataaaaaagtgtctgcttcaagcggcgacccacagaaatactatgggaaggaactcaagattgcgaagagcttggcgctgatcctctttctgttcgcactcagttggcttccacttcacatccttaattgtattacactgttctgcccctcctgccacaaacctagtatcctcacatacatcgcgatatttctgacgcacggaaatagtgccatgaatcccattgtctacgccttccgaatccaaaagttcagagtcacattcttgaagatctggaacgatcattttcggtgccaaccagcgcctccgatagacgaagacttgcccgaagaaaggcccgatgactag

SEQ ID NO: 107410 - DNA, 981 bp, Artificial Sequence
  Description of Artificial Sequence: Synthetic coding sequence
atgccgccttctatcagcgcctttcaggccgcctatatcggcatcgaggtcctaattgcgctcgtcagcgtcccaggcaatgtcctcgtgatatgggcagtaaaagttaaccaggctctaagagatgcaacattctgtttcattgtctcccttgcagtcgctgatgtggcagttggtgcactcgtgattcctctggctatactgatcaacatcggccctcagacctacttccatacctgccttatggtggcatgcccggtgctcatattgacacagagcagcatcctcgcccttcttgcaattgccgtcgaccgctacctacgagtgaagattcctctgcgctacaagatggtggtgacgcccagaagggcagccgtcgcaatcgcaggatgctggattctgtccttcgttgtcggtttgactcccatgtttggctggaataacctgtctgccgttgaaagggcatgggcagccaatggctcaatgggagaaccagtaattaagtgcgaattcgagaaggtcatttctatggagtatatggtgtactttaacttttttgtatgggttctgcccccattgctgttaatggtgctcatctatctggaggtgttctacctcattagaaaacagcttaataaaaaagttagcgcaagcagcggggaccctcagaaatattatggtaaggaactcaagatcgcaaagtcactggcgttaattctgttcctatttgctttgtcatggctgcccttacacattctaaattgtattactctgttttgcccatcttgtcacaaaccaagcatattaacctacatagccatatttctgacgcatggcaattctgcgatgaacccaatcgtctacgccttcagaattcagaaatttagagtgaccttcctcaagatttggaacgatcatttccgatgtcagcctgcccctcccatcgacgaggatttacccgaagaaaggcccgatgattag

SEQ ID NO: 107411 - DNA, 378 bp, Artificial Sequence
  Description of Artificial Sequence: Synthetic coding sequence
atgcctcctagcatcagcgccttccaggctgcttacattggcatcgaggtgcttattgcactcgtgagcgtgccaggaaatgtgctcgtcatttgggccgtgaaagttaatcaggctctgcgggatgccactttttgcttcatcgtatccttggccgtcgctgacgtggcggtaggcgcccttgttattcccctggccatactgataaacattggtccacagacatacttccatacatgtcttatggttgcgtgcccagtcctaatcttaacacagagctccatcctcgccttacttgctatcgcagtggaccgctacctgcgggtgaagattccacttcgccgaattagccagtgtatggcttccactaagtcctag

SEQ ID NO: 107412 - DNA, 981 bp, Artificial Sequence
  Description of Artificial Sequence: Synthetic coding sequence
atgcctccctccattagtgcctttcaggctgcctacattggaatcgaggttcttattgccctggtgtctgtcccgggcaacgtgctggtcatttgggccgtcaaagtgaaccaggccctccgggatgccactttttgctttatcgttagcttggccgtggccgacgtggcagtgggcgctcttgtgattccgttggcaatactaataaacatcggaccccagacctactttcacacctgcctgatggtcgcttgcccagttctcatcctgacccaatcttccatccttgctctcttggccatcgccgtcgatcgatatctcagggttaaaatccctctgcgctataaaatggtggttactcctaggcgtgccgccgtggccattgcgggatgctggatcctgagctttgtagtagggctcactcccatgtttggctggaataatctgagtgctgtggagagggcctgggcagctaatgggtctatgggggaaccagtaattaagtgtgaattcgagaaagttatctctatggagtacatggtatattttaatttcttcgtctgggtgctgccgccgctgctactgatggtgctcatatacctggaggttttctaccttattcgcaagcagcttaataagaaagtgtcagcctcatctggcgatcctcagaaatattatgggaaggagctaaagattgccaagtctcttgccttaattctttttctgtttgcccttagctggctgccattgcatatccttaactgcattacgcttttttgcccatcctgccataagccaagcatccttacctatatcgccatattcctcacccacgggaattccgccatgaacccaatcgtgtacgcatttagaatccagaagttcagagtgactttcttgaagatctggaacgaccattttcggtgtcagcctgccccacccatcgatgaggatctgcccgaggagcgacccgacgactag

SEQ ID NO: 107413 - DNA, 1239 bp, Artificial Sequence
  Description of Artificial Sequence: Synthetic coding sequence
atgcctattatgggtagcagtgtctatatcactgttgagctggccatcgctgtcttggctatattaggcaatgttttggtttgttgggccgtttggctcaactctaatcttcagaacgtaaccaattattttgtggtatcactcgctgctgctgatatcgccgtgggcgtgttggctatcccattcgccattactatcagtactgggttttgcgccgcatgccatggctgcctttttatagcttgcttcgtgttggtcctgactcagagcagcatcttttccttgctggcaattgctattgatcgatacatcgctattcgcattccgctgagatacaatggactcgtgaccggcacccgagccaaggggataatcgcaatttgttgggtgctctcttttgcgattggacttaccccgatgttagggtggaacaattgcggccagccgaaggaaggcaagaatcacagccagggctgcggagaagggcaggtagcatgtctttttgaagatgttgttccaatgaattacatggtgtacttcaactttttcgcctgtgtactggtccctctgcttcttatgttaggagtctacctgcggatatttttagcagctagacgccaactgaaacagatggagagccagccacttccgggggaacgcgcacggagcacgctccagaaagaagtccatgccgcaaagtctttggctattatagtgggtctgtttgccctgtgctggctccccttgcatatcatcaactgcttcaccttcttttgcccggattgctcacacgcaccactatggctcatgtatctagccattgtactgtcacacacgaacagcgtcgtcaacccattcatctatgcttaccgcatcagggagtttagacagaccttcaggaagataattagatcacatgtcctacgtcagcaagagccattcaaagctgctggcacatctgctagggtgctggctgcccatgggtcagatggagagcaggtcagccttcggctgaacggtcatccaccaggcgtgtgggcgaatggctctgcaccccaccctgagaggaggccaaacggctatgctctgggattggtaagcggcggtagcgcccaggaaagtcaaggtaacacgggactgccagacgtagagctgctcagtcatgaactgaaaggcgtgtgtccagagcccccaggcctagacgatccgctggcccaggacggcgccggggtgagctag

SEQ ID NO: 107414 - DNA, 1239 bp, Artificial Sequence
  Description of Artificial Sequence: Synthetic coding sequence
atgcccattatgggatcaagcgtttatatcaccgtggaactggcgatcgcagtgcttgctattcttggaaatgtgctggtttgctgggccgtgtggctgaattccaaccttcagaatgtgacaaattacttcgtagtctctctggctgctgctgatatagccgttggcgtgctcgccatcccatttgctataacaatctcaaccggcttctgtgccgcctgtcacggatgcctttttattgcatgttttgtgctggtactgacacaatccagtatattcagcctgcttgctatagcaatcgatagatacatcgccattagaatcccactgcggtataacggccttgtgacggggacacgcgccaaaggaatcattgcgatctgttgggtgctttcctttgccattggcctcactcccatgctgggatggaataattgtggccagcctaaagaaggcaagaaccacagccaggggtgcggcgaggggcaggtcgcatgtcttttcgaggacgtcgtgcctatgaactacatggtttactttaacttttttgcctgcgtgctggtgccccttctgctgatgctgggagtgtatcttcggatcttcctcgcggcgagacgacaacttaagcaaatggagtcgcagcccttgcctggcgagcgtgctcggtcaacgttgcagaaggaggtgcacgccgcaaagtctcttgccatcatagtcggactgtttgccctgtgttggctgcccctccacattatcaattgctttactttcttctgtcccgactgttctcacgcgccactttggctgatgtatctcgctatagtcctaagtcacactaactctgttgtgaaccccttcatatatgcctatcgtatacgggagttcagacagacattcaggaagatcattagaagtcacgttcttcgccagcaggagccctttaaggccgcggggacttctgcgagggtcctggcagcccacggaagtgatggagagcaggtatcgctccggctgaacggacatcctccaggtgtgtgggctaatggaagcgctccgcacccggagaggaggccgaacgggtatgccctgggcctagtgagcggtggctccgctcaggaatcacaagggaatacgggtctaccggatgtcgagttgttgtcacacgagttaaaaggcgtgtgtccggaacccccaggactcgatgaccctttggcgcaggacggtgctggggtaagttag

SEQ ID NO: 107415 - DNA, 267 bp, Artificial Sequence
  Description of Artificial Sequence: Synthetic coding sequence
atgcccatcatggggtccagtgtgtacatcaccgtcgaacttgcaatcgctgtgctggctatcctaggaaacgttctggtctgctgggcagtctggctgaactctaatttacaaaatgtcactaactatttcgtggtatccctggccgcagccgacattgctgtgggggttctggccattccctttgctattacaatttccactggcttctgtgccgcttgtcacgggtgtttattcatcgcgtgctttgtgctggtcctgacctag

SEQ ID NO: 107416 - DNA, 195 bp, Artificial Sequence
  Description of Artificial Sequence: Synthetic coding sequence
atgcccattatgggttcctcagtgtacatcacggtcgaactggcaatcgccgtcttggccattctgggaaacgtgttagtatgctgggcagtctggttgaattccaatctgcagaacgtgactaactatttcgtggtgtcgctagccgcggccgatattgcagtgggagtccttgccatccctttcgccatctag

SEQ ID NO: 107417 - DNA, 231 bp, Artificial Sequence
  Description of Artificial Sequence: Synthetic coding sequence
atgccaattatgggatcaagtgtttacattaccgtcgaactcgcaatcgccgtactggctattttgggaaatgtcttagtatgctgggccgtatggctcaattccaacctccagaacgtgaccaattattttgtagttagtctggccgccgcggacattgctgtgggggtcctcgcgataccattcgcgattactatttccacaggtttttgcgctgcatgccatgggtag

SEQ ID NO: 107418 - DNA, 1098 bp, Artificial Sequence
  Description of Artificial Sequence: Synthetic coding sequence
atgcctatcatgggaagcagcgtgtatataaccgttgagttagcgattgccgtcctcgcaattctgggcaatgtactggtgtgttgggcagtatggctgaactccaatcttcagaacgtcacaaattattttgtggtgtccctagcagcggcggacatcgccgtcggcgtacttgcgattccatttgctataacaatatcgacaggcttttgtgctgcgtgccacggctgcctcttcatcgcctgcttcgtgcttgtactgacacaaagcagcatttttagtctgttagctattgccatcgacagatatatagccatacggatccccctacggtataatgggctggtgactggcacgcgggcaaagggtattatagccatctgctgggtattaagcttcgctattggactgaccccgatgctcggctggaacaactgcgggcaacccaaggaaggaaagaatcacagccaagggtgtggggagggccaggtggcctgtctatttgaagatgtagtccctatgaactacatggtatacttcaattttttcgcttgtgttctggtgccgttgttgctgatgctgggcgtgtacctgcgcattttcctagctgctaggaggcagttgaagcagatggagtcccagccacttccaggtgagcgggcgcgatcaaccttgcaaaaggaagtccacgcagccaaatccttggcaatcatcgtgggcctcttcgccctctgttggctgcctcttcacatcatcaactgttttactttcttttgccctgattgcagccatgcccctctgtggttgatgtatctcgctatagtgctgtcacatacaaatagtgtcgtgaacccatttatttacgcttacaggatcagggagtttcgacagacattccgcaaaatcatccggtctcacgtcctacggcaacaggagccgtttaaggcggctggtacatccgctagggttctggcagcccacggatcagacggcgagcaggtctctctgcgtttgaacggccaccctcctggagtctgggccaatggctcagcaccccacccagagcggagacctaatgggtacgcactcggcctctag

SEQ ID NO: 107419 - DNA, 1239 bp, Artificial Sequence
  Description of Artificial Sequence: Synthetic coding sequence
atgcccatcatgggatcgagtgtctacattactgtagagctggctatcgctgtactcgctatactgggtaacgtcttggtctgctgggccgtgtggctaaacagcaatctccagaatgttactaattacttcgttgtgtccttagcagcagccgatattgctgttggggtgctggcaatcccgttcgccattacgatctctaccggtttttgcgccgcgtgccatgggtgcttgttcattgcttgcttcgtactcgtcctgacccagtcaagcattttctcactgcttgccattgccatcgaccgctatatagctataaggattccattaagatataatgggttagttacgggcacacgtgcaaagggaattattgccatctgctgggtcctcagctttgcgattggcctgacgcccatgcttggctggaacaactgcgggcaacctaaggaaggcaaaaaccattcacagggctgcggtgagggtcaagtggcttgtctcttcgaagacgttgtgccaatgaactacatggtttacttcaattttttcgcctgcgtgctggtcccactgctcttaatgcttggcgtgtacttgcggatcttcctggccgcccgacggcaactgaaacagatggaatcccaacccctgcccggtgagcgcgcacgctctaccttgcaaaaggaagtgcacgcagccaagagtctggcaattattgtcggcctattcgcgctgtgttggcttcctctgcacattataaattgctttaccttcttctgccctgactgcagccatgcacctctttggctcatgtatttagcaattgtcctgtcccacaccaactcagtggtcaatccattcatttacgcctacaggatccgggagtttcgccaaacatttagaaagatcatccgatcccatgtgttaaggcagcaggaacccttcaaagccgctggcacctcagcccgcgtgctggccgcccatggctccgatggcgaacaagtctcactgcggctgaacggccacccaccaggagtttgggcgaacggttcagccccacatcccgaacgacgccccaatggctatgccctcggcttggtgtcagggggctcagcccaggaaagtcagggcaacacggggcttccagatgtggagctgctgagccacgagctcaaaggtgtgtgtcctgaaccaccaggcttggatgatccgttagcccaggatggcgccggagtctcttag

SEQ ID NO: 107420 - DNA, 999 bp, Artificial Sequence
  Description of Artificial Sequence: Synthetic coding sequence
atgctgcttgagacacaagatgcattatacgtggccctcgagctggtgatagccgcactgagtgttgccggaaacgttctggtgtgcgcagcagtggggaccgccaatacgctccaaactccaacaaactactttctcgttagtttggccgcagccgatgtggcagttggtctcttcgctatcccgtttgctattacaatctctctgggattttgtacagacttttacggatgtttattccttgcatgtttcgtgctcgttctcacccagtcctccatcttctctcttctggctgtggctgtggaccgatacctagctatctgtgtgcccctgaggtataagagtttagtgactggaacgcgagccagaggtgttattgctgtgttgtgggtgttggcttttggcatcggcctcactcccttcttgggttggaattcgaaggatagcgctacgaataactgtactgaaccctgggacggaaccaccaatgagagttgctgtctggtgaaatgtttatttgaaaacgttgtccccatgtcttacatggtgtactttaacttcttcgggtgtgtgctgccccctctgctgatcatgctggtcatatacattaaaatcttcttagtcgcatgtagacagctacagcggactgagctcatggatcactctcgaaccacgttacaacgagaaatccacgccgctaagtcactggcgatgatcgttggcatctttgcactgtgttggctccccgtgcacgctgttaactgcgttaccctcttccagcctgctcaaggtaagaacaagccaaaatgggctatgaatatggctatattgctctcccatgctaattccgtcgtgaaccccatcgtttatgcgtatcgaaaccgcgactttagatatacctttcacaagatcatttcaagatatctgctttgtcaagccgacgtgaaatccggtaacggacaggccggcgtccagcctgctctcggagtgggactgtag

SEQ ID NO: 107421 - DNA, 957 bp, Artificial Sequence
  Description of Artificial Sequence: Synthetic coding sequence
atgccgaataatagtacagcactgtcgttggctaacgtgacttatatcactatggagatattcattggactctgcgccatagtggggaatgtactcgtcatctgtgtcgtaaaattaaacccctcactgcaaaccacaaccttctattttatcgtctccctggcacttgccgacatcgcagtgggggtgctggtcatgcctctcgccatcgtggtgagcctgggcatcacaattcacttttacagttgcttattcatgacttgcctgctacttatcttcacacatgcctcaatcatgtctctactcgcaatcgcagtggaccggtacctgagggtaaagctaacagtgcggtacaagcgcgtaaccactcatcggagaatatggctcgctttggggctctgctggcttgtgtcgtttctggtgggtctaactcctatgttcggttggaatatgaaactgacaagcgaatatcaccgaaatgtgactttcttatcatgtcaattcgtatcggtaatgcgcatggactatatggtttattttagctttctgacctggatctttatcccattagtggtgatgtgcgcaatctacctagacatcttttacatcatccgtaacaaactgagtctgaacctgagtaactccaaggagaccggcgcgttctatgggcgagagttcaagacagcgaaaagcctgttcctcgtgctctttttatttgcgctgagttggctccctctgagcattattaactgtataatttatttcaacggagaagtgccccagctcgtgctgtacatgggcattctgctgtcacatgcaaactccatgatgaatccaattgtgtatgcctataaaataaaaaagtttaaggaaacttacctactcatcctaaaagcctgtgtagtgtgccatcccagtgatagtctcgacacatcaattgagaagaacagcgagtag

SEQ ID NO: 107422 - DNA, 537 bp, Artificial Sequence
  Description of Artificial Sequence: Synthetic coding sequence
atggaagggagtcctgcaggcccgattgagcaaaaggaggctcgctgggagtctagctgggaagagcagccggattggaccctaggatgccttagccctgagtcccacactaaccatgtcgccctgagggatacagggaaccagttgatagtgaccatgagctgtctgacaaaagaagacacaggctggtactggtgtggcatacagcgcgattttgctcgggacgacatggatttcacagaactgattgtcactgatgacaaaggcacgctcgctaacgatttttggtcaggcaaggacctgtccggcaataagacaaggtcttgcaaagctccaaaggttgtgagaaaagcggacagatcgaggacttctatcctgattatctgtattttgatcacaggcctgggaatcatatcagtgatatctcacttaacaaaacgccgaaggtcgcagagaaatagacgggttggaaatactttgaagccattctctagggtcctgacgcctaaggagatggcacccaccgagcagatgtag

SEQ ID NO: 107423 - DNA, 1044 bp, Artificial Sequence
  Description of Artificial Sequence: Synthetic coding sequence
atgcccaataatagcaccgcactatcgctggcgaatgtgacctatatcaccatggaaattttcataggcctgtgcgctatagtcggcaacgtgctggttatatgcgtagttaagctgaatccttctctgcaaacgactactttctatttcatagtgagtctcgcgctcgctgacattgctgtgggcgtcctggtgatgccactcgccattgtcgtgtctctcggcattactatacacttctactcgtgcctctttatgacctgcttattactcatattcacccacgcaagcattatgtcactgctggctattgcagttgatcgatatcttcgtgtaaaactgaccgtgaggttcagaattccaggcctgcccggttgtatactgagctttcagttaaaggtatgctttctgcctgtgatgtggcttttcattcttcttagtcttgctctgatttctgatgccatggtgatggatgaaaaggtgaagagatcatttgtattagacactgcctctgcgatctgtaactataacgcccattacaagaatcacccaaagtactggtgtagagggtacttcagggattattgcaatataatcgccttcagtcctaactctactaaccacgtagccctgcgggacacgggtaatcagcttatcgttactatgtcctgtctgactaaagaggacacgggatggtactggtgcggaatccagcgggatttcgcccgcgacgacatggatttcaccgagctgatcgtgactgacgacaagggcactttagcaaacgacttttggagtggcaaggacttgtccggtaacaaaacgagaagttgtaaggctcctaaggtagtgcgtaaagccgaccggtctagaacgtcgattttaataatctgcatccttattacaggccttgggattataagcgtcatttctcaccttacaaagcgacgcaggtcccagcgcaacaggcgggtggggaataccttgaaaccattcagccgggtgctgacccccaaagaaatggcccctactgaacagatgtag

SEQ ID NO: 107424 - DNA, 801 bp, Artificial Sequence
  Description of Artificial Sequence: Synthetic coding sequence
atggaggggtcgccggcggggcccattgaacagaaggaggcgcgctgggaatcttcttgggaagagcagcctgattggactctcggctgcctgagccccgaatctcagttccgcatccctggacttcccggctgtatcctttcttttcaactcaaggtgtgcttcctccctgttatgtggctgtttatcctgctgtcacttgcattgataagtgacgcaatggttatggacgagaaggtgaagagatcctttgtcttggacacagcaagtgccatctgcaattacaatgcacattataagaaccatcctaaatattggtgtcgcggttatttcagagactactgcaatatcattgcattttctccaaatagcaccaaccatgtggcccttcgtgacacggggaaccagctcattgtcacgatgtcgtgcctcaccaaagaggatacaggatggtactggtgcgggatacagagagacttcgcccgcgatgatatggactttaccgaactcatagtcactgatgacaaaggcacactcgcgaatgacttttggagcggtaaagacctctcgggaaacaaaacacggtcatgcaaagcgcccaaggtggttaggaaagctgatagatcccgcacgagcatactcatcatttgcatcttgatcacaggactgggcattatttccgttatcagccacttaactaaacgccggaggtctcagcgtaataggcgggtgggcaatacgctgaagccattttcccgggtcctgaccccaaaagagatggcgcccactgagcaaatgtag

SEQ ID NO: 107425 - DNA, 624 bp, Artificial Sequence
  Description of Artificial Sequence: Synthetic coding sequence
tgaccccaagccctgcagggaccacctagctcaaacgacgccatggtgatggacgagaaggtgaaacgttcctttgtcctggacacagcaagcgctatttgtaattacaatgcgcactacaagaatcacccgaaatattggtgtagggggtacttcagggactactgtaatatcattgctttttcccctaactcaacaaaccacgtcgctcttagagacactggaaatcagctcatcgtgacaatgtcctgcctgacgaaggaagatacaggttggtattggtgtggaatccaacgtgacttcgctagagatgatatggactttacggagttaattgtgacagacgacaaggggaccttggcgaacgatttctggagcgggaaagatctgagtggcaataagacccgctcttgcaaagcccctaaagtggttaggaaggccgacagatcaaggactagtatcctaattatatgtattctcatcacaggactggggattatatctgttattagccatctcacaaaacgccgcaggtcccaaaggaacagacgcgtggggaatacactgaaaccctttagcagagttttgactcccaaagagatggcacctaccgagcaaatgtag

SEQ ID NO: 107426 - DNA, 348 bp, Artificial Sequence
  Description of Artificial Sequence: Synthetic coding sequence
tagccatcctcccatgtggcactgcattccacactcctggggagccatttctccaccaatcatgttgccctgcgcgataccggcaaccagcttatagttactatgagttgcctaacaaaggaagacaccgggtggtactggtgtggaatccagagggatttcgcccgcgatgacatggattttaccgagctgattgtcacagatgataaaggtacacttgccaatgacttctggagcgggaaggacctctctggaaataagacccgaagttgcaaagcgcccaaagtcgtgagaaaagctgatcgatcccgcactagcatcctgattatctgcattcttatcacatag

SEQ ID NO: 107427 - DNA, 519 bp, Artificial Sequence
  Description of Artificial Sequence: Synthetic coding sequence
ggcccgatcgagcaaaaagaggctaggtgggaatcaagttgggaggagcagccggattggacgctggggtgtctcagcccggaatcccacaccaaccacgtcgcattgcgagatactggcaaccagttgattgtaactatgtcatgtctgacaaaggaggacaccgggtggtactggtgtggcattcaaagagacttcgcccgcgatgatatggacttcacagagctgatcgtcaccgacgacaaaggcaccctggccaatgacttctggtcaggaaaagatttgtccggcaacaaaacacgatcctgtaaagcacctaaggtcgtccgaaaagcagaccgctcaaggacgagcattctgatcatctgcatcctgatcactggattaggcatcatctccgtgataagccatttgactaagcgaaggagatcacagcggaacaggcgcgtgggcaacacactgaaaccgttctcgcgagtgctcacacccaaggagatggcacctacagaacaaatgtag

SEQ ID NO: 107428 - DNA, 1092 bp, Artificial Sequence
  Description of Artificial Sequence: Synthetic coding sequence
atggcgcaaacacctgcctttgataagccgaaagtggaattgcatgtccacctggatggcagtatcaaacctgagacaatcttgtactacggcaggcgccggggaatagccctgcccgcaaacaccgctgaaggattactcaatgtaatcggcatggacaagccactgacactgcctgacttccttgccaagtttgattattacatgcctgccatagccggctgccgcgaggcaattaagagaatagcttacgaattcgtcgaaatgaaggccaaagaaggagtcgtctatgtggaggtgcggtactcccctcacctcttggccaatagtaaggtggagcccattccatggaaccaggccgagggagacctgacacctgacgaggtggtcgctttggtggggcaaggactgcaggaaggagagagggattttggcgtgaaagcacgatcgatcctctgctgtatgcgccatcagcccaattggtcgcctaaagttgtggaactttgcaagaaatatcagcagcagactgttgttgctatcgacctcgccggtgatgagactatccccgggtcttctcttctcccgggccacgtgcaggcataccaagaagctgtgaaatctggcattcaccgcaccgtgcatgcaggagaggtgggcagcgctgaagtcgtaaaagaggcagttgatatactgaaaacggagcggctggggcacggctatcacaccctggaggaccaggccttatacaatagactccggcaggagaatatgcactttgagatctgtccttggtcctcctacctgaccggcgcctggaagccggataccgaacacgccgtgatcaggctgaagaacgaccaggcaaactacagtttaaatactgacgacccactgatatttaagagtacgctggacacagattatcaaatgaccaaacgggatatggggttcactgaagaggagttcaagagactgaacattaatgccgccaagtccagttttttgcccgaggacgaaaagcgcgaattgttggatctgctttacaaggcctatgggatgccaccgtctgccagcgccggacagaacctctag

SEQ ID NO: 107429 - DNA, 1731 bp, Artificial Sequence
  Description of Artificial Sequence: Synthetic coding sequence
atggcttctaacaatcactggttccagagttcgcaggtccccagctttgcccagatgttgaagaagaaccttccagtgcagccagccaccaaaacaatcacaaccccaacggggtggtctagtgagtcttatggtttaagcaaaatggcgagcaaggtaactcaagtgaccgggaactttcccgaacctcttttaagcaagaatctttcatccatcagcaaccccgttttgccacccaagaagatacccaaggagttcattatgaagtacaagcgtggtgagatcaacccagtatccgcactccaccaatttgcccaaatgcagagagtccaactggacctgaaagaaactgtgacaacagggaatgtcatgggcccgtattttgctttctgcgccgttgttgacgggattcagtataaaacgggccttggtcagaataaaaaggagtcaagaagcaacgccgccaaactggccctggatgaacttcttcagctggacgagcccgagccaagaattctggaaacttcagggccacccccatttcctgcagaacctgtggtcctgtcagaactcgcctacgtcagtaaggtccattacgagggcagacacatccaatatgccaaaatcagccagattgttaaagaacgttttaaccaactgatcagtaatcggagcgaataccttaagtactccagctccctggctgcattcatcatcgagagagccgggcagcatgaagtggtcgctattggcaccggtgagtataattattctcaggatataaaaccagatggacgtgtcttgcatgatactcacgccgtagtcacagcccgccgatctctgctgcgctacttttacagacagctactattgttctactccaaaaatccagccatgatggagaaatcaatcttctgcacagaaccaaccagtaatctgttgacgttgaagcagaatatcaatatttgcctctacatgaatcagctgccaaaaggaagtgcacagatcaaatcgcagctgcggttgaatccacactctatttcagcattcgaggccaacgaagagctgtgcttgcatgtggccgttgagggcaaaatttatctgaccgtttactgtcctaaggacggtgtgaatcggatctcctcgatgtcgagttccgacaagctgacacggtgggaagtgcttggcgtccaaggcgccctgcttagccacttcatccagccagtgtatatctcctccatcctgataggagatggtaattgctcagatacaaggggtctggagatcgctatcaagcagagagtggacgacgccttaacgagcaagctgcctatgttttatttggtaaaccgcccacatatcagcctagttccttcagcctatcctctccagatgaacttggagtacaaattcctctctctgaactgggctcagggagatgtaagtttggaaatcgtggacgggctctctgggaagattaccgagagcagtccctttaagtctggcatgagcatggcttctcgactgtgcaaggctgcaatgctgtcccgattcaatctgctggcaaaagaggccaaaaaggagctgctggaggccggtacctaccatgctgccaagtgcatgagtgcttcatatcaagaagctaagtgcaagctgaagtcttatctccaacagcacggttacggttcatggatagtgaaaagtccttgcatcgaacagtttaatatgtag

SEQ ID NO: 107430 - DNA, 1698 bp, Artificial Sequence
  Description of Artificial Sequence: Synthetic coding sequence
atggccagcaacaatcactggttccagtcttctcaggtgccctctttcgcacagatgctaaagaagaatctgccggttcagccagccacaaagaccatcactactccaactggctggtcgagtgaatcttacggcctttcgaagatggcaagcaaggtgactcaggtgaccggaaatttcccagagccattactgagcaaaaacctgagcagtatcagcaaccctgtcctacctccaaagaagatccccaaggaattcattatgaaatataaacgtggagagatcaatccggtgtctgcacttcatcagttcgcacagatgcaacgtgtgcagctggacctgaaagagaccgtaactaccggtaatgtgatgggaccctattttgctttttgcgctgtggttgacggaatccagtacaagacaggattggggcaaaacaaaaaggaatcacgatcaaacgcagcaaaattagccctcgacgaactgctccagcttgacgagcccgaaccacgcatcctcgagaccagcggtccgcctccctttcccgctgaacccgtggttctcagcgagctcgcctacgtgtctaaggttcattatgagggtaggcatatccaatacgcgaagatatcacaaatagtgaaggagaggtttaaccagctgatcagcaatcgcagtgagtatctgaaatactcctcttcacttgcggcattcatcatcgagcgggcagggcaacatgaagtcgtggcaataggaaccggagagtataattattctcaggatataaagccagatgggcgggtgcttcacgacacacacgctgttgtcaccgcccgccgaagtcttctgagtaagaaccctgctatgatggaaaagtccatattttgcactgagcccacttcaaacttgctcactctcaaacagaacatcaatatctgcttgtatatgaaccagcttcccaaaggatctgcccagattaagagtcaactccgcctgaacccacacagcatctcagctttcgaagctaacgaagaactgtgcctccatgttgccgtggaggggaagatctatctgactgtgtactgtcctaaggatggtgttaatcgtataagttctatgtcttcctcggataaactcacaagatgggaggtccttggcgtgcagggcgccctgctgagtcatttcatacagcccgtgtatatcagctcaatcctcattggcgatggaaactgttctgacactagagggctagaaattgcgataaaacagagggtcgatgacgcactgacctcaaagctaccaatgttctacctggtaaataggccacacatcagcctggtgccctcggcgtatcctctgcagatgaatctcgagtataagttcctgagccttaattgggcacagggagacgtatccctggagatcgtggacgggctgtccgggaaaattacagagagtagccctttcaaaagtggcatgtctatggcatcccggctgtgcaaagcagccatgctgtccaggttcaatctgctggcgaaggaggccaagaaggagttgcttgaggcaggtacctatcacgctgcaaagtgtatgtcggcttcctaccaagaagcgaagtgcaaactgaaatcatatttacaacaacatggctacgggagttggattgttaagagcccatgcatcgagcaattcaacatgtag

SEQ ID NO: 107431 - DNA, 726 bp, Artificial Sequence
  Description of Artificial Sequence: Synthetic coding sequence
atggccagcaataatcattggttccagagcagccaggtgccttctttcgcacagatgctgaaaaagaatctgccggtgcagcccgcaactaagactattacgacaccaaccgggtggtcaagcgagtcatatggcctttctaagatggcaagcaaggtaactcaagttacaggcaactttccagagcctcttctctccaagaatctgagcagtattagcaaccctgtccttcctcctaaaaagattccaaaagagtttattatgaaatacaaacgcggcgagattaaccccgtgtccgcactgcaccagtttgcgcagatgcagcgagtgcagctcgatctcaaagaaactgtgacaactggaaatgtaatggggccctattttgcattctgcgctgttgtggatgggatacaatataagacgggactcggtcagaataagaaagaaagccgctccaacgcagcaaagcttgccctggacgagctcctgcagcttgatgagcccgaacctcgcatactggagacatccggcccgcctcctttccccgcagagcccgtggtcctttctgagctggcgtacgtttctaaggtgcattacgagggcaggcacattcagtacgccaagatctctcagatagtgaaggagcggttcaatcagctaatttccaaccgcagcgaatacttgaaatattccagttccctggcagcattcataatcgagagatag

SEQ ID NO: 107432 - DNA, 471 bp, Artificial Sequence
  Description of Artificial Sequence: Synthetic coding sequence
atggcctccaataatcattggttccagtccagccaggttccaagctttgcacaaatgctaaaaaaaaatctaccagtgcagcctgccactaagaccatcactacccctaccggctggagttcagagtcttatggactctccaagatggccagtaaggtgacacaagtcacgggaaattttcccgaacctcttctctcgaagaacctgagtagcataagcaatcccgtcctcccacccaagaaaataccgaaagagttcatcatgaagtataaacgaggtgaaatcaaccccgtcagtgccctgcaccagtttgctcaaatgcagagagttcagctcgatttgaaagagactgtcaccaccgggaacgtaatgggaccatacttcgctttttgcgcagtcgtggatggcatacagtataagaccgggctcggacagaacaagaaggagtctcgatccaacgccgctaaatag

SEQ ID NO: 107433 - DNA, 1677 bp, Artificial Sequence
  Description of Artificial Sequence: Synthetic coding sequence
atgttaaaaaagaatcttcctgtgcaacctgccaccaaaacaatcacaactccgacaggctggagttccgaatcttacggactcagtaaaatggcaagcaaggtgacccaggtgacaggcaatttcccagaaccactgctgtcgaagaatttgtcctccatctcaaatccggtgctgcctcctaagaagatccccaaagagtttatcatgaagtacaaacggggggagatcaaccccgtgtctgcgctgcaccagtttgcacagatgcagcgtgtccagttggaccttaaggagacagtgaccactgggaacgtgatgggtccttacttcgccttctgtgccgtcgtcgatggcattcagtataagactggcttgggtcagaataagaaggagtcgcggtccaatgctgctaagttggctctggatgagctgctccagctggacgagcccgaaccacgaatactagagactagcgggccgccccccttccccgccgagcctgtcgttctgtctgagctcgcatacgtgtcaaaggttcattacgaggggagacacatccagtatgctaagatctctcagatcgtgaaagaacgcttcaaccagctgattagcaaccgcagtgagtatctgaaatactccagctctcttgcggcctttatcattgaaagggcaggtcagcacgaagtggtggcaatcggtactggtgagtacaattatagccaggacatcaaacctgacggacgtgttttacatgacacccatgccgtagtaaccgctcgaagaagtctgttacgctacttctatagacagctgctcttgttctactcaaagaatcccgctatgatggagaagagcatcttttgtacggaaccgacatccaacctgttgactttgaaacagaatattaatatctgcctatacatgaaccagctgcccaagggaagcgcccagatcaagagccagttgcgccttaatccacacagcataagcgcctttgaggccaacgaggagttgtgcctgcacgtggccgtggaagggaagatataccttaccgtgtactgccctaaggatggagtgaacagaatttcttctatgagcagttccgataagttgacccgctgggaggtgctgggcgtgcagggtgctcttctctcccacttcatccagccagtctacatttcatcgatactgattggcgatggaaattgttcagatacaaggggactggagattgcgattaaacagcgggttgacgacgccttgacctcaaagctcccgatgttctacctcgtcaatagaccccacatctctctggttccttccgcctaccctctgcaaatgaacctcgagtacaagtttctgtcacttaattgggctcagggcgacgtcagcctcgagatcgtggacgggctgtcaggtaagattactgagtcttcgccgtttaagagcggaatgagtatggcctctagactgtgcaaagcggccatgctctcacgcttcaatctgttggcgaaggaggccaaaaaggagctgctagaggcagggacatatcatgccgcgaagtgcatgagcgccagctaccaggaggcaaaatgtaagctgaaatcttatctgcaacagcatgggtatgggagttggatcgtaaagagcccgtgcattgagcaattcaacatgtag

SEQ ID NO: 107434 - DNA, 3810 bp, Artificial Sequence
  Description of Artificial Sequence: Synthetic coding sequence
atgatgagtcccatatgcgatcaaacgatcgattcccgtcttaaggttgagaaagcaacctggtggggcagggtgggcgggggctctcgacctcattggcagagcccaggcgtcagaccttgtcccgaggaagtgcaggacccaggctattctcttagcgggtactacactcatccttttcaaggatacgaacatagacagctcagatatcagcagccaggtcctggcagctccccaagctcctttctgctgaaacagattgagttccttaagggccagcttccggaggcacccgtgattggcaagcagacaccatccctgccgccttccctacccggccttcgccctaggtttcctgtgctgctggcctcctccacaaggggaagacaggtggacattcgtggcgtgcctagaggggtgcacttaagatcacaaggacttcaacggggcttccagcacccttccccaagggggagatctttacctcagagaggcgtagattgccttagctcccattttcaggagctcagcatttaccaggatcaagaacagagaattctgaagtttctggaagagttgggcgaagggaaggccacgacggcacacgatctctcagggaagctgggaacaccaaagaaggaaattaacagagtgctctattctctcgccaagaagggcaagctgcagaaggaggctggcacccctcccctctggaagattgctgtttcaacacaagcttggaaccagcacagcggcgtcgtcagacctgacggtcattctcagggcgcccctaatagcgatccaagcctggagcctgaggatcggaactcaacttccgtcagtgaagacttgcttgaaccattcatcgcggtgtccgcccaagcttggaatcagcacagtggcgtcgtgcgaccagatagccatagccagggctctcccaatagcgatcctggcctcgagccagaggattctaactctacctcagccctggaagacccactggaattcctggacatggcggagattaaggaaaaaatctgcgactacctctttaacgtatcggactctagcgcgcttaacctcgccaagaacatcggtcttactaaggccagagatattaacgctgtgctgatcgatatggaaagacagggagatgtgtatcgacaggggacaactcctccgatatggcatctcactgacaagaagagggagcgcatgcagatcaagcgcaacacaaacagcgtgcccgagaccgctcctgcagcaataccggagacgaagagaaacgcggagttcctgacatgtaatatacccactagtaacgctagcaacaacatggtcaccactgaaaaagtggaaaacggacaggagcccgtcatcaagcttgagaacaggcaagaagcaagaccagagccggcgagactcaagccgcccgttcactataatggtccgtccaaggctggatatgtcgacttcgaaaatgggcagtgggctactgacgatatccccgacgacttgaattccatcagagccgcccccggggagtttagagcgattatggagatgccaagcttttatagccacggactcccccggtgctcaccatacaaaaagctcacggagtgtcagctgaaaaatccaatctccggactcttggaatacgcccagtttgccagccagacatgcgagtttaacatgatcgagcagtcaggcccaccccacgagcctagatttaagtttcaagtcgtgataaacgggagggaattcccccctgccgaggcggggagtaagaaggtagccaagcaggacgctgccatgaaagcgatgaccatcttacttgaggaagcaaaggcaaaagactccgggaaatctgaggagagctctcattattcaacagaaaaagagtccgagaaaacggcagaatcccagacccccacaccgtccgccacgagcttcttctctggaaaaagccccgtcacaaccctcttagaatgtatgcacaagctgggcaactcatgtgagtttaggcttctttccaaggagggcccggcacatgaacctaagttccaatactgtgtggccgtcggagcccaaacatttccatccgtgtctgccccttccaagaaggtcgcgaagcagatggcggcggaggaagccatgaaagccctgcacggggaggcgacaaactccatggcctctgacaaccagcctgagggcatgatcagcgagtcactggataatcttgaatcgatgatgcccaacaaggtcaggaaaatcggtgagctggttagatacctgaataccaaccccgttggcgggctgctagagtatgctaggtctcacgggttcgccgctgagttcaaactggtggaccaaagcggcccgccacatgagccgaagtttgtgtaccaagctaaggtgggcggtagatggttccctgctgtctgtgcccactcaaaaaaacagggaaaacaggaagcagccgatgccgctttacgtgtacttataggggagaacgagaaagcagaacgaatgggatttaccgaagtgacgccagtgactggggcaagcctgagacggaccatgttgcttcttagccggtctcctgaagcacagcccaaaactcttcctctcacaggatcaaccttccacgaccagatagcaatgctgtcacatcgatgttttaatacactcacaaactccttccagccaagtctcctgggccgcaagattttggcagcgatcattatgaagaaagatagcgaggacatgggagtcgtcgtaagcctgggcaccggcaatagatgcgtcaaaggggacagtctgagccttaagggggaaactgtcaacgactgccatgcagagattatcagccgcagaggctttatcagatttctgtactctgagctcatgaagtataattcccagactgcgaaggacagcatttttgagcctgccaaaggtggtgagaaactgcaaatcaagaagacagtatcgtttcatctgtatatctccaccgcaccctgcggggacggcgctctgtttgataaaagctgtagcgatagagccatggaatcaacagaatctagacactatcccgtgttcgagaatccaaaacagggcaagctccgcacaaaagtggagaacggcgagggcacgattccagtcgagtccagcgatatcgtcccaacttgggatggcatccggctgggagaacgcttgaggaccatgtcatgttccgataaaatcttacgttggaatgtcctcgggcttcagggagccttattgacacatttcctgcaacctatctacctgaagtctgtaacccttgggtacttgtttagccagggccatctgacccgggctatctgctgcagagtgacacgagatggttccgcatttgaagacggcttgagacatccattcattgttaaccaccctaaagttgggcgggtgtctatttatgattccaaacgtcaatctggaaagacaaaggagactagcgttaattggtgtttagcagacggatatgacttggagatcctggatggcacaagaggcacagttgacgggccccggaatgagctgagtagggtgtctaagaaaaacatcttcttgcttttcaagaaattgtgctctttccggtatagaagagacttactacgactctcttacggggaggctaagaaagctgcaagagactacgaaaccgccaagaactattttaaaaaaggactcaaggacatggggtatgggaactggatctccaaaccgcaggaggagaagaatttttacctgtgccccgtttag

SEQ ID NO: 107435 - DNA, 159 bp, Artificial Sequence
  Description of Artificial Sequence: Synthetic coding sequence
atggccaatgagcacactttgatccatccagcctccattgaggacccgttggaagccagacctatgagcgatgaggaccctgaggacgaggacgctttaccagcgcgttggaaaaaggaaatgggccgtaaaaggaagcgaactatcgctactctatag

SEQ ID NO: 107436 - DNA, 2106 bp, Artificial Sequence
  Description of Artificial Sequence: Synthetic coding sequence
atggacatagaggacgaggagaatatgtcatcttcctctacagacgtcaaggagaaccgtaatctggataacgtttccccgaaggacggctcgactcccggcccgggtgagggctcacagttgtccaacggtggcggtggagggcccggtaggaagaggccactggaggagggaagtaatggacactctaaataccgacttaagaagaggagaaagactccgggacccgtcctcccaaagaatgccctgatgcagctaaacgagataaaacccggtctccagtacacactgttgtcccaaacgggaccggtacacgccccactctttgtgatgagtgtggaggtgaacggacaggtgtttgagggttcaggtccaaccaagaagaaggcaaagcttcatgctgctgagaaggcccttcgctccttcgtccagttccctaatgcctccgaagcccacttagccatgggcaggactctttcagttaacaccgattttacatccgatcaggcagacttccccgataccctttttaatggcttcgaaacgcccgacaaagcagagccaccattttatgtcggtagcaacggggacgacagctttagctctagcggagacctgtccctgtccgcttcccctgtgcctgcctccctcgcccagcctccactcccggtgctacccccattcccaccaccgagtggtaagaatcccgtcatgatactgaacgagctgaggcctggactgaagtacgactttctctccgagagcggtgaaagtcatgctaaatcattcgtcatgtctgtagttgtagatggccagttctttgaggggtctggtcgcaataaaaaacttgcaaaagcccgcgccgcacaaagcgcactggctgcaattttcaatctccatcttgaccagactccaagtcgacaacccatcccctctgagggccttcagctgcacttaccacaagtgcttgccgatgctgtatcaaggctcgtgcttggcaaattcggagacctgacagataacttctcgtctcctcatgcacgtcgcaaagttctggccggagtcgttatgacaacaggtaccgacgtgaaagatgcaaaagtcatcagcgtgagcacaggtacaaagtgcatcaacggcgaatacatgagcgaccgcgggctggccctcaacgactgccatgccgagatcatctctcgccgctccctgctacggtttctgtacacccagttggagttatatcttaataataaggacgaccagaaacgctcgatcttccagaaaagcgagagaggcggttttcgactgaaggagaatgtacaatttcacctgtatatcagcaccagtccgtgtggcgacgccagaattttctcaccgcacgaacccatactggaagaaccagccgatcgacacccaaacaggaaagcacgaggacagctacggactaagattgaaagtggtgagggaaccatcccagtgcgttccaacgcaagcatccagacctgggatggggtgctacaaggtgaaagattgctaacgatgagctgtagcgacaagatcgccaggtggaacgtggtgggaatccagggaagcttgttgtctatttttgttgaacccatttacttttcttcaattatcctaggctcactttatcacggagaccatctgtctcgcgccatgtaccagagaataagcaacattgaggacctgccccccctctataccctcaataaaccactgttgtccggaatatctaatgccgaagcccgacaaccaggcaaggccccaaatttttccgttaattggactgttggggactccgcgatcgaggtgatcaacgcaactactgggaaagatgaactgggcagagcctcacgactatgtaagcacgctctctattgtcgctggatgagggtgcacggaaaggtaccatcccatttgcttcggtccaagattactaagcctaatgtgtaccatgaaagtaagctcgcagcgaaggagtatcaggctgcaaaggctaggctgtttacagctttcatcaaagccggtctcggagcctgggtcgagaagcccacagagcaggaccagttcagcctgacgccatag

SEQ ID NO: 107437 - DNA, 2226 bp, Artificial Sequence
  Description of Artificial Sequence: Synthetic coding sequence
atggacattgaggatgaggaaaacatgtcatcaagcagtactgacgtgaaggagaatagaaacttagacaatgtctccccgaaggatggctcgacaccaggccccggagaggggtcacaactgtccaacggaggaggaggcgggccaggccgcaagcgccctcttgaggaaggaagcaacgggcatagtaaatatcgacttaagaaaaggcgcaagacccctggcccagtgctgccaaagaacgctctgatgcaactcaacgagatcaaacccgggctgcagtatacactcttatcccagactggacctgtccacgccccactcttcgtaatgagcgtcgaagtgaatggacaggtgtttgaaggatcaggacccacaaagaagaaagctaagctgcacgctgcggagaaggcgctccgatcatttgtgcagtttcctaacgctagtgaggcccacctggcaatgggccgcaccctgagtgtcaacaccgacttcacatctgaccaggctgatttccctgataccctgttcaatggattcgaaacacctgacaaggctgagccccccttttatgtgggatcgaatggcgacgactctttcagttcttcaggcgacttaagcctgagcgcaagtccagtgcccgcttcactcgcccaaccacctctacccgttctccctccgttcccccccccttctggaaagaatccagtcatgatcctgaatgagcttcgcccgggactgaagtatgactttttgtccgaatctggagagagccatgccaaatctttcgtaatgtccgtggtggtggacgggcaattcttcgagggttcaggtcgtaataaaaagctggcaaaggcccgggccgcccagagtgccctggctgctattttcaatctccatttagaccagacgccatctaggcaaccaataccctccgagggcctgcagctgcatctccctcaggtactcgcagacgcagtgagtcgcctcgttttgggcaagttcggagatctgacagataacttctcatccccccatgcacgtaggaaggtgctggctggcgtggtgatgacgacgggcactgacgttaaggacgcaaaggtcatatcagtgtccactggcacaaaatgcattaacggagaatacatgtctgaccggggattggccctgaacgattgtcacgccgaaattatttcccgaagatcgctgctgcgatttctctatacccagttggagctgtaccttaacaacaaggatgatcaaaagcgttcaatctttcagaaaagtgagagaggtgggttccgcctgaaagagaacgttcagtttcatctttacataagcacgtccccttgcggcgatgccaggatctttagtcctcacgagccaattcttgaaggaagccgctcttacacccaagccggcgtgcagtggtgcaaccatgggagtctgcagccgaggccaccaggactgttgtcggatcccagtacctctacctttcagggagctggcaccaccgagcctgccgaccgtcacccgaacagaaaagccagggggcagctcagaacaaagatagagtctggcgagggaaccattcctgtcaggagcaacgcctctatccaaacttgggatggggtgctgcagggcgagaggctactgaccatgagctgctctgacaagattgcccgatggaatgtggtcggaatccaaggttcccttctgagcatcttcgtggaaccgatctactttagttctattattctgggctcactttatcatggtgatcacctgtccagggcaatgtaccagcgcataagcaatatcgaagatctcccacctctctatacattaaataaaccactgttaagcggcatttctaacgcggaggcccgacaacctggtaaagctcccaacttcagcgtaaactggacagtgggcgactccgcaatagaagtcatcaatgccacaacagggaaggatgagttaggccgagcctccaggctttgcaaacacgccctatactgtcggtggatgcgcgtgcatggcaaggttccatcccacttgctgcgatctaaaatcactaagcctaacgtgtatcatgaatcaaagttggccgccaaagaataccaggcagcaaaggcccggctatttaccgcttttatcaaggcaggcctgggggcctgggtggaaaaaccaaccgagcaggatcaattttctttgacaccatag

SEQ ID NO: 107438 - DNA, 2145 bp, Artificial Sequence
  Description of Artificial Sequence: Synthetic coding sequence
atggatattgaggacgaggaaaacatgtcctctagctcgaccgacgtgaaggagaaccgcaatctggacaatgtctctccgaaagatgggagcacacccggcccgggcgaagggagccagctcagcaacggggggggcgggggcccagggagaaagcgccccttggaagaaggatctaatgggcattccaagtacaggttaaagaaacggcgcaagacacccggaccagtccttcccaagaacgcgctaatgcagttaaatgaaattaaacctggtctgcaatacacactactctctcagacaggacccgtccacgcccccctgtttgtgatgtcagtggaggtaaacggtcaggtgtttgaaggtagcggacctactaagaagaaagcaaagctgcatgccgccgagaaggcactgcgaagcttcgttcagtttccaaacgcatcagaagcacaccttgcgatgggccgaaccctttctgttaatacagatttcaccagcgatcaggcagacttccccgatacgctttttaatggttttgaaacccctgacaaagctgagccacccttctatgtcggcagcaatggggacgattctttctcttcatcaggagaccttagccttagtgcctcacctgtgcccgcctccctcgcacagcctcccctgcctgttctacccccatttcccccgccctcgggcaagaatccagtaatgatcttgaatgaactcagaccaggcctgaagtacgacttcctgtccgaatcgggagaaagtcacgccaaatccttcgtgatgtcggtcgtggtcgacggtcagttctttgagggctcaggccggaataagaaattagccaaggctcgcgccgcgcagtctgctctggccgctatattcaatctgcacctcgatcagaccccctctagacagccaattccctccgagggcctgcagctgcatctgcctcaggtgctcgctgatgccgtctcgaggcttgttctcggaaagttcggggacctgactgacaacttctcgtcccctcatgctaggcggaaagtcctggccggtgtcgtgatgacaaccggcacagacgtgaaagatgctaaagttatatctgtcagtacaggcacgaaatgtatcaacggggaatatatgtccgataggggcctcgctttgaacgactgtcatgcagaaattatcagcaggcggtctttgctgcgatttctttacacccagctggagctgtacctgaataataaggacgaccagaagaggtcaattttccagaagtccgagagggggggtttccgtctgaaagaaaatgtgcagttccacctgtacatctccacatccccctgcggagatgccaggatctttagcccccacgagcccattctggaaggtagcagatcatatacgcaggcaggagtgcagtggtgcaaccatggtagcctgcagccacgcccgcccggattgttaagcgacccaagtacatccaccttccagggcgcaggaaccacggagcctgctgatcgccacccaaatcggaaagcaagagggcagcttcggactaaaatcgagagtggcgaagggactattccggttagatccaacgctagcatccagacttgggatggagtgctccagggcgaacggttgctgacgatgagttgctccgacaagattgctcggtggaacgttgtcgggatccaagggtccttgctgtccatattcgttgaacctatttacttctcgtcgatcatactgggctccttgtatcacggggaccacctgtcacgagctatgtaccaacgcatttctaacatcgaggatctaccacctctctatacactgaataagcccctgctgtcaggcatctcaaatgctgaggctcgtcagcctggaaaagctcccaacttcagtgttaattggacagtcggtgacagcgccatcgaggtcattaatgctacaacaggaaaggacgagctggggagggcttcaagactttgtaagcatgccctgtactgtcgctggatgcgagttcatggcaaggtacctagtcacttactgcgttccaaaatcacaaagcctaatgtctatcacgaatccaagctggcagctaaggagtaccaagccgccaaggttcattag

SEQ ID NO: 107439 - DNA, 39 bp, Artificial Sequence
  Description of Artificial Sequence: Synthetic coding sequence
atggatattgaggacgaggaaaatatgtccttcagttag

SEQ ID NO: 107440 - DNA, 426 bp, Artificial Sequence
  Description of Artificial Sequence: Synthetic coding sequence
atggatatcgaggatgaagaaaatatgagtagctccagtacagacgtcaaagagaaccggaacttggacaatgtgtccccaaaagacggttcaacccccggccccggggaagggtctcagctgtctaacggtgggggcggcgggccagggcggaagcgacccctagaggagggcagtaacggccactccaagtataggctcaagaaaaggcgcaaaacaccaggacctgtactgcctaaaaatgctttgatgcagcttaatgaaataaagcccggcctgcagtacaccttactgtctcagaccggtccagtgcacgcgccccttttcgtcatgagcgtggaggtgaacggccaggttttcgagggatcgggccccaccaagaagaaagccaagctacacgcggccgaaaaggccttgcgatcttag

SEQ ID NO: 107441 - DNA, 2226 bp, Artificial Sequence
  Description of Artificial Sequence: Synthetic coding sequence
atggatattgaagacgaagagaacatgagctcatcctccactgatgtgaaagagaatagaaatctggataatgtctcccctaaagacgggtcaacccctggacccggggaggggagtcagcttagtaacggcggaggagggggccccgggcggaagcggcctttagaggaagggagcaacggacacagcaagtacaggttgaaaaagcgcagaaaaactccaggtccagttttgcccaaaaacgctttaatgcagctgaatgaaatcaagccaggcttgcaatacacccttctgagccagacaggcccagtccacgcccctctgttcgtgatgagcgttgaggtgaacggccaggtctttgagggtagcggccccacgaagaaaaaggcaaagctgcacgcggccgagaaggctctgaggagtttcgtgcagtttcccaatgcgtccgaagctcatcttgcgatgggaaggaccctgtcagttaatactgattttacatcggaccaggccgactttccagacacactgttcaatgggttcgagacccccgataaggcagagcccccgttctacgtgggatccaatggtgatgactcgttcagtagttcaggcgacctctccttatcggcctcaccggtcccagctagtctggcgcaacccccccttcctgtgcttcctccattccctccaccatccggcaagaaccctgtgatgatcctaaacgagctgagaccaggcctcaaatacgactttttgtccgagtcaggcgaatcccacgccaagtccttcgtgatgtctgtcgttgtcgacggacagttctttgaaggctcagggcgtaacaagaaattagcgaaggccagagcagcccagtccgccttagctgccatcttcaacttacatcttgaccagactcctagccgacagccaattccgagcgagggtctgcagctgcatctgccccaggtgctggctgacgccgtgagccgactggtactcggtaaatttggtgaccttacggataattttagcagccctcacgcgagaaggaaggttttggccggcgtcgttatgaccaccggaaccgatgtgaaggacgctaaggtcatttccgtgagcactggcacaaagtgcataaatggagagtacatgtcggacaggggtctggctctcaacgactgccacgccgagatcatctcccgccgttccctgttaagattcttgtacactcagcttgaactctatctgaataataaagatgatcagaagaggtcaatattccagaaaagcgagcgcgggggatttagattgaaagaaaacgtgcaattccacctttacatctctaccagcccatgcggcgacgctaggatcttctcgcctcacgaaccaatcctggagggtagtcgttcttatacgcaggcaggtgttcagtggtgcaatcacgggagcctgcagccaaggcccccagggctcctcagcgacccctccacttcgacctttcagggcgccggcacaacggagccggcagacagacatcccaaccgaaaggctcggggccagttaagaaccaaaatcgagtcgggggagggcacgatcccagttagatctaacgcgtctatacagacctgggatggcgtgctgcagggggaacggctgctaacaatgtcctgttccgataaaatagccagatggaacgtcgtcggcatccagggaagtttgctgagtatttttgtggagcccatttacttttccagcatcattctagggagtctctatcatggcgaccacctgtccagagccatgtatcagcggatttccaatatcgaagatctcccgcccctttacaccttgaataagccactgctgtccgggatcagtaacgccgaggcacgccagcccggcaaagccccgaatttctcagtcaattggacggtcggcgacagcgccatcgaggtaatcaatgccacaacgggcaaagacgagctcggccgcgctagtagattatgcaaacacgcgctgtattgccgttggatgagggtgcacgggaaggttccttcccacctgctgaggtcaaagatcacgaagcccaacgtttatcacgagtcgaagctggcagccaaggagtaccaggccgctaaagcaagattattcacagcttttattaaggctggacttggtgcttgggtcgaaaaaccaactgaacaagatcagtttagcttaactccctag

SEQ ID NO: 107442 - DNA, 2226 bp, Artificial Sequence
  Description of Artificial Sequence: Synthetic coding sequence
atggacatcgaagacgaggagaacatgtcaagcagcagtactgatgtaaaggagaaccggaatctggacaacgtgtcaccaaaagacgggtctacgcccggccccggagagggcagtcagctcagcaatggcggtggcggaggccctggtcggaaaaggcctctggaagaaggctccaatgggcacagtaagtatcgccttaagaagcgtagaaaaacccctggccctgtgctgccaaagaatgcactgatgcaactcaacgaaattaagcccgggcttcagtacacactgctctcccagaccggccccgtccatgcccccttgttcgtcatgtcagttgaggtcaatggacaggtatttgagggctcaggccccactaaaaaaaaagcgaagctgcacgcagccgaaaaggcattacgatcttttgtgcagtttcctaatgcgtcagaagcacacttggccatgggacgaaccctttctgtcaacactgacttcacatctgatcaggcggacttcccagacacactttttaatggtttcgagacccccgacaaggcagagccccctttttacgtcggtagcaatggcgatgattctttctcctccagtggggatctctccctgtccgccagtcctgtacccgcctctctcgcccagccccccctgcccgtccttccgccttttccgccgccctccgggaaaaatcccgtgatgatcttgaatgaactaaggccgggtctaaaatacgatttcctcagcgagagcggagaaagccacgccaagtccttcgtgatgtctgtcgtcgttgatggccagttttttgagggatccggacggaataagaaacttgccaaggcaagagcggctcaatcggccctggccgcaatctttaatctacacctggaccagactccaagtagacagcctattccatctgaaggcctgcaattacatttaccacaggtcctcgccgatgcagtgtccaggttggtgctgggaaagttcggcgatctgacagacaacttctcaagtccccatgctaggcggaaggtccttgctggggtggttatgacgacagggactgacgtcaaggatgccaaggtgatttccgtttccaccggcactaagtgcatcaatggagaatatatgtccgatcgcggtctagccctcaatgattgccacgctgagatcatcagccggaggtccctccttcgatttctttacacccaattggaactatatttgaataataaagatgatcagaaacgatcaatattccagaagtccgagagaggcgggtttcggctgaaggaaaatgtccagtttcacctctatatcagcacctccccttgcggtgatgcccgcatctttagcccccacgagccaattcttgaaggctctcgctcctatacccaagctggtgtgcagtggtgcaaccacggtagcttgcagccacggccgcccgggctactgtcagatccttccacctcaacattccagggcgccgggaccaccgaacccgcagaccgccaccccaacaggaaagcccgtgggcagctgaggaccaagattgagagtggcgaaggaacgatcccggtgagaagcaatgcctctattcagacatgggatggtgtgcttcaaggggaaagattgttgacaatgagttgctccgataaaatcgccagatggaacgttgtgggaatccagggtagtcttctgtcaatcttcgtggaacctatttatttctccagtatcattttggggagcctgtaccatggcgaccatttgtccagagctatgtatcagagaattagcaatatcgaagacctgcccccactgtacactctgaacaaacccctgttaagtggtatatccaatgccgaggccagacaacctggcaaagctcccaacttcagcgtaaattggaccgtaggtgatagtgccattgaggtaattaatgctacaactggaaaggatgagctagggcgggcctctaggctctgcaagcatgccctatactgtaggtggatgcgcgtccatggtaaggtgcctagccacttgctgaggtccaaaattacaaagcccaacgtttatcatgaatctaaattggctgccaaggaataccaagcagcaaaggctcggttatttactgccttcatcaaagccggactgggcgcctgggttgagaagccaactgaacaggaccagttcagcttgaccccttag

SEQ ID NO: 107443 - DNA, 2097 bp, Artificial Sequence
  Description of Artificial Sequence: Synthetic coding sequence
atggacatcgaggatgaggaaaacatgtcaagctcgtcaaccgatgtcaaagagaatcgaaacctggacaatgtaagcccaaaggacggatccaccccgggccccggcgagggaagtcaactctccaatggaggagggggtggcccaggcagaaagagaccgttagaagaaggatcaaatggacactctaagtatagattgaagaagcgacggaagactcctgggcccgtgctgccaaagaacgccctcatgcagctgaatgaaataaagcccggtctccagtacacacttttaagtcagaccggacctgtccacgcccctctgtttgtcatgtcagtggaagttaatgggcaggttttcgaggggtctggccccacaaaaaaaaaagccaagctgcatgcggcggagaaggcactacggtcctttgttcagttccctaacgcaagcgaggctcacctagcaatgggaaggaccctctcagtgaataccgactttacgagcgaccaggccgactttccggacactctctttaatggtttcgagactcccgacaaagcggagccacccttctacgtgggatccaatggagatgactcattcagttcctcaggggacttgtctttatctgcctcaccagtacctgcttctttggcccaaccaccgctcccagtgctgcccccattcccccccccttccggcaaaaatccagtgatgatcctcaacgagctgagacccggccttaagtacgatttcctttctgaatcaggagagtctcatgcaaaaagtttcgtgatgtccgtggtcgtggacggccaatttttcgagggatcagggagaaacaagaaactcgcgaaggcacgggctgcccagtccgccttagcagccatctttaatctccaccttgaccagacacccagcaggcagccaattccatctgaaggacttcagctacacctgccccaagtgctcgctgacgctgtgagcagactcgtgctcggcaaatttggtgacttgaccgacaatttctccagtccacatgcacgccgaaaggtattagcaggcgtggtgatgactacaggaaccgatgtgaaggacgctaaggtaatcagtgtatccacagggacgaaatgcataaacggtgaatatatgtcggatagggggttagctctgaatgattgtcacgcagagatcatcagccgccgaagcctcttaagattcctgtatacgcagctggagttgtatctgaacaataaagacgatcaaaaaaggtcaattttccagaagagcgaacgcggcggcttcaggttgaaagagaacgtgcagtttcacttatatatttctacaagtccatgtggcgacgcaagaatcttcagtccgcacgaacctatcctagaaggcagccgatcgtacacacaggccggcgtgcagtggtgtaaccacgggagtctgcaaccaagaccgcctgggctacttagcgatcccagcacaagcacctttcagggtgccgggactaccgagcccgccgacagacaccccaatagaaaagctagaggccagcttaggaccaagatcgagtcaggcgaaggtacaatcccagtacggtcaaatgccagcattcagacatgggatggggtgttgcaaggtgagcgtctgctgacgatgtcttgcagtgacaagatcgcacgctggaatgttgtcggcatacagggaagcctgttatcaattttcgtggagccaatatatttttcctccataatcttggggtctctttaccatggagaccaccttagccgggcgatgtaccagaggattagcaatatagaagatctacctcctctgtatacgctaaacaaacctctgttgagcggaatcagtaacgcagaagcacgccagcctggtaaagcacccaactttagcgtgaattggaccgtgggagactccgcgattgaagttatcaacgccactactggcaaggatgagctgggccgcgcaagccgtttgtgtaaacatgctttgtactgccgatgggcatgcgcgagacaggggtcactccctctgaccactctccaggattatcaggcgcaacgggttccatag

SEQ ID NO: 107444 - DNA, 426 bp, Artificial Sequence
  Description of Artificial Sequence: Synthetic coding sequence
atgtcgcataggatggaaggggtggggcaacttccggcctcgtacaggcataacagacctcttctctctggggtgagtgacgctgaggcccggcagcccgggaaatctccaccattttccatgaactgggtcgttggcagtgcagatctagagattatcaatgctacaacagggcggcgctcgtgtggaggacccagcagactttgtaaacacgtgttgagtgcccggtgggcacggctctacggtaggctcagtacaagaacaccctcccctggggacaccccttccatgtattgtgaagctaagcttggagctcatacatatcagagtgttaagcagcagctgttcaaggccttccaaaaggccggcctcggaacatgggtccggaaaccgcctgagcagcagcagttcctgctgactctctag

SEQ ID NO: 107445 - DNA, 747 bp, Artificial Sequence
  Description of Artificial Sequence: Synthetic coding sequence
atggggctgtggtcaccagtgcccggtaacagcgtacctcgggcacccgtgatggcgggacttggtcttggccatagtcaaggggcccctcagggccctcacgacggtaaaacagatcgctctagcggtcctggaaggagacgcaccgaacggacacgcttgcccggattgctgggtggtgctcctctgaccgcgggctctcctcacagatggaacgttctcgggctgcagggagctctcctctcccatttcgtagaacctgtgtacttgcagtctatcgtcgtggggagtttacaccacaccggacaccttgcgagagtgatgagccatcgcatggaaggcgtcgggcagctaccagcctcctatcgccacaacagaccccttctctcaggggtgtccgatgcagaagccaggcagcctgggaagtccccgcccttttctatgaactgggttgtgggcagcgcagatctggagataataaatgcaacaactggccggcgctcctgtggcggcccaagtcggctctgcaagcacgtcctgtctgcccgctgggctagactgtacgggcgactgtcaacccgcacaccttcgccgggtgacacccccagtatgtattgtgaagcaaaactaggagcacacacgtaccagtccgtgaagcagcagctgttcaaagccttccagaaagctggcctgggcacctgggtccgcaaacccccagagcagcagcagtttctcctgacactgtag

SEQ ID NO: 107446 - DNA, 2220 bp, Artificial Sequence
  Description of Artificial Sequence: Synthetic coding sequence
atggcgagcgtgcttgggtcgggacggggatcaggaggtctgtcctcccaactaaaatgtaaaagtaaacgaaggagaagaaggcgttccaaacgcaaagataaagtgtccatactgagcaccttcctggccccctttaagcacctaagccccggcattactaacactgaggacgacgacacattgtccacctcttccgcggaggtgaaggaaaaccgtaacgtggggaatctggctgcgaggcccccgccttcaggtgatagagcacgtgggggagctcctggcgccaagaggaagaggccattagaggaaggcaatggagggcacctctgcaagctgcagcttgtttggaagaagctctcctggtctgtagccccaaagaatgcgctggtccagctgcatgagctgcgccctggcttgcagtaccggacagtttctcaaacaggtccagttcacgcccccgtgtttgctgtggccgttgaggtaaatggtcttaccttcgagggaaccgggcctacgaaaaagaaggccaaaatgcgggcagcagaacttgcgctcaggagctttgtgcagtttcctaatgcctgccaggcgcatctagctatggggggcgggccagggcccggaacagacttcacaagcgaccaggccgatttccccgacactctgttccaggaattcgaaccgcctgcaccaagacctgggctggccggggggaggccaggcgatgccgcacttctgtctgcagcctatgggagaaggagattactctgtcgcgccttagacctagtggggcccacgccagccacccccgccgcccctggcgagcgcaatccagtggttctgctgaacagactgcgcgccggactccgctacgtgtgcctggccgagccagccgaacgacgggcacgcagtttcgttatggccgtgagcgtcgacggtcgcacattcgaagggtccggtcgttctaagaagttagcccgcggccaggcagctcaggctgctctacaggagttgtttgacatccaaatgcctggtcacgcgcctgggagggctagaagaacccctatgccccaagagttcgccgacagcatcagccagttagtcacacagaagtttagggaggtgaccacagatctaactcccatgcacgctcggcataaagccctggctgggattgtgatgacaaagggactcgacgcccggcaggcccaggttgtggctctctcgtccggaaccaaatgtatcagcggagaacacctgtctgatcagggtcttgtggtcaacgattgtcatgccgaagttgtggccaggcgggcgttcctgcacttcctgtacacacagttggaactgcacctctctaagcggcgcgaggacagtgaaagatctatctttgtgcgactgaaggagggcggttaccgcctcagggagaatattctgttccatttgtacgtttcgacctccccctgtggtgatgcacggcttcattcaccctatgagattacaaccgatttacatagcagcaagcacttggtgcgcaagttccgcggccatctgaggaccaagatcgaaagcggggagggtactgttcctgtaaggggacccagtgcagttcaaacttgggatggagtccttttaggcgagcagctgataacaatgtcatgcactgacaaaattgctcggtggaatgtgctcggccttcagggggccctcctctctcactttgtagagccggtgtatcttcaatctattgtggtggggtcattacatcacactggacacctggcacgtgtgatgagtcaccgcatggaaggcgttggtcagcttcccgctagttaccgccacaaccgtccactcctgtccggcgtgtctgacgccgaggcccgtcaaccagggaaaagccccccattttcaatgaattgggtggtcggctcagccgatttagaaataatcaatgcaacaacaggccggaggtcatgcggcggacccagcaggctgtgcaaacatgtccttagtgctaggtgggcccgcctctatggccggttatctactcgaacgccatccccaggcgatacccccagcatgtactgcgaggcgaagctgggcgcccacacttaccaatccgtcaagcagcaacttttcaaagcttttcaaaaggccggccttggcacctgggtgcggaagccccccgagcagcaacaatttctgttgaccctgtag

SEQ ID NO: 107447 - DNA, 1509 bp, Artificial Sequence
  Description of Artificial Sequence: Synthetic coding sequence
atgtggactgcagatgagattgcgcagctctgctacgaacattacggcatacgcctgccaaaaaagggaaaaccagaacccaatcacgaatggaccttattggcagccgttgtcaaaatccagtctccggcggataaagcatgtgatactccggacaaacctgtgcaagtaaccaaggaggtcgtctctatgggaactggcacaaagtgtatcggccaatcaaaaatgaggaaaaatggagatatattaaacgactctcacgccgaggtgatagcacgaagatctttccagagatacctcctccatcaactgcagctcgccgccactctgaaagaggattcaatctttgtgccaggaacccagaaaggtgtctggaaactcagacgtgatctaatcttcgtgttcttctcgagtcacactccctgcggggatgcctctatcatccccatgctggaattcgaagatcagccttgttgtcccgtgtttcgcaattgggcccataacagctcggtcgaagcttcttctaatcttgaagcacccggcaacgagcgaaaatgcgaagatccagattcacccgtcacaaagaagatgaggctggagcctggaactgctgctcgtgaagtgactaacggggcggctcaccaccagtctttcggtaagcagaaatcaggacctatcagcccaggaatccacagttgcgaccttactgtcgagggactggccacggttacaaggatcgccccaggtagcgcaaaagtcattgatgtgtatagaaccggggcgaaatgtgtgccaggggaggcgggagactccggtaagcccggcgccgcctttcatcaggtgggcctcctgcgagttaaacctggacgtggggaccgcacacgctctatgagctgcagcgataagatggcaagatggaacgtgctcggctgccagggggccctgctgatgcatctactcgaagagccgatctatctgtccgcagtggtaattggaaaatgtccctattctcaagaggccatgcagcgggccctgatcggacgctgtcaaaatgtcagcgcactgccgaaggggtttggagtgcaggaattgaagatacttcagtctgacttacttttcgagcaatccagatctgctgtacaggctaagagggctgacagccctggcagactggtgccatgtggcgccgccatctcatggagtgccgttccagagcagcctctcgacgtcacggcgaatgggtttcctcaggggaccactaagaagacgatcggtagtctgcaggctcgaagccagatttccaaagtggaactcttccgtagctttcagaaactgctgtcaagaatcgccagagacaaatggccccacagcttgagagtccagaagctggatacttatcaggagtacaaagaggccgcatccagttaccaggaagcttggtctacattgcggaagcaggtgttcggctcatggatacggaatccaccagactaccatcagttcaaatag

SEQ ID NO: 107448 - DNA, 1422 bp, Artificial Sequence
  Description of Artificial Sequence: Synthetic coding sequence
atgtggacactgctggctgcggttgtgaaaatccagagcccagccgataaagcctgcgacacccctgacaaaccagtgcaggttacgaaggaggtggtttccatggggacaggtaccaaatgtattggccagagtaagatgagaaagaacggtgatattcttaacgatagtcatgcggaggtgatcgctcgacggtcatttcagcgctacctgttgcaccagttgcagttagctgctacactcaaagaagattctatttttgtgcctgggactcagaaaggtgtgtggaagcttagaagagacctaatttttgttttcttcagctcccacacaccatgtggggatgcttccataattccaatgctggagttcgaagaccagccatgttgccctgtctttcgcaattgggctcacaacagttccgtggaagcaagctctaatctcgaagctcctgggaatgaacgcaagtgcgaggaccccgacagccccgtgaccaagaaaatgcgactggagcccggaactgccgctcgggaggtgacaaacggcgcagcccaccaccagtcctttggaaagcagaaatcgggacccattagccctggcatccattcatgcgacctgaccgtcgaagggctggccaccgtgacacgcattgcccctggttcggcaaaggtgatagacgtctatcggacgggagctaagtgtgtccctggtgaagctggtgactctgggaagcctggtgccgcattccatcaggtcggacttcttcgcgtgaagcctggccgcggtgaccggactcggtccatgtcatgttccgataaaatggcccggtggaatgtgcttgggtgccaaggcgccctactgatgcaccttttggaggaaccaatctatctgtctgccgtcgttatcgggaagtgtccatatagccaagaagctatgcagcgagccctgattggccggtgccagaacgtgtcggccctgccaaagggatttggtgtgcaggagctgaagattctgcagtccgatctgctgttcgagcaatctaggtccgcggtgcaggccaaaagagccgactctccaggacgtctcgtgccgtgtggtgcagccataagctggtccgctgtgcccgagcagcccctcgacgtgacagcgaatggattccctcaggggaccaccaagaagacgatcgggagcctgcaagctcgtagtcaaatttcaaaggtcgagctgttccgctcatttcaaaaactgctgtcgcgcatagccagagacaagtggccccactcgctccgggtgcaaaagctggatacttaccaggaatataaggaggccgcatcttcttatcaggaagcttggtctaccctgagaaagcaagtctttggaagttggatccgtaatccacctgactatcatcagttcaaatag

SEQ ID NO: 107449 - DNA, 1089 bp, Artificial Sequence
  Description of Artificial Sequence: Synthetic coding sequence
atggcagctgccgaggaagagccaaagcccaaaaagctgaaagtggaagcgccacaggcgctgagggagaatatcttgttcggtatgggtaaccccttgctggacatcagtgccgtggtcgataaggattttttggataagtattcccttaagcccaacgatcagatcctggcagaagataagcataaggagctttttgatgagctagtgaagaagttcaaggtagagtatcatgctgggggatccacacaaaacagtataaaggtagcccagtggatgatacagcagccacataaggccgccacctttttcggatgcattggcattgataagttcggcgaaatcttgaagcggaaagcggccgaggcccacgttgacgctcactattatgagcagaacgagcaacctactgggacatgcgccgcatgcatcaccggagacaacaggtctttaatcgctaacctggccgcagctaactgctacaagaaggagaaacacttggacctggagaaaaattggatgctcgtagagaaagcacgtgtgtgttacatagccggcttctttctgactgtatctcccgaaagtgtcctcaaggtggcacaccatgctagtgagaataaccgtatattcaccttgaacctgtctgccccatttatttcccagttttacaaagaatctcttatgaaagtgatgccgtacgtagatatcctcttcggtaacgaaaccgaggccgcaacctttgcaagggagcaggggtttgagaccaaggacatcaaggagatagccaagaaaacccaggccctgcccaaaatgaattctaagcgacagcgcatagtcattttcactcagggcagagatgataccatcatggcgacagaaagtgaagtgaccgcttttgctgtacttgaccaggaccaaaaagagattattgatacaaatggagccggtgacgcctttgtgggcgggtttctgagccagctggttagcgataaaccactgaccgagtgtattcgggccggccactacgcggcgtcaataatcatcaggcgaactggttgtaccttccccgagaagccagatttccattag

SEQ ID NO: 107450 - DNA, 1038 bp, Artificial Sequence
  Description of Artificial Sequence: Synthetic coding sequence
atgacaagtgtgagggagaatattctgttcggcatggggaacccccttctcgatatatctgctgtggtcgataaggatttcttagataaatacagcctcaagcccaatgaccaaattctcgccgaagacaaacacaaagaactcttcgatgagctggtcaaaaaattcaaagtagaataccatgccggcggctccacccaaaattcaatcaaagtcgctcaatggatgattcaacaacctcacaaggcggcaacctttttcggatgcattggtattgacaaattcggagagatcctgaaaagaaaggccgccgaggcccatgtggatgcgcattattacgaacagaatgagcagcctacaggaacctgcgcagcctgcatcactggcgataatcgcagtctcatcgctaatttagcggctgccaactgctacaagaaggaaaagcatctggacctagaaaaaaactggatgctcgttgagaaagccagggtgtgctacattgccggattttttctcacggtgtctcctgaatccgttctgaaggttgctcaccacgcttccgaaaacaaccgtatatttacgctgaacctgagcgccccatttatttcacaattttacaaggagagcctgatgaaagttatgccgtatgtcgacattttatttggtaatgagaccgaggctgccactttcgctcgggagcaaggtttcgaaaccaaagatatcaaggagatcgccaaaaaaactcaagcactgcccaagatgaacagtaagagacaacggatagtgatcttcacgcaagggcgagatgacacaattatggcaacggaaagtgaagtcactgcctttgccgtcctggatcaggatcagaaggagatcatcgacactaatggcgccggcgatgccttcgtgggaggttttctgtcgcagttagtaagtgacaaacccctcacggaatgcattagggcaggtcattatgctgcttcaatcattatcagacgcactggctgcactttccctgagaagccagacttccattag

SEQ ID NO: 107451 - DNA, 918 bp, Artificial Sequence
  Description of Artificial Sequence: Synthetic coding sequence
atggctgcggcggaggaggagccaaaaccaaagaagctgaaggtagaggcacctcaggcactcagagaaaatatcctttttggtatgggcaaccctctgttagacatctctgcggttgttgataaggatttcctcgataagtactcattgaagccaaacgaccagatactggccgaggacaagcacaaggagctgttcgacgaactggtgaagaaatttaaggttgaataccatgcaggcggctcaacccagaatagcatcaaagtcgctcaatggatgattcaacaaccccacaaagccgcaaccttctttggatgtatcggcattgataagttcggcgaaatactcaagcgcaaggctgctgaggcccatgttgacgctcattactacgaacagaatgagcagccgaccgggacatgcgctgcttgtattaccggagataaccgcagtctgatcgcgaatctcgccgccgctaattgctataagaaagagaagcatttggacctggagaaaaattggatgcttgtcgagaaagccagggtgtgctacatcgcagaggccgccacattcgcccgcgaacaaggctttgagacaaaagatattaaggaaatcgccaaaaaaacccaggccctgccaaagatgaactccaaaaggcagaggattgtgatctttacgcagggaagagacgacaccataatggctactgagagcgaagttaccgccttcgccgttcttgatcaggatcaaaaggagataattgatacgaacggtgcaggagacgccttcgttggcggttttctgagtcagctggtttcggataagcccttgaccgagtgtattagagcaggccattatgccgccagcataattatccgacggaccggatgcacgttccccgagaaaccagattttcactag

SEQ ID NO: 107452 - DNA, 984 bp, Artificial Sequence
  Description of Artificial Sequence: Synthetic coding sequence
atgacttcggtacgtgagaacatcctgtttggtatgggcaatccgctgcttgacattagcgctgttgtcgataaagacttcctggacaaattcgatgagcttgtcaaaaaatttaaggtcgagtaccacgctggcggatccacccaaaacagtattaaagtggcgcaatggatgattcagcaacctcataaggcggcaaccttctttggatgcataggcatcgataaatttggagaaatcctgaagcgcaaggcagctgaagcacatgtcgacgctcactactatgagcaaaacgaacaaccaacaggaacctgcgccgcctgcattaccggtgataacagaagtctcatcgccaacctggccgccgcgaattgttataagaaagagaagcacctggatctggagaagaattggatgctggttgagaaagctcgggtgtgctatatcgccggcttcttcttaaccgtctccccagagagtgtactgaaggtggcccatcatgccagtgagaacaacaggatcttcactcttaacctgagcgctcccttcatctcccagttttacaaggaatcactgatgaaagtaatgccttacgtggatatccttttcgggaatgaaacagaagccgcgacatttgcacgggagcaggggttcgagacaaaggacatcaaagaaatcgcaaagaaaacccaggcgctacccaaaatgaactctaagcggcaacgcattgtgatcttcacccagggtagagatgacactatcatggcgactgaatcagaagtaacggcttttgcggtgctcgaccaagatcagaaggagatcattgatacaaatggggctggggatgctttcgttggcggatttctctcacagctggtcagcgacaagccactgacagagtgtattcgtgcaggccactatgcagcttcaattatcatcagacgtaccggatgcaccttccctgagaagcctgacttccactag

SEQ ID NO: 107453 - DNA, 2244 bp, Artificial Sequence
  Description of Artificial Sequence: Synthetic coding sequence
atgccccttttcaaactgcccgctgaagaaaagcagatcgacgatgccatgcgtaatttcgccgagaaggtgttcgcgtcagaagtcaaggacgagggtggccgacaggaaatatccccctttgacgttgatgagatttgccctatcagccatcacgaaatgcaggcccatatcttccatctggagaccctgtccacaagcaccgaggccagaaggaagaagagattccaggggcgaaagacagttaatttgagtatccctctgagcgagacttcctccacaaagttatcacacattgacgagtatataagctcgagtcccacttaccagacagtgcccgattttcagcgagttcagatcactggggattatgccagtggtgtaactgttgaggattttgaaatcgtctgcaaggggctgtatcgtgcactgtgcatcagagagaaatatatgcagaagtcttttcagagattcccaaagacaccatccaagtacttaaggaacatcgatggagaagcttgggtcgctaatgaaagcttttacccagtgttcactccccccgtgaaaaaaggagaggacccgttcagaaccgacaatctgcctgaaaatctggggtaccaccttaaaatgaaggatggcgttgtatacgtatacccaaacgaggccgcggtgtcaaaggacgagcctaagcccctcccctaccccaacctcgacacttttctggacgacatgaatttcctgctggcgcttatcgcgcaagggcccgtcaagacgtatactcaccggcggctgaaatttctttcctccaaatttcaggttcaccagatgctgaatgagatggatgaactgaaggaactgaaaaacaaccctcatcgggatttctacaactgtcgcaaggtcgacacacacatccacgcagccgcctgtatgaaccagaagcatctactcaggtttattaaaaaatcataccagatcgatgcggacagagtcgtgtattctacaaaggaaaagaatctgaccctcaaagaactgttcgcgaaactgaaaatgcatccttatgacctgactgttgacagcctggatgtccatgccggcaggcagacattccaacgcttcgacaagttcaatgataagtacaacccggtcggtgcgagcgagctgagagacctatacctcaagacagataattatatcaacggcgagtactttgcaaccattatcaaagaggtgggtgctgacctcgtggaggccaaataccagcatgcagagccaaggctcagtatctacggtagatctcctgacgagtggtcaaagctttcttcctggttcgtctgcaacagaatccactgtcctaacatgacctggatgatccaggtgccccgaatatacgatgtgtttagatcaaaaaatttcctgccccactttggcaagatgctcgagaatatctttatgccagtattcgaagcgaccataaacccacaagccgaccccgagctaagcgtgtttcttaagcacatcaccggatttgactctgtagacgatgaatccaaacactccggacacatgttttcatccaagagcccgaagccacaggagtggacccttgaaaaaaacccatcctacacatactacgcttactatatgtatgcaaacattatggtgttgaattccctgcgtaaggagcgggggatgaacaccttcttgttccggcctcattgtggcgaagccggggcactgactcacctcatgacagcctttatgatagccgatgacatctctcacgggcttaacctgaagaagagtccagttctgcagtacctgttcttcctggcacagatcccgatcgctatgtcgcccttgagcaataactccttgttcctggagtatgccaaaaacccattcctggattttttgcaaaaggggctaatgatttcactctcaacggacgatcctatgcagttccactttaccaaagagcctctcatggaagaatatgcaatcgcagctcaggtgtttaaacttagtacctgtgacatgtgcgaggtggctcgcaactccgtcctccaatgcgggatctcccacgaggagaaggtgaaattccttggtgataattatttggaggaagggcctgcagggaatgacatccggagaactaacgtggcgcagatccggatggcttataggtacgaaacctggtgctatgagttgaacctgatcgccgaaggcctgaagtccactgagtag

SEQ ID NO: 107454 - DNA, 2343 bp, Artificial Sequence
  Description of Artificial Sequence: Synthetic coding sequence
atgaatgtgaggattttctactctgtttcacagtctcctcatagcctactgagcctgctgttctattgtgcgatcctggagtccagaatttcggccacaatgccccttttcaagctgccagcagaggagaagcaaatagatgacgccatgcgaaattttgcagagaaggtattcgccagtgaggtcaaggacgaaggtggacgccaggaaatttcaccttttgacgtggacgaaatttgtcccatttctcatcatgaaatgcaagctcacatcttccaccttgagacgctgagtacatccaccgaagctcgtagaaagaaaagatttcagggccggaagacagtgaacctgtccattcctctgtcagagacctcctcaaccaaactgtcccacatcgatgaatacatttccagcagccccacctaccagaccgtgccagactttcagcgtgtgcaaatcactggtgactatgcatctggtgtcaccgtggaggacttcgagatcgtatgcaaaggcctctatcgcgcactctgcatacgcgaaaaatacatgcagaagtcattccagaggtttccaaaaacacctagcaaatacctgcggaatatcgacggcgaggcgtgggtggccaacgagagtttttaccctgtctttaccccccctgttaagaagggggaagaccccttcaggaccgataatttgccggaaaacctgggctaccacctgaagatgaaagatggcgtcgtgtatgtctacccgaacgaagctgctgtcagcaaagatgagccgaaacctttgccatatccgaatctggatactttcctagatgacatgaattttttattagcgctaatcgcccaggggcctgtcaagacatacacccatagacgcctgaagttcctcagctctaagttccaggtccaccagatgctgaacgagatggacgagttaaaagagcttaagaacaatcctcatcgggacttctacaactgccgaaaggtagatactcatatccacgccgccgcctgcatgaaccagaagcatttactgaggttcatcaaaaaatcatatcagatcgacgctgaccgagttgtgtacagcacgaaggagaaaaaccttactctcaaggagctctttgctaaattgaagatgcacccatacgatcttactgtcgactctctggacgtacacgccggccgccaaacttttcagcgcttcgataaatttaacgataagtataatcccgtgggcgcgtccgaactgcgcgacctgtatctaaagacagataattacatcaatggcgaatacttcgctaccatcatcaaggaggtgggagcagacctggtagaggctaaataccaacacgccgaacccaggttgagcatctatggacgaagtcctgatgagtggtctaaattgtcctcttggtttgtgtgtaatcgtattcactgccccaacatgacctggatgatccaggtgccaaggatttatgatgtgttccgaagcaaaaactttctgccacactttggaaaaatgctcgagaacatcttcatgcccgttttcgaggcgacgattaacccccaggcagacccagaactcagcgttttcctgaagcacatcacaggcttcgactctgtggacgatgagtccaagcattccggtcacatgttctcgagcaagagcccaaaacctcaggaatggaccctggagaagaatccctcatatacatattatgcctactacatgtatgccaatataatggtgttgaactcactccgaaaagaaagaggcatgaacactttcctgtttaggccacactgcggcgaagctggcgcccttacccacctcatgactgctttcatgattgccgatgatatctcacacgggctcaacctgaagaagtcccctgtgctccaatacttgttctttctggcccagattccgattgccatgtcacccttgtctaataattctttgttcctggaatatgccaaaaatccattcctcgactttctgcaaaagggccttatgatttccttgagcaccgatgatcctatgcagtttcacttcacaaaagagcctctgatggaagagtacgcgatcgccgctcaagtgtttaaactctctacatgcgatatgtgtgaggtggccaggaattctgtgctgcagtgcggtatatcacacgaggagaaggtcaaattcctgggtgataattatctagaggagggtccagccggtaatgatatacgccggaccaacgtggctcagatccgtatggcttatcgatacgaaacctggtgctatgagttgaatcttatcgccgaaggcttgaagagcactgaatag

SEQ ID NO: 107455 - DNA, 2331 bp, Artificial Sequence
  Description of Artificial Sequence: Synthetic coding sequence
atgaatgtgcggatcttctacagcgtgagccagagcccccacagcctcctgtcattgctcttctactgtgccatattggaatctaggatttccgccactatgcctttgttcaaactgcccgagatagacgacgccatgaggaacttcgccgagaaagtgttcgcttcagaagtgaaggacgagggcgggcgccaagaaatctctccatttgatgtagacgaaatttgtcctatctcgcatcatgaaatgcaggctcatatcttccacctggagactctgtcaacttcaacggaggcccgccgcaaaaaaagattccagggacggaaaacagttaatctgtcgatacccctgtccgaaacttccagtacaaaactctcgcacatcgatgagtatattagctcatcacccacataccagactgttccagattttcagagagtccaaatcactggcgactatgccagcggcgtgaccgtagaggatttcgaaatagtatgtaagggcttgtatagggcgctgtgcatcagggagaagtatatgcagaaatcgtttcaacgttttcctaaaaccccctcgaagtacttacgaaacatcgatggcgaagcatgggtcgcaaatgagagtttttaccctgtgtttacacctccagtgaagaaaggtgaggacccctttaggacagataacctccctgaaaacctgggctaccacctgaagatgaaggatggcgttgtctacgtgtacccgaacgaagctgccgtatctaaagacgagccaaaacctctgccctatccaaacctggacacattccttgatgacatgaattttcttctagcattgatcgcgcaagggccagttaagacttacacacatcgccgcctgaagttcctgagctccaagttccaagtacaccagatgctcaacgagatggacgaattgaaggagctaaagaacaaccctcaccgcgatttttacaattgtcggaaggttgatacccacatccatgcagccgcttgcatgaaccagaaacatcttcttcggtttatcaaaaaatcgtaccagattgacgccgaccgcgtggtgtacagtaccaaggaaaagaaccttacactcaaggaactgttcgctaagctgaaaatgcatccatacgatctgacagtggacagcttagacgtgcacgctggcaggcagacctttcaaagatttgataaattcaacgacaagtataacccggtgggtgcctccgaacttcgcgatttgtacctgaagactgataactacattaatggagagtacttcgccacgatcataaaggaagtcggggcggatctggtggaggcaaagtatcaacatgccgagccacgactgtccatttacggaagatctccagatgaatggtctaagttgagcagctggtttgtgtgtaataggattcactgcccaaacatgacttggatgatccaggtaccacggatttacgacgtcttccgcagtaagaactttctcccacactttggcaaaatgctggagaacattttcatgccagtgtttgaggccacaataaatccacaggccgaccctgaactatctgtgtttctgaagcatattactggttttgactcggtggacgacgaatcaaaacattccgggcacatgttttctagcaagagtcctaaacctcaggagtggacgcttgagaagaatccctcttatacctactacgcctactacatgtacgccaatatcatggtgcttaattccctgaggaaagagcgtggtatgaacacattcttgtttcggccccattgcggggaggcaggcgcacttacacacctcatgaccgcctttatgatcgcagatgatatctcccatggcttgaatctgaaaaaatccccagtgcttcagtatctgttcttcttggcccagattccaatcgccatgagcccacttagtaacaactcattattcctggagtatgccaaaaatccttttcttgatttcttgcaaaagggcctgatgatttcactgagcacagatgatccgatgcagttccacttcaccaaggagccgctgatggaggagtacgctattgctgcacaggtgttcaaattgagcacctgcgacatgtgcgaggtcgccagaaactccgtcctgcagtgcggtatctcacatgaggagaaggtcaagttccttggagataattatctcgaggagggaccagcaggaaacgacatccgccgcacgaatgtcgcacagatcagaatggcatatagatacgaaacgtggtgctatgagttgaatctgattgcagaaggacttaaatctacagagtag

SEQ ID NO: 107456 - DNA, 2640 bp, Artificial Sequence
  Description of Artificial Sequence: Synthetic coding sequence
atgaggaatagagggcagggcctgtttcgcctgaggtcccgttgtttcctgcatcagagcttgccacttggcgccgggagaagaaagggcttggacgtagctgaaccaggcccatcacgttgcaggtcagattcccctgcggttgctgccgtggtgccagcaatggcctcttatccttcaggcagtgggaagcctaaagcgaagtatcccttcaaaaagcgggccagtctgcaggcctccaccgctgcaccagaagctcgcggcggcctgggtgccccccccctgcagagtgcacgttctcttcctggacccgctccctgtcttaaacacttcccgctcgatctgcgaacttcaatggacggcaaatgcaaggaaatcgccgaggagcttttcacgcgctccttggccgaatctgagctgcgctctgccccttacgagtttcctgaagagagtcccatagagcaactggaggagcgacgccagcgcctggaacgacagataagtcaggacgtgaaacttgagcctgacattttactccgggcaaaacaagactttttgaagacggactctgactctgatctgcagctttacaaggaacagggagagggtcagggagacagaagcctccgcgagcgtgatgttctggagcgggagtttcagagggtcaccattagtggggaggaaaagtgcggagtcccattcaccgatctacttgatgctgctaagagtgtggtccgggccctgtttattagggaaaaatacatggcactatccttacaatccttttgcccaacgaccagaaggtatcttcaacaacttgccgaaaagcctttggaaacccggacatatgaacagggacccgatacccctgtgtctgccgacgccccggtgcaccctccagccctcgagcagcacccctatgaacactgcgaaccttcaaccatgccaggcgacttgggcctgggattgcgcatggtgcgcggtgtcgtgcacgtatacacaaggagggagcccgatgagcactgttccgaggtggaattaccctatcccgacctccaggagtttgtagccgacgttaacgtgctgatggccctgatcattaatggcccgattaagtccttttgctataggcgcctgcagtacttgtcatctaagttccagatgcacgtcctattgaatgagatgaaagaactggcggcccagaagaaggtgcctcatcgggacttctataacatccgtaaggtggacactcacatccacgcctcctcctgtatgaatcagaaacatctgctgagatttattaaacgtgccatgaaaaggcaccttgaagaaatcgtgcatgtggaacagggacgcgaacagactctgagggaggtgttcgagagcatgaacctaaccgcttacgatctgagtgttgatactctagacgtgcatgctgatagaaacacgtttcatcggttcgataagttcaacgcaaagtacaacccaatcggtgagagcgtgcttagagagatattcatcaagacagataatagagttagcgggaaatactttgcacacatcatcaaggaggtcatgtcagatctcgaagaatcaaaataccagaacgccgagcttagattgtccatctatggtcgctccagagacgaatgggacaagctggcaagatgggccgtgatgcatcgtgtgcactcccccaacgtacggtggctggttcaagtccccaggctgttcgatgtatacaggactaagggacagctagctaacttccaggagatgcttgagaacatattcctgccgttgttcgaagctaccgttcaccccgcatctcaccccgagctgcatcttttcctggagcatgtggacggtttcgactcggtagatgatgaatccaaaccagaaaaccatgtcttcaacttggagtcccccctgcccgaggcatgggtggaggaagataaccccccgtacgcctactacctctactacaccttcgccaacatggctatgttaaaccacctccgccggcaacgaggctttcacacattcgtgcttcgtcctcactgtggggaggccggccctattcaccatttggtctccgctttcatgctagctgagaatattagccatggcctcctgctgaggaaggcccccgttctccagtatctgtattatctggctcagatcggaatcgcaatgagcccactttccaataacagcttattcttgagttaccaccggaacccacttccggagtacctatcaaggggactgatggtgagcctgagcaccgatgatcccttgcagtttcacttcacaaaggagccactcatggaggaatattccatagctacccaggtctggaagttaagctcatgtgatatgtgcgaactggccaggaatagcgtgctaatgagcggattctcccacaaggtcaaaagtcactggctggggcctaactataccaaagaagggcctgaagggaacgacatccggagaacaaatgttccggacattcgagtaggatacaggtatgagaccctgtgtcaggagctggctctgatcacccaggcagttcaaagtgagatgttagaaacaatccctgaagaggccggcatcaccatgtcgcccggccctcagtag

SEQ ID NO: 107457 - DNA, 2397 bp, Artificial Sequence
  Description of Artificial Sequence: Synthetic coding sequence
atggccagcgaagcgcggggcggtctcggcgcccctcctttacagagtgccagatcccttcctggccctgcaccttgcctaaagcactttccactggacctacggacctcaatggacggaaagtgtaaagaaatcgcagaggaactgttcactcgctctctcgctgagtccgaactgcggtccgcaccatacgagttccctgaggagtcccctattgagcagcttgaggagaggaggcaacgactggagcgacagataagccaagatgtcaagctcgagcccgacatcctgcttcgagcaaaacaggattttctgaagactgattccgactctgatctccaactctataaggagcagggcgagggtcagggggaccggtcactgcgcgagcgggatgtgcttgagcgcgagttccagagggtcacaatttccggcgaggagaagtgcggcgtcccttttacagatctgctcgacgcagccaaatcagtcgtgagggccctcttcatccgtgaaaagtacatggccctgagccttcaaagtttttgcccgacgacacgaagatatttgcagcaactcgctgagaagcctcttgagacaagaacttacgaacaaggccctgatacacccgtctcagctgatgctccagtacaccctcctgccctggaacagcacccttatgagcactgcgagccaagcaccatgcctggtgatctgggactgggcctgcgtatggtccgtggggttgtgcatgtgtatacacgccgggaacccgatgaacactgttccgaggtggaactcccatacccagacctgcaggaatttgtggcggatgtaaatgttcttatggccctcataataaatgggccgataaaatctttttgctataggcggctccagtatctctctagtaagtttcagatgcatgttcttcttaacgagatgaaggaattggcagcacagaagaaagtcccgcatcgcgacttttacaatatccgcaaggtggatacccatattcacgcatccagctgtatgaatcagaagcatttgttgcgctttattaaaagggcaatgaaacggcacctggaagagatcgttcacgtggagcaaggcagagagcagacactgcgggaggtgttcgaatccatgaacctgaccgcgtatgatctgtcagtggataccttagacgttcatgccgaccgtaacacatttcaccgcttcgacaagttcaacgccaagtataaccccataggagagtcagtcttgcgagagattttcattaaaactgataacagggtctccgggaaatattttgcccatataatcaaggaagtcatgtcagacctggaagaaagcaaatatcagaacgccgaactgcgtctgtctatctacggcagatcccgggatgaatgggataagctagcccggtgggctgtcatgcaccgcgttcacagcccaaatgtacggtggctggtacaagtcccccgtcttttcgatgtctaccgaacaaagggacagcttgctaacttccaggaaatgctggaaaatatctttttacctctttttgaggcaactgtgcaccctgcgagtcaccccgagcttcatttgtttctggagcacgtggatggtttcgacagcgtcgacgacgagagtaaacctgaaaatcacgtctttaaccttgagtcaccattaccggaagcttgggtcgaggaggataacccaccgtatgcctactacttgtactatacatttgctaacatggctatgctgaaccatttaaggcggcaacggggcttccacaccttcgttttgaggccccactgcggtgaggctggccctatacaccatttggtatcggcctttatgttggcggagaacattagtcatgggcttcttctgaggaaggcccccgtgctccagtatctttactaccttgcgcagatcgggatcgctatgtcccccctctctaacaattccctgtttcttagctatcatcggaacccactccccgaatacctgagtcgaggcttgatggtaagcctgagcacagacgacccgctgcaattccattttaccaaggagccgctgatggaagagtactccatcgccactcaagtttggaagctctcttcttgtgacatgtgtgagctggcccgcaatagcgtactcatgagcggtttctctcacaaggtcaagtctcactggttaggaccaaattacaccaaggagggaccagaggggaacgacattcgaagaacaaacgtgcctgacattagagttgggtatcgctacgaaacactctgtcaggagctagccctcattacgcaggcagtgcaatcagagatgttggaaaccattccagaggaggctggcataaccatgtcacccggcccacagtag

SEQ ID NO: 107458 - DNA, 2415 bp, Artificial Sequence
  Description of Artificial Sequence: Synthetic coding sequence
atgtggcagtctcaagcacccgccggagcagctcagacacctccgcttagcccaccttggtctcagccttggcaccctatccacctcgctttagcgtctccgcgcccaaatatcccccttcgctcgggccccgcttgcaggcctcccctgcagctccaagaattgttcacccggagtcttgcagaatccgagctgaggtcagccccgtatgaatttccggaggaatcaccaatcgagcagttggaggaacgacgccaacggttggagaggcagattagccaggacgtgaaactggaacccgacatcctgttacgcgctaagcaggacttcttaaagactgactccgactcagatctgcagctgtataaggagcagggggaagggcagggcgataggtccttgcgggaacgagacgtgctggaaagggagtttcagcgagtgacaatttctggtgaggaaaaatgcggagtgcctttcactgatctgctcgatgccgccaagtctgttgtcagggccctgttcattagggagaaatatatggcactgtcacttcaatcattttgccctaccactcgtcggtacttacagcaactggcagagaagccactcgagacccgcacatacgaacagggccccgacactccagtatcagctgacgcccctgtccacccaccagcactagaacaacatccatacgagcactgtgagcccagtactatgcccggcgacctgggcttgggcctccggatggtgagaggtgtggttcacgtgtatactaggcgcgaaccggatgaacattgcagcgaggtcgaactgccttacccagatctgcaggaatttgtggctgacgtgaatgtgctcatggcactcatcatcaacgggcctatcaaatctttttgttacaggcggttgcaatatttgtctagcaaatttcagatgcacgtcctgttaaatgagatgaaggaactcgccgcacagaaaaaggtgccacaccgcgacttttataatatcaggaaggtggacacccacattcacgccagttcttgcatgaaccagaaacacctgcttaggtttatcaagcgcgctatgaagcgacaccttgaagaaatcgtgcacgttgagcagggacgtgaacagacactgcgggaggtatttgagagcatgaacctgacggcctacgacctttccgttgacacactggacgtgcacgccgacagaaatacatttcacaggttcgacaaatttaacgctaagtataatccgatcggcgagagcgtgctaagagaaatttttatcaaaaccgacaatagggtgagtgggaaatattttgctcatattatcaaggaggttatgagcgatttggaagaaagtaagtatcagaatgcagagctaaggctgagcatatatgggcgctcaagggacgagtgggataaactggctaggtgggccgtgatgcatcgagttcacagtcctaacgtcagatggctcgttcaggtccctcgtctgttcgatgtgtatcgaaccaagggccaactcgcaaactttcaggagatgttagagaacatctttctgcccctgtttgaggcgaccgtgcatccggcatcgcaccccgaacttcaccttttccttgaacacgtggatgggtttgatagtgtcgacgatgagagcaagcccgaaaaccacgtgttcaatttagagagcccccttccagaggcctgggttgaagaagataaccccccttatgcttattacctttactacaccttcgcaaatatggcaatgttgaaccatttacgccgtcagagaggcttccacaccttcgtgctgcggccgcattgtggcgaagcgggtccaatccatcatttagtgagcgccttcatgttggccgaaaacatctctcatggtctgctactgaggaaggcccccgtgctgcagtacctctactacttggcccaaattggaattgctatgagccccctgagcaataactccctgtttctgagctaccatcggaatcccttgccagagtacctgtcaaggggcttgatggtgtctctgtctactgacgatcctctgcagttccactttacgaaggaacccttgatggaggagtacagcatcgccacacaggtctggaaactatcaagttgcgacatgtgtgaacttgctcggaactcagtgctgatgtcaggattttcacataaagtgaaatcacactggctcggacccaattacaccaaggagggacccgaggggaatgacataagacgtacaaacgtccctgatattcgggtaggttatcgatacgagactctgtgccaggagctggctttgatcacccaggctgtgcagtctgaaatgctcgagaccatcccagaagaggcaggtatcacaatgtcgccagggccgcagtag

SEQ ID NO: 107459 - DNA, 2283 bp, Artificial Sequence
  Description of Artificial Sequence: Synthetic coding sequence
atgctgacattcctgccctcccctcaggaactgtttaccagaagcctagctgagtctgagctgcgatccgcaccatacgagttccccgaagaatctccgatcgaacaactggaagaacggcggcaacgcctggaacgccagatctctcaggacgtcaaactggagcctgacatcttgcttcgcgcaaaacaagacttcctaaagaccgattccgactcggatttgcagctttacaaggagcagggtgaaggccaaggagaccgcagcttgagggagagggatgtacttgaacgcgaatttcagcgcgtgacaatcagcggggaggagaaatgtggtgtcccatttacagatcttctagatgccgctaaatctgtcgttagggcgctctttattcgcgagaaatatatggccctgtctctgcagtccttttgccccacaaccaggagatatctgcagcagcttgccgaaaagccactggagactcggacctacgagcaagggcccgatacaccggtgtccgctgatgctcccgtgcaccctccagcccttgagcagcacccttatgagcattgtgagccctctactatgcctggagacctggggcttggactgcggatggtccgtggtgtggtgcacgtatacacacgccgggaaccagacgagcactgctccgaggtggagttaccctatccggacctccaggagttcgttgccgatgtgaacgtgttaatggccctgataattaatggacctataaagtccttttgttatcgaagactccagtatctcagctccaagtttcagatgcacgtcctcctcaacgagatgaaggaactcgccgctcaaaaaaaggttcctcacagggatttttacaatatacggaaggttgatacccacattcacgcaagctcctgtatgaatcagaaacacctgctaaggtttattaaacgcgctatgaagagacaccttgaggagatcgtgcatgtggaacagggtcgggagcagacactgcgggaggtgtttgaatcaatgaacctgaccgcctacgacctttctgtggatacccttgacgtgcacgccgacagaaatacctttcatcggtttgacaaattcaatgctaagtataaccccattggagagagcgtgcttcgagagatcttcattaaaaccgacaaccgcgtgtcaggaaagtatttcgcacacataatcaaagaggtcatgagcgacctcgaggagtccaagtatcagaatgctgagctgaggctcagcatctacggcaggtcccgggatgagtgggacaagctggcacgatgggccgtgatgcaccgggtccattcacctaacgtcaggtggctagtgcaggtgcccaggctttttgacgtgtacagaacaaagggtcagttggcgaattttcaggaaatgttagagaacattttcttacctctgttcgaggcaacggttcaccccgcgagccaccctgagctacatctgttcttggagcatgttgacgggtttgacagcgtggatgacgagtctaaacctgaaaaccatgtcttcaatttggagtccccacttcccgaggcctgggtggaagaggacaatccgccctatgcctactatctgtattataccttcgccaatatggctatgctgaaccatttgagacggcaaagagggttccataccttcgtgctgaggcctcattgcggagaggctggacctattcaccacttggtctccgcattcatgttggctgaaaatatttcacatggcctgctgctgagaaaggcgcccgttttacagtatctgtactacctagcgcagattggaattgctatgtccccattgagcaacaacagtctgtttctcagttaccacagaaacccactacctgagtacctcagccgtggactcatggtgtccctgtcaacggatgatcccttgcagttccactttaccaaggagcccttgatggaggaatacagtattgcaacccaggtatggaagttgagcagctgcgatatgtgtgagctggcccgaaactccgtgctgatgtcaggttttagtcataaagtcaagagccattggctgggtcccaactacaccaaggagggcccagagggaaacgatatcaggcgcactaatgtgccagacatccgagtcgggtaccgctatgagactttgtgccaagagcttgccctgataactcaggccgtgcagtctgagatgctcgagaccattccggaggaagcagggattaccatgagcccaggccctcagtag

SEQ ID NO: 107460 - DNA, 6 bp, Artificial Sequence
  Description of Artificial Sequence: Synthetic coding sequence
atgtag

SEQ ID NO: 107461 - DNA, 2640 bp, Artificial Sequence
  Description of Artificial Sequence: Synthetic coding sequence
atgcggaatcgaggacagggactgtttaggctcaggagccgatgtttcctgcatcaatcattgccgctaggagcaggacgtcgaaagggcttggacgtggctgagcctggaccttcgagatgccgctccgactccccggctgtggcagccgtcgtgcctgcaatggccagttacccgtctggatcaggcaaaccaaaggcaaagtacccttttaaaaagagggcctctctgcaggcctcgaccgcggcaccggaagctagaggtggcttgggcgcccctcctttgcagtcagcccggagcttgcccgggcccgcaccctgtctaaagcactttcctttggatctgcgcacctctatggacggcaaatgtaaggaaatcgcggaagaactcttcacgaggagcttggccgaatctgaactcaggtcagctccttatgaatttcctgaagagtcgccaattgagcaactggaggagaggagacagaggcttgaacgacaaatctcccaggacgtgaagcttgagcctgatatcctactgcgtgccaagcaggatttcttaaagactgatagcgactctgacttacagttgtataaagaacagggcgaaggacaaggggaccgcagcttgagggagagggacgttctcgagagggaatttcagcgcgtgacaatctcaggcgaggaaaagtgcggggtgccctttactgatctgctggacgccgccaagtcagttgtgagagccttattcatccgtgagaagtatatggccctgtcacttcagtccttttgtcccactacacgcagataccttcaacagctggccgaaaagcccctggagactagaacgtacgaacagggccccgacactcccgtctccgctgacgccccagtgcaccctccagcccttgaacaacacccatacgaacactgcgaacccagcaccatgcctggcgacctgggtctggggctgcggatggtgaggggggtggtccacgtctacaccagaagagagccagatgaacactgtagtgaggtcgagcttccctatcccgacctgcaggagttcgtggccgacgtgaacgtgctcatggctcttataattaacgggccaattaagtcattttgctacaggcggctgcaatacctctcgtcaaaattccaaatgcacgttctgctgaatgagatgaaagagctggcagcgcagaaaaaagtaccccatcgcgacttctacaacataaggaaagtggacacgcacattcacgctagttcctgtatgaatcagaaacatcttctgcggtttataaaaagggcaatgaagagacacctggaagagattgtgcacgtggagcaggggcgcgaacagacactccgcgaagtcttcgagtcgatgaacctcaccgcctacgatcttagcgttgatacattagatgtacatgcagacaggaacacattccacaggttcgacaaattcaacgccaaatacaatcctatcggggagtccgtgctgcgggagatatttatcaagaccgataatcgggtgtctggcaaatatttcgcacacataatcaaggaggtcatgtctgatctggaggagagcaaatatcagaacgcagaactccggctgtctatctacggaaggtcccgagatgagtgggacaagctggcccggtgggctgttatgcatagagtgcactcgcctaacgtcaggtggctggtgcaggtgccacgcctgttcgatgtatacaggacaaaaggccagctggcaaactttcaagagatgttggagaatatcttcctcccactgtttgaggccaccgtccaccccgcttcacatcccgagcttcacctgttccttgaacacgtggacggcttcgatagcgttgacgatgaatcaaagccagaaaatcacgtgtttaacctagaaagtccactgcccgaggcatgggtggaggaggataatcctccgtatgcgtactacttatactatacgtttgcaaatatggccatgcttaaccatctaaggcgtcagcggggttttcacaccttcgtgctccgaccccactgcggcgaagcaggacctatccaccatctcgtatcagccttcatgctggccgagaatatatctcacgggttgctcctccgaaaagcccccgtacttcaatatctatactatttggctcaaatcgggattgctatgagccccctctccaataattccctctttctgtcgtatcatcgcaaccccctccctgaatacctctcccggggacttatggtgagcctttcaaccgacgaccctctgcaatttcatttcaccaaggagcccttaatggaggaatattcaatcgctacacaagtgtggaagctcagctcatgtgacatgtgtgagctggcgcggaacagtgtcctcatgagcggattttcccataaagtgaagagccattggctaggtccaaactacaccaaagagggtccagagggtaacgacatccgccgcaccaacgttcctgatattcgagtgggctatcggtatgaaacactgtgccaggaacttgctttaatcactcaggcagtgcagtcagaaatgcttgagaccatccctgaggaagcgggaatcaccatgagccctggacctcagtag

SEQ ID NO: 107462 - DNA, 312 bp, Artificial Sequence
  Description of Artificial Sequence: Synthetic coding sequence
atggcctcagaggctaggggtgggttaggcgcacctccgctgcaaagcgctcgctctctcccggggcctgccccttgtcttaaacattttcctctggacctgcggactagcatggatggaaaatgcaaggaaattgctgaagagctgttcaccaggagtttagccgagtccgagctgaggagtgcgccgtacgagttccctgaggagagcccgatcgagcaactggaggagcgcagacagcgcctggaaagacagatctcacaggacgtgaagctggagccggatatcctactgcgggccaagcaggactag

SEQ ID NO: 107463 - DNA, 2304 bp, Artificial Sequence
  Description of Artificial Sequence: Synthetic coding sequence
atgcccaggcagtttcctaagctcaacatcagcgaggtcgacgagcaagtgcgccttctggcggaaaaggtcttcgccaaagtcttaagagaggaagattccaaggacgctttaagcttgttcacagtgcctgaagactgccccatagggcaaaaggaggccaaagagagagagcttcagaaagaactcgcggagcagaagtcggttgagaccgcaaagcggaaaaagagctttaaaatgattcgctcccagtctctgtcgctgcagatgccaccacagcaagactggaagggccccccggctgcctcaccggcaatgtctcctactacacccgtggtgactggcgccaccagtctgcccacgcctgccccttatgcaatgcccgagtttcagcgggtcactatctcgggcgactactgcgctggtatcacgctggaggattatgagcaggctgcgaagagcctcgcgaaggcattgatgattcgggaaaagtatgctcggctggcttaccacagattcccacgtattacctctcagtatctcggccacccacgcgccgacaccgcgccacctgaggaaggactccctgattttcacccccctccgctaccacaggaagacccgtattgcctggacgatgccccaccaaacctggattaccttgtgcacatgcaggggggtatacttttcgtatacgataataagaaaatgcttgaacatcaagagcctcacagcttgccctatcctgatctcgaaacgtataccgtagacatgtctcatattttagcactaatcaccgacggtcccacaaaaacctactgccaccggaggctgaacttcctggaaagtaagttttccctccatgaaatgttaaatgagatgtccgagtttaaggagctcaaaagtaatccccacagagatttttacaatgtccggaaggtggatacgcacatccatgccgctgcctgcatgaaccaaaaacacctgttaagattcataaaacatacttaccagactgaaccagaccggaccgtcgctgagaaacgtggcaggaagattacgctacgacaggtatttgatggcttacatatggacccctacgacctgacagtggacagtttagatgtccacgcaggcaggcagacttttcaccgctttgacaagttcaattccaagtataatccagtgggtgcttctgagctccgggacctgtacctcaagacagagaactatctcggaggagaatatttcgccaggatggtgaaggaggtggccagggagctggaagagtctaaataccaatatagcgaacctcgcctgtctatctacggcagatcacccgaagagtggccaaacctggcatattggtttatccaacacaaggtgtactcccctaacatgcgatggataatccaagtgccccgaatctacgatatttttcggagtaagaaattgctgcccaactttgggaaaatgctggagaatattttcctgcccctgttcaaagcgacgatcaatcctcaagatcaccgcgaactccatctttttctgaagtacgtgaccgggtttgatagcgtagatgacgagtcaaaacactctgatcatatgttctccgacaaatccccgaatcccgacgtctggacaagcgaacagaatccgccatactcttattacttgtactacatgtacgccaacataatggtgctcaataacctgagaagggaacgcggcctctctacgttcttgtttagacctcactgcggagaagctggctctattacacaccttgtgtctgcctttcttacagctgacaatatctcacacggcttacttctcaagaagagtccagtcctccaatacttatattaccttgctcagatccctatcgccatgagccctctgtcaaataactcgctgttcctggaatatagtaaaaaccccctacgtgagttccttcataagggattacacgtgtctctatctacagacgaccctatgcaattccactacacaaaggaggccctgatggaagaatatgccatagccgcacaggtgtggaagttgtccacatgcgatctttgcgagatagctagaaactcggtacttcagtctggactcagccaccaggaaaaacagaaatttcttgggcaaaattattataaggaggggccggagggcaacgatatcaggaaaacaaatgttgctcagatcagaatggcatttcgttacgaaactctgtgcaatgaattgtcatttctgtctgatgctatgaagagcgaggagatcactgcactgaccaactag

SEQ ID NO: 107464 - DNA, 2331 bp, Artificial Sequence
  Description of Artificial Sequence: Synthetic coding sequence
atggctttgtcttcagaacccgccgagatgccacgccagttccccaagctcaacatctccgaagtggatgaacaggtacggctgctggctgaaaaagtctttgccaaagtcctgagagaggaggactctaaagatgctctctccttatttacagtgcccgaggactgcccaattggacagaaagaggccaaagagcgggagttgcaaaaagagctggcagaacagaagtccgtggaaaccgctaagagaaaaaagtctttcaagatgatcaggagtcagtcgctgagtctacagatgcctcctcagcaagactggaagggtcccccagccgccagcccagcgatgtctcccacaactcctgtggttactggcgccactagccttcccacccctgccccttacgccatgccagaatttcagagagtcaccatctctggggactactgcgccggcataaccttggaggattatgaacaagccgccaaaagtctggccaaagcactcatgatcagagagaaatacgctaggctggcttaccacaggttccctcggattactagccagtatctgggtcatccccgcgcagataccgctccaccagaagaaggcctgcctgacttccatcctccaccgcttccacaagaggatccctattgcctagatgacgctccccccaatctggattacctggtgcacatgcagggcgggattctgttcgtgtacgataataaaaagatgctcgagcatcaagagccacattcgctcccctatccggacctcgagacttatactgtggatatgtcccatatcctcgcactgattaccgacggtcccaccaaaacgtattgtcacagaagacttaactttttggagtcaaagttttcactgcacgaaatgctgaacgagatgtctgaatttaaggagctcaaaagtaacccccacagggatttctataatgtccgtaaagtggacacccatatacacgctgccgcctgcatgaatcagaaacacttacttaggttcatcaaacatacttaccaaaccgagccagatagaacagtcgcggaaaaaaggggaaggaaaatcactctccggcaggtatttgacgggctgcacatggatccctacgacctgaccgttgattcccttgatgtccatgcgggacgtcagacgttccacagattcgacaagtttaacagtaagtataatccagtaggtgcctctgaattacgcgacctatacctgaaaactgaaaactatctcggaggcgagtatttcgcccgcatggtgaaagaggtggcccgcgagctggaggaatctaaataccagtacagcgagcctaggctgtcaatttacggccgatcacccgaagaatggcctaacttggcttactggttcatccaacataaggtgtacagccccaacatgaggtggataattcaggtaccgagaatttatgatattttcaggtccaagaaactgttacccaacttcgggaaaatgttggaaaatattttcctccccttgtttaaggccacgataaatccgcaggaccaccgcgaattgcatctgttccttaagtatgtcaccggttttgattctgtggatgatgaatccaaacattcagatcatatgttctcagataagagtcccaaccccgatgtatggacttccgaacagaatccaccttactcctattacctttactacatgtacgctaacattatggtactgaacaacctccgccgtgaaagagggctttcaacttttctgtttcgaccgcattgtggcgaggcaggctctataacacacctggtgagcgcgttcctcacagccgacaacatctcccatggtctgcttctgaagaagagtcccgtgctgcagtatttgtattacctggcccagatacctatcgctatgtccccactgtccaataatagcctgttcctagaatacagcaagaaccctctaagagaatttttgcacaaaggcctgcacgttagcctgagcaccgatgatcccatgcagtttcattatacaaaggaagccctgatggaggagtatgccatcgccgcccaggtgtggaaactgtcaacctgcgacctctgcgagatcgcaagaaattctgtgctgcagtccggcctctcacatcaggagaaacagaagttcctaggacagaattactacaaagagggcccagagggcaacgacattcgcaaaacaaatgtagcccaaattagaatggccttccggtacgagactttgtgcaacgaactgagcttcctctctgacgctatgaagagcgaggaaataacagcccttacaaactag

SEQ ID NO: 107465 - DNA, 1827 bp, Artificial Sequence
  Description of Artificial Sequence: Synthetic coding sequence
atgattcgggagaaatatgccaggctagcataccacagatttcctcggatcacatcacagtacctggggcatccccgggccgataccgcaccacctgaagagggcctgcctgacttccaccccccgcccctcccacaggaagatccctattgtctcgacgacgctccccctaaccttgattacttggtccacatgcaagggggtatcttgtttgtctatgacaacaagaagatgctagagcatcaagaaccccatagtctaccttatcctgatcttgaaacatacaccgtggatatgtctcatatcctggctcttatcactgacggacccaccaaaacctattgccatcgacggctcaacttcctcgagtcaaagtttagcctgcacgaaatgctgaatgaaatgtctgaatttaaagaactcaagagtaatcctcatagagatttttacaacgtcagaaaggtggacacacacatccacgccgccgcatgtatgaaccagaagcacctgctcagatttatcaaacatacatatcaaaccgaaccagaccggacggtcgctgagaaaagagggcgaaaaatcaccctgcgacaggtcttcgacgggctgcacatggatccttatgacctcaccgttgatagcctggacgtgcacgcaggtcggcagacattccatcggtttgataagttcaatagcaagtacaaccctgtaggagccagtgagctcagagatctgtacctgaaaactgaaaactacctgggcggtgaatactttgctcgcatggtgaaggaggtcgccagggagctagaagaaagcaaataccagtactcagagcctcgtctctctatttacggcagatctcctgaggagtggcctaatctcgcctactggttcattcaacacaaggtttactcgcccaacatgcggtggatcatccaggtgccacggatttatgatattttccgctcaaaaaagctgcttcctaatttcgggaagatgttagagaacatcttcctgccgctgtttaaagctacaatcaatccacaggaccatcgagagttgcacctgttcctgaaatacgtgacaggctttgatagcgttgatgatgagtccaagcacagcgaccatatgttctcagacaagagtcctaacccagacgtatggacctccgaacaaaaccctccctattcctactatctctattacatgtacgccaacattatggtgctgaacaacttgagacgtgagagaggcctcagcaccttcttgttccgtcctcattgcggagaggccggctctattacccacttggtcagcgcattcttgaccgcagacaacatttcccacggtctgctccttaaaaagtccccagtgctccaatacctatactacctcgcacagatcccaatagcgatgtctcctctgtctaacaattccttattcctggagtacagcaagaacccactgcgcgagtttctgcacaaaggtctgcacgtgtccctttccaccgatgaccctatgcagtttcactatacgaaagaggcactcatggaggagtacgctatcgccgctcaggtgtggaagcttagcacctgtgacctgtgtgagatagctagaaattcagtcctgcagtccggcctgagtcaccaggagaaacagaagttcctcggacagaactattataaagaaggcccagaaggaaacgatataaggaaaacaaacgtcgcacagatacgtatggcgtttagatacgagaccctatgtaatgagctgtcgtttctttccgatgctatgaagtccgaagagattactgctcttacgaattag

SEQ ID NO: 107466 - DNA, 804 bp, Artificial Sequence
  Description of Artificial Sequence: Synthetic coding sequence
atgccaaggcaatttcctaaactgaacatatcagaagttgacgaacaggtgcggcttttggctgagaaggttttcgctaaagtgttacgcgaggaggacagcaaggacgcactctctctctttaccgttcccgaggactgcccgattggacaaaaagaggcgaaggagcgggaactgcagaaagagctcgccgaacagaaatccgtggagacagcaaaacgcaaaaagtcctttaaaatgatccgctctcagtccctctctctgcagatgcccccacaacaggactggaaaggtccgccagccgcctcccccgccatgtcccccacaacccctgtggtgaccggagccaccagcttacccacgcctgcaccctatgctatgcctgaatttcaaagggtaactattagcggcgactattgtgctggtatcaccttggaagactacgagcaagcagcaaagtccctcgcaaaagcgttgatgatcagggaaaaatacgctagactcgcctatcacagattccctcgtattacttcgcagtacttaggtcacccacgtgccgacaccgcccctcctgaggaaggcctcccagatttccaccctcctccccttccgcaggaggatccgtactgtttagacgacgcaccacccaacttggattatttagtgcacatgcagggtggcatactcttcgtatacgataacaagaagatgcttgagcatcaggagcctcattcattgccctaccccgatctcgaaacgtatacagtcgacatgtcccatattctggcattgatcacggattag

SEQ ID NO: 107467 - DNA, 2325 bp, Artificial Sequence
  Description of Artificial Sequence: Synthetic coding sequence
atggagcccggctccgcagagatgccccggcagttcccgaagttaaacatttctgaagtagacgaacaggtccgacttttagctgagaaagtgttcgccaaagtgcttagggaggaggatagcaaggatgccctctcactgttcactgtgcctgaagattgtcctatcggccaaaaggaggccaaggagagagaactgcaaaaggagttggctgagcagaagagcgtggagaccgctaagcgaaagaagtcttttaaaatgatcagaagccagagcttgtctcttcaaatgcctccgcaacaggactggaaaggcccccctgctgcctcaccggctatgtctcctacgacacccgtcgtgaccggtgccacatccctgccaactcctgccccttatgcgatgcctgagttccaacgcgtaacaatttcaggagattactgtgctggtatcactctcgaggactacgagcaggcagccaagtcactggcaaaagccctgatgattcgagagaagtacgcccgactggcttaccacaggttccccaggatcacttctcaatatttgggccatccacgagccgatacagcaccgcccgaagaggggctacccgattttcatccgcctcctttgcctcaggaggatccctactgccttgacgatgcccctccaaacctcgactacctggtgcacatgcaaggggggattctgttcgtttatgataataaaaaaatgctggagcaccaagaacctcacagcctgccataccctgacctggaaacctatacagtagatatgtctcacattctggcactgatcaccgacggcccaaccaagacatattgtcaccgccggctcaattttttagaatctaagttttccctgcacgagatgctgaatgagatgagcgagttcaaggagctgaagagtaacccgcaccgggacttttacaatgtccggaaagtggatacgcacatccacgccgccgcctgcatgaatcagaagcacttgctgcgcttcatcaaacatacttaccagactgaacccgacaggactgtcgcagagaagagagggaggaagatcactcttagacaggtgtttgacggcttacacatggatccatatgacctgactgtggacagtttggacgtccacgccggccgccaaactttccacagatttgacaaatttaatagtaaatataaccccgtgggcgcctccgaactaagagatttatatctgaaaaccgagaactacctgggcggcgaatattttgctcgaatggtgaaggaggttgcaagagaattggaagagtcaaagtaccagtacagcgaaccgaggctgtcaatttatggtaggagtcccgaagagtggccaaatctggcgtactggtttatccaacacaaggtgtatagccccaatatgcgatggatcatccaggttccgcgaatctacgatattttccggtcaaagaaactccttcctaattttggtaagatgcttgagaacatcttcctgcctttgtttaaggcgaccattaaccctcaggaccatcgggaactccacttgtttctgaagtacgtcacgggctttgactctgttgacgacgaaagcaaacatagcgaccacatgttcagtgacaagtcccctaacccagacgtgtggacctcagaacaaaatcctccctattcatactacttatactacatgtatgccaacattatggttctgaacaacctgaggagggaacggggtctgagcacgttcttgttccgccctcactgcggcgaggccgggtctattacacaccttgtgagcgctttcctgacagctgacaacataagtcacgggctgctgctaaagaagagtcccgtgctgcagtatctgtactatctggctcagatcccaatagcaatgtctccactctcaaacaatagcctgtttttagagtacagtaagaatcctcttagggaatttttgcataaaggtctccacgtgagcttgtccacagatgaccccatgcagttccactataccaaagaagcacttatggaggaatacgctatcgctgcccaggtgtggaagttgtcgacctgtgatctgtgtgagattgcccgaaactccgtgctgcaatctggtctttcccatcaagagaagcagaaattcctgggtcaaaattactataaggaggggccagaaggcaatgacatcaggaaaaccaatgtggcccaaatccgcatggcattccggtacgaaactttatgtaatgaactctccttccttagtgacgctatgaagagtgaagagatcacagctttaaccaattag

SEQ ID NO: 107468 - DNA, 2304 bp, Artificial Sequence
  Description of Artificial Sequence: Synthetic coding sequence
atgcccaggcagtttcctaagctgaatatctcagaggtggatgagcaagttagattgctggctgaaaaggtatttgctaaagtgctgcgggaagaagacagtaaagatgccctatctctgtttacggtaccagaggattgccctatcggccagaaggaagctaaagagagggagctgcaaaaggagttagcagaacaaaaatcagtagagacagccaaaaggaaaaagagcttcaagatgatccgctcacagtccctgtcgctgcagatgcctccacagcaagactggaagggcccccctgccgcctcacccgccatgagccctacaaccccagttgttacaggggccacatccttgcccactcctgccccctacgcgatgcccgaattccaacgcgttaccataagcggggattattgtgcaggcataactttggaagattacgaacaagccgccaaaagtttagcaaaggccttgatgatcagagaaaagtacgccaggctggcctaccaccgttttcctagaattacctcacagtacctcggtcacccccgcgctgacaccgcgccccctgaggagggcctcccagacttccacccgccacccctaccgcaagaggacccatactgtctggacgacgctcctcctaatctggattacctggtccatatgcagggaggaatcctcttcgtgtacgacaataaaaagatgctcgaacaccaggaacctcacagcttgccttacccagatctggagacatatactgtggacatgtcccatatcctggcactgatcaccgatggccccacaaagacctactgtcaccgccgcctgaactttctggagtccaagttttctctgcacgagatgctcaatgaaatgtctgagtttaaggaattaaaatccaatcctcacagggatttctacaacgtgagaaaagtcgacacacacatccatgccgccgcctgcatgaaccagaagcacctcttgcgttttattaaacatacttatcagacagagcccgaccgaacagtagccgagaagagaggccggaagatcactctgcgccaagtctttgatggcctgcatatggacccctacgacctgactgtggatagcctcgacgtccatgctggtcgtcaaacatttcacaggtttgataaattcaacagtaagtacaaccctgtgggggccagcgagctcagggacctctatctaaaaactgagaactatctcgggggagaatatttcgcccggatggttaaggaggtcgccagagaactggaagagagtaagtaccagtacagcgagccacgcttatccatttatggaagaagcccggaagagtggcctaatctggcctattggtttatccagcataaggtttactcacccaatatgagatggatcattcaagtgccacgaatatacgatatttttcgcagtaagaaactcttgcccaattttggaaaaatgttagagaacatctttttgcccctctttaaggccaccataaatcctcaggatcaccgggaactccacttatttttgaagtatgtgaccgggttcgactctgtggacgatgaatctaagcactctgaccatatgttcagcgacaagtccccaaatccagatgtttggactagcgagcagaacccaccgtactcgtattacctgtactatatgtacgccaacattatggtcttgaacaacttaaggagggagcgcggcctgtcaacttttttgttcagacctcattgcggagaggctggctccatcactcacctagtaagcgcctttcttactgctgataatatttctcatggcttgctcctcaaaaaaagccccgtgctgcagtacttatattacctagcccagattccgattgccatgtctccactctcgaataactcactgtttttggagtattcgaagaacccgctgagagaattcctgcacaaaggtctacatgtgagcctgagtacagacgatcccatgcagttccactacactaaagaggcactcatggaggagtatgcgatcgcggcacaggtctggaagctgtcaacctgtgacctgtgtgaaattgctcggaactccgtgctgcaatctggactttcccaccaggaaaaacaaaaatttctcgggcagaattattacaaagagggacctgaagggaatgatatccggaaaactaacgtcgcccagatacgtatggcatttcgttatgagaccctctgcaatgagttgtctttcctttcagacgctatgaagtcagaggagatcacagctctgacgaactag

SEQ ID NO: 107469 - DNA, 336 bp, Artificial Sequence
  Description of Artificial Sequence: Synthetic coding sequence
atgcctagacagtttccaaaattaaacatatccgaagtggacgaacaggttcggctgctggccgagaaggtgttcgccaaagtcttacgcgaggaggattcaaaggacgccctgagcctgtttaccgtccctgaggactgccccattggccaaaaagaggccaaagaacgggaactgcaaaaggaactggctgaacagaaatccgtcgagactgctaagagaaaaaaatctttcaaaatgatacgaagccaatcactgtctctgcagatgcccccacagcaggactggaagggtccgccggccgcaagccccgctatgtctccaactacaccttag

SEQ ID NO: 107470 - DNA, 426 bp, Artificial Sequence
  Description of Artificial Sequence: Synthetic coding sequence
atggcccgccctctgtgcaccctgctcctgctcatggccaccttagcgggagccctagctagctccagcaaggaagagaataggataattcctggcgggatctatgacgccgacctcaacgacgagtgggtacaaagggcactgcatttcgcgatctcagagtataacaaggccacagaagacgagtattatcggaggcccctgcaggtactgcgagctcgggagcagacctttgggggagtgaattactttttcgacgtcgaggttggccgtaccatatgcacaaaatcacagcctaacctggatacatgcgccttccacgagcaaccagagttgcagaaaaaacagctatgttcttttgagatatacgaagtgccctgggaagaccggatgagcttggtaaacagtcggtgtcaggaggcatag

SEQ ID NO: 107471 - DNA, 1215 bp, Artificial Sequence
  Description of Artificial Sequence: Synthetic coding sequence
atgcccggcttaatgcgcatgcgagaacgctattccgccagcaagcctctaaagggcgctcggattgcaggctgcctgcatatgaccgtggagacggctgtactgatcgagactctggtaactttgggagctgaagtgcagtggtcaagttgtaatatcttcagcacccaggaccatgctgcagcggctatcgcaaaagcaggaatcccagtgtatgcatggaaaggggagacagacgaagagtacttatggtgcatcgaacagacactgtacttcaaagatggacccctcaatatgatcctagacgatgggggggacctgactaatctgattcacacgaaatacccacagttactgccaggaatcaggggaatctccgaagagactacaactggagtacataacttatataagatgatggcgaacggtatattaaaggtgccagctatcaacgttaacgactctgtcaccaaatcaaaatttgataatctttacggctgtcgggaatctcttatcgatgggatcaagcgggctacagatgtgatgatcgctggcaaagttgcagtcgtggctggctacggcgatgtaggtaagggctgtgcccaggccctgcggggtttcggcgccagggttatcattaccgagatcgacccgatcaatgctctccaggccgcaatggagggctatgaggtcacaacgatggacgaagcctgtcaggaggggaacatcttcgtcaccacaaccggctgcattgatatcatcctcggacggcatttcgaacagatgaaagatgatgctatagtctgcaatattggacacttcgatgttgagattgatgttaagtggctgaacgagaacgcagtggagaaagtgaatatcaagccgcaggttgatcgatacaggctgaaaaacggacggcgcattatcctgttggccgagggccgcttggtgaacctgggctgtgccatgggtcacccaagctttgtgatgtctaattcattcactaatcaggtgatggcccaaattgagttgtggactcacccagacaaatatccagtcggagtccactttctcccaaaaaaactcgacgaagctgtggcagaagcacacctggggaagctgaacgtgaagctgacgaagctgacagagaagcaggcccaatacctagggatgtcttgtgacgggccattcaaaccggaccattaccggtactag

SEQ ID NO: 107472 - DNA, 798 bp, Artificial Sequence
  Description of Artificial Sequence: Synthetic coding sequence
atgttcgtgtccaagcggagatttatcctcaagacctgcggtactacacttctactcaaggctctggtgcctttgctgaagctggccagggattactctgggtttgattcgatccagtcattcttctactctcgcaaaaattttatgaaaccttcccatcaggggtaccctcatcggaattttcaggaagaaatagagtttctgaacgcaatattccctaacggggctgcctactgtatgggacgtatgaattcagattgttggtacttatacacccttgacttccccgagtctcgcgtcatcagtcagcccgaccagacgctggagatactgatgagcgaactcgatccagccgtgatggatcagttttacatgaaggacggagtaaccgcgaaggatgtgaccagggagtccggcattagagacctaatacctggttcagttatcgacgctacaatgttcaatccttgtgggtatagcatgaacgggatgaaaagtgacgggacatactggacaatacatattacacccgaacctgagtttagctacgtgtccttcgaaaccaatctcagccaaacaagctacgacgacctcattcggaaggttgtggaggtgttcaagcccggaaaattcgtaaccacattgttcgttaaccagtcatctaaatgcagaaccgtgttggcatccccacagaagattgagggcttcaagcgactggattgtcaatcggctatgttcaacgattacaacttcgtgttcacatcgttcgctaaaaaacagcaacagcaacaatcgtag

SEQ ID NO: 107473 - DNA, 918 bp, Artificial Sequence
  Description of Artificial Sequence: Synthetic coding sequence
atggaagcagcccacttcttcgagggaactgagaagctgctcgaggtttggttctctaggcaacagccagacgcgaaccagggttctggagacctccgtacaatcccatcggagagttccatgtttgtgtctaagcgtcgctttattcttaaaacctgtggtaccactctgctgctcaaggccctggtgccactcctgaagctggcgagagactattctggcttcgattctatccaatcattcttttactccagaaaaaattttatgaagccttcacaccagggctacccgcatagaaatttccaggaggagattgagttcctaaacgccatctttccaaacggcgccgcctattgcatgggacgaatgaattccgactgctggtacctgtacactttagactttccagaaagtagggttattagccaaccagatcagactttggagattctgatgagcgagctcgaccccgctgtgatggatcagttctacatgaaggacggtgtcacagcaaaggatgtcacacgagagtccgggatccgggatctgattccgggaagtgtcatcgacgcaaccatgttcaacccatgcggatattccatgaatgggatgaaatccgacggcacctactggacaatccacattacgccggagcctgaatttagctacgtgtccttcgagaccaacctatcccaaacttcatacgatgacttaatcaggaaggtcgtggaagtattcaagcctgggaagttcgtgactaccctttttgttaaccagtctagcaaatgccgcaccgtgcttgcttccccccagaaaattgagggatttaagaggctcgactgccagtccgcgatgttcaatgactataatttcgtgttcacttcttttgcaaaaaaacagcagcagcaacagtcatag

SEQ ID NO: 107474 - DNA, 561 bp, Artificial Sequence
  Description of Artificial Sequence: Synthetic coding sequence
atggggcgcatgaattccgactgctggtacctctacaccctggacttcccggaatctagggtcatctcccagccggatcagaccctggagatactgatgagtgagctggaccctgctgtaatggaccagttttatatgaaagacggcgtgacagccaaagatgttactagggaatctggcataagggatctcatccccgggagtgtcattgatgccaccatgttcaacccctgcggctattctatgaatggcatgaaatcggatggcacttactggaccattcacatcacccctgagccagagtttagttacgtgagctttgagactaatctgagtcagacctcttacgacgatcttatccgtaaggtggtggaagtcttcaaaccggggaagtttgtgaccacgttgttcgtgaatcaatcaagcaaatgtcggactgtactcgcctctccacaaaaaatcgagggtttcaagaggctggactgccagtctgccatgttcaacgactataactttgtttttacgagttttgctaagaaacagcagcaacagcagagctag

SEQ ID NO: 107475 - DNA, 1005 bp, Artificial Sequence
  Description of Artificial Sequence: Synthetic coding sequence
atggaagctgcccatttttttgagggcacggagaaattgctcgaggtttggttttcccggcagcaaccagatgcaaatcagggcagcggtgatctgcgtacaatcccccgaagcgagtgggacattttgctcaaggacgtccagtgcagtatcataagcgttacaaaaacagacaaacaggaagcctatgtgctttctgagagctccatgtttgtaagtaaacggcggttcatcctaaaaacttgtggaacgacgctgttgttgaaggctctagtgcccctcctgaagcttgctcgggattattccgggttcgattctattcaatcctttttctactcaagaaagaattttatgaagccaagccaccaaggctatccccacagaaactttcaggaagagatcgagttcctgaacgccatctttccgaacggggcagcttactgcatgggccggatgaatagcgactgctggtacctgtacaccctggattttcccgagtcccgtgtaatttctcagcccgaccagaccctggagattttaatgagtgagttagaccccgccgtcatggatcaattttacatgaaagatggcgtcactgccaaagatgtgacccgggaaagtggcattagggatctgattccaggaagtgtgatcgacgctacaatgttcaacccctgtggttacagcatgaatggaatgaagagtgatggcacctattggaccatacatattacacccgaaccagagttttcttatgtgtcgttcgagactaacttgtcccagacttcctacgacgacctcatcaggaaggtggtcgaggtgtttaagccgggaaagttcgtgacaacactgtttgttaatcagagttccaagtgccggacagttttggcttcgccccagaagatcgaagggtttaaacggcttgattgccagtctgctatgttcaatgactacaattttgtcttcacatcattcgccaagaagcagcagcagcaacagtcctag

SEQ ID NO: 107476 - DNA, 645 bp, Artificial Sequence
  Description of Artificial Sequence: Synthetic coding sequence
atggaagcagctcacttctttgagggaactgaaaagttactcgaagtttggttttcgcgccagcaacccgatgcaaatcagggttcaggagacttacgcacaattcctagatatttatacactctggatttcccagaaagccgcgtcatcagccagccagatcaaacgcttgaaatcctgatgtccgagctcgatcctgccgttatggaccagttttatatgaaagacggagtgacagccaaggacgtgacaagagaaagtgggatccgagacctgattcccgggtccgttatagatgcaaccatgtttaacccctgtgggtattccatgaacggaatgaagagcgatggcacatattggactatacacattacccctgaaccagaattctcatatgtgtccttcgaaaccaacctcagtcaaacaagctacgatgatttgattagaaaagtggtggaagtctttaaaccgggtaagttcgtaacgaccctgttcgttaatcagtcttcaaaatgccgtacggtcctggctagccctcaaaaaatcgagggctttaagaggctggactgccagtctgccatgttcaatgactataattttgttttcacatcttttgctaaaaagcagcagcagcagcagtcctag

SEQ ID NO: 107477 - DNA, 3360 bp, Artificial Sequence
  Description of Artificial Sequence: Synthetic coding sequence
atggccggggctccccgcggcggaggtgggggaggagggggtgcaggcgagccaggaggtgctgagcgtgccgcaggtacctctcgccgcagaggattgcgcgcatgcgacgaagaatttgcgtgtccggagctagaagcactgtttcgagggtacactcttagattggagcaagcagccacacttaaggccctcgccgttctctcactgttggccggcgccctggccttggcagaactgctcggtgctccaggtcccgcacctgggctcgctaaggggtcgcaccccgtccactgtgtcctctttctggcccttctggtagtgacaaacgtcagaagtctgcaggtcccacagctccagcaggtgggacagctggctctgctgtttagcctcacattcgcactcttgtgctgcccctttgcactcgggggccctgccagaggctcagccggggctgctggggggcccgccaccgctgaacagggcgtctggcagctacttctggtcacattcgttagttatgcactcctgccggtgcggtctctcctggcaatcggctttgggcttgttgtggccgcctctcacctgctcgtcacagcaacactggttcccgcaaagagaccgcggctatggaggacacttggggctaatgccctgctgttcgtgggggttaacatgtatggtgtattcgtcaggattctgacagagaggagccagcggaaggcattcctgcaggcccgctcctgcatagaagaccggctacggctcgaagacgagaatgagaagcaggagaggttattgatgtcacttctcccgaggaatgtagccatggagatgaaggaggacttcctgaagccacccgagcgcattttccataaaatctatattcagcggcatgacaacgtgtcaatcctgttcgctgacattgtgggctttaccggactcgcgagtcagtgcacagcacaggaactcgtcaaactgctgaatgaactgtttgggaagtttgacgagttggccacggaaaaccattgtagacggatcaagattctgggagactgctactattgcgtgtcaggtttaacgcagcctaagacagaccatgcccactgttgtgtggaaatgggactggatatgatcgacactattacttccgtcgccgaagccactgaagtggacctgaacatgcgtgtaggactccatacaggcagagtcctgtgtggagtgttgggattgcggaagtggcagtacgatgtttggtctaatgatgtcacccttgcaaatgtgatggaggctgcgggactccctggtaaggttcacatcacaaagacgaccctggcttgtctcaacggggactatgaggtggagccaggttacggacatgagaggaactccttcctcaaaacacacaacattgaaacctttttcatagttccctctcatagacgaaagatatttcccggcctcattctatctgacatcaagcctgcgaaaaggatgaaatttaaaaccgtctgctatctgcttgtgcaacttatgcactgcagaaaaatgtttaaagctgaaatccccttctccaacgtcatgacatgcgaggatgacgataagcgaagagcgttgaggaccgcctcggaaaaactccggaaccgaagcagcttctctactaacgtggtctataccactcccggcacgcgggtgaaccggtacataagtaggcttctggaagcaaggcagacagaactcgaaatggcagatctaaatttctttacactgaagtacaagcatgtcgaaagggaacaaaagtatcaccaattacaggatgagtactttacaagtgccgttgtgctaacgcttatactggcagcccttttcgggcttgtctatcttctcatctttccccagtcggtcgtcgtcctgctgctgctggtcttctgtatctgtttcttagttgcctgtgtattatacttgcacattacaagagtccaatgttttcccgggtgcctcactattcaaatccgtacagttctgtgcatttttattgtcgtgctcatttattccgtggcccagggatgcgtggtgggctgcctgccttgggcctggtctagtaagccaaactccagccttgtggtcctgagttccggcggacagagaaccgcgttgcctacactaccctgtgagtctacccatcacgccctgctctgctgtctggtgggtactctgcccctggccatcttcttccgtgtctcaagtctcccaaagatgatcttactgtctggactgacaacttcatacatcctggttcttgagctgtctggatacaccagaaccggcgggggagcagtgagcggtagatcctacgaaccaatcgtggcaatccttcttttttcatgcgcactcgctttgcacgcacggcaagtggacatcagactgcggctcgactacctgtgggctgctcaggccgaggaggagcgcgaagacatggaaaaagtgaagttggacaatcgccggattctcttcaacttgcttcccgcccacgtcgcccagcacttccttatgtccaatccccgcaatatggatctgtattaccaatcctacagtcaggtgggcgtgatgttcgcgtcaatcccgaatttcaacgatttctatatcgaacttgacgggaacaacatgggcgtggagtgtttgcggctgctgaatgagatcatcgcggatttcgacgagctgatggaaaaagatttctataaagacatcgagaagatcaaaaccatcggaagcacctacatggctgccgtaggcctggctccgaccagcggcaccaaagccaaaaagagtatctccagccacctctcgaccctggccgactttgccattgaaatgttcgatgtgctcgacgagattaactatcagtcatataatgacttcgtcctgcgtgtgggaataaacgtcgggcctgtagtggccggcgttatcggagctaggcgcccccagtatgacatctggggaaacaccgtgaatgtcgctagcagaatggactcgactggtgtacaaggtcgcatacaggtgactgaggaggtgcataggttgcttagacgctgtccgtatcactttgtctgtaggggtaaagtttccgttaagggtaagggggagatgctcacctacttcctggaaggcagaaccgacggcaatgggagtcaaatccggagtctgggccttgatcggaagatgtgcccattcggccgcgcaggcctgcagggacggcgcccgcccgtatgtcccatgccaggagtgtctgttcgtgctggattgccgccacactcccccggacagtacctcccatctgccgctgccgggaaagaggcatag

SEQ ID NO: 107478 - DNA, 3174 bp, Artificial Sequence
  Description of Artificial Sequence: Synthetic coding sequence
atggcgggcgcccccaggggaggggggggaggtggcggaggggctggcgagcccgggggtgctgagagagccgctgggacgagcaggaggcgggggttgcgcgcatgtgacgaagaatttgcctgccccgaactcgaggccctgtttcggggttatactttacgattagagcaggccgcaaccctgaaagcgttagccgtgctcagtctgctggcaggagccctggcccttgcagaattactcggtgcacctggcccagcaccaggactggctaaggggtcccatcccgtgcactgcgtcctgttcctggctctgctagtcgttaccaacgtccggagcttacaggtgccccagcttcagcaggtgggacaactggccctattgttcagcttgactttcgccttgctttgctgcccttttgccctgggcgggccagcccgagggagcgcaggcgctgccggaggccccgccaccgcagaacaaggtgtctggcagttgctgctggtcaccttcgtcagctatgcactcctgccagtgcggtcgctcttggcaataggtttcgggcttgtggtggcagcgtcccatttactcgtaactgcaaccctcgtaccggctaagagacccaggctgtggaggaccctgggagcgaatgctctcttgttcgtgggcgtcaatatgtacggagtcttcgtgcgcattctaacggagcgcagccagcgaaaagcctttctgcaagctcgttcctgtatcgaggatcgcctgcgactggaagacgaaaatgagaaacaggagcgcctgttgatgtctctgctgcctcgtaacgtcgccatggagatgaaggaagacttcctgaagccccccgaacgcattttccataagatttacattcagcgacatgataacgtgtccatacttttcgcagatatagtcgggtttactgggctggcctcgcagtgtaccgcgcaggagctggtgaaacttctgaacgaactgttcgggaagttcgatgaactggccaccgaaaatcactgcaggcgcattaaaattctaggagactgctattattgtgtcagtggcctgactcagccgaaaacagaccacgcgcactgctgcgtggaaatgggactagacatgatagacactatcacctcagtggccgaagctaccgaagttgatttaaacatgcgtgttggactgcacaccgggcgggtactgtgcggggtccttggcctaagaaaatggcagtatgatgtgtggtctaacgatgttaccctggcaaatgtcatggaggccgcaggcttgcctggcaaagtgcacatcacaaagaccactttagcctgccttaacggggactacgaggttgaacctgggtacggccacgagagaaacagctttctgaaaacccacaatattgagacttttttcatcgtgcctagccacagacgaaaaatctttcccggtctgatactgtccgatatcaaacctgcaaagcgaatgaagtttaagactgtctgctacctcctggtacaattgatgcactgtaggaaaatgtttaaggctgagatccctttttctaatgtaatgacctgcgaggacgacgacaagaggcgagccctacgcactgcctccgaaaagttacgcaatagatcgtctttcagcacaaatgtggtatacaccacgccaggaacccgggtaaaccgttatatctctaggctgctggaggccagacagacggagctcgaaatggcagacttgaacttttttaccctgaaatacaagcatgtggaacgagagcagaaataccaccagctccaggatgaatacttcacctctgccgttgttctgacactcatcctggctgcattgtttggcctggtttacctcctgattttcccacagagtgtagttgtgctgcttttactcgtcttctgtatctgctttttagtcgcctgtgtgctgtatctgcatattaccagggtccagtgtttccctgggtgtctgacaatccagatcagaacggttctatgtatcttcatcgtggtcctgatctacagtgtagcgcaaggatgcgtggttgggtgtctgccttgggcctggtcctccaagcccaatagtagccttgtggtcctgtcaagtggagggcagcgaacagccctgcctactctgccttgtgagagcacacaccatgcactcctctgttgtctggtgggcacactgccattagccattttcttccgggtgtcatccctgcctaaaatgatactgttatccggcctgacaacctcgtatatcctagtgctggagctgtccggctatacacggacaggggggggtgctgtttctgggcgctcctacgaacccattgtggccatcctgcttttctcttgcgcgctcgccttgcatgcaaggcaagtcgatatacggctccggctggattacctgtgggccgcccaggctgaagaagaaagggaggacatggagaaagtgaaactcgataataggaggattctctttaacctcttaccggcccatgtcgcgcagcactttttgatgtctaatccaagaaacatggacctgtactaccagtcatattctcaggtgggtgtaatgttcgctagcatacccaacttcaacgacttttacattgagctcgacggtaacaacatgggtgtagaatgtctgagactacttaatgagataatcgctgacttcgacgagctgatggaaaaagacttttacaaggacatcgagaagatcaaaaccattggatccacttacatggcggccgtggggctggccccaacttctggcacaaaagccaagaagagtattagcagccacctctcaactctggcagacttcgccatcgagatgttcgacgttctggacgagataaactaccaaagctataatgactttgtattgagagtcggcatcaacgttggccctgttgtcgcaggggtcatcggggccaggcgccctcagtacgacatctggggcaacacggtcaacgtcgcatcgaggatggactccactggagtccaaggacgcattcaagtaactgaagaagtacaccgcctactgcggaggtgcccgcctctctgtgtacccagacaatctcagtgccagggtcagaggagagatgtggacatcctttcacgcagacaagattag

SEQ ID NO: 107479 - DNA, 3276 bp, Artificial Sequence
  Description of Artificial Sequence: Synthetic coding sequence
atgtggcaggaggctatgagaagacggagatacctccgcgatcgcagcgaagaagccgccggcggcggcgatggactgccacggagtagagattggctttatgagagctattactgtatgagccagcaacaccctctgattgtttttctgctccttattgtgatggggagctgtctggcactgcttgctgtattttttgcattagggctcgaagtagaagaccatgtcgcattcctgataactgtgccaaccgcgctggccatcttcttcgctatcttcatactggtgtgcattgaatctgtgttcaagaaactgctgcgcctattctctctggtgatatggatctgccttgtagccatgggatatctgttcatgtgcttcggcgggactgtgagcccctgggatcaggtatcttttttcctgttcatcatcttcgtggtctacactatgctaccttttaatatgcgggacgccatcatcgcctcagtgctcacatccagttcacataccatcgtgctgagcgtgtgtctttccgctacgccggggggaaaagagcatctggtgtggcagattctggctaacgttataatattcatttgcggcaatctagctggggcctaccataagcatctgatggagcttgcattgcagcaaacctaccaggatacatgcaattgtattaaaagcaggatcaagctcgaatttgagaagaggcaacaggagaggttactcttgagcctgctcccggctcatatcgcgatggagatgaaagctgagatcatccagcgactacaaggccccaaggctgggcagatggagaacacaaacaacttccacaacttatacgtcaaacggcatacaaacgtgtccatcctgtacgctgacatagtggggttcacaaggctggctagcgactgtagtcctggggaacttgtacatatgttaaacgagctcttcgggaagtttgaccagatcgccaaagagaatgagtgcatgcggattaaaatactgggggactgttattattgcgtgtctgggctcccgatttctcttcccaaccacgcaaagaactgcgtgaagatgggtcttgatatgtgtgaggcaattaagaaagtgagagacgccactggggtcgacatcaatatgcgggtgggcgtgcattccggaaacgtcctgtgcggggtgatcgggctgcagaaatggcaatatgacgtctggtctcatgacgttacactggccaaccacatggaggctggcggggtgccagggcgtgtccatatctcgtccgtaaccctggagcatctaaatggcgcatacaaagtggaggagggagatggtgatataagagacccctacctgaaacagcatttggtgaaaacatattttgtgatcaaccccaaaggcgagcggcgctccccccagcatctcttcagacctagacacaccctggatggcgcaaagatgcgggcctccgtccggatgacccgatatctggagtcttggggcgctgccaaacctttcgcccatttacaccaccgggactctatgacgaccgaaaacggcaaaatttctaccaccgacgtgcccatggggcagcataactttcagaatagaactctgcggacaaaaagtcagaagaagcggttcgaggaagagttgaatgaacgcatgatacaggctatcgatggaattaatgctcaaaaacaatggttaaagtctgaggatatccagagaatttcactcttgttctataacaaggtgctggagaaggaataccgcgccaccgcacttccggcattcaaatactatgtgacctgcgcctgcctcattttcttctgcattttcattgtccaaatccttgtgctaccgaagacctccgtactgggaatttcctttggcgccgcttttctgcttctggcctttatcttgtttgtctgctttgctggtcaacttctgcagtgcagtaaaaaggcctcgcctctgttgatgtggcttctgaaatcctccggcatcattgccaatcgcccttggccacgcatttcactgactatcattactactgcaatcattctgatgatggccgtattcaatatgttcttcctatccgacagcgaagaaaccatacctccgacagctaataccacaaacacaagttttagtgcgtctaataaccaggtcgcaatactgcgagctcagaatctgttttttttaccatatttcatctatagctgcattctgggccttataagctgtagtgtctttctgcgggtgaactatgagctcaaaatgctgataatgatggtcgcactggtgggttataacacaatactgttacatacccatgctcatgtcctcggagactacagtcaggttctgttcgaaaggcccggcatctggaaggacctcaagacaatgggaagcgtttccctgagcattttcttcattacgttgctggtgctgggaaggcaaaacgagtactattgtcgcttggattttctttggaagaataaatttaagaaggagagagaagaaatcgaaaccatggagaatctgaaccgggtgctgctggagaacgttctgccagctcacgttgccgagcactttcttgcacgcagtctgaaaaacgaagagctgtaccatcagtcctacgattgtgtctgcgtgatgttcgctagtattccagattttaaggaattctataccgaaagcgatgtcaataaggaagggttggaatgcttacggttattgaatgaaatcatcgcagacttcgacgatctcttgtcgaagcctaagttcagcggcgttgaaaagatcaagactattggctccacctatatggccgccactgggctgagtgctgtacccagtcaggagcactctcaagagcccgaaagacagtacatgcacataggtacgatggttgaattcgcttttgcgctggtgggcaagttggatgcaattaataaacactcttttaacgacttcaagctgcgcgtggggatcaaccatggcccagtcatagcaggagtgatcggggcccagaaaccacaatacgatatatggggcaacactgttaacgttgcctccagaatggacagtacaggtgtgctagacaagattcaggtcactgaggaaaccagtctagtgctgcagacattgggttacacttgcacgtgccgcgggattatcaacgtgaaaggcaaaggagatctgaagacatattttgtgaacactgagatgagccgttccctgtcacagagcaacgtggcatcttag

SEQ ID NO: 107480 - DNA, 612 bp, Artificial Sequence
  Description of Artificial Sequence: Synthetic coding sequence
atggagaacctcaaccgcgtgttgctggagaacgtcctccccgcccacgtggctgagcacttcctcgcgagaagcctgaagaacgaggaattgtaccaccagtcttacgattgcgtgtgtgttatgtttgcctccattcccgacttcaaagagttctatacagagtctgacgttaacaaagaaggcctcgaatgcttacgccttcttaatgagattattgccgacttcgacgacctgctgtcgaagcccaagtttagtggggtggaaaagatcaaaaccatcgggtcgacctatatggccgctaccggactgtcggccgtgccgtcccaggagcattctcaggagcccgagagacagtatatgcatattggtactatggtggagttcgctttcgccctggtgggaaagcttgatgcaatcaacaagcacagcttcaatgattttaaactgcgagtcggggttaccgaagagacttcactcgtgctgcaaactctgggttatacctgcacctgtagaggaattatcaacgtgaaaggcaaaggagacttgaagacttacttcgtcaataccgaaatgtcccgcagcctatcacagagtaacgtagcttcctag

SEQ ID NO: 107481 - DNA, 2736 bp, Artificial Sequence
  Description of Artificial Sequence: Synthetic coding sequence
atggacctgcgatgggcaagagatttgcatcttcgtgaagcgagccgttctgtcgcattcacaacactgcgcttgggtgctgtcaccaccggcttgctgacttttcgggagccaggtgacaaagaaaagtcagggaagggactgggcaaacgctggcggatccaacgcgaagaaagccaggaacgcctgctcttgtctctacttcccgcccatatagccatggagatgaaagcagaaataatacagagactgcagggcccaaaagcggggcagatggaaaacacaaataacttccataatctctacgtaaagcgccatacaaatgtcagtattctttatgcagatatcgtcggctttacacgcctggcttccgattgtagcccaggtgagttggtgcatatgctgaacgagcttttcgggaaatttgaccaaatcgccaaggaaaatgaatgtatgcggatcaaaattctcggggattgttattattgtgtgtcgggccttcctatatccctccccaatcacgctaagaactgcgtcaaaatgggcctggatatgtgtgaggctatcaaaaaagtgagagatgccaccggggtggatattaacatgcgcgtgggcgtgcacagcgggaatgtgctgtgtggcgtcatcggactgcagaagtggcaatacgacgtctggtctcacgatgtgactttggctaaccatatggaggccggcggggtcccaggccgggtgcacatcagcagcgttacgctggaacacctgaatggcgcctataaggtggaagagggggatggagacatccgcgacccttacctcaaacagcacctggttaagacttatttcgtaattaatcctaaaggcgaaagacgctcaccccaacatctgtttcgcccacgtcataccttggacggcgctaaaatgcgagcctctgttaggatgacaaggtacctggagtcctggggagccgccaagcccttcgcccatctgcaccatagagactctatgaccacagagaatggtaaaattagcacgaccgacgtccctatggggcagcacaacttccagaaccggactttgaggactaagtcccagaaaaagcggtttgaagaagagctgaacgagcggatgatccaagctattgacggcataaatgcacagaaacaatggctgaaaagtgaggatatccaacgtattagcctgctgttttataataaagtgcttgagaaagagtaccgggctaccgcacttccagcatttaagtactacgtgacctgtgcatgccttatcttcttctgcatctttattgtgcagatccttgttcttcctaaaacaagcgtgctgggtatctcgtttggcgccgcatttctcctgcttgcattcattctgtttgtatgtttcgccggccaactcttgcagtgctccaagaaggcgtctccattgcttatgtggctactaaagagtagcggaattatcgccaaccgcccctggcctcggattagtcttaccatcattacgactgctattattctgatgatggctgtctttaatatgtttttcctctccgattcagaggaaacaataccacctaccgctaatacaacgaacacatcatttagtgcatccaataaccaggtggcaatcctgcgggcacagaacttgttctttctaccttatttcatttattcctgcattctcggcttaattagctgcagcgtgttcctcagagtgaactacgaactgaaaatgcttataatgatggtcgcactagtgggctataataccatcctgctccatacccacgcacacgtcctaggagattatagccaagtgctgttcgaaaggccgggcatttggaaagatctgaagacgatgggctcagtgtccctgagcatattcttcatcaccctcttagtcctgggacggcaaaatgagtactattgtcggctcgactttctctggaagaacaagttcaaaaaggaaagggaggagattgagacaatggaaaacttgaacagagtgctgctggaaaatgtcctccccgcccacgtcgcagagcattttctagcccgatccctgaagaatgaggaattgtaccaccagtcctatgattgcgtgtgcgtcatgttcgcctctatacctgacttcaaggaattctacaccgaatccgatgtcaataaggaggggttagagtgccttcggctcttgaacgagatcatagctgacttcgatgacctgctttccaagcccaaattttctggagtagagaaaatcaaaacaataggaagcacctatatggccgccacaggattatctgccgtgccttcccaagaacactcacaggaaccagaaagacagtatatgcatatcggcaccatggtggagttcgcgtttgccttggtcggtaaattggatgccattaacaagcactccttcaatgactttaagcttcgggtgggcattaatcatggccccgtcattgcaggggttattggcgcccagaaacctcagtacgatatatgggggaatactgtgaacgtggctagccgaatggactcaacgggcgtgctggacaaaatccaggtgactgaggagacttctctggttctgcagacgctgggatacacctgtacttgcagaggaatcatcaacgtgaagggcaagggcgacctcaaaacctacttcgttaacacagagatgagtaggagtctgtcgcagtctaacgttgcttcttag

SEQ ID NO: 107482 - DNA, 2775 bp, Artificial Sequence
  Description of Artificial Sequence: Synthetic coding sequence
atgctgcctttcaacatgcgcgatgctatcatcgcatccgttcttaccagcagctctcacacaatcgtgttgtctgtgtgtctttcagccacacctggagggaaggagcaccttgtgtggcagatcctcgccaatgtgattatattcatctgtggtaatttggcaggcgcgtaccacaagcatctcatggagcttgcactacagcagacatatcaggatacctgcaattgtatcaaaagtcggataaagcttgaatttgagaagaggcagcaagaacggttgctgctcagtctcctccccgcccacattgctatggaaatgaaggccgagatcatccagcggctgcagggccccaaggccggccagatggaaaataccaataattttcataatttgtatgtgaagcgacatactaacgtctctatcctgtatgcagatatagtcggcttcacccgattagcttccgactgctctcccggagagctggtccacatgttgaacgaactctttgggaaattcgatcagatcgccaaggaaaatgagtgcatgcgcattaaaatcctgggggactgttactactgcgtatctgggcttcccattagcctgccaaaccacgcgaagaattgcgtgaagatgggtctggacatgtgcgaagctatcaagaaggtgcgggatgctacaggagttgacattaatatgcgtgtgggagtgcacagcggaaatgtactgtgcggcgtgatagggctccaaaagtggcagtacgatgtgtggagccacgacgtcactcttgccaatcatatggaagcgggcggtgtgccaggtcgcgttcatatctccagtgtcacactagagcacttaaacggtgcatacaaggtcgaggagggcgacggcgatatccgagacccgtatctcaagcagcaccttgtcaagacctactttgtgatcaaccctaaaggggagcgcagatcaccccagcatctcttcagaccacgacatacgcttgatggcgccaagccttttgcacaccttcatcaccgcgacagcatgacaacagaaaacggtaagatttccacgacggatgttcctatgggccagcacaattttcagaaccgaacactgcggactaagtctcaaaaaaaacgcttcgaggaggaattgaatgagaggatgatccaggccattgatgggattaacgcacaaaaacagtggctcaaatctgaggatatacagaggatctcacttcttttctataataaggtactcgagaaagagtatcgcgcaacagctctgccggcgtttaagtactacgtgacatgcgcctgtctgatcttcttttgcatctttatcgtgcaaattctggttctcccaaagacatcagttttagggattagtttcggcgccgcttttctgctgctcgctttcatcctgtttgtgtgcttcgctgggcagctccttcaatgctcaaaaaaagccagtcccttattgatgtggctgcttaagtcaagcggcataatagccaacagaccttggccccggatctctcttaccattatcacaacagctatcatactgatgatggctgtttttaatatgttttttctgtctgactccgaagagaccatccctcccacagctaatacgacgaacacaagtttcagcgcctctaacaatcaggtggccatcctgagagctcagaacctattcttcctcccctacttcatttatagttgcattcttggactcatttcttgtagtgttttcctaagagtgaattatgagctgaaaatgctcattatgatggttgccctggttggatataatactatcctgctacacactcacgcccacgtgctaggggattactcgcaggttcttttcgagagacccggcatatggaaagatctaaagactatgggcagtgtgagtctgtctatcttcttcatcactttgcttgtgttagggagacagaacgagtactattgtagattggatttcctgtggaagaacaaattcaagaaggagagagaggaaatcgagactatggagaacctgaatagagtgcttctggaaaatgtcctcccagcccatgttgccgagcattttctcgctcggtccctcaagaacgaggaactgtatcatcagagctatgactgtgtgtgcgtcatgtttgcttccatccccgacttcaaagagttttataccgagtctgatgtaaataaggaagggctggaatgtctaagattgcttaatgagatcatagccgatttcgacgacttattgtcgaagccgaagttctccggagtggagaaaatcaagacgattgggtccacatatatggcagccaccgggttaagtgccgtgccaagccaggagcattctcaggaacctgagagacagtatatgcacataggaactatggtggaattcgcctttgccttagtaggtaaactagatgccattaataagcattccttcaacgatttcaagctgcgtgtgggaattaatcacgggccagtcatcgcgggggtgatcggggcccagaagcctcagtatgacatttgggggaacaccgtcaatgtggccagcaggatggacagcaccggcgtcctcgacaagattcaggtgaccgaagagacaagtctagtgctgcagacgctcgggtacacctgcacttgcaggggaatcatcaatgtgaaagggaagggcgatctgaaaacatatttcgtgaacacagaaatgagcaggagtctctctcagagtaacgtggctagttag

SEQ ID NO: 107483 - DNA, 3435 bp, Artificial Sequence
  Description of Artificial Sequence: Synthetic coding sequence
atgccacgaaatcaggggtttagcgaacctgagtacagcgccgagtactccgctgaatatagcgtttctctgccctctgatcctgatagaggagtggggagaactcacgagatcagtgttcggaatagcggcagctgcctatgtctgccacgattcatgcgactgactttcgttcctgaaagcctcgagaatctgtaccagacttactttaagagacagcgacacgaaaccctgctagtgctggtggtattcgcagctctgttcgactgctatgtagttgtgatgtgtgctgttgtcttttcctcagataagctcgcctctttagcggtggccggcattgggctcgtgctggatatcatcctgttcgtattatgcaagaaggggctcctccccgaccgagtgaccaggcgagtgctgccttacgttctgtggctgctgatcactgcccagatttttagctaccttggtttgaactttgctcgggcacatgctgcatctgacaccgttgggtggcaagtattcttcgtcttttctttctttataacgctcccccttagcctgtcacccattgtcattatttctgtagtgagttgcgtcgtacacacccttgtactgggggtgacggtcgcgcaacagcagcaggaggaactgaagggtatgcagctcctgcgcgagatcctggccaacgtgttcctatacttatgcgccattgctgtcggaatcatgagctattacatggccgacagaaagcaccgtaaggccttcctggaagcccgacagtctttagaggtcaagatgaacctcgaagagcagagccaacagcaggaaaatctgatgctgtcaattttgcccaaacatgtggccgatgagatgctgaaagatatgaaaaaagatgaaagccaaaaggatcagcagcagttcaacacgatgtatatgtatagacacgaaaacgtatcaattctctttgcagatatagtaggctttacccaactttcttcggcatgcagcgcccaggaattggtgaaattgttgaacgagctgttcgctcggttcgacaaactagccgctaaataccaccagctgagaattaaaattctgggagattgctattactgcatatgtggacttccagattaccgcgaagaccacgcagtgtgctccatcctgatgggccttgcaatggttgaagccatttcttatgtcagggaaaaaaccaagactggagttgatatgagagtaggggtccacacagggaccgtcctgggtggcgtgttggggcagaagaggtggcagtacgacgtgtggtctactgatgtgaccgttgccaacaagatggaggcaggaggcattcctggaagagtccatatcagtcaatctactatggattgcctgaagggagaatttgacgtcgagccgggggatggcgggtctcgttgcgactacctggaggagaagggcattgagacttatcttatcattgcatcaaagccagaagtaaaaaaaactgccacacagaatggactcaacgggagcgctctgcccaatggcgcccctgccagcagcaaatcaagcagtcccgccctcattgagaccaaggaaccgaatgggagtgcccattccagcggcagcacaagcgaaaagcccgaggaacaagatgcacaggccgacaatccatccttcccgaatcccagacggagactcagactgcaggaccttgccgaccgcgtggtggacgcctccgaagatgagcacgaacttaatcagctcctgaacgaagctcttctggagagagagtcggcacaggtggtgaaaaaaaggaataccttcttgctgtctatgagattcatggaccctgagatggagactaggtactctgtggagaaggagaaacagtccggagcggcctttagctgctcgtgcgttgtgctgctgtgtaccgcgctcgtggagatactcatcgatccttggcttatgacaaattatgtgacctttatggtgggcgaaatcctcctcctaattctaacaatttgttcactggccgccatctttcccagagctttccctaagaagctggtggcctttagcacatggatcgatcgcacaaggtgggccagaaatacttgggcaatgttggcaatcttcattcttgtcatggccaacgtcgtcgatatgctatcctgtctgcagtattataccggcccgtctaatgccaccgccggaatggaaaccgagggttcttgcctcgaaaaccctaaatattataactacgtggccgtgctctctctgattgccactattatgttagtgcaggtgagccatatggttaagttgacccttatgctcttagttgccggggctgtagccaccattaacctgtatgcctggagaccagtgttcgacgaatacgatcataagagattccgtgaacacgatttgcccatggtggctttggaacagatgcaggggttcaatcccggacttaacgggaccgatcgcctcccgttggtgccctctaaatacagcatgaccgtaatggtgtttctcatgatgttgtctttctactatttcagccgccacgtcgagaagctcgcccgcacgctgttcctgtggaaaattgaggtgcacgatcagaaagagcgggtatacgagatgaggcgttggaacgaagctctcgtgaccaatatgcttcctgagcacgtggcgcgacactttctgggctctaagaaaagagatgaagaactgtacagtcagacctatgacgaaataggtgttatgtttgcctcgctgcctaattttgcggatttctataccgaggagtctatcaacaatggtggtatcgagtgtctccgcttcctaaacgaaatcatctccgactttgatagtctgctggataaccctaagttcagagtcattactaaaattaagacaatcggaagcacttatatggccgcatcaggggtgaccccagacgtcaataccaatgggtttgcttccagcaataaagaggacaaatccgagagagagcgctggcaacatctcgccgacttagctgattttgccctggccatgaaggacacgctcacaaatatcaacaaccagtcgttcaacaactttatgcttagaataggcatgaacaaaggaggcgtcctcgccggggtgatcggggcgagaaagccccattatgatatttggggcaatactgtgaacgtggctagtcgcatggaatccaccggagtaatgggcaacatccaggtagtcgaggagacacaagtcatactgagggaatatggcttccgatttgtgcgaaggggcccaatcttcgtgaaaggaaagggcgagctgttaaccttttttctcaaaggaagggacaagttagccacctttcctaacggcccgagtgtgacactaccccatcaggtggtcgacaactcctag

SEQ ID NO: 107484 - DNA, 3360 bp, Artificial Sequence
  Description of Artificial Sequence: Synthetic coding sequence
atgccgagaaatcaaggcttctctgaacccgagtattccgccgaatattcggcagaatactcagtctctctcccgcgattcatgcggctcacctttgtaccagaatctctcgagaatctttaccagacatacttcaagaggcagcggcacgaaaccctccttgttctggtcgtgtttgcagcgctatttgactgttatgtggtggtgatgtgtgcagtcgtattctcgagcgataaactggcgtcccttgccgtggccgggatagggctggtgctggatatcatattgtttgttctttgcaagaaaggtctgcttccggatcgagttacccgacgtgtgctgccatacgttctttggttattgataacagcccagatcttttcatacctgggcctgaatttcgctcgtgcccatgctgcaagtgacactgtgggctggcaggtgttctttgtgttttccttcttcattacgctgcctctcagtctgtcaccaattgtgatcatatccgtggtgagttgcgtagttcatacactcgttctcggtgttacggtggcacaacaacaacaggaagaattgaaaggcatgcagctgctacgggaaatcttggctaatgttttcctgtacctgtgcgcaattgctgttgggatcatgagttattatatggcagacaggaaacatcgcaaagcttttctggaagccagacaatctctagaagtaaagatgaacctggaggagcaaagtcagcagcaagaaaatttgatgctgagtatcctacctaagcatgtggccgacgagatgctcaaagatatgaagaaagacgagtctcagaaagatcagcagcaattcaacaccatgtacatgtacaggcatgaaaacgtgtcaattctctttgcagacatcgtcgggtttacccagctctcaagtgcgtgttcagcacaagagcttgtgaagctattaaacgagctgttcgctcgcttcgacaagctcgctgccaagtatcaccagctgagaatcaagattcttggagactgttactactgcatttgtggcttgccagattatcgagaggatcacgcagtttgctccatcttaatgggcctggctatggtggaggctatttcctatgttagggaaaagacgaaaacgggcgtcgacatgcgtgtcggcgtgcacacggggactgtgcttggcggtgtgctgggccaaaagcgttggcaatacgatgtctggtcaaccgatgtaacagtggccaataagatggaggccggaggaatccctggacgggtgcatatcagccagagcactatggactgtctgaagggcgagtttgatgtcgagcccggtgacggcggctcaaggtgcgactatttggaggagaaagggattgagacgtatttgattatagcttcaaaacctgaggtgaagaaaactgctactcagaatggcctgaacggatccgccctgcccaatggagcaccagcctcatccaaaagtagctccccagcgctcatcgagaccaaagagccgaatggctctgcgcattcttccggcagcacaagcgagaagcccgaggagcaagatgcgcaggcggataacccctcctttcctaaccctcggaggcgcttgcgactccaagatctggcggacagggtcgttgatgcatctgaggacgaacacgagctcaaccagctgctgaatgaagctctgcttgaacgcgaaagcgcacaggtcgttaaaaaaagaaacacattcctgttatccatgaggttcatggatcccgaaatggaaactcgatattctgtagaaaaggagaaacagagcggcgcagcatttagctgctcatgtgtggtattactatgcactgcactggtcgagatcctgattgacccgtggctgatgactaattacgtcacctttatggtcggagaaatcctgctattgatccttacaatctgctctctggccgctatatttccacgcgcctttccaaaaaagctggtcgcttttagcacctggattgatcgcacacgctgggcccgcaacacatgggccatgttggcgatctttatccttgtgatggccaacgttgttgatatgctcagttgcctgcagtattacacagggccgtctaatgccactgccggaatggagaccgaagggtcttgcctggaaaatccgaagtactacaattacgtcgctgtactttccctcatcgctaccatcatgctcgtccaggtgtctcacatggtgaagctcacgctcatgttactagtggctggcgccgtcgctactattaacctgtacgcttggagacccgtttttgatgagtacgatcacaaacggtttcgggagcacgatcttccaatggttgcgttggaacagatgcagggcttcaatcccgggttaaatggtaccgacagattacctctggtaccttccaaatatagtatgaccgtcatggtgttcctcatgatgctgagtttttactacttctcccgccatgttgaaaaacttgcaagaaccctgttcctgtggaagatagaagttcatgaccagaaggagcgcgtctatgagatgcggcggtggaacgaggctcttgtgactaatatgctgcctgaacatgttgcccgacattttctgggctcaaagaaacgggacgaggagctgtacagccagacttatgacgagattggtgtaatgttcgcatctctgcccaattttgccgacttctataccgaggagtccattaataacgggggtattgaatgcctccgctttctgaacgaaattatttctgactttgacagcttgctcgacaaccccaagttccgagtgatcaccaaaataaagacgatcgggtcaacatacatggctgcatccggtgtcactccagacgtaaacactaatgggttcgccagctctaataaggaggataaatccgagcgggagaggtggcagcacctcgctgacctggccgacttcgcgctggcaatgaaggacaccctgactaatattaataatcagagctttaataactttatgctgaggatcggcatgaacaagggcggggtacttgccggagtgataggcgcccggaagccccactacgatatttggggtaacaccgttaacgttgcatcccgcatggaatccaccggagtgatggggaatatccaggtggtcgaagaaacacaggtcatcctcagggagtacggttttcggttcgttcgcagggggcccatttttgtcaaaggcaaaggtgagctgctgaccttcttcctgaaaggccgagataagctcgctacctttcccaacggtccaagcgtcaccctcccccaccaagtagtcgacaatagttag

SEQ ID NO: 107485 - DNA, 339 bp, Artificial Sequence
  Description of Artificial Sequence: Synthetic coding sequence
atgccgagaaaccagggattttcagaacccgagtactctgccgaatactcggccgaatattccgtctccctgccttctgatccggaccgtggagtgggccgcacacatgagatcagtgtgcggaatagtggctcttgcctttgtttgccacgctttatgagactaactttcgttccagaatccttagagaatctctaccagacttacttcaaacgccagcgacacgagactcttctcgtgctggtcgtgttcgccgctctgtttgattgttacgttgttgtgatgtgcgccgtggtcttcagtagcgacaaactggccagcctggccgtcgccggatag

SEQ ID NO: 107486 - DNA, 3234 bp, Artificial Sequence
  Description of Artificial Sequence: Synthetic coding sequence
atggcaagactgttcagtccaagacctccaccctccgaggatctcttctacgagacctactacagtctctctcagcagtaccccttacttctgcttctgctgggcattgtgttgtgtgcgttagcagccctgctcgccgtcgcgtgggcatcaggccgagagctgacctctgacccatccttcctcaccactgtactgtgcgccttggggggtttctctctcctcctaggcctagcatccagggaacaacgacttcagaggtggacacggcccttatctggtctggtctgggttgccctgctggccttaggacacgccttcctctttactggcggtgtggtgtctgcctgggatcaggtgtcttactttctttttgtaattttcaccgcatatgcaatgctaccgttgggaatgcgcgatgcagcagttgctgggctggcttcctccttgagtcacctcttggtactgggcctgtacctggggccccaaccggatagtaggccggctctcttaccacaactggctgcaaatgctgtgctgtttctttgcggaaacgtggccggcgtgtatcataaggcattaatggaacgcgcactcagagcaaccttccgcgaagcgctgtcctctcttcacagtcgacgacgactggacactgagaagaagcatcaggagcatctgctactttcgattctgcctgcttatcttgcccgggagatgaaagcagagattatggcacggctccaggccggtcagggctctcgccccgaatccaccaacaacttccactccctgtacgtcaaacgccatcagggcgtctctgtactctatgctgacatcgtaggctttactagactggcctctgagtgttcccccaaagaactggtcctaatgttaaatgagctgtttggaaaatttgaccaaattgctaaagaacatgaatgtatgagaataaagatcttaggtgattgttactactgtgtgtcagggctgcctctaagtctgccagatcacgcaataaactgcgtgagaatgggactggacatgtgcagagcaattagaaagctcagggcagctacaggagttgacatcaacatgcgtgtcggcgtgcactcggggtctgttctctgtggggtaataggactgcaaaaatggcagtacgacgtttggtcgcacgacgttacactagccaatcacatggaagctgggggggtgccaggtcgggttcatataacgggcgccaccttagctctgctcgcaggggcctacgccgtggaagacgccggaatggaacatagggatccctatttgagagagttgggggagcctacatacttggttatcgatccccgcgccgaagaggaggatgagaaggggactgccggcggtttactttcatcacttgagggattgaagatgcgcccaagcctccttatgaccaggtacctggagtcttggggagccgctaaaccctttgctcatttaagtcacggcgactccccagtctccaccagcacacctctgccggagaagacacttgcctctttctccactcaatggtcacttgatcggtcaagaaccccacgtggcttggacgatgagctcgacaccggggatgctaaattcttccaggttatcgaacagctcaacagccagaagcagtggaagcagtcaaaggacttcaaccctctgacactatactttagggaaaaggaaatggaaaaagagtaccggttgagtgcgatcccagcttttaaatattacgaggcttgtactttcctggtgttcctttccaattttataattcaaatgctcgttactaaccgacccccagcgctcgcgattacatatagcatcaccttcctactgttcctcctgatcctcttcgtgtgcttttcagaggaccttatgaggtgtgtgcttaagggccccaaaatgctgcactggttacccgctctttcaggtctggtggcaacgcgcccagggctgagaattgccttgggaaccgccaccatccttctggtgttcgccatggccatcacctctttgtttttctttcctacgagctcggattgtccgttccaggcccccaacgtctcatctatgatctcgaacctgtcatgggagctgcccggcagtctgccgctgatctccgtaccctacagcatgcactgttgtaccctcgggttcctgagctgttcccttttcctgcacatgagctttgagctcaaactgttgttactgcttctgtggctagcggccagctgtagcctgttcctgcattctcatgcttggctgagcgagtgcttaatcgttcggctgtacttgggacctctggacagtcgacccggagtgctcaaggaaccaaagctcatgggggcgatctcattcttcattttctttttcactctactggtgctggctcggcaaaacgagtattattgtagactcgatttcctatggaagaagaaacttaggcaggagagggaagagacggaaactatggaaaatttgaccaggctgcttctcgaaaatgtgctgccagctcacgtcgcaccccagttcatcggacagaatagaagaaatgaggatctgtatcatcagagttacgaatgcgtgtgtgtgctatttgctagcgtaccagactttaaagaattctacagtgaatcaaacataaaccatgaaggattagaatgcttgcggttgctgaatgagattatcgccgacttcgacgaactgttgtcgaagccaaaatttagcggggttgagaaaatcaaaactattggctctacttacatggctgctacaggactgaacgcgacgtccggtcaagatgcgcaacaagacgcagaaagatcttgttcacaccttggaacaatggtggaatttgccgtcgcattaggatcaaaactcgatgtgattaataagcatagcttcaacaacttcagactgagagtcgggctcaatcatggacctgttgtggcaggtgtaatcggagcccagaagccgcagtacgatatctggggaaatacagtgaacgtcgccagtaggatggagagcacgggagtgctcggcaaaatccaggttacagaggagacggcatgggcactgcagtccctaggatacacttgctatagccgcggcgttatcaaggtcaagggcaaagggcagctttgtacatactttctcaacaccgatctcactaggacaggtccaccatcagccactctcggctag

SEQ ID NO: 107487 - DNA, 1260 bp, Artificial Sequence
  Description of Artificial Sequence: Synthetic coding sequence
atgtctcgcggaactagagaatcagcgtgttgcatgctgacctcatgggcgagcagaggctggcccgccagtgtgcctttgaggagttggtgcagttgttccatgtctagcctggcttcatctaccagactgccccgaaaattgcgcgctgcaaccggcgtggatatcaatatgagggtgggggtccattctggctctgtgttgtgtggagtgatcggactgcaaaaatggcagtacgacgtgtggtcgcacgatgtgaccctggccaatcacatggaggctggaggggtcccgggtcgcgtgcatatcacgggtgcaacactggcactgctcgcaggggcttacgcggtcgaggatgccggtatggagcacagggatccttatcttcgcgaacttggagaaccaacctacctcgtgattgacccccgcgcggaagaggaagacgagaaaggcactgccggcggcctattatctagcctggaaggactcaaaatgagacctagcctccttatgacccgatacctcgagtcgtggggcgcagcaaaacccttcgcccacctctcccatggagatagccctgtgtccacctccaccccacttcccgagaagactttggcgtctttctcgacccagtggagtttagatcgttctaggacccccaggggacttgacgacgagttggacaccggagacgccaaattttttcaggtcatagaacaactgaatagccagaaacagtggaagcagtcaaaggactttaatcctctcacattgtacttccgggagaaagagatggaaaaggagtatagactcagcgctatccctgcctttaagtactacgaagcctgcaccttcctcgtcttcctctcaaactttattattcagatgctggtgacgaatcgaccaccagccctagcaattacctactcaatcacgttcctgctctttctattaatacttttcgtctgttttagcgaggatttaatgcgctgtgtactgaaagggcctaagatgttgcactggctaccagcactgtcgggccttgtggctactcgccccgggttacgcatcgcgctcggaactgcaaccatccttcttgtattcgcaatggccatcacgtctctctttttttttccaacctcttcagattgccccttccaagcccccaatgtgagtagtatgattagcaatctgtcttgggaattacccggttcattacccctgatatccgtgccggtgtctgtaccgacctgtccctag

SEQ ID NO: 107488 - DNA, 3234 bp, Artificial Sequence
  Description of Artificial Sequence: Synthetic coding sequence
atggcaaggctgtttagccctcggccccctccatcggaagacttattctatgaaacttattactccctctcacagcagtaccctctgctgctgctgctcctcggtatcgtcctttgtgcccttgccgccctgctcgctgtggcatgggcatccggaagagaactcacatccgatccttctttcttgacaacagtgctctgcgctttgggcggttttagcttgttgctcgggctggcaagccgggagcagaggttgcagcgctggacaaggccactttcaggtctggtatgggtcgccctgctggcccttggacacgcgtttttatttactgggggtgttgtgagtgcttgggatcaggtgtcatacttcctgttcgtgatttttaccgcctatgccatgttgcccctcggcatgcgagacgctgctgtagcgggcctagccagcagcctcagccacctgctggtgctgggactctatttggggccccagcccgactcgagacccgcgcttcttcctcaacttgccgccaacgcagtacttttcctttgtggtaatgtggctggcgtgtatcacaaggccttgatggagcgtgccctgagagccacctttcgtgaggccctgtcctcccttcattccagaagacgtttggataccgagaaaaaacaccaggagcatctactcctgagtatcttgcctgcctacttagcgcgagagatgaaggccgaaatcatggccaggttgcaggctggacaaggttcaaggcctgagtcgacaaacaatttccacagcctgtatgtcaaacgccatcagggcgtttccgtcctctatgcagacatagtcggattcacccgtctggctagcgaatgtagcccaaaagaactggtcctgatgttaaacgaactgtttggaaagtttgaccagattgcgaaagaacacgagtgtatgcgaatcaagatcctgggtgactgctactactgtgtgagcggccttccgttgtcgttacccgaccacgcgataaattgcgtccggatggggctggatatgtgccgggccatcagaaagctgagagctgctacgggagtggatattaacatgagagtgggagtgcatagtggctccgtgctttgcggagttattggtctccagaagtggcagtacgatgtgtggagccacgacgtgacactagcaaatcatatggaggcaggcggcgtgcctgggcgcgtccatatcacaggagctacactggctttactggcaggggcttacgctgtggaggacgccggtatggagcaccgcgatccctaccttcgtgagctgggcgaacctacctacttagtgatcgatccccgggcagaggaggaagatgaaaagggcaccgctggggggttactgagttctttggagggcctaaaaatgcgtccgagcctcctgatgaccaggtacctcgaatcctggggtgccgccaagccattcgcgcacctgtctcacggagactccccggtatctaccagcactccacttcccgaaaagaccctggcctcctttagtacccaatggtcgcttgatcgctctcggactccgcggggcctagatgacgagttggataccggagatgcaaagttttttcaggtcatcgagcagctgaacagccaaaaacagtggaagcagtctaaagactttaacccccttacactctacttccgcgagaaggagatggaaaaagagtaccgcctgagtgctattccggcatttaagtattatgaggcttgcacatttttggtatttctgtcaaatttcataattcagatgttggtcacgaaccggccccccgcgctagccattacttatagtatcacattcctgctgtttctgctgatcctattcgtgtgcttcagtgaagatctgatgaggtgtgtgctgaaaggccccaagatgctgcactggctcccggctttaagcggattggtagcaacaagacccggactacgcatcgcgttagggacagctacaatcttgctagtctttgcaatggccatcacgagcctcttcttttttcctacatcttcagattgcccctttcaagcacctaacgtctcctccatgatttctaatctttcttgggaactgccagggtctctgcccctcatatccgtgccatattcaatgcactgctgtacccttggattcttgtcatgcagcctttttctgcacatgagcttcgaacttaaactgttactgctcttgctgtggctggccgcaagctgctctctgttcctgcatagccacgcatggctcagtgaatgcctcatcgtccgactgtacttaggcccacttgattctcgtcctggtgtgttaaaagagccaaagcttatgggtgcgataagctttttcatttttttctttactttgctggtgcttgcccgccagaatgaatactactgcagactggactttctctggaagaagaagttaaggcaggagagagaggaaacagagactatggaaaacctaacccggctcctgcttgaaaacgtactccccgcccatgtggcaccacagttcatcggacaaaatcgccgaaacgaagatttgtaccatcagtcatacgagtgtgtctgtgtactgtttgctagtgtcccagatttcaaggagttttatagtgagagtaacatcaaccacgagggcctagagtgcctacgactgctgaatgagattatcgcggacttcgatgagttgttgtccaagcctaaattctcaggcgtggaaaagattaaaacaatcgggtctacatatatggctgcaactggacttaatgctacttccggacaggacgcccaacaggatgcagagaggagttgttctcatcttgggacgatggttgaatttgcagttgcgctggggagtaagctagatgtgataaacaaacactctttcaataactttcggctacgggtggggctgaatcatggacccgtggtagctggtgtgataggcgcgcaaaagcctcaatacgacatttgggggaataccgtgaacgttgcatccagaatggagagtaccggagttctggggaagatccaagtgaccgaggagacagcttgggccctccagtcactgggctacacctgttatagcagaggggtcatcaaagtgaaaggcaagggtcagctttgtacttacttcctcaacaccgatctgacacgaacaggacctccaagcgcaactctggggtag

SEQ ID NO: 107489 - DNA, 3234 bp, Artificial Sequence
  Description of Artificial Sequence: Synthetic coding sequence
atggcgagactgttttctcccagacctcccccctcggaagatctgttttatgagacatactacagcctctcacagcagtatccccttttgttgctgcttctgggaatagtgttgtgcgcccttgctgctctattagctgtggcctgggccagcggccgggaactaacatcagatccaagcttcctgactaccgtgctgtgtgccttggggggcttctcactcctgctcggcctcgcatcccgggagcagcggctgcagaggtggacccggcccctgagcgggttggtgtgggtggctctcctcgcactggggcacgcatttttatttactgggggcgtggtcagtgcctgggatcaggtatcctacttcttgtttgttatctttactgcctacgccatgctgcctctgggaatgcgcgacgccgcagtggctggactggcttcctctctgagtcaccttctggtcctcggtctgtatttgggaccacagcctgacagccggcccgctctgttgccccagctggcggcaaatgctgtgctctttctgtgtggaaacgtggccggagtgtatcacaaagcccttatggaacgggcgctgcgcgccactttccgcgaggccctatcctcgttacactcgcggcgcagactggatactgagaagaaacaccaggaacatctcctactgtccattcttccagcctacctggcgagagaaatgaaggcggagatcatggccagattgcaagcggggcaaggttctcgtcctgagtctacgaataatttccactctttgtacgtcaagaggcaccaaggggtgagcgtgctgtatgctgatatcgtcggattcacacggttagccagtgaatgctcgccgaaggaattggtgttaatgctcaatgagttgttcggcaaattcgatcaaattgccaaagagcacgaatgtatgagaattaagatcttgggggactgctattattgtgtttccgggttgccattgtcattgccagaccacgctattaactgtgttagaatgggcctagatatgtgtagggctattcgaaaactgagggctgctacaggagttgatatcaacatgagagtcggagtgcattccgggtcggtcctgtgcggcgtgattggcctccagaagtggcaatacgacgtgtggtctcatgacgtaacccttgctaaccatatggaggcaggtggagtgccgggtcgagtgcacatcactggggctacccttgccctgctcgccggcgcctatgccgtagaagacgcaggtatggaacatagagacccttatcttagggagttaggggagccgacataccttgtcatagatccgcgtgcagaggaggaggatgaaaagggtaccgccggcggtctgttgtccagtctcgagggccttaaaatgaggcccagtctgttgatgacgaggtacctggaatcctggggtgcggcgaaaccgtttgcccatttgagtcacggagactcccctgttagcacaagcactcctttacctgagaagaccctcgcctcttttagcactcaatggtcattggacaggagcagaactccgaggggtctggacgatgagctggacaccggcgatgctaaattcttccaggtgatcgaacagttgaacagccaaaagcaatggaagcagtcaaaagactttaatccactcaccctgtatttcagggagaaggagatggaaaaagagtatcgcttgagtgcaattccagcatttaagtactacgaagcgtgcacctttctggtgttcctgtccaatttcatcatccagatgctcgttaccaataggcccccagcgcttgcgatcacttatagtattaccttccttctgttcttacttattctcttcgtctgcttcagtgaagaccttatgaggtgcgtgcttaagggccccaaaatgcttcattggctgccggccctcagtggccttgttgccacccggcccgggcttcgcatcgccctcggcacagcgaccattttactggtgtttgccatggccattacatctctattcttctttcctacatctagtgactgcccattccaagcacccaacgttagctcaatgataagcaacctttcatgggaattgcccggaagcctcccccttattagtgtcccttattcaatgcactgttgtacgctgggcttcctgtcatgttcactgtttcttcacatgagctttgagctaaagctgctcctactcttgctgtggttggcggctagctgcagcctgtttcttcatagccacgcctggttaagcgagtgtctcatcgtaagattgtatctcgggccactggactctaggcccggcgtcttaaaggaacctaaactgatgggagccatctcgtttttcatctttttctttaccctgctggtgctggccagacagaacgaatattattgcaggctggactttctgtggaagaagaagctcagacaagaacgagaggagacagaaactatggaaaatttgacacggctccttcttgagaatgttcttcctgctcacgtggctccccagttcatcggccaaaatcgacggaacgaagatttgtaccatcaatcttatgagtgcgtctgtgtactctttgccagcgtaccagattttaaagagttctattctgaaagtaatattaaccatgagggcctggagtgccttcggctcctgaatgagataattgcagattttgatgagctgctaagcaagcctaaattctccggcgtggaaaagattaaaacaatcggatcaacttacatggcagcaactgggttaaacgcaaccagtgggcaggatgcgcagcaagatgccgaacggtcatgctctcatcttgggacaatggttgagttcgccgtggccctgggatccaagttggacgtcattaataagcacagcttcaataactttagactgagagtcggcctgaatcatggccccgtggtggccggcgtgattggcgctcagaagccgcagtatgatatttggggtaacaccgtgaacgtggccagccggatggaaagtactggggttctggggaagattcaggtgactgaggagacagcatgggccttgcagagcctaggatatacatgctattccagaggggtgataaaggtgaaaggtaagggccagctttgtacttatttcttgaatacagatcttactcgaacaggaccacctagcgccacgctggggtag

SEQ ID NO: 107490 - DNA, 348 bp, Artificial Sequence
  Description of Artificial Sequence: Synthetic coding sequence
atggctcggcttttcagtcctcgccccccccccagcgaagacctgttttatgagacctactatagcctgagccagcagtatcctctgctgctgctgcttctgggcatcgttctgtgcgccctcgctgcgctcctggccgtggcctgggccagtggcagagagctaactagcgaccctagtttcttgactacggtcctgtgtgccttgggcgggtttagcttgctcttggggctggcctcacgtgagcagcggctacagcgctggacacggccactgtcaggtctggtgtgggtggcgcttctagccctgggtcacgcattcctgttcactggtggagtcgtgagttag

SEQ ID NO: 107491 - DNA, 2736 bp, Artificial Sequence
  Description of Artificial Sequence: Synthetic coding sequence
atgaagtcccagaaggaaggctgttgttctcgcggcgacctgtccatccagaccggacctggaggcgagtgggcaccaaggcgcctggtgtccaatgtcctgattttctcttgcaccaacattgtgggagtgtgtactcattatccagcagaagtatcgcagcggcaagcctttcaagagacccgggaatgcatccaggcccggctccactctcaacgagagaatcaacaacaggagcgactgcttctgagtgttcttccgcggcatgtagccatggagatgaaggcagacataaatgccaaacaagaggacatgatgttccataagatctacatacagaaacatgataacgtctccatcctatttgcagacatagaaggatttacctccctggcatcgcagtgtaccgcccaggagttggttatgacgttgaacgagctctttgcccgcttcgacaaactcgcagccgagaatcactgtctgaggatcaaaatattgggcgattgttactattgtgtttctgggttaccagaagcccgggcagaccacgctcactgttgtgtagaaatgggtatggacatgatcgaggccatctcattagtgcgggaagtcactggggtgaacgtgaacatgcgggtggggatccattcaggaagagtgcactgcggcgttttgggcctgagaaagtggcagtttgacgtatggagcaatgacgtcactctcgcaaatcatatggaggctggtggcaaggctgggagaatacatattaccaaggccacactgaactacctcaacggagactatgaggtcgagcctggatgtggtggcgagagaaatgcctacttaaaggaacacagcatcgagacgtttctgattctccgttgcacacagaagagaaaggaagagaaggccatgatcgctaagatgaaccgccagcggacaaactccatcgggcacaatcccccacactggggtgcagaaagaccattttacaaccatctggggggaaatcaagtttctaaagagatgaagcgaatgggttttgaagacccaaaagataagaatgctcaggaaagcgcaaaccccgaggacgaggtggatgaatttctgggcagggccatcgacgcgcgctccattgaccggcttcgctccgagcatgtcaggaagttccttctgacgttccgcgagccggacctcgagaagaaatacagtaagcaggtggatgatcgattcggagcctacgtggcatgtgcgagtctcgtgttcttgtttatctgtttcgtccaaatcaccattgtgccccattctatcttcatgctaagtttctacctcacgtgttccttgctgctcaccctcgtcgtgttcgtgagcgtgatttactcttgtgtgaaactgtttcctagccccttgcagactctcagtcgcaagatcgtgcggtccaagatgaacagcaccctagtcggcgtgtttacaatcacactggtctttctggccgcctttgttaacatgttcacatgtaactctagagacctcctaggctgcctggctcaggaacataatatctctgcatctcaggtcaacgcatgtcacgtggctgagagcgctgtcaattactctctgggagacgaacaaggcttctgcgggagcccatggcccaattgcaatttcccagagtacttcacctattctgtattgctttctctactagcttgctcggtgttccttcagatctcatgtatcggcaagctggtcctcatgctagctatcgagctgatttacgtcctgatagtggaagtccctggagtgacattattcgacaacgccgacctgctggttaccgcaaatgccattgatttcttcaacaatggcacttctcagtgccctgagcatgcgactaaggtcgctctgaaggtggtcaccccaatcattatctctgtctttgtgttggcactgtacttgcatgcacagcaggtggaatctaccgcccggcttgacttcctctggaagctgcaagccactgaggaaaaggaggaaatggaggagcttcaggcttataacaggagactgctgcataatatcctgcctaaagacgtggcagctcacttcctcgctcgggagagaaggaatgacgagctctactatcaaagttgtgagtgcgtggccgtcatgtttgcgtctatagccaatttctcagagttctacgtggagctggaggcaaataatgaaggcgtagaatgcctgaggctgttgaatgaaatcattgctgacttcgatgaaattattagcgaagaccgatttaggcagttagagaagatcaagacaatcggttcaacatatatggccgctagcggcctaaatgattcaacatacgacaaggtcgggaaaactcacattaaagcactggccgattttgctatgaagctgatggaccagatgaagtacattaatgagcatagctttaacaacttccaaatgaaaattggtctcaacatcggtccggtggtcgccggtgtaataggggctcggaaaccccagtacgatatttggggaaacactgtcaacgtagcgtcacgtatggactccacaggagtacccgataggatccaggtcacgactgatatgtatcaggtgctcgctgcgaatacctaccagctggagtgtagaggagtagtaaaggtgaagggcaagggggagatgatgacctactttctaaatgggggaccaccgctatcgtag

SEQ ID NO: 107492 - DNA, 3786 bp, Artificial Sequence
  Description of Artificial Sequence: Synthetic coding sequence
atgagcgggtctaagtcggtgagccccccaggctacgctgcgcaaaagacagccgccccggctccacgcggaggtcccgagcatcggtcagcatggggcgaggccgattcgagagcgaacgggtatccccacgctcccggggggtcagccagggggagtactaaaaaacccggcggcgcagttactcctcagcagcagcaacgactggcctcccggtggaggagtgacgatgacgatgatcctccactctccggggacgaccctctcgcaggcgggtttggcttttccttccgtagcaagtctgcgtggcaggaaagaggaggagatgattgtggtcgtggtagtagacgtcaacgccggggcgctgcctccggaggatctacgcgcgcccccccagctggaggcggcggaggatccgccgcagcggccgcctccgctggtggtacggaagtgagaccccgttccgtagaggtcggactcgaagaacggagaggaaagggacgggctgcagatgagctggaagcaggggccgttgagggcggagagggatcaggcgacggcggctcaagcgctgatagcggaagcggcgccggccctggggcagtgctctccctgggagcctgttgtctggcactgctccaaatattccgtagtaagaaattcccctccgacaaactggagagactttatcagaggtacttcttcagactgaatcagtcttctctgaccatgttgatggctgtgctagtgctggtctgtctggtgatgttggccttccatgctgcaagacccccactacagctcccttatctcgctgttctggcagccgcggtgggcgtgatcctcatcatggctgtgctatgcaaccgggccgcattccatcaagaccacatgggcctggcctgctacgccttaatcgcagtggttttggccgtgcaggtcgtcggcctgctgctcccgcaaccccgatccgcttctgaaggaatctggtggacggtgttctttatctacaccatctacacattgctgccagtgaggatgagagctgcggtcttatctggcgtgttactgtcagctttgcaccttgcaatcgcccttagaactaatgcacaggaccagtttctcctgaaacagctggtcagcaacgtgctcatattcagttgcactaacattgttggagtctgcactcactatccagccgaggttagccagcgccaggcctttcaggaaacccgtgagtgcattcaggcgaggttgcactctcagcgtgaaaaccagcaacaggagcggcttctgctcagcgtgctgccaagacatgtagcaatggaaatgaaggctgatattaatgccaagcaggaggacatgatgtttcacaagatatacatccaaaaacatgacaatgtgagtatcctgttcgccgatattgagggattcaccagtttagcatctcagtgtaccgcccaggagctcgtcatgaccctgaacgagttattcgctagattcgacaaactggcggccgagaaccactgcctcagaataaagatactgggggactgctattactgtgtttcagggctcccggaggcacgtgccgatcacgcccactgttgcgtggagatggggatggacatgatagaggccatctccctggtcagggaggtcaccggagtcaatgttaatatgcgggtcgggatccacagcggtcgggtccactgcggagtgttgggcctacgtaaatggcaattcgatgtgtggagcaacgatgtcaccctcgctaatcatatggaggctggagggaaagcggggcgcatacatatcaccaaagcaaccctcaattatctaaatggagattacgaggtggagcctgggtgcggaggagaacgaaacgcctatttaaaagaacactccatcgaaacattcctgattctccgttgtacccagaagagaaaggaggaaaaagccatgattgctaagatgaaccggcagcgtacaaattccatcggtcataaccctcctcactggggagccgaaaggcctttctataaccatctcgggggcaaccaggtcagcaaagaaatgaagcgcatgggttttgaagatccaaaggacaaaaacgcacaggaaagtgccaatcccgaggacgaagtggacgagtttctggggagggccattgacgctcggtccatcgacaggctgagaagtgagcatgtaagaaagttcctgctgacgttccgagaacctgatcttgagaagaaatatagcaagcaggtggatgatcgattcggcgcatacgtagcttgcgcgtctctggtgttccttttcatttgctttgtccagatcacgatcgtgccacacagcatcttcatgcttagcttctacctcacttgctccctccttttgacactggtggtgtttgtctcagtcatatactcatgcgtgaaactcttcccaagtcccctccaaacactcagcaggaaaatcgtgagatcaaaaatgaattctaccctggtgggggtgttcaccataacccttgtgttcttggctgcctttgtcaacatgttcacttgtaatagccgggacctgttagggtgcttagcgcaggaacacaatattagcgcttctcaggtcaatgcatgtcacgtggcagaatctgccgtaaattatagcttaggagacgagcaaggcttctgcggctctccttggcccaactgcaacttccccgaatactttacttacagcgtcctgttgtccttgctggcatgctctgtgttcctacaaatctcgtgcattggtaagctggtactgatgcttgccattgaacttatctacgtcttaatagtcgaggtgccaggcgtcacgttgttcgataatgctgatctactcgtgacagctaatgcaattgacttcttcaacaacgggacaagccagtgccccgaacatgccaccaaggtcgctttaaaggttgtgactcccattattatttcagtgttcgtgttagcgttatacctgcacgcccagcaagttgagagcacagcgaggttggattttttgtggaagctgcaggccacagaggagaaggaagaaatggaggagctgcaggcgtataacagaaggttgctccacaacatcctgcctaaagacgttgcggcccacttccttgcccgtgagcggagaaacgacgaactttactaccagtcttgtgagtgtgtagccgtgatgtttgcatctatagccaacttctccgaattttatgtggagttggaggctaacaatgaaggggtggaatgtctccggctgctgaatgagataatagctgacttcgatgagattattagcgaagaccgcttcaggcaattggagaaaataaaaaccataggatcaacctatatggcggcatctggtctcaatgacagcacttacgacaaagtggggaaaacccacataaaggccctggccgactttgccatgaagttaatggaccagatgaaatacattaacgagcacagctttaataatttccagatgaagataggcctgaatatcggtcccgtcgtcgcaggcgtgatcggcgcacggaagccgcagtacgatatctggggcaacaccgtgaatgttgcgtcaaggatggatagcacaggcgttccagaccggatccaagtcacgaccgacatgtatcaagtgcttgcagctaacacataccagctggaatgtaggggagtcgtcaaagtgaaaggcaagggcgagatgatgacatacttccttaatggtgggcctccccttagttag

SEQ ID NO: 107493 - DNA, 2760 bp, Artificial Sequence
  Description of Artificial Sequence: Synthetic coding sequence
atggcaccgtctaggttccgcactcaactggagttagtgtccaacgtgctgatattttcctgcacgaatattgtcggggtgtgtacacactatccagcagaagtgagtcagcgccaagccttccaggaaacgagagagtgcatccaggctagactacattctcagcgagagaaccagcaacaggagcggcttcttctttctgtgctgccgaggcatgtcgccatggaaatgaaggccgacatcaatgccaaacaagaagacatgatgtttcataagatttacatccagaagcatgacaacgtctcaatcctcttcgccgacatcgaggggttcacatccctcgcctcccagtgcaccgctcaagagctcgtgatgactctgaacgaattgtttgctagattcgacaagctcgccgccgagaaccactgtcttcgcatcaaaattttaggggattgttactattgtgtgtcagggctcccggaagctcgagccgaccacgcacactgttgtgtggagatgggcatggatatgattgaggccatttcactcgtgagagaggtgacgggagttaatgtgaacatgagagtgggcatccacagcgggcgggtgcattgtggagtgcttgggctgcggaaatggcagtttgatgtatggtcaaacgatgttactttggccaaccatatggaagcaggaggcaaagcagggcggattcatatcacgaaggcaacactcaattatctgaatggcgattatgaagtggaacccggatgtggcggggaacgcaatgcatatctgaaggagcattctatcgagacctttctcatccttagatgcactcagaagcgtaaagaagaaaaggccatgatcgccaagatgaatcgacagcgaaccaattccattggacataacccaccccactggggggcggagcgccccttctacaaccacctgggcggaaatcaggtgagcaaggaaatgaaacggatggggttcgaggatccaaaagataagaacgcgcaggaatcagcaaatccggaagacgaagtggatgagttcctcggacgggctattgacgccagaagcatcgaccgactccggtcggagcatgtacggaagttcctgctgacgtttagggagcctgatcttgagaagaaatattccaaacaagtcgatgatcgcttcggagcctacgttgcttgcgcgtcactggttttcctgtttatctgtttcgttcaaatcactatcgtgccccatagcatatttatgctaagtttttacctgacctgcagccttcttttgacacttgtagtgttcgtcagcgtgatttactcgtgcgttaaattattccccagtccgttgcaaacactcagccgcaagatcgtgaggtcaaaaatgaactctacattggtaggtgtgttcacaatcacccttgtctttctcgccgccttcgtgaacatgtttacgtgcaacagtagagatctgctaggctgcttggcccaggaacacaacatcagtgcaagccaagtaaacgcctgccacgtagctgaatccgccgtcaattactccttgggtgacgaacagggcttctgtggcagcccctggcccaactgcaattttccggagtattttacctacagcgtgctcctgagcctgctggcttgttccgtgtttctccagatttcatgcattgggaaattggtgctgatgttggcaatagaattaatctatgtgctcattgtcgaggttccaggtgtgaccttgttcgataatgcagatcttctggtaaccgccaacgccatagattttttcaataacggcacctcacaatggtccctatgcgaaaacctgaggcaccgacgtatggaagccggcacctattttccatcaggagtgaaggagcagtccccagagcatgccacgaaggtggctctgaaggttgtcacacccatcattatatccgttttcgtgttagctctttatctgcacgctcagcaagttgagtccacggctcggctagactttttgtggaaattgcaggccacagaggaaaaggaagaaatggaggagttgcaggcctataaccggaggcttctgcacaacattctccccaaggacgtagccgcccattttctggcacgggagcggcgcaatgacgagctctactaccagagctgtgaatgcgtggccgtcatgtttgcctccatcgctaacttctcggagttttacgtggagctcgaggctaataatgaaggagtggaatgtctccggctcttaaatgaaatcatcgcagatttcgacgaaattatcagcgaggatcgcttcaggcagttggagaagatcaagacgatcgggtccacttatatggccgcttcaggtctcaacgattcaacctacgacaaagtggggaagacccatataaaggcgctggccgacttcgccatgaaactgatggaccaaatgaaatatattaatgaacactcattcaataactttcagatgaagattggactcaacattggccccgtcgtggcaggtgttatcggggcccgcaagcctcaatacgatatctgggggaacacggtgaacgtagcctcaagaatggactctacaggggttcccgaccggattcaggtgacaacagatatgtatcaggtgttagccgctaacacctaccagttggagtgccgtggtgtcgtcaaagtgaagggtaaaggcgagatgatgacatactttctgaatggcgggccacctctgtcgtag

SEQ ID NO: 107494 - DNA, 3507 bp, Artificial Sequence
  Description of Artificial Sequence: Synthetic coding sequence
atgtcgtggttttccggcctcctggttcctaaggtcgatgagcgtaagacagcttggggagaacgcaatggccagaagcggtccagacggaggggaacacgcgctggcggcttctgcactccaagatacatgagctgcctaagagacgcagagccaccttccccgacaccagccggccctccaaggtgcccatggcaggatgacgccttcattcggagaggtggcccaggcaaaggcaaggagctgggcctgagagcagttgcccttggctttgaggacaccgaagtgacgacaacagccggcggaaccgctgaagtggcccctgacgccgtcccaagatcaggtagatcttgttggcggagactggtgcaagtatttcaatcgaaacagttccggtcagccaagctggagcgtctctaccagcggtatttctttcagatgaatcaaagctccctcaccctgttaatggcagtcctggtgctgctgaccgccgtccttctggcttttcacgctgcacccgcacgcccacagccagcttacgtcgcactgctcgcctgtgccgctgctctgtttgtaggacttatggtagtgtgcaatagacactcgtttcggcaggactccatgtgggttgtaagctacgtggtactgggcatcctcgccgccgtgcaggtgggtggcgccctggccgccgatccccgctcccccagcgcgggcctgtggtgtccagtcttctttgtatatatcgcctatactctgctacctatcaggatgagagcagccgtgctcagcggcctgggcctcagcacccttcatctcatacttgcctggcagcttaatcgaggggacgccttcctgtggaaacagctcggcgctaacgtcctgctgtttctgtgcaccaacgtgattgggatctgtactcattacccagccgaggtgtcccagcgccaggcatttcaagagacgagggggtatatccaggctcgactgcacctccagcatgagaatcgtcagcaagagaggctgcttttgagtgtactgccccagcatgtggcgatggagatgaaggaggatatcaacacaaaaaaagaggatatgatgtttcataaaatctatattcaaaaacacgacaatgtgtcaatcttattcgccgacattgagggcttcaccagcttggccagccagtgcaccgctcaagaacttgtaatgacgctgaacgagctgttcgctcggtttgataagctggccgcggagaaccattgtttgcgcattaagatacttggggattgctattactgcgttagtggattaccagaggcgcgggcagatcatgcccactgctgcgtagagatgggagtggatatgattgaggctatctccctcgtgcgcgaagtcactggggtaaacgtgaacatgagagtgggtatccactcagggcgagtccactgtggagttctcgggctccgcaagtggcagttcgacgtttggtccaacgacgtaactcttgccaaccatatggaggcaggcggacgggccggtagaatccatataacgagggctactttgcagtatctgaatggagactacgaagttgagccgggtcgcggaggcgaacgtaacgcctacctgaaagagcaacacatcgagaccttcctgatcttaggcgcctctcagaagcggaaagaggagaaggctatgctggctaagttacagcgaaccagagccaacagtatggagggcctcatgccacgttgggtgcctgatagggcattctcccgaaccaaagactctaaggcatttcggcagatggggatagacgacagcagcaaggacaatcgcggcacacaggacgcactgaatccagaggatgaagtggatgagttcctgtcaagagctatcgatgcacggtccatcgatcaactgaggaaggaccatgtgcggcggttcttgctaacatttcagcgagaggatctggagaaaaagtacagtcggaaggtcgaccctcgcttcggagcatacgtggcatgtgcattgctggtcttctgttttatctgtttcatccagctcttgatatttccacactcaactctgatgcttgggatctacgcctcgatatttctgctgttactgatcactgtgctcatatgtgccgtgtacagctgcggctctctcttcccaaaagccctacaacgactctcccgttctatagtgaggagccgggcacatagcaccgcagtggggatattcagtgtgctgctcgtttttactagcgcgattgcaaatatgtttacttgtaaccacacaccaattaggtcatgcgctgccaggatgcttaacctcacccccgccgacatcaccgcctgccatttgcagcagctgaattactccttgggtctggacgcacccctgtgtgaaggaactatgcccacctgcagcttccctgagtacttcattggcaacatgctattaagcctacttgcatcaagtgtgttccttcatatcagcagcatcggtaagctcgcgatgatatttgtgctaggcctaatctatctggttctgctcctcctcggcccacccgcaaccatctttgacaattatgacctgctcctaggcgtgcacggcctggcatcctctaacgaaacatttgacggcctcgattgcccggccgccggaagggtcgccctgaaatacatgaccccagttattctgctcgtgtttgctttggctctctatctgcacgctcaacaggtggaaagcacggctaggcttgacttcttatggaaactgcaggctacaggagaaaaggaagagatggaagaattacaggcttataatcgcaggctgctccacaacatcctccctaaagacgtggcagcgcattttctggcgagggagagacgcaatgacgagttgtattatcagtcgtgcgaatgcgttgctgtcatgtttgcctccatcgccaatttttcagaattttatgtggaactggaggctaacaatgaaggagtggagtgtttgcggcttctcaatgagataattgcagattttgacgagattatctcagaggagcggttcaggcagcttgaaaaaatcaagactatcggcagcacatacatggccgcttccggcttgaacgcctctacctacgaccaggtgggtagaagccatattacagccctagcagactacgccatgagacttatggagcaaatgaagcatatcaacgaacactcttttaacaatttccaaatgaagatagggctgaacatgggccctgtggtagctggagttataggggcacgtaaacctcaatatgatatctggggaaacactgttaacgtatcgagtaggatggacagcactggtgttcccgatagaattcaggttacaacggatctttaccaggttctagctgccaaagggtaccaactagaatgtcggggcgtggtgaaagtgaaagggaaaggcgaaatgactacctatttcttaaacggaggcccctcctcatag

SEQ ID NO: 107495 - DNA, 3348 bp, Artificial Sequence
  Description of Artificial Sequence: Synthetic coding sequence
atgagctggttctcaggactattggtccccaaggtcgacgaacgaaaaaccgcgtggggcgagcggaatggacagaagcgaagtagaaggagaggaactcgagctgggggattctgcaccccccggtatatgtcctgcctaagagatgctgagccaccgtctccgacaccagcaggtcctcctagatgcccctggcaagacgacgccttcatacggcgtgggggaccgggcaaaggcaaggagttgggactccgggctgtggcgctgggtttcgaagatacagaggttaccacaacagccgggggcacggccgaggtggcccccgatgcagtccctagatctggccgctcctgttggcgtagactggtgcaggtcttccagtccaaacagttccggagcgctaaactggagcgcttatatcaaagatatttcttccagatgaatcaaagctctctgactttactgatggccgtgctcgtcctactgacagccgttctgctggccttccacgctgctccagcaagaccccaacccgcgtatgtggcccttttggcttgtgctgccgccttgttcgtgggtttaatggtggtatgtaataggcatagtttcagacaggactcgatgtgggtagtttcatatgtggtccttggcattctagccgccgtccaggtcgggggcgccctggccgccgaccctcggtccccttcagccggcctgtggtgtccggtgtttttcgtctacatagcctacacgttacttccaatccgcatgagagcagccgtcctgagtggcctgggccttagcactttgcatctgattctcgcctggcagcttaatagaggagacgcatttctctggaaacagctgggtgctaatgtgctgctgtttctgtgtacaaatgttatcggtatttgcacacactaccctgctgaagttagccagcggcaggcctttcaggagacacgcggatacattcaggcacgactacatctgcaacacgaaaataggcagcaagaacgcttattgttgagtgtcctacctcagcatgtcgctatggaaatgaaagaggatataaatacaaaaaaagaggatatgatgtttcacaaaatctacattcagaaacatgataatgtctcaattctattcgcagacatcgagggtttcacctccttagcaagccagtgcacggctcaggagttggtaatgactttgaacgaactctttgctcggttcgacaaactcgctgccgaaaaccattgccttaggatcaagattctaggcgactgttactattgcgtgtctgggctccccgaagcacgcgccgatcacgctcactgttgcgtggagatgggagtcgatatgattgaagccattagcctggtgagagaagtgaccggggtcaatgtcaatatgcgggtgggtattcactcgggtagggttcattgcggagttttggggctccggaagtggcagttcgatgtctggagtaacgacgttacactggcaaaccacatggaggctgggggcagggcaggcaggattcacattacgcgggcaactctccagtacctcaatggagactacgaagtagaaccaggtcgggggggtgagcgcaacgcctatctgaaggaacagcatatcgagacgttcttgatcctcggcgcttctcagaaaagaaaggaggagaaggccatgctagcaaaactacagcggacccgcgccaatagcatggaggggcttatgccgagatgggtgcctgatcgcgccttctccaggacaaaagactcaaaggccttcagacagatgggcatcgatgattcctccaaagacaatcgcggaacacaagacgcccttaacccagaggacgaggtcgacgaattcttatcaagagccattgatgccagatccatagaccaattacgaaaggatcatgtccggcggttcctgctcactttccagcgagaggatcttgagaagaaatattctaggaaggtggatccacgtttcggggcgtacgtcgcctgcgctttgctggtattctgcttcatctgcttcattcaactgctcatctttccccattcaactctgatgttagggatctatgcatcaatttttcttctgttactgattacggtactaatttgcgcggtgtatagttgcgggtccctgttcccaaaagccttgcaacggctgagccggtctatagttcgctccagggcacacagcactgcagtgggcattttttccgtactgctcgtgttcacttcagccatagcaaacatgtatttcattggcaacatgcttcttagcctcctggcctccagtgtgttccttcacattagcagcatcggcaagctcgccatgattttcgtcttaggcttgatctatttggttctactccttctcgggccgcccgcaactatctttgataactacgatctcctattaggagtccacgggcttgcctcctctaacgagacattcgacggacttgattgtccggctgccggacgtgtggccttgaagtacatgaccccagtgatactgctcgtgtttgcactggctctgtacctgcacgcccagcaggtcgaaagcactgctagacttgactttctgtggaagctgcaagcaaccggtgaaaaagaggagatggaagaactccaagcctataaccgccggcttctccacaacattttgcctaaggacgtggccgcacactttctcgctagagagaggcgcaacgacgaattatattatcagtcgtgcgaatgtgtagctgtcatgtttgcttcaatcgcaaatttttccgagttttatgtggagctggaggccaataatgagggcgtcgagtgtctgcggttgctgaacgaaatcatcgccgactttgatgagatcatctccgaggaacggtttagacagttggaaaaaataaagacgattggatctacatatatggcagccagcgggctcaatgcctctacatacgaccaggtgggccggagtcatattacggccctcgcagactatgcaatgaggttgatggagcagatgaaacatattaacgagcactccttcaataatttccaaatgaagattggattaaacatggggcctgtcgtcgccggtgtaataggtgcaaggaaaccccagtacgatatttgggggaacactgttaacgtgtctagccgcatggacagtacaggcgtgcctgacagaattcaggtgacaaccgatttgtatcaggtccttgccgccaagggttatcagctggaatgccggggagtagtgaaagtcaagggcaagggggagatgaccacgtacttcttgaacggcgggccttcatcctag

SEQ ID NO: 107496 - DNA, 3348 bp, Artificial Sequence
  Description of Artificial Sequence: Synthetic coding sequence
atgagttggttttccggactcttggtgcctaaggtggacgaaaggaaaacagcctggggggaacgaaatggacaaaagcgttcaagaaggcgcggcacacgtgcaggcggattttgtacgcctagatacatgagctgtctgagggatgccgagccgccttcccctacgccggccgggccgccaagatgcccttggcaggacgacgccttcattcggcgagggggtcccgggaagggcaaggaattaggcttacgagcggttgccctcggctttgaagatactgaagtgaccactactgccggtggcactgccgaagtcgcccctgatgcagttccaaggtcaggcagaagctgctggcgaaggctggtgcaggtcttccagagcaagcagtttagaagcgccaaattagagcgtttatatcaacgatacttcttccagatgaaccaatccagtctgacgttattgatggccgtgctcgtgctgcttactgcagtcctgctcgcttttcacgcagcgcctgccagacctcaaccggcgtacgtggccctgctggcctgtgccgccgctctgtttgtgggattaatggtggtttgcaatcggcatagcttcaggcaggattccatgtgggtcgtgtcctacgttgtcctgggcatcttggcagccgtgcaagtgggtggcgccctagccgccgacccccggagtccctcagctgggctgtggtgccccgtgttcttcgtgtatattgcttacacccttctgccaatcaggatgagagccgcggtactgagtggtctgggattgtcaacactccaccttatcctggcatggcaactcaacagaggagacgcctttttgtggaaacaattgggtgctaatgtactgcttttcttgtgtactaacgttattgggatatgtacgcattaccccgccgaggtctctcagaggcaggcctttcaggaaacgcggggctacattcaggctcggctccaccttcagcacgagaacagacagcaggagcgtttgctgctttctgttctgccacagcacgtcgccatggaaatgaaggaagatatcaacaccaagaaggaggatatgatgtttcacaagatctacatccagaaacatgacaatgtgagcattttattcgctgacattgaaggcttcacatcccttgcctcccagtgcaccgctcaagagctggttatgacattgaatgagctattcgcccgtttcgacaagctggctgccgaaaatcactgcctgcgaataaaaatcctcggagactgctactattgcgtgtcgggccttcccgaggccagagccgaccacgcacactgctgtgtggagatgggcgttgatatgattgaggctatctcacttgtgcgggaagtgaccggcgttaatgtgaacatgcgggtggggatccactctggcagagtccattgcggcgtgctggggcttaggaaatggcagttcgacgtctggtccaatgatgtaacattggctaaccacatggaggcaggcgggagggccggaagaattcacatcactcgggccacactccagtatctgaatggcgattatgaagtagagccaggacggggcggggagcggaatgcatatcttaaggaacagcacattgagacgttcctgatcctgggtgcatcccagaagaggaaggaagaaaaggccatgctggctaagctccaacggaccagagccaactccatggaaggcctgatgccccgctgggtgcccgatcgcgcttttagcagaacaaaagactctaaggcattccgccaaatgggcattgatgactcctctaaggacaatcgggggactcaggatgccctcaacccagaggacgaggtagatgagtttctcagcagggctatcgacgcacgctcaatagaccaattgcgcaaagaccatgtccggagatttctccttacattccagagggaagacctcgagaagaagtactctcggaaggtggatcctcgttttggggcctatgtggcatgcgcactccttgtgttttgctttatctgcttcatacagctgctcattttcccgcactcaacactcatgctgggaatctacgccagcattttcctgctgctgttgatcactgtgctgatttgcgccgtatatagctgcgggtctctgttccctaaggctctgcagagactaagtcgctctatcgtgcggagcagggcccactccacagccgttggaatcttttctgtcctcctagtctttacctccgcaatcgccaacatgtatttcattggtaatatgcttctaagcttgctcgcgtcttctgtctttttacacatatcttcaatcggcaagttagctatgatcttcgttctgggcctgatctatctggtcctgttactcctcggaccacctgcaacaatatttgacaactatgatctgctgctcggtgttcacggactggcatccagtaatgagacctttgatggcctagattgcccggccgcggggagggtggcactgaagtacatgaccccggtcatcctgctggtctttgcactggcactatacctgcacgcccagcaggtcgagagcacggctcgactggacttcctctggaaattacaagccactggcgaaaaagaggagatggaggagctccaggcttacaatagacggctcctccataatattctcccaaaagatgtcgccgcccactttctggcgagagagcggcggaacgatgaactgtattaccaatcttgcgagtgtgttgctgtgatgtttgctagtatagctaacttttccgagttttatgtggagctggaagctaacaacgagggcgtggaatgcctgcgcctgctgaatgaaattatcgcagatttcgacgagatcatcagcgaagagagattcagacagttggaaaaaatcaaaactatcggctcgacctacatggctgccagcggccttaatgctagcacgtacgaccaggtggggcggtcacatattacagccttagccgattacgcgatgcgcttaatggagcagatgaagcacattaatgagcactcttttaacaacttccaaatgaagataggactgaatatggggcctgtagtcgcaggcgtgatcggcgccaggaaaccccagtacgacatttggggtaacactgtaaacgttagtagtaggatggatagtaccggcgtgcccgatcggatccaggttacaaccgatctgtaccaggtcctggccgccaaagggtatcagttggagtgccgtggtgtggtgaaagttaagggcaaaggagagatgaccacttattttctgaacggaggaccttcaagttag

SEQ ID NO: 107497 - DNA, 3243 bp, Artificial Sequence
  Description of Artificial Sequence: Synthetic coding sequence
atgcctgctaaaggcaggtacttcctgaatgagggcgaggagggcccagatcaagacgcactgtacgagaagtaccagctgactagccagcacggacccctcctcctgactctgttgttggtggccgcaaccgcctgcgtggctctgatcattatcgcattctcacagggagatccttccaggcaccaagccatattaggcatggccttcctcgtgctagcagtctttgcggccttgagtgtgctgatgtacgttgagtgcttgctcaggcgctggctgcgagccttagctttgctcacctgggcttgtcttgttgcgctgggctatgtgcttgtgtttgatgcgtggacaaaagctgcttgcgcttgggaacaggtacctttcttcctttttatcgtgttcgtcgtttatacactgctgccgtttagtatgcgaggagcagttgccgtgggggccgtgagcactgcatctcatctcctcgtcctgggcagcttgatgggcggatttaccacaccatccgtaagggtcggcttgcaattactggcaaacgccgtcatcttcctgtgtgggaatctaacgggcgcgttccacaagcatcagatgcaggatgctagcagggatctcttcacatatactgtcaagtgtatccaaattcgtcgcaagctgcggattgagaagcgtcagcaggaaaacctgctgctatcagtgctgcccgcccacatcagtatggggatgaagttggcaattattgagagactgaaggaacacggcgataggcgctgcatgccggacaacaactttcatagcctgtatgtgaagaggcatcagaacgtgtctatcctatacgccgatattgtgggattcacacaactggccagcgactgttcccctaaagagctggtcgtagtgctaaatgaattattcggcaagttcgaccaaatcgccaaagctaatgaatgtatgcgaatcaaaatccttggcgactgttattactgtgtgagtggcttgcccgtcagcctgcccacacacgcccggaattgtgtgaaaatggggctcgatatgtgtcaggctattaaacaggttcgagaggccaccggagtggatatcaacatgcgcgttgggattcactcgggaaacgtactttgtggggtgatcggcctgcgtaaatggcagtatgacgtgtggtctcacgatgtctccctggctaacagaatggaggcagccggggtaccagggcgggtccacatcaccgaagccaccctgaaacacctggataaagcatatgaggtggaagacggccacggacagcaaagggacccctacctgaaggagatgaacatcaggacttatcttgtgatagatccaagatcccagcagccacctccgccctctcagcacctccctcggccaaagggcgacgcagcattaaagatgagggcatcagttaggatgacgcgttatctggagtcctggggcgctgccaggccattcgcccatctgaatcacagggaatccgtgtccagtggggagacccatgtccctaatggccggaggcctaaaagcgtacctcagcgacacagaagaacacccgaccgctctatgagtcccaagggacggtccgaggatgacagctatgacgacgaaatgctgtccgccatcgaagggctgtcaagcacccgcccgtgctgttctaagagtgacgacttctacacattcggttccatattcctggagaaagggttcgagagagagtataggctggctccaattcctagagccagacacgattttgcttgcgcatcactgatcttcgtgtgcattttgctcgtgcacgtgctgctgatgccacgcaccgcggcgctgggcgtgtctttcggactagtggcatgcgttctcggattagttctcgggctttgcttcgctacaaaattctctaggtgctgtccagcgcgcgggacgctgtgtactatctctgagcgggttgaaactcaaccactccttcgtcttaccctggctgtgttgaccataggctcactgcttaccgttgcaattattaatctccctctcatgccctttcaggtcccagagctgccggtgggcaacgagaccggattgttagctgcaagcagcaagacgagggcactgtgcgaacccctgccctattatacctgctcttgtgtcttaggctttattgcatgtagtgtgttcctgagaatgtctctcgagccaaaggttgtcctgttgacagtggcgctagttgcctacttggtactgtttaacttgtcaccctgctggcaatgggattgctgcgggcaaggactcggcaatctgaccaagcctaatgggaccacttccggcactccatcttgcagctggaaagacctcaagacaatgaccaatttttacctagtgttgttttatatcaccctgctgaccttgagtcgtcaaatagattactactgtagacttgattgcctctggaagaaaaagttcaaaaaggagcacgaagaatttgaaacgatggaaaacgtgaaccgattgctcctcgagaatgttctgccggcgcacgtcgctgcacacttcatcggtgacaagctgaacgaggactggtaccatcaatcctacgattgcgtttgcgtgatgtttgccagtgtaccggatttcaaggtcttctataccgagtgtgacgtaaataaggaggggctggaatgcctccgactgttgaatgagatcattgcagacttcgacgagctcttactgaagcccaagttttccggggtagaaaaaatcaaaaccatagggtcaacttatatggcagccgccgggctgagcgtggcaagtggtcacgagaaccaggagctggagcggcaacatgcccacatcggagtgatggttgaatttagcatagccctgatgagtaagctggacggaatcaatcggcattcattcaactccttcaggcttagagtcggcatcaaccatggtccggtgattgccggtgtcataggggctcgcaaaccccaatacgatatctggggtaacactgtgaacgtggcttccagaatggagtccacaggggaactgggcaagatccaggtcactgaagaaacatgcactattctccagggcctgggctactcctgtgagtgccgagggttaatcaacgtaaagggaaaaggcgagttgcggacatatttcgtctgcaccgacactgccaaatttcagggcttggggctgaattag

SEQ ID NO: 107498 - DNA, 3243 bp, Artificial Sequence
  Description of Artificial Sequence: Synthetic coding sequence
atgcctgcaaagggccgttattttcttaacgaaggcgaggaaggcccggaccaggacgccctgtacgaaaagtatcagctcacatctcaacatggtccattactgctcacacttctgcttgtggcagccactgcgtgtgtagccctcatcattattgctttctcgcagggcgacccttccaggcaccaggcaatcctcggcatggccttcctcgttctggccgtttttgccgccctctctgtcttgatgtatgtggagtgtctcctgagaaggtggctcagggccttggccctgctcacttgggcttgcctggtggccttaggttatgtgctggtcttcgacgcctggaccaaagcagcgtgtgcctgggaacaggtgcccttcttcctgttcatcgtctttgtagtttatactcttctccccttttccatgcggggagccgtggctgtgggagcagtgtcgacggccagccacctgttagtcctgggctcacttatgggaggattcacaacacctagtgtgagggtaggccttcagctgctggcgaacgcagtcatctttctgtgtggtaacttaaccggagccttccacaagcaccagatgcaggatgcatctcgagacctattcacttacacagtgaagtgcattcagatccggcgaaaacttcgcatcgagaagagacagcaggagaatctcttactctcagttttacccgcccatatcagtatggggatgaagttggcaataattgagcggcttaaggaacacggcgacagacgatgtatgcctgacaataattttcacagcctttatgtcaagagacaccagaacgtgagcattctctacgccgatattgtgggatttacgcagctggcgtccgattgtagccccaaggagctggtggttgttctgaatgagctgttcggaaagttcgaccagatcgcgaaggctaacgagtgcatgcgcattaaaatactgggggactgctactattgtgtaagcggattgcctgtgtcactgcccacccacgccagaaactgcgtcaagatgggcttagacatgtgtcaagccatcaagcaggtgagggaggccacgggggtcgatattaacatgagagtgggcatccatagtgggaacgtcctttgtggcgtcatcggcctgcgaaagtggcaatacgatgtctggtcccacgatgtgtcactcgctaacaggatggaagcggccggtgtaccaggccgagtgcacattaccgaagcaaccctcaagcacctggacaaagcttacgaggttgaagatggacacggacagcagcgcgatccatacctgaaggaaatgaacattcgcacatacctggtgatcgatccaagatcacaacagccgcccccccccagccagcacctgcccaggcctaaaggcgacgcagctttgaagatgcgcgcgagtgtgagaatgactagatatctggaaagctggggagctgcccgcccgtttgcccacctcaatcatagagagagtgtctcctcgggcgagacccacgttcctaatggccggcgccccaagagcgtgcctcagaggcatcgccggacccccgaccgtagtatgtcccctaagggccggtctgaggacgattcctacgatgacgagatgctaagcgccattgaaggactgtcgtcgacaaggccttgttgctctaaaagtgacgatttctacacttttgggagcattttcctcgagaaagggtttgaaagggaatatagactggctccaatcccaagagcacgtcacgacttcgcttgtgcatcactgatattcgtgtgtattctgcttgttcatgtacttctgatgcctcgtaccgctgcgctaggagtgtctttcggcctggtggcttgtgtcctgggtctcgttctgggcttgtgcttcgcaactaagttttcacgatgttgtcccgctagggggacactctgtactatatctgagcgggtcgagactcagcctctcctacggctgacactcgccgtgctgaccattgggtctttgcttacagtcgccatcatcaatctaccgctcatgccatttcaggttcctgagctaccagtggggaacgaaaccgggcttttggctgcatctagcaagacaagagctctctgcgagcccctgccttactatacttgctcttgcgtcctggggttcattgcttgctcagttttcctgagaatgagcttagaacccaaggtcgtattgctaaccgtggctttggtggcttatctcgtgctctttaacctgagtccttgctggcagtgggactgctgcggacaggggcttgggaatctcaccaagccaaacggtacaacctccggcaccccttcctgctcttggaaggacctcaaaaccatgaccaacttttatctcgtgctcttttacatcacactgctgacacttagtagacagattgattattactgcagattggactgtctgtggaagaagaaatttaagaaggaacacgaagagttcgagacaatggagaatgttaatagactattactagagaatgtgctgccagcccacgtcgccgcacacttcattggtgacaaacttaacgaagactggtaccaccagtcttatgattgcgtgtgtgtgatgttcgctagcgtccctgatttcaaagtcttctacacagagtgcgacgtgaacaaagaaggtttagagtgtttgcgtctgctgaatgaaatcatcgccgacttcgacgaactcttgctgaagcctaaattttctggagtcgagaaaatcaagacaatcggtagcacttatatggctgcagccggcctctctgtggcttccggtcatgaaaaccaagagctagagaggcagcacgcccacattggggtgatggtggagttctccattgctcttatgagcaagctggatgggattaaccggcatagcttcaatagttttcggctcagggtcggaattaaccatggtcccgtcatcgcaggcgttatcggggctagaaagcctcagtatgacatctggggtaatacagttaacgttgcgtcccgaatggaaagcactggcgaactcggaaaaatccaggtgacggaggagacatgtacaattctccagggattgggatactcatgtgaatgtcgggggctgattaacgtaaagggcaagggagaactcaggacgtatttcgtttgtacagacacagcgaagtttcagggcctgggcttgaactag

SEQ ID NO: 107499 - DNA, 1302 bp, Artificial Sequence
  Description of Artificial Sequence: Synthetic coding sequence
atgccagctaagggacgttatttccttaacgagggcgaggagggacctgatcaggatgcactatacgagaagtatcagcttacgtctcagcacgggcccctcttgctgactcttcttctggtggcagccaccgcgtgtgtggcactgataattatcgccttcagtcaaggtgacccgtcacggcaccaggctatcctcgggatggctttcttagttctggccgtgttcgcggccctctctgtgctcatgtatgtcgaatgcctgctcagacggtggctccgagcattagctctcttaacctgggcctgtttggttgctctggggtacgttttggtgtttgacgcctggactaaagcagcctgcgcctgggagcaggtgccattcttcttgttcatagtgttcgtcgtctacactctcttgccttttagcatgaggggagcggtagcagtcggggctgtcagcaccgcatctcacctgttggtgcttggctctctcatggggggctttacaaccccaagcgttcgcgtgggcctgcaacttttagccaatgcagttatcttcctgtgcggaaatttgacgggagcatttcataagcaccagatgcaggatgcatctagggacctatttacatacaccgttaagtgcattcaaattcggaggaagctgcgtatcgagaagcgacaacaggaaaacctgcttctcagcgtcctgccagcccacatatctatgggaatgaagcttgctataattgaacgactgaaggaacacggggaccgccggtgcatgcccgataataacttccactcactttatgtcaaacggcaccaaaacgttagcatcctctatgctgacattgttgggttcacccaacttgcctctgactgctcccctaaagagttggttgtggtgcttaacgagctcttcgggaagtttgaccagattgcaaaggccaacgagtgtatgcgaatcaagatactgggagactgctattattgcgtgagtgggctgcctgtttctttgccaacccacgctcgaaactgtgtaaagatgggcctggatatgtgccaggctataaaacaggtgagagaagccaccggggttgatattaacatgcgcgtgggtatacattctggcaatgtcctttgcggcgtgatcggactccggaaatggcagtatgacgtctggtcccatgacgtgtcacttgccaaccgcatggaagccgccggagtgcccggaagggttcatatcactgaggctactctaaaacatctagacaaggcactgctcctccaggtaaggtag

SEQ ID NO: 107500 - DNA, 2205 bp, Artificial Sequence
  Description of Artificial Sequence: Synthetic coding sequence
atgccggcgaagggcagatattttctgaatgaaggcgaggaggggcctgaccaagacgccctatacgaaaagtaccagctgacctcacagcacgggccactcctcctcacgctcttacttgtggccgcaaccgcttgtgtcgccttaatcataatagcctttagtcagggggacccatcccggcaccaggccatccttggaatggcgttcctggtgctcgcagtctttgccgcgctgagcgttctgatgtacgtcgagtgtttattaagaagatggcttcgggcgctcgctctactgacctgggcctgcttggttgcactggggtatgtcctcgttttcgacgcatggactaaagccgcctgtgcctgggaacaggtcccgtttttcctttttatcgttttcgtcgtgtacaccctgctgcccttcagcatgaggggcgccgtggccgtgggagccgtctcgaccgcctcacacctgcttgtccttggcagcctcatgggtggcttcactacccccagcgtcagagtaggtttacagctgctagcaaacgctgtgatatttctctgtggcaacctcacaggtgcgttccacaagcatcaaatgcaggatgcctctcgggacctattcacatataccgtgaagtgcatccagatccgtcgaaaactccggatcgaaaaaaggcaacaagagaacctactgcttagcgtgcttcctgcccacatttcaatgggcatgaaactcgccatcattgaaaggctgaaagaacacggcgaccggaggtgcatgcccgataataatttccacagcctgtacgttaagcgccaccagaatgtgtcaattctgtacgccgacattgttgggttcacccagctcgcgtcggattgctcaccaaaggagctggtcgtggtcttaaatgaactatttggcaagtttgatcagatcgccaaggccaacgaatgcatgcggataaagatcctgggcgactgctattattgcgtgagcggattacccgttagcctgcccacacatgcgaggaattgcgtcaagatggggctcgacatgtgccaggcaataaagcaggtgagggaggcaacgggtgtggatatcaatatgagggttggaatacattctggtaatgtactgtgtggcgtaattgggttaaggaagtggcagtacgatgtttggtcgcacgatgtttcactcgccaaccgaatggaggcagctggtgtaccgggccgggtccacataacagaagctactctgaagcacctggataaagcctacgaagtggaggacgggcatggccagcaaagggacccttatctcaaagaaatgaacatccggacttatctggtcattgatccccgtagccagcaacccccaccaccgagccagcacttaccccggcccaaaggcgatgcggctctgaaaatgcgcgcatcagttcgaatgacccggtatctggagtcctggggggctgctaggccttttgcccatctcaaccaccgagagtctgtttcgagcggtgagacacacgttccaaatgggcgaaggcccaagtccgtgccccagcggcacaggaggaccccggatcgatctatgtcccctaagggccgcagcgaggacgattcctatgatgatgagatgctctctgcaattgaggggctctctagcacccggccatgttgtagcaaatctgatgatttctacacatttggctccatctttttggaaaaggggttcgaacgcgaataccgcttggcacccatcccgagagcccggcacgatttcgcttgcgcttctttgattttcgtgtgcatactgcttgttcatgtcttgctaatgccgaggacagccgccctgggagtttcttttggcttggtggcttgtgtgcttggcctggtgctgggtctatgtttcgccacaaagttctcacgatgttgccccgctaggggaaccctgtgcaccataagcgaaagagtggagacacagccattgctgagactgaccctcgccgtgcttactattggtagtctgctgaccgtggcaattatcaacctgcccttaatgcccttccaggttccggaacttcctgtgggcaatgagacaggccttctggctgcatccagtaagacgcgggcactttgtgagcctctgccccacttgcacactgtcttctcccggctgaacgagctgacatcctag

SEQ ID NO: 107501 - DNA, 3756 bp, Artificial Sequence
  Description of Artificial Sequence: Synthetic coding sequence
atggaactgtctgatgtgaggtgtctgactggctccgaggagttgtatacaatacatcctacccctccagctggagacggcaggagtgcttcgagaccacagaggctgctctggcagacggctgtacgccatatcacagaacagcggtttatacacggtcatcgcggcgggagtgggtcaggatccggtggtagtgggaaggccagtgatcctgcaggcggagggccaaaccatcatgccccccaactctctggggacagcgcactgccactttattctcttgggccaggcgaacgggctcactctacttgtgggactaaggtattcccagagcgatccggaagcggctccgcctctggttccggaggaggtggtgacctcgggttcttgcatctggactgcgccccctctaattctgacttttttctgaacgggggatatagctacaggggcgtgatattccctactttgagaaacagttttaaatccagagatttggaaaggctttaccagagatacttcttgggacagcggaggaaatccgaagtagttatgaacgtactcgatgtcctgaccaagcttacgttgctggtgctccatctcagtctggcgagcgcccccatggaccctctgaagggtatcctgctgggtttttttaccggaattgaggtggttatctgtgcactcgtggtagttaggaaggacactacatctcatacgtacctccagtattctggcgtggtaacctgggtggcaatgactacccaaatactggccgcagggctgggatatgggctcctgggggacggtatcggctacgttctgtttacgctctttgcaacatactccatgctgcccttacctcttacctgggcgatcctggccgggttgggtactagcttgcttcaagtaatcctccaagtcgtgatcccccgccttgcggtgatttcgattaatcaagttgtagcccaggcagtcttattcatgtgtatgaataccgcgggtattttcatttcgtatctctccgatcgggctcaacggcaggccttcctagaaacacgtagatgcgttgaagcaagactgagacttgaaacggaaaaccagcgccaagaaaggttggtcctgtcagtacttcctcgatttgttgtgcttgagatgatcaatgacatgacaaatgttgaagatgagcatctccagcatcagtttcacagaatttacatccatcggtatgagaatgtcagcattctgttcgcagatgtcaaagggtttacgaatctttcaactaccttaagcgcacaagagctcgttaggatgcttaacgaacttttcgcccggtttgataggttagcccacgagcaccattgcttgagaattaagatcctgggggactgctactactgtgtttccgggttacctgaaccacgccaggatcacgcccactgttgcgtggaaatgggactatctatgatcaaaacaatccgttatgtcagaagccgaaccaagcacgatgtggacatgcgcatcggcatccattcaggtagcgtgctgtgcggggtgctaggcctgaggaaatggcagttcgacgtctggtcatgggatgtcgacatcgctaataagcttgaatccgggggtattcctggtcggatccacatctctaaggcaaccctcgattgcttgaatggcgactacaatgtggaagaggggcatggcaaggagagaaatgaatttttaagaaaacataacattgaaacctatttgatcaaacagccagaggacagcctattgagtctccctgaagatatcgtgaaagagtcggtatcttctagcgataggagaaactctggcgcaacctttaccgaggggagctggagccccgaattacccttcgacaatatcgtggggaagcagaacacattagcagcactcacacgaaactcaataaacctgctgccgaaccacctggcgcaagctcttcacgtgcagtctggacctgaggaaatcaacaagaggatcgaacacactatcgatctgaggtctggcgacaaactgagaagggagcacattaaaccgtttagtctcatgttcaaggattccagcctcgaacacaaatacagccagatgcgggacgaggtgtttaagagcaacttggtctgcgctttcatcgtgctcctctttataaccgcaatacagtctctccttccatccagccgggtaatgccaatgacgattcagttttccatactgatcatgctgcattccgccctcgtgttaattacaaccgcggaggactataagtgtctgcctctgatactccgcaaaacctgctgttggattaacgagacatacctcgcacgcaacgtgataattttcgcctcaatactgataaacttcctgggggctatcctgaacatcctgtggtgcgacttcgataagagtattcctcttaagaatctaactttcaattcctctgccgtattcactgatatctgttcttacccagaatactttgtgtttaccggggtgctcgctatggtgacttgcgccgtgttcttgagactaaactcggtgctcaagctggcggtactgcttattatgatcgccatatacgccttattgacggaaaccgtgtacgcgggactattcctgaggtacgataacttaaaccactccggagaggacttcctcggcaccaaggaagttagtctactgctgatggctatgttcctactagccgttttctaccatggacaacagcttgagtatacggcccggttggattttctgtggcgggtacaggccaaggaagaaattaacgaaatgaaggagctgcgtgagcataatgagaacatgctgcgaaatatcctgccgagtcacgtggccagacactttctggagaaggaccgggacaacgaagaattatattctcagagctatgatgccgtgggtgtcatgttcgctagtatacctggattcgccgatttctattcgcagaccgaaatgaacaaccagggcgtggagtgcttgaggttgcttaatgaaatcatcgcggattttgatgagctgctaggtgaggatcggtttcaagacattgaaaagatcaagactattgggagcacatatatggcagtctctggtctgagcccggaaaaacagcaatgcgaggataagtggggtcacctatgtgctcttgccgactttagcctcgctctgaccgagtcaatccaggaaattaacaagcacagcttcaataactttgaactgaggatcggtatcagtcatggctcagtggtggcgggggtgattggggccaagaaacctcaatacgacatctggggcaagacagttaacctggcatctagaatggactcaacgggagttagcggcagaattcaggtgccagaggagacgtacctcatcctgaaggaccagggtttcgcgttcgactacaggggagaaatttacgttaaaggaatctccgagcaggagggcaagattaaaacatatttcctgctgggacgggtccagccaaatcctttcatcttgcccccgcgtaggttaccggggcagtattctttggcagctgtcgttttaggcttggttcagtcgctgaaccgccaaagacagaaacaattgcttaacgaaaataataataccgggatcattaagggccactacaaccgtagaacgctcctatcaccgtccggcaccgaaccgggagcccaggcagaaggtactgacaagtctgacttgccttag

SEQ ID NO: 107502 - DNA, 4062 bp, Artificial Sequence
  Description of Artificial Sequence: Synthetic coding sequence
atggccagcccaccccatcaacaactactgcaccaccactccactgaagtctcctgtgacagctctggcgactctaattccgttcgcgtgaaaatcaaccccaaacagctcagttctaacagccatcctaaacattgtaagtatagtattagctcctcttgttcaagtagtggggattccggcggagtgcccaggcgggttgggggtggaggacgcttgagaaggcagaagaagctgccacagctgtttgagagagcgagttcaagatggtgggatcctaagttcgattctgtcaatctggaagaggcatgtctggagcggtgcttcccccagacacagcgccggttccgctacgctctgttttatatcggtttcgcttgtctgttgtggtctatctattttgcagtacacatgcgcagtcggttaatcgtgatggtggcccctgccctctgtttcctgctcgtgtgtgtgggcttttttctgtttacatttacgaagctgtatgcaagacattacgcatggaccagcctagcactgactctgttagtctttgccctcacactggccgcacagttccaagtgctgactccggtgtctggcaggggggatagtagtaatctcactgcaaccgcaaggcccaccgacacatgtctgagccaagttggctctttttctatgtgcatcgaggtgctgttcctgttgtacactgttatgcacctgccactatatctgtcactctgcttgggtgtcgcatactcagtgctttttgaaacttttggttaccatttccgggatgaggcctgcttcccctccccaggtgcaggcgcccttcactgggaattgctctctcgcggcctgctccatgggtgtattcacgcgatcggtgtgcacttgtttgtgatgtcacaggtgaggagccggagcactttcctcaaggtgggccaatctattatgcacggcaaggacttagaggtggagaaagccctcaaggaacgcatgattcactctgtgatgccaaggatcatcgcggatgacctgatgaaacagggggacgaagaaagtgaaaactccgtaaaacgtcacgccacttctagcccaaagaacaggaagaaaaaatccagcatccagaaggcgccgattgcgtttagaccattcaagatgcaacagattgaggaggtcagtatcctgtttgcagacattgtcggcttcacgaagatgtcagccaataagagcgcccacgcattggtcggacttctgaacgatttattcggcaggttcgaccggttatgtgaagaaacaaagtgcgaaaaaatttccacccttggtgattgttattactgcgttgccggctgtcccgagcctcgcgccgatcatgcatattgttgcattgagatggggctggggatgattaaggctattgaacagttctgtcaggaaaagaaagagatggtgaatatgcgcgtcggcgttcatacaggcacagtgctgtgcggaattctgggaatgcgtagatttaagtttgatgtgtggtccaatgatgtcaacttggcgaacctgatggagcagttgggtgtggctggcaaggtgcacataagtgaggccacggctaagtatttagacgacagatatgagatggaggatggcaaagtgattgagaggctcggccaaagcgttgtcgccgatcaactaaagggcctgaaaacctaccttatcagtggtcagcgcgccaaggagagccgatgttcgtgcgcagaggcactactgagtggcttcgaggtcattgatgggtctcaggtaagctcaggcccccggggccagggaaccgcgtcatcaggcaatgtgtccgacctggcacaaactgtgaaaactttcgataatctgaaaacatgcccttcgtgtggtatcacattcgcacctaagagtgaggccggtgcagagggaggggccccccagaacggctgccaagacgagcataagaactcgactaaggcaagtgggggaccaaaccccaagactcagaatggactgctgagcccaccacaagaggaaaagctgactaacagccagacctccctctgcgaaatactgcaagagaagggtcgatgggccggcgtgtctctagaccagtcggccctcctccccctcaggtttaaaaatatacgagaaaagaccgatgcccattttgtcgacgtgattaaggaagactctctgatgaaggactacttctttaaacctccaatcaaccagttctccctgaacttcctcgatcaggaattggagaggtcgtacaggacttcctatcaggaggaggtcataaaaaactccccagtgaaaacattcgcttcacccacatttagttccctgttggacgtgttcttgagtacaaccgtgtttctaacattgagcaccacttgtttcctgaaatacgaggccgccacggtgccccctcctcccgctgcattggcggtcttcagcgctgccctgctgttggaagtgttgtctttggctgtatccatcaggatggtctttttcttggaagacgttatggcttgtacaaagagactcctagagtggatcgccggttggctgcctcggcactgtataggcgctatcctagtttcgcttcctgctctggcagtttattctcatgtgaccagcgaatacgagactaacatacacttcccagtgttcaccgggtccgccgcgctcatcgcagtcgtgcactactgtaacttttgtcagttatcttcttggatgaggtcaagcctcgccacagttgttggtgctggtcccctcctgctgctgtacgtctcactgtgcccagactcttctgttctcacatcgccactcgacgccgtgcaaaatttcagcagcgaacgcaacccatgcaatagctccgtcccgagagatctcagaaggcctgccagtctcattgggcaggaggttgtgctcgtattcttcttgctgctcctcctggtatggttcctgaatcgagaatttgaagttagctacaggctgcattaccatggcgacgtagaggccgacttacatagaaccaagatccagagtatgagagaccaagcagattggctcctacggaatatcataccctaccacgtggcagagcagctcaaggtgtcacaaacctattccaaaaatcatgacagtggcggagtgatattcgccagcattgtgaatttctccgaattttacgaagaaaactatgagggaggtaaggagtgttaccgcgtcctgaatgaattgatcggcgattttgatgagttgttatcgaaacccgattactctagtatcgagaaaataaaaacaatcggggcgacatatatggccgcctccggactgaacacagcacaggcgcaggacggaagccaccctcaggaacacctccagatcctgttcgagttcgccaaggaaatgatgcgggtggtggatgactttaataataacatgctttggttcaactttaaactgagggtgggtttcaatcatgggcctctgacagcaggggtaatcggtacaactaagctcctgtacgacatctggggggacacggtgaatatagcttcgagaatggacacaactggcgtagaatgtcgcatccaggtgagcgaggagtcctatcgcgtactctctaagatggggtacgatttcgattacagagggaccgtgaacgtgaagggaaaaggacagatgaaaacgtatctgtatcctaagtgcaccgaccacagagtgattccccagcaccagctttctatctcacccgacatccgggttcaagtggacggtagcataggtcggagccctacggatgagatagccaacctcgtaccaagcgtccagtacgtcgacaagactagcctaggctcagatagtagcacccaggcaaaggatgcccacctttcccctaagaggccctggaaggagccagttaaggcagaagagcggggaaggtttggcaaagctatcgagaaagacgattgtgacgaaactggtatcgaagaggcaaatgagctgacaaagctgaacgtctcaaaaagtgtgtag

SEQ ID NO: 107503 - DNA, 531 bp, Artificial Sequence
  Description of Artificial Sequence: Synthetic coding sequence
atgaccatgtgctcaggagcccgactagccctgctcgtatatggcatcattatgcatagtagtgtctactcctcacccgccgctgctggccttagatttcccggaattaggccagaagaggaagcttacggtgaggacgggaacccactgcccgattttgatggaagcgaaccacctggcgcaggctcccccgcctctgcaccaagagccgccgccgcgtggtaccgtccagcgggtcgaagggatgtggcccacgggatcctgaacgaagcctacagaaaggtcttggaccaactgtctgcgggaaaacacctgcagagcctcgtagctcggggggttggggggtccttgggggggggggctggagacgatgccgaacctctgtccaagcgccatagcgacggcatcttcaccgatagctacagccggtataggaagcagatggctgtgaaaaagtacctggccgcggttctggggaaacgttataagcagcgtgttaagaataaaggacggcgaattgcctacctttag

SEQ ID NO: 107504 - DNA, 531 bp, Artificial Sequence
  Description of Artificial Sequence: Synthetic coding sequence
atgacaatgtgttccggtgcccgcctcgcactgctggtgtacgggatcattatgcattcatctgtatattcttctccagctgccgccgggctcagatttccgggcattcggccagaagaggaggcttatggcgaagacggcaatcccttgcctgacttcgatggctccgagccgcctggcgcaggttcaccagcctccgcccctagggcagctgcagcctggtacagaccggcaggaagaagggacgtggcccatggaatcctcaatgaagcatacagaaaagtcctggaccagctgtctgccgggaaacacctgcagtctctcgtggcccggggcgtggggggttcactgggcgggggagctggggatgacgcggaacccctctccaagaggcatagcgacggcatattcaccgatagttacagtaggtaccggaagcaaatggcagtgaagaagtacctcgcagccgtgctcggaaagcgctacaaacagagggtgaaaaacaagggacgcaggattgcttatttgtag

SEQ ID NO: 107505 - DNA, 948 bp, Artificial Sequence
  Description of Artificial Sequence: Synthetic coding sequence
atgctgactaagcgcgctttgcaaaagccctgctccgaccgattcctgcgcaccgcacagataaacagaagccgaagaccagtgacttccgtgacctcaggctcttcttcccgaagtcgtgctagtccccatagaccattattcctctcttcagccagcttatctgcacctccgagtcttcgggtcacgctgccccctggctctgcccgcctgcagacttttgaacaaaacacgagtctaggaaagagggttccccagctgctactccttctgcccctggtgccggctgcctccgcccagactcctacacctgacggcgacgcatcccgagtagtgacaccagctcaagagctggaggaggccttgtgtccacctagttatcttgctgcactgctcgcagccggcggagttgagggcatgaccatgtgcagcggcgcccgattggccctcttggtgtacggaattatcatgcattccagtgtttactccagtccagctgcggcgggcctgcggtttcccggcatacggccggaagaagaagcttatggagaggacggcaatcccctacctgattttgacggaagtgagccgcccggtgccggatcccccgctagcgccccacgcgcagccgctgcttggtaccggcccgctgggaggcgggacgtagcccacggtattttgaacgaggcctatcgcaaggtcctggaccagctgtctgcggggaaacaccttcagtcgctggttgccaggggcgtgggtggaagcctaggcggaggcgctggggacgatgccgagccacttagtaaacgccattcggatggtattttcacagactcctacagcaggtataggaagcaaatggccgtcaagaagtacttagccgcagtcctcggaaagcggtacaagcagagagtcaaaaataagggaaggagaattgcgtacctctag

SEQ ID NO: 107506 - DNA, 531 bp, Artificial Sequence
  Description of Artificial Sequence: Synthetic coding sequence
atgactatgtgcagcggagccaggctcgcactgttggtgtacgggattattatgcactcctctgtgtacagctcgccggctgctgccggtctcagattccccggtattcggccggaagaagaggcatacggcgaagacggcaaccccctgccagattttgatggctctgagccccctggggctgggtcacctgcgtccgctcctcgggcagcagccgcctggtaccgccccgcagggcggcgagatgtagcacacggaattctcaatgaggcctataggaaggtgctggatcagttgtctgctggcaagcacctgcagagtctggttgccagaggcgtaggcggttctctgggcggcggtgctggagacgatgccgaaccgctatccaagcgccactccgatggaattttcactgactcctattcccggtacagaaagcagatggccgttaaaaagtacctcgccgccgtgctaggcaaacggtacaaacaaagggtgaagaataaggggcgaagaatagcttatctttag

SEQ ID NO: 107507 - DNA, 1407 bp, Artificial Sequence
  Description of Artificial Sequence: Synthetic coding sequence
atggcaggggtagtgcacgtgtctctagctgctctgcttctcctgccgatggctccagccatgcacagcgattgtatctttaaaaaggaacaggcgatgtgcctggaaaagatccagcgtgcgaatgagctgatgggcttcaatgactcaagtccaggttgccccgggatgtgggacaatatcacctgctggaagcccgctcacgtcggtgagatggtgctcgtgagctgtccggagctatttcgaatttttaaccccgatcaggtgtgggagactgagacgatcggggagtctgacttcggcgacagcaatagtctagatttgagtgacatgggcgtggtctcacgcaactgcacggaggatggttggagcgaaccttttcctcattattttgatgcatgtggcttcgatgagtacgaatctgaaaccggggaccaagattactactatctcagtgtcaaggctctctatacagtagggtacagtacatccctcgttacattgactaccgcaatggtgattctttgcagatttcggaagctccactgcacccggaactttattcacatgaatttgtttgtatcttttatgctgcgtgctatcagtgttttcatcaaggactggatcctctatgcggaacaagacagcaatcactgtttcatatcaaccgttgagtgcaaggctgttatggtcttctttcattactgtgtggtgtctaattacttttggctcttcatcgaaggcttgtatctgttcacattgttagtggagacattttttccggagcgaaggtatttttattggtatactatcattggatgggggacaccaacagtttgcgtgactgtctgggcaactctgcgactgtacttcgatgatactggatgttgggacatgaacgactctactgccctttggtgggtgattaaaggacctgttgtcgggtccatcatggtgaacttcgtcctcttcattgggataattgtaatattggtgcaaaaactgcagagtccagatatgggtggaaatgagagctcaatttatctgagacttgcaagaagtacattgctattaattcctctgttcggaatccattataccgtgtttgctttctcaccagagaacgtgtcaaaaagggaacgactggtttttgagctcggcctcggctcattccaggggttcgtagtcgcagtgctgtactgtttcctcaatggtgaggttcaagcggaaatcaaacggaaatggcggtcatggaaggttaatcgatattttgctgttgattttaaacacagacacccatccctcgctagcagcggtgtgaacgggggaacgcaacttagcatacttagcaagtcaagctcccagatccggatgtccggtcttcctgcggataacctggccacatag

SEQ ID NO: 107508 - DNA, 594 bp, Artificial Sequence
  Description of Artificial Sequence: Synthetic coding sequence
atggtattctttcactactgtgtagtctccaattacttctggctgtttattgagggactgtatctgttcactctactggtcgaaacttttttccctgagagacggtatttctactggtatacgattattggatggggtacacccacggtctgcgtgaccgtgtgggcaactctgcgcctctatttcgatgatactggatgttgggatatgaatgactctaccgccttgtggtgggtgatcaaggggcccgtggtgggctccatcatggttaactttgtgctctttatcggcatcatcgttatcttagttcagaagctgcagagcccagatatgggcggcaatgagtctagcatctatctgactaacctcagccccagagtgcccaagaaggcaagggaggatcccttgccagttccctctgatcaacacagtcttccttttctttcctgcgtacagaagtgctactgcaaaccacaaagggcacaacaacacagttgtaaaatgtctgagctgagcacgatcaccctgcgcctggctaggagcactctgttgctgatcccccttttcgggatacactacacggtttttgcctag

SEQ ID NO: 107509 - DNA, 1491 bp, Artificial Sequence
  Description of Artificial Sequence: Synthetic coding sequence
atggcaggcgtggttcacgtgagtctggccgccctcctcctgctgcccatggcccccgcgatgcattcggattgtattttcaagaaagagcaagctatgtgtttggaaaagattcagcgcgccaatgagctgatgggtttcaacgactcctcccccgggtgcccaggaatgtgggataacattacctgctggaaaccagctcacgtaggcgagatggtgctggtctcatgcccagagctctttaggattttcaatcctgatcaggtgtgggagaccgagactattggcgagtccgatttcggagatagtaattctctcgatctttcggacatgggcgtcgtaagtcgcaattgcactgaggacggctggtcagagccttttccccactatttcgatgcttgcggctttgacgagtacgagtcagaaacgggcgaccaagattactactacctgagtgtgaaagccctgtacaccgtggggtactccacctctctagtaacactgactacagccatggttatcttgtgcaggttccggaagctccactgtacgagaaacttcattcacatgaatctctttgtctcgtttatgctcagagcaatatcggtgttcataaaagactggattctctatgccgagcaagacagcaaccactgcttcatatcaacagtggaatgcaaggctgtgatggttttcttccattactgtgtggtgagtaactacttttggttgtttatcgagggcctctacctgtttacactgttggtggaaacctttttccccgagaggcgctacttctattggtatactattatagggtggggcacgcctacggtatgcgtgacagtgtgggccaccttacggctctactttgatgataccgggtgttgggatatgaatgactccaccgccctgtggtgggtgattaaagggcctgtggtgggatccatcatggtcaacttcgtcctgtttattgggatcatagtaattctggtccaaaagctgcagagtcctgatatgggaggcaacgaatcgtccatatatttctcctgtgtgcagaagtgttattgtaagcctcagagagctcagcagcattcatgcaaaatgtcggagctttccacgattaccctgagactggcacgctcgactttactcctgatccccctgttcggcatccactacacagtttttgctttctcacccgagaacgtctctaaaagggagaggcttgtgtttgagttgggattgggcagcttccaagggtttgttgtcgcagtgctctactgttttctaaacggagaagtacaggcggagatcaaacgaaagtggcggagttggaaggtgaaccggtattttgcagtcgattttaagcatagacatcctagtctggccagctccggggtgaacggggggacacagctaagcatactctcaaagtccagcagccagatccggatgtcaggcctcccagccgataacctggctacttag

SEQ ID NO: 107510 - DNA, 1575 bp, Artificial Sequence
  Description of Artificial Sequence: Synthetic coding sequence
atggctggtgtggtccacgtttccttggcagctctgcttctgctgcctatggcgcccgcaatgcactccgattgtatttttaagaaggaacaagcaatgtgtctagagaagatccagcgggccaatgaactcatgggattcaatgactctagccccggctgccctggcatgtgggacaatatcacctgttggaaaccagcgcacgtaggcgagatggtcctggtgtcatgcccagagttgtttcggatctttaacccagatcaggtctgggaaactgaaacaataggagagtcagattttggcgacagcaattccttggacctctctgatatgggagttgtgtcccgtaactgcactgaggatggttggtctgagccctttccccactattttgatgcatgcggattcgatgaatatgagagcgaaaccggcgaccaggattattattacttatctgtgaaggccctgtacacagtcgggtactccactagcttagtgactctgaccacagcaatggttatcctgtgcagatttcggaagcttcattgtacaagaaattttattcatatgaatctgttcgtgtctttcatgcttcgcgccatcagtgtattcatcaaggactggatcttgtacgctgaacaagacagtaaccactgctttatctcaaccgtagaatgcaaggctgtgatggtattcttccattattgtgtagtgagcaactatttttggctattcattgagggattatatctctttaccttactggttgaaactttcttccctgaacggaggtatttttactggtatacaatcattggatggggcaccccaaccgtgtgtgtgactgtgtgggcaaccctgaggctctatttcgacgatactggctgctgggacatgaatgattcaacagccttgtggtgggtaataaaaggaccagttgtaggaagcatcatggtgaatttcgtgctgttcattggaatcatagtaattctggtgcaaaaacttcaaagtccagacatggggggcaacgagtcatcaatttaccttactaatctgtcacccagagttcctaagaaggccagggaagatcccctgccagtgccctcggatcagcacagtcttcctttcctcagctgcgtgcagaaatgctattgcaagccgcagcgtgcccagcagcattcctgcaagatgagtgaactgtcaaccattaccttgagacttgcgcgctctacactcttgctgataccactgttcgggattcactacactgtctttgcattttccccagagaatgtctctaagagagagcgattggtgtttgaattaggactggggtcctttcaggggtttgtcgtcgccgttctttactgctttttgaatggcgaagtgcaggctgagattaagcggaagtggaggagctggaaggtcaacagatactttgcagtggactttaagcaccggcacccatcactggcttcaagcggagtcaacggcggtacccagttatccatcctgtccaaatcttcaagtcagatccgcatgagcggcctgcccgccgataacctcgctacatag

SEQ ID NO: 107511 - DNA, 225 bp, Artificial Sequence
  Description of Artificial Sequence: Synthetic coding sequence
atggccggtgtggtgcatgtaagcctcgctgccctcctactgctccccatggcacctgcaatgcatagtgactgtatcttcaagaaggagcaagcaatgtgcttggaaaagattcagagggcaaatgagcttatgggctttaacgattcatcacctggttgccccggcatgtgggataacataacctgttggaaaccagcccacgttggggaaatggtactgtag

SEQ ID NO: 107512 - DNA, 447 bp, Artificial Sequence
  Description of Artificial Sequence: Synthetic coding sequence
taggcaacgttaagactctatttcgatgacactggatgttgggacatgaatgattccactgccctctggtgggtcatcaaaggaccggttgtaggtagcatcatggtgaattttgtcctcttcatcgggatcatagtgattctggtgcaaaaactgcagtcacctgacatgggcggcaatgagagttccatctaccttacaaacctcagcccgcgtgtgcccaaaaaggcacgggaggatcctttgcctgtgccatccgaccagcacagtcttccatttttacgtttagctcgcagcactctgctgctcatccccctgttcgggatccactacaccgtgttcgcattttccccagagaatgtatcaaaacgggagcgattggtattcgaactgggtctcgggtcctttcaaggtttcgtggttgctgtcctgtactgttttctgtag

SEQ ID NO: 107513 - DNA, 1344 bp, Artificial Sequence
  Description of Artificial Sequence: Synthetic coding sequence
atggcaggcgtggtccatgtgtcactggctgccttgctgctgctgcccatggccccagcaatgcactctgattgcatcttcaaaaaggagcaggccatgtgccttgagaaaatccaacgagccaacgaactcatgggttttaacgattcctccccaggctgtcctggaatgtgggacaacataacatgctggaaaccggcacatgtgggagagatggtcttggtgtcgtgccccgaactgtttagaatattcaatccagatcaggatatgggagtcgtatcaaggaattgcacggaggatggctggtccgagccattccctcattactttgatgcttgcgggtttgacgagtatgaaagtgagacaggagaccaagattattactacctttccgtcaaggcactatataccgtgggctacagcaccagcctggtcacactgacgaccgccatggtcatcctttgtcggttccggaaactgcattgcacgaggaactttattcacatgaacctgttcgtctcgtttatgctgcgcgcaattagcgtgtttataaaggactggattttatatgccgagcaagactctaaccattgctttatctcaaccgttgagtgtaaggccgtaatggttttcttccattactgtgtggtgtcaaactacttctggctgtttatcgaaggcctttatctgttcacactgctggtggagacattcttcccagagaggagatacttttactggtatacaatcataggctggggaactcccacagtatgtgtcactgtctgggccacactcaggctctacttcgatgataccgggtgctgggatatgaatgacagtacagctttatggtgggtgatcaagggacccgtggtgggctcgatcatggtcaactttgtcctctttattggcatcattgtgatcctcgtccagaagctgcagtcccccgatatggggggtaatgagtcttctatatacctcagactggcccgatcaactcttttgctgatcccgctgttcgggattcactataccgtgttcgccttcagccccgagaatgtgagtaaaagagaaaggcttgtctttgaactgggacttggcagcttccagggctttgtggttgccgtgctctactgcttccttaacggagaagttcaggccgaaattaagaggaaatggcgcagttggaaggtgaaccgctacttcgcagttgatttcaagcacagacatccgagcctggctagtagcggtgtgaacgggggtacacagctatctatccttagtaagtcatccagccaaatccggatgtctggtctaccggcagacaacctggccacctag

SEQ ID NO: 107514 - DNA, 705 bp, Artificial Sequence
  Description of Artificial Sequence: Synthetic coding sequence
atggatcccggactgcagcaggctctcaacgggatggcccccccgggtgatactgcaatgcacgtgcccgctggcagcgtggcttcccacctggggaccacctccaggtcttatttctatttaacgacagccacgttagcgctctgcctggtgtttactgttgcgacgattatggtacttgtagtccagcgtacagatagtataccgaacagtccggacaatgtccccctgaagggaggcaactgttcagaggatctactctgtattctgaaaagggccccctttaaaaagagttgggcatatctgcaggtggctaaacacctgaacaagacaaagctgtcatggaataaagatggcatactgcacggcgtgaggtatcaagacggcaacctggtaatccagtttccaggcctgtattttattatctgccagctgcaattcctcgttcaatgcccaaacaactccgttgacttaaagctggagcttctgatcaacaaacacattaagaagcaggccctggtgaccgtgtgtgagtcgggcatgcagactaagcacgtctatcagaacctgtcccaatttcttctcgactatctccaggtgaatacgaccattagcgtgaatgttgacacgtttcagtacattgacacgagtacatttccattagaaaatgtgctgtcaatctttctgtactccaacagcgattag

SEQ ID NO: 107515 - DNA, 585 bp, Artificial Sequence
  Description of Artificial Sequence: Synthetic coding sequence
atggaagagaaactgaaaaagactaagataattttcgtggtcggtggccccggatcaggcaagggcactcagtgcgaaaaaatcgtccagaagtacgggtacacgcatctttccacaggggatctgctgaggtccgaggtcagctccggctctgcccgcggaaaaaagctgagtgagattatggaaaagggccagcttgtgccgctggaaaccgtgctggacatgctgcgtgatgccatggtggctaaggtgaatactagcaaggggttcttgattgacgggtacccccgagaggtccaacagggtgaagaatttgagaggcgtatcgggcagcccacgttgctgctctacgttgatgcagggcccgagacaatgacccagaggctactcaaaagaggggaaaccagcggaagagtcgacgataatgaggagaccatcaaaaaaaggctagaaacttattataaggccaccgagccagtcatcgctttttacgaaaagcgcggcattgtccgcaaggttaacgccgagggaagtgtggattccgtattttcacaagtttgtacgcacttagacgcactcaagtag

SEQ ID NO: 107516 - DNA, 585 bp, Artificial Sequence
  Description of Artificial Sequence: Synthetic coding sequence
atggaagaaaagctgaaaaagaccaagatcatatttgtggtcggcgggcctgggtccggcaaaggcacacaatgtgagaagatcgtgcaaaagtatggctacacccacctcagcacaggcgacctgctgagaagtgaggttagcagcggatccgcacgagggaaaaagttgagcgagatcatggagaaaggccagcttgtacccctcgaaacggtgctggatatgctgcgcgatgccatggtggcaaaagtgaatacttctaaagggtttcttattgatggttaccccagggaggttcaacagggggaggaatttgaacggagaatcgggcagcccacgctgctcctatatgtggatgccgggccagagaccatgacccagaggctacttaaacggggcgaaacttctggaagggttgacgacaacgaggagacaatcaagaagcggttggaaacctactataaggcaactgaacccgtgatagcattctacgagaagcgcgggatagttcggaaggtgaacgctgaaggcagcgtggactctgtctttagtcaggtgtgtactcaccttgatgcattgaaatag

SEQ ID NO: 107517 - DNA, 720 bp, Artificial Sequence
  Description of Artificial Sequence: Synthetic coding sequence
atggcccccagcgtgccggccgccgaacccgaatacccgaaaggtatccgggccgtgttgctcggccccccaggagctggaaaaggaacccaggcgccaaggctggcagagaatttttgtgtctgccatctggccacaggagatatgctgagggccatggtggcttcaggatcagagttaggcaagaaattgaaagctacaatggacgccggtaaattagtaagcgatgagatggtagtcgaactgattgaaaagaacctggagacaccgctgtgcaaaaacgggttcttgctggacggtttccctcgtactgtccggcaggccgagatgcttgacgatttgatggaaaaacggaaggaaaaactggattctgtcatcgaattctcaatccctgacagtctgctcatccgacgcatcaccggtagactcatccatcccaaaagcggtagatcataccatgaagagttcaaccctcccaaagagccgatgaaggacgatataaccggcgagcccctcattcgcagatctgacgacaatgagaaagcactaaaaattcggcttcaagcctatcatacacagacaacaccacttattgaatactaccgcaagcgcggcatccacagtgccatagacgcaagtcaaactccagacgtggtgttcgccagcatccttgccgccttctccaaagcaacatgcaaggacctggtcatgtttatttag

SEQ ID NO: 107518 - DNA, 699 bp, Artificial Sequence
  Description of Artificial Sequence: Synthetic coding sequence
atggctccctcggttcctgccgcggaacccgaatatccaaagggtattcgggcagtgctcctgggacctcctggcgccggcaagggaacccaggctcccaggcttgcggagaacttctgcgtgtgccatttggccacaggtgatatgctcagagccatggtggcatccggcagcgagctgggcaagaaattaaaagcaaccatggatgccggtaaacttgtaagcgacgagatggtggttgaactgatcgaaaagaatctggaaactcccctctgcaagaacggttttctgctggatggcttcccacgaactgtcagacaggctgagatgctcgacgacctcatggagaagagaaaagaaaaattggacagtgttattgagtttagcattcctgatagtctgttaattcggcgcatcactgggcgcctgatccacccgaaatctggacggtcctatcatgaggagtttaatcccccgaaagaacccatgaaagacgacattacaggcgagccactgataagacgatccgatgacaacgagaaggcactgaagattcggcttcaggcatatcatacacagactaccccactcatagagtattaccggaagcggggcatccattccgctatcgacgcctcgcagacacctgacgtggtttttgctagtatcctggcagctttctcgaaggcaacctcttag

SEQ ID NO: 107519 - DNA, 609 bp, Artificial Sequence
  Description of Artificial Sequence: Synthetic coding sequence
atggctccgagcgtgccagcagctgagcccgagtatccaaagggcatccgggctgtgctgctcgggccccccggggccggaaagggtacacaggccccacggcttgccgagaacttttgcgtatgtcatttagcaacaggcgatatgttgcgggcaatggttgcatcaggttccgaactgggaaagaaacttaaggccacaatggacgcgggcaaattagtatccgacgagatggttgtcgaactaatcgaaaagaatttggagactcctctttgcaagaacggctttctgttagatggattccctcgcactgtaaggcaggcggaaatgctcgacgatctgatggaaaaaaggaaggagaagctggacagcgtcattgagttcagcatcccagacagtctgcttatccgccggatcaccggaagactcattcatcctaaatcagggcgttcctaccacgaagaattcaatccaccgaaagagcccatgaaagacgacattacgggagaacctttgattaggcgcagcgtgattggtcaagccaaaagaagcttcctccgcctggccaaaatcagtttcgatgtgctcattaaaaaggccctggcttag

SEQ ID NO: 107520 - DNA, 474 bp, Artificial Sequence
  Description of Artificial Sequence: Synthetic coding sequence
atgactaggcttgcactgcacgagcttaaaaatcttacccagtactcttggctgctcgatggctttccccggacccttccacaggcagaagcccttgacagggcataccaaatcgatacagttatcaacctcaacgttcctttcgaggtgattaagcaacgcttaactgctcgttggattcaccccgctagtgggcgagtctacaacatcgagttcaatcccccaaagactgtgggaattgacgacttgacaggcgaacccctgatccagagagaggatgacaagcctgagacagtaattaaacgcctgaaggcttacgaagatcagacgaaacctgtcctggaatattatcagaaaaaaggcgtgctcgaaacctttagtggcacggagaccaacaagatctggccgtacgtttatgcctttctgcagaccaaagtgccacaacgcagccagaaggcctccgtaactccatag

SEQ ID NO: 107521 - DNA, 684 bp, Artificial Sequence
  Description of Artificial Sequence: Synthetic coding sequence
atgggagcctcagcccgcctcctgcgtgctgtcattatgggggctccagggtccggaaagggcactgtctcttctcgaatcacaacacactttgaacttaagcacctcagcagcggcgatttgttgcgcgacaacatgctgcgcggcaccgagattggcgttctggccaaggcttttatcgaccagggaaagttaattccagatgacgtgatgacaaggttggcactgcacgaactgaagaaccttacccagtattcctggctgcttgacggctttcccaggacactgccgcaggccgaggcactggacagggcttaccagatcgacaccgttatcaatttgaatgttccttttgaagtcattaagcagaggctcaccgcacgctggattcatccagcctccggcagggtgtacaacatcgaattcaatcctccaaagactgtagggatcgatgacctgacaggagaaccactgattcaaagggaggacgataagccagagacggtgataaaacgccttaaagcctacgaggaccagacaaaacccgtgctcgagtattaccagaagaagggtgtcctggaaacctttagcgggaccgagacgaacaaaatctggccgtacgtctacgcctttctccaaaccaaggtgccccagcgctcacagaaggcctccgtaaccccttag

SEQ ID NO: 107522 - DNA, 564 bp, Artificial Sequence
  Description of Artificial Sequence: Synthetic coding sequence
atgggcgcttctgcccggctcctgcgagctgttatcatgggggctcccgggagcggaaagggcaccgtgtcgtcaaggatcactacccatttcgagttgaaacacttgagtagcggtgatttgctgagagacaatatgctcagaggaaccggctttcccaggaccctccctcaggccgaggctcttgatcgggcctatcagatcgacactgtgattaatttgaatgtgccatttgaagtgatcaaacagcggctgacagctaggtggatccatccggcctctggccgcgtttacaacattgagtttaatcccccgaaaactgtggggatcgatgaccttacgggtgaacccctgattcagcgggaggatgacaagcctgagacagtgatcaaacggctgaaagcttatgaggatcagaccaaaccagtgttggagtactatcagaagaagggggtgcttgagaccttcagcggtacagagacgaacaaaatatggccttacgtttatgcgtttctgcagaccaaagtaccacagagatcccagaaagcctccgtcaccccctag

SEQ ID NO: 107523 - DNA, 474 bp, Artificial Sequence
  Description of Artificial Sequence: Synthetic coding sequence
atgacacgactggcactgcacgagctgaaaaaccttacccagtattcttggcttctagacggatttccacggacactgccccaggccgaagcattggacagggcctatcagattgacacagtgatcaacttaaacgtaccatttgaggtgatcaaacagcgacttacagcacgttggattcacccagccagcggcagagtgtacaacatcgaattcaacccaccaaagactgttggcattgacgatttgaccggcgagcccttgattcaacgcgaagacgataagcctgagaccgttatcaaaagactcaaagcatacgaggaccagaccaaacccgtgctcgaatactatcagaagaaaggtgtgcttgagacattttccggcaccgagaccaataaaatttggccctacgtgtatgccttcttacagacgaaagttccccagcgcagccagaaggcctcagttacaccatag

SEQ ID NO: 107524 - DNA, 1611 bp, Artificial Sequence
  Description of Artificial Sequence: Synthetic coding sequence
atgtgctcgaagccagaggaccctgtagaatatttagagtcatgtctccagaaggtgaaagagctgggtgggtgtgataaggtgaagtgggatacctttgtatcccaggagaagaaaacactgcctcctctaaatgggggccagtcccggaggagttttttgaggaatgtcatgcccgaaaattctaattttccttaccgccgctatgataggcttccaccgattcaccaatttagcatcgagtctgatacagatctgtcggagaccgcggagctgattgaggaatacgaggtgttcgaccccacacgcccacggcccaaaattatcctcgttattggaggccctggatctggtaagggcacacagtcattgaagatcgcagaaaggtacggtttccagtatatttctgtgggggagctgctcaggaaaaaaatacacagcacctcatccaatcgtaagtggtcattaatcgccaaaattatcacaaccggcgaactcgcccctcaagagaccaccattacagagataaagcagaagctgatgcagatcccagatgaggagggaatcgtgatcgacggcttcccccgcgacgttgcacaagccctgagctttgaagatcagatctgtacccctgacctcgtagtttttctggcgtgtgcaaatcagcgcctgaaggaaagactgctgaaacgcgcagaacagcagggaagacctgacgataacgtgaaggctacacagaggagactcatgaacttcaagcagaacgccgccccgctggtgaagtacttccaggagaaaggtctgattatgaccttcgatgctgaccgggatgaggacgaagtgttttatgacatcagtatggcagtcgataacaagctgttccccaataaggaggccgctgcagggtcttcagatctggacccttctatgatcctcgataccggcgagattatcgacaccgggtccgattacgaagatcagggggatgatcaactcaacgtgtttggtgaagatactatgggcggcttcatggaagatcttcgcaagtgtaaaatcatatttatcatcgggggacctggatcggggaagggaactcagtgcgagaagctcgtggaaaaatatggcttcacccacctctccactggtgagctgcttcgcgaggaactagcctcagaatctgagagaagtaagctcattagagacatcatggagaggggggacctggttccttctggcattgttctggaattgctgaaagaggctatggtggcttcattgggtgatactcgtgggtttctgatcgacggatatcctagggaggtgaaacagggagaggagttcgggcgcagaattggagacccgcagctggtgatttgtatggactgctccgccgacacaatgacaaacagactgcttcagcggagccggtcttccctgcccgtggacgatacaaccaagactattgccaagcggcttgaggcttattatcgtgccagcatcccagtaattgcctactacgagactaagacccaactccataaaatcaatgcagagggaacacccgaagatgttttcttacagctgtgtactgcaatcgactccatattctag

SEQ ID NO: 107525 - DNA, 1689 bp, Artificial Sequence
  Description of Artificial Sequence: Synthetic coding sequence
atgaacactaatgacgccaaggagtaccttgcacgccgggagatcccccagttgtttgagtccctgttgaatggtctcatgtgcagcaagcccgaggatcctgtggaatatctggaatcatgccttcagaaagtcaaggaactcggagggtgtgacaaagtgaagtgggacacatttgtatcccaggaaaagaagactctgcctcctctgaatggcggccaaagcaggcgctcattcctgaggaacgtcatgcctgaaaactcaaactttccataccggcgctacgaccggttgcctcctatacaccaattctccattgaatcagacacagacctctctgaaactgcagagctaattgaagaatatgaagttttcgaccctacccggccgaggcctaagataatcctggttatcgggggccccggtagtggaaaaggcacgcaatctcttaaaatcgctgaaaggtatggcttccagtacatctcagtgggagaattgctgcggaaaaagatccattcaacatcatcaaatagaaaatggtctctgatcgccaaaatcattacgacaggcgaactggcaccccaagagacaacgatcacggaaatcaagcagaagctgatgcagatccccgacgaagaggggattgtgattgacgggtttcctcgggatgtcgcccaagcgctgagctttgaagaccaaatatgcacccccgacctggtggtgttcctggcttgcgccaaccagcgcttgaaagagcgactgttgaagagggcagagcagcagggtaggccggatgataacgtgaaggccacacagaggagactgatgaatttcaagcagaacgcagcccccttggtgaaatatttccaagagaagggtttgatcatgacattcgacgccgatcgagacgaagacgaggtgttttatgacatttccatggctgtagacaacaagctattccccaacaaagaggccgctgctgggtcctcagatttggatccttctatgatactggacacgggcgagatcattgacaccggcagcgactatgaggaccaaggcgacgatcaattaaacgtttttggcgaggacacaatggggggttttatggaggacttgagaaagtgcaaaataatttttattattgggggtccagggagcggaaagggaacgcagtgcgaaaagttggttgagaagtatggctttacacacttgagcactggagagttactgcgagaagaattagccagcgagagcgaaagaagtaaactgatcagagatattatggaacggggtgatttagtgcccagcgggatcgtgctggaactccttaaggaggcaatggtagccagcctcggtgatacaaggggtttcctaatcgatggttatcccagagaagtgaagcagggcgaggagttcgggcgccggatcggagaccctcaactcgtcatctgtatggattgctccgcggacacaatgaccaaccgtctgcttcaacggtctaggtcatctctgcccgttgatgacaccaccaaaaccatcgcaaagcggcttgaagcctattaccgggcctccatccccgtaatcgcctactatgagaccaaaacacagctccacaagattaacgcagaggggacccctgaggacgtctttcttcagctttgcacagccatcgattcaatcttctag

SEQ ID NO: 107526 - DNA, 531 bp, Artificial Sequence
  Description of Artificial Sequence: Synthetic coding sequence
atgtgttccaagcccgaagaccccgtcgaatacctcgagtcttgtctacagaaggtcaaagaactgggcggttgcgacaaggtgaaatgggatactttcgtgagccaggagaagaaaacacttcccccgctaaatggaggacaatcacggcgaagttttctgagaaatgtgatgcctgaaaactccaacttcccttaccggaggtacgataggctgcctcctatccaccagttctctattgaatcggacaccgatctgagcgagaccgcggagctgattgaggagtacgaggtgtttgatcccacacggccacgtcccaagatcatactggtaattggcgggcctggcagcgggaagggcacccagagcctcaagatagccgagaggtatggcttccagtatatctctgttggcgagcttctgcgcaaaaaaatacactctacttcatcaaatcgcaagtggagcctcattgccaagatcatcacaacaggagagctcgctccccaagaaactacaattacagagatttag

SEQ ID NO: 107527 - DNA, 1647 bp, Artificial Sequence
  Description of Artificial Sequence: Synthetic coding sequence
atggccaaattcatgacccccgtgatccaggacaatccctcagggtggggcccttgtgcggtgccagaacagttcagggacatgccctatcaacctttcagtaaaggggataggcttggaaaggtggcagattggaccggtgccacctatcaagataagcgctatacaaacaagtattcatcacagttcggcggaggctctcagtacgcatatttccatgaggaagacgagagttccttccagctggtggatacagcacgtactcagaaaaccgcttaccaaaggaaccggatgcgattcgcccagcgcaacctacgaagggataaggacaggaggaatatgctccagttcaaccttcagattctgcccaagtctgccaagcagaaggagagagagagaatcagattacagaagaagttccagaagcagtttggagtacgccagaaatgggatcagaagagccaaaaacctcgggactcttccgtagaggtccggtccgattgggaagtgaaagaagaaatggattttccccagttgatgaaaatgaggtatctggaggtgtctgaaccgcaggatattgagtgctgcggcgctctcgagtactacgacaaagcttttgaccgaattactacgaggtccgagaagcccctcagatctatcaaacgaatattccacactgtgacaacgacagacgaccccgtaatcagaaaactggccaagacccaggggaatgtgtttgccacagacgcaatcttggccacgctgatgtcatgtacccggagtgtctactcgtgggacattgtggttcaaagagtgggatctaaacttttcttcgacaaacgcgataattcagatttcgacctgctcactgtctctgaaaccgctaacgagcctccacaggatgaaggcaactcatttaactctcctcgaaatctggccatggaggcaacctacataaatcacaatttctcccagcaatgcttgagaatgggaaaagaaaggtacaatttccctaacccgaaccctttcgtggaggatgacatggataagaacgagatagcatcggtagcttaccggtatagacgatggaagctgggagacgatatcgatctgatcgttagatgcgaacacgatggggtgatgactggggcgaacggggaggtgagctttatcaatatcaaaactctaaacgaatgggattcccggcattgcaacggcgtggattggagacagaaattggactctcagcggggtgccgtgatcgcaactgagctcaagaacaactcgtacaagttagcaaggtggacatgctgcgcccttctggccggcagtgaatatctgaagttggggtacgtgtctcgctatcacgttaaggacagttcgcgccacgtcatcttgggtacgcagcagtttaagccaaacgaatttgctagccagatcaacttgtctgttgagaatgcatgggggatcttgcggtgtgtgatagacatctgcatgaagctcgaggagggcaagtacctgatcctgaaagaccccaataagcaggtgatcagagtgtattccctgccggatgggaccttcagtagcgacgaggacgaagaagaggaagaggaagaggaagaggaagaggaagaggaggagacctag

SEQ ID NO: 107528 - DNA, 1278 bp, Artificial Sequence
  Description of Artificial Sequence: Synthetic coding sequence
atggctgctggaggcgatcacggctctccggactcctatcgatcacccctcgcgagccgatatgcaagcccagagatgtgttttgtttttagcgacagatataaattccgaacatggagacagctttggttgtggctggccgaagctgagcagacactgggacttcccattactgatgagcaaatacaggaaatgaagtcgaacttagagaacatcgactttaagatggctgcagaggaagaaaagcgcctcaggcatgatgtcatggcccatgtccatacattcggacactgctgcccaaaggccgctggaattatacatctcggggccactagctgctatgtaggagacaacacagacctcattatcttgcggaacgctcttgacctcctcctccctaaattggcaagagtgattagcagactggcagattttgcaaaggaaagggcctcactgcccacactagggtttacccattttcagccagcacagctgactacagtcggaaagaggtgctgcctgtggatacaggacctgtgtatggatctgcagaatctgaaaagagtacgggatgacctgagattcaggggtgtcaagggcactacagggactcaggccagctttctacaattgtttgagggtgacgatcacaaggtggagcagttggacaagatggtcacagagaaggctgggttcaagagggccttcattatcaccgggcagacatatacaagaaaagtggacatcgaagtcctgagcgtgctggctagcctgggcgccagtgtacataagatatgtactgacatccggctgctggcaaatctgaaagaaatggaagagccattcgaaaaacagcagatcggctccagtgccatgccttataaaagaaaccctatgagatctgagagatgctgttcgctggcccgtcatcttatgaccctggttatggaccctctgcaaacagcaagcgtgcaatggttcgaaaggaccctggacgattctgcgaatcgcaggatttgtttggccgaagcctttctgaccgctgacaccatactgaacacattacagaacatctcagagggcctcgtggtttatcctaaggttatcgaaagaagaatccgtcaagaactgcctttcatggcgacagagaatatcataatggccatggtgaaggcaggaggatcccggcaggttcaacggtttctcgaggaagaggtgtaccccctgctgaaaccatatgaaagcgtaatgaaggtcaaagctgaactttgcctctag

SEQ ID NO: 107529 - DNA, 1497 bp, Artificial Sequence
  Description of Artificial Sequence: Synthetic coding sequence
atggccgcaggaggagatcacggatctccggattcttatcggtccccactggcttcaagatacgcttcacccgaaatgtgttttgtattttcagatcgctacaagtttcgaacgtggcggcagctgtggttgtggctggccgaagcggagcagactctcggactccctattaccgatgaacagatacaggaaatgaaatccaatctcgagaacatcgattttaaaatggccgcggaggaggagaagcgtctgcgtcacgatgtcatggcgcacgttcataccttcggccattgttgcccaaaggccgcaggaattattcacctgggggctacctcctgctatgtgggggataacacttcactgatcctgtctaggggagtgattaaggcttactgcaacctgcgcctccctggctctgacagcagccctgttagtgtctctcagctggctagagtcattagcagattagcagactttgctaaggagagggcaagcctccctaccctgggcttcacacactttcagcctgctcagctcacgacggtgggaaagaggtgttgtctctggattcaggacttatgtatggacttgcagaacctgaaacgcgttagagatgaccttcggttcaggggtgttaaagggactactgggacacaggcctcttttctccaactttttgaaggcgacgatcacaaggtagaacagcttgacaaaatggtaaccgagaaggcggggttcaaacgcgcattcattatcacaggccagacttacaccaggaaggtggacatcgaagtcctgagcgtgctcgcatccctcggagcctcggtccataagatctgtacagacatcagactcctagcaaaccttaaggaaatggaagagccgtttgagaagcaacagatcggaagcagcgcaatgccatacaaacgcaaccctatgcgatctgaacgatgctgctctctggctcgacacctgatgaccctggtcatggaccccctgcaaactgcttccgtgcaatggttcgaacgtaccctggatgactccgcaaataggcggatttgtctagcagaggccttcttaacagctgatacaatccttaataccctgcagaatatctcagagggattggtcgtgtacccaaaagttatagagcggagaatacgtcaggagttgccattcatggctactgagaacataatcatggccatggtgaaggcaggtgggtcgcgacaggactgccacgagaagatccgagtcctctcccagcaggcagccagcgtggtcaagcaagagggtggagataacgatttgatcgaaagaattcaggtggacgcttatttctctccgattcatagccagcttgaccacttactcgatccctcaagcttcactggtcgagcctctcagcaggtccagcggtttctggaggaagaggtgtaccccctgctcaaaccttatgagagcgtcatgaaggtgaaggccgagctttgcctgtag

SEQ ID NO: 107530 - DNA, 915 bp, Artificial Sequence
  Description of Artificial Sequence: Synthetic coding sequence
atggacttacagaatttgaagcgagtgcgcgacgatctgagatttaggggcgtcaaaggtacaacgggcacccaagcatcctttctgcaactgttcgagggagatgaccacaaagtggaacaactggacaagatggtcactgagaaggccgggttcaagagagcctttatcatcactgggcaaacctataccaggaaggttgacatagaggtactgagcgtgttggcaagcctgggggcctcagtccataagatttgcacagacatccggcttcttgccaatctgaaagagatggaggaaccattcgaaaagcagcagatcggtagcagcgccatgccgtataagaggaatcctatgcgctcagagcgttgctgtagtttggctcggcatttgatgaccctggttatggaccctctccagacagcctccgtgcagtggttcgagcggacacttgacgatagcgcaaatagaaggatctgcctggctgaggcatttctgactgcggacacaattctgaacactttgcaaaacatcagcgaggggttggtggtttatcctaaagtcatagaacgtaggatcaggcaggagctgccctttatggccaccgagaacattataatggccatggtgaaagccggcggctcaagacaggactgccacgagaaaattcgggtgctatctcagcaggctgctagcgtcgttaagcaggaagggggagacaacgaccttattgagcgaatacaagtggatgcctatttttcaccgatccactcccagctggatcatttgctggacccctccagcttcacgggacgggccagtcagcaggtgcaaaggtttctggaggaggaggtgtatccgctgctgaagccctacgaaagcgtcatgaaagtgaaagccgagctctgtctgtag

SEQ ID NO: 107531 - DNA, 384 bp, Artificial Sequence
  Description of Artificial Sequence: Synthetic coding sequence
atggcagctggaggcgatcatggcagccctgatagttacagatcaccattagcttcaagatacgcaagccccgagatgtgtttcgtgtttagtgacagatacaagttccggacatggcgtcagctgtggctgtggctggccgaggctgagcagacacttggactccctattactgatgagcagatccaggagatgaagagcaacctggaaaatatagattttaaaatggccgccgaggaggaaaaaagactccggcacgatgtaatggcacacgtccatacatttggccattgctgtcctaaggcagccgggatcatccatttgggggcgacatcctgctacgttggtgacaacacagtcggagcctgtgtcgtgtacacctag

SEQ ID NO: 107532 - DNA, 1371 bp, Artificial Sequence
  Description of Artificial Sequence: Synthetic coding sequence
atggccttcgccgagacttaccccgcagccagcagcctgccgaatggggattgtggaaggcctcgggcgagacctggcggaaatagggtgacggtggtcctaggtgcgcagtggggtgacgaagggaaagggaaggtggtcgacctacttgcacaggacgccgacatagtgtgcaggtgccagggggggaacaatgccgggcatacagtcgtagtggatagtgtagagtatgattttcatctgcttccctccgggatcataaaccctaatgtcaccgcattcattggtaacggtgtggttatccacctccctggcctttttgaggaagctgagaagaatgttcagaagggtaaggggttggagggttgggaaaagcgtctgatcataagcgacagagcgcacatcgtctttgactttcatcaggctgcggatggaatacaggaacagcagcggcaggaacaggccggcaagaacttgggaaccacaaaaaagggtatcggccctgtctactcttccaaggccgcaaggagcggactcagaatgtgcgatttggtgagcgacttcgacggcttttccgagcgctttaaagtgctggctaaccagtacaagagtatataccctaccttggaaatagatattgaaggcgaactccaaaaactcaagggttatatggagaagatcaagccaatggtacgggatggagtctacttcttgtacgaggccctgcacggtccccctaagaagattctagtcgagggggccaacgccgcactgctggatatcgattttggaacttacccttttgtcacatctagcaactgtacagtcggcggcgtttgcactggactcgggatgccacctcaaaatgtaggggaggtctatggggtggtcaaggcctacaccacaagagttggcatcggcgcattccccactgaacaggacaatgaaatcggcgaactattgcaaacccgtggtcgagagtttggtgttaccacggggagaaaaagaagatgcggttggctggacctggtgctgcttaaatatgcccatatgattaacgggttcaccgccctcgccctcacaaagctcgacatattagatatgtttaccgaaataaaggtgggggtggcttacaagctggacggcgaaatcattcctcacatccctgcaaatcaggaggtgctgaacaaagtggaggtccagtacaaaaccctgccaggatggaatactgacattagcaacgcgagggcattcaaggagctgcctgtgaatgcacagaattatgtaagatttatcgaggatgagctccaaatccctgtgaagtggattggtgtggggaaatcccgggagagtatgattcagttgttctag

SEQ ID NO: 107533 - DNA, 1308 bp, Artificial Sequence
  Description of Artificial Sequence: Synthetic coding sequence
atggcctttgccgagacgtatccagcagcctcgagcctccctaatggggattgcgatgagggcaaagggaaagtcgtggatctcctggctcaagatgccgacatcgtatgccggtgtcagggtgggaacaacgccggacacaccgtggtcgtcgactcagtcgagtatgatttccacctactgccctctggtattataaatcctaacgttacagccttcataggcaacggcgtggtcattcatctgcctggactttttgaggaggctgagaagaacgtacagaaaggaaaaggactggagggatgggaaaagaggctgattatctccgatcgagcccatattgtctttgattttcatcaagctgctgacggaattcaagaacaacaaaggcaggagcaagcaggcaagaatttggggacaacaaaaaagggcattggccccgtgtactccagcaaggccgccaggagcgggctgaggatgtgcgatctggtgagcgacttcgatggtttcagcgagcgcttcaaagtactcgccaatcagtacaaaagtatctatccaaccctggagatcgacatcgaaggggaactacagaagcttaaaggctatatggagaaaatcaaacccatggtgagggatggggtgtattttctgtacgaagcgctgcatgggcccccgaagaagattctggttgaaggagctaacgcagcgttattggatatcgatttcggcacatacccttttgtgacctcatctaattgcacagtcgggggcgtgtgtacagggcttggcatgccccctcagaacgtgggagaggtttatggagtggtgaaagcctataccacccgcgtgggtattggcgcattccccacagaacaagataatgagattggggagctcctgcaaacaaggggacgggagtttggggttaccaccggcagaaagaggcgttgtggctggctggacttggttctcttaaagtacgcccatatgatcaatggtttcaccgcactcgccttgacgaaattggatatccttgacatgtttactgaaatcaaggtcggagtggcgtataagctggacggcgagattatcccccacatcccagcgaaccaggaagtgctgaacaaggtcgaagtgcaatataaaacactgccaggatggaacactgacataagtaacgcccgggccttcaaggagctcccagttaatgcccagaactatgtgcggtttatcgaggatgaattgcagatccccgtgaagtggatcggcgtcggcaagtcaagagaatcaatgatccaactattctag

SEQ ID NO: 107534 - DNA, 1236 bp, Artificial Sequence
  Description of Artificial Sequence: Synthetic coding sequence
atgtggatccagcaattactgggcctcagcagcatgtcaatcagatggccgggaaggcccttaggaagccacgcatggatactcatcgcgatgttccagctggccgtcgacctgcctgcctgcgaggctttggggccaggcccagaattttggttattacctaggagcccaccccgtccaccgagactgtggtcatttcggtctgggcagcctgccagggtgcccgcacccgtgtggagccctaggccaccccgcgtggagagaattcatggccaaatgcagatgcctcgagctagaagagcccatcggcctagagaccaggcggccgccctggtgcctaaggcagggctagccaaacctcctgcggctgcaaagagtagcccatccctggcaagttctagcagttcgtcatcctcagcggttgccggcggcgcgcccgaacagcaggctttactgcgaagaggaaaacggcatttacaaggcgatggtctgagttcattcgacagccgtggctcacggcccactactgagactgaattcatcgcctggggccccaccggcgatgaagaagccttagaatctaatacttttcctggcgtatatggtcccacaacagtcagcatactgcagaccagaaaaacgaccgtggcggcaaccacaacaaccacaaccaccgctactccaatgaccctccagacaaaaggatttaccgagtctcttgatcctaggcggaggatcccagggggcgttagcacaacggaacccagcacgagtccttccaacaatggcgaggtgactcaaccccctcggattttgggagaggcgagcgggctcgctgtccatcagattataacaataactgtttccctgatcatggtgatcgcggcattgatcacgacactcgtgctcaagaattgttgcgcacagtcgggaaacacaagacgcaattcacaccagcgcaaaactaaccagcaggaagaatcctgtcagaacttgaccgacttcccttctgcgcgcgttccttcctcgctcgatatcttcaccgcatacaacgagacactccagtgttcacacgaatgcgtgcgcgccagtgtacctgtctataccgatgaaactttgcactccactactggagagtacaagtccaccttcaatggtaaccgcccaagttcctctgaccgccacttgattcctgttgccttcgtgagcgagaagtggtttgagattagttgctag

SEQ ID NO: 107535 - DNA, 1236 bp, Artificial Sequence
  Description of Artificial Sequence: Synthetic coding sequence
atgtggatacagcagttgctaggactctcatctatgtccattaggtggccaggccgcccattaggatctcacgcttggattttgatagcaatgttccagctcgccgtggatcttcccgcttgcgaagctttaggtcccgggcctgagttttggctgttgccgagatcccccccccggcccccccgtctgtggagttttcggagcggccagcctgctcgggtgccggcaccagtctggtccccccgtcccccaagagtcgaacgaatccacggccagatgcagatgccgcgagcccggagggcccatagaccgcgcgatcaggcagcggccctggtccctaaggcaggcctggccaaaccacctgccgctgccaaatcttctccctcattggcgtccagctcttcaagtagcagctccgctgtggcaggaggggcaccggaacagcaggcgctgttacgccgcggaaagagacacctgcagggtgacggattgtccagttttgactcacggggaagccgccccaccacagagaccgagtttatcgcgtgggggccgaccggcgacgaggaggcactggagagcaataccttcccaggtgtgtatggaccaaccacagtgtccatcttgcagacaagaaaaacaactgtggctgcgacaactacaacaaccacgactgctacgcctatgacgcttcagacaaagggattcaccgaaagcctggacccaaggagacggattcctggaggagtgagcacaactgagccaagtacctcacctagtaataacggagaggtcacacagcccccacggatcctgggtgaggcttctgggctggccgtgcatcagatcattactatcacagttagcctgataatggtgatagccgcactgattaccacgctcgtcctcaaaaattgctgcgcccaatcagggaataccagaagaaattcccaccagagaaagactaatcagcaggaagagagctgtcagaacctaactgattttccttcagcgcgagttcccagcagtctggatatttttacggcatacaatgaaaccctccagtgcagccatgaatgtgttagagccagtgtacccgtgtacactgatgagacgctgcatagcactaccggcgagtacaagtctacattcaacgggaatcgaccgtcctcctcagaccggcacctcatacctgttgcgttcgtatcagagaagtggtttgagatatcttgttag

SEQ ID NO: 107536 - DNA, 1155 bp, Artificial Sequence
  Description of Artificial Sequence: Synthetic coding sequence
atggtctctggcgattacagtctaggcctcaatgacctgaatgtgtcaccgcctgaactgactgttcacgttggtgattctgccctcatgggctgtgttttccagagcacagaggacaaatgtatatttaaaatagattggacactatctcctggggagcacgctaaagatgagtacgtattgtattactactcaaatttaagtgtgcctatcgggcgcttccagaaccgcgtccacctaatgggggatattttatgtaatgacggatcccttcttctgcaggatgtccaggaggccgaccaagggacgtatatctgcgaaattcgcctcaaaggcgaatctcaagttttcaagaaagctgtggttctgcacgtgttaccagaggagcctaaagaattaatggttcacgtgggcggcctcatccagatgggctgtgtgtttcagtctacagaggtcaagcatgttactaaagtagagtggatcttttccggccggcgggcaaaggaagagatagtatttagatattaccacaagctcaggatgtccgttgaatattcccagagctggggacacttccagaatagggtcaacctcgtcggggatatcttcagaaacgacggatcaatcatgctgcaaggcgtgcgtgagtctgatggagggaattacacttgcagcatccacctcggcaatctggtattcaagaagaccattgttctgcacgtgtccccagaggaaccacgcactctagtgacccccgctgcattgcgtcctctagtgctgggaggcaatcagcttgtcatcatcgtcggcattgtatgtgctaccatactgctgttgcccgtgctaatacttattgtcaaaaagacatgtggtaataagagctctgtgaatagcaccgtgttggttaagaatacaaagaaaaccaaccctgaaattaaagaaaaaccatgtcactttgaaaggtgcgagggcgagaagcacatctactcccccatcattgttcgtgaagtgatcgaggaagaggaaccatcagagaagtcagaagctacatacatgaccatgcatcctgtctggccatcactgcggagcgaccggaacaattctcttgagaaaaagtccggaggcggaatgcccaaaacacagcaggctttttag

SEQ ID NO: 107537 - DNA, 1185 bp, Artificial Sequence
  Description of Artificial Sequence: Synthetic coding sequence
atgttttgccccctgaaactcattctgctcccagtgctgctggactatagcctcggactcaacgacctgaatgtcagcccacccgaactgactgtacacgtcggagatagcgcactaatgggctgtgtcttccaatctactgaagataaatgtatattcaagattgactggactttgagtccgggtgagcacgcaaaagacgaatacgtgctatattactatagcaacctgtcggttcccatcggtaggttccagaaccgagtccatctcatgggtgatatcctctgtaatgacggatctctcctactgcaagatgtgcaagaggccgatcagggaacctacatctgcgagattaggctgaagggagagtctcaggtctttaaaaaggcagtggtactccacgtcttgccagaggagccaaaagagttaatggtccacgtgggagggcttattcagatgggatgcgtttttcagagcactgaagtaaagcatgtgacaaaagtggaatggatattttctgggcggagggcaaaggaagagattgtcttccgttactatcacaagttgagaatgtctgtcgagtactctcagagctggggccatttccaaaacagagttaacttagtgggggacatctttagaaatgatggttctattatgttgcagggcgtgcgggaatccgatggagggaactacacgtgctccatacacttgggcaatctagtgtttaaaaagacaatcgtcctgcatgtcagtcccgaagagccacggacgttagtgacccctgctgcccttaggcctctcgtcttgggtggcaatcagctagtcattattgtgggtatcgtgtgtgccacgatcctgctcctgcccgtcctgattctcatcgtcaaaaaaacttgtggaaacaagtcaagtgtgaatagcacagtgctggtgaaaaataccaagaagacgaacccagagattaaggaaaaaccctgccattttgaacgctgcgaaggggaaaaacatatttactctcccataatagtgagggaggtgattgaagaggaggaacctagcgaaaagtccgaagccacctacatgacgatgcaccccgtgtggccatcccttagaagcgaccggaacaactcgttggaaaaaaagagtggaggtgggatgcccaagactcaacaggccttttag

SEQ ID NO: 107538 - DNA, 468 bp, Artificial Sequence
  Description of Artificial Sequence: Synthetic coding sequence
atgttttgtccccttaaactgatccttctgcctgtgctcctcgactacagcctcggtctgaacgatctgaacgtgtcacctccagaactaacggttcacgtcggagattcagcattgatggggtgtgtcttccaatccacggaggataaatgtattttcaagatcgattggactttgtcccctggcgagcatgcaaaggacgaatacgtcctctactattattctaatttatctgtccctatcggaagattccagaaccgcgttcacctgatgggggatatcctgtgcaatgacgggtcccttcttctacaggacgttcaggaagccgaccagggaacttacatatgcgagattagattaaaaggcgagtctcaggtgtttaagaaggccgtggtactgcatgtgctgcctgaggaaccaaaagagctgatggtgcacgtgggggggctgattcagatgggatgttag

SEQ ID NO: 107539 - DNA, 663 bp, Artificial Sequence
  Description of Artificial Sequence: Synthetic coding sequence
atgggctgcgtattccagtccacagaagataagtgtattttcaagatcgactggaccctgagtcctggggagcatgccaaagatgaatacgtgctctattattactcaaatttgagtgttcctattggcagatttcagaaccgtgtgcacctcatgggtgatatactgtgtaatgatggctctttactcctgcaagacgttcaagaggcggatcaaggaacatacatctgcgagatcagactgaagggcgagtcccaggtttttaaaaaggcggtagtcctgcacgtgctgcctgaggagccgaaagagctcatggtccacgtgggcgggctgatacaaatgggctgtgtttttcagagtaccgaagtgaagcatgtcacaaaagtagagtggattttctccggccggagagctaaggaggaaattgtctttagatactatcacaaactacggatgtcggtggaatattcacagtcgtgggggcacttccagaacagggtcaatttggttggcgatatcttcaggaatgatggatcaattatgctgcaaggtgttcgcgagtccgatggcggcaactacacctgcagtatccacctaggtaacttagtcttcaaaaaaactatcgtccttcacgtgagccctgaggagcctaggaagtggtag

SEQ ID NO: 107540 - DNA, 1128 bp, Artificial Sequence
  Description of Artificial Sequence: Synthetic coding sequence
atgagcagtcataaaggcagtgtggtggcgcaggggaacggggctcctgccagcaaccgagaagccgacaccgtggaattggcagaactgggtccacttctcgaagaaaaaggcaagcgggtgatcgctaaccctcctaaagctgaagaggaacaaacctgcccagttcctcaggaggaggaggaggaagtccgagtcttgaccctccccctgcaagctcatcatgccatggagaagatggaagagttcgtttacaaggtttgggagggtaggtggcgcgtcataccttacgatgttctccctgactggcttaaggataatgactatttgctgcacggacatcgcccccctatgccatcattcagagcctgtttcaagtctattttcaggatccatacggaaaccgggaatatctggacgcacctcctcgggtttgtgttgttcctcttcctgggaatcctgacaatgctgcggccgaacatgtactttatggctccactccaagaaaaagtggtgttcgggatgttctttttaggggcagtgttatgcctgtcctttagttggctttttcacacagtgtactgtcacagtgaaaaagtcagtcgcactttttctaagttagactattcagggattgccctattgattatggggtcgtttgtgccgtggctgtactatagtttttactgctcccctcagccccggctaatttacctctcaatcgtatgtgtactgggcatctcagccattatcgtcgcccagtgggacagatttgccaccccaaaacatcgacagactcgggccggggtgtttctcgggctgggactgtcgggagtcgtgcccacaatgcacttcactatcgccgagggctttgtaaaggctacaaccgtgggacaaatggggtggttttttctgatggccgttatgtatataacgggagcagggttatatgcagcacggataccggagagattcttcccaggcaaattcgacatctggtttcagtcccaccagattttccacgtgctggtggtcgcggccgcattcgtacatttctacggcgtgtctaatctgcaagagtttcggtatggcctggagggggggtgcacagacgacacactgctgtag

SEQ ID NO: 107541 - DNA, 516 bp, Artificial Sequence
  Description of Artificial Sequence: Synthetic coding sequence
atgtcatctcacaaggggtcagtagtagcccagggtaatggtgcccccgcctccaatcgtgaggccgacaccgtagagctcgcagagctcgggccattattagaggaaaagggcaaaagggttatagcgaacccacctaaagcggaagaagaacaaacttgccccgtgccccaggaagaagaagaagaggtgagggtactaactttaccactgcaagctcatcatgcaatggagaagatggaggagtttgtgtacaaggtgtgggaggggcgatggcgcgtgattccctacgacgtccttccggactggttgaaggataacgattatctactgcatggacataggccgcctatgcccagctttcgagcctgctttaagtcaattttcagaatccacacggagaccgggaatatttggactcatctgctcgctaccgcgcatctgccgcttcatagactgtgccccggtcacttctgccaccattgtggcgcggtcggacccgtgtgtcattcttag

SEQ ID NO: 107542 - DNA, 801 bp, Artificial Sequence
  Description of Artificial Sequence: Synthetic coding sequence
atgtccagtcacaaggggtccgtcgtggcccagggcaacggggcccctgctagcaatcgcgaagccgacaccgtagaactggcagaactgggaccacttctggaagagaagggaaagagggtaattgccaatcctcccaaggctgaggaggaacagacatgccctgtgcctcaagaagaagaggaggaggtaagggtcctgactttaccactccaagcgcatcacgcgatggagaagatggaggagttcgtttataaggtctgggaggggaggtggagagtcatcccatatgatgttttgccggactggctcaaagataacgattatcttcttcacggacatcgcccccccatgccctcttttagagcctgttttaagagcatattcagaattcataccgaaacgggaaacatatggacacacctgctgggcttcgtgctgttcctcttcctcggaatacttacgatgctgcggcccaatatgtacttcatggctcctctgcaggagaaagtggtctttggcatgttttttttaggcgccgtcctgtgcctttccttttcttggctcttccatactgtatattgtcactccgaaaaggtttcacggaccttcagtaagcttgactattcaggcattgctttgcttatcatgggcagctttgtcccttggctgtactactctttttactgttcccctcaaccgcggttgatatacctgtcgattgtttgcgtgttaggcattagtgcgataatcgtggctcagtgggaccggtttgcgacccctaagcacagacaaacttag

SEQ ID NO: 107543 - DNA, 618 bp, Artificial Sequence
  Description of Artificial Sequence: Synthetic coding sequence
atgagctcccataaaggttctgtcgtcgctcagggtaatggtgccccagccagtaatagagaggcagataccgtggaacttgcagaattaggtcctctccttgaggaaaagggtaaacgagtcattgccaatcccccgaaggctgaggaggagcagacctgtcccgttcctcaggaagaggaagaggaagttcgagtcctgaccctccccttacaggcgcaccacgctatggagaagatggaggaatttgtttacaaggtgtgggaaggcaggtggagagtgatcccatacgatgtgcttccagattggctcaaagacaatgactacctgttacatggccaccggcccccaatgccaagctttcgtgcctgctttaagtccatctttaggattcatactgaaactgggaatatttggactcacctgttaggcttcgtactgtttctatttctgggcatcctcactatgctacggcctaatatgtactttatggcccctctacaagagaaagtagtcttcgggatgtttttcctgggggctgtgctgtgtctcagcttcagctggctgttccatactgtctactgccactccgaaaaagtatcacggaccttttcttag

SEQ ID NO: 107544 - DNA, 1128 bp, Artificial Sequence
  Description of Artificial Sequence: Synthetic coding sequence
atgagttctcacaagggctctgtcgtggcacaagggaacggggccccggcatccaatagagaggctgacacagtggaactcgctgagttgggcccactgctggaggaaaagggaaaaagggttatcgctaacccccctaaggcggaagaggaacagacgtgtcctgtgcctcaggaagaggaggaggaggttcgcgtgcttactttacctctgcaggcccatcatgccatggaaaagatggaagaatttgtgtataaggtttgggaaggccgctggagggtgatcccttacgatgtgctccccgattggcttaaggataacgattacctgctccacggccacagaccgcctatgcctagctttcgggcctgctttaagagcattttcagaattcatacagagacggggaacatctggacccacctcctagggttcgtcctattcctcttcctgggaattctcaccatgcttcggccaaatatgtacttcatggctcccctccaagaaaaagtcgtgttcggcatgttttttcttggtgctgtgctgtgcctcagtttctcttggctttttcacactgtgtattgtcacagcgaaaaagttagtcgcaccttctccaaactggactatagcgggattgccttactgattatgggatctttcgtgccttggttgtactattccttctattgttcgcctcagccacggctcatttacctgtcaattgtgtgtgttcttgggatatcggctattattgtggcacagtgggatcgttttgcaacacctaagcataggcaaacacgcgcaggagtttttttgggcctgggcctcagcggagtcgtccccactatgcactttactattgccgagggcttcgtgaaagcgaccacagtcgggcagatgggctggttcttcctcatggctgttatgtacatcacaggggccgggctgtatgcagcaaggatacccgaaaggttttttccgggcaagtttgacatttggttccaaagccatcagatttttcatgtgctggtggtggcagcagccttcgtccatttttacggcgtgtctaacctgcaggagtttcgatacggcttagagggcgggtgcacagatgatacattgctgtag

SEQ ID NO: 107545 - DNA, 1161 bp, Artificial Sequence
  Description of Artificial Sequence: Synthetic coding sequence
atgaacgagcctaccgaaaaccggctcggttgcagcagaacacccgagccggacattcggctgcgaaaagggcatcagttagatgggacacgacgcggcgacaacgattcccaccagggtgacctggagccaatcctcgaggcatctgtgttatccagccaccacaagaagtcttctgaggaacatgaatactccgatgaggccccccaggaagatgagggctttatgggcatgtctccgctcttgcaggcccatcatgctatggaaaagatggaagaatttgtgtgtaaagtttgggagggtcgctggagggtcatcccacacgatgtgctgcccgattggctaaaggacaatgactttctgctgcacggtcaccgacctcctatgccaagcttccgcgcctgcttcaagagtatttttagaatccacactgagaccgggaatatttggacccacctgttgggttgtgtatttttcttgtgtctgggcatcttttacatgtttcggccaaacatcagctttgtggcgcctctacaggaaaaagtcgtttttggcctgtttttcctcggcgctattctctgcctttcattttcctggctgttccacaccgtgtactgtcacagtgagggcgtgtctcgtctcttctctaagttggattacagcggcatcgctctgttgatcatgggctcctttgtcccatggctttactattccttctactgtaacccccagccatgttttatttacctgatcgttatttgtgtactgggcatcgccgctatcatcgtgagccagtgggatatgtttgcaactccccagtacaggggtgtgcgtgctggagttttcctggggctcggcctaagtgggattatcccaaccctgcactacgtcatctccgaagggtttctgaaagctgcaaccattgggcagatcggctggcttatgcttatggcctcattgtacattaccggcgctgcgctctatgctgctaggatccccgaacggttctttccgggtaaatgtgacatttggtttcactcacatcagctgttccacatatttgtggtggccggggcattcgtccacttccacggcgtgtccaatctccaggagttcaggttcatgataggtgggggctgctccgaggaagatgccctttag

SEQ ID NO: 107546 - DNA, 735 bp, Artificial Sequence
  Description of Artificial Sequence: Synthetic coding sequence
atgcttctgctgggcgccgtccttctgctgctcgccttgcctggacacgaccaggagaccaccacacagggcccaggagtcctgctgccactgcctaaaggagcctgtactgggtggatggccggcattcctgggcacccaggtcacaatggcgcaccaggccgcgacggccgtgacggcactccaggcgagaagggagaaaagggagaccctggcctaatcggacccaaaggggatatcggggaaaccggtgtccctggcgccgagggtccgcggggttttccaggaatccaaggcaggaagggcgagccaggtgagggtgcttacgtctatcgctccgcctttagcgtgggcctggaaacctatgtgacgatccccaacatgcccatccgtttcaccaagatcttctataaccagcagaatcactatgatgggtctaccgggaagtttcattgcaacatcccggggctttattactttgcttaccacattacagtctatatgaaggacgtgaaggtgtctctcttcaagaaagataaagcaatgcttttcacttacgaccagtaccaggaaaacaatgtagaccaagcttccggcagtgtcttgctgcatcttgaggttggagatcaggtctggctccaagtgtacggagaaggagagaggaatggactttacgctgacaacgacaacgatagcaccttcaccgggttcctgctctaccacgacaccaattag

SEQ ID NO: 107547 - DNA, 735 bp, Artificial Sequence
  Description of Artificial Sequence: Synthetic coding sequence
atgttgctcttgggcgccgtactcctgctactggcgctgcccgggcatgaccaagagacaaccacccaggggcccggggtgctacttccgctccctaaaggtgcatgcacaggatggatggccggcataccaggacacccaggccacaacggagcaccaggacgtgatgggcgggatggcacccctggtgaaaaaggagagaagggcgaccctggcttgatcgggccgaaaggggatatcggtgaaactggggtgccgggtgctgaaggccctaggggcttcccgggaatccaggggagaaaaggggagcccggcgagggcgcttatgtctatcgcagtgctttttccgtagggctcgagacctatgtgacaatccctaacatgccaataagattcacaaaaattttttataaccaacagaatcattacgacggctccacagggaaattccactgcaatatccccggtctgtattacttcgcctatcacattaccgtctatatgaaggatgttaaagtgtctctattcaagaaggataaagccatgctcttcacttatgaccagtatcaagagaacaatgtggaccaggcctctggatctgtgctgcttcatctggaggtcggcgaccaggtctggctccaggtgtatggtgaaggtgagagaaatggcctgtacgctgacaacgataatgacagtacctttaccggctttctgctgtatcatgacactaactag

SEQ ID NO: 107548 - DNA, 735 bp, Artificial Sequence
  Description of Artificial Sequence: Synthetic coding sequence
atgttactgctgggggccgtactgctcctgctcgccctgcccggacatgaccaagagaccaccacgcagggtcctggggttctcctgcccctccccaaaggggcctgtactgggtggatggccggcattcctggacatcccggtcacaatggggctccggggcgtgacgggcgcgacggcactcctggagagaaaggagaaaaaggcgaccccggcctcatcggaccaaagggggatatcggggagacgggggtacccggggcggagggaccacgggggtttcctggaatccagggcaggaagggtgaaccaggtgagggagcctacgtgtataggtcagcgttctccgtgggcctggagacatatgtaacgatacccaatatgcccattaggttcactaagatcttctataatcagcagaatcattacgacggcagtacaggaaagttccactgcaatataccagggttgtactattttgcataccatataacagtatatatgaaagatgttaaggtcagtctgtttaagaaagacaaagccatgctcttcacttatgatcaatatcaggaaaataacgtggaccaagcaagcggtagtgtgctgttacaccttgaggtgggggaccaggtgtggttgcaggtctacggagagggagagaggaacggactgtacgcagataacgataacgactcgacatttacgggattccttctgtaccatgacacaaattag

SEQ ID NO: 107549 - DNA, 1491 bp, Artificial Sequence
  Description of Artificial Sequence: Synthetic coding sequence
atggcattgtggagagggtcagcatacgcaggatttttagcactggctgtaggatgcgtgtttctgcttgaacccgagcttcctggctccgccttgcgctcgctctggtcttctttgtgtctcggaccagcgcctgccccccctgggcccgtgtcccctgagggacggctggctgcagcttgggacgctctgatcgttaggccagtacgaagatggaggcgggtggcagtgggggtaaatgcctgtgttgatgtggtactctctggagtgaaactgctgcaggcactcgggctcagtcccggcaatgggaaggaccactctattctccactcacggaacgacctggaggaggcctttattcatttcatgggtaaaggtgctgccgcagagcggttctttagtgacaaggaaacttttcacgacatcgcacaagtcgcctccgagttccctggagcccaacactacgtgggcgggaacgcggcactgattggacagaaattcgctgccaactccgacctgaaggttctgctatgtggccctgttggccccaagcttcacgaactgctggacgataacgttttcgtccccccagagtctctccaggaagtcgatgaattccacctgattctcgaataccaggctggggaagaatggggccagctcaaggccccacatgccaaccgcttcatctttagccacgatttgagcaacggcgctatgaacatgttagaggtctttgtttcatctctcgaagagtttcaaccagacctggtagtgctgagcggattgcatatgatggaagggcagagtaaggaactccaacgcaagcgcttattggaagtagtcactagcattagcgatatccctaccggcattcccgttcatctagaactggcttccatgaccaatagggaactgatgagcagcatcgttcaccaggtcttccccgcagtcacgtccctaggcctgaatgagcaggaattgttgttcctgacgcagtccgcatccggcccccattcttccctgagctcctggaatggcgttccagacgtcgggatggtctcagatatcctattctggattcttaaggagcacggccgctccaagtctagggcatccgatctcaccagaatccacttccataccttggtttatcacattctcgccaccgttgacgggcactgggctaaccagctggcagccgtcgcggccggcgccagagtggccggcacccaggcctgcgctaccgaaacaatcgatacaagccgggtatctctacgtgccccccaggaattcatgacctcacactctgaggccggttctagaatcgtcttgaatcccaataagccagtggtcgaatggcaccgcgagggcatttcctttcacttcactccagtcctcgtctgcaaggacccgattcggacggtgggcctgggcgatgccatttcagcagaaggactcttttacagtgaagtacatccacattattag

SEQ ID NO: 107550 - DNA, 1041 bp, Artificial Sequence
  Description of Artificial Sequence: Synthetic coding sequence
atgggtaagggagcggctgctgagcgtttcttttcagacaaagagacctttcacgatattgcacaagtggctagtgaatttcccggtgcccagcactatgtgggagggaatgcagcgctgataggccagaagttcgccgcgaacagcgacctgaaggtcctgctgtgcgggcccgtgggacctaaattgcacgaactactggacgacaacgtatttgtgccccctgagtccctccaggaggttgatgagtttcatctgatcctggaatatcaagctggagaagaatggggacagctcaaggcgccccacgcaaatcggttcatcttcagccacgacttaagcaatggagccatgaatatgctcgaggtttttgtgtcttccctggaagagtttcaaccagacctcgtggttctctccggactgcacatgatggaaggccagagtaaagaactgcagcgaaagaggttgttggaggtggtgaccagcatcagcgacatccctaccggtatccctgtacacctggagttagcttctatgacaaatcgagaattgatgtcttcaattgttcatcaacaagtcttccctgcagttactagcttggggttgaacgaacaagagcttctcttcctgacccaatctgccagcgggccacattcctccttgtccagctggaacggcgtgcccgatgtgggtatggtttcagatatcctattttggattctcaaagaacacgggaggagcaagagcagagcaagtgatctgactagaattcactttcataccttagtctaccatatcctggccactgtggacgggcactgggccaatcagctcgcagctgtggcttcttcctgcgggtgggacaccggtctacggcaccggaaccaccgacaccagccctctgtgtcagagggcacaccgagggttcacgacttcccatttggcggccgtctccaggattgtatcaagcctaagcaggcgagcagtcgcatggcacaacgtgggaatatattacccttgcatacctccattggagtctag

SEQ ID NO: 107551 - DNA, 1251 bp, Artificial Sequence
  Description of Artificial Sequence: Synthetic coding sequence
atggccctgtggaggggctccgcgtacgccggctttcttgcgttgggattatccccagggaacggaaaggaccacagtatcctgcattccaggaatgacctggaagaagcttttatccatttcatggggaagggcgctgccgcagaaaggtttttctccgacaaggagacttttcatgacattgctcaggtcgcgagtgagtttccaggagcccagcattacgtcggaggcaacgccgcccttatagggcaaaagttcgcagccaactccgacctgaaagtcctgctttgtggccccgttggcccgaaactgcatgagcttcttgacgacaacgtcttcgtccccccagagtcactgcaagaggtggacgaatttcacctaattctcgaataccaggccggggaggaatggggacaattgaaagccccccacgccaacagattcattttctcccatgacctcagcaacggagccatgaatatgctagaagtcttcgtttcgtcattggaggaatttcaaccggatctggtggttctcagcgggctgcacatgatggagggtcaatccaaagagctccagaggaagagattactcgaagtggtaacatccatcagcgatatcccaactggaatcccagtgcacctggagctcgcttctatgaccaaccgggagctgatgtcctcaatcgtccaccaacaggtgtttcctgctgttacctctctgggactgaacgaacaggaactcctgtttttaacacagtccgcatccgggccacatagcagcttgtctagctggaacggggtgcccgacgtcggcatggtgagtgatatccttttttggattctcaaagagcacgggaggtccaagagccgtgcgagcgatctgaccaggattcattttcacacactcgtttaccacatcctggctacagtggacggccactgggccaaccagctggccgctgtcgctgcaggagcaagggtcgccggcactcaagcttgtgccacagaaaccatcgatacatcacgcgtcagcctccgtgccccccaggagttcatgacgtcccatagcgaagccggttcaagaattgtgttgaatcccaataaacctgtagtcgaatggcatagagaaggaatcagcttccatttcaccccagtgctggtatgcaaagacccaattcgcactgtgggactgggtgacgcaatcagtgcagaaggcctcttttattccgaagttcatccccattattag

SEQ ID NO: 107552 - DNA, 669 bp, Artificial Sequence
  Description of Artificial Sequence: Synthetic coding sequence
atggccgctagttgtagagtggtcacttctatttcagatattcccaccggcattcccgtacacctggaattagcttcgatgactaatagagagctcatgtctagtatcgtgcaccaggtgtttcctgcagtcacgtctctcggactgaatgaacaggagttactgttcctgacccaaagcgcatcaggcccacatagcagcctgtctagctggaatggcgtgcctgatgtaggcatggtgagcgatattcttttctggatcctgaaagaacacggcagatctaagagccgagcttctgatctgacccggatccacttccacactctggtatatcatatcctagctaccgtggacggccattgggctaaccagctcgccgcagtcgccgccggcgccagggtcgccgggacacaggcctgtgctacggagactatcgacacctctagagtctctcttcgagccccccaggaatttatgactagccactctgaagccggctccagaatagtgttgaatccaaacaagcctgtggtggagtggcaccgggaaggcattagcttccactttactcctgtactggtgtgcaaggatcctattcggaccgtgggcctgggggacgctatcagcgctgaagggctcttttacagcgaagtgcatccgcactattag

SEQ ID NO: 107553 - DNA, 546 bp, Artificial Sequence
  Description of Artificial Sequence: Synthetic coding sequence
atgggcaatattttcgctaatctgtttaaaggactttttggcaagaaggagatgcgcatcctcatggttggtctcgacgcggctggtaagactacgatcctgtacaaactgaagctgggcgagatagtcactacaatcccaaccataggattcaatgtagagactgtagagtacaaaaacatctccttcaccgtgtgggatgtgggcggacaggacaagatacgaccgctgtggcgacactatttccagaatacccagggtttaatctttgttgtagattctaacgaccgcgaaagagtcaacgaggcacgcgaagaactcatgcggatgttagcagaggatgagctgagggacgcggtgttactagtgtttgctaataagcaggatttgcccaatgctatgaacgccgccgaaattacagacaagcttggcctgcactctctgcgacaccgaaactggtacatacaggctacatgcgcaacaagcggggacgggctgtacgagggactggattggctgtctaaccagctgcggaaccagaaatag

SEQ ID NO: 107554 - DNA, 546 bp, Artificial Sequence
  Description of Artificial Sequence: Synthetic coding sequence
atggggaatatttttgccaacctgtttaagggccttttcggaaaaaaagaaatgcggattttaatggtgggattagatgcagccggtaagaccacgatcctgtacaagctcaagctgggcgagatcgttaccacgatccccactatcgggttcaatgtagagaccgtggaatacaagaatattagcttcaccgtgtgggacgtcggggggcaggataaaattaggcccctctggcgccattattttcagaacacgcagggcctgatttttgtggtcgactctaacgatcgagagagggtaaacgaagctcgcgaggagcttatgcgcatgttagctgaagacgagctgcgggatgccgtcctgttagtcttcgccaacaaacaagatcttcctaacgccatgaatgccgcggagatcacggacaagctgggacttcactcgctccgccaccgaaattggtacatccaagctacatgcgccacatccggcgacggactttacgagggattggactggctgtctaaccagctgagaaaccaaaaatag

SEQ ID NO: 107555 - DNA, 546 bp, Artificial Sequence
  Description of Artificial Sequence: Synthetic coding sequence
atgggcaacatctttgctaatttgtttaaaggcctctttggaaagaaagagatgcggattcttatggttgggttggacgctgctgggaaaacaacaatcctttacaagctcaagctgggcgaaatcgtcactacaataccaacaatagggttcaatgtcgaaaccgtggagtacaagaacatttccttcacggtctgggatgtcggcggacaggacaagatccgtcccctgtggaggcattattttcagaacacacaggggctgatctttgtggtggactctaacgaccgagagagagtgaatgaggcgagagaggaattgatgagaatgcttgctgaggatgaacttcgagacgctgtgctgctggtgttcgcaaataagcaggatcttcctaacgcaatgaacgcagcggaaatcaccgacaaactcggactgcatagtttacgacatcgcaactggtatatacaagctacgtgtgccaccagcggagatggactgtatgagggtttggactggctaagtaaccagctccggaatcagaagtag

SEQ ID NO: 107556 - DNA, 519 bp, Artificial Sequence
  Description of Artificial Sequence: Synthetic coding sequence
atgggcaacattttcgccaatctgttcaaagggttattcggcaagaaggaaatgagaattctgatggtgggcctagatgccgccggaaaaacaaccattctctacaaattgaaactaggggaaattgttacgacgatccctaccatcggttttaacgtggaaacagtagagtacaaaaacatctccttcactgtgtgggacgttggcgggcaggacaaaattcgtcctttatggcggcattatttccagaatacccaggggcttattttcgtggtcgacagcaatgatagggagcgggtgaacgaggctcaagacgagcttcgcgacgcggtgctgctggtgttcgcaaataaacaggatctgccaaatgcaatgaatgccgcggaaattacagataagctgggtttgcatagcctccgacatcggaactggtatatccaggctacatgcgcaacatcgggcgatggcctgtacgaaggactggactggctctctaaccagcttcggaaccagaaatag

SEQ ID NO: 107557 - DNA, 546 bp, Artificial Sequence
  Description of Artificial Sequence: Synthetic coding sequence
atggggaacatctttggcaacctgctgaaatccctaattgggaaaaaggagatgaggattcttatggttggtctcgatgccgccgggaagacaactatactttataagctgaagttaggagagattgtcacaactatcccgacaataggcttcaacgtagaaacagtagagtacaaaaacatctcattcacagtatgggacgtgggcggtcaagacaaaattcggccattatggcgacattattttcaaaacactcagggccttatcttcgtcgtggacagtaacgaccgggagagggttaatgaagcccgtgaggaactcatgcgtatgcttgcagaggatgaactcagagacgctgttctgttggtgtttgctaataagcaggacctccccaacgcgatgaatgccgcagaaattactgacaagctcgggctgcacagcctgcgacatagaaactggtacatacaagccacatgtgccacaagcggagacgggctgtatgaaggtctcgactggttggctaatcagttgaagaacaaaaagtag

SEQ ID NO: 107558 - DNA, 435 bp, Artificial Sequence
  Description of Artificial Sequence: Synthetic coding sequence
atggggaatatctttgggaacctcctgaagagcttaattggtaagaaggaaatgcggatacttatggtgggcctcgatgctgccggcaaaaccacaatcctgtacaagctgaagctgggcgagatcgtaaccacaattccaacaattgggctgattttcgtggtggactctaacgaccgggagcgggtgaatgaagccagggaggagctcatgcgcatgctggccgaagatgagttgcgcgacgcggtcctgctcgtattcgcgaataaacaggatctcccaaatgcaatgaatgctgcagaaataacggacaaactaggcctgcacagcctgcgtcacaggaactggtacatccaggccacttgcgcaaccagtggtgatggcctttatgagggactggattggttggccaaccagctgaagaataaaaagtag

SEQ ID NO: 107559 - DNA, 153 bp, Artificial Sequence
  Description of Artificial Sequence: Synthetic coding sequence
atggggaacatcttcggcaatctgctcaagtccttgattggaaaaaaggagatgaggattttgatggttgggctcgacgcagcagggaagaccaccatactctacaaactaaagctcggcgagatcgtgactaccatccctactatcggttag

SEQ ID NO: 107560 - DNA, 309 bp, Artificial Sequence
  Description of Artificial Sequence: Synthetic coding sequence
atgggtaacattttcggcaacctgctcaagagccttattggtaagaaggagatgcgaatcctgatggtcggcctcgatgccgcgggaaagactacaatcctgtacaaactgaagctgggggagatcgtcacgaccatccccaccatcgggtttaatgtggaaacagtggaatacaagaatatttcgttcacagtttgggatgttggagggcaggataaaatcagacccctatggcgtcattactttcaaaacacacagggactgatttttgtcgtcgactccaatgaccgggaacgagtgaacgagtag

SEQ ID NO: 107561 - DNA, 546 bp, Artificial Sequence
  Description of Artificial Sequence: Synthetic coding sequence
atgggaaacatctttggaaacctgttaaagagccttatcggcaaaaaggagatgagaatcctgatggtcggcttagacgccgctgggaagactaccatactatacaaactcaagttgggggaaatagtgacaaccatcccgacgatcggatttaatgtcgagacagtggagtataaaaacataagctttactgtatgggacgtgggcggacaagacaagataagaccgttgtggagacactatttccagaacacccagggcctgatttttgtcgtcgattcaaacgatcgcgaacgtgtgaatgaagcacgggaagagctaatgcgcatgcttgcagaggacgagctcagagacgctgtattgctggtgtttgcaaacaaacaggaccttcccaacgcaatgaacgccgctgaaatcaccgataagttgggactccactctctccgtcatcggaactggtacatacaggcaacctgcgccacaagcggcgatgggttgtatgagggacttgattggctggccaatcagctgaagaacaaaaagtag

SEQ ID NO: 107562 - DNA, 123 bp, Artificial Sequence
  Description of Artificial Sequence: Synthetic coding sequence
atgggcaatatttttggaaaccttctgaagtccctcatcggaaagaaggaaatgcgcattctcatggtgggcctcgatgcagccgggaaaaccacaatcctgtacaagctgaagttgggctag

SEQ ID NO: 107563 - DNA, 543 bp, Artificial Sequence
  Description of Artificial Sequence: Synthetic coding sequence
atgggcctcactatttcttctcttttcagcaggctcttcggcaagaagcagatgagaatcctgatggtcggtctggatgctgccggtaagactactatactatacaagctcaagctgggggagatagtgactactattcccacgattggcttcaatgtcgaaaccgttgaatataagaacatttgtttcaccgtgtgggacgtcggtggccaggatcgtattagaccactttggaaacactacttccagaacacccagggcctgatattcgtcgtggatagcaacgatagagaacggattcaggaggtggcggatgaactgcaaaaaatgttgctggtcgacgagctgcgggacgccgtgcttctgctgttcgcaaacaagcaggatctcccgaacgccatggcgatcagcgagatgactgacaagctgggcctgcaatcactgaggaacagaacatggtatgtgcaggccacctgtgcaacacagggtactgggctatacgagggcctggattggttatccaatgagctcagcaaacgctag

SEQ ID NO: 107564 - DNA, 384 bp, Artificial Sequence
  Description of Artificial Sequence: Synthetic coding sequence
atgggcctgaccatctcatctctgttctcacgcctgtttggtaaaaagcagatgcgaattctgatggtcgggttagacgctgcaggcaaaacgacgattctgtataaattgaaactaggggagattgtaaccacaataccaactattgggttcaatgttgaaactgtggagtataaaaacatatgcttcacagtctgggacgtgggcggacaagatcggatacggcctctgtggaagcattactttcagaacactcagggcctgattttcgtggtggattcaaatgacagggagcgcattcaggaggtcgccgatgagctgcaaaaaatgctgctggtcgacgagttgcgtgatgcagtcctgttgcttttcgcaaacaagtag

SEQ ID NO: 107565 - DNA, 69 bp, Artificial Sequence
  Description of Artificial Sequence: Synthetic coding sequence
atgggactaactatcagttcgctctttagcagactctttggaaagaagcagatgagaatccttatgtag

SEQ ID NO: 107566 - DNA, 543 bp, Artificial Sequence
  Description of Artificial Sequence: Synthetic coding sequence
atgggcctcaccgtgtctgcgctcttcagccgcatatttgggaaaaaacagatgcggatcctgatggtgggactcgatgccgcaggaaagactaccattttatacaaattaaagctcggcgagatcgtgacaactatcccaacaatcggctttaacgtcgagacagtcgagtataagaacatctgctttacagtttgggacgttggaggacaagacaaaatcagaccgctgtggaggcattacttccagaatacccagggtctcatcttcgtggtcgattctaacgatagggagcgggtccaagagtctgctgacgagctgcagaaaatgcttcaggaagatgagctgagagatgctgtcctcctggtgttcgccaataagcaggatatgcccaacgccatgcctgtgagtgaactgaccgataagctgggcctacaacacctgcggtcgagaacctggtatgtccaagccacctgcgccactcaaggcaccggcctctatgacggcctcgactggctgtctcacgagctgtcaaaaagatag

SEQ ID NO: 107567 - DNA, 1245 bp, Artificial Sequence
  Description of Artificial Sequence: Synthetic coding sequence
atggcgtctccccgcacgaggaaagtcctgaaggaggtgagagttcaagacgagaataatgtctgcttcgaatgtggcgcctttaacccccaatgggtctctgtgacatacgggatctggatttgtctcgagtgctccggtcgacatcgcggcctcggcgtccacctatcttttgttcgatcagtcacaatggataaatggaaggacattgagttggagaaaatgaaggcaggcggcaacgcaaaatttcgtgagttcctagaatcccaggaagactatgacccgtgctggtccttgcaggagaagtacaactcccgagccgcagcgctgttccgggacaaagttgtggcgctggccgagggccgtgaatggtctcttgagagttcacccgctcagaattggaccccaccacagccccggactcttccttccatggttcatcgcgtgagcggccaaccacagagtgtcaccgctagttctgacaaggcttttgaagactggctgaatgatgacctcggatcctatcagggcgcccagggcaaccgatacgtgggcttcgggaacaccccaccgccgcagaaaaaagaagatgacttcttaaacaatgccatgagctctctgtattccggttggtcatcttttacaactggagcatccaggttcgcatcggccgccaaggaaggagctactaagttcggaagccaagcttcacagaagttctggggccacaaacaacagcccgaaccagctagtgagcttgggcactcactgaatgagaacgtgctaaagcctgcccaggaaaaggtgaaggaaggtaaaattttcgatgacgtcagctcaggggtgagtcagttggcgtccaaaggagtggggagcaaggggtggagagacgtgaccacattcttcagcgggaaggccgaaggaccgcttgactcacctagcgaggggcacagctaccagaattccgggctggaccacttccaaaattcaaacatcgatcagagcttttgggaaacctttgggtccgccgaacccacaaagacacggaaatccccttcatctgattcatggacttgtgctgacacaagcacagagcgcaggtcctccgatagctgggaggtgtggggctccgctagtaccaataggaacagcaactccgatgggggcgaggggggtgagggtacaaaaaaggcagttcctcccgccgtgcccacagatgatggttgggacaatcagaactggtag

SEQ ID NO: 107568 - DNA, 1212 bp, Artificial Sequence
  Description of Artificial Sequence: Synthetic coding sequence
atggcctctcccagaacacggaaggtgttgaaagaggttagagtgcaggatgaaaataacgtttgctttgagtgtggggcgtttaaccctcagtgggtatccgtcacttacggaatctggatttgcctcgaatgttcaggtcgccacaggggcctgggcgtgcatctcagctttgtgaggtcggttacgatggacaaatggaaggacatcgagctggaaaagatgaaagccggcggaaacgccaagttcagagagttccttgagtcgcaggaagactatgatccatgttggtccctccaagagaagtacaatagtagggccgccgccctgttccgagacaaggttgtcgccctcgccgaagggagagagtggagtctggaatcttcccccgcgcagaactggactcccccacaacctcgcactctgcctagcatggtacaccgggtatcgggccaaccacagtcggtgacagcatcctcagacaaagcttttgaggattggctgaacgatgacttgggtagctatcagggggctcaagggaaccgctatgtgggctttgggaacaccccacctcctcagaagaaggaagacgacttcctcaataacgctatgtcctccctgtactctggatggagctctttcacaacgggggctagccggtttgcctctgctgccaaggagggagctacaaagtttggatcgcaagcctctcagaaggcaagcgagctgggccactctcttaacgagaacgtcctaaaaccggcacaagagaaggtcaaggaaggtaagatttttgatgatgtgtcttctggcgtgtcccagctggcctcaaaatgccaacggcgcctttgttgtcatcaaagtcattgcagcgcgggacatttggggagggcattctgccccgtctcttggcacgaggccctctgcggacagacaggcagagaagagcaggcttcactgctgccgcctaagcacgtggtcggtgcactggaggtttgcgcacgcggctgccccagatgccacgtcccacacacccctggtacagcggctgagtggcccggcaggctgtgcctgtcccgcgaatccgttgttcgcgacggagggaccagccctccattcttccggggtaagcagcgggccccgtggacagctcctcgtagggccacagttataagaacagcagtgtggaccacttctaaaactgctacatag

SEQ ID NO: 107569 - DNA, 1221 bp, Artificial Sequence
  Description of Artificial Sequence: Synthetic coding sequence
atggcatctcccagaacgcggaaggtgttgaaagaagtgagggtacaggatgaaaataacgtgtgcttcgagtgcggagctttcaacccccagtgggtaagcgtaacctacggtatttggatttgcctggagtgcagtggaaggcaccggggtctaggcgtgcatctcagctttgtgaggtccgtgacgatggataaatggaaagatatagaattggagaaaatgaaggccggcggcaatgcgaagtttagagagttcctggaatcccaggaagattatgacccttgttggtctttgcaggagaagtacaattctagagcagctgctttattccgtgataaggtggtggctcttgcagagggcagggaatggagtctcgaatctagtcctgcacaaaactggactcccccgcaaccccggactctacctagcatggtgcatagggtctcaggccagccacagtccgtgacagccagcagcgataaagcgttcgaggattggctaaacgatgatcttggctcgtatcaaggggcacagggaaaccgctacgttgggttcgggaacacaccgcctccgcagaaaaaggaagatgactttctgaacaatgccatgtcatctctttatagcggatggagttcctttactacaggggcttctagattcgcctctgccgccaaggagggagctacgaaatttggctcccaggcatcacagaaggcctcggaacttgggcactcactgaacgagaatgttctgaagccggcgcaggaaaaagtgaaagagggaaaaatctttgatgacgtttcatcaggcgtttcccagctggcttccaaggtgcagggagtaggctctaaaggatggcgtgatgtcactacttttttctcaggtaaggccgagggcccccttgactctccttcagaggggcattcatatcagaactcaggactggatcactttcagaatagcaacattgaccagagcttctgggagacttttggcagtgctgaaccaactaaaacaagaaagtccccaagtagtgacagctggacgtgcgctgacacttcgacggagcgccgcagctctgactcctgggaagtttgggggtcggctagtaccaatcgcaattccaatagtgatgggggagagggcggtgaagggaccaaaaaggcagttccccccgcggtgcctacagatgacggatgggacaaccagaattggtag

SEQ ID NO: 107570 - DNA, 882 bp, Artificial Sequence
  Description of Artificial Sequence: Synthetic coding sequence
atgcttagctctgaatccagctggtccctgaggaggataaccattcttgcaggcccttgtaggcgatctacaaccgccgagcctcgcccttccttaggcatcagagtgagcggacaacctcaaagcgtgactgcctcctctgataaggctttcgaagactggctgaacgacgacctcgggagttatcaaggggcccagggtaacaggtacgtgggattcggaaacacaccaccaccgcaaaaaaaggaagatgactttctgaataatgctatgagcagcctttactcagggtggagttctttcactactggagccagtcgatttgcctcagccgctaaggagggggccactaaatttggctcacaggcttcgcaaaaggcatcagagctggggcactcactgaacgaaaatgtcctcaagcctgcgcaggaaaaggtgaaagagggtaagatattcgacgatgtgagcagcggcgtctcccaacttgctagtaaggtgcaaggggtggggtctaaggggtggagggacgtgacaaccttctttagcggaaaagcagaaggtccattagactccccaagtgaaggacattcataccagaatagtggtctggaccacttccagaattcaaacattgaccagtccttttgggaaacgtttggttctgcagagcccactaagacccgcaagtcacccagctcggattcatggacgtgtgcagataccagcaccgaacggcggagcagtgattcttgggaggtctggggaagcgcatcaaccaaccgcaactccaattcagacggcggagaggggggggagggtaccaaaaaagccgtaccgcccgccgtgcctactgatgacgggtgggacaaccagaactggtag

SEQ ID NO: 107571 - DNA, 1086 bp, Artificial Sequence
  Description of Artificial Sequence: Synthetic coding sequence
atgaggacaaccttcgtgcgctctgtaacaatggataagtggaaggacattgagttggaaaagatgaaagctggcggaaacgcaaagttccgtgagttcctcgagtcccaagaggattatgatccgtgctggtctctccaggaaaaatataatagcagggctgccgccctgttccgtgacaaagtggtggcacttgcagagggccgagagtggtcactggagtctagtccggcacagaactggaccccgccgcaacctcgaaccttgcctagcatggtacatcgcgtctccggacaaccacagagcgtcaccgcgagctccgacaaggcgtttgaggactggctaaacgacgacttggggtcttatcagggggctcagggtaatagatacgtcggtttcggaaacacaccccccccacagaagaaagaagatgactttttaaacaatgcgatgtccagtctgtattctggttggtcatcattcaccaccggtgcctcgcgttttgcttccgcagccaaggagggggcgacaaaatttgggtctcaggcctcccagaagttttggggccacaagcagcagccagagccagcttcagagctggggcactctctcaatgagaatgtcctgaagcctgcacaggaaaaggtgaaagaaggcaaaatttttgacgacgtgtccagtggagtgtctcagctggcatccaaaggcgtcgggtcaaaaggatggagggatgtgacaaccttcttcagcgggaaggcagagggccctctcgattctccttccgagggtcactcttatcagaatagtgggctggaccactttcagaacagcaacatcgatcagagtttttgggagacctttggcagcgccgaaccaactaaaaccaggaaatcaccctcatccgatagttggacttgcgcggacaccagcaccgagcgccgatcctccgactcctgggaagtgtggggcagtgcctccaccaacaggaacagcaatagtgacggcggagaaggcggcgaaggcaccaaaaaagctgtgccaccagccgttccgaccgatgacggatgggacaaccaaaactggtag

SEQ ID NO: 107572 - DNA, 786 bp, Artificial Sequence
  Description of Artificial Sequence: Synthetic coding sequence
atggccagcccccggacacggaaggtcctcaaagaagtgagagtgcaggacgagaataatgtttgtttcgagtgtggcgcctttaacccacaatgggttagtgtcacttacggaatatggatttgtctggaatgttctggtcgccacagggggctgggagtgcatctgagctttgtgagatcagtcacgatggacaaatggaaagacatagagctcgaaaaaatgaaagcaggcggcaatgctaagtttagggaatttctggaatctcaagaagactacgacccatgctggtccctgcaggagaaatacaacagtcgcgcggcagctctgttcagagataaggtcgtcgctttggcagagggcagagaatggtcactggagagcagccctgcacagaactggacaccgccgcaacctcgtaccttacctagtatggtacatagagtgagcggccagccccagagcgttactgcatcctccgataaagcatttgaagactggctcaacgatgacctcggaagctaccagggagcacagggtaatcgctacgtcgggttcggaaacacgcccccaccccaaaaaaaagaggacgatttccttaacaacgctatgtcttctctctactccggttggtcctcatttaccaccggcgcaagccggttcgcaagcgcagctaaagaaggcgccactaaattcggatctcaggcatcccaaaaggcaagcgaactaggccacagcctgaatgagaacgttctgaaaccggcccaggagaaagttaaagagtag

SEQ ID NO: 107573 - DNA, 240 bp, Artificial Sequence
  Description of Artificial Sequence: Synthetic coding sequence
atggccagccctcgcacccggaaggtgttaaaggaggttcgcgtgcaagatgaaaataatgtgtgtttcgagtgcggggcgttcaacccccagtgggtgtcagtcacttacggcatctggatttgtctcgaatgtagtggaagacatcggggattaggcgtccatctcagtttcgtaaggagcgtgacaatggacaagtggaaggacatcgagctagagaaaatgaaggccggcggctag

SEQ ID NO: 107574 - DNA, 369 bp, Artificial Sequence
  Description of Artificial Sequence: Synthetic coding sequence
atggctagtccccgaacgaggaaagttctgaaagaggtgcgagtgcaggacgaaaataacgtgtgtttcgagtgcggggcctttaacccacagtgggtgtcagtgacctatggcatttggatctgcctagagtgttccggccggcaccgggggttaggcgtacatctttcatttgtacgtagcgttaccatggacaagtggaaggatatcgaattagagaaaatgaaagccggcggaaatgcaaaatttcgcgagttccttgagtcccaggaggattacgacccgtgttggtctcttcaggaaaaatacaattctagggccgctgcactgtttcgtgataaagtggtcgcccttgccgagggccggtag

SEQ ID NO: 107575 - DNA, 759 bp, Artificial Sequence
  Description of Artificial Sequence: Synthetic coding sequence
atggtggccagcatgagactggcttaccaagaactgcaaatagatagaaaaaaggaagaaaagaagctgcagaatctggagggaaagaaacgggagcaggccgagaggctggggatgggcctggtcagcagatcttctgtgagtcacagcgttctgagcgaaatgcaggttatcgagcaggaaacacccgtgtcagcaaagtctagtagatctcagttggacctgttcgatgatgtcggaacattcgcaagcggcccgccgaagtacaaggataaccccttttcacttggagaaagctttgggagccgctgggacaccgatgcggcatggggaatggatagggtggaggagaaagaacccgaagttaccatctctagcataaggccaatatccgagcgcgccactaaccgcagagaagtggaatctagatcatctggacttgaatcttccgaggctagacagaagttcgcaggtgcaaaagccatatcaagcgatatgtttttcggcagagaggtagacgccgagtacgaggcccgcagtcgtttgcagcaactgtctggctcgtctgcaatcagttcttcagatctctttggtgatatggatggggcgcatggagcaggatctgtgagtttaggtaacgtattacctacagcagacattgcccagttcaaacaaggcgtcaaatccgtggccggaaaaatggccgtgctcgccaatggcgtgatgaacagtcttcaggaccgctacgggtcctactag

SEQ ID NO: 107576 - DNA, 1245 bp, Artificial Sequence
  Description of Artificial Sequence: Synthetic coding sequence
atgcaagttggtgggaacgccaacgccaccgcttttttcaggcaacacgggtgtaccgcaaatgacgctaacaccaaatacaattcgagagccgcccagatgtaccgggagaagatcaggcagctgggctctgccgccttggccaggcacggtacggatcccccggcatgggacgccccagccactgagccttccggtacacaacaacctgccccctccactgagtcaagtggcctggcacagcccgaacacggaccaaacaccgacctgttagggacaagtcccaaggcttcattagaacttaagagcagtatcatcggaaaaaaaaaaccggccgctgcaaagaagggactcggcgcaaagaagggcctgggggcccagaaagtgagctcacagtctttctcggaaatagaacgccaggcccaagttgccgaaaaattgcgcgagcagcaggcggctgatgccaaaaagcaggccgaagagtctatggtggccagtatgcgtctggcttaccaagaactgcagatcgatcgcaagaaggaagaaaaaaaactccagaatctggagggtaaaaaacgggagcaggctgaacggctaggcatgggcctggtgtcccgaagctctgtgagccactcagtcctctccgagatgcaggtcatcgagcaggaaacaccagtgtctgccaagtcatcacggtcacaactggacctatttgacgatgttggtacttttgcatcaggcccacccaagtataaggataatcccttcagcttgggcgagtcctttggctctcgctgggataccgatgctgcgtgggggatggaccgcgtcgaagagaaagagcccgaggtgaccatcagtagtattaggcctatatctgagcgggcaacaaatcggagggaagtggagtcccggtccagcggcttggagagcagcgaagcccgccagaagtttgcaggagcgaaggcaatctcttccgatatgttttttggccgcgaggtggacgccgagtacgaggcgcgttccaggctgcagcaactgagcggaagcagtgccatttcatcctccgatctatttggcgacatggacggtgcacacggagccgggagcgtaagtctcggcaatgttctccctacagccgacattgcacaattcaagcagggggtgaagtccgtggccggtaaaatggccgtactggccaatggtgtgatgaacagtctccaagaccgatatggatcttattag

SEQ ID NO: 107577 - DNA, 1158 bp, Artificial Sequence
  Description of Artificial Sequence: Synthetic coding sequence
atggctgcagagcccaacaaaaccgaaatccagactctctttaagaggctaagggccgtccccactaataaggcatgttttgattgtggagctaaaaatccttcatgggcatccataacatatggagtcttcttgtgtatcgactgctccggggtgcacagaagtctaggcgtgcatttgagcttcataaggtctacagaacttgactccaattggaactggttccagctccggtgcatgcaggtcggcggcaatgctaacgctttaggcgcaaaaaagggattaggagcacagaaagtgtcatctcaatccttctccgaaattgagcgtcaggcccaggttgctgagaaactgagggagcagcaggctgctgacgcaaaaaaacaagctgaggaaagtatggttgctagcatgaggctggcttaccaggagctacagatcgataggaaaaaagaagaaaagaaacttcagaacctggagggcaagaagcgggagcaggccgagagactgggcatgggcctcgtgtcacgttcttcagtgtcccactccgtgctgtccgaaatgcaggtaatcgaacaggaaactccagtgagtgccaagtcgagccgctctcagctggatctgttcgacgacgtcggaacatttgccagcgggccacctaagtacaaggataaccccttcagcctgggagaatccttcggatccagatgggacaccgatgccgcatggggaatggatagagtcgaggagaaggagcccgaggtcaccatatctagcattaggccaatcagtgagagagccaccaataggagggaggtggagagtcgttctagcgggctggagtcttctgaggctagacagaaatttgccggggcaaaggctattagctcagacatgtttttcggacgagaggtggatgctgaatatgaggcccgatcaagactgcaacaactctccggcagttccgccatttctagttccgacttgttcggggatatggacggtgcacatggggctggatccgtctctctggggaatgtcctaccaacagcagatatagcccagtttaagcagggagtgaaaagcgtggctgggaaaatggccgtactggcaaacggcgtgatgaactctcttcaagacaggtacgggagctattag

SEQ ID NO: 107578 - DNA, 1566 bp, Artificial Sequence
  Description of Artificial Sequence: Synthetic coding sequence
atggcggccgagcctaacaagacggaaattcagaccctctttaagcgtctacgtgccgtccccaccaacaaggcctgctttgactgcggggcaaagaacccctcgtgggcctctatcacctatggcgtttttctatgtatcgattgttcaggagtccatcgctcacttggggttcacttgagctttattcgctcgacggagctcgattcgaactggaactggtttcagctgaggtgcatgcaggttggtgggaatgctaacgctaccgctttttttcgccagcatggatgtaccgcaaatgatgcgaatactaaatacaacagtcgcgcagctcaaatgtatcgggagaagattcggcaactggggagtgcagctctggcccgccacggcacagatctctggatagataatatgagctcagcagtacctaaccattctcctgagaaaaaggattcagacttcttcaccgagcacacccagccgcccgcctgggatgcacccgcaacggagcctagtggaactcagcagccagcgccatcaaccgagtcctctggtttggcacaacctgaacacgggccaaacacagatctcctaggtacctcccccaaggcctccctggagctgaaatcatcaatcataggaaagaagaagccagccgcagctaaaaagggcctgggcgccaagaagggcctcggagctcagaaggtttcctcacagtcgttctcggagatcgaaaggcaggctcaggtcgctgaaaagctacgggagcagcaggccgccgatgctaaaaagcaggcagaagagtcaatggtggctagcatgaggctcgcatatcaagagctgcaaatcgatcgtaaaaaagaagagaaaaagctgcaaaacctggaaggcaagaagagagagcaggcggaaaggttgggaatgggcctggtgagcaggtccagtgttagccattccgtcctaagtgaaatgcaggtaatcgaacaggaaacccccgtgtctgccaaatcatcccgctcccaactggatctttttgatgacgtcgggactttcgcctcgggaccccccaagtacaaagacaacccattctccctcggagaatcatttggatcccgatgggataccgacgccgcttggggaatggatagagtagaagagaaagaacccgaggtaacaatttcaagcataagacctatctcagagcgggctacaaataggagggaggtggaaagtcgctcttctggccttgaatcttccgaagcaagacagaaattcgcaggcgcaaaagcaatttctagcgacatgttctttggtcgcgaagtggacgccgagtatgaggcacgctctcgacttcagcagttgagtggatcatctgccatttcatctagcgacctgttcggcgacatggacggagctcatggtgcggggtccgtgagcctcggcaacgtgctgcccaccgcggatattgctcagtttaaacagggcgtaaagtctgttgcaggcaagatggcagttttggcaaatggagttatgaacagtttgcaggaccgatatgggagttattag

SEQ ID NO: 107579 - DNA, 1551 bp, Artificial Sequence
  Description of Artificial Sequence: Synthetic coding sequence
atgggggatccatcgaaacaggacatcctcactatcttcaaacgcctgcgatccgttcctacaaacaaggtgtgcttcgattgtggagcgaagaacccaagttgggcatcaattacctatggcgtgtttctatgcatagactgctctgggtcccaccgctcactgggagtccacctgagtttcatcagatccacagaactagactctaattggtcttggttccagcttaggtgcatgcaggttgggggcaacgcgtctgctagcagttttttccatcagcacgggtgttcgactaatgacacaaacgcgaagtacaactctagggccgcacagctgtacagagaaaaaattaaatcattggcaagtcaggcgacacgcaagcatggtactgacctctggctggatagctgcgtcgtgccccccctaagtcctccccctaaggaagaggacttcttcgcatcccatgtgagccccgaggtgagcgataccgcctgggcttcggctattgccgagccctcctctctcacctctcgtcctgttgagactaccctggaaaacaacgaaggaggccaggaacagggacccagtgtagaaggcttgaatgtgcccacaaaagctaccctggaagtgagtagcattatcaagaagaaacccaatcaggccaaaaagggactgggagccaaaaagggcagcctgggtgcacaaaagttagctaacacctgtttcaatgaaattgagaagcaggcccaagccgctgataagatgaaagaacaggaggacctggcaaaggtggtttctaaagaagaaagcattgtgtctagcttgcgccttgcttacaaagacctcgagatccagatgaaaaaggacgaaaagatgaatattagcggcaagaaaaacgttgatagtgacagacttggaatgggttttggcaattgcaggtcagtgatctcacactcagtcactagcgacatgcagacaatcgagcaggaatctccgattatggctaagccccgcaagaagtataatgatgatagtgacgactcttactttacatccagtagttcctacttcgacgagccagttgagctccgctcgagtagctttagctcatgggatgatagctccgactcttattggaaaaaagaaacatctaaggacaccgaaacagtcttgaagacaaccgggtacagcgacaggccgacagcaaggaggaagccagattatgagcctgttgaaaatacagatgaggcccagaagaagttcggcaacgtgaaagctatcagttcagatatgtacttcggtaggcaaagccaggcggactacgaaacccgcgcccggctagaaagactttcggccagttcaagtattagttccgccgatctgttcgaggagcctcggaagcaaccggccgggaattactccctctcctctgtgctgcccaacgccccagatatggcgcagtttaaacagggcgtccgttccgtcgcaggaaaactgtcagtcttcgctaacggggtggtgacctccatccaggataggtacggcagctag

SEQ ID NO: 107580 - DNA, 1335 bp, Artificial Sequence
  Description of Artificial Sequence: Synthetic coding sequence
atgggtgacccgtccaagcaggacattttgacgattttcaagagactccgcagtgtgcctacaaacaaggtctgcttcgattgcggagccaagaacccgagctgggcctctattacatatggagttttcttgtgcatcgattgctccgggtctcaccgctctctcggggttcacctttctttcattaggagtaccgagctcgacagtaattggtcctggttccagcttcgctgcatgcaggttggagggaacgcatccgccgttagcgacaccgcgtgggcctctgcaattgccgagccctcctctctgacctccaggcccgttgagactactcttgagaacaatgagggtgggcaagaacagggaccttccgtagaaggcttgaacgtacctaccaaggccaccctagaggtgtcgagtattattaagaagaaaccaaaccaggcaaagaagggcctcggggcgaagaagggctctcttggagcccagaagttggcgaatacctgttttaacgagatcgaaaaacaagcacaagccgcagacaagatgaaggaacaagaagatctcgcaaaggtggtttcaaaggaagaatcaatcgttagttcacttcgcttagcttacaaagacctagagatccaaatgaagaaggacgaaaagatgaacatatccggaaaaaaaaacgttgacagcgatcggctggggatggggtttggcaattgccgaagtgtgataagtcactccgtcacctccgacatgcaaactatcgagcaggaatcccccatcatggcaaaacctaggaaaaagtataacgatgactctgacgattcttacttcacgtcaagttctagctactttgatgaacctgtggaacttagatcctcctctttttcttcctgggacgatagttcggacagctattggaaaaaggaaacttccaaggatactgagacggtgctgaaaacaacaggctactccgatcggccaacggccagaagaaagcccgattatgagcctgtggagaataccgatgaggcccagaagaagttcgggaacgtgaaagctatctcaagcgacatgtacttcggtcgacagtcacaggccgactatgagacaagggcccgacttgagaggttgagcgctagttcctccattagctcagcagatctcttcgaggagccaagaaagcagccagccggtaattattccctgtccagcgtgctgcccaacgctcccgatatggcccagttcaaacagggtgtgcgatcagtggcgggcaaactgagcgtctttgccaatggggtcgttacgagtattcaggatcggtatgggtcctag

SEQ ID NO: 107581 - DNA, 1419 bp, Artificial Sequence
  Description of Artificial Sequence: Synthetic coding sequence
atgggggacccaagcaaacaggatatactcaccatattcaagcgcctgcgaagcgttcctaccaataaagtgtgttttgattgtggagctaagaatccaagctgggcgtctataacatacggggtgttcctgtgcatcgattgtagtggaagtcatcgatctctgggagtgcacctgtcatttatccgaagcaccgaactagatagcaattggtcctggttccaattgcgttgtatgcaagtcggaggcaatgctagtgccctgtggttagattcttgcgtagtacctcctctgagcccccccccaaaagaggaagactttttcgcaagccacgttagccctgaagtgtctgatactgcgtgggcctccgccatcgcagaaccttcctctcttacctccagacctgtcgagaccactctggagaataatgaaggagggcaagaacagggacctagcgtcgagggactgaacgtccccactaaggccacccttgaagtttccagcatcatcaaaaagaagcctaaccaagcaaaaaaaggtttaggagcaaaaaagggcagtcttggggctcagaaactggccaacacttgcttcaatgagattgagaagcaggcgcaggctgccgataagatgaaagaacaggaagacctggcgaaggttgtgagcaaggaggaaagtattgtgtcttctcttaggctcgcttacaaagatctcgaaatccagatgaaaaaggatgaaaaaatgaatatctccggcaagaagaacgtagatagcgacaggttgggaatgggcttcggcaactgccgctccgtgatttctcacagtgtcaccagcgacatgcaaaccattgaacaggagtctcctattatggccaaacctagaaagaagtacaatgacgactcagacgacagttactttaccagctccagctcttactttgacgaaccagtcgaactccgcagtagctcatttagcagctgggatgatagctcagattcatattggaagaaggaaactagcaaggacacagagactgtgctgaagaccacaggttatagtgatcggccaacagctagaaggaagccagactatgagccagtcgagaacacagacgaggcccagaagaagtttgggaatgtgaaagccattagttccgacatgtactttggccggcagagtcaggctgactatgagacccgggcacgactggagcggctgagtgcttcatccagcataagctccgctgacctgttcgaggagcccaggaaacaaccggctgggaattactcccttagctccgtactgccaaacgcccctgacatggcacagttcaagcagggcgtcagatcagtggcaggcaaattatccgtcttcgcgaatggagtagtgacatccatacaggaccggtacggttcttag

SEQ ID NO: 107582 - DNA, 822 bp, Artificial Sequence
  Description of Artificial Sequence: Synthetic coding sequence
tgacttgcacttttccaggtgtctgatactgcctgggctagtgccatcgccgagccctcatccctcacttcacgtccagtggaaacaacattggaaaataacgagggcggacaggaacaggggcccagcgtggaagggcttaacgtgcctacaaaggccactctggaggtatcctcgattattaaaaaaaaaccgaatcaggccaagaagggtttgggggcaaaaaaaggctctttaggggcacagaagttagccaatacctgcttcaatgaaatcgagaaacaagcgcaggctgcagacaagatgaaagagcaagaggacctggccaaagtggttagcaaagaagagtctatagtttctagtctgagactggcatacaaggatctcgagattcaaatgaagaaggatgagaagatgaatatcagcggaaaaaagaatgtcgactctgaccggttgggcatgggctttggtaattgtagaagtgtcatcagccactccgttacatctgacatgcagacaatcgagcaggagtctcccatcatggcgaagccaagaaaaaagtataacgacgattctgatgacagctacttcacaagttcgtctcgccctaccgcacggcgtaaaccagactatgagcccgtggaaaataccgatgaggcacaaaagaaattcggaaacgtcaaggctatttctagtgacatgtactttgggcgacagtctcaggccgactacgaaacccgagcccgattggagagactaagcgcgtcctcctctatcagctcggctgacctcttcgaagagccgcgcaaacaacccgcgtag

SEQ ID NO: 107583 - DNA, 459 bp, Artificial Sequence
  Description of Artificial Sequence: Synthetic coding sequence
atgggcgacccatctaagcaggatattctgaccatatttaagcgactgcgctcagtccccacaaacaaggtatgcttcgactgcggagccaaaaatccttcatgggcgagcatcacgtatggcgttttcttgtgcattgactgttccggcagccatagaagcctgggcgtgcacttgagttttatccgcagcacagaacttgacagcaattggtcatggtttcagctccggtgtatgcaggtcggaggcaacgcttctgctgtgtcagatacagcatgggcctcagctattgccgagccgagcagtctgacgtccagacctgtcgagaccacactggaaaacaatgagggcggccaagagcagggcccttcagtcgagggtctcaatgttccaaccaaggccaccctcgaagtgtcatctattattaagaaaaaacccaatcaagctaagaagggctag

SEQ ID NO: 107584 - DNA, 5550 bp, Artificial Sequence
  Description of Artificial Sequence: Synthetic coding sequence
atgtatgagggcaagaagaccaaaaacatgtttcttacacgggcactggagaagatcttggccgacaaagaggttaagaaggcccaccatagtcagctccgcaaagcctgtgaagtggctctggaagaaattaaggctgaaacagaaaagcagtctcccccacacggagaagcaaaggctgggagcagcactctgccccccgttaaatccaagaccaacttcattgaggctgacaagtacttcttgccgtttgaactggcatgtcagagtaagtgtccacggatcgtttctacaagtctggactgccttcaaaagcttatcgcctatggacacctcaccggcaacgcgccagattccacgaccccaggtaagaaacttatagaccgcatcattgaaactatttgtgggtgttttcagggccctcagaccgacgagggagttcagcttcagatcattaaagctctgctgaccgccgtaacttcacagcacattgaaatccatgaagggaccgttctgcaggctgtgagaacctgttataacatttatttggcctctaaaaacctgattaatcagactacggcaaaggcgacattaacacagatgctcaacgttatcttcgcccgcatggaaaatcaggcactccaagaggcaaagcagatggaaaaggagcgacatagacagcaccatcacctcctccaatcgcctgtgagtcatcatgaacctgagtcgcctcagctgagatacctgcccccacagacggtggatcacatttctcaggagcatgaaggcgatctggatcttcacaccaacgatgtggataaatctttgcaggatgatacagagccagagaatggcagtgatattagttccgcagagaatgaacagacagaggctgaccaagccacggcagccgaaaccctgagtaaaaatgaagtactgtacgatggcgaaaatcatgactgtgaagagaaaccccaggatatcgtccaaaatattgtggaagaaatggttaatatcgttgtaggagatatgggcgaaggcacaactatcaacgcatcagcagacgggaacattggcacgattgaggacggatccgattctgaaaatatccaggccaacgggatcccaggtacccccatttctgtggcctacaccccaagcctgcctgacgatcgactttctgttagctccaacgacactcaggagtcagggaactcaagcggtccatctcccggcgctaagttctcccacattctccagaaagacgccttcttggtgttccgctcactctgcaagctgtctatgaagcccctctcggacggaccacccgatcccaagtctcacgagctgcggtccaagattttgtcacttcaactgctgctatccatcctccagaatgccggtcctatcttcagaactaacgagatgttcataaacgctataaagcagtacttatgcgtagccctgtctaagaatggggtatcgagcgtgccagaggttttcgagctgtctctgagcatttttcttacgcttctgagcaatttcaagactcatttgaagatgcaaattgaagtcttttttaaggagatatttctatacatcctggaaaccagcaccagctcgttcgaccacaaatggatggttatacaaaccctgacacggatctgcgcagatgcgcaaagtgtcgtggatatttacgtgaactacgattgtgatcttaacgcagcaaacattttcgagaggctggtgaatgacctgtctaaaatcgcccaggggagaggcagtcaagagctgggcatgtccaacgtccaggagctaagccttagaaagaagggtctggaatgcctggtgtccattcttaaatgtatggttgaatggtccaaggaccaatacgtcaacccgaatagccagaccacacttggccaggagaagccatctgagcaggagatgtctgagatcaagcaccccgaaacgattaaccgctatggtagtcttaattcccttgagagcacgagctcttccggcattggatcatattctacacagatgtctggaaccgataatccagagcagtttgaggtgctgaagcagcagaaggagattatcgagcaggggattgaccttttcaacaagaagccaaaacgggggattcagtatctgcaggaacagggtatgctgggaactacccctgaggatatagcccagtttcttcatcaagaggaacggctcgattctacgcaggtcggagagtttctgggcgacaatgataagttcaacaaagaagttatgtatgcttatgtggaccaacacgacttcagcggtaaagacttcgtgagcgccctgaggatgttcctggaaggattccgcctgcccggggaggcccagaagatagacaggctgatggagaaattcgccgcaagatatctggaatgtaaccaggggcagacattgttcgcatcggccgacacagcctatgtactggcgtatagcatcattatgctgactacagatcttcactcacctcaggtgaagaacaaaatgacaaaggagcagtatattaagatgaaccgcggcattaacgatagtaaagatctgcccgaggaatacctgtccgccatctacaatgagatcgctggtaaaaaaatctcaatgaaggagactaaagagttgacaatccccacaaagagttcaaaacagaacgtggcttcggagaaacagcggcgcctgctttataacctcgagatggagcagatggcaaaaactgcgaaggctcttatggaggctgttagccacgtccaggccccatttacctcggccactcacctggaacacgtgcgacccatgttcaagttggcctggactccttttctggctgctttctcagtgggcctgcaagactgcgacgatactgaggttgcctctctctgccttgagggcattcggtgcgctatccggattgcgtgtatttttagcatacagttggagagggacgcttatgtacaggctctggcacggtttacgttgctgacagttagctctggtattactgaaatgaagcagaaaaacattgacacaataaagacgctgataactgtggcccacaccgatgggaattacctaggtaattcttggcacgaaattctgaagtgcatcagtcagctggagctagcgcagttaattggtactggtgttaagcccagatacatctcaggcaccgtccgcggaagagaggggagcctcactggcaccaaagatcaagcacctgatgagtttgtgggattaggactagtggggggcaacgtcgattggaaacagatagcctctattcaggagtccatcggcgagacttcctctcagagcgtggtggtagctgtggatagaatctttacaggcagtacgcgtctggacggaaatgccattgtagatttcgtgagatggctctgtgctgtgagtatggatgagcttctgtcaacgacacacccgagaatgtttagcctgcaaaagattgtcgaaatcagctattacaatatgggaaggatcagactccaatggtcacgcatttgggaggtgatcggtgatcacttcaacaaggttggctgtaatccaaatgaggatgtggcaatctttgccgttgattcactgaggcaactgagtatgaagtttctggagaagggagagttggccaacttccggtttcagaaagatttcctacgccccttcgaacacatcatgaagagaaacaggagtcccactattcgggatatggtagtccggtgcatagcccaaatggttaattctcaagccgccaacattcggtccggttggaaaaatattttctccgtgtttcatctggcggctagcgaccaggacgagtctatcgtagagctcgccttccagacaacaggccacatcgtaactcttgtatttgagaagcattttccagctaccatcgactcgtttcaggacgcggtcaaatgtctcagtgagttcgcgtgcaatgctgcgttcccagacacatctatggaggccatacgactcatccgtcattgcgcaaaatacgtcagtgatcgcccacaggcctttaaggagtatacaagcgatgatatgaacgtggctccagaggatcgggtttgggtcagagggtggtttccaatactgtttgaactcagctgcatcatcaacagatgcaagttggatgtgcggacacgcgggctgactgtaatgtttgaaatcatgaaaacttatggacacacctacgagaagcattggtggcaggatctgttcaggattgtctttcgtatttttgataatatgaagctgccagagcagcagaccgagaaggctgagtggatgaccaccacctgcaaccacgccctgtatgcaatttgcgatgtgtttacccaatatctcgaagtgctgtccgacgtgctgctcgacgatatctttgcccagctttactggtgcgtccagcaagacaatgaacagctcgctaggtccggcactaattgcctggaaaatgtcgtgatcctgaatggcgagaagttcaccctggaaatttgggataaaacttgcaattgtactcttgatatattcaaaactacaatccctcacgcactgttgacctggaggccaaacagtggagaaaccgcgccgccccctccaagcccagtaagtgaaaaacctctggacactatctcacagaagagcgttgacatccacgacagcatccagcctagatccgtagacaacagacctcaggcccccttggtctccgcctcagcagtgaatgaggaggtatcaaagatcaagagcactgctaagttccctgaacagaagttgtttgctgccttgctgatcaagtgcgtcgtgcaacttgagctgatccagactattgataatatagtcttctttccggccaccagcaagaaagaagatgccgagaacctggccgccgctcagcgtgacgctgtcgacttcgatgttagagtggatacccaggaccagggcatgtaccgcttcctcaccagccagcagcttttcaagctcctggactgcctgctggaatcacaccgctttgctaaggcgttcaattccaataatgaacaacgaaccgcgctgtggaaggctggctttaagggcaaaagcaaacctaacctgctgaaacaggaaacaagttccctggcatgcggccttagaattctgttcaggatgtacatggacgagtcaagagttagcgcttgggaggaggtgcagcagcgcctccttaacgtgtgttccgaagcactgagctattttcttactctcaccagcgaaagtcatcgcgaggcatggacgaatcttttgctcttgttccttacgaaagtgttgaagatctcagacaatcgtttcaaagctcacgcatccttttattacccactgctgtgtgaaataatgcagtttgaccttattcctgagctgagggccgtgttgcgaagattctttctgagaataggagtcgtctttcagattagtcaaccacccgaacaagagcttggaatcaacaaacagtag

SEQ ID NO: 107585 - DNA, 5358 bp, Artificial Sequence
  Description of Artificial Sequence: Synthetic coding sequence
atgcaggaaagccagacaaaaagcatgttcgtgtccagggccctcgagaagatccttgctgataaggaagtgaagcgtcctcagcactctcagctcagaagagcatgccaagttgcccttgacgagataaaggcagaaatcgagaagcagcggctaggcacagccgctccaccgaaagcgaattttattgaggctgacaagtacttcctgcctttcgagctagcctgccagtcgaagtctccgcgcgtcgtgagtaccagcttagactgcttgcaaaaattaatcgcatatggtcacattaccggcaatgcccctgactcaggcgcacccggcaaaagactcatcgatagaattgtggaaactatttgtagttgctttcaaggcccacagactgacgagggcgtgcagctgcagatcataaaggccctgcttacagccgttacctctccccacatcgagatccatgaaggtacaattttacagaccgtgcggacatgttataacatttatctggcttctaagaatttgattaatcagactaccgctaaagccacactgacccagatgctcaatgtgatcttcacccggatggaaaaccaggtgcttcaagaagccagagaattagaaaaacccatccagtccaaacctcaatcacccgtcatccaggccgccgccgtatcccccaagtttgtgcggctcaaacattcgcaagcccaaagcaagcctaccacacctgagaagaccgatctaaccaacggagaacatgcaaggtcagattccgggaaggtctccacagagaatggcgatgctccacgcgagcgcggctcaagcctgagtggcactgatgatggcgcgcaggaggtcgtcaaggacattctggaggatgtggtgacctctgctatcaaggaagctgccgaaaaacatggactgaccgaacccgaaagagttcttggagaattggagtgtcaggagtgcgcgatccccccaggagtggacgaaaattcccaaacaaacgggatcgccgatgatcgacagagcttaagttctgctgacaacctagaatccgatgcgcagggacaccaggtcgccgcaaggttttctcatgttctccagaaagacgcatttctcgttttccggagcctttgcaagctgagcatgaaaccattaggggagggtcctccagatccaaagtcacatgaattgaggtctaaagttgtctcacttcagttgctgctctcagtcctgcagaacgccggccccgtttttaggactcacgagatgtttatcaacgctattaagcagtatctttgtgtcgccctgagcaaaaatggagtgtctagtgtgcccgatgtgtttgagctcagcttggccatctttttaaccttactcagtaacttcaagatgcacctgaagatgcagattgaagtcttttttaaagaaatttttctgaacatccttgaaacttccaccagctccttcgagcaccggtggatggtgatccagacgttaacaaggatatgcgcagacgcgcaatgcgtggttgacatctacgtgaactacgattgtgacttgaacgctgccaacattttcgagagactggtgaacgacttgagcaagatcgcccagggtaggtcagggcatgaactcggcatgacaccgctgcaagaactatctcttcgaaagaagggcctggagtgtttggtttccatccttaaatgtatggtcgaatggtctaaagatctgtacgttaaccctaatcaccagacttccttgggacaggaacgccttacggaccaagagattggggacggaaaagggctcgacatggctcggcgatgcagcgtaacgtcgatggagagcactgtgtcctcaggcactcaaacgaccgtgcaggatgatcccgagcagttcgaggtgataaagcaacagaaagagatcattgaacacggtattgagctgttcaataagaaacctaaacgtgggatccagtttctacaggagcagggcatgctggggacgtcagtcgaagacatagcacagttcctgcatcaggaagaaaggctagatagcacacaggttggcgatttcctaggggacagcgcgcgctttaataaggaggtgatgtatgcttatgtggaccaattggacttctgcgagaaagaattcgtcagtgccctgcgcaccttcttagagggatttcgtctgcccggagaagcccagaagatagacagactgatggaaaagttcgctgcccggtacatcgaatgtaaccagggacaaactctgtttgctagtgctgataccgcttatgtactcgcgtacagcatcatcatgttaaccactgacctgcatagccctcaagtgaagaataaaatgactaaagaacagtacataaagatgaaccgagggatcaatgactccaaagacctgcccgaagagtacctctcttctatttacgaagagatcgaaggcaagaagatcgccatgaaggagacaaaggagcttaccatcgcaaccaagtcaaccaaacagaatgttgcgtccgagaagcagagaaggcttttgtacaatcttgagatggaacagatggctaagacagcaaaggccttgatggaagcagtgagtcatgcaaaagccccatttacaagtgccacgcatctggaccatgtccgcccaatgtttaagctagtttggactccccttctagcggcctattccattgggttgcagaactgcgatgacaccgaagtggcctctctatgtcttgaggggatacgatgtgctatccgcatcgcttgcatttttggtatgcaactcgagagagatgcctatgtgcaggcgttggcacgcttcagcctcctaacggcctcttcaagtattaccgaaatgaagcagaagaatatcgataccatcaagacactgatcaccgtagctcacaccgacggtaattacctgggaaatagctggcacgaaattttaaagtgcatatcacagttggaacttgctcagctcattggtacgggagttaagactagatacctttctggaagcgggagagaacgggaaggcagtttgaagggtcatactctagctggtgaggaatttatgggtctcgggttggggaacctagtaagtggaggagtggacaagcgacagatggccagcttccaggagtcagtgggcgagacctcaagtcagtcagtggtggtggctgtcgatagaattttcactggatcaacaagattggacggaaatgccatcgtggatttcgttagatggctgtgcgccgtgtctatggatgaattggcatccccccatcatccccggatgttcagcctgcaaaagattgtagaaatctcatattataacatgaacagaatccgccttcagtggtcccgaatttggcacgtcataggggaccactttaataaagtagggtgtaatcctaatgaagatgtcgcaattttcgctgtcgattcattgcgacagcttagtatgaagtttctcgaaaagggagagctggcgaactttagattccaaaaagattttctccggcccttcgagcacatcatgaagaagaaccgctctcccactatccgagatatggccatcagatgtatcgctcagatggttaacagtcaagccgccaatattcgcagtggttggaaaaacattttcgcagtatttcatcaggcagcctctgaccacgacgggaatatcgtagagcttgcatttcagacgacctgtcatatcgtgacgacgatttttcaacatcactttccggcagctattgactcattccaggacgcagtcaagtgtttatctgagtttgcctgtaacgcagcgttccctgacacctccatggaagctatacgccttatccgcttctgtgggaagtatgtgagtgaacggccgcgtgttttacaggagtacacttccgacgacatgaatgtagcacccggggatcgagtatgggtacgtgggtggttccccatcctgtttgagttgagttgtatcatcaatcgatgcaagctggatgtccgcacccgcggactgactgtaatgtttgagatcatgaagagctacggacacactttcgagaaacactggtggcaagatctgtttcgaattgttttcaggatctttgacaacatgaagttgccggaacagctgtcagagaaaagcgaatggatgaccaccacctgcaaccacgctctgtacgccatctgtgatgtattcactcaattctatgaggcactgaacgaggttctgctatcagacgtatttgcgcaactgcagtggtgtgtgaagcaggacaatgaacaactggcacgttccggcacgaattgtctcgaaaacctggtgatttccaatggcgagaagttctcccctgaggtgtgggacgagacatgcaactgtatgctggacatctttaaaacaaccatcccgcatgtcctgctcacatggcggccagttggtatggaggaggactcttctgagaagcacttggatgtggatcttgatcgccagtccctgtcttcaatcgacaagaacccgagcgagcgcggtcagagtcaactgagtaatccgacagatgactcctggaagggccgcccatatgccaaccagaagctgtttgccagcctactgattaaatgcgtagtgcaattagagctgattcagacgatcgacaacattgtcttttatcctgcaactagcaaaaaagaagacgccgagcacatggtagccgcccagcaagatacattagacgccgatatccatattgaaaccgaggatcagggaatgtacaagtacatgtcctctcagcatctgttcaagctgcttgactgcttgcaggaatcccactctttttcgaaagcctttaactctaactatgagcaacgaaccgtgctttggagggcagggtttaaggggaagagcaagccaaaccttcttaaacaagagacctctagtctcgcatgttgtttgcgcattctgttccgcatgtacgtcgatgaaaataggcgcgattcatgggaagagatacagcagcgtctcctgaccgtgtgctcagaagccctggcttacttcattacagtgaactcagagagtcaccgagaggcctggacctcactgttactcctgctgctgactaagacactgaaaattaacgacgagaagttcaaggcccacgcctcaatgtattatccctatttgtgcgaaatcatgcagttcgatctaatcccagagcttagagccgtccttagaaagtttttcctgcgtatcggagttgtgtacaagatctggattcccgaagaacctagtcaggtgcctgctgctctctcacccgtgtggtag

SEQ ID NO: 107586 - DNA, 2499 bp, Artificial Sequence
  Description of Artificial Sequence: Synthetic coding sequence
atgcaggaaagccagacgaaaagcatgttcgtctctagggcactggagaaaatcctagccgacaaggaagtgaagcggccacagcactcccaactgaggcgggcctgccaggttgccctcgatgaaatcaaggccgaaatagagaagcagcgtttagggaccgccgcccctcctaaggccaactttatcgaggcggacaaatacttcctgccatttgagctggcctgccagagcaaatcgccgcgggtcgtatccacaagcttggactgtttgcagaagcttatagcttatggccacatcaccggaaatgcccctgatagcggcgcccccggcaagaggctgattgatagaattgtggaaacaatttgctcttgcttccagggtccgcagaccgatgagggtgtccagctgcagatcattaaagccctgctgaccgctgtgaccagcccccacatcgagattcacgaagggaccattctccagacagtgcgaacatgttataacatctacctggcatctaagaatctgatcaaccagaccacagccaaagcaactctgacccaaatgctgaacgtcatattcactaggatggaaaatcaagtgttgcaggaagctcgggagctcgagaagcctattcagagtaagccccagagtcctgtcatccaggcggccgcagtaagtccaaagttcgtgaggctgaaacactcgcaagcacaatctaaacctacgacgcctgaaaagacggatttgaccaacggtgagcatgcccggtccgactccggaaaagtaagcactgagaacggagatgcgccacgggagcgggggagctcactgtctggaaccgatgatggtgcccaggaggtggtaaaggatattctggaagatgttgtgacgagtgcaatcaaagaggccgcagaaaagcacggactaactgagcctgaacgagtcctgggcgagctggagtgccaggagtgcgcaatccccccaggggtagacgagaacagccagaccaacggcattgcggacgataggcagtcactgtcatctgcagataatttagaatctgacgctcaaggccatcaggttgcggctaggttctcgcacgttctgcagaaagacgcttttttggtgtttcgatctctgtgcaaactgagtatgaagcctttgggagagggacctccagatcctaagtcacacgaactccggagcaaggtcgtgtccctgcagttgctgttatccgtcctccaaaatgcgggacccgtcttccgtactcacgaaatgttcatcaacgcgattaagcagtatctgtgcgtggcgctatcaaaaaacggggtctcaagcgtgcccgacgtgtttgaactgtccttggccatatttctgacactgttgagcaactttaagatgcatcttaagatgcagatcgaagttttttttaaggagatctttcttaatatcttggaaacctctacaagttcctttgagcaccgttggatggtgatccaaacactcactcgcatatgtgcggatgcacagtgcgtggtggatatttacgtaaactacgactgcgacctcaatgctgcgaacatttttgagcgactcgtcaacgacctatccaaaatagcccaaggacgctctggacacgagctgggcatgacccctctgcaggaactctctctcagaaaaaagggcttagagtgccttgtgagtatattgaagtgcatggtggaatggtctaaggacctgtatgtgaaccctaaccaccaaactagcctggggcaggaacgccttaccgatcaggaaattggggacggcaagggtctagacatggccagacgatgctccgttacatctatggaaagtactgttagctccggtacgcagacaacggtccaagacgacccagaacaattcgaggtgatcaagcagcagaaggaaatcatcgagcatggaattgaactgttcaataagaagcccaagaggggcatccagtttttgcaagaacagggaatgctggggacctccgtcgaggacattgcccagtttctacatcaagaagaacgcctggattccacccaggtgggtgacttcttgggagattcagctcgttttaataaagaggtaatgtacgcatacgtggaccagctggacttctgcgagaaggaattcgtttccgccctccgaacctttcttgaaggattccgcctgcccggcgaagcccagaagattgacagactgatggaaaaatttgcggcaaggtatatcgagtgtaaccagggtcagactctcttcgctagcgcggataccgcatatgtgttagcctactccatcatcatgctaactactgaccttcactccccccaggtaaagaataaaatgacaaaagaacagtacattaaaatgaacaggggaataaacgattcgaaggatctgcccgaggagtatttatcatcaatctatgaggaaatcgagggtaaaaagattgccattaaaaagaattag

SEQ ID NO: 107587 - DNA, 591 bp, Artificial Sequence
  Description of Artificial Sequence: Synthetic coding sequence
atgggatctgtcaattcacgcggccacaaagcagaggcccaggtggtgatgatgggattagattcagccggcaaaacaaccctgctgtataaacttaaaggtcaccagcttgtcgagaccctcccaaccgtgggcttcaatgttgaaccactcaaggcacctggtcatgtaagcctgacattgtgggatgtcggcggacaggcacccttgcgcgctagctggaaggattatctggagggaacagacattttggtttacgtgctggactccaccgacgaagcccggctcccggaaagtgcagctgaattgacggaagtacttaatgatcctaatatggcaggtgtgccattcctggtgctggccaataaacaggaagctccggacgctttacctttactcaagatcaggaacaggctatccttagaaaggttccaggatcattgctgggagcttagagggtgttccgcattgacaggcgaaggcctgccagaggctctccagtccctttggagtcttcttaaaagtcgctcttgcatgtgcctgcaggcacgggcccatggcgccgagagaggggactctaaacgctcgtag

SEQ ID NO: 107588 - DNA, 966 bp, Artificial Sequence
  Description of Artificial Sequence: Synthetic coding sequence
atgttttcgttaatggccagttgctgcgggtggtttaaacgctggcgggagccagtgcggttggccaacaagcaggataaagaaggcgcccttggcgaagcagacgtgatagagtgtctcagtcttgagaaattggttaatgaacataagtgcctctgccaaatcgagccatgctccgcaatatccgggtatggaaagaagatagataagagtatcaagaaagggttatattggttgctccacgtgatcgcaagagacttcgatgctcttaacgaaagaattcagaaggagacgaccgagcaaagggctttggaggagcaggaaaagcaagagagggccgaaagggttaggaagctacgagaagagcgcaagcagaacgaacaggaacaggctgagctcgatgggacttctggactcgccgagctggaccctgagcccacaaaccccttccagccaatcgcctcagtgattatcgaaaatgagggcaagctcgaaagagagaaaaaaaaccagaaaatggagaaagactcagatggctgccaccttaaacacaagatggagcacgagcagattgagacccagggacaggtgaatcataacggtcagaagaacaacgaatttggactcgtcgagaactacaaggaggcgctgacacagcagctgaaaaacgaggacgagaccgaccgccctagtctggaatctgccaatggcaagaaaaagacgaaaaagctgaggatgaaacggaaccatcgagtcgaacctctcaatattgatgactgtgcgcccgaatccccaacgcccccacctccccccccaccggtggggtggggtacacccaaagtgactagattgccgaagctagagcctctaggagagactcatcacaatgatttctacagaaagccattgccaccccttgccgtccctcagcgccccaatagtgacgcgcacgacgttatctcctag

SEQ ID NO: 107589 - DNA, 1287 bp, Artificial Sequence
  Description of Artificial Sequence: Synthetic coding sequence
atgttctcactcatggctagctgttgtggctggttcaaacgatggcgcgagcctgttcgtaaagtcactttactgatggtaggcctcgataacgcaggcaagacagccacagctaaagggatacaaggagaataccccgaagatgtggcacccacggtgggattttcaaaaataaatcttaggcagggaaaattcgaggtgacgattttcgatttaggtgggggcattagaatccgaggaatctggaaaaattactacgctgagagctacggcgtgattttcgtagtcgactccagtgatgaagagaggatggaggagacaaaagaagcaatgtctgagatgctgaggcaccccaggataagcgggaaacctatcttggtgctcgccaataagcaggacaaagagggggctctcggcgaggcagatgttatcgagtgcctgagtctagaaaagctcgtgaacgagcacaaatgcctgtgccagatcgaaccttgttccgctatttctgggtacggcaagaagattgacaagtcgatcaaaaagggcttgtactggcttttgcatgtgatcgctagagactttgacgctcttaacgaaaggattcaaaaggagaccacagagcaaagggccctggaggaacaagagaaacaggagcgagcagagcgggtgaggaaattgagagaagagaggaaacaaaacgaacaggagcaagccgaacttgatggtacatccgggctcgcagaactcgatcccgagccgacgaacccatttcagccgattgctagtgtgattatcgaaaatgaaggcaagctcgagcgcgaaaaaaagaaccagaaaatggagaaagactcagacggctgccacctcaagcataagatggaacatgaacagatcgaaacacagggtcaggtcaaccacaacgggcaaaaaaacaacgagtttggtttagtagaaaattacaaggaggccttgacccagcagcttaagaatgaggacgaaacagaccggccctcgctggaatctgccaatggtaagaaaaagacaaagaaacttaggatgaaacgcaaccatagggtagaaccacttaatattgatgactgtgccccagaaagccctacaccaccaccgcctccacccccagtcggctgggggacccctaaggtaactcgcctgcctaagctcgagcccttgggcgagacccaccataatgacttttacaggaagcctcttccccccctggcagtcccacagcggcctaacagcgacgcacatgatgtgatatcatag

SEQ ID NO: 107590 - DNA, 1287 bp, Artificial Sequence
  Description of Artificial Sequence: Synthetic coding sequence
atgttctcattgatggcgagctgctgtggatggtttaagcgatggcgcgaaccagtgaggaaggtgaccctattaatggtgggactcgacaatgccggcaaaaccgcgaccgcaaaaggcattcaaggagaataccctgaggatgtggcacctactgttggattttccaagatcaatctccggcaggggaaatttgaagtcacgatttttgatctcggcggcggtatcaggatcagaggtatctggaagaactattacgcagagtcatatggtgtcatatttgtggtcgatagctcagacgaagagcgtatggaagagaccaaggaagccatgtcagaaatgctgaggcacccaaggatttcaggtaaacctatcttagttctggccaacaagcaggataaagagggagccctcggagaggcggacgtcatcgaatgtctgtcacttgagaagctagtgaatgagcacaagtgtctctgccagattgaaccttgtagcgctatttctggctatggaaagaaaatcgacaaaagcatcaagaaagggctctactggctgctgcacgtgatcgcccgtgattttgacgccctaaacgaacgaatacagaaagagacgaccgagcagcgagcattggaggaacaggagaagcaggagagagccgagagagtgcgtaagctcagagaagaacgaaagcagaacgaacaagaacaggcagagctcgacgggacctccgggttggccgagctggaccctgagcctaccaacccatttcagccaatcgcatcagtgatcatcgagaatgagggaaagcttgagcgggaaaaaaagaatcagaagatggaaaaagatagtgacggctgccatcttaaacataaaatggagcatgaacagatagagacacagggacaggtgaatcataacggccagaagaacaatgagtttgggcttgttgaaaactataaggaagccctcacccagcagttgaagaatgaggacgagacagaccgtccgtctctagagtctgccaacggcaaaaagaaaactaaaaagttgcgaatgaaaagaaaccatagggtggaaccactcaatattgacgactgcgccccagagagccctacccctcccccccctccccctccagtggggtggggaacaccaaaagtaacgaggcttcctaagcttgagcccctaggcgagacacatcataatgacttttacagaaagccgctgcccccgctggccgtgccccagcgcccaaacagcgatgctcacgatgtaatcagttag

SEQ ID NO: 107591 - DNA, 978 bp, Artificial Sequence
  Description of Artificial Sequence: Synthetic coding sequence
atggaagagaccaaggaggcgatgtccgaaatgctcagacacccacgcattagcggaaagcctattctcgttctcgccaataaacaagataaggagggagcgctcggtgaagctgatgttattgaatgtctgagccttgaaaaactggtgaatgagcacaagtgcctgtgccagattgaaccctgctccgccatttctgggtacgggaagaaaattgacaagtcaatcaaaaagggactgtactggctgttgcatgttatcgcccgggatttcgacgcactgaatgaacggattcaaaaagagacaacagaacagagggctctggaggagcaggaaaaacaagaacgcgccgagagggtaagaaaacttcgggaggaacgcaaacagaatgagcaggaacaggcagagctggatggtacaagtggcctggctgagttagacccggagccaaccaaccccttccagcccatcgcatctgtgatcattgagaatgagggtaaattggagagggaaaagaagaaccagaaaatggaaaaggattcagacggctgtcacctgaagcacaagatggaacacgagcaaattgagacccagggacaagtgaatcacaatggccagaaaaacaacgagtttggtctagtcgagaactacaaagaagcattgacgcagcagctgaagaacgaggatgagacagacagaccgtcgctggagtctgccaacgggaagaaaaagaccaagaagctgcgcatgaagcgtaaccacagggtagaaccgcttaatatcgatgactgtgccccagagagcccaacgcctccaccccctcctccccctgtcggatgggggacccccaaagtcacccgcctgcccaaactcgagcccctgggtgagactcaccacaatgatttttataggaagccactgccccccctggccgtgcctcagcggcccaactcagacgcccatgatgttatctcatag

SEQ ID NO: 107592 - DNA, 450 bp, Artificial Sequence
  Description of Artificial Sequence: Synthetic coding sequence
atggagaaagattctgatggttgtcacttgaagcataagatggagcacgagcagattgagacgcaagggcaagtcaaccacaacggccaaaagaacaacgagttcggtctggtcgagaactacaaggaagctctgacacagcagttgaagaatgaagacgaaaccgacaggccctcccttgagagcgcaaatggtaagaaaaaaactaaaaaattgcggatgaagagaaaccacagagtcgagcccctcaatattgatgactgcgcacccgagagtcctacacccccccctccacctccaccagtgggatgggggacgccaaaagtgacaaggttgcctaagctagagccacttggtgaaacacatcacaatgacttctacaggaagccactgccacctttggcagtgccccaacggcctaatagtgatgcacatgacgtgatctcttag

SEQ ID NO: 107593 - DNA, 579 bp, Artificial Sequence
  Description of Artificial Sequence: Synthetic coding sequence
atgggcagcctgggttccaagaacccacagacaaagcaagcccaggtcctgctgctgggactggacagcgccggcaaaagcacgctgctgtataagttaaaactggcaaaagacatcacaaccattccaacaataggttttaacgtggagatgatagaattggaacgaaatctctcactgactgtttgggatgtcggcggtcaggagaagatgaggactgtgtggggatgctactgtgaaaatactgacgggctggtgtatgtggttgattccaccgataaacagaggctggaagaatcccagaggcaatttgaacatattcttaaaaatgagcatattaaaaatgtgccagtggtgctactcgccaataagcaggatatgccgggcgccctgacggcagaagacatcaccaggatgttcaaggtcaagaagttatgcagcgataggaactggtacgttcagccatgttgcgcccttaccggtgaaggactcgcacaaggatttcggaaactaaccggtttcgtcaagagccatatgaagagtaggggtgatactctcgccttctttaagcagaactag

SEQ ID NO: 107594 - DNA, 555 bp, Artificial Sequence
  Description of Artificial Sequence: Synthetic coding sequence
atgggcctgctcaccatccttaaaaagatgaaacagaaggagcgggagctacggctgctaatgttggggctcgacaatgctggcaagacgaccattcttaagaagttcaatggagaagatatagacacaatttcaccgactctgggcttcaacatcaaaactctcgaacaccgcggctttaagctcaatatctgggatgtgggaggacaaaaatccttgcgttcctactggcgcaactactttgaaagtacggacggtttaatttgggtggtagactccgccgacagacagagaatgcaagattgccagagggagctccagtctttattggttgaggagcgcctcgctggtgccaccttgctgatcttcgcaaataagcaggacctgcccggcgccctgagttcaaacgccatcagagaggtcctcgaactcgactctatccgatcacatcactggtgtatccaggggtgttcggccgtgaccggagaaaatctgctcccaggaatagattggctgttggatgacatctccagccgaatttttacggcagattag

SEQ ID NO: 107595 - DNA, 555 bp, Artificial Sequence
  Description of Artificial Sequence: Synthetic coding sequence
atgggcttacttactattctcaagaagatgaagcagaaagagcgtgagctgcggttgctgatgttgggcctcgacaacgcggggaagactacaattctgaagaagtttaacggagaggatatcgacaccatctcccccacactgggctttaacattaagactctcgagcaccgtgggttcaaactcaacatctgggacgtggggggtcagaaatcgcttcgctcatactggcgcaattacttcgaaagtactgacggattgatttgggtcgtggactctgctgatcggcagcggatgcaggattgtcagcgggaactgcagtctctgctcgtggaagagaggctggccggcgccactttattgatcttcgccaataaacaggatctccctggcgcactgtccagcaacgctatccgagaagtactcgagctggactctatccgaagtcaccactggtgcatacaggggtgctcagccgtgacaggagaaaacctgctcccaggtatcgattggctgctggatgacatatcctcccggattttcacagccgattag

SEQ ID NO: 107596 - DNA, 474 bp, Artificial Sequence
  Description of Artificial Sequence: Synthetic coding sequence
atggggctgctgacaattcttaaaaaaatgaagcaaaaagaacgggagctcaggctgctgatgcttggattagataacgcagggaaaacaaccattttgaagaaatttaatggagaagatatcgatacaattagcccaaccctgggtttcaatattaagaccctggagcaccggggcttcaagctcaatatctgggacgtgggcggacagaaatcactcagaagctactggaggaattacttcgagtctaccgacggcctgatatgggtcgtcgattcagctgaccgacaacgaatgcaggattgccaacgggagttgcaaagcctgctggtggaagaggtgcttgaactcgactcaatccggagccaccattggtgcatccagggatgctctgcagtgactggcgaaaatctgctccctggcatcgactggctcctggatgacatctcttcgagaatcttcacagctgattag

SEQ ID NO: 107597 - DNA, 549 bp, Artificial Sequence
  Description of Artificial Sequence: Synthetic coding sequence
atgggcttgctcagcattctgcgcaagctgaagagcgctcctgaccaggaagttaggatcctactccttggactggataacgcaggcaagactacacttctcaaacagttggctagtgaagacatcagccacattactccaacacagggttttaacattaagtccgttcagtcccagggatttaagctgaacgtttgggatatcggtggtcagaggaaaatccggccttactggaaaaactacttcgaaaacaccgatattttaatttacgtgatcgacagcgctgatcgaaaaaggtttgaggaaacaggccaggaactggcagagctgttggaggaggagaaactttcgtgtgtgcccgtcctcattttcgcaaataagcaagacctgttaactgcagctcccgcctccgagatcgcagagggactgaatctacacactatccgggatagagtttggcagattcagtcctgctccgccctcactggcgagggtgtgcaagatggtatgaactgggtttgcaagaacgttaacgcgaagaagaaatag

SEQ ID NO: 107598 - DNA, 606 bp, Artificial Sequence
  Description of Artificial Sequence: Synthetic coding sequence
atggggaaccatctgactgagatggctcccacagcaagctcatttctccctcacttccaggctcttcacgtggtggtcattggattggactcggccggcaagacctccctgctatataggctcaagtttaaagaattcgtgcaaagtgtgccaaccaaaggcttcaataccgagaagattagggtgcctctgggtggctctcgcgggataacttttcaagtgtgggacgtgggcggacaggagaaactgcggccgctgtggaggtcgtacactcgcaggaccgacggccttgtgttcgtcgtggatgcagcagaagctgaaaggctggaagaagccaaggtggaactgcaccgcattagccgggcaagcgataatcagggggttccagtgctggtgcttgcgaacaagcaggaccagccaggggccctgagcgctgccgaggtcgaaaagcggttagccgtacgtgagctcgcagctgccaccctgacacatgtacagggatgttccgccgtggatggcctcggcttacagcaaggtctcgagaggctatatgaaatgattcttaagaggaagaaagccgccaggggcggcaagaaaagacgctag

SEQ ID NO: 107599 - DNA, 561 bp, Artificial Sequence
  Description of Artificial Sequence: Synthetic coding sequence
atgggcctactggaccggctctcagtgctgcttgggctgaaaaagaaggaggtgcacgtgctctgtctgggactggataatagcggaaaaaccaccatcatcaacaagttgaagccatcaaacgctcagagtcagaacatccttcctaccataggattcagtattgaaaaatttaaatctagcagcttaagttttaccgtgttcgatatgagcggccagggcaggtatcggaacctgtgggagcattactataaagagggccaggccatcatcttcgtcatcgatagctcagaccgtttgcgaatggtggttgccaaggaagagctggacaccctgctcaaccatcccgatatcaagcatagacgcattccgattctcttcttcgccaacaagatggacctgagagacgctgtgaccagcgtgaaagtctcccagctcctgtgcctagaaaatattaaagacaagccgtggcacatttgcgcctccgacgccatcaaaggtgagggcctgcaagagggggtggactggctgcaagaccaaattcagactgttaagacttag

SEQ ID NO: 107600 - DNA, 561 bp, Artificial Sequence
  Description of Artificial Sequence: Synthetic coding sequence
atgggcctgcttgataggctgagcgtactcctgggactgaagaagaaagaagtgcacgtcttgtgtttggggctggataactcgggcaaaacaacaatcatcaacaaactcaagccttccaatgctcagtcgcagaacatcttacccaccataggcttttcaattgagaagttcaaaagcagctccctttccttcaccgtattcgacatgtctggtcaaggtcggtacagaaacctgtgggagcactactataaagaaggccaagccatcatcttcgtcatcgattctagcgacagactccggatggttgtagctaaggaagaactggatacactgctaaatcacccagatatcaagcaccgccggattcctatcctctttttcgcaaataagatggatctgagggacgctgtcacaagtgtaaaagtaagtcaactgctgtgcttggagaacatcaaggacaagccctggcatatttgcgcgtccgatgctatcaaaggcgagggcttacaggaaggggtggattggctccaagatcaaattcaaactgttaagacatag

SEQ ID NO: 107601 - DNA, 366 bp, Artificial Sequence
  Description of Artificial Sequence: Synthetic coding sequence
atgggcttgcttgatagactatccgtattgctggggctgaagaaaaaagaggtgcatgttctctgcctggggctcgacaactcaggtaagaccactattattaataaactcaaacctagcaatgcgcagtcacagaatattttgccaaccattggattttctattgaaaagtttaagtcgtcttcactcagctttactgtcttcgatatgtccggccaaggtcgttatcggaatttgtgggagcattattataaagaaggacaagcaatcattttcgtgatcgattcatctgacaggctgagaatggtggttgcaaaggaggagctggataccttacttaaccaccctgatatcaaacacaggtag

SEQ ID NO: 107602 - DNA, 561 bp, Artificial Sequence
  Description of Artificial Sequence: Synthetic coding sequence
atgggcctcttagacaggctgagcgtacttttgggactcaaaaaaaaggaggtccacgtgttgtgcctgggtctggacaatagcggcaagaccaccattattaataagctgaagccttcaaacgcccagtcccagaacatcctccccactatcggcttcagcatcgagaaatttaagagtagctccctgagtttcacagtgttcgatatgagtggccaggggcgatatagaaacctttgggagcactattacaaggaggggcaggcaattatctttgtgattgactcctcggataggctccggatggtggtcgccaaagaggagcttgacacactcctcaatcacccggacatcaaacaccgacggattcctattctgttcttcgccaataaaatggacctgcgcgatgcagtgacttcagttaaagtgtctcagctgctgtgtcttgagaacattaaagataagccttggcacatctgcgctagcgacgcaatcaaaggcgagggtctgcaggaaggcgtcgactggctccaggatcagatacagacggtgaagacctag

SEQ ID NO: 107603 - DNA, 561 bp, Artificial Sequence
  Description of Artificial Sequence: Synthetic coding sequence
atgggacttctggacaggctgtctgtgttgctgggccttaaaaagaaggaggtacatgtcctgtgtcttggcctggataattcaggtaaaactaccataattaacaaactgaaaccatctaatgctcaatcgcaaaatatccttcctactatcggctttagcattgagaaattcaaatccagcagcttgagttttactgtatttgacatgtctggacaggggcgatacaggaacctctgggaacactattacaaagagggacaggcaatcatttttgtcatcgattctagcgatcggctcaggatggtcgtggcgaaagaggaattggatacccttctcaaccacccggacattaagcaccgccggataccaattctattcttcgctaacaaaatggatctcagggatgctgtaacaagcgtcaaggtgtcccaactgctgtgccttgaaaatatcaaagacaaaccctggcacatctgtgccagcgacgcgataaaaggagagggactccaagagggggtggattggctgcaggaccagatccagacagtgaagacctag

SEQ ID NO: 107604 - DNA, 564 bp, Artificial Sequence
  Description of Artificial Sequence: Synthetic coding sequence
ctcagacctacatggaaggctctgtcgcatcccgcttggccggaagagaagaataagcagatcctcgttttgggcttagacggggcaggaaagacctccgtgttgcattcactcgccagtaatcgagtacagcattccgtcgcccctacccagggattccacgctgtgtgtatcaatacggaggacagccagatggaatttctggagattgggggcagcaagccttttcggagctactgggaaatgtatctcagcaaaggccttctgctaatctttgtggtggacagcgctgatcacagtaggttgcctgaggcgaaaaagtaccttcaccagctgattgcagcaaatccagtattgcctctggtggtcttcgcgaacaagcaagatcttgaagcagcctaccacatcacagatatccatgaagctcttgcactttcagaagttggaaacgatcgtaagatgtttctctttggaacttatctgactaaaaacggatctgaaatcccaagtactatgcaggacgcaaaagacttgatagcccagctcgcggccgacgttcagtag

SEQ ID NO: 107605 - DNA, 1083 bp, Artificial Sequence
  Description of Artificial Sequence: Synthetic coding sequence
atggaaagagctggccccgcaggtgaagaaggtggagctcgggagggccgcctgctcccaagggcccccggagcctgggtgctacgtgcttgcgctgagcgggccgcccttgaggtgggagccgcatccgccgacacaggggtacgcggctgtggagcccgcggcccagcccccttgctggctagcgcggggggtggtcgagcacgcgatgggacctggggcgtaagaactaaggggtccggcgcagcccttcctagcaggccagcctcgcgcgcagcaccaagacccgaagcctcttctcctccattaccactggagaaggcaaggggcggtttatccggaccacaaggaggacgcgcgcggggtgctatggcgcacgttggctccaggaagcgatctcgctccagatctcgaagtcgaggccggggttcagagaaaagaaagaagaagtcccgaaaggatacgtcaagaaattgcagcgcctctacatctcagggacgcaaagcctctactgctcctggggccgaagcgtcaccgtctccctgtattacagagagatccaaacagaaggcccgcagaagaacacggtcgtcctcttcaagctcaagttcaagcagtagctcttctagttcaagcagcagctctagcagttcaagttcatctgacggccgaaagaagagaggcaagtacaaggacaagaggaggaagaaaaagaaaaagaggaagaagctgaagaagaaggggaaagagaaggctgaagctcagcaggtggaggctctacctggtcccagtcttgaccagtggcacagatcggcaggagaagaggaggatggaccagtcttgaccgacgagcaaaagtcccggatccaggctatgaagcccatgactaaggaagagtgggatgccagacagtcgataatcagaaaagtcgtggatccagaaaccgggcgtactcgattgatcaagggcgacggtgaggtgctcgaggaaatcgtgaccaaggagcgccatcgggaaattaacaagcaggccaccagaggcgattgtctcgcgtttcagatgagggccgggctgctcccgtag

SEQ ID NO: 107606 - DNA, 1017 bp, Artificial Sequence
  Description of Artificial Sequence: Synthetic coding sequence
atggagcgggctggaccagctggggaggaggggggcgccagagagggccgcctgctcccacgcgcgcccggggcttgggtactacgcgcctgtgccgagagagcggcactagaggttggggcggcgagtgccgacactggggtgcgtgggtgcggtgctaggggccctgctcctttactcgcgtcagcaggtggaggtcgagcgagggacggcacttggggggttcggaccaaaggcagcggagccgccttgccctccaggccagcctccagagcagctccccgacctgaagcttcatcaccccccttacctctcgagaaggcaaggggtggcctgtcggggcctcaagggggtcgggctagaggcgccatggcccacgtcggatcaaggaagcggagcagatcacgaagcaggtcccgcggcaggggatctgaaaagagaaagaagaaaagcaggaaggacacttcacggaactgtagtgcaagcacttctcaggaaaggtccaagcaaaaggccaggcgtcgaacacgctccagctcctcttcaagttcgtcatcctcatctagctcatcctcatcaagtagcagctcttcgagcagttccagcgacgggcgcaaaaagcgcggtaagtataaagacaaaagacgcaaaaaaaaaaagaagcgcaagaagctcaaaaaaaagggcaaggaaaaagcagaggcacagcaggttgaagccctgccaggtcctagcttggatcagtggcatcgaagcgcgggagaagaagaggacggacccgtactgactgatgaacagaaaagccggattcaggcaatgaagccaatgacaaaggaagagtgggacgctcgccagagcatcatccgcaaagttgtggatccagagacgggccggaccagattgataaagggagatggcgaggttcttgaagagattgtaaccaaagagcggcatcgggagatcaataaggtgggagtggcaccactacctgccatcaggccccagttatgtctctag

SEQ ID NO: 107607 - DNA, 1059 bp, Artificial Sequence
  Description of Artificial Sequence: Synthetic coding sequence
atggagcgcgcaggtccagctggcgaggagggtggcgcgagagaaggccggctgcttccacgcgccccaggggcctgggtactgagagcatgcgctgaaagggccgcactggaggtgggcgccgcctcagctgatacgggggtaagaggctgtggggctagaggcccagcaccattgctggcatctgccggtggggggagagcaagagatggcacatggggggtccggactaagggatcaggtgccgcactgccttcccggcccgcttcccgggccgcgccccgtcccgaagcctcctcacctccactgcctctggagaaagcccgcggaggactctcgggccctcagggcggaagagcgaggggcgctatggcacacgtagggagtagaaaacgctcccgctcacgctcccgctccaggggaaggggttcagaaaaaaggaaaaaaaagtcccgtaaggacacctctcgcaactgctccgcttcaacatcacagggaagaaaggctagtactgctccgggcgccgaggaaaggtccaagcagaaggcacggaggagaacacggagttcgtcctcaagctcatcttcgtcttcctcgtcatcctcaagttcaagctcatccagctcctccagttcttctgacggacggaaaaaacggggaaagtacaaggataagaggcggaaaaaaaagaaaaaaaggaaaaagttgaaaaaaaaaggaaaagagaaggctgaagcgcagcaagtagaggcactgcccggccctagcctggatcagtggcatcgcagtgcaggagaagaagaggatggccccgtgctgactgatgagcagaaaagtcgcatccaggcaatgaagcccatgacgaaggaggagtgggacgcaagacagagcatcattcgcaaagtcgtggatcccgagaccggacgaacacgcttgattaagggggacggcgaggtccttgaagaaatcgtgactaaagagaggcatagggagatcaacaaacaggcaactcgcggcgactgtctcgctttccagatgcgcgctggcttacttccatag

SEQ ID NO: 107608 - DNA, 1026 bp, Artificial Sequence
  Description of Artificial Sequence: Synthetic coding sequence
atggaaagggcagggcctgctggggaagaaggaggcgcaagagaaggtcgcctgctcccacgtgccccaggagcgtgggtactccgagcatgcgccgaacgggccgctcttgaggtgggcgccgcctcggccgatacgggagtgcgtgggtgcggtgcccgcgggcctgctcccttgttggcctccgctgggggaggaagagctagagatggcacgtggggggtcagaactaagggctccggagctgccctgccgagccgcccggcctcgcgagctgcaccccgacctgaagcctccagtccacccctgccactggagaaggcgaggggcggcttaagcgggcctcagggggggcgcgccagaggagccatggcccacgttggtagtcgcaagcggagtcgctcccgatcgcgctccagggggcgtggtagcgagaaacgtaagaaaaaaagcaggaaggatacttcgaggaactgttctgctagcacctcccaggagcgtagcaaacagaaggcccgaagacggactcgctccagcagctcttccagctcatcatcttctagtagctcatcctcctcttccagcagcagtagcagcagctccagcgatggaagaaagaaacggggaaagtataaggacaagagacgcaaaaagaaaaagaagcgcaagaagttaaaaaaaaagggcaaggagaaggctgaggcccagcaggttgaggccctgcccggacccagcctcgatcaatggcatagaagtgcaggggaggaggaagatggacctgttcttactgatgagcagaagtctcgtattcaggcgatgaagccaatgactaaggaggaatgggacgccagacagagtattatcaggaaagtagtggaccccgagactggtcgaaccagactgattaaaggagacggcgaggtgctggaggagatcgtaaccaaggagcgacaccgtgagatcaacaagcaggccacaagaggcgactgtctggcgttccagatgagagccgggctgttgccctag

SEQ ID NO: 107609 - DNA, 567 bp, Artificial Sequence
  Description of Artificial Sequence: Synthetic coding sequence
atggacgttaatatagctcccctgcgcgcctgggacgactttttcccaggcagtgataggttcgcacgccctgacttccgggacataagcaagtggaacaatagggtggtaagcaacctgttgtactatcaaacaaactatctagttgtcgccgcaatgatgatttccatcgtggggtttctatccccatttaatatgatcttaggcgggattgtggttgtcctcgtgttcaccgggttcgtgtgggccgcgcacaacaaggacgtactccgacgcatgaagaagcgctatccaaccaccttcgtgatggtcgttatgctggctagctactttctgattagcatgtttggcggcgtgatggtgttcgtgtttgggatcacttttcctctcctgctgatgttcatccatgctagcctccgcttgaggaacctgaaaaataaactggaaaataagatggaggggattggcttgaagcgaacaccaatggggattgttctcgatgcactggaacagcaggaggaagggattaaccgtctgacagattacatctccaaagtaaaagaatag

SEQ ID NO: 107610 - DNA, 411 bp, Artificial Sequence
  Description of Artificial Sequence: Synthetic coding sequence
atggacgtaaatattgctccgctgagggcttgggatgatttcttccccggcagcgaccgtttcgccagaccagacttcagggacatcagtaagtggaacaaccgggttgtctcaaacctcttatactatcagacgaattatctggttgtggccgccatgatgatatctattgtggggttcctcagtccatttaacatgatcctcggggggatagtggtggtgctcgtctttactggatttgtgtgggccgcacacgacgtgcgctatggcgggcacgtgggcgagctgtttccctatttgcacgtgtggagaagccacgggctgtgcgtctggcattacttcagttttgccgtggacgtgtacccatgcatcgtcgagacctcggaaccccaggaacagactggggaatag

SEQ ID NO: 107611 - DNA, 819 bp, Artificial Sequence
  Description of Artificial Sequence: Synthetic coding sequence
atggtgcgatgttacgtggaaattgttgaaaagctccctgagcggcgccccgatccagcaacaatcgaaggatgcgcccagttgaagcccaacaactacttactggcctggcatacgcctttcaacgaaaaagggagcggcttcggtgctgctactaaagccatgtgtatcggactgaggtattggaagcccgagagattagagaccctgattgaagtttcggtggagtgcgggagaatgacccacaaccacccgactggctttttggggtccctgtgtaccgccctatttgtgagttttgctgcacaggggaagccgcttgtccagtgggggcgcgacatgctgcgggctgtgccgctggccgaagagtattgtcgcaagactattaggcacactgccgagtatcaagagcattggttttacttcgaagccaaatggcagttttaccttgaagagcgcaagatcagtaaggactcagagaacaaggcaatcttccctgataattacgacgctgaagaacgggagaaaacctaccggaagtggtctagtgagggaagaggggggcgcagagggcacgacgccccaatgatcgcatacgacgcactgctggctgccggcaattcttggaccgaactctgtcaccgcgcgatgtttcacgggggagagtcagcagcaaccggcacaattgccggctgtttgtttggacttctttatggactggatcttgtgccgaaagggctgtaccaagatctggaggataaggagaagctggaagaccttggggcggctctatatcggctcagcaccgaggagaaatag

SEQ ID NO: 107612 - DNA, 1065 bp, Artificial Sequence
  Description of Artificial Sequence: Synthetic coding sequence
atggagaagtttaaggcggcaatgctgctggggagcgtgggcgacgccctgggctatcgcaacgtgtgtaaggagaattctaccgtcggcatgaaaattcaggaggagcttcagcggtctggagggctggaccatttagtgctctcgcctggggaatggccagttagcgataacaccattatgcacattgccaccgccgaggcgctcacaaccgactattggtgcctagatgacctgtatcgcgagatggtgcgctgctacgttgaaatcgtggagaagctccctgaaagaaggcccgaccccgccactatcgagggctgtgcccaactcaaacctaacaactatttgttagcttggcatacaccctttaacgaaaaaggcagcggattcggcgctgccaccaaagcaatgtgcatagggctgaggtattggaagcccgagaggctggaaaccctaatagaggtttcagtggagtgcggcaggatgacacacaatcaccccaccggatttttaggcagcctatgtacggctcttttcgtatccttcgctgctcagggaaaaccattggtccaatggggcagggatatgttacgggccgtccccttggcagaggaatactgcagaaagaccatccggcacacagccgagtaccaggagcattggttttacttcgaagcaaagtggcagttctacctggaggaaagaaaaatctcaaaggacagcgagaataaagccatattcccagacaattacgacgccgaggagcgcgaaaaaacatacagaaaatggtctagcgaaggtcgggggggtcggcgcggtcacgatgcccctatgatcgcttacgacgccctgttggctgccgggaactcctggacggagctctgtcatcgggccatgttccatgggggcgaaagcgcagcaactggaaccattgctggatgccttttcggcctgttatatgggttggatcttgtgccaaaaggcctgtatcaggatctcgaggacaaagagaagctggaggacttaggtgcggcactctaccggctctccactgaagagaagtag

SEQ ID NO: 107613 - DNA, 531 bp, Artificial Sequence
  Description of Artificial Sequence: Synthetic coding sequence
atggtgaggtgttacgtcgagatcgtggagaaactccccgaacgccggccagacccagctaccatcgagggatgcgcccagttaaaaccaaataactatctcctggcctggcatacacccttcaacgagaagggtagcgggtttggtgccgccaccaaggctatgtgtatcggcctaagatattggaaacctgagcggttggaaaccttaatagaagtgtctgtcgagtgcgggaggatgacgcacaaccaccccacaggtttcttgggcagcctttgtaccgccctctttgtttccttcgccgcacagggtaagcctctggttcaatgggggcgggatatgctcagagccgttcccctcgccgaagaatattgccgcaagaccatccggcacaccgcagaataccaggagcactggttctacttcgaggcgaaatggcagttttaccttgaagaaagaaagatttccaaagatagcgagaataaggcaatttttcctgacaattacgacgcggaggagagggaaaaatag

SEQ ID NO: 107614 - DNA, 1092 bp, Artificial Sequence
  Description of Artificial Sequence: Synthetic coding sequence
atggcagcggcagcgatggctgccgccgcagggggaggagcaggcgcagcaaggtctctttctcggtttcgtgggtgtctggcaggtgcactgcttggggattgcgtggggagtttttacgaggctcatgatactgtggatcttacttccgtgctgagacacgtgcagtcactggagcctgaccctggaactccagggtcagaacggactgaggctctttattatactgatgataccgctatggccagagcccttgtgcagtctttactggccaaagaggccttcgacgaggtagacatggctcatcgcttcgcccaggagtataaaaaggatcccgatcggggttacggagccggcgtggtcaccgtgtttaagaaactgctcaatcccaaatgcagggacgttttcgagcccgcgcgggcccagttcaatgggaaggggagttatgggaacggcggcgcaatgcgggtggcaggaatatcattagcatactcttccgtacaggacgtccagaagtttgctcgtctgtcagcacagttgactcacgcaagttcactggggtacaacggggccatcctgcaagccctcgctgtgcatctggctttgcagggggaatcctcatctgaacatttcctcaagcagctgcttggccacatggaggacctagagggggacgcgcagagcgtcctcgacgcccgggagctcggtatggaagagagaccctactcctcgcgcttaaagaaaattggagagcttctggatcaagcctcagtgactagggaagaggtagtttctgagctgggaaacggaattgccgcatttgagagtgtccccaccgcaatttactgttttttacgctgtatggaacccgaccccgagattccgagcgccttcaacagtctacagagaacattaatctactcaatctctttggggggcgatacagacacgattgccacgatggcaggtgccattgcaggcgcttattacggaatggatcaggtgcccgaatcatggcagcaatcttgcgaagggtatgaagaaaccgatatattggctcagtcccttcatagggtcttccagaaatcctag

SEQ ID NO: 107615 - DNA, 852 bp, Artificial Sequence
  Description of Artificial Sequence: Synthetic coding sequence
atggctagggcgctcgtgcagagtttacttgccaaggaagcatttgacgaggtggacatggcgcacagattcgcccaggaatacaaaaaagatccagacagaggctatggggccggagtggtcaccgttttcaagaaactgttgaacccaaagtgtagagacgtgtttgaaccggctcgcgcccagttcaacggaaaagggtcttatggtaacgggggtgctatgcgcgtggcaggcatcagtctagcatattcaagtgtccaggacgtgcagaagtttgcgcggctttcggcacagctgacccatgcctcgtctctcggttacaacggggcaatactgcaggctctcgccgtgcacctggctctgcagggcgagtcatcaagcgaacatttccttaagcaactgttgggacacatggaggatcttgaaggcgatgctcagtctgtgttagacgccagggagttaggaatggaggagcgaccatatagctctcggctaaaaaagatcggcgaactgctagatcaggcctctgtgacacgagaagaggttgtgtccgagttagggaacggtatagccgcattcgagtctgtccctacggccatctactgcttcctgcgctgtatggagccggatcctgaaataccttcagctttcaactcactccaaaggaccctcatttattcaatctccctcggaggcgacaccgataccattgcaacgatggccggcgccatcgctggtgcatactatggtatggatcaggtacctgagagttggcagcagtcttgtgagggctacgaagagaccgacatactcgcccagagtcttcatcgcgttttccagaagtcttag

SEQ ID NO: 107616 - DNA, 630 bp, Artificial Sequence
  Description of Artificial Sequence: Synthetic coding sequence
atgagggttgccggtatatcgcttgcgtactctagtgtgcaagatgtgcagaagttcgcacgacttagtgcccagctaacccacgcctctagcctcggttataatggagcgattttgcaggcattggcagtccatctcgcccttcagggagaaagctcttcagagcacttccttaaacaactgctgggccatatggaggaccttgagggcgacgcacaatcagtgttggatgcccgcgagctgggcatggaggaacgaccctatagtagtcggctgaaaaagattggagagttgttagaccaggcgtctgttacaagggaggaagtagtcagcgagctggggaacggcatcgctgcctttgagagcgtacctaccgccatttattgttttcttaggtgcatggaacccgatcccgagattccctcagcctttaattccttacagaggactctgatttattccatctctctaggaggggacacggacacaatagccaccatggctggagccattgccggcgcctattatgggatggatcaggtccctgaatcatggcaacagtcctgcgagggctatgaagagaccgacattcttgctcagtcacttcaccgcgtctttcagaagagctag

SEQ ID NO: 107617 - DNA, 984 bp, Artificial Sequence
  Description of Artificial Sequence: Synthetic coding sequence
atgcagatgcccgccatgatgagcttactgttagtgtctgttggtttaatggaggcactgcaggcccagagtcaccctatcacccgcagggatctcttctcccaggagatccagctggacatggccttagcctcatttgatgatcaatatgccgggtgcgctgccgccatgactgccgcattgcccgacttaaatcataccgagttccaggccaatcaagtttacgcggacagttggaccctcgcttctagtcagtggcaggaacgacaggctaggtggccggagtggagtctgagccctaccagaccctctccccccccgttgggctttcgggatgagcatggcgtcgcattgctagcttacacagcaaactcccctctgcataaggagtttaatgcagcggtgagagaggccggcaggtccagggcacattatttgcaccatttttcctttaagacactgcacttcctgttgacagaagctctgcaactgctcggatcaggccagcgcccgcctcggtgccaccaggtcttcagaggcgttcatggactcagattccgacctgcgggcccacgagcaacagtgaggttgggggggttcgcatcagcttcgctgaagcacgtggctgcccaacagttcggggaagatacattctttggcatttggacatgtctgggagcaccgattaagggatactcattttttcccggggaagaggaggtcctcattccaccctttgagacctttcaggtgattaacgccagccggctggcgcaggggcctgcccgcatttacctacgggcccttggcaagcacagcacttacaactgtgagtacattaaagacaagaagtgtaagtcagggccctgccacttggacaactctgctatgggccagtcacctctctcagcagtctggtcactcctgttactgctgtggtttctcgtggtgcgcgcgtttcccgatggacccgggcttttatag

SEQ ID NO: 107618 - DNA, 1104 bp, Artificial Sequence
  Description of Artificial Sequence: Synthetic coding sequence
atgaagacgggccatttcgaaattgtgacaatgcttcttgccaccatgatcctggtcgacatatttcaggtgaaggccgaagtgttggacatggccgacaacgcattcgacgatgaatacctgaagtgcactgatagaatggagattaaatatgtcccccagttgctgaaggaggagaaggctagccatcagcagctcgatactgtatgggagaacgctaaggccaagtgggcagcaagaaagactcagatcttcctccctatgaattttaaagacaaccacgggattgctcttatggcttacatcagcgaagcccaggaacagacgcctttctatcacctattcagcgaggctgtgaagatggccggccagtcacgggaagattacatatatggttttcagtttaaggctttccatttctacttgacccgagctctgcagctgttgcgaaagccctgtgaggcctctagtaagaccgtggtatatcgaaccagtcagggaacttcattcacgtttggaggcctcaaccaggccaggtttggacactttaccttagcatacagtgccaagccacaggctgccaacgaccaacttaccgtgctgagtatttatacgtgcttaggagtcgacatcgaaaacttcctagataaggagtccgaacgtattacactcattcccctgaacgaggtcttccaagtctcccaagagggtgccggcaacaatttgattctgcagtccattaataagacatgcagtcactatgaatgtgcattcttaggcgggctgaagaccgagaactgtattgagaacctggaatacttccagcctatatacgtgtacaatcctggagagaaaaaccaaaaactcgaggatcacagcgagaaaaattggaaactcgaggatcatggagaaaaaaatcagaaactagaggaccacggagtgaaaatcctggaaccaacgcagatacctgccccagggccagtcccagtccctggtccaaagtcccacccgtctgcctcctccggcaagctcctgttaccacagttcggaatggtgattatcctgatttccgtgtccgctattaacctgtttgtcgcactttag

SEQ ID NO: 107619 - DNA, 1137 bp, Artificial Sequence
  Description of Artificial Sequence: Synthetic coding sequence
atgaaaaccggccactttgagatcgtaactatgctgctggcaactatgatcctcgtcgacatcttccaggtgaaggcggaggtgcttgatatggccgataatgccttcgacgacgaatatctcaagtgcaccgaccggatggagataaaatatgttccacagttactcaaggaagaaaaggcctcccatcaacaactggatactgtttgggagaatgccaaggctaagtgggccgcccggaagacccagatcttcctgcctatgaatttcaaagacaatcatggtatcgccctcatggcctacattagtgaggcccaggagcaaaccccattctatcacttattttccgaggctgtgaagatggcaggtcagtcgagagaggactacatctacgggttccaattcaaggcctttcatttctatctgactcgcgctctgcagctattgaggaaaccctgtgaagcttcctcaaagaccgtggtttaccggacatcacagggcactagctttacttttggagggctgaatcaagctcgtttcggacattttactctggcctattcagctaagccgcaggcagccaatgatcaattgacagtactgagcatctatacttgtctgggcgtggacatcgagaactttttggacaaagagagcgagcggataacgttaatcccgctgaacgaggttttccaagtctcacaggaaggagccggcaataatctaatcctacaatccataaataagacatgtagtcattatgaatgcgccttcctggggggcctgaaaacggagaactgcatcgagaatcttgagtatttccagcctatctacgtgtataacccaggcgagaagaaccaaaaactggaagatcacagtgaaaaaaactggaaactggaggaccacggcgagaaaaatcagaaacttgaagatcatggtgtgaagatactcgagcctactcagatccctgaagataagagtcaaggcaacatcaacaatcccacaccaggtcctgtgcccgtgcccggtccaaaatctcatccaagtgctagctctggcaaactgctcctgcctcagtttggcatggtgattattctgatttcagtcagtgcaattaacctctttgtggccctgtag

SEQ ID NO: 107620 - DNA, 1170 bp, Artificial Sequence
  Description of Artificial Sequence: Synthetic coding sequence
atgaagacagggcacttcgaaatcgtgaccatgctcttagctacgatgatccttgtcgatattttccaggtgaaggcggaggtccttgacatggcagataatgcgttcgacgatgagtatctcaagtgcactgaccggatggagatcaagtacgtgccgcagctcctcaaggaggagaaggcatcccatcagcaactggacactgtgtgggagaatgctaaagctaagtgggcagccagaaaaactcagatctttctcccaatgaactttaaggataatcacggaatcgccctcatggcttatatctcagaggctcaggagcaaactcccttctatcatctgttcagcgaggccgtgaagatggccggtcagagtagggaagactacatctatggattccagttcaaggccttccacttttacttgacgagggccttacagttactccgtaagccttgtgaggctagctccaaaaccgtggtgtaccggacatctcagggcacatcctttacttttggcggccttaatcaggctcgctttggacattttaccctggcttactcagccaagccgcaggcagccaatgaccaattgactgtcctgagcatatatacatgccttggggttgatattgaaaacttcttggataaagagagcgagaggattactctcatccccttgaacgaagtgttccaggtgtcacaagaaggcgccggcaacaatttgatcctccagtcaatcaataaaacctgttcccactacgagtgtgcatttctgggtgggctcaaaaccgagaattgcatcgagaacttggagtactttcaaccaatctacgtgtacaacccgggagaaaaaaatcagaaattggaggaccacagtgaaaaaaactggaagttggaggaccacggtgaaaaaaaccaaaagctcgaggaccacggggttaagattctcgaacctacccaaatcccagggatgaagatcccagaaccctttcctctgccagaggacaagagtcaaggtaatatcaacaacccaaccccaggacccgtgcctgtgccaggccctaaatcccaccctagcgcttccagcggaaaattgttgctccctcaattcggaatggtcattattctgattagcgtgagcgccattaatctgtttgtggccctgtag

SEQ ID NO: 107621 - DNA, 390 bp, Artificial Sequence
  Description of Artificial Sequence: Synthetic coding sequence
atgaaaaccggacattttgagatcgtgaccatgctgctggccacgatgatcctggtagatatcttccaggtgaaagcagaagtcctagatatggccgacaacgcctttgacgatgaatacttaaagtgcactgacaggatggagattaagtatgtgcctcagcttctcaaagaggagaaggcctcccatcagcagcttgacacagtatgggagaacgccaaggccaagtgggcggcccgcaagacccagattttcctgcccatgaattttaaggataatcacggcatcgctctgatggcttacataagcgaggcccaggagcagaccccattttaccacctcttcagtgaagcagtgaaaatggccgggcaaagccgagaagactattag

SEQ ID NO: 107622 - DNA, 528 bp, Artificial Sequence
  Description of Artificial Sequence: Synthetic coding sequence
atgaagaccggccatttcgagatagtgactatgctgcttgcaaccatgattttggtggacatttttcaggtcaaagcagaagtcttggacatggcagacaacgccttcgatgatgaataccttaaatgtactgaccgcatggaaatcaaatatgttccccagctgctgaaggaggaaaaagcaagccatcaacagctggatacagtatgggagaatgcaaaggccaaatgggccgcaaggaagacccagatattcttgcccatgaacttcaaggacaatcacggaattgcacttatggcgtacatctctgaagcccaagaacagacaccattctaccatctcttttccgaagctgtgaaaatggcgggtcagagccgggaggactacatttatggatttcaattcaaggcttttcacttctacctgactcgggccctgcaactcctgcgaaaaccctgcgaggcctcaagcaagactgttgtgtacaggactagccaagggacgtcatttacatttggcgggttgtag

SEQ ID NO: 107623 - DNA, 609 bp, Artificial Sequence
  Description of Artificial Sequence: Synthetic coding sequence
atgaagacaggccacttcgagattgttacaatgcttctggccacaatgatattggtggacattttccaagtgaaggcagaagtcctggacatggctgacaatgcattcgatgatgaatacctaaaatgtactgatcggatggaaatcaagtacgtgcctcagctgctaaaggaggagaaagcctcgcatcagcagctggacactgtatgggaaaatgcaaaagccaagtgggcggctcgcaagactcagatctttctccctatgaactttaaagataaccacggcatagctttgatggcatacatctcggaggcccaagagcagaccccattttaccacctattctctgaagccgttaagatggctgggcagagtcgcgaggattacatctacggcttccagtttaaggcctttcacttctacctgactcgagctttacagctgttacggaagccttgtgaagcttcttctaaaacagttgtgtaccgaacatcccaggggacatcctttacattcggcggattgaaccaggccaggtttgggcactttacgctcgcctactcggcaaagccacaggcggcaaacgatcaactgacggtgctgtcttag

SEQ ID NO: 107624 - DNA, 324 bp, Artificial Sequence
  Description of Artificial Sequence: Synthetic coding sequence
atgaaaacgggccactttgaaattgttaccatgctgttggctaccatgatcctcgtagacatcttccaagttaaggccgaggtgctggatatggctgacaatgcattcgacgacgaatatctgaagtgcactgatcgcatggagataaaatacgtgcctcagctgctgaaggaggaaaaggctagccatcagcagctcgacacggtctgggagaatgctaaagcaaagtgggctgccagaaagacacagatatttctcccaatgaattttaaggacaaccacgggatcgcgcttatggcttacatttcagaggcccaggaatag

SEQ ID NO: 107625 - DNA, 456 bp, Artificial Sequence
  Description of Artificial Sequence: Synthetic coding sequence
atgtctggcagaggcaagcagggagggaaggtcagagctaaggccaaaagccggagcagtcgggccggcttacaattccctgtcggtcgggtgcaccgcctgcttcggaagggcaattacgctgagcgagtgggagcaggcgccccagtttatctcgcagctgtcttggagtatctcacagccgagattctggaattggcgggaaatgccgccagagacaacaaaaaaaccaggatcattccaagacacctgcagttggccataaggaacgacgaggagctgaataaacttctggggaaggtgacgattgcccagggtggcgtgctaccaaacattcaagcggtgctactcccaatttgcgagcacagtgggccaagctccggaaaaatcccttcagatcgcgccgaattaggtgcaggtagcgtctgcggtcacatcttccaaaaagtcgaatag

SEQ ID NO: 107626 - DNA, 177 bp, Artificial Sequence
  Description of Artificial Sequence: Synthetic coding sequence
atgggccccttgataaaccggtgcaaaaaaatccttctaccaacgaccgtcccaccagctaccatgagaatatggcttctcggcggccttcttccattcctacttctgctttccggcctccagcgtcctactgagggtagcgaattgcctgcccgcaacgcaagcctgatcctgtag

SEQ ID NO: 107627 - DNA, 876 bp, Artificial Sequence
  Description of Artificial Sequence: Synthetic coding sequence
atggcgttggccgcactgatgattgctctgggaagcctgggccttcacacctggcaagcacaggcggtccccatcctacctcttggcctggctcctgacaccttcgacgatacctacgttggctgtgctgaagagatggaggaaaaagcagctcccctgctgaaggaggaaatggcacaccacgctctgctgagggaatcctgggaagctgcccaggagacatgggaagacaagagacggggccttactctcccccctggattcaaagctcagaacggcatcgccattatggtatacactaattccagcaacacgctgtattgggaactcaaccaggctgtcagaacaggcggcggaagccgcgaactatacatgaggcattttccttttaaggcccttcacttttacttaatccgtgcattacaactcctcaggggcagcggaggatgctcaaggggccccggcgaggtggtcttccggggagttggcagcctccgttttgaacccaagcggcttggggattctgtgaggctgggacaattcgcctccagtagcctcgacaaggcggtggcacaccgcttcgggaacgcgacactatttagtctcacaacgtgtttcggcgctccgatccaagccttttcagtcttccctaaagagcgggaggtcctaatccctcctcatgaagtattccttgtgactagatttagccaagacggggcccaatctctcgtaaccctttggagttacaaccagacatgctcacacttcaactgcgcgtacctggggggcgaaaagcgtcggggatgtgtgagcgctcctggagcccttgggacaggagatctgcatatgaccaaacgccatctccagcaaccatag

SEQ ID NO: 107628 - DNA, 720 bp, Artificial Sequence
  Description of Artificial Sequence: Synthetic coding sequence
atggctctggccgccctcatgattgccctgggatccctgggcctgcatacctggcaggctcaggccgtgcccatccttcctctcggacttgcccctgacacgttcgatgatacatacgttggatgtgccgaagaaatggaggaaaaagcggcccctcttttgaaggaggaaatggctcaccacgctctactaagagagagctgggaggctgcacaggaaacctgggaagacaagcgtcgagggcttaccctgccaccagggttcaaagcccagaatggaatcgccatcatggtctacaccaactcaagcaatacactgtactgggagctgaatcaggctgtgaggacaggcggaggaagtagggagctgtatatgaggcactttccctttaaagcgttacatttctacttaattagggcactgcagcttctgcggggaagcgggggttgcagccgaggccccggcgaggtagtattcaggggcgttggtagccttagatttgaaccaaaaagactgggagactcagtcaggctcggccagttcgcttctagctcattagataaggcggtcgcccacagattcggagaaaaaaggcggggctgtgtcagtgcccctggtgtacagttagggtcccagtccgagggtgctagcagcctccccccatggaaaacgcttctactggcgcctggggaatttcaattgtccggcgttggtccttag

SEQ ID NO: 107629 - DNA, 876 bp, Artificial Sequence
  Description of Artificial Sequence: Synthetic coding sequence
atggctctggccgctctgatgatcgctctcggatctcttgggctccacacgtggcaggcacaagcagtccccattttgcctctcgggctggcacccgacacatttgatgacacatacgtggggtgcgctgaggagatggaagagaaggccgctcctctgttgaaggaagagatggcccatcatgccctgcttagggaatcctgggaggctgcccaggaaacctgggaggataaacgaaggggcctgacattaccgccaggatttaaggcccagaacggcatagctattatggtatataccaacagtagcaataccctgtattgggagctgaaccaggcggtgcgtaccggaggcggatcacgggagctctacatgcgtcactttccatttaaggccctacatttttatctgattagagctctgcagctcctccgagggtctggtggatgtagccgaggaccaggcgaggttgtcttcagaggcgtggggagtttaagatttgaaccaaaaagactcggggactctgtacggctggggcaatttgccagcagtagccttgataaggctgttgcgcacaggtttggcaacgccacactgttcagtttaaccacatgcttcggtgctcccattcaagcctttagcgtgtttcccaaagagagggaggttctgattcctccacatgaggtttttctggtcaccaggttttcacaggacggcgctcagtccttagttaccctgtggagctacaaccaaacatgctcacacttcaattgcgcgtacctgggaggtgagaagcggcgggggtgcgtaagtgcccccggagcgttagggactggagacttgcacatgacgaagcgccacctccaacagccatag

SEQ ID NO: 107630 - DNA, 1401 bp, Artificial Sequence
  Description of Artificial Sequence: Synthetic coding sequence
atggtgtttctttctggaaatgctagtgatagcagtaactgcacacagcccccggcacccgtgaatatcagcaaagcaatcctgctaggggtcatattgggaggacttattctgtttggcgtgcttggcaacattctagtaattctgtcagtcgcctgccatcgtcatctgcactccgtgacccactattatatcgttaatctcgccgtggctgacctgctcttaactagcaccgtccttcctttcagcgctatcttcgaggtgctgggctactgggcatttgggcgcgtgttctgcaatatctgggccgccgtagatgtgctttgctgcacagcatctatcatgggtctgtgcatcatctccattgaccggtacatcggggtttcttatcctctccgctacccaaccatcgtcactcagcgacggggcttgatggcgctgctctgcgtgtgggcattatcactggtgattagtattgggcccctgttcgggtggcgccagcccgcaccagaggatgaaacgatatgccagataaacgaggagcctggatatgtgttgttttcagccctgggctccttttaccttcccctggcgatcatactggtgatgtactgccgggtatatgtagtagccaagcgtgaaagtcggggcttgaaaagcggcctcaaaactgataagagcgactctgaacaggtaactcttcgtattcatcgtaaaaacgctccagctggcggttcagggatggctagcgcgaaaactaagacacatttcagcgttcgcctactgaagtttagtcgcgaaaagaaggctgctaagaccctgggaattgtggtcgggtgcttcgtgctgtgctggctcccattttttttagtgatgccaatcggttcgttcttcccagacttcaaaccctccgaaacggtctttaagattgtcttttggctcggatatcttaatagttgtataaaccctatcatttacccgtgctcgagtcaggagttcaagaaagcattccagaacgtgctgcggattcaatgtttgtgccgtaagcagtcctctaagcatgccttgggctacacactgcaccccccttcgcaggcagttgaaggacagcataaagacatggtacggatacccgttggatcaagagagaccttttaccgtatttctaaaactgacggagtttgtgaatggaaattcttttctagtatgccaaggggctcagcaaggataactgtgagcaaggaccagtcctcctgtaccaccgcccgcgtaaggtcgaagtccttcctgcaggtctgctgctgcgtggggccttccaccccctctcttgataagaaccatcaagtgccgaccattaaagtgcacactatcagcctctctgagaacggagaagaggtgtag

SEQ ID NO: 107631 - DNA, 1368 bp, Artificial Sequence
  Description of Artificial Sequence: Synthetic coding sequence
atggtcttcctctccggtaatgcatccgactcaagtaattgtacccagccccccgcgcctgtaaatatttccaaggcaattctgttgggcgtgatcctgggaggactaattttgttcggagttctgggaaacatactcgtcattctttctgttgcatgccacaggcatcttcactctgttactcactattacattgtgaacctcgcggttgccgatctcttgctgacatctaccgtgctcccattcagtgcaatcttcgaagtgctgggttactgggcgtttgggcgcgtgttttgcaatatctgggccgcagtcgatgttttatgctgcactgcttcaatcatggggctctgtattatttctatcgaccggtatatcggggtaagctaccctctgcgttatcctactatcgttacgcagagaagggggctgatggcgctcctatgcgtctgggcattaagcctcgtcatctctatcgggccactgtttggttggcggcagcctgctcctgaggacgaaaccatttgccagattaacgaggagccgggttatgtgttattttccgccctcggcagcttttatttgccactcgcaattatcctggtaatgtattgcagagtgtatgtagtggctaagcgagaaagcaggggcctgaagagtgggttgaagactgacaagagcgactctgagcaggtcaccctccgaattcacagaaagaatgcgccggcaggcggatccgggatggcctcagcgaaaactaagacacatttctcagtcagacttttaaaattttcgcgagaaaagaaggccgctaagactttaggtatagtcgtgggatgtttcgttctttgttggcttccatttttcctggtgatgccaattgggtccttctttcctgattttaaaccctcggaaacggtttttaagattgtcttctggcttggctatcttaacagctgtattaatcctatcatctatccatgcagtagccaggagttcaagaaggcattccagaatgttctgcggatccaatgcctttgtcggaaacagtcttccaaacatgctctgggatatacactgcacccgccatcccaagcagttgaaggacaacacaaggacatggtcagaattcccgtgggatcacgggaaaccttttaccgcattagcaagaccgacggagtttgcgaatggaaattcttttcaagcatgcctcgcggcagtgccaggattaccgtgagcaaagatcagtcttcctgtacaacagcgcgtagagggatggattgtcggtattttaccaagaactgccgggaacacattaaacacgtaaatttcatgatgcctccttggaggaaggggagtgaatgctag

SEQ ID NO: 107632 - DNA, 975 bp, Artificial Sequence
  Description of Artificial Sequence: Synthetic coding sequence
atggtgtttctgtccgggaacgcctctgatagtagcaactgcactcaaccccccgcccctgtgaacatcagtaaggccatcttacttggcgtgattctgggcggcctgatcctctttggggtcttggggaacatcttggtaattttatccgtcgcctgtcatcgccatctacactctgtgactcactactatatcgtgaaccttgctgtggccgatctgctcttgacatcaactgttttacctttcagtgctatcttcgaagttcttggttactgggcatttggccgagtgttctgcaacatctgggccgccgttgacgtcctatgttgcactgctagtattatgggactttgcattatctctatcgaccggtacataggcgtgagttaccccctgcgctacccaacaatcgtcacacagcgtagggggctgatggcactgctttgtgtgtgggctttgagcctggtaatctccatcggacccctgtttgggtggcgacaaccagcacccgaggacgagaccatatgccagattaacgaggaacccggctacgttctcttcagcgccctggggtcattttaccttcccctcgccatcattctcgtcatgtactgtagagtctacgtagtggctaagagagaatctcgggggttgaaatctggacttaagacagataaatctgattctgagcaggtcacactaaggatccatcgaaaaaacgcgcctgcaggcggctctgggatggcatccgcgaagaccaagacacactttagtgtgagactactgaaattctctcgcgagaagaaggccgcaaaaactcttggcatcgttgtcgggtgtttcgttttatgttggttaccattctttctagtaatgcctattgggacctatatcttgaagtacgacgtgctattctggagaaaagggctatctgtgtgtacaaggctgcgcgaaagaaaggagatcaagaactag

SEQ ID NO: 107633 - DNA, 1029 bp, Artificial Sequence
  Description of Artificial Sequence: Synthetic coding sequence
atggtgtttttaagcggaaatgcatcagattcctcaaattgcacacagccacctgctcccgttaacatctcaaaagcaatccttcttggtgtaatcttagggggattgattctcttcggggtgttggggaacattctggtgatcctctctgttgcgtgtcatcgccacctccactcggtcacacactattacatcgttaatcttgccgtggctgatctgctcctgaccagtactgtactgccattctccgctatatttgaggtgttaggttactgggcctttgggcgggttttctgtaatatatgggccgcagtcgatgttctctgctgtactgcaagcattatgggactgtgcataatctcaatcgacaggtatattggtgtgtcatacccactccgataccctacaatagtcacacagaggagaggattgatggcattactttgcgtttgggcgctgtctctggtgatctctattggccccctgttcggctggcgccaacccgcacctgaggacgagacaatttgtcagatcaatgaggagcctggctacgttttgttttcagctctcgggtccttttaccttcctctagccattatactggtaatgtactgcagagtttacgtggtggctaagcgggaaagtcgcgggctcaaatcagggcttaagacagacaaatcagatagcgaacaagtgacgctgcggattcatagaaaaaatgcacccgcggggggatccggcatggctagcgcgaaaaccaaaacccacttttcggtcagactgctcaaattttcccgtgaaaagaaggcagctaagactttaggcatcgtcgttgggtgcttcgtgctttgttggctgccctttttcctggtgatgccaatcgatgaagaaacagaagcccaagagggcaagaatgacagcccttcgttcaagcaacctgtgcaccacgcggctgtgctgggcttggaggtgatggaaaaagagaatctggagggtgtgtcacgcaaagacacgtgcggcgtgtggtag

SEQ ID NO: 107634 - DNA, 1401 bp, Artificial Sequence
  Description of Artificial Sequence: Synthetic coding sequence
atggtgttcctttctggaaatgcctctgatagttccaattgtacccaacctcccgcgccagtcaacataagtaaggccatactcctgggagtgatcttaggaggcctgatcctcttcggcgtgcttggaaatatcttggtaatcctgagcgtcgcttgccatcggcacctgcattctgtaacccattattacatcgttaatctggccgtggctgacttactgctgacttcaaccgtccttcccttcagcgcaattttcgaggttttgggctattgggccttcggacgtgtgttctgtaatatctgggccgccgtggacgtgttatgttgtactgcatcgatcatgggtttatgcattatctccattgacaggtacatcggcgtcagctatcccttgcgatacccaactattgtcacccagaggcgcggattaatggctctcctctgtgtgtgggctttaagcctcgtcatttctattggtcctttgtttggatggcgccagccagctcccgaggacgaaaccatttgccagattaacgaagaaccgggatacgtattgttttccgctctcggttccttctacctgcctctcgccataatcttggtgatgtattgtagagtgtacgtggttgctaagcgggaatccagaggccttaagagcgggctaaagacggacaaatccgacagcgaacaggtcacactcagaatccatcggaagaatgcccctgccgggggaagtggaatggcttccgccaagacaaagacacacttcagcgtcagacttctcaagttctctcgcgagaaaaaagctgctaaaacactgggcattgtggtcggatgttttgttctatgttggctgcctttttttttagtaatgcccattggttcctttttccccgatttcaaacccagcgaaacagtcttcaaaatcgtattttggctaggctacctcaattcctgtatcaaccccattatttatccatgctctagtcaggagtttaagaaagcgttccagaacgtgctgagaatccagtgtctttgtagaaagcagagctcaaagcatgcacttggttacacattgcatcctcccagccaggctgtggaagggcagcacaaagatatggtgagaattcctgtggggagccgtgagaccttctatcgcatcagtaagactgacggggtctgcgagtggaaattcttctcatctatgccacggggctcggccaggataactgtgagtaaggaccagagtagctgcaccaccgcgcgggtgagaagtaaatcatttctccaggtgtgctgttgtgttggtccctctacgcctagtttggacaaaaatcatcaagtcccaactatcaaggtgcacactatcagcttgagtgagaacggagaagaggtgtag

SEQ ID NO: 107635 - DNA, 1119 bp, Artificial Sequence
  Description of Artificial Sequence: Synthetic coding sequence
atggtgttcctgtccggaaacgcctcagatagttcgaactgcacacagcctcctgcgccagtgaacatatccaaggccatcctccttggcgtaatcctgggcggcctcatcctgttcggcgtgctggggaacattctggtgattttgtctgtcgcttgtcaccgtcaccttcacagtgtgactcattattacatagtcaatctcgcggttgctgatttgctgttgacaagcaccgtcctgcccttctctgctattttcgaagtactaggatattgggccttcgggagagtattctgcaatatttgggcagctgtggatgtgctgtgttgtaccgcctcgataatgggcctttgtattatctctatagataggtatataggcgtgagttaccctttaaggtatcccactatcgtcacccagagaagggggctgatggcgttactctgtgtatgggccttaagtcttgttatcagcataggcccgctgttcggctggagacagccagcccctgaggatgaaacaatatgccagatcaacgaagagcccgggtacgtattgttctcggcgcttggatctttctacctgcctctggcaataattctggtgatgtattgccgtgtatacgtcgttgccaaaagggaatcccgcggtctgaaatcaggcctgaagaccgacaaatcggacagcgagcaggttactttgcgcatccatcggaagaacgcgcctgctggtggatccggcatggcgtctgctaaaacaaaaacccatttcagcgtgaggcttctgaagtttagccgtgaaaaaaaggccgctaagacactcgggattgtggtcggatgtttcgtcttgtgctggttgccctttttcctagtgatgccaatcggcacacacacccacgatatgaaacccgcgtcaagacctcggctgctgtccctgctcccaaaggagggcgagcacgaaacacatcactggagctgcgatcctctgtctctggagagtacgcctggagcccaggagccatgtctcacgctgggatttacaagcttgtcttccatccatctgaccaaggcccagattcagcacgtgaccgtaacagatacgggcaagacagtgacctag

SEQ ID NO: 107636 - DNA, 1290 bp, Artificial Sequence
  Description of Artificial Sequence: Synthetic coding sequence
atggtgtttctatcaggcaatgcctccgatagcagtaattgtactcagccacctgctcctgtgaatataagcaaggccatcctgctgggcgtgatccttggtggcttgatactgttcggggtcttaggaaatatcctcgtgatcctgtctgtggcgtgccaccggcatcttcacagcgtaacacattattatatcgtcaatcttgcagttgctgatcttctgttgaccagcaccgtgctacccttctccgccattttcgaggtgttgggctattgggccttcgggagggtattttgtaatatctgggcggctgtggacgtgctatgctgcaccgctagtatcatgggactctgtataatatccatcgatagatacattggagtcagttatccgctgagataccctaccatcgtgacacagaggaggggactgatggcattactttgcgtatgggccctgagtttagtgatcagcatcggcccgctattcggttggagacagcccgctccagaggacgagacaatctgtcagattaatgaggaaccaggctacgtgctgttctccgcactcggtagtttctacttacccctcgccatcattctagtgatgtactgccgcgtatacgtcgtggccaaacgcgagtcgaggggcctcaagagcgggcttaaaactgacaaatctgacagcgagcaagttaccctccgcatccaccggaagaacgccccagctgggggctctggaatggccagcgccaaaaccaagacacatttttccgttcgtctgttgaaattctcacgggaaaaaaaggcagccaaaaccctgggcattgtcgttggctgctttgtcctttgctggctgccattctttcttgtgatgcccatcggttccttttttcccgactttaagccaagcgaaacggtgttcaagattgtgttttggcttggatatctgaactcttgcattaaccccattatatacccatgctccagccaggaattcaagaaggcattccagaacgtgctgcgtatccagtgcttatgccggaaacagagttctaaacatgccctggggtacacgttgcacccgccctcgcaggccgtggaaggacagcataaagacatggtccgtatacctgtgggtagccgtgagactttctaccgaataagtaagactgatggtgtatgtgagtggaagtttttctcttccatgccaagagggagcgcacggattactgttagtaaagaccagtcatcgtgtacaaccgcaagaggtcacactcccatgacttag

SEQ ID NO: 107637 - DNA, 1428 bp, Artificial Sequence
  Description of Artificial Sequence: Synthetic coding sequence
atggtgttcctgtccgggaatgccagtgattcatcaaattgcacgcaacctccagcaccagtgaacatcagtaaagctatcctcttgggcgtgatcctgggcggattaatcttgttcggtgtactagggaatatcctagtgatactgagcgtggcatgccacaggcaccttcattctgtgactcattattatatcgtgaaccttgctgtggctgacctgctgctgacgagcacagttctccctttctcagcgattttcgaggtcctgggctactgggccttcggacgcgtcttttgcaatatctgggcagccgtggacgtgctatgttgcacagctagcattatgggcctgtgcattatatccattgaccggtacatcggggtgagttatcctctgcgttaccccacaatcgtaactcagagacgcggacttatggcactgctgtgtgtatgggctcttagcctcgttatctcaatcggtccactattcggctggcggcagccagctccagaggacgagacaatttgccaaattaatgaggagcccggctacgtactgtttagcgccttgggtagcttctatcttcctctcgccattattctggtgatgtactgtcgggtttacgtggtcgccaagcgagaatcacggggcctcaaaagtggactgaaaactgacaagtctgatagtgagcaggtcactcttcgcattcataggaagaatgcccccgccggcggttcggggatggcttccgccaagacgaagacacatttctccgtaaggctactcaagttctcgcgagagaagaaggccgccaagacactcggcatcgtggtagggtgctttgttctgtgctggctgcctttttttctggtaatgcccattggatcatttttccccgacttcaagccatccgagaccgtgtttaagattgttttttggctgggctatctgaacagctgcattaaccctataatctacccctgtagtagccaggagtttaaaaaagccttccagaacgtactgcggatccagtgcctgtgcaggaagcagtcttccaaacatgccctgggttatactctgcacccccctagccaagcagtggaggggcagcataaagacatggttaggatccctgtcggctctcgggaaacgttctatcgaatcagcaaaacagacggcgtgtgcgaatggaaattctttagttccatgccaaggggatctgcacgaattactgtttctaaagaccagtccagctgcaccactgctcggaccaaatccaggagcgttacacgcttagagtgcagtggaatgattctagcgcactgcaacttacggctccctgggtccagggattcacccgccagcgcctctcaggcggctggcaccacaggtatgtgtcaccaggccgatgcaacaaggccgtcctag

SEQ ID NO: 107638 - DNA, 1113 bp, Artificial Sequence
  Description of Artificial Sequence: Synthetic coding sequence
atggtttttctgtccgggaatgcatccgactcctcaaactgtacacagcccccagcacccgttaatatcagcaaggcgattcttctgggagtcatcctcggcggccttatactattcggcgtactgggcaacatcttggtgattctctccgtggcttgccataggcacctgcattcagttacccactactatattgttaacctcgccgttgccgatcttcttctcacgtctactgttttgccattttccgcaattttcgaggtgctcggctattgggcgttcgggcgggtgttctgtaatatttgggccgcggtcgacgtcctgtgctgtaccgcctccatcatgggcctgtgcatcatcagcatcgaccggtacataggagtgtcctaccctttgcgataccccaccatcgtcacccagagacgcggtctgatggcactgttgtgcgtttgggcgctgtctttggtaatctctatcgggccattgtttggatggaggcaacctgcccctgaggatgagaccatatgccagattaacgaagaacccggttacgtcctgttctctgctctgggctcattttacttgcccttggcgatcatcctggtgatgtattgtcgcgtgtatgtagtcgccaaaagagaaagccgaggcttaaagtcaggcttgaaaaccgataaatccgacagtgaacaggtcactttgcgcatccatcgtaaaaatgccccagctggtggatcagggatggccagcgccaaaacgaaaacccacttctctgttagactcctaaagttttcgagagaaaagaaggctgctaaaaccctggggattgtggtgggctgctttgtactttgctggctgccttttttcctggtgatgcccattgacgaagtcagcctttgccatcaggctggcgtgcagtggcacgatctaggctcactccagcctcccccccccggctttaagcgattcagttgtttgtcgctcccctcttcgtgggattatcgggatgtgccgcctgggagaaggcaccaggcccagctgatattcgtgtttcttgtcgagaccggattccaccatgttggccaagacgacttagatttactaacgtcttag

SEQ ID NO: 107639 - DNA, 1284 bp, Artificial Sequence
  Description of Artificial Sequence: Synthetic coding sequence
atggtgttcctgtccggaaatgccagcgattcatccaattgtacccagcccccagcccccgtaaacatctcgaaggctatcttgctcggggtcatccttggaggcctaattttgttcggggtcttgggcaatatccttgtgattctgtctgtggcttgtcacaggcacctgcactcagtgacgcactattacatcgtgaatctcgccgtggccgatctgcttcttaccagcaccgtgctgcctttttctgccatcttcgaggtacttggctactgggcgttcgggagagtcttctgcaacatctgggccgcagtcgacgtactttgttgtactgccagcataatgggattatgcatcatttccattgacaggtatattggagtatcctacccccttcggtacccaacgattgtaacgcaacgccgcggtcttatggccctgttgtgcgtgtgggccctgtccctggtgattagcataggccctctctttgggtggcgccaaccagccccagaggatgaaaccatatgtcaaataaacgaagagcctgggtacgttctcttctcagccctaggcagtttctatcttcccctggctatcattttagtgatgtattgtagagtgtatgtggtggccaagagagagtctcgaggactgaagagcggcctcaagaccgacaagtccgactcagagcaggtaacccttaggatccacagaaaaaacgccccagctggcggatccggtatggcaagcgccaagaccaagacacacttttcagtccgactcttgaagttcagtcgcgagaaaaaggcagcaaagacactgggaatcgtggtggggtgcttcgtactgtgctggcttcctttcttcctcgtcatgccaatcggcagtttttttcctgattttaagccctccgaaactgtcttcaagatcgtgttctggctggggtacctcaacagctgtataaatccaataatttatccatgctccagccaggagttcaagaaggccttccagaatgttcttagaatacaatgtctgtgtcggaagcagtccagtaaacatgccctgggctacaccttgcatcccccaagccaggctgtcgagggccaacacaaagatatggtgcgtatccccgtgggcagccgggaaactttttaccgaattagcaagacagacggtgtgtgtgagtggaagtttttttcatccatgccacgtggttctgcgcgcatcaccgtgtctaaagaccagtcttcatgcacaaccgcccggtcgtccggtttctag

SEQ ID NO: 107640 - DNA, 1563 bp, Artificial Sequence
  Description of Artificial Sequence: Synthetic coding sequence
atgaatcccgacctcgacacaggacacaatacatctgcaccagcccactggggtgagcttaagaacgcaaattttaccgggcccaaccagacttcatcaaactccacgctgccacagctcgatattaccagggctatcagcgtgggtcttgtgcttggcgctttcatactgttcgccatagtaggcaatatactcgtgatcctgagtgttgcctgcaaccgacatcttcgtactcccaccaactacttcattgtgaacctcgccatggctgatttactgctttctttcacagtcctgccattcagcgcagccttagaggttctcgggtattgggtgctcggtcgcattttctgcgacatttgggccgccgtggacgtgttgtgctgtactgcttctatcctgagcctgtgcgctatctcaatcgaccgctacataggagtcagatactccctgcagtatccgactctggtcacaaggcgcaaggccatcctagctttgctcagtgtgtgggtgttgtccacagttatttctatcggtccactacttgggtggaaggagccggccccaaacgatgataaagaatgtggcgtcacagaagagcccttttacgctctcttcagcagtctgggctccttttatatccctctcgccgtaattcttgtaatgtactgcagagtgtacatcgtggccaaacggacaacaaagaatttagaagcaggggttatgaaggagatgtctaacagcaaggagctcacacttaggatccactctaaaaacttccacgaggacacgcttagcagtacgaaagcaaagggccacaaccctagaagctctatcgccgtgaagctctttaagtttagtcgagagaagaaggctgccaagaccctgggtattgtcgttggcatgtttatcctgtgttggctgcctttttttattgctctgcctttgggttctctgttctccactttgaagcctccagatgcggtatttaaggtcgtcttttggttgggatacttcaattcctgccttaatccaatcatttatccttgcagttcaaaagaattcaaaagggcctttgtccggattctcggatgtcagtgtcgtggaagaggaagacgccgccggcgcaggaggaggaggctaggcggctgtgcatatacctatagaccttggacgcgagggggatctctggagcggtcccagtcacgtaaagactctctggacgacagcggctcctgcctatccgggtcccagcgaacattgccatcagccagccctagccctggctacctggggaggggcgccccaccaccggtcgagctctgtgcctttccagaatggaaagcccctggggccctgttgtcgctccccgcacccgagcctcctgggagacggggccggcatgacagtgggccactgtttaccttcaaattattgaccgaacctgagagtccagggaccgacgggggggcttctaatggagggtgcgaagctgctgctgatgtcgctaatggacagcccgggtttaagtccaatatgcccttggcgccaggccagttttag

SEQ ID NO: 107641 - DNA, 1719 bp, Artificial Sequence
  Description of Artificial Sequence: Synthetic coding sequence
atgactttccgcgacctactcagcgtctccttcgagggccccagacccgactcctctgctgggggctctagtgcaggggggggcggagggtccgctggcggagctgcgccatcagaagggccagccgtcggtggagtccctggcggcgccggcggtggaggaggtgtggtgggggcaggaagtggagaagacaaccggtcttccgccggtgagccagggtccgctggggcagggggagatgtgaatgggactgctgcggtcggggggctggtcgtaagtgcccagggggtgggcgttggggtcttcctggctgcatttatcttgatggctgtggctgggaatctcctcgtgatcctcagtgttgcatgcaatagacatctgcagactgtcactaactatttcatagtgaacctggcggtggctgatttgctgctgtctgcaacagtgctccccttctccgccaccatggaggtgctggggttttgggcttttggacgagcattctgcgatgtttgggcagcagtggacgtgctctgctgcaccgcgtccatcttgagtctgtgtactatatcagtggaccgttacgtaggagtcaggcacagcctcaaatacccagccataatgacagaaagaaaggcggcggccatcctggccttactttgggtcgtcgctcttgtggtctccgtgggcccactcctgggctggaaggaacccgtccctccagacgaacggttttgtgggataactgaggaagctggatatgcggttttttcaagcgtttgcagcttttacttgcccatggcggtgattgtggtgatgtactgccgcgtgtacgtggtcgcgagatctaccacgcgtagcctggaagctggtgttaagcgcgaacgcggcaaagcatcagaggtagtgctgcgtattcactgtagaggagctgccacaggggcagacggcgctcacgggatgaggagcgccaagggtcatacatttcggtccagtctgtctgtacgcctgttaaagttttcgcgcgagaaaaaggcagccaagacactagccattgtagtgggcgtgtttgtgctttgctggttcccattcttttttgtgttgcccctgggatcgctatttccccaactgaaaccaagtgaaggggtgttcaaggtaattttttggctcggctatttcaactcctgcgtgaatccgttgatatatccgtgtagtagccgcgaattcaagagagcttttctgaggttgctcaggtgccagtgccggaggaggcgtcgccgtaggccactgtggagggtttacggacatcactggcgggcctctacctcaggtttacggcaggattgtgcaccgtcgtcaggtgacgcacccccgggagctccactggcattgacagccctgccagatccagatcctgaaccacctggtactcctgagatgcaggctccggtggcctctagacgaaagccaccaagtgcattccgtgagtggcgcctgctgggcccttttaggcgcccaaccacccagctgcgggcgaaggtaagctcactgtcacacaaaatacgcgccggtggcgctcagagggcagaagccgcgtgcgcacaaagaagtgaagttgaggctgtctcactcggtgtgccccatgaggtggctgaaggcgcgacctgtcaagcttatgaattggcggactatagcaacctcagagagaccgacatctag

SEQ ID NO: 107642 - DNA, 1344 bp, Artificial Sequence
  Description of Artificial Sequence: Synthetic coding sequence
atggaccatcaggatccctatagcgttcaggccaccgccgctatcgctgcagccattacattcctgattctgttcaccatcttcggcaatgccctggtaatcctcgcagtgctgacttcacgcagcttgcgcgctccacagaatttgttcctcgtgagtttggcagccgccgacattctagtagccaccctgataatccctttcagcctggccaatgaattgttaggatactggtactttaggcggacatggtgtgaagtgtacctcgccttggatgtactcttctgcacttcttctattgttcatctttgcgccattagtttggatcgctactgggccgtctcccgagccctggagtacaatagcaagcgtacccctcggcggattaaatgtatcatcctgaccgtgtggcttatcgccgcagtgatctctctccctcctttaatttataaaggtgatcaggggccgcaacccagggggagacctcaatgtaaactgaaccaagaggcatggtatatcctcgcctcttccatcggtagcttctttgccccctgtctgatcatgattctagtgtacctgaggatttacctgattgcaaagcgatcaaacaggaggggtccccgtgctaagggcggccccggccagggggaatccaagcagccaaggcccgaccatggtggggcactggcatctgctaagctccccgcgctcgcaagcgtggcatccgcccgggaggtgaacggccattctaagtctacaggggaaaaagaagagggcgagacacccgaagatacgggcaccagagccctgccgccatcctgggccgccctccctaatagcggccaaggccagaaggagggggtgtgcggagcctcccccgaagatgaggccgaggaggaggaagaagaggaggaggagtgtgagcctcaggccgtccccgtgagcccggcttcagcctgctcccctccattgcagcagcctcagggctctcgcgttctagctaccctgagagggcaagttcttctggggaggggggtgggcgcaattggggggcagtggtggcggcgcagagcgcagttaacacgagagaagcggtttacttttgtgctggctgttgtgattggagtgttcgtactatgttggtttcccttcttctttagctacagcttgggcgccatctgccccaaacattgcaaggtgccacacggcctgtttcagtttttcttctggattggttactgcaattcctctctgaatcctgtgatctacaccatctttaatcaagactttcgtcgggcctttaggagaattctctgccggccctggacccaaaccgcgtggtag

SEQ ID NO: 107643 - DNA, 1389 bp, Artificial Sequence
  Description of Artificial Sequence: Synthetic coding sequence
atggcctcccctgccctagcagccgccttagctgttgctgccgcagccgggcccaatgccagcggcgccggggaaagggggagcggtggtgttgcaaatgcgagcggagcctcatggggcccaccgcgaggccaatactcagctggagcggtcgccggtcttgctgcggtggtgggcttcctgattgtgttcaccgtcgtgggaaatgtgctggtggtgattgctgttctgacttccagggccctgcgcgccccccagaatctctttctggtgagtttggcatccgccgatattctagtggccacgcttgtgatgccctttagcctggcgaacgagttgatggcatactggtatttcggtcaggtgtggtgcggagtgtatcttgccctggatgtgctgttctgtacctcctctatcgtgcacttgtgtgctatatcattggacagatactggtccgtcacacaagcggtcgaatacaatctgaagcggacacccaggcgcgtgaaggccaccattgtcgccgtgtggctgatttccgccgtgattagtttccctcctttggtgtccctttacagacagcctgacggcgccgcttacccacagtgtggattgaacgatgagacatggtacatactaagcagttgcataggatcattcttcgcaccctgcctgattatgggcctggtttacgctcggatataccgcgtggctaagctgagaacacggacactctccgaaaagcgcgctcctgtgggacccgacggcgcttctcctactaccgagaatgggctgggggctgcagccggagcaggggagaacgggcattgcgccccaccaccggctgacgtcgagccagacgagtcctcagccgccgctgagagacggcgacgacggggcgctctcaggagggggggccggcgccgggccggtgcagagggcggtgcggggggcgctgatggacaaggcgcaggaccaggggcagcagaaagcggagcactgacagctagtaggtcaccaggcccaggggggaggctgagcagggcttcttcacggtctgtcgaattttttctgtccagacggaggcgggcccgttctagtgtgtgccggcgtaaagtggcgcaagcaagggaaaagcgtttcacctttgtgcttgccgtggtgatgggcgtgtttgtgctgtgttggtttccatttttttttagttattctctatatgggatttgtagggaagcctgtcaggtgcccggtccactgtttaaatttttcttctggatcgggtattgtaatagctcactcaatcctgtaatatacactgtgttcaaccaggatttccggcgtagtttcaaacatatcctgtttcgcaggaggaggcggggattcaggcagtag

SEQ ID NO: 107644 - DNA, 2070 bp, Artificial Sequence
  Description of Artificial Sequence: Synthetic coding sequence
atggcagatctggaggccgtattggcggacgtttcttatctgatggctatggagaagtccaaggctacgccagcagcgcgcgccagcaaaaaaatacttctgcccgagcccagcattcggtccgtgatgcaaaaatacctcgaagatagaggtgaggttacctttgagaagatcttctcccaaaagctgggttatctgttgtttagagacttctgcctcaaccacttagaagaggctcgccctctggtcgaattctacgaggagatcaaaaagtacgagaagttagaaactgaggaggagcgggtggcaagatctagggagatattcgacagctatataatgaaagaacttctcgcctgttcacatcccttctctaagtcagccacagaacatgtgcaagggcacctggggaaaaagcaagtgccccccgacctcttccagccgtatatcgaagagatctgccaaaacctccgcggcgacgtttttcagaagttcatcgaatctgataagttcaccaggttctgccagtggaagaacgtagagctaaacattcacctgacgatgaatgacttcagcgtccataggattatcggcagagggggctttggtgaagtgtatggctgccggaaagccgatacgggtaaaatgtacgccatgaagtgccttgataagaagagaattaaaatgaagcagggggaaaccctggctctgaacgagagaatcatgctaagcctggtaagcacaggcgattgtccctttatcgtgtgcatgagctatgctttccacacacctgataagctgtcatttatactcgatctgatgaacggaggtgacctacactaccacctgtcccagcacggcgtttttagtgaggcagatatgcgcttttacgctgctgagatcatcttgggcctggagcatatgcataataggtttgtggtgtaccgcgatctcaagccagctaacattctgctggacgaacatgggcacgttaggatttccgacctcggattggcctgcgatttctcaaaaaagaagccacacgctagtgtcggcacgcatggctacatggctccagaagtcctgcagaagggagtcgcttatgactcttcagctgattggttttcccttggctgcatgctgttcaaattgcttcggggacatagcccctttagacagcacaagactaaggataaacacgaaatcgaccgcatgacactgaccatggccgtggaattaccggatagtttctccccggagctccggagcttgctggagggattgctgcagcgtgatgttaacagaaggctagggtgtctgggacgaggcgctcaagaagtgaaggagagcccatttttcagatctctcgactggcagatggtatttttgcagaaatacccacctcccctgataccacctcgtggggaggtaaacgcggcagacgcctttgacataggcagtttcgacgaagaggataccaaaggtataaaactgctagattcggatcaagagctgtaccggaatttccctctgactatttctgagaggtggcaacaggaggtggctgagaccgtgttcgacacaataaacgcagagactgacaggctggaggcgcgcaaaaaagccaagaacaaacaactgggccatgaagaagactatgcactcggcaaagactgcattatgcacggttatatgtccaaaatggggaatccttttcttacgcagtggcagcggcgttacttttatctatttcctaaccgactcgagtggcggggcgagggagaagctccccaaagtctgttaacaatggaagagattcagtccgtggaagaaacacagatcaaggaacggaaatgtttactgcttaagatacggggcgggaaacagttcatattgcagtgtgattctgacccagagctggttcagtggaagaaggaactgcgcgacgcttaccgggaagcccagcagctggttcagcgagtgcctaaaatgaagaataaacctagatcacccgttgtggagctctctaaagtgccactcgttcagagaggaagcgccaacgggctgtag

SEQ ID NO: 107645 - DNA, 2067 bp, Artificial Sequence
  Description of Artificial Sequence: Synthetic coding sequence
atggccgatcttgaggcagtactcgccgatgtttcctacctgatggcaatggagaagtcaaaggctactcctgctgcacgggcctctaagcgcattgtgttgcctgagccctctatacggagtgtgatgcaaaaatacctggcagagagaaacgaaattacattcgataaaatatttaaccagaagatcggctttctgctgtttaaagacttttgcctgaatgagatcaatgaagcagtaccccaggtgaagttctatgaagagatcaaggagtatgagaagctcgacaatgaagaggacaggttatgtagaagcagacagatttacgatgcttacataatgaaggagctccttagttgcagccatccattttcaaaacaggcggtagagcatgtacagagtcacctttcaaagaagcaagtgacctcgaccctgttccaaccatatatcgaagaaatatgcgaaagtctacgcggcgatatcttccagaaattcatggaaagtgacaagtttacacggttctgccaatggaagaacgtggaactcaatatacacctcacaatgaacgagttctccgtgcacaggataattggtcgcggaggctttggcgaggtgtacggatgtcgaaaggctgacaccggcaagatgtacgccatgaaatgtctcgacaagaagcgtatcaagatgaaacagggagaaaccctcgctctgaatgagagaattatgctcagtctggtctccaccggagattgtcccttcatagtttgcatgacatatgcattccatactcccgataaactgtgtttcatcctggatttgatgaatgggggagatttgcattaccacctctcacaacatggagtgttttctgagaaggagatgcgcttctacgcgactgaaatcattctaggtctggagcacatgcataatcgatttgtggtttaccgggatcttaaaccagccaacatccttttggatgaacacggacatgcccggatatctgacctgggtttggcttgtgacttcagcaagaagaaaccccacgcctcagtgggcactcacgggtacatggcgcccgaggtgctgcagaaagggactgcctacgactctagcgccgactggttcagcttaggctgcatgctattcaaactgctccggggtcacagtccatttcgccagcataagactaaggacaaacacgagatcgaccgtatgaccctgaccgtgaacgttgagctccccgatacattctctcctgagctgaaaagtctgctggagggacttctacaacgcgacgtgtcgaagcgcctcggatgccatggaggaggatcccaggaagtaaaagaacactcctttttcaagggggtggactggcagcatgtgtacctccagaagtatcctccaccattgattccacctagaggagaggtcaatgcagcggacgccttcgatatcggtagtttcgacgaggaggatactaagggcattaagctactggattgtgatcaggagctgtataagaactttcccttagtgatctctgagaggtggcagcaggaggtcactgagactgtgtacgaagctgttaacgcggacacagacaaaattgaggcacgaaaaagagcaaagaataaacaactggggcacgaagaagattacgcccttggtaaggactgcataatgcacgggtacatgctaaaacttggtaacccgtttttaactcagtggcagcggcgctatttttatctcttcccaaatcggctagaatggagaggggagggcgagagtcgccaaaatttgctgactatggaacaaatactgagcgtagaagagacccaaataaaggataaaaaatgcattttgtttcggatcaagggaggaaaacaatttgtgctgcagtgtgagtcggatcccgagtttgtccagtggaaaaaggaactgaatgagaccttcaaggaggctcaacggttgctgcgacgcgctcctaagtttttgaataagccacgcagtgggacggttgagctgcccaagccaagcttgtgccacagaaattcgaatggtctatag

SEQ ID NO: 107646 - DNA, 1164 bp, Artificial Sequence
  Description of Artificial Sequence: Synthetic coding sequence
atggcagacctcgaagctgtactggcagatgtgtcttatctgatggccatggaaaaatctaaagcgactccagctgcgcgcgcgtctaagaggatcgtgctccccgaaccctcaatcaggagcgtcatgcagaagtatctggccgagagaaatgagatcacatttgacaaaatctttaatcaaaaaattggctttctcctgttcaaagacttttgcctgaatgagattaacgaggccgtgccccaggtgaagttctacgaagagatcaaagagtacgagaaactggataacgaggaggaccgactatgccgatctaggcagatctacgacgcttacataatgaaagaattactttcctgcagtcatccattcagcaaacaggcagtcgagcatgtccaaagtcatctgagcaaaaaacaagtcacaagcactctgtttcagccctatatcgaggaaatatgcgagagtctcagaggcgatatattccagaagttcatggagtccgacaagtttactaggttttgccagtggaagaatgtcgaacttaatatccacttgacgatgaacgagttcagcgtccacaggattataggccgcggagggttcggcgaagtgtacgggtgtcgaaaggctgacaccggcaagatgtatgccatgaagtgcttggataagaagcgcattaaaatgaagcagggggaaacgttggctctgaacgaacggataatgttgagcctggtgagcaccggcgattgcccctttattgtgtgcatgacttatgcattccatacccccgacaagctttgcttcatcctggaccttatgaatgggggggaccttcactaccatctgtctcaacatggggttttctcagaaaaggaaatgagattttacgccactgaaatcatactgggcttggaacatatgcataacaggttcgtagtatatcgggaccttaaacctgctaacatcctgcttgatgaacacggacatgctaggatctccgacctcgggcttgcctgcgacttctccaagaaaaaacctcacgccagcgtgggcactcacggatatatggcaccggaggtgctgcagaaaggaacggcctacgattcttctgccgactggttctcactgggctgtatgctcttcaagctgttgagaggctag

SEQ ID NO: 107647 - DNA, 1434 bp, Artificial Sequence
  Description of Artificial Sequence: Synthetic coding sequence
atgggcgcgggagtgctcgtgttgggcgccagtgaaccaggaaacctgagctcagcagcccccttaccagatggagccgccactgccgcacggttattggtgcccgcttctccccctgccagtctcctgccgccagccagcgaaagtcccgagccgttgagtcagcaatggacagccggcatgggtttactcatggccttaattgtgctcctgattgtggctggtaatgtcctcgtgatcgtggcgatagcgaagactccaagactacagactctgacaaaccttttcataatgagtctggcatctgccgatctggttatgggtttgctagtggtgccattcggagcgacaatagtcgtttggggccggtgggagtatggatcatttttttgcgagctgtggacgtctgtggacgtgctttgcgtcactgctagtatagagacactttgcgttattgctctcgaccgatacttggctattacctctccattccgctaccaatcccttttgaccagggcacgggcaaggggcctcgtatgtaccgtgtgggccatttctgctttggtgtccttcctgcccatcctcatgcactggtggcgcgccgaatctgacgaggcaaggaggtgctataacgatcccaaatgttgcgattttgttactaatagagcatacgccatcgcgagttccgtagtatccttttatgtgcctttgtgtattatggcatttgtgtatcttagagtttttagagaagcacagaaacaggtcaagaagatagactcctgcgagcgacgatttctgggcggccctgctagacctccgtctcccagcccttcgccagtccccgcgcccgcccctccgcctggaccgcccagacccgccgctgccgccgcaactgccccactggccaacggtagagccggaaaaagaagacccagccgactcgtggctctgcgcgaacagaaagcactgaagactctgggtattattatgggtgtgttcaccctgtgctggttgccattcttccttgcaaacgtagttaaggcattccaccgggaactcgtccccgatcgactgtttgttttcttcaactggttgggctatgccaactctgctttcaatcccattatctactgccgatcccccgatttccggaaagccttccaggggcttctgtgctgcgcccgcagggccgccagaaggagacacgcaacgcacggagatagacccagagcttctggatgcctagctagaccaggtcctccaccttcgccaggcgctgctagcgacgatgacgatgatgatgtagtgggagccacccctccagctcgcctgctggaaccatgggctggatgtaacggtggcgccgccgcagacagcgacagtagtctggacgagccatgtcgccccggctttgcctccgaatcaaaagtatag

SEQ ID NO: 107648 - DNA, 1242 bp, Artificial Sequence
  Description of Artificial Sequence: Synthetic coding sequence
atggggcagcctggcaatggtagcgcttttctcttggctcccaacggaagccacgctccggatcacgacgtgactcaagagcgagacgaggtttgggttgtaggcatgggaattgttatgagcctgatcgtgctcgccatcgtcttcggcaacgtgcttgtgattaccgctatcgctaaattcgagagattacaaactgtgacaaactactttataacctctttggcttgtgcagatcttgtgatggggctggctgttgtgccctttggggccgcccacatcctgatgaagatgtggacattcgggaatttctggtgcgaattctggacttctattgatgtgttgtgcgtgacagcctccattgagacactgtgtgtaattgctgtagaccgatattttgccatcacgtctcctttcaagtaccagtcgctgctcaccaagaataaagcgcgggtaatcatacttatggtgtggattgtcagcggtttgacctcctttcttccaatccaaatgcattggtatcgggcaacccaccaggaggccataaattgctacgctaatgagacctgttgtgatttcttcaccaaccaggcttatgccattgctagcagtattgtaagtttttacgttccactggtgatcatggtgtttgtctattctagggtgtttcaggaggccaaacgacagttgcagaaaatcgacaagagcgagggcagatttcacgtacagaatttgtcgcaggtggagcaggatggccgaacgggccatggactccggcgctcgtcaaagttttgcctgaaggaacataaagctttgaagactctcggtattatcatgggaacgttcacactgtgctggcttccctttttcatcgtgaatatcgtccatgtcatccaagataatctcattcgaaaagaagtatacatcctgctgaactggatcggatatgtgaacagcgggttcaatcccttaatctactgtagaagcccagacttccgaattgctttccaagagctgttgtgtctacgacgatccagcctgaaggcttacggcaatggatattcctctaacggaaataccggagagcagtctggatatcacgtcgagcaagagaaagaaaacaagcttttatgcgaggatctccccggtactgaagacttcgtgggacaccaaggaactgtgccttctgacaacatcgattcccagggcaggaactgcagcacaaatgactccctgctgtag

SEQ ID NO: 107649 - DNA, 1227 bp, Artificial Sequence
  Description of Artificial Sequence: Synthetic coding sequence
atggccccgtggcctcacgagaattccagtctggccccttggcccgaccttcccacgctggcacctaatactgcaaatacgagcggattaccaggtgtcccatgggaggccgccttagctggagcgttgctagcccttgcagtgctggcgaccgtggggggcaatttactggtgatagtggctatcgcatggacaccacgcttacagactatgacaaatgtctttgtcaccagtttagccgccgccgatctggttatgggtttgctagtagtgcctcctgctgctacactggccctgaccggccactggcccctgggggccacgggctgcgaactttggacatctgtggatgtgctgtgtgttaccgcctccatcgagacgctatgcgcactggccgttgaccggtatctggctgttacgaatcccttgcggtatggcgccttagttacgaaaagatgcgcccgtacggccgtggttttggtgtgggttgtgtccgctgccgtctcctttgcccctatcatgtcccagtggtggcgggtgggtgccgacgccgaggcacagcgttgtcattcaaaccctcgctgctgtgcgtttgccagcaatatgccctatgtgttgctaagctcttctgtctctttctacttgcctctcctagtaatgctttttgtgtacgcccgagtttttgtggtggctacacgacaacttaggctactgcgcggcgaactgggacggttccctcccgaagaatcacccccggcccctagtcgttctctcgcacccgctccggtgggcacctgcgctccccccgagggcgttccagcctgcggtcgccgccctgcgcgcctccttcctctcagggagcaccgcgcactgtgcacattaggtttaatcatgggaacttttactctctgctggttgcctttctttctcgccaatgtgttgagggccctgggaggcccatcactggtgcccggcccagcctttctcgccttgaattggcttggatacgcaaatagcgcctttaatccccttatttactgcaggtctcctgatttccggtccgcttttcgccggttgctgtgccgttgtggcagaaggctcccccctgaaccgtgtgccgcagctcgtccagccttatttccgtcaggggtcccagcagccagatcttcgccagcacagccacgcctgtgtcaacgcttagacggtgcttcatggggcgtgagttag

SEQ ID NO: 107650 - DNA, 1044 bp, Artificial Sequence
  Description of Artificial Sequence: Synthetic coding sequence
atggctgctggaaccgccgtgggcgcgtgggtgcttgtcctgagtctgtggggtgccgtggttggagcacagaacatcactgcgagaatcggagaacctctggtgttgaagtgtaaaggcgcccctaagaaaccccctcagcgactggaatggaaactcaacactggcagaacggaggcatggaaggttctatccccccagggtggcggcccgtgggactcagtagctcgggtcctgccaaacggctccctgttccttcctgccgtgggcatacaggacgaaggaatcttccgctgccaggctatgaaccggaacgggaaggagacaaagtctaactatcgtgtacgggtctatcagatacctgggaagcctgaaattgtagattctgcatctgagcttactgccggcgtccccaataaggttggcacatgcgtttctgaagggtcctatcctgcgggaacactcagctggcacttggacggtaaacccctcgtgccaaacgaaaaaggagttagcgtgaaagagcagacccggaggcatcctgagaccgggctctttaccctccagtcagagctgatggtgactcctgcccggggcggtgacccaaggcccactttttcgtgttcattctctcccggactgcctagacacagggcgttacgcaccgcacccatccaaccccgggtgtgggagccagtgcccctagaagaagtacagttggttgtcgagcccgagggaggagcggtggcccctggaggcaccgtgacgcttacctgtgaagtccctgcccaaccgagccctcagattcactggatgaaggatggcgtgccgttgccacttccaccaagtcctgtgctgatcctaccagaaatcggcccacaggatcagggtacctattcctgtgtcgcgactcattcctcacatgggccacaagagagtcgagcagtgagcattagcattattgagccaggggaagaagggccaacagcgggagaggggttcgacaaggtgagggaagcagaagatagccctcagcacatgtag

SEQ ID NO: 107651 - DNA, 702 bp, Artificial Sequence
  Description of Artificial Sequence: Synthetic coding sequence
atggccgccggcaccgccgtgggtgcctgggtactagtgcttagcctatggggcgcagtggtaggggcccagaacatcactgcaagaatcggcgaacccctcgtgcttaagtgcaagggtgccccaaagaagcccccccagcgactcgaatggaagttaaatactggtcgtacggaagcctggaaggtattaagtccgcaaggggggggtccttgggactccgtggctagggtgcttccaaatggaagcctgtttctgcccgctgtcggtatccaggatgaaggaatctttcgctgtcaggcaatgaacaggaatggtaaggaaacaaagagtaattaccgagtgagagtgtaccagatccctggaaagcccgaaatagtcgatagtgcttcggagctcacggccggcgtgcctaacaaagtcgtggaggagtcacgaaggtcacgaaaacggccttgcgagcaggaggtggggacctgtgtgagcgaaggaagttatcccgcagggactctctcatggcacttggacggcaagcctcttgtgcctaatgagaaaggcgtttctgtgaaggagcagactcggcgccaccccgaaacaggactgtttactctccagtcagaacttatggtgacacccgcccgcggaggcgacccaaggccaactttttcatgtagttttagccctggactgcctaggcattag

SEQ ID NO: 107652 - DNA, 402 bp, Artificial Sequence
  Description of Artificial Sequence: Synthetic coding sequence
atgaaagacggagtccccttgcccctgcccccatccccagtgctgatccttccggaaattggaccccaggatcaaggtacttattcttgcgtagcgacacacagttcccacggtccacaagagtcccgtgccgtcagcatcagcatcatcgagcctggcgaggagggccccaccgctggttcagtgggtggttctgggctgggtaccctcgctctagccttagggatcctggggggtctcgggacggccgcgcttctgatcggggtgattctgtggcagcggagacagcgtagaggggaagagcggaaagcccctgagaatcaagaggaggaagaagaaagggctgagctgaatcagagcgaggagccggaggcaggggaatccagcactggcggcccatag

SEQ ID NO: 107653 - DNA, 366 bp, Artificial Sequence
  Description of Artificial Sequence: Synthetic coding sequence
atggctgcaggaacagctgtaggcgcatgggtgctggtgctgagcctttggggcgccgttgtgggagctcagaatatcactgcccgcataggcgaacccctggtgctcaagtgtaaaggggctccgaaaaaacccccacagcgccttgagtggaaactcaatacaggaagaactgaagcatggaaggtgctgagtcctcagggaggcggcccatgggattccgtcgctagggttctgccaaatggaagcctgttcctgcccgcggtgggcattcaagatgagggaatctttcgctgtcaggccatgaataggaatggcaaggaaaccaaatcaaactggtggtggtctcaaaaggttgagcagtag

SEQ ID NO: 107654 - DNA, 1029 bp, Artificial Sequence
  Description of Artificial Sequence: Synthetic coding sequence
atggcagcgggtactgccgtgggcgcatgggtgcttgtcctttccttgtggggcgccgtggtgggggctcagaacataactgcaaggataggcgagccactggtgctgaaatgtaaaggcgccccgaagaagccaccccaacgattagagtggaagctgggagggggaccttgggatagcgtggcgagggtgttgccaaatgggtccctgtttctgccagctgttggcattcaggacgagggaatctttcgatgtcaagccatgaaccggaacggtaaagaaactaaatcaaactatcgcgtgcgagtttaccagatcccagggaagcccgaaatagttgacagcgctagcgagctgaccgccggagtgcctaataaggttgggacttgtgtgtctgagggcagttatccagccgggaccctgagctggcacttggacggcaagcctctggtaccaaatgagaaaggagtatccgtaaaggaacagacccgccgacaccctgagacaggtttgtttaccttacagtccgaactgatggtaaccccagctaggggcggagaccctagacccaccttcagttgctccttttcaccagggttgcctagacatagggctctccgaacagccccgatccagcctcgcgtctgggaaccagtgccccttgaggaggtacaattggttgtcgagcccgagggcggagcagtggccccagggggcaccgtgaccctgacttgtgaggtacccgctcagccctcaccccagatacactggatgaaggatgtttcggatttagaacgcggggctggccgcactagacgcgggggtgctaactgccggctctgcgggaggataagagcaggcaactcgagcccggggcctggagatcccggtagacccggcgatagccgacccgcccactgggggcacttggtagcaaaggccgcaactccaaggaggggcgaagagggcccccggaaacccggcggccgggggggcgcatgccgtactgaaagtgtggggggcacttag

SEQ ID NO: 107655 - DNA, 885 bp, Artificial Sequence
  Description of Artificial Sequence: Synthetic coding sequence
atgaacagaaacggaaaggagactaagtccaattaccgcgtccgggtatatcagatcccaggaaaacctgagatcgtcgattcagcgtcggagctgaccgcgggagtcccaaacaaagtaggaacctgcgtttcagaaggctcataccccgccggtacactgagctggcatttggacggcaagcctctggtccccaatgagaaaggggtaagtgtgaaagaacaaactaggcgacaccctgagactggccttttcaccctacagagcgaactgatggtgacccccgcacgaggaggggatcctaggccaacatttagctgttctttctccccaggactgccccggcatcgcgccctgcgtaccgccccaattcagccaagggtgtgggagcctgtacccctggaagaggtccagctggtcgttgaacctgaagggggagctgtggcacctggcggtacagtcacacttacatgtgaggtgccagcccaaccaagcccgcagattcattggatgaaagacggagtaccattgcctctcccaccatccccagtgcttatccttcctgagattggcccacaggatcaagggacctatagctgtgtggccactcattcaagccatgggccccaggagagcagggctgtatcaatcagcataatcgggtcggttgggggcagcggccttggcaccctagctttggccttagggattctcggagggctcggcacagctgccttgctcattggggttatcctgtggcagaggcgacagcggcgcggagaggagcgcaaagctcccgagaatcaagaagaggaggaggagcgtgctgagctcaaccagtcagaagaaccggaggctggagaatcaagtaccggcggaccttag

SEQ ID NO: 107656 - DNA, 1308 bp, Artificial Sequence
  Description of Artificial Sequence: Synthetic coding sequence
atgggggcaggcgaacgggtgcaggcccccccgagagctgaggctaccgctggccggggtgctgatagagcccggacgttggagggcagcaggatggcagctgggacagccgtcggcgcctgggtgctcgttttaagcctttggggggctgtcgtcggggcccagaatatcaccgcccgcattggtgagccactggtgcttaagtgtaaaggcgcccccaagaagcccccccagaggctggagtggaagctaaatacaggacgaactgaagcttggaaggtgctgtcccctcaggggggagggccatgggactctgttgccagggtgctgcctaatggttctctgtttcttcctgccgtggggattcaggacgaaggcatctttagatgccaggcaatgaaccgcaacggaaaggagacaaagtctaactatcgcgtgagggtgtatcaaattcctgggaaacctgaaattgtggatagcgctagcgagctgaccgctggcgtgccaaataaggtggggacttgtgtgagtgaaggctcatacccagcgggaaccttgagttggcatctggacgggaagccccttgtccctaatgaaaagggtgtctcagttaaggagcaaactcgcaggcatcctgaaacggggctttttactttgcagtcagagctgatggtaactcctgctcgcggtggtgaccctcgtcctaccttcagctgtagtttctctcctggcctgcccaggcatcgagctctcagaaccgccccgattcaaccacgcgtgtgggaacctgtgcccctggaggaggtgcagcttgtggttgagcccgagggcggagctgtggccccaggcgggaccgtgacactcacatgtgaagttcccgcgcagcctagcccccagatccattggatgaaggacggcgtacccctcccacttcccccctcccccgtcttgatccttcctgagattggacctcaagaccaaggtacttatagttgtgttgctactcattcttcacacgggcctcaggagtcacgagcagtctcgatttcaatcatcgaacccggcgaggagggcccgaccgcgggatcagtaggtgggtctggtctgggcacactggccttggccctcggcattctgggaggtctaggcacggctgcgctgctgattggggtaatcttatggcaaaggcgccagcgacgtggagaggagcggaaggcccctgaaaatcaggaggaagaagaggagagagcagaacttaaccagtcagaggaaccggaagcaggggaaagtagcactggggggccttag

SEQ ID NO: 107657 - DNA, 1215 bp, Artificial Sequence
  Description of Artificial Sequence: Synthetic coding sequence
atggccgccggaaccgccgtcggcgcttgggtcctggttttgagcctctggggagccgtggttggtgcccagaacatcacagcacggatcggcgagccccttgttcttaaatgcaaaggcgccccaaagaaacctccacagcgcctagagtggaagctgaatacaggcaggaccgaggcttggaaggtcctgtccccgcagggcgggggaccgtgggactcagtcgcaagggtgctgcccaacggatcactgttcttgcccgcggtgggcatacaagacgagggcatctttcgctgccaggccatgaaccgcaatggcaaggaaaccaagtcaaattaccgcgtacgggtctatcagatccctggtaagccagaaatcgtggactccgcaagtgaactaacagccggcgttccgaataaagtcggtacttgcgttagcgaaggctcctatcctgcggggaccctgagttggcacctcgacggtaaaccattagtcccgaacgaaaaaggcgtatcagtaaaagagcaaaccagaagacaccccgagacaggtctatttaccctacagagcgaactcatggtgacacccgcgagaggcggcgaccctcgaccaacattctcctgctcttttagtccagggctgcctaggcatcgtgccctgcggacagctcccattcagcctcgcgtctgggagccagtgccccttgaggaagtgcagttggttgtggaacccgaggggggcgccgtcgccccaggtggtactgtgaccttgacctgcgaggtcccagctcagccctccccgcaaatacattggatgaaagacggggtgcctctgcctttgcccccttccccagtccttattctgccagagattgggcctcaggatcagggcacatatagttgtgtcgctacccactctagccacggccctcaggagtcaagagcagtgtcaatttccatcatcgagcccggagaggaggggccaactgccggcagtgttggtggctcgggtttggggacgctggcacttgcactcggcatcctggggggactggggactgcggctcttctgatcggtgtaatcctgtggcagcgacgacagcgccgcggggaagagcggaaagctcccgagaaccaagaagaagaggaggaacgggccgagctgaatcaatcggaggagccagaagccggggagagctctactggggggccctag

SEQ ID NO: 107658 - DNA, 1044 bp, Artificial Sequence
  Description of Artificial Sequence: Synthetic coding sequence
atggccgccggcactgccgtcggcgcctgggtcttggtactgtccctgtggggagctgttgtcggggctcagaacattacagcgcgtattggggaaccactggttctgaagtgcaagggagcccctaagaagcccccacaaagactcgaatggaagctgaataccggcaggacggaggcttggaaggttctgtccccccagggcggcggcccatgggattctgtggccagagtgctcccaaacggctctttgttcttacctgccgtgggtatacaggacgagggcatcttccgttgccaggccatgaacaggaatggcaaggagacaaagtcaaactatcgcgttagggtgtatcagattcccggcaagccggaaatcgttgactccgcatccgagcttacagccggtgtcccaaacaaggtaggcacctgcgtctctgaaggctcatatcccgccggcactctaagctggcaccttgatggcaaacctctggtgcccaacgagaagggggtgtctgtgaaagagcagacgaggcgtcatccggagactggcctgttcacacttcaatccgaactcatggtgacaccggccaggggcggggatccccgccccacgttcagctgctccttctcgccgggcctgcctaggcatcgcgccctaaggacagctcctatccagccacgcgtgtgggagcctgtaccactggaagaagtccagctggtagtcgagcccgagggcggcgccgtcgcccctgggggcaccgtcaccctgacatgcgaagtgcccgcgcagccatctcctcagatccactggatgaaagacggtgtgccattgcctctcccgccctctccggtgttgatcctgcccgaaatagggccacaagaccaagggacatacagctgcgtggcgacccactcctcgcacggcccacaggagtctcgcgcagtgtccatttcaattattgagccaggtgaggagggaccgaccgccggggaagggttcgataaagtgcgtgaagctgaagatagccctcagcacatgtag

SEQ ID NO: 107659 - DNA, 1029 bp, Artificial Sequence
  Description of Artificial Sequence: Synthetic coding sequence
atggctgcagggaccgccgttggagcctgggtgcttgtcttgtcactctggggagcagtcgtgggggcacagaatatcaccgcccgaatcggggaaccactcgtcctgaaatgtaagggggcacccaaaaaacccccacaacgactcgaatggaaactgggtggcggaccatgggactcagtggccagagtcctgcctaatggatcactcttcctgccagccgtcggcatccaggatgaaggcatcttccgatgccaagccatgaacaggaacggaaaggagaccaagtccaactatcgcgttcgcgtctaccagattcccgggaaaccagaaatcgtagactcagcttccgagcttacagcaggagtccccaacaaagttgggacgtgcgttagtgaaggctcttacccagcagggaccctgagttggcatctggacggcaagccactggtaccgaacgaaaaaggggtgtctgtgaaggagcagactcggcgccacccggagaccgggctctttactcttcagtccgagctcatggtgacgcctgccagaggaggcgatccacggcctaccttcagctgcagtttttcccctggactccctcgacatcgtgcactgcggacagcgcccattcaaccacgagtatgggagccggttcctctggaagaagttcaactcgtcgtagagcccgagggaggagctgttgcccctggcggcactgtgacactaacgtgtgaagtgcccgcacagccaagtccacagattcattggatgaaggatgtcagcgatctggaacgaggcgctggccgcaccaggcggggcggcgccaactgcagattgtgcggacgaatacgggccggcaacagcagtcctggacctggcgatcccgggaggcctggtgattcccgcccggcgcattggggtcacctggttgcaaaggcggccacccctagacgcggcgaggaggggcctaggaagcccggtggtcgcggcggtgcatgtaggacagagtccgtgggtggcacctag

SEQ ID NO: 107660 - DNA, 1029 bp, Artificial Sequence
  Description of Artificial Sequence: Synthetic coding sequence
atggccgctgggactgccgtgggggcctgggtgttggtactgagcctctggggtgccgtggttggagcccagaacataacagcgaggataggtgaaccattggtactaaaatgcaaaggagcccccaaaaaaccacctcaacggctggaatggaagcttggtgggggaccctgggattccgtagccagagttctgccgaatgggtccctgttcttacccgccgtcggtattcaggacgagggtatattccgctgtcaggcaatgaatcgcaatgggaaagagacaaaatccaattaccgagtgcgggtgtatcaaatcccaggcaaaccggagattgtcgactccgccagcgagcttacagccggcgtgcctaacaaggtgggaacatgtgtttcagagggctcttatcccgccgggactctgtcctggcacctggacggaaagccccttgttcccaatgaaaagggagtgagcgtcaaagagcaaacccgtcggcacccagagaccggcttatttacacttcagagcgaactaatggttactcctgctcggggtggggaccctcgccccaccttcagttgtagctttagtccaggattgccgcgacaccgagctctgcggactgcccctattcagccgcgggtctgggaaccagtgcccctcgaagaggtccagcttgttgtagagcccgagggcggggccgtcgctccgggcggaacggttacgctaacatgcgaagtgcccgctcagccctctccacagatccactggatgaaggatgtgtctgacctcgagcgcggtgctggcagaacaaggcgaggcggcgcaaattgccggctttgtgggaggatcagggccggtaattccagtcctggaccaggcgatcctggtcgacccggagactcaagaccagcccactggggccatttagtggccaaagccgccacacctcgtcgtggcgaagagggtcccagaaagcccgggggaagggggggagcatgtcgcacagaaagcgtgggaggcacatag

SEQ ID NO: 107661 - DNA, 702 bp, Artificial Sequence
  Description of Artificial Sequence: Synthetic coding sequence
atggctgcaggtacagcggtgggagcttgggtgctggttctgagcttgtggggagctgtggtcggtgctcaaaacataacggctcgcataggagaacccctggtactcaaatgcaagggcgctccaaagaaaccccctcagagacttgagtggaaacttaatacaggaagaacggaggcctggaaagtcctctccccacagggaggcggcccttgggactccgtggcccgcgttctgccaaactctagtctttttctacctgctgtggggatccaggacgaaggcatcttcagatgtcaagcaatgaatagaaacggcaaagaaacgaaatccaactacagggtacgggtttatcagattccgggcaagccagagatcgtggactccgcgtctgaactgacagcaggagtgcccaacaaagtggtggaagagagccggcgttcgcggaagcgcccttgcgaacaggaggtcggcacctgcgtgtctgaaggctcatatcccgccggtaccttaagctggcacctggatggtaagcctctggtgccgaatgagaagggcgtcagtgtgaaggagcagactcgaaggcaccccgagaccggactttttactctccaatcagagttgatggtgacacccgcacgcggtggggaccctcggccaacgttttcctgctccttttcacccgggctcccacgtcattag

SEQ ID NO: 107662 - DNA, 705 bp, Artificial Sequence
  Description of Artificial Sequence: Synthetic coding sequence
atggccgcagggactgctgtaggggcttgggttttggttttgagcctctggggagcagtggtgggggctcagaatatcactgcgaggatcggagagcctctcgtgttgaaatgcaaaggcgctcctaagaagcccccgcaaagacttgagtggaaactcaataccgggaggaccgaggcctggaaggtgctgagcccccagggcggagggccatgggattctgttgcaagagtgctgccgaacggcagcctgttcttgccagcagtaggaattcaagatgaaggaatttttagatgtcaggcaatgaatcggaacgggaaggagaccaaaagtaactaccggtcactccgtacctttaccattactgcatctgactggatttttccgccatccgaaatacccgggaagcctgaaattgttgatagtgcctccgagctgacagctggggtgcccaacaaggttggcacatgtgtatccgaaggaagctacccagcgggaaccctgagttggcacctggatgggaagcctttagtgcctaatgaaaagggagtgtccgtcaaggagcagactcgccgccatccagagacaggtctgttcactctgcaatcggaactgatggtaactcctgcacggggaggcgatcctaggcccaccttctcatgctcatttagccctgggttaccacgccaccgagctctgcgctag

SEQ ID NO: 107663 - DNA, 705 bp, Artificial Sequence
  Description of Artificial Sequence: Synthetic coding sequence
atggccgctgggacggccgtgggggcttgggtgctcgtcctgtcactttggggtgccgttgtcggggcacagaatattacagccaggataggcgagccgctggtgctgaagtgcaagggcgccccgaagaagccaccccaacgtctggagtggaagctgaatacaggaagaacggaagcctggaaggtcctgtccccacagggcggggggccctgggacagcgtggcccgcgttttacccaacgggtcactgtttctgccagcagtaggaatccaagatgaaggcattttcagatgtcaggctatgaataggaatggaaaggagacaaagagcaactaccgcagcctgcgaaccttcaccatcacggcctccgactggattttccccccctccgaaatccccggaaaaccagagatcgtcgattccgcatctgagcttaccgcaggcgttccaaataaggtggggacttgcgtatctgaaggatcgtacccggcaggaactctgtcctggcacctcgacggtaagcccctcgtgcctaatgaaaagggagtttcagtgaaggaacaaaccaggagacatcccgaaactggcttgttcaccctgcagtctgaactcatggtgactcccgcacgaggaggcgaccccaggccgacgttctcctgttccttctcacctggactccctagacatagagctctccggtag

SEQ ID NO: 107664 - DNA, 702 bp, Artificial Sequence
  Description of Artificial Sequence: Synthetic coding sequence
atggctgctgggaccgcggtgggggcttgggtcttagtcctatctctgtggggcgccgtcgtcggtgcacagaacatcacggcacgcataggcgagcctctggtcctgaaatgtaagggggctcccaagaaacctccccagcgcctggagtggaagcttaacacaggaagaaccgaggcctggaaagtactttctccgcagggggggggtccatgggattctgtcgctagggtgctaccgaatggctctctgttcctgcctgccgtagggatccaggatgagggcattttccgctgccaggccatgaatagaaatgggaaagagactaaaagcaactatagggtcagggtgtaccagatacctgggaagcctgaaatcgtggactctgcctcagagctcacggctggagtccctaataaagtcgtggaggagtccaggcgcagcagaaaaagaccctgcgagcaggaggtgggcacctgcgtctcggaaggtagttatccagcggggactctctcttggcatctggatggtaagccactagtaccaaatgagaaaggggtcagcgtcaaggagcagacacggagacatcccgagacagggctcttcacattacaaagtgaattaatggttaccccggctcgcggaggtgacccaagacccacattctcctgttcattctctcctgggctgccccgccactag

SEQ ID NO: 107665 - DNA, 1215 bp, Artificial Sequence
  Description of Artificial Sequence: Synthetic coding sequence
atggccgctggcaccgcagtcggcgcctgggtactggtactcagcctatggggcgcggtggtgggcgcccagaacataacagctagaataggtgaacccctggtcctgaagtgcaaaggcgcaccgaagaaaccacctcagaggctggaatggaaactgaataccggcaggaccgaggcctggaaagtgctaagtcctcagggcggaggaccctgggatagtgtcgctcgcgtcctcccgaattcatcgctctttctgcctgctgtcggaatacaggacgaagggatttttaggtgtcaggccatgaaccgcaacggtaaagaaaccaaatctaactacagggtccgcgtctatcagatacctgggaaacccgaaatcgtagattccgcgtctgaattaaccgccggagtgcccaacaaggtaggtacgtgcgtgtcagagggatcctaccctgcagggacactctcttggcacctcgatggcaagccactggtgccaaacgaaaaaggcgttagtgttaaagagcagactcgcaggcaccccgaaacagggctgtttaccctacagtcagagctgatggtgacccccgcccgcgggggagatcctaggccgacgtttagttgctccttctcccccggcctccccaggcaccgcgccctaagaacggctcctatccagcctcgcgtgtgggagccagttcctctcgaggaagtgcagctcgttgtggaaccagagggcggggcagtggcgcccggcggcacggtgacactgacctgcgaggtgcccgcccagcctagtcctcaaatccactggatgaaagacggagtgccgttaccactgccaccctctcccgtgctgattctgcccgagatcggtccccaggatcaagggacttattcctgtgtagccacccactctagtcatggaccccaggagagccgagctgtgtccatctctatcatcgaacctggcgaggaagggccgaccgccgggtctgtcggcggcagcgggcttggtactttggcactggcccttggcattctcggcggactggggacagccgcgctgctgatcggggttattctatggcaaagacggcaacgacggggagaggagcgtaaagccccagaaaaccaggaggaggaggaggagagagccgagctcaatcagtctgaagaacccgaagccggagagtcctccactggcggcccatag

SEQ ID NO: 107666 - DNA, 1044 bp, Artificial Sequence
  Description of Artificial Sequence: Synthetic coding sequence
atggccgccggcaccgctgtaggtgcttgggtcttagtactcagcctgtggggagcggtggtgggcgcacaaaatattactgcccggataggagagcctctcgtccttaaatgcaaaggcgccccaaagaagccaccacagcgactggaatggaagcttaatacagggagaacagaggcctggaaggtcctgagcccacaaggtggtggaccctgggactccgtggcccgcgttctcccgaacgggtcgttgtttctcccagccgtgggtattcaggatgaaggcatatttcgctgccaagctatgaaccgtaatgggaaagaaacaaagtcgaattacagggtaagagtgtaccaaatccccggaaagccggagatagttgatagcgcctcagaactgactgctggggtgcctaataaggtagggacttgcgtgagcgagggctcttatcctgcagggactctgtcttggcaccttgatgggaagccattagtcccaaacgagaaaggagtctcagtaaaggagcagactaggaggcaccctgaaacaggactctttaccctacagtctgaattaatggtgaccccggctcggggaggagaccctcggcctactttctcatgttcgttttctcccggtcttcccagacatcgtgcattgcgcactgcaccgattcaaccaagggtgtgggagccagttcctcttgaggaagtccagctggtcgtcgagcccgagggcggggctgtcgctcccgggggcactgtcacgctgacttgtgaggtgccagcccagcctagcccccagatacactggatgaaagatggcgtccctctcccgcttccccccagccccgttctgattctgccggaaatcggcccacaggaccaaggaacctatagctgcgtcgcgacgcattctagccacgggcctcaggagtcgcgagcagtaagtatttcgatcattgaacccggcgaggaagggccaacagccggcgagggcttcgataaagtacgcgaggcagaggactcaccccagcacatgtag

SEQ ID NO: 107667 - DNA, 702 bp, Artificial Sequence
  Description of Artificial Sequence: Synthetic coding sequence
atggcggccggcaccgcagtgggtgcgtgggtgctggtgcttagcttgtggggagccgtcgtgggcgcccagaacataacagctcgcatcggcgaacccctggtgcttaagtgcaagggtgctcccaagaagccgccccaacggctagagtggaagctgaatacgggccggacggaagcgtggaaagtactctctccacaaggtggggggccttgggacagcgtggccagagtgctacccaacggctcactgtttctgcccgccgtgggtatccaagatgagggcattttccgatgccaagcaatgaatagaaacgggaaggaaactaaaagtaattaccgcgttcgtgtctatcaaattcctgggaagcctgagatcgtggacagcgcatcagaactgacagcaggagtgccaaacaaggtggtagaggagtcaaggcggtctagaaagagaccatgcgagcaggaagtgggcacctgcgtgtccgaggggtcctatcctgctggcaccctttcttggcacctcgatggaaagcccctggtgccgaatgaaaagggcgttagcgtgaaagagcagacacgtaggcaccccgagacaggtctattcaccctgcagtctgagcttatggttactcccgccagaggtggggacccaaggcccactttctcttgttccttttcccccggcttaccccgccattag

SEQ ID NO: 107668 - DNA, 1215 bp, Artificial Sequence
  Description of Artificial Sequence: Synthetic coding sequence
atggccgccggcacagctgtgggcgcctgggtactagtcctatctctttggggtgcagttgtgggagcacagaacattacggccagaatcggagagccccttgtcttgaagtgtaagggggcgccgaagaagccccctcagaggctcgagtggaaactcaatacaggccgtactgaggcctggaaagtcctgtctccccaggggggagggccttgggactccgtagcacgcgtactaccaaatggatccttgtttttaccagcagtaggtatacaggacgagggaatcttccggtgtcaggccatgaatcgcaacgggaaggagacaaagtccaattacagagtaagggtgtatcagatcccagggaagccagagatcgtcgactcagcttccgagctgaccgcgggggttccaaataaggtggggacctgcgtgtcagagggcagttaccctgcaggtactttgagctggcacctggatggtaagcccctcgttcccaatgaaaaaggggttagcgtgaaagagcagactagacgccaccccgaaaccggcctgttcacactacagtctgagctgatggtgaccccggcccgcggaggcgatccccgtccaaccttcagctgttcatttagcccaggattgcctaggcacagagccttacgaacagccccaatccagcctcgcgtctgggagcccgtccccctggaggaggtgcagcttgtcgtggagcctgagggcggcgccgtcgccccaggcggaaccgtgactctcacctgtgaggtccctgcccagccctctccccagatacattggatgaaagatggagtgccactccctctgccccccagtcctgttttaattctaccagaaataggaccccaggaccagggcacttattcatgcgtggcaacccactcaagtcacggtcctcaggaaagtcgcgccgtgtctatctctatcattgagcctggggaggagggacccacggctggatctgtggggggtagcggcctggggaccctcgctctggccctgggaatcctgggaggtctcggtacggcagccctgctgataggtgtgatcctctggcagagacgtcagcgccgcggtgaagagcgaaaggcgcctgaaaaccaggaggaggaggaggaaagggccgaattgaatcagtctgaagaaccggaagctggcgaatcatcaactggcgggccttag

SEQ ID NO: 107669 - DNA, 705 bp, Artificial Sequence
  Description of Artificial Sequence: Synthetic coding sequence
atggctgccggcactgcagtgggggcgtgggtacttgtgttaagcctatggggcgccgtggtgggggcgcagaatattaccgctagaattggagagccattagtgcttaaatgtaagggggcccccaaaaaaccccctcagcgccttgagtggaaactcaataccggccggaccgaagcctggaaagttttatccccacaaggaggcggaccttgggacagtgtggccagggtccttccaaacagctcactgtttctccccgctgtcggcatccaggatgagggcatttttcggtgccaggcaatgaatcgtaatggaaaagaaaccaaatcgaactatcggtccctgagaactttcaccattacagcatctgactggattttcccaccgtctgagatccccgggaagccagaaattgtggattcagccagtgagctaaccgcaggagtcccaaataaggtcggaacttgtgtatccgaaggatcataccctgctggcaccctgtcgtggcatttagatggaaaacctctggttcctaatgaaaagggggtgtcggtcaaagagcaaactcgcaggcaccccgaaacagggctatttacactgcagtcagagctgatggtgacccccgcccgggggggtgaccctcgacctacattctcctgcagcttctcaccagggcttccccggcacagggctctgagatag

SEQ ID NO: 107670 - DNA, 1092 bp, Artificial Sequence
  Description of Artificial Sequence: Synthetic coding sequence
atggctgctgggaccgcagtgggcgcttgggtgctcgtgcttagcctctggggggcagttgttggcgcacagaatatcacagcccgcataggagagcctcttgtgctcaagtgtaagggcgcacctaagaaacccccacagcggctggagtggaagcttaacactggcagaactgaggcctggaaggtcctctcacctcagggcgggggtccctgggacagcgttgcgcgcgtgctgcccaatggcagcctgttcctgccagcagtgggcatacaggatgaaggcattttcagatgtcaggctatgaatagaaacggcaaggaaactaaatcgaattatagggtcagggtctaccaaatccccggcaaaccagagatcgtcgactccgcttctgaattgactgctggtgttcccaataaagtggttgaagaaagtcgtaggtctcgcaaaaggccctgcgagcaggaggtggggacatgcgtgagtgagggttcctacccggccggaaccttgtcctggcacctagatggcaagccactcgtccctaatgaaaaaggtgtttccgtgaaagagcagactcgtcgacacccagaaaccggccttttcactctccagtccgagttaatggtgacccctgcacggggcggcgacccccggccgaccttctcctgctcctttagcccagggcttcctcggcatagagctttgcgcaccgcccctattcagccacgggtgtgggagcctgttccattggaggaagtgcaactcgttgttgaaccagagggtggcgccgtcgcgcctggcggtaccgtgacgttaacatgtgaagtgcccgcccagccaagcccccagatccactggatgaaagacggcgtaccattgcctttacctccaagtcccgtacttatcttaccagaaattggcccacaggatcaggggacttactcgtgcgttgccactcactctagtcacgggccccaagagtcccgagctgtgtccatcagcataatcgagccaggcgaagaggggcccacggccggagagggcttcgacaaagttcgcgaggctgaggactcccctcagcacatgtag

SEQ ID NO: 107671 - DNA, 1029 bp, Artificial Sequence
  Description of Artificial Sequence: Synthetic coding sequence
atggccgccgggaccgcagtgggcgcatgggttctagtactgagcctgtggggagccgtagttggcgcacaaaacattacagcacgcatcggtgagccgttagttctcaagtgtaaaggcgccccaaagaaaccacctcagaggttagagtggaagctgggtggcgggccttgggactcagtggctagagtcttgcctaacggtagcctgtttctgcccgccgtaggcattcaggatgagggcattttccgttgccaggctatgaaccgtaatggaaaggagaccaaaagcaactatagggtgagggtctaccaaattcctggaaagccagaaattgtcgatagcgcatctgaactgaccgccggggtgcctaacaaggtcggcacgtgcgtttcggaaggtagttaccccgcaggcaccctctcttggcatctagatggcaagccactggtgccaaacgagaagggggtatcggtcaaagaacaaacaagacgccatcctgaaacagggctcttcacgctgcagagcgagctcatggtgacccccgccagaggtggagatcctcgccctaccttcagttgttctttttctcctggccttccaagacaccgtgctctcaggaccgccccaattcagccgcgcgtttgggagccagtgccgctggaggaggtccagctcgtggtggagcccgaggggggcgctgtggcccccgggggaacagtcactctgacttgcgaagttccagctcagccaagccctcagatccattggatgaaagacgtgagcgatctagaaagaggcgccggacggacacgtcgcgggggggctaattgtagactctgcggtcgcatcagggctggcaattccagtcccgggcctggagaccctggaagaccaggtgacagccgccctgcacattgggggcacctcgtcgccaaggcagctactcctcgaaggggggaagagggcccccgtaaacctggcggccgaggcggggcatgccgcacagagtccgtcggtggcacttag
